United States Patent 9,675,668 (MODIFIED POLYNUCLEOTIDES ENCODING HEPATITIS A VIRUS CELLULAR RECEPTOR 2) - sequence listing, part 20

SEQ ID NO: 42241 - DNA, 4044 bp, Artificial Sequence
  Description of Artificial Sequence: Synthetic coding sequence
atggagaacctgcccttccccctgaagctgctgagcgccagcagcctaaatgcacctagcagcactccctgggtgctggacatcttcttaactctggtgttcgcgctgggattcttctttctgcttctcccatacctgtcatatttccggtgcgatgatccaccaagccccagccctggcaagcgtaaatgtccggtcggtagacgacggaggccccggggtcggatgaagaatcactcactgcgggcgggtagggagtgtaggaggggactggaggagaccagcgacctcctgtcccagctccagagcctgttgggtcctcacctggacaaaggtgacttcgggcagctgtccgggccagatccacctggagaggttggtgaacgagcgccagacggggccagtcagtcttcccacgaacccatggaagatgccgctccaattctatctcctctcgcttctcctgacccacaggccaaacatcctcaggatctcgcttcaacacccagtcccggccctatgaccaccagcgtcagcagtctatccgcaagccaaccaccagagccatccttgccactcgagcaccccagccccgagcctcccgctttgttcccacacccacctcacactccagaccccctagcctgcagcctgccccctccaaagggctttacagctccccctctgagagatagtactcttatcaccccttcccactgtgactcagtggcctttccactcgggaccgtgccacagagtctgtccccgcacgaggacctcgtcgcttcagtaccggctatctcaggtctgggtggatctaactcacatgtgagcgcctcaagtcggtggcaggaaactgccagaacctcctgcgctttcaattctagcgtgcaacaggaccacctgtcgaggcatccaccagaaacctgccaaatggaggccggaagtctgtttctgctcagttcagacgggcaaaacgtcgtgggaattcaagtaacagagactgccaaagtgaacatttgggaggagaaagaaaatgtcggtagcttcacgaacagaatgacaccggaaaaacacctcaatagtctccggaatctcgctaagtcccttgatgctgaacaagatactaccaatcctaagcctttttggaatatgggagagaacagcaaacagctcccaggacctcagaaattgtcagaccccaggctgtggcaggaatcattctggaagaattacagccaactgttctggggactgccctccttacactcagagagcctcgtggcaaacgcctgggtcacagaccgctcatacacccttcagagcccaccctttcttttcaatgagatgagtaatgtttgcccaatacaacgcgaaacaactatgtctcctctcctgttccaggctcagccactgagtcacctgggaccggagtgtcaaccctttatttcctcaactccccagtttagacctacaccgatggcacaggctgaggcccaggctcatctgcagtctagttttcccgtgttatcccccgcatttccatcgcttatccagaataccggcgtggcctgtccggctagccagaacaaagtccaggccttgagtctaccagagactcagcacccagaatggcccctgctgcggcgccagctggaaggacggttggcactcccctctagagtgcagaaatctcaggacgtgttcagtgtcagcacacccaacctcccccaggagagcctgacttccatcttgcctgagaatttccccgtctctcccgaattgaggaggcagctggagcagcacataaagaagtggatcattcagcattggggtaatctggggagaatccaggaaagcctagatctgatgcaattgagggacgaatctccaggtacatcccaagcaaaggggaagccctctccgtggcaaagcagcatgagtaccggcgagggtagcaaagaggctcagaaggttaaatttcagcttgaaagggatccttgccctcacctcggacagatcctcggagagactccccagaatctttcccgggacatgaagtccttcccacgtaaggtgctgggggtcaccagcgaagagttagaacgcaacctgcgtaagcctcttcgatcagactctggatccgacctactgaggtgcaccgaacgcacacatatagagaacatccttaaggcccacatgggacgtaatctgggccagacaaatgaaggtctgattcctgtgtgcgtgcgccggtcgtggcttgccgtcaatcaggcacttccggtaagcaatacccatgtgaagactagcaacctagccgcccccaaatcaggcaaggcttgcgtgaacacagcgcaagttctttcattcctggagccctgcacacagcaaggattgggcgcccatatcgtgagattttgggctaaacacaggtggggcctccctctgagagttctgaaaccgattcagtgcttcaagctggaaaaagtgtcttccctctccttaacccagctggcgggtccctcttcagccacatgtgaatctggcgcgggcagcgaggttgaagttgatatgttcctccgcaagcctcctatggcctctcttaggaaacaggttttgacaaaggcctccgaccacatgccggaatccttgttggctagttcccccgcctggaagcagttccagcgagccccccgcgggatcccgagctggaacgaccacgagccgttgaaaccccctccggcagggcaggaaggtcggtggcctagcaagcctctgacctacagcctcaccgggtccatccagcagagcagaagtctcggcgctcagtcttccaaagcgggggaaactcgggaggctgtcccccagtgtcgtgttccactggagacgtgtatgctggctaacttgcaggccacctcagaggacgtgcacgggttcgaggcccccggtactagcaagtcttctctgcacccacgggtgagcgtgagccaggacccccggaaactctgcctgatggaagaagtggttaacgagttcgagccagggatggccacgaagtccgaaacacagccacaggtttgtgcggccgtcgtgctcctcccagacggccaggcgtcggtcgttccccatgcaagtgaaaacctcgtctctcaggtcccacaggggcacctacagtctatgccgaccgggaacatgcgcgccagccaagagctgcacgacctaatggctgcaagaagaagcaaattagtgcacgaagaacccagaaatcctaattgccagggaagttgcaaaagtcaacgaccgatgtttccccctattcataaatccgaaaaaagtcgcaaacccaacctcgaaaaacatgaggagagactggagggacttcgaacaccccaactgacccctgtcaggaagaccgaggacacacatcaagacgagggagtccagttgctgccctccaaaaagcagccgcctagcgtctcacctttcggcgagaatataaaacaaatcttccagtggatcttctccaagaagaagagcaaacctgccccggtgacagctgaaagtcagaaaaccgtgaaaaacagatcccgggtttactcttcttcggcagaagcccagggcctgatgacggccgtggggcagatgctcgacgagaaaatgtccctgtgtcatgctagacacgcatcaaaagttaaccagcataaacagaagttccaggcccccgtatgtggcttcccatgcaaccatcggcacttattttactctgagcacggtagaatactgtcttatgctgccagcagccagcaggccaccctgaagtcacaggggtgtcccaatcgcgatcgtcagattaggaaccaacagcctctgaagtcagtccgttgtaacaatgaacagtggggcttaaggcatccccagatactccacccaaagaaggccgttagccctgtctcacctccccagcattggccgaaaacctctggggcctcttcacatcaccaccactgtccaaggcactgtttgctgtgggagggcatctag

SEQ ID NO: 42242 - DNA, 4032 bp, Artificial Sequence
  Description of Artificial Sequence: Synthetic coding sequence
atggagaacctgcccttccccctgaagctgctgagcgccagcagcttgaatgccccttcctctaccccgtgggtcctggacatttttcttactctagtcttcgctctgggttttttctttctgctgctgccgtatttgagttacttccactgcgatgatcctccgagcccttctcccggaaagagaaagtgcccagtgggacgccgtagacgtccgcggggccgaatgaagaatcattcactacgagctgggcgcgagtgccccagaggcctggaagaaacctcagacctacttagccagcttcaaagcctcttaggcccacatttggataaaggcgactttggccagctgtctggtcccgaccctccaggtgaggtgggagaaagggcccctgacggggcgtctcagtcctcgcacgagccgatggaagacgccgcgccaatactaagtcctctcgcatcccccgacccgcaggcaaagcacccacaggacctcgcctcgactccgtcacccggacccatgaccacatccgtgtcaagtctttctgcctcccaacctcctgaaccttctctgccgctggaacacccgtcacccgaaccgcccgcacttttcccccaccccccacatacacctgatccactggcctgctcaccccccccacctaaaggattcactgctccgcccctccgcgactctactttaattaccccatcccattgcgatagcgtggccttgccccttggcacagttccgcaaagcctcagccctcacgaggatcttgtagcttccgtacccgcaattagcggactcggaggctccaactcacatgtgagcgcctcatccagatggcaggagacagcacgcacctcctgcgcttttaatagctctgtgcaacaagatccgctctcccggcatcctccagaaacctgtcaaatggaggccggttcgctttttctgttatccagtgatggccagaacgtggtggggatacaggtcactgaaacggctaaagtgaacatttgggaggagaaagaaaacgtgggctcttttacgaatcaaatgactccggaaaagcatctgaattccttggggaatctcgccaagagcctcgatgcagaacaagatactactaatcccaagccattttggaatatgggagaaaacagtaaacagctccccggcccacaaaaatgctcggacccgagacttctgcaggagagcttttggaagaattacagtcagttattctggggcttgccatccttgcacagtgaaagcctggtggcaaacgcctgggtgaccgaccgcagctacaccctccaatcacccccattcctgtttaacgaaatgagcaatgtttgtccaatacagagggaaactaccatgtcgcctctgttatttcaggcccagcctctctcgcacaggcagcctttcattagcagtaccccgcagtttttaccaacaccgatggctcaggctgaagcccaggctcatctgcaaagttcttttcccgtcctctcccccgcatttccctcattgattaagaacactggcgtagcttgtcccgcctctcagaacaaggtgcaggccctttcccttcctgagacacagcaccctgagtggccactgttacggaagcagctcgagggcaggctcgctctgccctcgcgggtccagaagagccaggatgtcttctctgtttctactccgaatttgccacaagaatcactcacctccatcttaccagaaaacttccccgtctccccggagctgaggcggcaactggagcagcatatcaagaaatggatcatccagcattgggggaacctgggtcgtatccaggagagccttgacctgatgcaactcagggatgagagccccgggacgagccaagccaaaggcaaaccttctccctggcagtcttccactagcaccggggaatcctcgaaggaggcccagaaggtcaagttccagctggaaagggacctttgtccacatcttggacagatcctgggagagaccccgcagaacctgagccgcgacatgaaatcatttccccggaaggttttgggcgtgacaagtgaagagtctgagagaaaccttaggaaaccgctccgctcagacagcggatctgatctgttacgctgcactgaacgcactcatatcgagaacatcctgaaggcccacatgggccggaatctcggacagactaatgaggggctgatcccagtgcgcgtgcggcgtagctggttagcggtgaaccaagcactgccggtgagtaacacgcacgttaagacctctaatctggcagccccgaagtcgggaaaagcctgtgtgaatacagcacaggttctgagctttctggagccctgtacccagcaaggactgggcgcgcacattgtaagattttgggctaagcatagatggggcctgcctctacgcgttctgaaacccatacagtgctttaagctggagaaagtcagcagcttgtctctgacacagctggcaggcccgtcctcggccacctgtgaatccggtgctggaagtgaagtggaggttgacatgtttctgagaaaacccccgatggctagtctgcgcaagcaggtactgactaaagcaagcgaccacatgccagagtcactcttggccagctccccagcgtggaaacagttccaaagggcccctcgcggtataccctcctggaatgaccacggcccgctgaagcctccaccagctggccaggagggccgatggcccagtaagcctctcacttattccctaacagggtcaacacagcaaagccgaagccttggcgctcagtcttctaaagcgggtgaaactagagaggcagtgccccagtgtagggttccactggagacttgcatgctggccaacttgcaagcaacctcagaagacgtgcatggattcgaggcccccggaacatcaaaatctagtctgcacccaagagtcagtgtgagccaggatccacggaaactctgccttatggaggaagtcgtgtctgagtttgagcctgggatggccacaaagagtgagacacaaccacaagtttgcgcggccgtggtgctattgccggacggccaggcctctgtagtgccacatgctagtgaaaacctggtcagccaggttcctcagggccacttgcagtctatgcccactgggaacatgcgggcctcacaggagctgcacgacctgatggctgcaaggagaagtaagttggtgcaagaagaacccagaaacccaaactgccagggctcttgtaaatcccagaggccaatgtttcccccaatacataaatcagagaaatccagaaagcccaacttggaaaaacacgaggaaaggttggagggcctgcggacaccacaactaacacctgttaggaagacagaggacacacaccaggatgagggagtacaactgctgccatcgaagaaacagccaccatccgtcagccatttcggagaaaacattaagcagtttttccaatggatcttttctaagaaaaagagcaagcctgccccagtcacagccgagagccagaaaacagttaagaaccgcagctgcgtatatagctcatccgcagaagcacagggcctgatgacagctgtggggcagatgcttgacaagaaaatgtctctctgccacgcacatcatgcaagcaaggtgaaccagcacaagcaaaagtttcaggcgcccgtgtgtggatttccctgcaatcacaggcacctgttttactccgaacacgggcgcatcctatcctacgccgccagtagccagcaagccacattgaagagccagggatgcccaaaccgggacagacagattagaaatcagcaaccgctgaaatctgtacgctgcaataacgaacagtggggcctgcggcacccccagatcctgcatccaaaaaaagccgtgagccccgtgtcacctcctcaacattggccaaaaaccagcggtgcctccagtcaccatcatcattgcccaagacattgtctactgtgggagggcatctag

SEQ ID NO: 42243 - DNA, 4044 bp, Artificial Sequence
  Description of Artificial Sequence: Synthetic coding sequence
atggagaacctgcccttccccctgaagctgctgagcgccagcagcctgaatgcaccgtctagcactccatgggtgctggatatctttctcacactagtgtttgctctgggatttttcttcctgctgctgccatatctttcatattttagatgtgatgacccaccatctccttcaccaggcaagcggaaatgcccagtgggccggcgccggcggccacggggtcggatgaagaatcacagcctgcgggctggaagagagtgccctagggggctggaggagaccagcgatctcctttcgcaattgcaaagcctcctaggaccccaccttgataaaggggactttggccagctttcaggtccagatccaccgggcgaggtcggagaacgcgctcctgacggggcctctcagtcgtcccacgaacctatggaggatgctgctccaatcttatctcccttggcctcccctgatccccaggctaaacaccctcaagacctcgctagcaccccatctcctgggcctatgacgacttctgttagttcactttcagccagtcaacctccggaaccatctctgccactagagcacccaagcccagaaccaccggccttatttccacatcccccacacacacccgatccactggcttgctcgctaccgccacctaaaggctttacggcaccaccgctgagggactccacattgatcactccttcccactgtgactctgtggccttccccctcgggaccgtcccacagtccctgtccccgcacgaagacttggtagcaagtgtgcctgcaatatcaggcctgggcggaagtaactcccacgtgtcggcttcctctaggtggcaagaaacagcaaggacctcttgcgcctttaattcctcggtgcagcaggaccacctcagccgccacccaccagaaacatgtcagatggaagctggcagtctgttccttctgagcagcgatgggcagaatgtagtaggcattcaggtgacagagacagccaaagtgaacatctgggaagagaaggagaacgtgggttcctttactaatcgtatgacccccgaaaaacacctcaattacctgagaaatctcgccaagtctctcgacgccgagcaggataccaccaacccaaaacccttctggaacatgggtgagaacagtaaacaacttccagggcctcaaaaactgtcagatccccgcctctggcaggagagtttttggaaaaactattctcaactcttctggggtttgccgagcctgcacagcgagtctctcgtggcaaatgcatgggttaccgaccgcagctataccttgcagtcccctccttttctgtttaacgagatgtcaaatgtctgtcctatacaaagagaaacgacgatgtctccactgcttttccaggcccagccgctgtctcacctgggtcctgagtgccagccctttatatccagcacaccacaattcaggcctactccaatggctcaagcggaggcacaggcacacttacagtccagctttcccgtcctgtctccagcatttccttccctcatccagaataccggagtggcctgccctgcctcacaaaacaaggtccaggcgctatcactgcccgagactcagcaccctgaatggcctctgctcaggcggcagctcgagggtcgactggcactgccttcccgagtccaaaaaagccaggatgtgttctctgtctcaactccaaatctgccacaggagagtctgacatccattctgcctgagaacttccccgtgtcccctgagctgcgccgacagctggagcagcacatcaagaagtggattattcagcactggggcaacctcggccgcattcaggaatctctggacctaatgcagctgagagacgaaagccccggcacctcccaggcaaaggggaagccatccccatggcagagcagtatgagcaccggagagagttccaaggaggcccaaaaagtgaagttccagcttgaaagggatccatgtccacacctgggacagattctcggcgagaccccacagaatctctcgcgggacatgaagagcttccctaggaaggtccttggtgtgacctctgaagagctggagagaaacttgcgaaaaccgctaagatctgacagcggaagcgacctattacgttgtacagagcggacacacatagagaatatattgaaggcccatatgggccggaacctgggccagaccaacgagggactgatccctgtgtgcgtccgcagatcgtggctggcagtaaatcaggcccttcctgtgagtaatacgcatgtaaaaactagcaatcttgctgcacccaagtccggaaaagcttgtgtgaacaccgcgcaggtgctctcatttctcgagccttgcactcagcaagggctgggggcacacattgtgcggttctgggctaaacataggtggggactgcccctcagagtgctcaagcccattcagtgtttcaaactggagaaggtgtcctctctaagcttaacgcagctggctggcccctcgtcagccacttgtgagtcgggggccggctccgaggtggaagtggacatgttcctgagaaagccacccatggcgagcctgcgcaaacaagtgctgactaaggcatcagaccacatgcccgagtctctgctggcctcttcacctgcgtggaagcagttccagagagctccgcggggcatccctagttggaacgaccatgaaccactcaagcctccacccgctgggcaggaagggagatggcccagcaagcccctgacttattcgttgactggttctatccagcagtctaggtccttgggtgcccagagcagtaaagcaggcgaaacccgggaggccgtaccccagtgcagagtgcctttagaaacctgtatgctggctaatctccaggccacctctgaagatgtgcacggctttgaggccccaggcacgtcaaagtcctccttacacccaagagtcagcgtgagccaggatccgcggaagctctgccttatggaggaagtggttaatgaatttgaacccggcatggccaccaagtctgaaacccagccccaggtctgtgccgctgtagtgctactgccagacggccaggcatctgtggtgccacatgccagtgaaaatctggtcagccaggttccacagggccatctgcaatctatgcctacgggcaacatgcgtgcttcccaggaactgcatgacctgatggctgctaggcggagcaaattggtgcatgaagaaccacgcaacccaaactgtcagggcagctgtaagagccagagacccatgtttccccctattcacaaatcagaaaagagccgaaagcccaatctggaaaagcacgaggaaagactcgaagggctccgcacaccccagctgacacccgtacgcaagacagaagatacacaccaggatgagggtgtccagctgctgccctcgaagaaacagccaccctccgtgtcaccattcggcgaaaacatcaagcagattttccagtggatcttctctaaaaagaagtctaagcccgcccctgtcactgcggaatcccagaagaccgtgaaaaatagaagtagagtttattcatcatccgcagaggcccagggactgatgactgcagtgggacagatgctggacgagaagatgtctctttgccacgcgcggcacgccagcaaagtaaatcaacacaagcagaagttccaagctcccgtgtgcgggttcccatgcaatcatcgccacctgttctacagcgaacatggccgtatcctctcgtacgcagcgagttctcagcaagccactctcaaaagccaaggttgccctaatagggaccgccaaatccgaaaccagcaaccactgaaatccgtccgatgcaacaacgagcagtggggtctcagacacccccagatcctgcaccccaagaaggccgtgtcacccgttagtcctccccagcactggccgaaaacttccggcgcttcatcacatcaccaccactgccccaggcactgcctactgtgggagggcatttag

SEQ ID NO: 42244 - DNA, 4731 bp, Artificial Sequence
  Description of Artificial Sequence: Synthetic coding sequence
atggagaacatcctgtgcttcctgaacagctacaccgagaccggcctgtcccccgattcgcattggcttgacatagaccccaacttcatctgtcttagtggattaggactctttatattgtacctgttctatgtggtgcttacactctactcttctccaactgagaaaaacaatgacatccagaagcatcagggccgtgcaaagagacggaggaagggcggtacttttaaggggttccctgactggaagtcattccagcgcgaggaagaggaagaacgaaaactattgtccctcttgaaatctttcggcccccccgtttcttgctcccctcgcggacaacatcacgacaccaatcacttccgacgcttgctttgtcctgatcccgtgtgcagggtttgcaaaagagctacagccgacattcagcagcttctatcctgggaaagtcttaaggatgcagcccctagtgtctctcccctggcctcaagcgcgagcgctaccgagagttcctttacgttggcttccactcccagcgccacccctcctgaggacctgattctgagccccagacctaaggcctctcctccccctccactgatccttagccctgatctcattactacgctagccgacctgttttccccaagtccactaagggaccccttgccaccccagcctgtgagccccctggatagcaagtttcccatcgaccattccccgccacaacagctaccattcccattacttcccccacaccatatagaacgtgtggagagttcgttacagccggaggccagcctttcattgaacaccattttctcgtttgggtcgaccttgtgccaggacatctcacaagccatgaaccctattgattcctgcgccagacatcacggtccaccaatcccttcagcgttacccccagaggattgtaccgtgacccagtccaagagttccctgaccattctcaagacatttcccgaaatgctctctctaggaggaagcggaggtagctctacctccgccccgacgatcaagggaattgatcattcacacctcgcttccagcgaattcacctggtggcaaccgcacgctaaggactcattttcatctaatttcgtgccatccgatttcatggaagagctgttaaccctccacagttctgaggcgtttctgggtgggcactcagtggccaacctcattgaaccagtgaatatctcctttctgagccacgacattcttgccctcctggaaaggcaggtgaaaaaaaggggcgacttcctgatgtggaaggagaacggtaaaaagcctggatcttttcccaagcagcttcgtccgaattatcaactgaatagcagtaggaacatgctgactagcattgcggtcaaacatgacctggccgagagctttccgttctgggcgtccaaaggtaagctcgagtggcagcacatccaccaacagccgccccactcgaagtgctttgaggatcacctcgaacagaagtatgtgcagctgttttggggtctgccctccttgcacagcgaatcacttcaccccacggtgctcgtccagagggggcactcttccatgttcgtcttctttaatggcatcactaacacaagtatatctcatgagtctccggtcctgccccctcctcagccattatccctcccgtccacccaaccgcttcccctaccacagacactgcctcagggtcagagtccccatcttacccaggtcaaatccctggcgcagccacagtcccctttccgagctctcctgccatcacctctttttcttattcgcatctgcggcgtttgcttccatcgtcctcaaaatgaggcgaggtccctccttccctctgagattaaccacttggaatggaacgtactccagaaggtgcaggaaagtctctgggggcttccgtcggtcgtgcaaaagtctcaggaagacttttgtcctccagcgccaaatccagagctggtacggaagtcgtttaaagtgcatgtgcccatttctataatccccggtgatttcccactgagctcagaggtgcggaagaagttagaacagcacatccggcgaaggttgattcaaagacgctggggtcttccccgcagaatacacgaatccctgtctctgctgcgtcctcagtctaaaatcagcgagctgtcagtgtccgagaggatccacgggcctttgaacatctctctggtcgagggacaacggtgtaatgtgctgaaaaaatccgcgtcgagtttccctcggagctttcatgagagaagctccaatatgctgtccatggaaaatgtaggaaactaccaagggtattcacaagagaccgtgcccaaagatcacctgctgcacggaccagaaacatctagtgataaagatctcaggtcgaactctgaaagagaccttgaaacacacatgatgcatctgagtggaaacgatagcggcgtccgcctgggacagaagcaactggagaacgctctgacagtccgcttatcaaaaaagtttgaagagatcaatgaaggccgcatgccgggaaccgtgcactcaagttggcattcggtcaaacaaactatgtcccttccagaaaaaagccactcacagattaagcatagaaatctagtgactcttgtgtccgaagaccattgcgtcgatacttcccaggagatctcgtttctgagcagcaacaagcagaaaatgctggaggcccacatcaagactttcaggatgagaatgctttggggactgccgttgaaggtgcttgagtccatcgaaatcttcaagtctaaggctgacctctcaacctccttctcgcacttcgacctgccctcatccgcaacatttatctcacagggagattctaaagacggtgtgagcaagtcccgcagcaggagcactttccaaggcgaaaaactcggcacgacctcatctgttccaatccttgatcgcccccacccagtaagcagtccggtcgtgcaagagggccagggaacactgagaaggcaattttctgacaccgaccacgacctgatcgagaccgatagtaaggatggcgccagcacatcactcagaagggggaccaccgacttccagtccgagaaactggacagcacctcatctttcccgatcctgggacactcttatctcgttaccagtcctgtgaatcaggagaagcaggggacactgcggcgagagttcagtgacacagacaatgacttgacagagtcagtgcgcacaaccgaagacggtaggcagacctttctgccgcctcctcattctatcgttgacgaagtttctcagaagcagaccgtgctggccagtcggtgcagcgctgaactccccataatgcaggctggcgctggctgtgaaagctgggacaaacggaagagttcctttcataatgtagaccggctacagggcagcagaaaaacatttccggttactaatgccctgcagtctcagacccggaacaacctcacaaccagcaagtcaggaagctgttcgttgaccaacgtcaaagcatccacgtccaatgaaactgaaatttttcccccccgcatctccgtgccacaagacccaaagtcttcctaccttaagaaccaaatgctgtcccagctcaaactggttcaacggaagcattcccagccgcagagccatttcacggatatgtcatttgcactcgacaacctctcatctaaggacctcctcacgaatagtcagggaatcagcagtggtgacatgggcactagccaggttgtccatgtgcaccttgaagattccgggatccgggtcgcccagaaacaggagccaagggttccgacttgcgtgttacagaagtgtcaggtgacaaacttcccgcccgccgtgaaccgagttagccctgtccgccctaaggggggcgagctcgacggtggggacgcagggctgggcacctcacaaaggagacggaagtccctgcccgtgcacaataaaacatccggggaggtcctgggctctaaatcgtcccccactctgaagactcagccccccccagagaatctgttcagaaagtggatgaaaacaagcttacagtggttcaacaaaccatctatctcctatgaggaacaggagagctcatgggagaaaggcagtagcctctctagctgcgtccagaatatcggaagagtaatccgcgcagcttttactggaacgaccgaggctcaaaagattcgtaaagacacccgagaattcttggaggagaagctgggacaccgtcacggtatcgatattacgtgtccgcaggagcccttaagttttcctgtggggctggggaaagcccagcacaatcccgaggtgcatgtacgagctgaaccggttcagggctgcccctgtaattaccgcgctcccagttgcaaggtgacacgcaccaaatcctgctcacagcaggccatcttcgttggacagaactaccccacaagaatcagacagatcatcgacaaggatcggcagccgcagaaggtggaggcattcaaggggaagatcctctgtcaaagtcacccccaaagtatgccacatcgaaagcctgtgccccatccaaaccctacatgccgcagacaggtctctctcgtatgtccggccgtgccgacgagtgcgaaatcgcctgtcttcagcgatgttcctttccttacagggcagaagatgctgcctaagcacctccaaggtggtaaattccccccaacaaagtag

SEQ ID NO: 42245 - DNA, 1242 bp, Artificial Sequence
  Description of Artificial Sequence: Synthetic coding sequence
atggccgagggccccgaggaggcccggggccacccccccggccaggacgacggcggtggagatcacgaacccgtcccaagtctaaggggtccccccactactgctgtcccatgcccccgggacgaccctcaggcggagccacaagcaccagggagaccaacagctccaggcctggcagctgcggcggctgccgataaactggagcccccaagggaattgcgcaagcggggggaagccgcctcggggtctggagccgagcttcaggaacaggcaggctgtgaagcaccagaggccgccgctccgagggaaagacccgctcggttgtccgccagggagtattcacgccaagtccatgagtggctttggcaatcttattgcggctacttaacctggcattccggactagcggccttccctgcttactgttctcctcaaccgagtcctcagagctttccctctggaggcgccgccgtccctcaggccgctgcaccaccacccccccagctgggatactataatcccttttacttcctgagcccaggggcagcgggacccgacccaagaacagcagctggtatatccacgccggctccggtggcagggctgggacctcgagctccccatgtgcaagctagcgttcgcgccacaccagttaccagggtcgggtcggccgcgccaagcaggagtccaagcgaaactggcagacaagccggcagagagtacgtcatccctagcctagcacacaggttcatggctgaaatggtcgactttttcattttgttcttcatcaaggccaccattgtgctgtcaatcatgcacctttctgggatcaaagacatttctaaatttgcaatgcattatatcatcgaggaaatcgatgaggacactagcatggaggacctccaaaagatgatggtggtggccttgatctataggttgctcgtgtgtttttacgagattatttgtatttggggcgcagggggggccacacctggtaaatttctcctggggctcagggtggtcacgtgcgataccagtgtactgattgccccatctagggtgctcgttatcccctcttcaaacgtgagtattactacctctactattcgagccctgatcaagaattttagtattgcatccttttttcctgctttcataaccctactctttttccagcataatcgcacagcctacgacattgtggctggcactatagttgtgaagaggaatggcgttcgttag

SEQ ID NO: 42246 - DNA, 492 bp, Artificial Sequence
  Description of Artificial Sequence: Synthetic coding sequence
atggccgagatggtggacttcttcatcctgttcttcatcaaggccactatcgtcctgtcgattatgcatctgtcagggatcaaagacatttctaagttcgccatgcactatatcattgaggagatcgacgaggacacttcgatggaagacctgcagaaaatgatggtggtcgcacttatctacagattactggtctgtttttacgaaattatttgcatttggggcgcaggcggcgcaacccccggaaaatttttgttgggactgagagtggtaacctgcgacacctcagtgttgatcgcacctagtagagtgcttgtgatcccttcttctaacgtctccatcaccactagcacaatccgcgccctgattaagaatttctccattgccagcttctttcccgcgttcatcaccctcctattcttccaacataaccgaacggcatacgatatcgtcgccggtacaattgtagtgaaacggaacggcgtccgctag

SEQ ID NO: 42247 - DNA, 915 bp, Artificial Sequence
  Description of Artificial Sequence: Synthetic coding sequence
atgaacatcgtgttcagccgggacagccaggtgcgggtgatggagaatacggtggccaacactgaaaagtactttgggcaattctgttccttgctcgccgcttacacgcgaaagactgcgcgtctgagagacaaagcagaccaactcgtaaaacagcttatcgacttcgcaaattcggagaacccagaacttagggcgaccatgcgcgggttcgccgaggatctggcaaaagtgcaggattaccggcaggcccaggtggagaggctggagaccaaagtcgtcaatcctcttaagctgtacggcgcccaaatcaagcagactcgggcagaaatcaagaagtttaagcacgttcaaaatcacgagatcaagcagctggaaaagcttgagaaattgcggcagaagagtccatctgatcaacaaatgattggccaagccgaaacacgtgtacaacgcgcagccgtggactcaagccggacaacactgcagctggaggagaccgtagacggatttcaacgtcagaaactcaaggacctacaaaaattcttttgcgatttcgtgaccattgagatggtcttccatgccaaggcggtggaggtctattccagcgccttccagacacttgagaaatatgatcttgagcgagatctgctggatttccgcgccaagatgcaaggtgtatacggccactatgatacccgcctgcttgcgaatacctcaccccctccttctgtccttcagtctcttgcctctcagggcactctgcaggttcagctcagtcgagcaaacgaagatcccgaacaccctcatgcaaaccacggcagattctccctctgtgaatgggttgttaagggtcagccagcccactgcgtatgtggtcagggaggtcatctgatgttgccaggtcactctctgtag

SEQ ID NO: 42248 - DNA, 915 bp, Artificial Sequence
  Description of Artificial Sequence: Synthetic coding sequence
atgaacatcgtgttcagccgggacagccaggtgcgggtgatggagaataccgttgctaatactgagaagtatttcggacagttctgttcactcctcgcagcttataccagaaaaaccgctcgtcttagggataaagccgaccaacttgtcaaacagctcatcgactttgcgaatagcgaaaaccccgaactgcgtgccaccatgcgtggtttcgctgaggacctcgcgaaggtgcaagattaccgccaggcccaggtcgagcggctcgaaaccaaggtggtgaatccattgaagctctacggcgctcagatcaagcagactagagcagaaatcaagaagttcaagcatgtgcagaatcacgaaattaagcagcttgagaagttagagaaacttagacaaaagagtccatctgatcagcagatgatttcccaggccgaaactcgggtgcagcgtgccgctgtagacagctcaaggaccactttgcagcttgaagagacggttgacggcttccagcgtcagaaactgaaagatctccagaagttcttttgcgactttgtgaccatcgaaatggtgttccatgccaaggccgtggaggtatattcctcagcattccagaccttagagaagtacgatctcgaaagagacctcctcgacttccgtgctaagatgcagggagtgtatggtcactacgacacccggctgttggccaatacctctccaccaccatcagttctgcagtccctggcatcacaagggacactgcaggtgcagctgagcagggccaatgaggatccagaacaccctcatgccaaccatggtagattctcactttgtgagtgggtagtaaagggacaacctgcccattgcgtatgtggacagggagggcatctcatgttaccaggccattccctgtag

SEQ ID NO: 42249 - DNA, 3402 bp, Artificial Sequence
  Description of Artificial Sequence: Synthetic coding sequence
atggcccccaagaccaagaagggctgcaaggtgaccctgcccgagaagcccgtcaagcttgcgtctcatacaagagatactaccggtgtttcccagatgtttcctagtagcaaagcacgcacaaagtctttgctcggtgatgatgtcttcagcacgatggccggcctcgaggaggccgacgcagaagtaagtggaatctctgaagctgacccgcaagctcttctccaggcgatgaaggatcttgatggtatggacgctgacatcctggggctgaaaaagtccaactcagcccccagcaagaaggccgccaaggacccaggcaaaggcgagctgccaaatcaccccaagccagccgggggcgctatccccaccaaaaaaagtctgccttcaccaagctcatcaggccaccaaaatcggaggttctccagcgaggacctcgaggacccattacgagggcttctgtcctacgacgaaggggggattaccaagcagccccccgtaacacaatcaaagaccgcctccgataagagtccatccactgtgagggaccagggtccatccattcctcttaccccaggtgacactcctatccgcaaaaaagaagagttgctgtttgatgacggtgacgacatcatggctacacttggatttggggacagccccaaggctgagaaacgacagattggagatcaggaagggcctaggccggctagatccacactggatgaactccttggacgaggtatggccaccaagctgctcgcccgtccaggtaccggcgaacatcgagagttcaagctcgataagaagtatcaacgtccgcaagactctgaagacatgtggggagacgaggattttaccttcggggcatatcagccgacagtggtgagctccgaaggacgtcagtcaagacggcagtccgtgagatttttcgccgatagcggcgcagacccaaaaggcgaacccggatcaaaacagagcccccctatggcttcttctcctatccagcctcgaaagggcggggctgattggcttgggctgaaagatgaggacctagatctgttcccggcaagtccaacccgggaagcgcatagagagtcttctgtgcctgtcacgccttccgttcctccacccgcatcacagcattccactcctgccggactccccccttcgagggcaaaacccccgaccgaaggcgctggctcaccagccaaagcgtcccaggccagcaaactcagggcctcaaaggaggagaaggaggactggttgagtcacgcgctgtcaagaaagaaatctcagggcttggcccgtgagcagcacgcaggcacgagcgagggtctccatctcgcaggaaccgcaggacaccctccatctggctcacagcccctcactagcacccagggtctggaacacgccgcagccggcggctcatccggcacgacagcccgggaacgtccatgcgtacggcccggcgtctcggggtctccagtgacacagaatcacgcggccagcgccttgcctacaggctcaccaaaaaggggcactgcccctggagatctgtccgcaacggaacccgcgacatgttttcccagcacccaaaagccgactgaaccttccgttcctgtccagcctctccttccagagagtctagctcgctctcttctgccgagcacggaatatcagaagcagttattagccgctcaggttcaactccagtgttctcccgccgagctgcaagctgaactgctacacagtcaggcccgactagccgagctggaagcccaagtgcgtaagttagaattggaaagggcacagcacgaattactgcttgggtcactgcagcagcagcaccaggcagatctagagctcatcgagagcgcccatcggtctaggatcaaggttttggagacatcctatcagcagcgcgaagaaaggctgcgacgtgagaatgaggagctgtccgcccgttatctgtcccaatgccaggaggctgaacaagccagagctgaactaacagctcagcatcagaggcgactcgcagccatcgcccaggagaaggaccaggaaatggagcgtctgcgggagcttcagcgggctagtattctggatatgagacgggatcacgaggaacagctgcagcggttgaagctgctgaaggatcgagaagtggacgcggcaacttcagctacctcccacacaagatcactcaattccatcattcaccagatggagaaattttcatcctctctccacgagctatcctccagagtcgaagcctcccatctgacaacctcccaagagagagagttgggtattcggcagcgtgatgaacagctccgggcacttcaggagagattaggtcaacagcaacgcgatatggaggaggaaagaagtagacagcaggaagtgattggcaagatggaggccaggctcaatgaacagagtcggctgctggagcaagaaaggtggagggtgactgccgagcaatctaaggcagaatccatgcagagagccctggaagaacagcgaaaagtaactgctcagcagatggccatggagcgcgccgagttggaaagggcaaaaagcgctctcctcgaagaacagaaatcggtcatgctaaagtgtggcgaagaaagacgacgcctggcagccgagtgggcagagttctccgctcagcagaagctgagtaaggagagagccgagagggaggctgagcgcgccctacaggtagacacgcaacgtgaaggcacactgatatcactggccaaagagcaggctgaattgaagattagggccagtgagctgcgcgccgaagaaaagcaattagctgcagaacgtgcggccttggaacaggagcgtcaggagctgcggctcgagaaggagagaataaatgcgaccgccctgcgggtgaaactacgggctgaggaggtggagtcaatgagtaaagtggccagcgaaaaatacgaggaaggcgaacgcgctctgagggaagcgcaacaagtgcaggccgagcagcaggctaggttgcaggctgtccaacagcagcaggaacggctccgaaagcaagagcagcacatgcaccaggaacacctgtctctcgctcagcaaaggctgcaacttgatcgcgccagacaggatctacccagtagtttggtcggcctgtttccacgggcacaaggtcctgccgccagcagccaatctgcacttatgccacccgctcccaccacgaggtggtgttcacagccccccacgggcctggacccttccccacttcatctgcatgccagattagcactgttaagacacatggccgaacaggacagagatttcctggagaacgaacagttttttctcgaaacccttaaaaagggaagctataacctgacgagccactccgcctag

SEQ ID NO: 42250 - DNA, 2493 bp, Artificial Sequence
  Description of Artificial Sequence: Synthetic coding sequence
atggcccccaagaccaagaagggctgcaaggtgaccctgcccgagaagcccgtgaaactggcttcacacacccgggatacgaccggtgtttctcagatgttcccctcttctaaagcccggaccaagagcctgctcggagacgacgtgtttagcaccatggccggcctagaggaagcggatgctgaagtgtctggcatttctgaagcagacccccaggctctgctgcaagcaatgaaagatctggatggtatggatgccgatattctgggcctcaagaagagcaatagcgcacctagcaagaaggcggccaaggatcccgggaaaggggagctccccaaccacccgaaacctgcaggaggagctatcccgaccaaaaagagccttccatctccttccagttctggccaccagaatcgacggttttccagcgaagacctggaggaccccctccggggtctgctgagctatgatgagggcgggataacaaagcagcctcctgtcacacagtcgaaaactgcttcggataagtccccctccacagtccgcgaccagggaccctcaatccccctcacccccggagatacaccaattaggaagaaagaggagcttctgtttgacgacggtgatgatattatggccaccttggggttcggcgattcccctaaagctgaaaaaagacaaataggagatcaagaagggcctagacctgcaagatctactttagatgaactgctaggccggggaatggctacaaagcttctggctaggccgggcacaggagagcatagggagttcaagcttgacaagaaataccagcgaccacaggattcagaagacatgtggggagacgaggactttacatttggtgcgtatcagccaaccgtagtgagctccgagggaagacagagcagacgccagagtgtctctcgatttttcgctgatagtggcgcagatccaaagggagagccaggatcaaagcaatcacctcccatggcgtcaagtcccattcagccacgcaaaggtggagcagactggctgggattgaaagacgaggatctagatttgttccctgcgtctccaacaagagaagctcatagagagagcagtgttccagtgaccccctccgtgcccccaccagccagccagcattccacaccggctggcttgcctcccagccgggcaaaaccacctaccgagggtgccggcagcccagccaaagccagccaagcctccaaactcagagctagtaaggaggaaaaggaggactggctcagccacgccttatccaggaaaaagagtcaaggattggctcgggagcagcatgcgggaacatccgaaggcctgcacctggcgggtacggcaggccaccccccgtccgggtcacaaccgctgacgagcacccaggggctagagcatgccgctgccggcggatcctcaggtaccacagcacgcgagagaccttgcgtgcggcctggagtgagtggcagtcctgtgacccaaaaccacgccgcctccgccttacccactgggtcacccaagagaggcaccgcccccggcgacctgagtgcaacagaaccggccacatgttttccaagtacccagaaaccaactgagcctagtgtacccgtgcagcctcttctgccagaatccctcgccaggtctttgttacctagtaccgaataccagaaacagctattggctgcccaggtacaacttcagtgttcgcctgcagagctgcaggccgaactgctgcatagccaggcacgtttagcagagcttgaggcacaagtccgcaagttagaactcgagcgagcccagcatgagctgctgctcggctcactgcaacagcagcaccaggctgacctggaactgatcgaatcagcacaccgcagccgtatcaaagtacttgagacatcttaccagcaaagggaggagcgactgcgtcgcgagaatgaggaactgagtgctcgatatctgagccagtgtcaggaggccgagcaggctcgcgctgagctgacggcacaacatcagaggcgcttagcagcaattgcccaagagaaggatcaggagatggaacgacttagggagctccaaagggcctctatcttggatatgcgcagggaccacgaggagcagttgcagcggcttaagcttcttaaagacagggaggtggatgcagccaccagtgctacatcacacactcggtcacttaactctattatccatcaaatggaaaagttctcctcatccctccatgagctgtcaagccgtgtggaagcatctcacttgacgaccagccaggagcgtgagttgggcatccgccaaagggatgagcaattgcgggcattacaggagcggcttggtcagcagcagagggatatgggtcgggacgaggaggggagcctttgcgctgctcatcttccaaaggctcagctgtcaggatatgccgtcgaggcaacccgcaatcagagccaactccagcgatttctgtag

SEQ ID NO: 42251 - DNA, 3405 bp, Artificial Sequence
  Description of Artificial Sequence: Synthetic coding sequence
atggcccccaagaccaagaagggctgcaaggtgaccctgcccgagaagccagttaagctcgctagtcatacacgggataccactggcgtctcccagatgttcccttcgagtaaagctcggactaagagcctactcggtgacgatgtttttagcactatggccgggctagaggaagccgacgccgaagtgagtggcatatccgaagccgaccctcaggcactgttgcaggcgatgaaggacctggacgggatggatgcagatatcctcggtttgaaaaagagtaattccgcccctagcaaaaaggcagcgaaggaccccggcaagggggaactccctaatcacccgaagcccgctggaggtgctatccccaccaagaagagcctgccatcaccttcttctagcggacatcagaaccggcggttctcctccgaggatctggaggacccactacggggcctgctatcatatgatgagggtggtatcacaaagcagccacctgtgacccaaagtaaaacagcgtccgacaagagccccagcacagtcagggaccagggaccgagcattcctctcactcccggagacacgccaattcgcaagaaagaagagctcctgttcgacgatggtgacgacattatggctaccttagggtttggggattcgcctaaggcagagaaaaggcagattggagatcaggaggggcctcggccagctaggtcaacacttgacgagttactgggacggggaatggcaactaagctcctggctaggcctggcaccggagaacacagagaatttaagctcgacaagaaataccagagaccgcaggacagcgaggacatgtggggcgatgaggatttcacctttggcgcctaccagcccacggttgtgagctccgaggggcggcagtcccgcaggcagtcagtcagtcgttttttcgccgacagtggggctgatccgaagggagagcctggtagcaaacagtcacccccaatggcctcctcgccgatccagccaaggaaaggaggtgcggactggctgggtctgaaggacgaagacctggatctgtttcctgccagccccactcgagaagcccacagggaatcttcggttcccgttacgcccagtgtcccacccccagcctcccagcactcgacacccgccggccttcccccttccagagcgaagccgccaactgagggtgcagggagtcccgctaaggcatcccaggcgtcaaaacttcgagccagcaaggaagaaaaggaagattggctgtcccacgctctttcgcgaaaaaagtcgcagggcctcgcgcgagagcagcacgcgggaaccagcgaaggactacaccttgccggaactgcaggacatcctcctagtggctcgcagccattgacgtctactcaggggttggagcatgccgccgccggggggtccagtggcactaccgcccgggagagaccctgcgtacgacccggagtcagcggttctccggtgactcagaaccatgccgcttcagctctccctaccggctcccctaaaaggggcactgcgccaggcgatctctcagccactgaaccggcaacatgcttcccgtccacgcagaagcctaccgagcccagcgtcccagtccaaccactcctgcctgagagcctcgccagaagcctccttccttctactgaataccagaaacagctgctggcggcacaggtgcaacttcaatgtagcccagcagaactgcaggcggaactactgcactctcaagcccgcctcgccgagttagaggcgcaggtgcgcaaactcgagttggagcgggcccaacacgaacttttgctggggagccttcagcagcagcaccaggctgacctggaactgatcgaatctgcgcatcgtagccggattaaggtgctcgaaaccagttatcaacagcgcgaagagaggctgcgacgagagaatgaagaactctcagcaaggtacttatctcagtgtcaggaggcagaacaagccagggccgaactcactgcccagcaccagcgccgcctcgctgccatcgcccaggagaaggaccaggaaatggaacgcttaagggagctgcagcgcgcctcaatcctagatatgcgtcgtgatcacgaagaacagctgcagagattgaagctcctaaaggaccgcgaggtggacgctgccacctccgccaccagtcacactcgtagcctcaactctatcatccaccaaatggagaaattcagttcttcactacatgagctgtccagcagggtcgaggcgtcacacctgactacgtcacaggagagagagttagggattagacagcgggacgaacagctgcgcgcactgcaggagaggctgggtcaacagcaacgcgacatggaagaggagcggagccgtcagcaggaggtcataggcaaaatggaggcccgcctcaatgaacagtctcggctccttgagcaggagcgctggcgggtcacagcggagcagtctaaggccgagtcaatgcagagagctttggaggagcagagaaaagtcaccgcccagcagatggccatggagagagccgagttggaacgcgctaagtccgcactgctggaggagcagaaatccgtcatgctgaagtgcggggaggaaagacgacgactggccgcagagtgggccgaattcagtgcccaacagaaactctcaaaggagcgggctgaaagagaggccgaacgtgcgttgcaggtcgacacgcagcgcgaaggaaccctgatttccctggctaaagaacaagcagaattaaagatccgcgctagtgagctgcgagcggaggaaaagcaactggccgcagaacgagcggcactggaacaggagcgacaggagctgagactcgagaaagagcggataaacgcaaccgcccttcgcgtgaagttgcgggcagaggaggtcgagtctatgtctaaagtggcctcagagaagtatgaagagggtgaacgtgcacttcgggaagcccagcaagttcaggcagagcaacaggcaaggctgcaagcagtccagcagcaacaagaacgtctgaggaagcaggagcagcatatgcatcaggagcatctatctcttgctcaacaacggctccaacttgacagggccagacaagacctgccgtcctctcttgttggtctcttccccagggcgcagggacctgccgcatcctcgcagtcagccttgatgccacccgcgccaaccacacgttggtgtagccaaccgcctaccgggctggatccttcaccgctgcacctgcacgccaggctagcactgctgcgccatatggccgagcaggaccgcgattttctcgagaacgagcagttctttttggagactctgaagaaaggaagctataatctcacaagccactccgcatag

SEQ ID NO: 42252 - DNA, 3444 bp, Artificial Sequence
  Description of Artificial Sequence: Synthetic coding sequence
gcccccaagaccaagaagggctgcaagggcagcatcgacgacttcctgggtgatttgttaggggacgatatgacattgccggagaagccagtgaagctggctagtcatactagggataccaccggggtctcgcagatgttcccctcctcaaaggccaggacaaagtctctgctgggtgatgatgtgttttcaacaatggctggacttgaagaggccgatgcagaagttagtggcatctcggaggccgatcctcaggctctgctgcaggctatgaaggatcttgacggaatggacgcggatatcttgggcctgaagaaatcgaatagcgctccctctaagaaggccgccaaggaccctggaaagggcgagctacccaatcaccctaaacctgccggaggcgcaatccctactaagaagtccctgccttcccccagcagttctggacatcagaaccgaagattcagctcagaagacctggaagatcctcttagaggcctattgagttatgacgaaggtgggatcaccaagcagccacccgtgacacaatcaaagactgcctctgataaatctccctccaccgtgagagaccaggggccttcgatacccttgaccccgggggacacccctatcaggaagaaagaagaacttctattcgatgacggcgacgatattatggccactctgggttttggtgatagtcccaaagcagagaaacggcagatcggcgaccaggaggggcctaggccggctaggtcgactcttgacgaactgttaggccggggaatggccactaagttactggctcggcctggcactggggagcatagagagtttaaactggacaagaaataccagaggccacaggacagtgaggacatgtggggtgacgaggacttcaccttcggggcctaccagccaacggtcgtcagcagcgaggggagacaatcccgccggcagtcagtcagtcggttctttgccgattctggagccgatcctaaaggcgaacccggaagcaaacagagtccgccaatggcatcgagccctatccagccccgcaaggggggtgctgattggctcggcttgaaagatgaggatctggaccttttcccagcgtctcccaccagggaagctcatcgggagtcttctgtgccagtaacgccttctgtccctcccccagcgtcacagcacagtacccccgccggcctgccaccatcaagagctaagcctccgactgagggtgcgggatcgcccgctaaggcttctcaagcatctaagctaagagcctcaaaggaggaaaaagaagactggctgtcacacgcactgtccaggaagaagtcacagggattggcgagagagcagcacgctggaacctcagaggggctccatcttgccggaactgcagggcatccccctagcggtagccagccactgacatcaacccaaggactggagcacgccgctgctggagggtcctccggcacaactgccagagagaggccgtgtgtgcggcccggggtcagtgggtctccagtgactcagaaccatgccgccagcgccttacctaccggaagccccaagagaggtaccgcacccggagatctgtctgccaccgaaccagccacctgtttcccaagcacacagaaaccaactgaaccatccgttccggttcaacccctgttgccagagtcactagcgcggtctctgcttccatccactgaataccaaaagcagctgctcgcggcccaggtacagttacagtgtagccccgctgaattacaggcggagttgttgcattcccaggcaaggctggcggagctcgaagcacaagtgagaaaactggagctcgaaagggctcagcatgaattgctgttgggcagccttcagcaacagcatcaggccgatctcgaactgatcgagagcgcacaccggtcccggatcaaagttctggaaacttcctaccaacagagggaggagcgcctccgtcgcgaaaacgaagaactgtccgcacggtacctctcccagtgtcaggaggccgagcaggcgagagcagagctaaccgcccaacatcagagacgattagctgccatcgcgcaagagaaagatcaggagatggagagattgcgcgaactccagagggcctccattttagatatgcgcagggaccacgaagagcaattgcagcgcttgaaactgctaaaagatcgagaggttgacgctgccaccagtgcaactagccacaccaggtctctgaattcaatcattcaccaaatggagaagtttagctcctcattgcacgagcttagctctagggtggaggcctcgcatcttaccacctcccaggagcgtgagctgggcatcagacaacgagatgaacagttaagggctctccaggaacgactcgggcagcaacagagagacatggaagaagagcggtcccgccaacaggaggttatcgggaaaatggaggctagactcaatgagcagtcccgtctgctggaacaggagcgctggagggtcactgctgaacaatcaaaagcagaatcgatgcagcgagcccttgaggaacagcggaaagttaccgcacagcaaatggccatggaaagagccgaactggaacgcgccaagagcgcactcttagaggagcagaaatcagttatgctgaaatgcggagaggagcgccgccgtctcgcagctgagtgggcagagtttagtgcccagcagaagctgtcaaaggaacgggctgagagagaggctgaaagagcacttcaggttgatacccagagggagggtacactgatatcccttgccaaagagcaggccgaactgaaaatccgcgcgtcagagctaagagctgaggaaaaacaactggctgcagaacgtgccgccctggagcaggagcgccaggagctgcgattagagaaagagcgcattaatgctactgcattgagggttaagttaagagcggaagaggtggaatccatgtcaaaggtcgcatcggagaaatacgaggagggcgaaagggcattgagagaggcacagcaggtccaggccgagcagcaggctcgactgcaggctgtccagcagcagcaggagcgcttaaggaaacaagaacagcatatgcaccaagagcacctctctctagctcaacaacgtttgcaactcgaccgcgcaaggcaggatcttcccagttcactggtgggtctgttcccccgcgcccagggacccgcagcaagctcccagtccgctttgatgccacctgctcctaccactagatggtgttcccagccccctaccggcctggatccctctcctcttcacctgcacgcacgactcgcgcttttgcggcatatggccgaacaggacagggatttcctggaaaacgagcagtttttcttagaaacgctgaagaaggggtcttataacctaacatcccactcagcctag

SEQ ID NO: 42253 - DNA, 831 bp, Artificial Sequence
  Description of Artificial Sequence: Synthetic coding sequence
atgaagaagacccccgtgttcctggagagcctggtgaccaacatgttgagattacgggccatctgccccttcagctggagagtgttccagttcaggccgattagctgcgaaccactgataatccagatgaataagtgtaccgacgaggagcagatgttcgggtttattgagagaaacaaagctatcctgtccgaaaagcaggtcggatgtgcgttcgatatgctctggaagctgcaaaaacagaagactagccttcttaaaaatgcggaatacgtgcgggaccatccccagtttctgaccttgcacaacttagctacaaataagtttaaactgatgaatgacgataccttagttaatgtcctgtacgtgacccagcagtttgctggagaagcccacgatccactggtggaagctctcgttacggaggcctggaggcgtctcgagaggtttgacatcaagctcctgagcgaattctccagctgcctcgcagaccagcatttgtattttagcccactcatgggcaagattgccgacatcgttcatagaaaccttgagactactcaggacttgtcttccctctccgttctcatggtcaacattagctctctgatctcccggcacttccagcaacagctcgtcaataagacagagctgctgtttgataccatcgattcatctgaagtgaacgttgctaagtctatagccaaattcctcaggaacgtaaggtaccggtaccaacccctgctggagaggtgcaacaacgttttcctcagcaacgttgaccatttagatctcgacagcatcagcaaaatactatccgtgtacaaatag

SEQ ID NO: 42254 - DNA, 2544 bp, Artificial Sequence
  Description of Artificial Sequence: Synthetic coding sequence
atgaagaagacccccgtgttcctggagagcctggtgaccaacatgttgaggctcagggcaatatgcccttttagttggcgcgtattccagttccgccccatcagctgtgagccactgatcatacagatgaacaagtgcactgatgaggagcaaatgttcggcttcattgagcgtaacaaagccatcttgagcgaaaagcaggtcggttgcgcatttgatatgttgtggaagcttcagaagcaaaagacatctcttctcaaaaatgcagagtacgtcagagatcatcctcagttcctcacactgcataacctcgcaacaaacaagtttaagctcatgaacgacgatacacttgtgaatgtcctctatgtgacccagcagttcgccggtgaggcgcatgaccctttagtcgaagcactggtgactgaggcttggagacgcctggagcggttcgatataaaactgctgagtgagttctcctcgtgtctggctgaccagcacctctatttttcccctctcatgggaaaaattgctgatatcgtgcataggaatttggagacgacccaggatctgtcctccctgtctgtgcttatggtgaatatttcctctttgatcagcaggcattttcaacagcagctagtgaacaaaacggagttgttgtttgacaccatcgattcatctgaagtgaacgtcgctaagtctattgcaaagttcctgcgcaatgtccggtaccggtatcagcctctcctcgagcggtgcaataatgtgtttttatccaatgtggaccacctcgacctagattccatcagcaagatactgagcgtgtataaatttctacagtttaatagttttgaatttatcatcatggcaaagaagaagttgaccgagatgatccctctttgcaaccatccagctagcttcgtcaaacttttcgtggctctgggcccgattgccgggccggaagagaagaagcagctcaagagcacaatgctgcttatgagtgaagacctgactggcgaacaagccctagctgttctgggcgccatgggtgatatggaatcgcggaacagctgcctaattaagagggtgactagcgtcctgcacaagcacttggacgggtataaacccctggagctattgaaaatcacacaggagctcacattccttcatttccagcgcaaggaattctttgccaaattaagagagctgctgttgagttatcttaaaaacagtttcatcccgacggaagtttctgtcttggtgagagccatctctctgcttcccagccctcacctcgacgaggtggggatttctcgaattgaagcagtcctgccccagtgtgacctgaataacttatcatcatttgcaactagcgtcctgcggtggatacagcatgaccatatgtacctggacaacatgaccgctaagcagctcaagctgctgcagaagctggaccattacggtcgacagcggttacagcactccaactctttggatctgctacgcaaagaactcaaatcactgaagggtaacaccttccctgaaagtcttctcgaggagatgatagccacattgcagcactttatggacgacatcaactacatcaacgttggcgaaatcgcttctttcatctccagcaccgactatctctctactctgttgctggatcgcatagcttccgttgccgtgcagcagatagagaaaatccatccctttacgatcccagccatcataaggccgtttagcgtcctgaactatgacccaccacagcgtgacgagttcctgggtacctgtgtccagcaccttaactcttaccttggcattttggatccgtttatcctcgtgttcttaggcttcagtctcgcaaccctggagtatttcccagaggatcttctcaaagcaatattcaacatcaagtttctggcgcgactcgacagccagctcgagatcctgagcccttcccggtctgccagagtacaattccaccttatggagctcaatcggtcggtgtgcctcgaatgccccgagtttcagattccctggtttcacgaccgcttctgccaacaatataataaggggatcgggggtatggacggcacacaacagcagatctttaagatgcttgctgaagtgcttggcggtatcaattgcgtgaaggcaagcgttctcactccatactaccataaggtcgatttcgaatgcattttagataagaggaaaaagccgctgccctacggaagccacaatatcgctctgggtcagttgcccgaaatgccctgggagtccaacatcgagatcgtaggcagtaggctccctccgggcgcagaaagaatcgcattagaatttctggatagtaaggctctctgtcggaacatccctcacatgaagggaaagagcgcgatgaagaagcgccatctggagatcctgggctacagggtaattcagatctcacaattcgagtggaattccatggctctgtctactaaagatgctcgtatggactatctgagggagtgcatttttggggaagttaagagttgtctgtag

SEQ ID NO: 42255 - DNA, 2415 bp, Artificial Sequence
  Description of Artificial Sequence: Synthetic coding sequence
atgaagaagacccccgtgttcctggagagcctggtgaccaacatgcttcgtttaagagccatttgcccgttctcctggcgcgttttccaatttcgtcccatttcttgcgaaccactcatcatccagatgaataagtgtacagacgaagagcagatgtttggattcattgagagaaacaaagctatactgagcgaaaaacaggtgggctgtgccttcgacatgctgtggaaacttcagaagcaaaagaccagcctcctgaagaatgcagagtatgtcagagaccatccccagttcctgacgttacataatttggccacaaataagtttaaactcatgaacgacgataccctagtgaacgtgctctacgtcactcaacagtttgctggagaggcccatgatcctcttgtggaggcccttgtcacagaagcatggcggaggctcgaacgtttcgacattaagctgcttagcgagttttcctcatgtctggcagatcaacacctgtacttcagtcccctaatgggcaagatagccgacatcgtacatagaaacctggaaacaactcaggacctcagctcattgtctgtgttgatggtgaacatcagttccctgatttctcgtcactttcagcagcagttggtcaataagacggagctcctgttcgacactatagattctagtgaggtgaacgtggccaagagcattgcaaaattccttcgcaacgtgcggtatcgctatcaaccgctgttggagcggtgcaacaacgtctttctgtccaatgttgaccaccttgacctggactctattagtaagatactgagtgtctacaaatttctgcaattcaactcattcgagttcatcatcatggccaagaagaaactgaccgaaatgatacctctttgcaatcacccggcatcctttgtcaagttgtttgtagctctgggcccgattgccggacccgaagagaagaaacagctaaaatctaccatgctgctgatgagtgaggacctgaccggcgagcaggccctggctgtgctgggcgccatgggggacatggaatcaaggaattcctgtctgataaagcgcgtgacaagcgtgcttcataagcatctggacggttacaaacccttggagttactgaaaatcacacaagagctcacattcttgcacttccaacgcaaagagttttttgcaaagctgcgcgagctgctcctgtcctatctgaaaaactctttcatccctacagaggtaagcgtactcgtccgggctatctccctgctcccatctcctcacctagatgaggttggcataagccggatcgaagcggttttgccacagtgtgacttgaataacttgagttcctttgctactagtgttttgcgttggatacagcacgaccacatgtatctcgataatatgaccgcaaagcagctcaaactgcttcagaaactggaccattacgggaggcagcgcctgcagcacagtaactctctggatctgctccgcaaggagctgaaaagtttgaaagggaacacctttcctgagtccttactggaagaaatgattgccactctccaacatttcatggatgatattaattacatcaacgtcggagaaatagccagctttatctcaagcacggactatctctccaccttgctgttggataggatagcttccgtggccgtccagcagatcgaaaaaattcatccattcacgattcccgcaattattaggccctttagcgttctgaattacgacccccctcagagagacgaattcctaggaacctgcgtgcaacacctgaatagttatttggggatcctggacccattcatactggtttttctggggttttcactcgctaccttagaatacttcccggaggaccttctaaaggctatctttaatattaagttcctggccaggctggactcccagctcgagtccattggcggtatggatgggactcaacagcagatatttaaaatgctagctgaagtgctaggaggcattaactgcgtcaaggcttcagtcctcaccccttactaccacaaggttgactttgagtgcatcctggataaacgcaaaaagccgctgccatatggcagccacaacattgccctgggccaactgcctgagatgccatgggaaagcaatatcgaaatcgtaggctcccgcctgccaccgggagctgaacgcatagctctggagttcctggacagtaaggcattatgtcggaatataccacacatgaaggggaagagcgccatgaagaaacgccacctggagatcctggggtaccgggtgatccaaatcagccagttcgagtggaattccatggcactgagtaccaaagacgctcgaatggattacttgcgcgagtgcatcttcggcgaagtgaagagctgcctctag

SEQ ID NO: 42256 - DNA, 1989 bp, Artificial Sequence
  Description of Artificial Sequence: Synthetic coding sequence
atggccctgatcaccctgcggaagaacctgtaccggctgagcgacttccagatgcaccgtgcgctggcagccctgaaaaataagcctctgaatcacgtccataaggtggtgaaagagaggctgtgcccatggctgtgttccaggcagcccgagccttttggtgtcaaatttcaccacgctcactgcaagaaattccacagtaagaacggtaacgatcttcacccactgggagggccggttttttcacaagtatccgattgcgatagactggaacagaatgtcaaaaatgaggagtcccagatgttttataggagactcagcaatctgacctcttcggaggaggttttatcttttatttccaccatggaaacccttccagataccatggcagcgggtgccctgcagcgcatttgtgaggtagagaagaaagatggtgaccagggtttgcctaaggagattttggagaattccatcttccaagcgttgtgcttccagtttgaaaaagagcccagccagctgagtaacactagcctggtcaccgctctgcaagccctgatcctgctgcatgttgaccctcaatcttcattgttactgaatctcgtggccgaatgccagaaccggctaaggaaaggagggatggaggtacgcaatctctgtatactcggtgagtctctgatcacccttcactcatccgggtgtgtgactctggagctgataataaatcagcttcagggggagaagcttgaaacctttacaccggaagatatcgttgcgctctaccgaattctccaggcttgcactgagaaagtggacgagcatcagaccttccttaataagatcaacaatttcagcctgtccattgtgagcaatctgagccccaagctcatttcgcagatgctgacagctttagttgtgctagatcagagtcaagcctttcctctgatcattaaattaggaaagtacgtggtccggcacgtcccccactttacgaatgaggagttgagacgggtgttggaagcttttatatacttcggtcaccatgacaccttttttacaaaagcattggaacatcgcgtggcagccgtgtgcctgacactggaccccgaggtagtttgtagagtcatggagtactgctccagggaactgatactgtcaaagccaatcctgaacgctgtcgcagagaccttcgtctgtcagacagagaaattttcaccaagacaaatctctgctctgatggagcctttcggaaagcttaactacttgcctccaaacgcctcagcactgttcagaaagctggaaaacgtcctctttactcattttaactattttcctccgaagagtctgctaaaattattgcattcttgctcactgaacgagtgtcaccctgtaaatttccttgcaaagatctttaagccgctctttctgcaacggttgcaagggaaggaaagtcatctggatactctgagccgcgcccagttaacacagctttttctggcgtctgtcctggaatgcccattctataaagggccaaaactcctgccaaagtatcaggtcaagagcttcctaacgccctgctgttctcttgaaacccccgtggactcacaactgtatagatacgtaaaaatcggcctaacaaatctgctcggggctcgattgtactttgccccgaaggttctgactccctactgctataccatcgacgtcgaaattaaactagacgaagagggattcgtgttaccatcaactgcaaatgaagacattcacaagcgcatcgctctgtgtatcgatggaccgaaacgcttctgctccaactctaaacatctgctgggcaaggaggctatcaaacagcgccatttgcaactgctgggctaccaagtagtgcagattccctatcacgagatcggcatgctaaaaagccgacgagagctagtcgagtacctgcagcggaaactgttcagtcagaatacagtccattggttacaggagtag

SEQ ID NO: 42257 - DNA, 738 bp, Artificial Sequence
  Description of Artificial Sequence: Synthetic coding sequence
atggccctgatcaccctgcggaagaacctgtaccggctgagcgactttcagatgcacagagccctggccgccttaaagaacaaaccacttaaccatgtgcataaggttgtgaaggagcggctctgcccttggctgtgttctagacagcctgagcccttcggcgtcaagttccaccatgcccattgcaaaaagtttcattcgaagaacggcaacgacctgcaccccctggggggccccgtatttagccaggtctcggactgtgaccgcctggaacagaatgttaaaaacgaggaatcccaaatgttttacagacgcctgagcaatttgaccagctcggaagaggtcctgtctttcatatctacgatggagacattgcccgacaccatggcggctggggccctgcagaggatttgcgaagtcgagaaaaaagacggtgaccagggcctccccaaggagatacttgagaattcaatctttcaggccttatgcttccaatttgagaaggagccctctcaactgtctaataccagcctggttacggcgctgcaggcactaattcttttacatgtggacccccagtcctccctgctccttaacttagtggccgagtgtcagaataggttgaggaagggtgggatggaagtcagaaacttgtgtatactgggcgagtccctcattactttacattcttctggctgcgtgacgctcgaactcatcatcaatcaactgcaaggatag

SEQ ID NO: 42258 - DNA, 879 bp, Artificial Sequence
  Description of Artificial Sequence: Synthetic coding sequence
atggagcggggccccgtggtgggcgccggcctgggcgccggcgccaggatccaggccctgttgggctgtctgcttaaagtcctactatgggtggcgtcagctctcctgtacttcggctcagagcaggcagcccgactccttggttcaccctgcctgcggagactgtaccacgcttggcttgccgccgtagttatcttcgggcccctgttacagtttcatgtcaacccccgcacaatcttcgcatcccacggcaatttctttaacataaagttcgttaattccgcctggggttggacttgcacctttctggggggtttcgtcctcctcgtggttttcctggccacccgccgggtggctgttacagccagacacctctccagactggtggtcggcgccgcggtgtggagaggcgctgggcgcgcatttttgctgattgaggatctaactggatcatgtttcgaacccctgccccaaggattgttgcttcacgagcttccggaccggcgctcctgtctggctgctggacatcagtggaggggctacacggtatcctctcatacctttctgcttaccttctgttgcctgttaatggcggaagaggccgccgtgtttgctaagtatctggcgcatggcttgcccgccggcgcccccctccgcctcgtgttccttctcaacgtcctcctcctgggcctgtggaacttcctgctactttgcactgttatttatttccatcaatacacccacaaggtggttggcgccgctgttggaacatttgcatggtacttaacatatggttcgtggtaccaccagccttggtcccccggcagtcccgggcatggtctgttccctcggccccacagctctcggaagcacaactag

SEQ ID NO: 42259 - DNA, 789 bp, Artificial Sequence
  Description of Artificial Sequence: Synthetic coding sequence
atggagcacctggagcggtgcgagtggctgctgcggggcaccctggtcagggcagccgtgcgaagatacctgccctgggctcttgtcgctagcatgttagcggggagtctgttgaaggagctcagtcccctgcccgaaagctacctctccaacaagcgaaatgtgctcaacgtttattttgtcaaggtggcgtgggcgtggacattctgtcttctacttccttttattgcgcttacaaactaccaccttacgggaaaagcagggctagtgttacgaagactgagcactctgttggtggggacagccatttggtatatttgcacatccatcttcagcaacattgagcattacactggctcctgttaccaaagcccggctctggaaggggtcaggaaggagcaccagagcaaacagcagtgccatcaggagggtggtttctggcacggtttcgacattagcgggcattcttttctcctgacattctgcgcactaatgatcgtcgaagagatgagtgtgcttcacgaggtgaagaccgacagatcccactgcttgcataccgccatcacgacgctggtcgtggccctgggcatccttacctttatatgggtactgatgttcctttgcaccgcggtttactttcataacctttctcagaaagtttttggtaccctgttcgggctgctctcttggtacggaacctacgggttttggtacccaaaggccttttcccctggccttcctccccagtcttgttcgcttaacctgaaacaggactcctacaaaaagtag

SEQ ID NO: 42260 - DNA, 1053 bp, Artificial Sequence
  Description of Artificial Sequence: Synthetic coding sequence
atggagcccaccgagcccatggagcccaccgagcccatggagcccgcacggagcgcccacaggggcggtgaagctcttctgagagaactggaagtgttagttcaggacgtagttcgcacttcttcctggtgggaacgacatggggttgattgtgctatcctggctctgagcttgttcgcactaccagccggttttctctgccttagatgggagaacgcgctagttttcgcctccgggataacaatacttggagtgtgtcactacacactcaccgttaaaggatctcatcttgcgacacatggagcactaactgaaagtaaacgatggagcaaaatctggttgcttttctttgtggaggtgtgcactgcttttacagctgagcacgctacccacggtcatgtgaaaatgcaccatgcatacaccaatgtcgtcgggctcggcgactcttctacttggcggctgccatgcctcaatcgatatgtgtatatgttcctcgctccgttcttgttgcctattgcaaccccgctggtggccgttgagcggttacgtaaggtcgagctggggaccgctctgagaacactcgcactcatatcactggggctctattctcactactggctgctgcttaacgtgtcagggttcaagaacccctcctccgctttgggatgcatgttcctgactcggtcccttctcgcccatccatatctgcacgtgaacatttttcagcatatcggtctaccaatgttctcccgagacaataagccgcgccgcatacacatgatgtcactaggggtactcaacctggcgcggttgccagtgctggattgggcctttggtcatagcatcatctcatgccatgtggaacaccatctgttcccccgcctttctgataacatgtgtttgaaagtgaaaccggttgtttctcagtttctcagggagaagcagttgccatataacgaagacagttaccttgcgcggttccagctgtttctccggcgatacgaggagttcatggtgcaagccccccctatcacagagctagtggggctctag

SEQ ID NO: 42261 - DNA, 615 bp, Artificial Sequence
  Description of Artificial Sequence: Synthetic coding sequence
atgcagggcctgcggcggtggggctgcagccccggcagccagcggtcttgcattgctcaactgtgtttgaccgggacgccggttagtttcctcgtcccaagctcccggtgcgcccagccaagcctccaatccacccctcgcatgggcactagccggtgtacaatgcctacccccacatggtgggcttggggcaccccagcccggggaggatgtctggctagtaccgctatgtctacatgctccctcctcctgagtagtagcccttctccactgcattggtggctttcacacattggcctgcccatgttctctcgcgataacaagccccggcggatacatatgatgagtttgggcgtgttgaatctggcaagacttccagtgttggattgggcttttggccacagtatcattagctgccatgtggagcatcacctgtttcccaggctctccgacaacatgtgtctaaaggtgaagccagttgtatctcagttcctgcgggaaaaacagctgccttataatgaagacagctatcttgcccgcttccagttgttcctcaggcgatacgaggagtttatggttcaggctccaccaattacagagctggtgggcctctag

SEQ ID NO: 42262 - DNA, 1548 bp, Artificial Sequence
  Description of Artificial Sequence: Synthetic coding sequence
atggtgagcatccccgagtactacgagggcaagaacgtgctgctgacgggcgctaccggcttcctaggtaaggtgctgctggagaagttgctgcgctcatgtccaaaagtcaacagcgtctacgttctggttcggcagaaagctgggcaaaccccccaggagagagtcgaagaggttctgtcaggcaagctctttgacaggctgagagacgaaaatcccgatttccgggaaaaaattatcgccatcaactccgagttaacccagcctaaacttgcactgtccgaggaggacaaggaggtcataatcgactccacgaatattatatttcattgtgctgccaccgtaaggttcaatgaaaacctgcgagacgcggttcaactgaatgtgattgcaactcgccagcttattctcctcgcccaacaaatgaagaacctagaagtctttatgcatgtgtctaccgcctatgcatattgcaatcgtaaacacatcgacgaggtggtttatcctcctcccgtggatcctaaaaaactgattgactcattagagtggatggacgacgggctggtgaatgatataacccccaaactgattggagaccggccaaacacctacatctacaccaaagcgctggccgaatacgtggttcagcaggagggtgccaagttgaacgtcgccattgttcgaccaagtatagtcggggcctcctggaaagagccctttccgggatggattgacaacttcaatggcccctcaggactgtttattgcggccgggaaaggtatactaagaactatcagagcctcaaataacgctctcgctgatctcgtgcccgttgacgttgtagtgaacatgagtctcgccgccgcctggtattccggggtgaaccgaccaagaaacatcatggtgtacaattgcacgaccgggtctaccaaccctttccactggggcgaggtggagtatcatgtgatctccaccttcaaaagaaaccctctggagcaggcctttaggcgccccaacgttaatttgaccagtaatcatcttttgtaccactactggatagcagtgtcacacaaagcccccgcattcttgtacgatatatacctccggatgacaggtaggtcaccacgaatgatgaaaacaattactagactccacaaggctatggtgttcctggaatatttcactagcaactcctgggtatggaatacagagaacgtgaatatgttaatgaaccagttgaacccagaagataaaaagactttcaacatcgacgtcagacagcttcattgggctgaatacatcgaaaactactgtttagggactaagaaatatgtcctgaatgaggaaatgagcggactacctgctgcaaggaaacacttaaataaactacgcaatattagatacgggtttaataccatccttgtcatcttgatttggcggatctttatcgcgaggtcacagatggcccgcaatatctggtactttgtcgtgagcctctgctacaaattcttgtcttatttcagggcttctagcaccatgcgctactag

SEQ ID NO: 42263 - DNA, 1029 bp, Artificial Sequence
  Description of Artificial Sequence: Synthetic coding sequence
atggtgagcatccccgagtactacgagggcaagaacgtgctgctgacaggtgccactgggttcctggggaaggtcctcctcgagaagttgctccggtcatgcccgaaagtgaactccgtgtacgtgctggtgcgccagaaagctgggcagaccccacaggaacgcgttgaggaggtcttgagtggcaaactctttgaccgcctgcgagacgaaaatcccgacttccgcgaaaagatcatcgctatcaacagtgagcttactcaacccaagttagcgctgtctgaggaggacaaggaggtgattatcgacagcaccaacatcattttccattgtgctgcaacggtgcgctttaacgaaaacctgagggacgcggttcagttaaacgtgattgctacacgccagttgattttgttggcccaacagatgaaaaacctggaggtcttcatgcatgtgtctaccgcatatgcatactgtaataggaaacacatagatgaggtggtgtacccccctcccgtggaccccaagaagctgatcgactcactcgaatggatggatgacggcctcgtgaacgatatcacacccaagttgataggagatcggcccaacacctacatttacaccaaggcactcgccgaatacgtggtgcagcaggaaggtgctaaattaaatgttgccatcgtgcggccttctattgtgggggcgtcttggaaagagcccttccccggatggattgacaatttcaacggaccatccgggttatttatcgccgcaggcaaggggattttgcgcacaatccgagcaagcaacaacgcgctggccgatctggtccccgtggacgtggttgtgaatatgtctctggcggccgcttggtacagcggggtgaatcggcctcgcaatattatggtgtacaattgcaccaccggtagcacgaacccctttcattggggagaagtgggcatgatcctacctgtgtttctgaacgtaagaatcaatctgaaggagcctcggaaaaagaagaagaagaaatag

SEQ ID NO: 42264 - DNA, 1548 bp, Artificial Sequence
  Description of Artificial Sequence: Synthetic coding sequence
atgagcaccatcgccgccttctacggcggcaagagcatcctgatcaccggcgccacaggttttttgggtaaagttctgatggagaagctctttcgcacctcccccgatctgaaagttatttacatattggtgagacccaaggccggtcaaaccctgcaacagagggtgttccagattttggacagtaagctatttgaaaaagtgaaggaggtttgtcctaacgttcacgaaaagatccgggctatctacgctgatctgaatcagaatgacttcgccatttcaaaggaggatatgcaggagctgctgagctgtacaaacatcatcttccattgcgccgccacagtcagattcgatgatacactccgccatgctgtgcagctcaatgttactgcaacgaggcaactccttctgatggcttcacagatgccaaagcttgaggcctttatacatatttccaccgcctattcaaactgtaatttgaagcatatcgacgaagtcatatatccctgtcctgtcgagccaaaaaagataattgacagtctggagtggctggatgacgccattatcgatgaaattaccccgaaactgatcagagactggcctaacatctacacctacacaaaagcccttggagagatggttgtgcaacaggaatctcgtaacctgaacatagccattatcaggccttccatcgtaggcgcgacctggcaggagccgtttcctggctgggtcgacaacatcaacgggccgaacggaatcataatagcgactggtaaaggcttcctaagagctattaaagcgactcccatggctgtggcagatgtgattcctgtggatactgtggtaaacctgatgctcgctgtggggtggtatacagccgttcaccgcccaaagagcactctcgtgtaccacatcacatccggcaatatgaatccttgcaattggcacaagatgggggtgcaagtcctcgctaccttcgaaaagattccattcgagcggcctttccgccgccctaacgctaatttcacctctaattcattcacatcccagtattggaatgccgtgtcccaccgtgcccctgctattatatacgattgttatctgcggctgacaggccgaaaacctaggatgacaaaactgatgaatcggttactgcggactgttagcatgttagagtacttcattaacaggtcctgggagtggagcacctacaatactgagatgctgatgagtgaattgagccccgaggatcagcgtgtgtttaacttcgatgtgcggcagttaaactggctggagtacattgaaaactacgtgctgggagtaaagaagtacttactcaaggaggatatggccggtatcccaaaagctaaacaaagactcaaacggctgcggaatatccactatttgttcaacaccgccctgtttctaattgcctggagattactcattgctaggtcccagatggcacggaacgtctggttcttcattgtctcattttgctataaattcctgtcatactttcgggctagctctaccctgaaagtttag

SEQ ID NO: 42265 - DNA, 1548 bp, Artificial Sequence
  Description of Artificial Sequence: Synthetic coding sequence
atgagcaccatcgccgccttctacggcggcaagagcatcctgatcactggcgctaccgggtttctggggaaagtccttatggagaaactttttagaacttctcccgatctgaaggttatatacattctcgtgcggcccaaggcgggccagaccctgcaacagagggtgtttcagatcttggattcaaagctgttcgaaaaggtcaaggaagtctgccccaatgtccacgagaaaattagggccatttacgcagacctcaatcagaatgattttgcaatcagcaaggaagatatgcaggagctgctcagctgcacaaacataatattccattgcgccgctacagttcggtttgacgacacactaaggcatgcggtgcaacttaatgtgaccgctacccggcaactgttgttgatggcttctcagatgcccaagttagaggcctttatacatataagcacagcttatagcaattgcaacctgaaacatatcgacgaggtgatatacccttgccccgtggagcctaaaaagatcatagacagccttgagtggctagacgacgccattatcgatgaaataactccaaagttgatccgcgactggcccaatatttacacctacacgaaggcactcggagagatggtagtgcagcaagaatcaaggaacctgaacatcgctatcattcggccttccatagtgggtgctacctggcaggaaccatttcccgggtgggtagataatattaacggtccaaacgggattattatcgctaccggtaaagggttcctcagagctattaaggccacacctatggcagtggccgatgttattcctgtcgatacagtggtgaacttgatgcttgccgttgggtggtatactgccgtgcacaggccaaagtccactcttgtctatcatatcacgtcaggcaacatgaatccatgtaattggcataagatgggggtccaagtgttggccactttcgaaaagatacctttcgagcggccattccgtaggcctaatgccaacttcactagtaatagctttacatcccagtactggaacgcggttagtcatcgcgctcccgctatcatttacgactgctacctgcgcctgactgggcggaaacccagaatgacaaaactaatgaatcgactccttcgtacggtcagcatgttagagtatttcataaataggagctgggagtggtcaacatataataccgaaatgctcatgagcgaactcagccctgaagaccagagggttttcaactttgacgtgagacagcttaactggctagaatatatcgagaactacgtgctcggggtgaagaagtatctgcttaaggaggatatggcagggattcccaaggccaagcagcgactgaaacgactgaggaacatccattacctgtttaatactgcactattcctcattgcgtggagacttctgattgctcgctcacagatggccaggaacgtatggtttttcattgtctcgttctgctacaagttcctcagctacttccgggcaagttccactttgaaagtgtag

SEQ ID NO: 42266 - DNA, 609 bp, Artificial Sequence
  Description of Artificial Sequence: Synthetic coding sequence
atgctgctgtggagcctgctggtgatcttcgagcgggtgcgggagaatttagacagcctcactctcgtggcaccttcatctgtctttgagggagactcaattgttctgaagtgtcagggcgaacaaaattggaaaatccagaagatggcttaccacaaggataacaaagagctgagcgtcttcaagaaattcagcgatttccttatacagtctgcggtgctttctgactccggcaattatttttgctccacaaaaggccaactgtttttatgggacaaaacttcaaacatcgttaagataaaggtacaggggcccgatggatataggagggatctgatgactgcaggcgtattgtgggggttgtttggggtacttggttttaccggggtcgcactgcttctgtatgcgctgttccacaaaattagcggagaaagttccgccactaatgagcctagaggagctagtcgtccaaacccacaggagtttacctacagttccccaacccctgacatggaagagctacagccagtatatgtcaatgctaatatccgcaccttacttgagaataaggattcccaggttatctacagtagtgtcaaaaagtcctag

SEQ ID NO: 42267 - DNA, 1527 bp, Artificial Sequence
  Description of Artificial Sequence: Synthetic coding sequence
atgctgctgtggagcctgctggtgatcttcgacgccgtgaccgagcaggctgattctttgactctggttgctcctagttctgtgttcgagggggacagcatcgtgctgaaatgccagggggagcagaactggaagatccagaagatggcttaccataaggataataaggagcttagtgtcttcaagaaattctccgactttctaatccagagtgccgtcctatccgatagcggtaactatttttgctctaccaaagggcagctgtttctgtgggacaagacatcgaatattgtaaaaattaaggtgcaggaactgttccaacgtccagtgcttactgcaagcagcttccaaccaatcgagggaggccctgtctccctgaaatgcgaaactagattgtctcctcaacggcttgatgttcagttacagttttgcttttttcgggaaaatcaggtgcttggctccgggtggtcttcctccccagagctgcaaatctccgcagtttggagcgaggacaccgggagctattggtgcaaagctgaaaccgtgacccacagaattagaaagcagtctttgcagagtcaaatccacgtgcaacgaatcccgatctctaacgtctccctggagatccgcgctcccggcggccaggtaacagaggggcagaagctgattctgctctgcagtgttgccgggggaactggaaacgtgaccttcagttggtacagggaggctaccggaacgtcaatgggaaagaaaacccagaggtcactcagtgctgaactggaaatcccagccgtgaaagaatccgatgcaggcaagtactactgcagggccgacaacgggcacgttcccatacagagcaaagtggtcaacatcccagtccgcatccctgtgtcccgccccgtgctcacactgcgctctcccggggcccaggctgccgtgggggacctcctggagctccattgcgaggctcttcggggtagcccacccatcttataccaattctaccatgaagacgtcacactgggaaacagctccgcaccatctggggggggcgcctcttttaatttgtcacttacagccgaacactccggaaattattcttgcgaggcgaacaacggcctgggtgcccagtgttctgaggctgtgcctgtgagcatcagcgggcccgacgggtacaggcgggacttgatgacggcaggcgtgctctggggactctttggagttttgggtttcactggtgtggccctgctcctttatgccctgtttcacaaaatatcaggggagtcatccgctactaatgagcccagaggagcttctcgacccaaccctcaagaattcacttattcatcacctactccagacatggaggagctgcagccggtgtacgttaatgtcggatcagtggatgtggatgtcgtgtactcccaggtttggtctatgcagcagcccgagtcctcagctaacatccggacattgctcgagaataaagatagtcaagtaatatatagtagtgtaaagaagtcatag

SEQ ID NO: 42268 - DNA, 609 bp, Artificial Sequence
  Description of Artificial Sequence: Synthetic coding sequence
atgctgctgtggagcctgctggtgatcttcgacgccgtgaccgagcaggctgattccctgaccctggtcgcaccatctagcgtattcgagggagatagcatcgtactcaaatgccaaggagagcaaaactggaaaatccagaaaatggcgtaccacaaggataataaggaattgtcagtcttcaaaaagttctctgacttcctgattcagtccgcagtgctgagcgactccggtaactatttttgtagcactaagggccaactctttctctgggataaaacatctaacatcgtcaagatcaaggtgcagggcccagacggttacaggagagatcttatgactgccggcgttctgtggggcctgtttggtgtgttgggcttcaccggcgtcgcccttcttttgtacgccctgtttcacaagataagcggcgaatctagcgcaactaatgagccccgcggtgcatctcgtcctaacccccaggagtttacctactcatcaccaaccccagacatggaggagctccagcctgtgtacgtaaacgccaatatccggacactgctggagaataaggactcacaagtgatctactcgtccgtgaaaaaatcatag

SEQ ID NO: 42269 - DNA, 1335 bp, Artificial Sequence
  Description of Artificial Sequence: Synthetic coding sequence
atgctgctgtggagcctgctggtgatcttcgacgccgtgaccgagcaagcggattccctgactcttgtggccccgtcctcggtgttcgaaggggactcgattgtgctgaagtgtcagggcgagcagaattggaaaattcaaaaaatggcctatcacaaggacaataaagagctatctgtatttaaaaagttttccgattttctgatacaatctgcggtactgtccgattcagggaattatttttgttccactaaggggcagttattcctttgggataaaacctccaatatagttaagattaaagtccaagaattgttccagagacccgttctgacggcttcatcatttcagcctattgaagggggtcctgttagcctcaaatgtgagacacgcctgtccccccagagactggacgtgcagctgcagttttgttttttcagagagaaccaagtgcttggttctggatggtcttccagcccagaattacaaatcagtgcggtttggagcgaggacaccggcagttattggtgcaaagccgagaccgtcacccataggattaggaagcagtcactacaaagccaaattcacgtccagcgtatcccgatctcaaatgtcagtttagaaataagggccccaggaggccaggtgactgaagggcagaaactgattttgttatgtagcgtggcgggcggtacaggcaacgtgactttctcttggtacagggaagcgaccggcaccagcatggggaagaagacccagcgaagccttagcgctgagctggaaatccctgccgtaaaagagtccgacgctggcaaatattattgcagggctgataacggacacgtccccattcagtccaaagtggtcaatatccctgttaggattcctgtttctaggcccgtactcactcttcgctctcctggcgctcaggccgctgtgggcgatcttctggagctccattgcgaggctctgcgcggctctcccccgattctctaccaattctaccatgaggatgtgaccctgggaaactccagcgcgcccagtgggggcggagcctccttcaacctgtctctgacagcggagcactcaggtaactacagctgtgaggctaataacggactgggcgcccagtgctccgaggctgttccagtctctatctccggccccgacggataccgccgcgacctcatgacggctggggtgctatgggggcttttcggggtcctcggctttaccggcgtggccctacttctctatgctctctttcacaagatatcaggggaaagctccgctactaacgagccacggacccctaagtccagtacactactgtag

SEQ ID NO: 42270 - DNA, 579 bp, Artificial Sequence
  Description of Artificial Sequence: Synthetic coding sequence
atgtgggagtggaagatctgcaacagccacggcgcccggcccttcgctgaacctgccgggtgggagtttgtcaatctccttagacaccacaagtctttcctgatagcacctctgtgcttatcagtgcctgtttctagacccgttctgactcttcgctcacctggcgcccaggccgccgtgggcgatctgttggaattacactgcgaggctttgcgggggtccccgccaatcctgtatcagttttaccacgaggacgtcacactaggcaattcctccgccccttccggcgggggggcaagtttcaatctttccctcactgccgaacattcagggaactattcttgtgaggcgaacaacggactcggcgctcagtgttctgaggccgtgcctgtgagtatttctgggccagacggttaccgccgggacctgatgaccgccggcgtgctttggggcctgtttggagtgctagggtttactggagtggcccttctgctctatgccctttttcacaaaataagtgggtgtatctaccaccttgattccccgtacttcgcgatgacattccctcttttgatttag

SEQ ID NO: 42271 - DNA, 2124 bp, Artificial Sequence
  Description of Artificial Sequence: Synthetic coding sequence
atgctgctgtggctgctgctgctgatcctgacccccggccgggagcagagcggtgtggcacccaaggccgttctcttgcttaatcccccctggagtaccgcctttaagggcgaaaaggtagccctgatctgttcgtccatttcccattccctagctcagggcgacacttattggtatcacgacgagaagctattgaaaattaaacacgataaaatccagattaccgagccaggcaattatcagtgcaaaaccagaggtagttccctgtctgatgccgtgcacgtcgaattcagcccggattggctcatccttcaggctctgcacccggtcttcgaaggggacaatgtgatactgcgctgtcagggcaaggacaacaaaaatactcaccagaaggtttattacaaggacggcaaacagctgcccaacagttacaacttggagaagattaccgtcaatagtgtctcacgagacaactcaaagtaccattgcactgcgtatagaaagttctatatcctggatattgaagtcacgagcaagccactcaacatacaggtgcaggagttgtttctgcatccagtgctgcgcgcctcatcaagtactcctatcgaaggctctcctatgaccttgacgtgtgaaacccagctttcgccccagcggcccgacgttcagcttcaattcagtctattccgagacagccagacactcgggcttgggtggtcacggagtccgcgtctgcagatccctgccatgtggactgaagactcaggtagttactggtgtgaagttgagaccgtcactcactccataaaaaagagatctttacgcagtcagatccgggtccaacgcgtaccagtgagcaatgtgaacctcgagattcgccctaccggaggccagttgatcgagggcgaaaacatggtgctgatctgttcagtcgcacagggcagtgggaccgtaacattcagttggcacaaagaagggcgcgtacggagtcttggccggaaaacccagcgtagccttctggccgagctgcacgtgctgacagttaaggagtcggatgccggccgctactactgcgcagccgacaatgtgcactcaccaatcctcagcacatggatccgcgtgactgtcaggatacccgtgtcacatcctgtactcacatttagagctcctcgcgcacacacagtggtcggcgatcttctggagctgcattgcgaatccttgcgcggatctccccccattctctacaggttttaccacgaagatgttacattagggaattcatcagcgccgtctggggggggggcctctttcaatctgtctctgaccgctgagcacagtggcaactactcttgtgatgcggataatggactgggggcccaacatagccatggggtgtctttgcgcgtcacagtccccgtcagccgcccggtgctgacactacgggcccccggagcgcaagcagtggtgggtgatctcctcgaactgcactgtgagtctctgaggggctcgttccccatattgtactggttctatcacgaggatgacacccttggcaatatttctgcccactccggaggaggagcgagttttaacttaagcctgaccaccgaacatagtggaaattacagctgtgaagcagacaacggactgggtgcccaacactcgaaggtggtcacgctaaacgtaactgggacctcacgcaatcgtacaggcttgacagcagcggggatcactggcctcgtgctgagcattttggtccttgccgccgcagccgccctgctccattatgcccgtgcaagacggaaacccggaggcctaagtgccaccggaacttccagtcattccccttctgagtgccaggaaccctcctcttctaggccctctagaatcgatccccaggagcctacgcactccaaacccctggcaccaatggagttggaacccatgtacagcaatgtgaatcctggggacagtaacccaatttactctcagatctggagtattcagcatactaaggaaaacagcgccaactgccctatgatgcatcaagagcacgaagagctgacagtcctttacagcgagctgaagaaagaacagtcctcgcggttcagtatgtctctttag

SEQ ID NO: 42272 - DNA, 2205 bp, Artificial Sequence
  Description of Artificial Sequence: Synthetic coding sequence
atgctgctgtggctgctgctgctgatcctgacccccggccgggagcagtctggcgtggctcccaaagctgttctacttctcaaccctccttggtcaacggcatttaagggcgagaaagtcgcactgatttgttcctccatttctcattcccttgcgcagggtgatacatattggtaccatgatgagaaacttcttaaaattaaacacgataaaatccagatcaccgagcccggcaattatcagtgtaagacccgtggaagttctctttctgacgcggtccacgtagagttttctcctgattggcttatcctccaagctctgcacccagttttcgaaggtgataatgtgatcctccgatgtcagggaaaagataacaagaatacacatcagaaagtgtactacaaagatggaaaacagttgcctaattcctacaacttggagaagatcactgttaattccgttagtagagacaattccaaatatcactgcactgcctatcggaagttctacattctcgacatagaggtgacgtccaagcccttaaacattcaagtgcaggagcttttcttacacccggtgctgcgggcctcttcgtctacgcccattgaaggaagccctatgactttgacctgcgaaacccagctgagcccccaaagaccggatgtgcagctacagttctctctgttcagagactcccaaacgctggggttagggtggtctagaagtccccggcttcaaataccagcaatgtggaccgaggactctggctcctactggtgtgaggtagagaccgtgactcactcaatcaagaagcggtcactgagatcacaaattagggtgcagagagtgccagtatccaatgtgaatctcgagattcgtcccactggcggacaattgattgagggagaaaatatggtgctgatctgtagtgtggcacagggcagcggtaccgtgaccttctcgtggcacaaagagggtagggtccgaagcctgggtaggaaaacacaacgtagtttactggcagaactgcatgtgctgaccgtgaaggaatctgacgcagggaggtattattgtgcagcagataacgtgcatagtcctatcctatctacatggattcgcgtgaccgtcaggattccagtgtctcatccagtcctcaccttcagggctccaagggcccacaccgtagttggcgatctcttggagttacattgcgagtccctacgcggaagccctccaattttatatcggttttaccatgaagatgtgacccttggaaattccagtgctccttctggggggggtgcatcctttaacctgagcctgactgctgagcattccggtaactatagctgcgatgccgataatggattgggggcccagcatagccacggcgtgagtctccgtgtgactgtgccagtgtcccgacccgtgctcacgctgcgagccccaggtgctcaggctgtggttggagacctgctggaactacactgtgagtcccttcgtggaagctttccgattctctactggttttaccacgaagacgataccctcgggaatatcagtgcacattctggggggggcgcctcgtttaatctctctctcacgaccgagcacagcggaaactatagctgcgaagcggataatgggttaggtgcccagcacagcaaagtcgtgacgctgaacgtgacggggacgagccgcaaccgcaccggtctcacagctgccgggattactggacttgtgctgagtattttggttctcgcagccgccgccgctttgctccattacgcacgcgctcgacgtaaaccagggggattgagtgcgactggaacgtcttcccactctccaagcgagtgccaagagccctcttcatccagaccctcacggatcgaccctcaagagcctactcattcaaagcctttagcccctatggagttagagcctatgtactctaacgtcaaccctggagactcaaacccaatctacagtcagatctggtccatccagcacactaaggagaactccgccaattgtcccatgatgcaccaggagcacgaagagctaacagtcctttacagcgagctgaagaagacgcatcctgacgattctgccggggaggcttcctcaaggggtagagcccacgaggaagatgatgaggagaattatgaaaatgtcccccgggtgctgctggcttcggaccattag

SEQ ID NO: 42273 - DNA, 2229 bp, Artificial Sequence
  Description of Artificial Sequence: Synthetic coding sequence
atgctgctgtggctgctgctgctgatcctgacccccggccgggagcagagtggagtcgcccctaaggctgtgctgcttctgaaccctccatggtctacagctttcaaaggggagaaggtggcactcatctgttcctccattagccatagccttgcccagggcgatacttattggtaccacgatgagaagcttttaaagatcaaacacgacaagattcaaatcaccgaacctgggaactatcagtgtaagacccgtgggagcagcctcagtgatgcggttcatgtggaattttccccagattggctgattctgcaggcgcttcaccctgtgtttgagggagacaatgttattctccggtgccagggcaaagataacaaaaatacccatcaaaaagtgtactacaaggacgggaagcagctgcccaacagctataatttggagaaaattacagtaaattccgtgagccgagataacagcaaataccactgcacagcctatagaaagttttacatcctggatatcgaggtcactagtaagccccttaatatacaagtccaggaactcttcttgcacccagtgttgagggcttcttcatcgacccctatcgagggatcccccatgacactcacctgcgagactcagctgagccctcaacgccccgatgtacagcttcaattttcgcttttcagggatagtcagacgctggggttgggatggtcccgaagcccccggctccagattccggctatgtggactgaagattctgggtcctattggtgcgaagtggagactgtgacacacagtattaagaaaagatcacttcggtctcagatccgtgtccagagagttcctgtgtcaaacgttaacctggagatcaggcctaccggtggtcaactcatcgagggggaaaacatggttcttatatgttccgtcgcccagggctctggtaccgtgacattttcctggcacaaggaaggcagggtgcgatcccttgggcgcaaaacacaacggtctctgctggccgagctgcacgtacttaccgtcaaggagagtgacgcgggtcgatattactgcgccgctgataatgtgcattctcctatcttgagtacctggatccgcgttaccgtcagaattcctgtctcccacccagtgcttacttttcgcgcacccagggcccacacagtcgtgggcgatctcctagagctccactgtgagtctctccgcggctccccaccgattctttaccgtttctatcacgaggatgttaccctcgggaattcgtcagcaccgtcgggcggcggggccagtttcaacctgagcctgacagcagaacactcaggcaattatagctgcgatgctgataacggcctcggtgcccagcactctcatggagtaagcttaagagtgaccgtacctgtctcaagacccgtgttaacactgcgcgccccgggggctcaagcggtggtgggcgacttgttggagcttcactgcgagtctttgcggggatcatttcccattctttactggttctaccacgaagatgacaccctgggcaacatcagtgcccatagcgggggcggagcttcttttaatttgtcgctcaccactgaacactccggcaactactcgtgcgaggcagacaatgggctgggggcccaacattcgaaagtagtcaccctaaacgtgaccggaacttcccgaaaccggaccggccttaccgccgccggaattaccggactggttctcagtatactggtcttagccgcagccgctgctttgcttcattacgccagagctagaagaaagcctgggggtttaagcgccacaggcacatccagccactcccctagcgagtgtcaggaacccagtagttctcggcccagtaggatagatccacaggagcccacccactccaagccactcgcccctatggaactcgagcctatgtactcaaatgtgaacccgggcgactctaatcccatttactcacagatatggagcatacagcacacaaaagaaaactctgctaattgtccaatgatgcaccaggagcacgaggagttgactgtcctctattctgaactgaaaaaaacccacccagacgatagtgcaggtgaagctagtagtcgcggcagggcccacgaagaggacgacgaagagaattatgagaacatcctgaatccacggaaaaataaggttcaggacttcccctgtctgtgtaacacctag

SEQ ID NO: 42274 - DNA, 2205 bp, Artificial Sequence
  Description of Artificial Sequence: Synthetic coding sequence
atgctgctgtggctgctgctgctgatcctgacccccggccgggagcagtcaggcgttgctcccaaagccgtccttttactcaaccccccctggagcaccgctttcaaaggcgaaaaagtagcccttatttgttcctctattagtcatagcttggcccagggagatacatattggtatcacgacgagaaacttctgaaaattaagcacgataagatccagatcaccgagccggggaactaccaatgtaaaacacgtggcagcagtctgtccgacgccgtccacgtggagtttagtccggattggctgatcctgcaggccctgcaccccgtgttcgagggagataacgttatccttcgttgtcaggggaaggataacaagaacacccatcagaaggtgtattataaggacgggaagcagctgcctaattcatacaatctcgaaaaaattaccgttaactctgttagccgggacaacagcaagtatcactgcaccgcttacaggaagttttacatcctcgacattgaggtcaccagtaagcccctaaatattcaggtccaagaactcttcctccatcctgtgcttagagcctcttctagcacgccaatcgaagggtcccccatgacactgacgtgtgagacccagctcagtccacagagaccggatgtgcagctgcaattctccctctttagagattcacaaacactgggccttggatggtctaggtctcctaggctccagatccctgcaatgtggaccgaggatagcggaagttattggtgtgaagttgagacggtcacacactccataaaaaagaggtcactgcgaagtcaaattagagtacaacgggtccctgtgtctaatgtgaacttggagattcggcccacgggaggtcagctcattgagggcgagaacatggtcctaatctgtagtgtggctcagggctcgggaacagttactttttcctggcacaaggaaggacgggtcaggagcctcggcaggaagacacaacgcagtctgcttgctgagcttcatgtcctcactgtgaaggagtcagatgctgggagatactactgcgctgccgacaacgtacactccccgatcctcagcacatggattcgagtcactgtgaggattcccgtgagtcacccagtcctgaccttcagggcaccacgggcccacactgtcgttggcgatctcctcgaactgcactgtgagagtctgcggggcagccccccaatcctctacaggttctatcatgaggatgttacattgggcaatagctccgcccccagcgggggaggggcaagttttaatctgagcctgactgccgaacattcgggaaactactcatgtgacgccgacaacgggttaggagcacagcattctcatggagtgtccctgcgcgtgaccgtccccgtttccagacctgttttaaccttgcgggcaccgggcgcccaggcggtagttggtgatctgctagagctgcactgcgagtcacttaggggatcttttcccatcttatactggttctatcatgaggacgacaccctgggaaatatctctgctcacagcggcggaggagcttccttcaatctctctctgacgaccgagcattctggaaactactcttgcgaggccgacaacggcctaggcgcccagcattctaaagtggtgacactgaacgtgacagggacgagtcgtaatcggaccggactgaccgctgctggcataacgggactcgtcctgtcaatattagtcttggccgcagcggccgcattacttcactacgcccgagctagaagaaaaccgggggggctttctgccacgggcacatcctcccatagcccctccgagtgtcaggagccttcatcatctcgccctagccggattgacccgcaagagccaacacattcaaagccattagcccctatggagctggaacccatgtacagtaacgttaaccctggcgatagcaaccccatctactcccagatttggtccattcagcatacgaaggaaaacagcgctaactgtccaatgatgcatcaagaacacgaggaacttacggtgctatacagcgaactaaaaaaaacccacccggacgattctgcaggtgaggcctctagcagaggacgggcccatgaggaagatgatgaagaaaattacgaaaacgtcccacgagtgcttctggcctccgaccactag

SEQ ID NO: 42275 - DNA, 1548 bp, Artificial Sequence
  Description of Artificial Sequence: Synthetic coding sequence
atgctgctgtgggccagcctgctggccttcgcccccgtgtgcggccagtcggcagccgctcataagcctgtcatctccgttcatcctccatggacaacattctttaaaggcgagagggtgaccttgacctgtaacggcttccagttctacgcaaccgaaaagactacctggtatcatcgtcattactggggtgaaaagctcaccctgacgcccgggaacactttggaggtgagagagagtgggctgtacagatgccaagcacgcggctctcccagaagcaatcctgtgagactgcttttctcctcagattccctcatattgcaagctccttattccgtgttcgaaggcgatacactggtgttgcgctgtcaccggcgaaggaaggagaagctgactgctgtcaaatacacttggaacgggaatattctgtcgatctcaaataaaagttgggatctcctcatcccccaggccagctcaaataataacggcaactacagatgtatcgggtacggtgacgaaaatgacgtctttaggtcgaattttaaaatcatcaagattcaggagctgtttcctcaccccgaactgaaagctacagatagccagcccaccgaaggcaattccgtcaatctgagttgtgaaacacaactgccccccgagcgaagcgacacaccgttacattttaatttttttcgtgatggagaagtgatcctcagcgattggagtacttaccctgaactccagctgccgaccgtttggcgggagaactcgggatcatactggtgtggtgcggaaacggtccgcgggaacattcacaagcacagccctagcctgcagatccacgttcaacgtatccctgtgtcgggtgtactcctcgaaacccagccaagtggaggtcaggcggtggagggcgagatgttggtgttggtctgctcagtcgccgagggcacgggggatactacattttcatggcacagggaggatatgcaggagagtctggggaggaagactcagcgatctttaagggcggaattagagctgcccgccataaggcagagccacgccggaggatactactgcactgcagataacagctacgggccagtgcaaagcatggtccttaacgttaccgtgagggagacccctggcaaccgggatggacttgttgctgcaggcgcaacaggcggacttctctcagctttgcttctcgcggtggcactgctctttcattgctggcgtcgacggaaatcaggagtaggcttcttaggtgacgagacccggctgcccccggctcctgggcccggagagagctcccactcgatttgtccagctcaagttgagcttcagtctttatatgtagacgtccatcccaagaaaggggacctcgtttactccgaaatacaaaccacccagttgggtgaggaagaggaagcaaatacctctcgaacactcctcgaggacaaggacgtgagtgtggtatattcggaggtgaaaacacaacaccctgacaactccgccggaaaaatctcctccaaagacgaagaaagttag

SEQ ID NO: 42276 - DNA, 2934 bp, Artificial Sequence
  Description of Artificial Sequence: Synthetic coding sequence
atgctgctgtgggtgatcctgctggtgctggtgcccagccccggccagtttccccgcacccctaggcctatcatttttcttcagcccccatggacgacggtgttccagggagaacgggtcacgctgacatgcaagggctttcggttctacagcccccaaaagaccaaatggtaccatagatatctaggaaaagagatcctgagagaaacgcctgacaacatcctcgaagttcaggagtctggcgaatatcgatgtcaggcccagggcagccccctttccagccctgtgcatctggatttttcctcagcttcccttattctccaagcgcctctctctgtgtttgaaggtgacagtgttgtactgaggtgtagagcgaaagccgaggttactctgaacaataccatctacaaaaatgataatgtcctggcgttcctgaataagcggacagatttccatatccctcacgcctgtctgaaggacaacggagcttaccggtgcactggctacaaggagtcatgctgcccagtatcctccaatacggtgaagatccaggtgcaggagccatttaccagacccgtgctccgcgcgtcttcattccagcccatttctgggaaccctgtgaccttgacttgtgaaacacagctcagcctggaacggtctgatgtgcccctgagatttcggttctttagggacgaccagaccctcggactggggtggagcctatccccgaacttccaaatcacagccatgtggagcaaagattcggggttttactggtgtaaggcggctactatgccatacagcgtgataagcgatagcccacgatcttggattcaggtccaaattccagcctcgcatccggtactcacgctctctcctgaaaaagccctcaatttcgagggcacaaaagtgactctgcactgtgagactcaagaagattccctacgaaccttgtacaggttttaccacgaaggcgtccccctgagacacaagagcgttagatgtgagcgcggagccagcatctccttctctctcactaccgagaatagcggcaattactattgcactgcggacaacggcctcggggcaaagccctcgaaagcggtgagcctgtctgtaacagtgcctgttagtcatcccgtgctgaacctcagcagtcctgaagacctcatttttgagggagctaaggttacgctgcactgtgaagcacagcggggcagcctgccaatcctttatcagtttcaccacgaaggcgccgccctggaaaggagaagtgccaacagcgctggcggggtggcaatttctttctctcttaccgccgagcatagtggtaattactactgcacagcagacaatggcttcggacctcagaggtccaaggccgtttcactcagcgtcactgtccctgtgtcgcatcccgtgctgacattgagctcagctgaggctcttacctttgaaggagctaccgtgacacttcattgcgaagtgcagaggggctccccccagattctttaccagttctaccatgaggatatgcctctgtggtccagcagcaccccatctgtggggagagtttctttttcattcagtcttactgagggacactctgggaattactattgtacagccgataacggttttggcccacaacggagtgaagttgtgtcactcttcgttactgttcccgtctctcgacctatcctcactcttcgtgtaccacgcgcccaggccgtggttggcgacttgctggaactgcactgcgaagcaccacgaggttcaccgcctattttgtattggttctatcacgaggacgtgaccctgggttccagcagcgcgccaagcggcggagaggctagtttcaacctgtctctcaccgcagaacatagtggaaactactcctgtgaggccaacaacgggctggttgctcaacactcagacacgatctctctgagcgtgatcgtgccagtgtctaggccaattctgactttccgtgctcccagagctcaggcagtcgtgggcgatctgctggagctgcactgtgaggcattacgcggatccagtcctattctgtattggttttaccatgaagatgtcactttgggaaaaattagcgccccatccggcgggggcgcttcctttaacctgtctctgaccactgaacatagcggaatttactcatgcgaagctgataacgggttggaagcccagcgttccgaaatggtgaccttgaaggttgccgtacctgtgagcaggcctgtgctgacactccgcgctcctggcacgcatgcggcggttggggacctattggaactgcattgcgaagctctccggggctccccgctgatcctgtaccgattcttccacgaggatgtcactcttgggaatcgcagctccccctccggaggtgccagtctcaatctcagcctgacagctgaacacagtggaaattattcctgcgaggctgataatggtctcggcgcccagaggtctgaaacagtgaccctgtatattacgggacttacagcaaacaggagtgggccctttgctaccggcgtcgcaggaggtctgctctccattgccggcctcgcagcaggggctctccttctgtactgctggctctctcgaaaggccggcaggaagcctgcttcagatcccgcaaggagtcccagtgatagtgactcccaggagcctacatatcacaacgttcccgcatgggaagaacttcagccagtctatacaaatgccaacccaagaggggagaatgtagtctacagcgaagttcgcattattcaggaaaagaaaaaacatgccgttgcatctgatccacgtcacctccgcaataagggatctcctatcatctacagtgaggtcaaggtcgcctctacgccagtgtcaggaagcctctttttagccagctcagccccacatagatag

SEQ ID NO: 42277 - DNA, 2934 bp, Artificial Sequence
  Description of Artificial Sequence: Synthetic coding sequence
atgctgctgtgggtgatcctgctggtgctggcccccgtgagcggccaatttgccagaacaccgcggccgattatctttctgcagcctccatggactaccgtctttcagggagaacgagtgactctcacttgcaagggatttcgattttattcgccacagaaaaccaagtggtatcatcgctacttaggcaaggagattcttagagaaacacccgataacatccttgaggtacaggaatcaggggagtacagatgccaggctcaaggatctcccctctccagccccgttcacttggacttcagttcagctagtctgattctacaggcacctctctctgtgttcgaaggcgacagtgtagtgctcaggtgccgggccaaggctgaagtgaccctgaacaacacaatctacaaaaacgataatgtgctggcttttttaaacaagcgaactgacttccatattccacacgcatgtttgaaagacaatggcgcctatcgctgcaccggctataaagagagttgctgccctgtgagttccaacaccgtcaagatacaggtacaggagcccttcactagaccggtccttagagctagttcattccagccaatcagtggcaacccggttacactgacctgcgaaacacaactctcactagagcgctctgacgtgccactgcggtttaggttctttcgagacgatcagacactcggtcttggatggtccctcagccctaacttccagattacagcaatgtggagcaaggactccggattttactggtgtaaggcggctaccatgccgtactctgttatctccgattcgcccaggtcttggatccaagttcaaatccctgccagtcatcctgttctgactctcagtcctgagaaggcacttaacttcgagggcacaaaggttaccctgcattgcgagacccaggaggactcactgcggaccctttatagattctaccacgaaggggtgcccttgcgccataagtccgttagatgcgaaaggggcgcttctattagtttcagtttgaccaccgaaaacagcggcaactactactgcaccgccgataacggattgggagctaagccttcgaaagccgtcagtctcagtgtcaccgtccccgtgagccatccggtgctgaacctttcatcaccggaggatcttatctttgaaggtgccaaagtcaccttacattgtgaggctcaaagagggtccctgccaattctctatcagtttcaccatgaaggagcggcacttgaacggagatcagctaacagtgcaggcggtgtcgctatcagtttttctttaactgccgagcattcggggaattactactgtacagctgacaacggctttggacctcagcgctcaaaagccgtgtcactcagcgtaaccgtgccagtctcacaccctgttcttacgctgtcatcagctgaggcccttaccttcgagggagccactgtcacccttcattgtgaagttcagagggggtctccccagattctgtatcaattttatcacgaggacatgcccctgtggtcctctagtactccaagtgtgggccgcgttagtttttccttctccctcactgagggccactcaggcaattactactgcaccgcagacaatgggttcggaccccagagatctgaagtcgtgtctctgtttgtaacagtgcctgtctcccggccaattcttaccttacgggtccccagggcacaggccgtggtgggcgacttgctggagctgcactgcgaggcaccccgaggcagcccccccattctctactggttctaccatgaggatgttactcttggaagttcatcggcgccaagtggtggagaagcttccttcaacttgagcttgactgccgagcactccgggaattattcctgcgaggcgaataatgggctggtagcccagcacagcgacacaataagcctgtcagtcattgtcccagtgagtcggccaatcctaacttttcgggctccaagggcgcaggccgtagtgggagacctcctggagcttcactgtgaagccctgcgcggttcatcccctattctctattggttttaccacgaagacgtcaccctcggcaagatatcagcgccttccggcggaggcgcctcattcaatctctctctcacaacagagcacagtgggatatatagctgcgaggccgacaacgggttagaagctcagcggtctgagatggtcactctgaaggtggctgtgccggtgtcaaggccagtgctgacccttcgggctccaggaactcatgcggctgtgggcgacttgctggagttgcattgtgaggctcttagagggtctcccttgatactgtaccggtttttccacgaagacgtgaccctggggaataggtcgtcaccttctggcggggcaagcctaaacctgtcccttacagcggagcacagcggaaactacagttgcgaagccgataatgggttgggtgctcaaaggagcgagaccgtgaccttatacattacaggcttgacagccaacagatccggccccttcgccacaggcgtggccggcggcctgctgtcaattgctggactggcagccggcgccctgttgctgtattgctggctgtcccggaaggcagggagaaagcccgctagtgaccccgcccggtctccctcggattcagactcgcaggaacccacataccacaacgtgcccgcttgggaggaactccagcccgtgtacacgaacgctaatcccaggggcgaaaatgttgtctattcggaggttaggattatacaggagaagaaaaaacatgcagtggcctccgacccaagacacctcaggaacaaaggaagtcctataatctactcagaagttaaagtcgcctccacgcctgttagcggcagtctgtttctggccagtagcgctccgcacagatag

SEQ ID NO: 42278 - DNA, 375 bp, Artificial Sequence
  Description of Artificial Sequence: Synthetic coding sequence
atgctgctgtgggtgatcctgctggtgctggcccccgtgagcggccaatttgccagaacacctagaccgatcattttcctgcaacccccgtggacaacagtgttccagggggaaagagtcaccttgacttgcaaagggttcagattttacagtccacaaaagactaaatggtaccatcgctacttggggaaggagattcttcgcgagacaccggataacatactcgaagttcaggaatcgggcgaatatagatgtcaggcccaagggagccccctgtcctcccccgttcatttggatttctcctccgaaatgggctttccccacgcggcccaggccaatgtcgaactcctgggttctagcgatctgctgacatag

SEQ ID NO: 42279 - DNA, 1779 bp, Artificial Sequence
  Description of Artificial Sequence: Synthetic coding sequence
atgctgctgtgggtgatcctgctggtgctggcccccgtgagcggccagtttgcacggactccacgccctatcatcttcctgcagccaccctggaccaccgtgttccagggtgagagagtcacgcttacgtgtaaggggtttcgcttctattcaccccagaaaacaaagtggtaccatagatatctgggtaaggaaatcctgagggagacacctgataatatcctagaagtccaggagtcgggggagtacaggtgtcaggcccagggaagcccacttagtagcccggtgcacttggatttttcttctgcctccctgatccttcaagctccactgagcgtattcgagggtgactccgttgtgttgagatgtcgcgcgaaggcggaagttactttaaacaataccatctacaagaatgacaacgtcttggccttcctgaataagcggactgattttcacataccacatgcctgcctcaaagataacggggcctacaggtgcacgggatacaaggagtcatgttgtccggtcagttcaaatacagttaaaatccaggtacaggagccattcacacggcccgtgttgagagcatctagctttcaacccattagcggcaatccagtgacactcacttgcgagacgcaactcagccttgaaagaagtgatgtccccctccgctttcggttttttcgcgatgaccaaacgctgggcttagggtggagcttgtctccaaatttccagatcacagcaatgtggagcaaagactctggattttattggtgcaaggcggctacaatgccatattcagtaatttctgattcacctcgcagttggatccaagtacaaattccggcctcccacccagtactgactctgagcccagaaaaggctctgaactttgaaggcaccaaagttacactccattgtgagacacaagaagacagcctccgcaccctgtatcgtttttatcatgaaggcgtgcccctcagacataaaagtgtccggtgtgaacggggcgctagcatatcgttctccctaaccaccgagaacagcggaaactattactgcactgctgacaatggcctcggcgctaaaccttctaaggcggtgtccctctccgtgacggtgcccgtgtcccaccccgtgctcaacctgtcttcgcctgaagatttgatctttgagggggcaaaggtgacccttcactgcgaagcccaaagaggttctttgccaatcctttaccagttccaccatgagggcgccgctcttgagcggaggtctgctaactccgctggcggggtggcgataagcttttcactgaccgcagagcattccggcaattattattgcacagcagacaacggattcggcccccaacgatctaaggctgttagcctgtccgttacagtccccgtctcacaccccgtcctgaccctctctagcgccgaggcacttacatttgagggagctactgttaccttgcactgtgaggtccagagggggtctccccaaatactttatcagttttaccacgaggacatgcccctgtggagcagctctactccttcagtgggacgagtcagtttctcgttttctttgacagaaggacattctggaaattattattgtactgctgataatggatttgggcctcagcggagcgaggtcgtgagcctctttgtcacaggaaagtgctgggtcctcgcaagccacccaccacttgcggaattcagcctcacccactctttcaagaacctttttgccctgtcctcattcctgccctag

SEQ ID NO: 42280 - DNA, 2280 bp, Artificial Sequence
  Description of Artificial Sequence: Synthetic coding sequence
atgctgctgtgggtgatcctgctggtgctggcccccgtgagcggccaatttgcaagaactccacgccccattatcttcctgcagccaccttggaccaccgtgtttcaaggtgagagagtgactttaacgtgcaaaggattcaggttttacagcccccaaaaaaccaagtggtaccatcgttatctgggcaaagaaattttgcgagagacccccgataatatcctggaagtgcaggaatcaggcgagtatagatgtcaggcgcagggcagtccattgtcctccccagtgcatctagatttctcttcagcaagtctgatcctccaggccccactgtcagttttcgagggtgacagcgtggtattgaggtgcagagccaaggcagaggtcacacttaataatacaatctacaaaaacgataacgtgctcgcattcctgaataagcggacagactttcacattccccacgcctgcctgaaggacaacggcgcctaccgctgcacaggttataaggagtcttgttgcccagtgtcctcaaataccgtcaaaatccaggtgcaggaaccttttacccgtcccgtattacgcgccagttcatttcagcctatatctgggaatcccgtgaccctgacatgcgagacccagttgtcacttgaaaggtcagacgttcctctcaggttcaggtttttcagggatgatcagacgctgggtttgggatggtcactgagtcccaacttccagatcacagcaatgtggtccaaagactcaggattttactggtgtaaggctgctaccatgccatatagcgtgatttccgattcgccccgttcctggatccaggttcagatcccggcctctcatcctgttctcactctgagcccagagaaggctctgaatttcgaaggcaccaaagtgacattacattgtgagacccaggaggattcattacgcaccctgtatcggttttaccatgagggagtgcccttgcgccacaagtcagtccggtgcgaaaggggcgcatcgatttctttcagcctcacgaccgagaatagcggcaattattactgcactgctgacaatgggctcggggccaagccctccaaggctgtgagtttaagtgttacggttccagtgtcgcacccagtccttaacctcagtagtccagaggatttgatttttgaaggcgccaaggtgacccttcactgcgaagcccaaagaggctctctccccatcctgtatcagtttcaccacgaaggggccgccctggagcgccgtagtgccaattcagctgggggagtggcaattagtttcagcctcacagccgagcactcgggtaattattactgcactgccgataacggattcggcccccagaggtctaaggccgtgagcctgtccgtgactgtgcccgtgtctcacccagtcctgactctcagctccgccgaagcgcttacgtttgagggcgccacagtcaccttacattgtgaggttcagaggggcagcccccagattctgtatcagttttaccacgaggatatgcccttgtggagcagttctaccccctccgtgggtagagtatccttttctttctccctgaccgaagggcacagcggtaattattattgtactgccgacaacggcttcgggccacaacgcagtgaagtagtcagcttgtttgtcacagtacccgtgtcacggcccatcctgactttgcgcgtacctcgcgcgcaggccgtagtgggtgacctgttagagctgcactgtgaggcgccacgcgggtctcctcccatattatattggttctatcatgaggatgtgaccctcggcagctcctctgctcccagcgggggggaggcttcatttaacctctcactgactgctgaacactctggaaactactcttgtgaggcaaacaacggtttggtggcacagcactctgacacaattagcctgagcgtcatcgtgcctgtgtctcggcccatactgaccttcagagcccccagagcccaagccgtagttggcgatctgcttgaactgcattgtgaagccttgagaggatcgtccccaattctctactggttctatcacgaggatgtgaccctgggtaaaatcagcgcccccagcgggggcggggcatctttcaacctctctctaactaccgaacatagcgggatctactcatgtgaagccgataacggtctggaggcccagagaagcgagatggtgacgctgaaagtggccggagagtgggctctacctacttcatctacctctgagaactag

SEQ ID NO: 42281 - DNA, 2025 bp, Artificial Sequence
  Description of Artificial Sequence: Synthetic coding sequence
atgctgctgtgggtgatcctgctggtgctggcccccgtgagcggccaattcgcgtcgctcatccttcaggctcctctgtcagtttttgagggagactctgtcgtgctgcggtgtcgcgctaaggctgaagtgacactcaacaacaccatctacaagaacgacaatgtgttggccttcctgaataagaggaccgacttccacatcccacacgcctgtctgaaggataacggagcttaccgctgcacagggtataaggagtcatgctgccctgttagctccaacaccgtcaaaatccaggtgcaggagccgtttacccggccagtactgagagccagctcctttcagccgatttctgggaacccagtgactttgacatgcgagacccagctgtctctggaaagatccgatgttccccttagatttcgctttttcagggacgatcagacgctggggctcgggtggtcccttagccccaattttcagatcacagccatgtggagtaaagatagcgggttttattggtgcaaggcggccacaatgccctattctgttattagcgatagcccgcgcagctggatccaagtacagatccctgctagccatccggtgctaactctttctcccgagaaagctttgaattttgaaggaacgaaggtgaccctccactgcgagactcaagaagattctctgagaactctttaccgtttttaccacgaaggagtgccactcagacataagtcagtcaggtgtgagcggggggctagcatttccttctccttgaccacagaaaatagcggaaactactattgcaccgccgacaacgggctcggtgcgaagcccagcaaggctgtgtctctgagcgtcactgttcccgtctctcatcccgttctaaacctgtcttctcccgaggacctgatttttgagggagctaaagtgaccctgcactgcgaggcccagaggggaagtctccccatcctctatcagtttcaccacgaaggggccgctctcgaaagacgatccgccaactccgcaggaggggtggcaataagctttagcctgactgctgaacattccggcaattactactgtacggcggacaacggcttcggtccacaaaggtccaaggcagtcagcttgtctgtgacggtgccggtgtctcaccctgtacttaccctcagcagcgccgaggccctgacctttgaaggcgccaccgttacccttcattgtgaagtgcagagaggctctccacagatcctgtaccagttttaccatgaggatatgcccctgtggtcttcctccacccctagtgtaggtcgggtcagctttagctttagcctcactgaggggcactctggaaattattattgcactgcagacaatggcttcggacctcagcgctcagaggtagtcagtttatttgtcactgtccctgtatcccggcccatcctaaccctaagagttccacgggctcaagctgtggtcggagacctcctcgagctgcattgtgaagcccccaggggtagccctcctatcctctactggttttaccatgaggacgtgaccctcgggtcctcctcagcaccttccgggggtgaggcaagtttcaacctgtccctgacagcagagcactcgggaaactactcttgtgaggcaaataatgggttggtcgcccagcatagcgatacaatttctttaagtgtaatcgtgccagtgtcgagacctatcctgacttttcgagctcctcgagcccaggctgttgttggggacctgctggaactacactgtgaggccctgagaggttcttctccaatcttgtattggttctaccacgaagatgtaactctaggaaaaatttctgcccctagcggagggggcgcaagcttcaatctgtccctgacaactgagcatagcgggatttactcttgtgaggcagacaacggactcgaagcccagaggtccgagatggtgaccttaaaggtagccggagagtgggccctgccaacctctagtacctccgaaaactag

SEQ ID NO: 42282 - DNA, 1194 bp, Artificial Sequence
  Description of Artificial Sequence: Synthetic coding sequence
atgctgctgtggaccgccgtgctgctgttcgtgccctgcgtgggcaaaactgtttggttatacctccaagcctggccaaacccagtttttgagggagacgcactcacactccgctgtcagggatggaagaacacacctttatcacaggtgaaattctaccgagatggtaaatttctgcacttctctaaagaaaatcagacactctccatgggagcggccacagtgcagagccgggggcaatattcatgtagcggacaggtgatgtacattcctcaaactttcacccagacctctgagaccgcaatggttcaggtgcaggaactattccccccgcctgtgctgagcgctatcccaagcccggagccccgtgagggcagcctggtgacactcagatgtcaaactaagttgcatcctctcaggagtgctctgcggctgctgttcagtttccacaaggatggtcacacgcttcaggaccgcggccctcacccagagctatgcattcccggtgctaaggaaggtgactccggtttatactggtgtgaggttgctcctgagggaggtcaagtgcaaaaacagtctccccagctcgaggttagggtgcaggctccagtatcccgccccgtgttgactcttcatcacggacctgctgaccccgccgtgggtgatatggttcagctcctctgcgaagctcaacggggcagcccacctattctgtacagcttctatttagatgagaagatcgttggtaatcactcggctccctgcggtgggacgactagtctgctctttcccgtaaagagtgagcaggatgccggcaattatagttgcgaggcagaaaacagtgtctcaagggaacgtagcgagcctaagaaactaagccttaaggggagccaggtgctctttaccccagcctcgaattggctggtgccgtggctccccgcctctctgttgggcctcatggttattgccgctgcattactagtttacgtgaggtcctggaggaaggcaggcccactgccctcacagatacctcctaccgcccctggcggggaacaatgtcctctgtacgcaaacgtgcatcaccagaagggcaaggatgaaggagtggtgtactctgtggtgcataggacatccaagcgcagtgagggacagttttaccacctgtgtgggggcgagatgcccgccgcccaatag

SEQ ID NO: 42283 - DNA, 1305 bp, Artificial Sequence
  Description of Artificial Sequence: Synthetic coding sequence
atgctgctgtggaccgccgtgctgctgttcgtgccctgcgtgggcaaaacagtttggctctacttacaggcttggcctaatcctgtgttcgagggagatgctctgactctcagatgtcagggatggaaaaacacaccactaagtcaggtcaagttctaccgcgatggcaagttcctccactttagcaaagagaaccagacactttcaatgggcgccgcgacagtgcagtcacggggccagtattcttgctctggacaggtgatgtatattccccagacattcacccaaacaagtgagaccgccatggtacaggtgcaggagctgtttcctcccccagtcctgtctgccataccctctcccgagcctcgggaaggctccctcgtgacgttgcgatgtcagactaaactccatccactgagatctgccttgcggctgttattcagcttccacaaggatgggcataccctacaggaccgcggaccacatccagagttgtgcatcccaggggcaaaggagggggatagtggcctgtactggtgcgaggtggcgcctgaaggaggacaagtacagaaacaatccccccagttagaggtgcgggtgcaagcccccgtaagccgcccggtcttaactcttcaccacggaccagccgatcctgcagtcggagatatggtgcagctattatgcgaggcccagcgcggctcaccgcccatcctgtacagtttttatctcgacgagaaaatcgtggggaatcattcagctccctgtggggggactacctccctcctcttcccagtcaagagcgagcaggacgccggaaactattcctgtgaggccgaaaactccgtcagccgtgagcgctctgagccaaagaagctgagtctgaaggggagtcaggtcctatttactccggcttccaactggctggttccctggctaccagccagcctgcttgggctcatggttattgcggccgccctgctggtctatgtccgtagttggcgcaaggccggccctctgccatcccaaattcccccgaccgcacctgggggcgagcaatgccctctgtacgccaacgtgcaccatcagaagggaaaggacgagggagtagtgtacagtgttgtgcatagaacctccaagagatcggaagccaggtctgccgaattcactgtgggaaggaaagattccagcatcatttgcgcggaggtacggtgcctgcagccctctgaagtgagcagtacggaggtgaacatgcggtcccggacactgcaggagcctcttagcgattgcgaagaagttctttgttag

SEQ ID NO: 42284 - DNA, 936 bp, Artificial Sequence
  Description of Artificial Sequence: Synthetic coding sequence
atgctgctgtggaccgccgtgctgctgttcgtgccctgcgtgggcaaaacagtgtggctgtatctgcaggcctggcccaatcctgtgttcgaaggagatgccctcacgctgaggtgccagggctggaagaacacacccctctcccaggtcaaattttacagagatggaaagttcttgcatttttcaaaggagaatcaaactctttccatgggcgcagcaactgtccaaagtagaggccaatactcctgctcaggccaggttatgtacatacctcagacatttacacagacatcagagacagccatggttcaggttcaggcccctgtgtcacgacccgtactgacactacatcatggacccgcggacccggcagtcggcgacatggtgcagctgctatgtgaggcacaaagggggagtccacccatcctgtacagcttctaccttgacgagaaaatcgtgggtaaccacagcgccccctgtggcggaactaccagcctactcttccccgtgaagagcgagcaagacgccggcaactactcctgcgaggcggagaatagcgttagccgcgaacgaagcgaacccaagaagctgtcattgaagggcagccaggtactgtttacgccggctagcaactggctggtaccgtggttgcccgcctccttactgggcctgatggtgatagcagccgccctgttggtgtatgttaggtcttggagaaaggctggtccgttgccaagccagattcccccgaccgctccaggcggcgagcaatgtccgctgtacgcaaacgtgcatcatcagaagggaaaagacgagggcgtggtatactccgtcgtgcacaggactagtaagcggtcagaagcaaggagcgctgaatttacagttgggcggaagttctaccacctgtgcggtggggagatgcccgcggctcagtag

SEQ ID NO: 42285 - DNA, 1581 bp, Artificial Sequence
  Description of Artificial Sequence: Synthetic coding sequence
atggtgaacgagggccccaaccaggaggagagcgacgacacccccgtgcctgagtcagcgctgcaagccgacccctccgttagcgtccatccgagcgtttctgtccacccctcagtctctatcaacccctctgtctccgtccacccttctagcagcgcacacccgtccgcattagcacagccctcggggctggctcacccgtcaagtagtggaccagaggacctaagcgtgatcaaggtgtcaagacgccgctgggctgtcgtgttggtcttcagctgctatagcatgtgtaacagcttccagtggattcagtatggatctattaacaatatattcatgcacttttatggggttagtgccttcgccattgattggttgtcgatgtgctacatgctgacctatataccgctgctactgccagtggcctggctgctggaaaagttcggcctcagaacgattgctctgactgggagcgctctgaattgcctcggagcctgggtcaaattgggtagtctaaaaccacacttgttcccagtcactgtagtaggccaactgatctgtagcgtggctcaggtgttcatcctggggatgccttcacggattgcaagcgtttggttcggcgcgaacgaggtgagtaccgcatgttctgtggcagtgttcggaaaccagctaggaatcgcgatcggctttctggttcccccggtgcttgtcccaaacatagaggatagagacgagctggcgtatcatatctcaattatgttttacattatcggaggagtggcaactttgctgctgatcctagttattattgtctttaaggaaaaacccaagtaccctccaagcagagcgcagtccctgtcctatgctctcacttcccctgatgctagttatcttggctcaattgcccgcctgttcaagaatcttaattttgtactgttggtgatcacctacggactgaacgctggagcgttctacgcactgtcgaccttactgaatcgtatggttatttggcactaccctggggaagaggtgaacgccgggcgaatcggcttgacaattgtgattgccggaatgttgggcgctgtgatctctggcatctggctggatcggtcaaagacctacaaggaaaccacccttgtcgtgtatataatgaccctggtcggtatggtggtgtatacctttactctcaatctgggacatctgtgggtggtttttattactgctggcacaatgggcttcttcatgaccggatacctgccattgggtttcgaattcgctgttgagcttacctaccccgagagcgagggcatctcgtctggattgctgaacatctcggcccaggtgttcggcattatattcactatctctcaggggcagataatcgacaattacgggaccaaacctggcaacatattcctgtgcgtgttcctgacattgggtgccgcacttacagccttcatcaaagctgatcttaggagacagaaggccaacaaagagactctcgagaataagctccaggaggaggaggaggagagcaatacgtccaaagtcccaacagccgtgtcagaagaccatctttag

SEQ ID NO: 42286 - DNA, 966 bp, Artificial Sequence
  Description of Artificial Sequence: Synthetic coding sequence
atgagcgccgacaacagcagcaccatctgcgtgtgccggagcgtgcgtcaggagttagggattgccattgggtttttagtgccccccgtgcttgtgccgaatatcgaggaccgggacgagctcgcttaccatattagtatcatgttttacataatcgggggagtcgctacgctgctcctgatactggtgattatagtctttaaagagaaacctaagtatcctcccagtagagcccaaagcctgagttacgcattgactagccctgatgccagttacctgggatcaatcgctagattgttcaagaatctgaattttgttttactcgtgattacatacggcctgaacgctggcgcgttctatgcccttagcacactgctgaacagaatggtgatttggcactacccaggcgaagaggtgaatgctgggaggatcggcctgaccatagtcatcgccggaatgctcggggccgtcatctctggcatctggctcgatcgctccaagacctataaggagacaaccctcgtggtatacataatgaccctggtgggcatggttgtgtataccttcaccctgaatctaggtcacctgtgggtggttttcattaccgctggtaccatgggtttctttatgaccgggtatttgccactgggcttcgagtttgccgttgagttgacatacccagaaagcgaggggattagttcgggcctgttgaatatcagcgcacaagtctttgggatcatctttacaatttcacaaggacagattatcgataactatggaacaaaacctggcaacatcttcctgtgcgtttttctaacgttgggggccgcccttacagccttcataaaagcagatttgaggagacagaaagccaataaggagacactcgagaataagctgcaagaagaggaagaggaaagcaataccagtaaagtccccacggcagtgtccgaagatcacttatag

SEQ ID NO: 42287 - DNA, 5574 bp, Artificial Sequence
  Description of Artificial Sequence: Synthetic coding sequence
atgttcggcctgaaggtgaagaagaagcggaacaaggccgagaagggactgatcttagccaataaagctgctaaggactcccaaggggatacagaggcgctgcaagaagagccatcacatcaggaaggtccccgaggagatcttgttcatgacgatgctagtatctttcccgtacccagcgcttctccaaaaagaaggagtaagctgctgaccaaaatccatgacggggaagtccgctcacaaaactatcagatcgcaattacaatcactgaggctcgccaactagtaggagagaatatcgatcccgtggtgaccattgagataggagatgaaaaaaaacaaagcacagtcaaagaaggcacgaacagtccgttttataacgagtatttcgttttcgactttattggaccgcaggtgcacctgttcgataagattataaagatatctgtcttccatcataagttaatcggttctgtcctcattggcagctttaaagtagacctaggtacagtgtacaatcagcccggtcaccaattctgtaataaatgggcccttctgactgaccccggcgacatccggactggaactaagggctaccttaaatgcgacatttcggtgatggggaaaggtgatgtcctcaaaacctctcccaagacctctgataccgaggaacctattgaaaagaacttattgatcccaaacggctttccgctggagcggccttgggcccggttttatgtgcgtctttacaaggcagagggccttccaaaaatgaatagttcaatcatggccaatgtgactaaagccttcgtaggagattccaaagatctcgtggatccctttgtagaggtcagctttgccggccaaatgggaaggacaactgttcagaaaaactgtgcagacccggtatggcacgagcaggtgattttcaaggagatgtttccccctctctgcaggagggtcaaaatccaggtgtgggatgaggggtctatgaatgacgtcgccctggcaacacacttcatagatctaaaaaagatttccaatgagcaggatggtgataaaggatttctccctactttcgggcctgcttggatcaatctttacggttctcctcgaaatcattccctcatggacgactatcaggagatgaatgaagggttcggggaaggcgtttctttccggggacgcattcttgtggagatagctgttgagattctaagcggcagggctcaggagagcaagttttctaaggcactcaaagagttaaagctcccatcaaaagacaaagactccaagtccagcaaagggaaggataaagcggataagaccgaagatggtaagtcccagcaagcttcaaacaagactaattccaccgaagtcgaggtggaaagtttcgacgtgccaccggagatcgtccctgaaaagaacgaggagtttttactcttcggcgcgttttttgaagcaacaatgatcgaccgcaagatcggcgacaaacctatatcatttgaagtctcgatcggaaattttggcaacttaatcgacgggggatcccaccatgggagcaaaaaaagcgccgaatctgctgaagaagatctgctcccactgctgcacgagggacagggagacgtggctcatgacgtgcctatccctatggcctctaccactcaccccgagaagccccttgtgactgagggaaatcgtaactataattacctacctttcgaggccaaaaaaccttgcgtctactttatctctagctggggcgaccaaactttcaggcttcattggagtaatatgctcgaaaagatggccgattttttagaagagagcatcgaagaagttcgagagctgatcaagatttctcaggaggcacctgaagagaaaatgaaaaccgtcttgtccgattttattagccgcagcagcgcattcatttccgaggctgagaagaaaccgaaaatgcttaaccagacgaccttagataaaaaacgcctgacactctgctggcaggagctggaggctatgtgtaaagaagcaaagggaatcatccaacagcagaagaagaagctgtctgtcgatgaaatgatccacgaagcccagaactttgtggaaaagatcagatttctggtggatgagccacaacacaccattcctgacgtgttcatatggatgctcagcaataatagacgggtggcttacgcacgcattgcgtcgaaggatctcctgtattctcccgtggcgggccaaatgggaaagcactgcgggaaaattaagacacacttcttgaaacctccaggcaagcgccctgcaggatggtctgtgcaggcgaaggtagacgtctatctttggctgggctcaatcaagcatgccagcgccatcttagacaatctgcccgtgggttatgaagctgagatgtctagcaaaggtgcagggaccaaccatccacctagtaaccttttgtaccaggagcaacatgtgttccagcttagagcacacatgtaccaggcccgaggcctgatcgccgcagatagtaatggcctatctgaccccttcgctaaagtgacctttctgtcccactgccagacaacaaagatcatatctcagacgctcagtcccacctggaaccagatgctgctgttcaacgatctggtgctgcacggcgatgtcaaagagctggccgagagtccacccctggtcgtagtggaactctacgacagcgatgccgtgggcaagccggagtatttaggagccacggttgctgcgcctgttgtcaagctggctgatcaagattacgaacctccacggctatgctatcatcctatcttctgtggtaacctgtcaggaggcgatctgcttgccgtctttgagctcttgcaagtgccaccatccgggttgcaaggcctgcctcctgtggagcctcctgacatcacacagatttatcccgttcccgccaacatccggccagttctctctaagtaccgtgtggaagttttgttctggggagtacgcgagatgaagaaagttcagctcttatctgtagaccggccccaggcccttattgaatgcggtggtcagggagtcaaatcttgcgttatccaatcttataaaaataaccctaatttctccatccaggccgacgccttcgaagtcgagcttcccgagaacgaactattgcacccaccccttagtatctgcgtggtagactggcgtgcgtttggccggagtactctggtcggaacatacacaattaattacctaaagcagtttttgtgtaagctgagagagcctctggcgccgatcacgcaagtggatggcacgcagccagggcacgacatctctgacagcctaacagccaccgagtcctccggcgcgcattcctcatcccaggaccctcccgcggatcatatctacgtagatgtggagcccccccctacagtggtgcccgactcggcgcaggcgcagcccgcaatcttagtcgacgtccccgatagtagtcccatgctggaacctgaacacactccggtggctcaggagcctccaaaggatggcaaacctaaggacccaagaaagccttctcgccggtctactaaacggagaaaaaggaccatagccgacgaaagcgctgaaaacgtcatagattggtggagtaaatactacgcgtctcttaaaaaagcccagaaagcgaaagagcgaaatccaaaggggaaaaagggcaacacagaggctaagccggatgaggtggtggtagacattgaggatggtcctaagaagaaaaaggataagatgttgaaaaaaaagcccaaggatgatgggatcccaaacctcgcaatccttcagatttatgatggagatctggagtctgaatttaataattttgaagattgggtgaagactttcgagctgttcagggggaaaagtaccgaggacgatcatgggctcgacggtgatagggtgatcggcaaattcaaaggaagcttttgtatctataagagtccacaggacagcagctccgaagattcaggacagctaagaatacaacagggcatacctccaaatcatcccgtgacagtattgatccgtgtgtacattgtggccgcttttaacctttccccagccgaccctgatggtaagtcagacccttacattgtaatcaagctcgggaagactgaaatcaaggaccgcgataagtacattccaaagcaactgaatcctgtttttgggaggtccttcgaaatccaagcgactttccctaaagagtctcttttgagtattttgatctacgatcacgatatgatcggaacagatgacctcattggtgaaaccaaaatagatctggagaataggttttactcgaaacatcgcgccatctgcggcctgcagagccagtacgaaatcgaaggttataatgcttggcgtgatacctcaaagcccaccgaaatactgacgaagctgtgcaaggataacaagctggacggcccatacttccaccctgggaagatccaaatcggaaaccaggtgttctccggaaaaaccatttttactgaggaagacacggatgaaacggtggagtcctatgaacacctcgctctgaaggtgttgcacagttgggaggacatccctgaagtggggtgccggctagttcctgagcacattgaaaccagaccactgtaccataaggacaaacccgggatggagcaggggagattgcagatgtgggtggatatgtttcctaaggacatgccacagccggggccaccagtcgacatttcaccacgaagacctaaaggttacgaacttagagtcaccatctggaacactgaggatgtcatcttggaagacgagaacatatttacaggccaaaagtcgagtgatatctacgtcaagggttggcttaagggactggaggacgacaaacaagaaacagacgtgcactataattccctgactggggaaggaaatttcaactggaggttcttattccctttccagtatcttcctgccgagaaacagatggtcatcactaaaagagagaatatcttctcactcgaaaagatggagtgcaagactcccgctgtcttggtccttcaggtgtgggacttcgaaaggctgtcctcagacgatttcctggggacgctggagatgaacttgaattcctttccaagagctgcaaagtctgcaaaggcatgtgacctggccaagttcgaaaacgcaagcgaagaaacaaagatctccatcttccagcagaaacgagtcagggggtggtggcccttttcaaagtccaaggaactgacgggcaaagtggaagctgaatttcatctagttacagccgaagaggccgagaagaaccccgtgggtaaggccagaaaagaaccggagcccctagccaagcctaatagaccggacacaagctttagctggttcatgtcaccattcaagtgtctttactatctaatctggaagaactacaaaaagtacattattatcgcttttatcttgatcatcctgatcatcttcctggtgctttttatttacacactcccaggtgctatcagccgccggattgtcgtcggctcgtag

SEQ ID NO: 42288 - DNA, 5574 bp, Artificial Sequence
  Description of Artificial Sequence: Synthetic coding sequence
atgttcggcctgaaggtgaagaagaagcggaacaaggccgagaagggacttatcctggcaaacaaagctgcaaaagatagccaaggagacactgaggctcttcaggaggagccatctcaccaagaaggacccaggggggacctcgtccatgacgacgctagcatttttccagtcccgagtgctagtcccaagcgccgctctaagttgctgaccaaaatccacgatggtgaggtacgctcccagaactatcagatcgccatcaccattacagaggctcgacaattggtgggagaaaacatagacccagtggtgacaatcgaaattggagacgaaaagaagcagtctactgtgaaggagggcacgaacagccccttctacaacgaatacttcgtctttgattttatcgggcctcaggtacatttatttgataaaatcatcaaaatcagcgtgtttcaccacaagctaatcggaagcgtgttgatcgggtcatttaaagtagatctcgggactgtctataaccagcccggccatcagttctgcaataaatgggccctgctgaccgatcctggcgatatacgcacgggaactaaggggtacctgaagtgtgatatttccgtgatggggaaaggcgacgttctaaaaaccagtcctaaaacttccgatacagaggaacccatcgagaaaaacctgcttattcccaatgggttccctctggaacggccttgggctcggttttatgtgaggctctataaggccgagggccttccgaagatgaactcctccatcatggcaaatgtgaccaaagctttcgttggggacagtaaagatctggtggatccattcgtcgaggtttcttttgccggccaaatgggcagaacaactgttcagaaaaattgtgccgatccagtttggcatgaacaggttatcttcaaagaaatgtttcctccactttgtcggagggtcaagatacaagtgtgggatgagggatctatgaatgatgtcgccctggcaacccactttatcgatctaaaaaagatttctaacgaacaggatggcgataagggatttttgcctaccttcggtcctgcctggattaacctctacggcagccccagaaatcacagcctgatggacgactatcaggaaatgaacgagggtttcggagaaggagtatcatttcgaggccggattttagtcgagatcgccgtagagattctctcaggccgggcccaggagtcaaaattcagcaaagctttgaaagagcttaaactcccctcaaaagataaggactccaaatctagtaagggaaaggacaaggcggacaaaactgaagacgggaaatcccagcaggcttccaataagacaaattccaccgaagttgaagttgagtcatttgacgttccccccgaaatcgttccagagaagaatgaagaatttttattgttcggagcattttttgaagccactatgatcgaccgcaaaatcggcgataaacccatttcgttcgaagttagcattgggaatttcggcaaccttattgatggggggagccatcacggctccaagaaaagtgctgaatctgccgaggaggatctattgccattactgcatgagggccaaggcgacgtagcacacgatgttcctatcccaatggcaagcacaacccacccggagaaacccctggtcactgaagggaatcgcaactacaattatctccccttcgaagctaagaagccttgcgtctactttatttcaagctggggcgaccagacctttcgcctgcactggtcaaacatgttggaaaaaatggccgacttcttagaagagagtatcgaggaggttcgagagctgattaagatctcccaggaggctccagaagagaagatgaaaactgtcctctctgattttatctctaggtccagcgccttcatctccgaggctgagaaaaaaccaaaaatgctcaaccagaccaccctcgataagaagaggctgaccctctgttggcaggagctggaagccatgtgcaaggaggctaaaggcatcatacagcagcaaaagaagaaacttagcgttgacgaaatgatccacgaagcccagaactttgtggaaaaaatcaggtttctggtggatgagccacagcatacaataccagatgtgttcatctggatgctctctaataacaggcgcgtggcctatgctcggattgcatcaaaagatttactatactctccggtggcgggacagatgggaaaacactgcggtaagattaagacccacttcctgaagccacccggaaagagaccggcgggctggagtgtgcaggctaaggttgacgtctatctgtggttaggaagcattaagcacgctagcgctatcttggataacctgcccgtaggttatgaagcagagatgagcagtaagggcgcgggaacgaaccatcctcccagcaatttactatatcaggagcagcatgttttccaacttagagcccatatgtaccaggccagagggctaattgccgccgacagcaacggcctttcagatcctttcgctaaggtgactttcctgtcccattgccagacgaccaagatcatcagtcagactctctcaccaacatggaatcagatgctgctttttaacgatttagtactacatggagacgtgaaggaactggctgagagtcctccgctcgtcgttgtggaactgtacgactcggatgccgtgggaaagcccgagtacctgggcgccacagtggccgcaccagtcgtcaagctggccgatcaggactatgaaccccctagattgtgctatcacccaattttttgcggtaatctctctgggggggatctgctcgcagttttcgaactgctccaagttccgccaagcggtttgcaaggtctccctcccgtcgaaccaccagacattactcagatttacccagtgcccgcgaacattcgacctgtgttgagcaaatatcgggtggaagtactgttttggggagtccgggagatgaagaaagtccagcttctcagcgtcgaccggcctcaagcactgatcgagtgtggtggccagggggtgaagagttgcgtgatccaatcttacaagaataatccaaacttcagcatccaagccgatgccttcgaggtcgaattgccagaaaatgaactgctacacccacccctgtccatctgcgtggttgattggagggcctttggaagatcaacactggtcgggacatacaccatcaactatctaaagcaattcctgtgtaagctccgggagccactcgcaccaataacccaagtggatgggacgcagccaggacacgatatttctgattcccttaccgcaactgaatcctcaggcgcgcacagcagcagccaggatccccccgctgaccacatctacgtggacgtcgagcctccccccaccgtagttccggacagcgcccaggctcagcccgccatccttgtggacgtccccgatagctctcccatgttagaaccagaacatactccagtcgcacaggaacctcctaaggacggtaagcctaaggacccacggaagccatctaggaggagcacaaagcggcgtaaaaggaccatcgccgacgagtctgctgagaatgtgatcgactggtggagtaagtactacgcctcgttgaagaaggcacagaaagcaaaagagcggaatcctaaaggtaaaaaggggaacactgaagcaaagccagacgaagtcgtggtggatatcgaggatggacctaaaaagaagaaagacaaaatgcttaaaaaaaagcctaaagatgatggaattcccaatctggctatattgcagatctatgatggggatctggaaagcgagtttaataattttgaagactgggttaagacatttgaactgtttcggggaaaatccacggaggacgaccacggtcttgacggtgaccgagtgataggaaagtttaagggatcattttgcatttataagagcccacaggactcttcaagcgaagacagcggccaactcagaatccagcaggggataccaccaaaccatccagtgaccgtcctgatcagagtgtacattgtagcagctttcaatctgagcccggcggaccctgacggaaaatcagacccttatattgtaataaaactgggtaagacagagattaaggatcgggataaatacatacctaagcagctcaacccagtctttgggagatcatttgagattcaggctacgtttccgaaagagagcttgctgtctatcttgatatacgatcatgacatgatcgggacagatgatctaattggcgagacaaagattgaccttgagaaccgtttctactcgaagcacagagcaatctgtggactccagtcccagtacgagatcgaaggatacaatgcctggcgagataccagtaaacccacggaaatcctgaccaagctgtgcaaggacaataagttagatgggccttacttccatccagggaagattcagattgggaaccaggtttttagtggcaagactatattcactgaagaagacaccgacgagaccgtggaatcatatgaacacctggccctgaaggttctgcacagctgggaggacatcccagaggttggctgcaggttggtgcctgagcacatcgagactcggcctctttaccacaaggacaagcctgggatggaacaggggaggctgcagatgtgggtcgatatgtttccgaaagatatgccccagcctgggccgcctgtcgatataagtccccgacgtccaaaaggctacgagctccgggtcaccatttggaataccgaagacgtcatcttggaggatgagaatatcttcactggacagaagagtagtgacatttacgtgaaggggtggctgaaaggtctggaggatgataaacaagagacagacgttcactacaactctctaactggcgagggaaatttcaattggcggttcctatttcctttccaatacttacccgccgaaaaacagatggtaattacgaaacgagagaacatattctcccttgagaaaatggagtgcaagactccggcagtccttgtgttgcaagtgtgggatttcgagcgactgtccagcgatgatttcctgggaactttggagatgaacttaaacagcttcccaagagccgctaagagcgctaaggcctgtgacttggcaaagttcgagaatgcctccgaagagaccaagattagtatcttccagcagaaaagagttcgcggctggtggccattttctaagagtaaggaactgactggtaaagtggaggcagaatttcacttagtcactgctgaagaagcggagaagaatccagttggaaaagctcgaaaggaacctgagccactggcaaagcctaacaggcccgacacatcattcagctggttcatgtcaccctttaaatgcctgtattacctaatttggaaaaattacaagaagtatatcattatagcctttatcctgatcatcttaattattttcctggtgctgtttatctacaccctccccggtgctatctcccgcaggatcgtagttggaagttag

SEQ ID NO: 42289 - DNA, 189 bp, Artificial Sequence
  Description of Artificial Sequence: Synthetic coding sequence
atggaggagctggagaccagcctgttccagacccggaaggcccaccggatcgagcaaatggtggctagatggttaagacggagtagggatagctccgcccgcgcgaaagttgcagccgcggacgggccagcaaggaaccccacccaaacactcatccccgttaggcacacagtcaaaatcgacaagtag

SEQ ID NO: 42290 - DNA, 4737 bp, Artificial Sequence
  Description of Artificial Sequence: Synthetic coding sequence
atggaggagctggagaccagcctgttccagacccggaaggcccacagaatagaacaaatggtggcccgatggttgagacggagcagagatagcagtgcacgcgccaaagtggcggcagcggacggccctgcccgcaacccaactcagaccctaattccggtgagacacaccgtgaagatagacaaagatacactgctgcaagactatgggtttcacatttccgaatcattacccctaacagtggttgccgtgacagcgggtgggtctgctcatgggaagttgtttcccggagaccagatcctgcagatgaataatgaacccgcagaagacctcagctgggaacgagcagtagatattctgagagaagcagaggattcccttagtatcactgttgttcgctgcacctctggagtaccaaagagttcttttctgactgaggaaaagagggcacgcctcaagactaatcccgttaaggtccactttgccgaggaagtgctgatcagtggtcacagccagggtaattcactcttgtgcatgcctaatgttctaaaactgtacttggagaatggccagacaaaagccttcaaatttgaggctaataccaccgtaaaggacataattttgacggtgaaggaaaagctttccattcgtagtatagagtacttcgcgcttgccctcgaggaacagtactccataagccgtctccatctgctgcacgaggaggagctcatacaacaggtggtcgaaagggaggagagccacgattataggtgtctatttcgagtgtgtttcgtgccaaaggaccccctcgacctcctgaaggaggatccagtggctttcgagtacttgtacctgcagtcctgcagtgacgtgcttcaggaaaggtttgccgttgaaatgaagtgttcaagtgccctgagactggccgcgctgcacatccaggagaggatttacgcttgcgcccagccccagaaaatctcgcttaagtatatcgagaaggactggggaatcgagaacttcataagtccaactctgcttcgaaatatgaagggcaaggatatcaaaaaggctatcagtttccacatgaaacggaaccaaaacttacttgagcctaggcagaagcagctgatcagcgccgctcagctgcgacttaactatctgcaaatacttggtgagcttaaaacatatggcggaagaatttttaacgcaaccttaatgttgcaagatcgagagagctacatcgccctgttggtgggcgccaagtacggaatctcacaggtgatcaattctaaactcaacatcatgtctaccctggctgagtttgcgaacatctctcgggttgagctgacagaagagtccgagaaggttagcgtcgtgaaagtctacctgcaggacgtcaaagtgctgacacttctactggagtctaatagcgccaaagatcttgcttgcctcattgctggatactatcgcctcttggtggatcccgtgacatccatattcctctggcccgggaacaaacagcaggctcatcgtgtgtctgcagaggagggatacgagtcccgtgcctgtagtgacagcgaggaaagctcagaagtggactgcgtcctggagcctctctccgatcgccggctggttaaactcgccccgtgccgaagcctgattaaagaggaacagccgccagggaatagtccaactccggaggttgccagacggggaccaagcacctgtggcgccagttccactactgacagtgcagagagcgaggcctccgatagcgcaaatactgagagccgaggctaccgtacctctggaagttcagaatcaatggacgctttagaggaagatgatcttgatacctgctccagcagcaggtctaccttcttccacttcgggtctcccggcctcgcagagtcgatcgattccgactcccaggaggagagatccggtattgagacttcgggctttctctgcctcctcgacctcgctcagcgcgcaaatccgcagtgccagaaaacggaatttagcgagagcgcagcccttgagaccttcggttgggcccctgaactgtcaaccgtgcgactagaccccagactgtacgaagggtcgcacgcggactactactctctgtgtagttccgtcagccctgccagttacttgtccgactccagtgagtctactgcttcccgtcaagggggggcaccgcctgcctgggggcagcaaggctggactgaggcccagcctagcagcatgctagaacctctggccctacacccacctcttgcctttgaagatggctctagtgatgaggaatactatgatgctgctgacaaattaaccccccctggccctccctcgggcccaagagacgtgtctaccgctgagccgtctgccacgtcgctgcagaacaaggccagcacctcctcacccgaaaatagcctgccctgtggccccgatggccgccaaccgtctagacgggggggtgtgaagaagtacgctaagactctgcggaagaggcgatcattcctgcagaccgattacactagccaggtctcattcccactggtgccaagtgcgtccctcgaatccgtggatgacgtgtgttattacgaccgggagccgtatctggccctcggggcaccgagtccaacagtcagctcccttcaggacatgcagggcgagccaggcttgcttgagacaaaggccttgggtctcctggcaccactcagagagactaagtctaccaatcctgccagtcgggtgatggagatggagccagagacaatggaaaccaagtcggtcatcgattctagagtgtccagcatttcagcaatacgcttcaggatcgaccccaacaataaagaaaactctggagttgtgcccgctgcatctagcagcgcgtcgaccccacactgctccaatcctggcagcagcgggccagatactgcccaggctaggccttcccaaatcctgccactcagccaggatttggacggcatcgctcctaaagaacctactattgagcacggggattccagttttagcctctcttctggtgatccaaaccctgatcgcgcctgcctggcctctaatccagggttgaacaacgtgtcacagggagacacattggaactacagctggagccccacgtccaattagagatgggactcgaaagcttctgcaccaatcacatacaggagaccgcccccaagtataccgagcccttgctgtccccacgggatgagcctagaagcgatgaatgtggtatcaaccccggtgaaaagattgcctccatcccgaccaaggaggaaccacaggggcaactgtccctcgagcgggacagggaagttaccaacaagaatgggactaacgtgtttcaggaggagtcacgaaaggattcaggcgactctcctggggacgtctctaacaacgtttcacagaccctcgatattagctcgcctgcaggcaaaatcgtgacctccctttcccttgatgcaccggtcacaggcaccgaacagatcccacctcaccctccaagggatccacagggccagagtcgtgagccacctggtcagggctgtcaggcccaagaacagaagctgttcgttgagctggacctggatccagacttctttctaggtaagcagacagtctcacccgctgtgccccccgaggggataaaagccgaagcccccaatcacgtgactggacaggacatcgcgccccgcgactcccctgagtgggtgtgctttaaccccgagccgagtttgccagagcctttaccctgtccccaggaggacccacacctcgagacttccaatcattgcttgctgtctgaggggaagtccgatagctccagcatatgtttgagtgcggaaaaatcctttctctgcttcgccccagagtcacacccagaggtctcagcctctctaagagtggccacatctttggggttcgccggcatgaatgagatggtcgcgccaagaattggcatggaccagtgctcctgccagttctcctacgccacgtgttttagaggcccgcagcctgagactgaagaggaggatcgggaccttgaagcgcatccaatggcaccacttacttcccctccaagcgctggcagccccgtggttctgccatggcgccctgccagagcgcattcttgcacaacagcccccctgtccaggaagagccacatttggcccgagtactgctcccgcgcgttgagacaactaaaggccactcccgcctctactcccgaaggtttcatccaattgatggaaagcctgttggaattacaggacatcctcgaaaccagctggggcgtgggcaacaagcatccccccgagaaatgtacgtggcatttcactgaatcacggagtagactgtgcatgggatcccaaaagctcctgtccagttgcaggcacgtaatcagaatggatcagagtcccgaggagatgcaaggggcggtccgcgacacattccagcacttggttcagctcgctgggctgtgtttccagtttaccgactgcagccgctgctctgccaggcaccgcgaggctgctggtaacctcagagacgtggtatacacctaccaccagttcatcgaagctgcaaagagcacatgcgagcgtggttaccacgatctgtcagtaaagttgctagcccgacagtgcacagcccttactgccgctgtcttttgcctcacccagaaattcagggcctccaccgcactctag

SEQ ID NO: 42291 - DNA, 1905 bp, Artificial Sequence
  Description of Artificial Sequence: Synthetic coding sequence
atgcccaacgtgctgaagctgtacctggagaacggccagaccaaggctttcaagtttgaagccaacacaactgttaaggacatcattttgacagtgaaagaaaaattgtcaatccgttccattgaatactttgcactggcattggaagaacaatattcaattagccggctgcacctactgcatgaggaagagctgatccagcaggttgtggagcgagaagagtctcacgactaccggtgcctgtttagagtttgtttcgtacccaaagaccctcttgacctgttgaaggaggacccagtggcttttgaatacttgtacctgcagtcatgtagcgatgtcctgcaggaacgcttcgcagtagaaatgaagtgctcttcagctcttcgtcttgctgcgcttcacatccaggagcgtatttacgcttgtgcacagccacagaaaatcagcctgaaatatattgagaaagactggggtatagagaattttataagcccgactctgctgcgcaatatgaaaggaaaagacatcaaaaaagctattagtttccatatgaaacgaaatcagaatctgctggaacctaggcagaaacagctgattagcgccgctcagctgagacttaactacctgcagatactcggcgaacttaagacgtatggtggaagaattttcaatgcaactctgatgctgcaggatagggagtcttacatcgccctgctcgttggcgcgaagtatggaataagccaagtgattaactcaaagctcaacattatgagcacactggcagaattcgccaacatctctagagtcgagttgacagaagagtccgagaaagtgagcgtggttaaggtgtacctacaggacgtgaaagttttgacactcctgctcgaatccaatagtgcaaaagatttggcatgtctgatcgcaggatattatcgtcttttagtcgatcctgtcacgtcgatttttctctggcccgggaataagcagcaggcccatcgggtgagtgcagaagaggggtatgagagcagagcgtgttcagacagtgaggagtctagcgaagtggattgcgtgctcgagcccctgtctgatcgcagacttgtgaagctggccccttgtaggtcgttaatcaaagaggagcagccacctggaaactctccgacacccgaagtggctaggcgcggcccttcaacgtgtggcgcttcgagtactactgatagcgcagaatccgaagcgtcagactcagcgaacacagagtctcggggatatagaacctctggatcctccgagagcatggatgcccttgaggaagatgacctggatacctgcagtagcagcaggtccacgttcttccatttcggctctccgggtctcgcagagtctattgattccgactctcaggaggagcgtagcggaatcgagacttctggcttcctctgtctcctggacttggcacaaagagctaatcctcagtgtcagaagactgaattcagcgaatcagctgcacttgaaacatttggctgggccccagaactgagcaccgttcgtctcgatcccaggctgtacgagggatcacacgccgactactactctctgtgcagcagtgtctctcccgcctcttacctgtccgacagctccgaatccacagcgagtaggcaggggggagccccgccggcttggggccagcagggctggaccgaggcccagcctagcagcatgcttgaacctttggccttacacccgcccttggcgttcgaagacggatcttcagatgaagagtactatgacgctgcagataaactcactccgcctgggcccccctctggagagccgagtttggctgggctgcaaaccagacaggccgcccccgagtgcctgcccgggattaaagcctggggacaagcgtag

SEQ ID NO: 42292 - DNA, 4737 bp, Artificial Sequence
  Description of Artificial Sequence: Synthetic coding sequence
atggaggagctggagaccagcctgttccagacccggaaggcccacagaattgaacagatggtggcacggtggctccggcgcagcagagattctagtgcccgggccaaggtggccgccgccgatggtccagcaagaaatcctacccagactctgatccctgtgcgacatactgtgaaaatcgacaaagatactctgctgcaggattatgggtttcacatctcagagtcgctgccactcactgttgtagcagtgactgccggcggatcagcccacggtaagctattccctggggatcaaatactccagatgaacaatgaacccgctgaggatctgtcctgggaacgagctgtggatatccttagggaggccgaggatagtttgtcaatcaccgtggtgcgctgcacatccggggtgcctaaatcatcttttctgaccgaggaaaaaagagcacggctgaagactaaccccgtaaaagttcacttcgccgaagaagtccttatttcaggccacagccagggcaatagcttactgtgtatgccaaatgtgctgaaactttaccttgaaaacggtcagaccaaagccttcaagtttgaagctaacaccacagttaaagatatcatcctgactgttaaagaaaaactctcaattcgcagcattgaatattttgctcttgccctggaagagcagtactcaatctcccggctgcacctgttacacgaagaagaattgatccagcaggttgtagagcgggaagaatcacatgactatagatgcctctttcgggtatgctttgtgcctaaagacccgctcgacctgctgaaagaggaccctgtggcgttcgaatatctctaccttcagagttgtagtgacgtgctccaggagagattcgctgttgaaatgaagtgctcctctgccctccggctagccgccctccacatccaggagaggatctacgcttgcgcccaaccgcagaaaatctctctgaagtacattgagaaggactggggaattgagaatttcatctcaccaaccctgctgaggaacatgaaggggaaggatatcaagaaggctatcagcttccatatgaaaagaaatcaaaatctgctggagccgagacaaaaacaacttataagcgccgcacagctgaggcttaactacctgcagattctcggagaacttaaaacctacggcggacgcatttttaacgccaccctgatgttacaggatagagagtcttatatagccctcctggtgggcgcgaagtatggcatcagccaggttattaactccaaactgaatattatgagcacgttggcggagttcgccaacattagcagagttgaactgaccgaggagagcgagaaagtctcagttgtgaaggtatatctccaggatgtaaaggtgctcacactgttacttgagtcaaacagcgcaaaggacctcgcctgcctgatcgctggttattatcgcctgctggttgatccagtcacatcgatcttcctctggccagggaacaagcagcaagcccatcgagtgagcgccgaagaggggtacgagtctagagcctgctccgacagcgaagagtcttcggaagtggactgtgtgttggagccattgtccgatcggcgtctggtgaagctcgccccgtgcagaagcctaataaaagaggagcagcccccaggaaacagtccaaccccagaggtggccaggcgcggcccctccacgtgtggcgcaagctctaccacagattctgccgagtcagaggccagtgattcagctaacactgagagcagaggatatcgtacatctggatcaagtgaaagcatggacgcactggaggaggacgacctggatacatgcagcagttctcggtctaccttcttccactttggcagccctggcttggctgaatccatcgattcagattcacaggaagagagatccggtatcgaaacctccggattcctgtgtcttctggatctcgcccagagagcaaacccccagtgccagaaaacggaattttccgaaagtgcagccctggaaactttcggttgggccccggaacttagcaccgttcgcttagatccgaggctctatgaaggatcccatgctgactactattcactgtgctctagtgtaagcccagcgagctatctgtctgactcctccgagagcaccgcatcaaggcagggaggcgctcctcccgcatggggccagcaaggatggactgaagcccagccctcttcgatgctggaaccacttgcattgcatcctcctctggctttcgaagacggatctagcgatgaggagtactacgatgcggctgacaaactgactcctccaggtcccccatccgggccaagagatgtgagcactgctgagccttctgcaaccagcctgcagaacaaggcgtccaccagttctccagagaattccctgccttgtggtccagacggccgccaaccatctagacgaggcggcgtgaaaaaatacgcgaagaccctccggaaaaggaggtcttttcttcagaccgactacacctcacaggtgagcttcccactggtgcctagtgcttcccttgaatctgtggacgatgtatgctattatgatagagaaccatacctagctctgggcgctcctagcccaactgtgtcttccttgcaagacatgcagggggagccagggttactggaaaccaaggccctcggattgcttgctcctcttcgagaaacaaagagtacaaatcccgcctcaagagttatggagatggaacctgaaacaatggagactaagagtgtaattgattctagggtgagctcaatttcagccattagattcaggatcgatcccaacaacaaggaaaattcaggagtggttccggcagcctcctcatctgcgagcaccccgcattgctcaaaccctggatcatctggccctgatacagctcaggcgaggccctcacagatcctgccactgtcacaggatctggatgggatcgctcccaaagagccaacgattgagcacggcgacagtagtttctctctgtcgtcaggagacccaaaccctgatcgagcctgcttggcctctaaccccgggctgaacaatgtgtcccaaggtgataccctagaactccagctcgagccacacgttcagctcgagatgggtttggaatcattctgtacaaatcatattcaggagactgcaccaaagtacacagaacctcttctgtcccctcgcgatgaaccccggagtgacgaatgtggtatcaatccgggcgagaagatcgcctccattcctaccaaagaggagccccagggtcagctgtccctggaaagagacagggaggtaacaaataaaaatggaacaaacgtgtttcaagaagagtctcgcaaggacagtggcgactcacctggggacgtgtctaacaatgtttctcagaccctggacatctcaagtcccgcaggtaagatcgtgacgagcttaagtctggatgctccagtgaccggtactgaacagatccctccccacccccccagagatccccagggacaatcaagggagccaccaggacagggctgtcaggcccaggaacagaagcttttcgtcgagctggatttagacccagatttcttcctcggcaagcagacagtgtccccagcagtgccaccagaaggcataaaagctgaggcacccaaccacgtaacaggtcaggacatcgcgccacgggattcccccgagtgggtgtgtttcaatcctgagccatctcttccagagccattgccttgtcctcaagaggacccacatctggaaacatctaatcattgtttgcttagtgaggggaagagtgatagcagcagtatttgcctgtccgccgaaaaatcctttctttgctttgccccagagtcccacccagaagtgtccgctagtcttagggtggctaccagcttagggttcgccggcatgaatgaaatggtagctccaaggatcggcatggaccagtgctcatgccaattctcatacgctacgtgtttccgggggccccagcccgagacggaagaagaggatagagacctggaagcccatcccatggcacccctgacaagtccccccagtgctggaagtcctgtggtcctcccctggcggcccgctcgggctcactcctgcactaccgctcccttatctcgcaagtctcacatttggcccgaatactgttccagagcactcaggcagctgaaagccaccccagcaagcaccccagagggtttcatccagctgatggagtccttgttagagttacaggacattcttgagacctcatggggtgtgggcaataaacacccccctgaaaagtgtacgtggcacttcacagaaagtagatcgcgactgtgcatgggttctcagaagctgctgtcttcctgcagacacgtcattcggatggatcagtcccctgaagagatgcagggtgcggtgagggataccttccaacacctggtgcagttagcaggcctgtgctttcaattcactgattgctcacgctgcagcgccaggcatcgggaggcagcaggtaacctcagagacgtagtgtatacttaccaccagtttattgaggccgccaagagcacatgtgaaagagggtatcacgatctctcagtgaaactccttgctaggcagtgtaccgctctgaccgccgccgtattttgtcttacccaaaaattccgcgcatccactgctctttag

SEQ ID NO: 42293 - DNA, 2046 bp, Artificial Sequence
  Description of Artificial Sequence: Synthetic coding sequence
atggccgaggtgggcggcgtgcccaagagcagcttcctgaccgaggagaaaagggcccggttaaagactaacccagtgaaagtgcactttgcagaggaggtgctcatcagcggccactctcagggcaactcacttttgtgtatgcctaacgtccttaaattatatctcgaaaatggccaaacaaaagcatttaagttcgaggccaataccactgtgaaggacattatcttgactgtgaaggagaagctgagtataaggagtatcgaatattttgccctagctctcgaggagcagtacagcatttcccggctgcatctgttacacgaagaggagctgatccagcaggtcgtggaacgagaagagagtcacgactacagatgtttgttcagggtatgttttgttccaaaggaccctctggatctgctgaaggaggatccagtcgcgtttgagtacctgtatctgcagagctgcagcgatgtgctacaggagaggtttgctgtggagatgaaatgctccagcgccttgcggctggccgcactccacatacaggaacgcatttatgcgtgtgctcagccccagaaaatctccctcaagtatatcgaaaaggactggggaattgagaatttcatcagtccgacccttctgcggaatatgaaaggaaaggatattaagaaagccataagctttcatatgaagaggaatcagaacttattggaacccagacagaaacaactcatctcagcagcacagctgagacttaattacctccagatactgggggagctcaagacctacggcggaagaatcttcaatgccactctgatgctccaggatcgagaaagttacatagccctccttgtgggcgccaaatatgggatttcccaggttatcaattccaaactgaatattatgagcacactggcagagtttgccaatatcagccgtgtcgaattgacagaggaaagcgagaaggtctcagtggtgaaagtctacctgcaggacgtcaaggtcctcaccctcctcctggagtccaattctgcaaaagacctagcctgtctgatcgcaggctactataggttgctagtggaccccgtgaccagcatattcttgtggcctggtaataaacaacaagcccatagagtgagtgcagaggaagggtatgagagccgggcttgctcagacagcgaagagagcagtgaggttgactgtgttttggaacccctaagtgatcgtcgactggtaaagctcgcaccctgcagatcccttatcaaggaagagcaacctcctgggaattcaccaacccctgaagtggcccgaagggggccttccacctgcggcgctagcagcaccaccgactccgccgagtctgaagcatctgatagtgctaatactgagtcacgggggtatcggacatcaggcagcagcgaatcaatggatgccttagaagaagatgaccttgacacctgctcatcatcaaggtcgacctttttccactttggaagtcccggtctcgcggagtccatcgattccgattcccaggaggagagaagcgggatcgaaacatctggtttcctctgtctgctcgatctggctcaacgagccaatccgcagtgtcaaaagaccgagttttctgagtctgcagctctggagacatttggttgggcaccggaattgtcaactgttcgtcttgatcctcgtctgtatgagggttcacacgccgactactattctctctgttccagtgttagccccgccagctatctaagcgactcttcagagagcaccgcctctcgtcaaggtggagcaccaccggcttggggccagcaaggttggacagaggcacaaccctcctccatgttagagcctcttgctctgcatccaccgttggccttcgaagacggctctagcgatgaggagtattatgacgccgccgataaactgaccccaccagggcctccttctggcgaaccctctctggccgggctgcagacccgccaagccgcccccgaatgccttcccggcatcaaggcatgggggcaagcttag

SEQ ID NO: 42294 - DNA, 1713 bp, Artificial Sequence
  Description of Artificial Sequence: Synthetic coding sequence
atgctgagccggctgatgagcggcagcagccggagcctggagcgggagtacagctgcaccgtgaggcttctggacgatagcgaatatacgtgtacaatccagcgcgacgcaaagggtcagtacctgttcgacctgttgtgccaccatctgaacttactggaaaaggactatttcgggattcgcttcgtggatcccgacaagcagcggcattggctggagtttacaaaaagtgtggtaaaacagctccggtcccaaccgccattcacaatgtgctttcgggtgaaattttaccccgccgaccctgccgccctaaaggaggagattacgcgctatttggtcttcctgcagattaaacgggatttgtaccacggccgactcctatgtaagactagcgatgcagccctgctggccgcctacattctgcaggcggagattggcgattatgacagcgggaagcatcccgagggttattcctctaagtttcagttttttcccaagcactcggaaaagctggaaaggaagattgcagaaattcacaaaacggagctgtctggccaaacacctgccacgtctgagctgaacttcttaagaaaggctcaaaccctcgagacctacggggtcgacccgcacccttgcaaggacgtgtctggcaatgctgccttccttgcttttacccccttcgggtttgtggttcttcaaggtaataagagggttcattttataaaatggaacgaggtgacaaaactgaagttcgagggaaagactttttacctttacgtgagtcagaaggaggaaaaaaagataattctgacctatttcgctcctacgcccgaggcgtgcaaacacctttggaaatgcggcatcgagaaccaagccttctacaaactagagaaaagctctcaagtcagaacagtatccagcagcaacctgtttttcaaaggaagtagattccgctactcagggagggtggcaaaagaggtgatggagtcctccgctaaaatcaaacgggagcccccagaaatccatcgcgcaggtatggtgcccagccggtcctgccccagtattacccatgggcctagactgtcgtcagtccccagaacacggcgacgcgccgtccatatatccattatggaaggcctggagtcactgagggactcagcccacagcacaccagtgagaagtacttcacatggcgacacatttctgccacacgtccgcagcagtcgtaccgattccaatgaacgggtggccgtgatcgccgacgaagcctattctcctgcagacagcgtgctccccacacctgtcgccgagcatagcttagagctgatgttgttgtcccgtcagattaacggtgctacctgttcaatcgaggaggagaaagagtccgaggcttccacacccacagcaactgaagttgaagcgctgggtggcgaactgcgagcgttatgccaagggcacagcggcccggaagaggagcaggtgaacaaattcgtcctttctgttctgcgtttgctcctcgtcaccatggggctccttttcgtcctgctcctgttactgatcattctcactgagagtgacctggacatcgcattttttcgggacatcaggcagacccctgaatttgaacagttccactaccaatacttttgccctctcaggaggtggttcgcatgtaaaatacgatctgtggtttccctcctcatcgacacttag

SEQ ID NO: 42295 - DNA, 1245 bp, Artificial Sequence
  Description of Artificial Sequence: Synthetic coding sequence
atgtgcttccgggtgaagttctaccccgccgaccccgccgccctgaaagaggagattactcgataccttgtttttcttcaaattaaaagggacctctatcatggacggctgctttgcaaaacatcagatgctgccctgctggccgcctacatactgcaggctgagatcggagattatgactcaggcaagcacccagaggggtattcttccaaatttcagttctttcccaaacactcagaaaagctagagcgtaagattgccgaaattcataagacagaactgtccgggcaaacgccagccacatctgagctgaatttcctgcggaaggctcagactcttgagacttacggggtagatcctcatccttgtaaggatgtcagcggcaacgctgcctttctagcgttcactccatttggcttcgtggtcctccagggcaacaaacgtgtccactttatcaagtggaacgaggttaccaaactgaaattcgaaggtaaaactttttacctctacgagaaaaaaattatacttacctacttcgcacctaccccagaggcctgcaagcatctgtggaagtgcgggattgaaaaccaagctttctacaagcttgagaaaagctcgcaagtgagaacggtcagctcgtctaatctcttttttaagggctcaagattccggtactccgggcgagtcgccaaagaagtgatggaatccagtgccaagataaaaagggagcccccggagatccatcgggccggtatggttccttcccgaagttgcccaagcattactcatgggccacggctgtctagtgtcccccgcaccaggaggcgcgcagtgcacatttctatcatggagggtctagagtcactcagagactctgcccacagcacccctgttaggtcaacatcccacggcgacaccttcttacctcatgtcagaagttcccgcacagattctaacgagcgcgttgctgtgattgccgatgaggcgtactctccagcagacagcgtgttgccaacacccgtggcagaacacagtttggaactcatgctcctcagtcgacagattaatggcgcaacgtgttccattgaggaagagaaggagagcgaagcatccacccctaccgccacagaggtagaagcccttggaggggagctgagagcattatgccaaggccatagtggaccggaagaggagcaggctatggtgtgcctgcagaatcctctgtcaggggaaccagcccattag

SEQ ID NO: 42296 - DNA, 1869 bp, Artificial Sequence
  Description of Artificial Sequence: Synthetic coding sequence
atgaacaagctgaacttccacaacaaccgggtgatgcaggaccggcgaagtgtttgtatcttccttcctaacgacgagtcactcaacatcatcatcaatgtgaaaattctctgccaccagctgctggtgcaagtgtgcgacctcctccgactgaaggattgccacctatttggcctgagtgtgatacagaataatgaacacgtctacatggagttgtcacagaagctctacaagtattgccctaaggaatggaaaaaggaggcaagcaaggtgcggcagtatgaggttacctgggggatcgatcagttcggccccccaatgattatccatttccgagtgcagtattatgtggagaatggtcgcttaatttctgacagggccgccaggtactattattattggcacctgcgtaaacaggtgctgcactctcaatgcgtgcttagagaagaggcttacttcctactcgctgccttcgccttgcaggccgatttaggcaattttaagcggaacaaacattacggcaaatattttgagcctgaagcttatttcccttcttgggtggtgtcaaaaagaggcaaagattacatcttgaaacacatcccaaatatgcataaagatcaatttgcccttactgcttcagaggcacacttaaagtacatcaaggaagccgtgaggctggacgacgtggctgtgcactattatagactgtataaggataaacgagaaatcgaggccagcctaacactggggcttactatgaggggaatccagatcttccagaatctggacgaagaaaagcagctcctttacgacttcccttggacaaacgtggggaagctagtctttgtcgggaagaagtttgagattctacccgatgggctgccatcagcccgaaagctcatttattatacagggtgtcccatgaggagtaggcatttattgcagctgttgagtaactcacatagactgtacatgaacttacagcccgtactgcgtcatatcaggaagctggaagaaaatgaagaaaaaaagcaataccgcgaaagctacatttccgacaacttggacctggacatggaccaactggagaaaaggagccgcgcaagtggttctagcgccggcagcatgaagcacaaacggctctctaggcattctactgcgtcccattccagcagccacacaagcggaattgaggccgacaccaaacccagggataccggacctgaggactcatattcttcctcagccatccaccgaaagctcaagacctgttcctcgatgaccagccacgggagctcacacacttcaggagtcgagtctggggggaaagataggcttgaggaagacctccaggacgatgagattgagatgctggtggatgatccccgcgacctcgagcagatgaatgaagaaagcctagaagtgagcccagatatgtgcatttatatcaccgaggacatgcttatgtctaggaaactgaacggccacagcggtcttatcgtgaaagaaatcggcagctctactagtagctcctccgaaactgtggtcaaactccgcgggcagtctacagattccctgccacagaccatttgccggaaaccaaagactagcactgataggcactccctgtctttggacgacatcaggctgtatcagaaagatttccttagaatagcaggactctgccaagataccgcccagagctacacattcgggtgtggccacgaattagacgaggaggggctgtactgtaatagctgcctagctcagcagtgcattaatatccaagatgccttcccagttaaacgcacaagcaaatacttctccctcgatctcacccatgatgaggtccctgagtttgtcgtatag

SEQ ID NO: 42297 - DNA, 1845 bp, Artificial Sequence
  Description of Artificial Sequence: Synthetic coding sequence
atgaacaagctgaacttccacaacaaccgggtgatgcaggaccggaggagtgtctgtattttcttacccaacgatgagtccctgaatattattatcaacgtcaaaattttgtgccatcaattgctggtccaagtgtgtgatttgctgagactcaaggactgtcacctcttcggtctgagtgtgatccagaacaatgaacacgtctatatggagctgagtcaaaagttgtataagtactgccctaaggaatggaaaaaagaggctagcaagggaattgaccagttcgggccacctatgataatccactttcgcgtccagtactacgtagagaacggtaggctgatttccgatcgagctgcccgctactattactattggcatctccgcaaacaggtgctgcactctcagtgcgtgctccgcgaggaggcctactttctgctcgccgcattcgcgttgcaggctgatttgggcaacttcaaacgtaataaacattacgggaagtacttcgagcctgaagcatatttcccgagctgggtcgttagcaaaagaggaaaggattacatattgaaacacatccccaacatgcacaaggatcagtttgctctaaccgcgtctgaggcacacctgaaatatattaaggaggcagtgagacttgacgacgtcgccgtccattattatcggctgtacaaagacaagagagagattgaggccagtctgaccctgggtctgaccatgcgcggcatccagatttttcagaatctggatgaggagaaacaattgctgtatgatttcccctggacaaacgtagggaaactggtgttcgttggcaagaaattcgaaatcttacccgacggtcttccaagtgcccgaaaacttatatactatacaggctgccctatgcggagccgacaccttctgcaactgctgtctaatagtcaccgcctgtatatgaacctgcagcccgtgctgagacacatccggaaactcgaagagaacgaagagaaaaaacagtacagagagtcatacatctctgataacttggatctcgacatggatcagctggagaagcgatccagagccagcggatcaagtgccggttccatgaaacataaaagactgagccggcatagcaccgccagccatagctcctctcacacatcaggcatcgaggctgacacgaagccccgcgacaccgggccagaagacagttatagttcatccgcgatccatcgcaagctcaagacatgcagctccatgacctcacatggatcttcccacacttcgggggtggaatccggcggcaaggatagacttgaagaggacctacaagacgatgagatcgagatgttggtcgatgatccccgcgacctggagcaaatgaacgaggagagtctggaggtttcccccgatatgtgcatatatataacagaagacatgctgatgtctagaaaactcaacgggcattctggcttgattgtaaaagagattgggagctctacaagctcctcctctgagactgtagtcaagctgaggggtcagagcaccgatagcctgccgcagaccatctgtcgcaagcccaagacatcgacagacagacattcgctgtccttggacgacatcagattgtatcagaaggattttcttaggatagcaggtctatgtcaggacaccgctcagtcctatactttcggctgtggccatgagctggacgaggagggactgtactgcaactcatgcctcgctcagcaatgtattaacattcaggacgcgtttccagtcaaaagaacttcaaagtattttagccttgatctgacccatgacgaggtgccagagtttgttgtatag

SEQ ID NO: 42298 - DNA, 1845 bp, Artificial Sequence
  Description of Artificial Sequence: Synthetic coding sequence
atgaacaagctgaacttccacaacaaccgggtgatgcaggaccggagatccgtgtgcattttcctgcccaatgatgaaagtctcaacattatcataaacgttaagattctctgtcaccaactgctggtgcaggtctgcgatctactgcggctcaaggattgccacctcttcgggttgtctgtgattcagaacaacgaacatgtttacatggaactgtctcaaaagttatacaagtattgcccaaaggagtggaagaaggaagctagcaaaggcattgatcagtttggccctccaatgataatccacttccgggtgcaatattatgtggaaaatggccggctgatctctgacagggctgcccggtattactattactggcacctcaggaagcaggtgttgcattcccagtgtgtgctgagagaggaagcctatttcctcctggcggctttcgctcttcaggcagatttagggaatttcaaacgtaacaagcattacgggaaatacttcgagccagaggcctacttccctagctgggtggtgtccaagagaggaaaggattacattttgaaacacatcccgaatatgcacaaggaccaattcgctctcaccgcgtcagaggcacacctcaagtatatcaaagaggccgtacgactggacgacgtcgctgtccactattataggctgtataaagataaaagggagattgaagcaagcctcacattaggccttacaatgcggggtattcagatctttcagaaccttgatgaggaaaagcaactcctctatgacttcccctggacaaatgttggaaaacttgtttttgtcggcaaaaagtttgagatccttccagacggcctccctagcgctaggaagctgatatattatactgggtgccctatgaggtccaggcacttgctgcagttactatccaattctcaccgcctctatatgaatctccagccagtgctgcgccacatcagaaaactcgaggagaacgaagaaaaaaagcagtatcgtgagtcttatatctcggataatctcgatctggatatggaccagctcgagaagcgatctagagcgtccggttcaagcgccggatccatgaagcacaagcgactgagccgtcattccactgcttcacactcttcttctcacactagcggtattgaagccgacacaaaaccgcgggacacaggccctgaagacagttattcatccagcgccatccatcgaaagttaaagacgtgtagctccatgaccagccacggctccagccatacaagcggggtggagagtgggggcaaagataggctcgaagaggacttgcaagacgacgagattgaaatgctggtcgacgaccctcgggacctagagcagatgaacgaagagagccttgaggtttctccagacatgtgcatttatattacggaggacatgctgatgtcgaggaagttaaacgggcacagcggactgattgtcaaggagatcggtagcagtacaagtagctcatccgaaacagtggttaaattaagaggccagtctacagattccctgccccaaacgatctgcaggaagcccaaaactagcactgatagacattcgctctcactcgatgacatccgcctctaccagaaagactttttgcgaatcgccgggctctgtcaggacacagcgcagtcatatacctttggctgcggtcacgaattagatgaggagggactgtattgcaatagctgtctggcccaacagtgtataaacattcaagacgctttccccgtgaagagaacttccaagtacttctcacttgatctcacccacgacgaagttcccgagtttgtggtgtag

SEQ ID NO: 42299 - DNA, 795 bp, Artificial Sequence
  Description of Artificial Sequence: Synthetic coding sequence
atggaccagctggagaagcggagccgggccagcggcagcagcgccggcagcatgaagcacaaaaggctttccaggcatagtaccgctagtcactcctcttcgcatacctcgggaattgaggctgatactaagcctagagacaccggacctgaggattcatatagctcatctgccatccatcgcaagttaaaaacttgttcatctatgactagccacggctcatcccatacctctggagtggagtccggcggcaaagatcgcttggaggaagacttgcaggatgatgaaatcgaaatgcttgtggacgacccccgagatctggaacaaatgaatgaagagagtctggaggtcagccccgatatgtgcatttatatcaccgaggatatgctgatgtctaggaaattgaatggccacagtggcttaatcgtaaaagaaatcggtagctctacttccagcagcagcgaaaccgtggttaaattaaggggacagtctacagacagcctcccccagacaatttgccggaaaccaaaaacctcaacagacagacactctctgtcgctcgatgacattcgcctctatcagaaggactttctcaggatcgccggcctttgtcaggatactgctcaaagttatacattcggatgcggacatgaactcgatgaggagggtctgtactgtaatagctgcctggctcagcaatgcatcaacatccaggatgccttccctgtcaagcgaacctcaaaatacttctctcttgatttaacccatgatgaggtgccagaatttgtcgtttag

SEQ ID NO: 42300 - DNA, 186 bp, Artificial Sequence
  Description of Artificial Sequence: Synthetic coding sequence
atgaacaagctgaacttccacaacaaccgggtgatgcaggaccggaggagtgtttgcattttccttccgaacgatgaatctctgaatataattattaatgtcaaaatcctgtgtcaccagctgctggtccaggtctgcgacctgttgagacttaaagactgccatctgttcggactctcagtttag

SEQ ID NO: 42301 - DNA, 3138 bp, Artificial Sequence
  Description of Artificial Sequence: Synthetic coding sequence
atgggcgagatcgagcagcggcccacccccggcagccggctgggcgccccggagaattccggaatctccacgttggagcggggccagaagccccctcccaccccctccggaaaactggtgtctataaagatacaaatgcttgatgacacgcaagaggcgttcgaagtgccccaaagggcacctggaaaggtcttgctggacgctgtatgcaatcacctcaacctggtggagggcgactattttggcctggagttccctgatcataagaagatcaccgtgtggctggacttactgaaacctattgtaaaacagatcagaaggcctaaacacgtcgtggtcaaattcgtggtcaagttcttccctccagaccacacccagctccaggaggagctgacccgctacctgttcgccttacaggtcaaacaggacctcgctcagggcagactgacatgcaacgatacgagcgccgctcttctcataagccatatcgtccagagcgagatcggagattttgacgaggcattggaccgagaacatctcgcgaaaaacaaatacatcccccagcaggatgctctggaagataagatagttgagtttcaccataatcatatcggccaaacgcccgcagagagcgattttcagctgttggagatagcgcggagactagaaatgtacggcatccgtttgcaccctgcaaaagatcgagagggaacaaagattaacttggccgtggccaacaccgggatactggtttttcagggattcacaaagatcaatgccttcaactgggccaaggtgaggaagctgtcctttaagcgtaagcgttttctcatcaagcttcgaccagatgccaactcggcatatcaagatactctggagttcctcatggccagtagggacttctgcaaatctttttggaaaatttgtgttgaacatcatgctttctttagactcttcgaggaacctaaacccaaacccaagccggtgctctttagccggggctcctcatttagattttcagggcggacccagaagcaggtgttggactacgtgaaggagggggggcataaaaaggttcagttcgaacggaaacacagtaagatacacagcataagaagccttgcctctcagccaactgaattgaattcagaggttttggagcagtctcaacagagcactagcctgaccttcggagagggcgcggaatcgcccggtgggcaatcctgccggcgtggtaaggagcccaaggtgagtgctggcgagcccgggagccacccctccccagcaccccgcaggtcaccagccgggaataagcaggccgacggagctgcaagcgctccaaccgaggaagaagaggaagtggtcaaggacaggacccagcagtcgaagccgcagccgccgcagccctcgaccggatccctcacaggaagcccccacctgtcagaactatccgtcaactctcagggaggcgtagcccccgccaacgtgactctttcaccaaacctttccccggatacaaagcaggccagtcctctgatcagtccactgctgaacgatcaagcttgtcctcggaccgatgacgaggatgagggaagacggaagcgctttcccacagacaaggcttacttcatcgctaaagaggtctctaccacagaacgcacttatctgaaggatcttgaggttatcacttcatggttccagtctactgtgtccaaggaagacgccatgcctgaggctctcaagtccctcatcttccctaactttgagcccctacacaaattccatactaactttctcaaagaaattgagcaacgcttagcactttgggagggccgaagcaatgcccagatcagggactatcaacggatcggcgacgtgatgcttaagaatattcagggcatgaaacacctggctgcccatctctggaagcactctgaggctctcgaagctcttgagaatggcatcaaatccagcagaaggctggaaaatttttgtagagatttcgagcttcaaaaagtgtgctacctgcctcttaacacatttctattgcggccattgcacagacttatgcattacaagcaggttttggagcgcttgtgtaagcaccatcctcctagtcacgctgacttcagggattgccgagccgctctggctgaaatcactgagatggttgctcagctgcatggcacaatgattaagatggagaacttccagaaactccacgaactcaagaaagacctgatcggtattgacaacctagtggtccctggccgcgaattcatccgactcggctcgctgagtaagcttagcgggaagggactgcagcagaggatgtttttcctgttcaatgatgtgctgctttacacctctaggggtcttaccgcctccaatcagtttaaagtgcatggccagttaccactgtacggtatgactatagaagaatctgaggatgaatggggcgtaccccactgtttgactctgcgcgggcagcgccagtctatcatcgtcgccgcctccagccgctcagaaatggagaagtgggtcgaagatatccagatggccatcgacctggccgaaaaatcaagtagtcccgcccccgaatttctcgccagcagcccacccgacaacaagagtcctgacgaagctacggccgcggaccaggagtctgaggatgacttgtcagcctctcgcacctcattggaacgacaggctccccacaggggaaatacaatggtgcatgtttgttggcaccgaaacacatccgtgagtatggtagatttcagtatcgctgtcgagaaccagctcagtgggaacttgctccggaaatttaagaattctaatggatggcagaaattgtgggtagtttttacaaatttttgcctctttttctacaaatctcaccaagacaaccaccctttagctagcttacctctcctgggttactctttgaccatacccagcgagtctgaaaacatccaaaaagactatgtgttcaagttgcacttcaaaagccatgtctattatttcagagctgaaagcgagtacacgttcgagaggtggatggaggtgataaggtccgctacttcttccgcttctcggcctcatgtactttcccacaaagaatcccttgtgtactag

SEQ ID NO: 42302 - DNA, 390 bp, Artificial Sequence
  Description of Artificial Sequence: Synthetic coding sequence
atgggcgagatcgagcagcggcccacccccggcagccggctgggcgccccggaaaattcagggatcagcaccctggaaaggggtcagaaaccaccacccacaccctccggtaaacttgtgagtatcaagatccagatgctggatgacacccaggaggccttcgaggttccaatggtgtcaagtagctcctttttaaaggccacaggcagcagctggactgggtgggtgctgcgatgctcaatgaagccaaagcaccacagccatctcatcgagaaatttggggaagacaggatcttgactcatctcaccggcagtatctcatacacaaactgggctggctcaagaagcttagccgtgaccgtcacagaggagttgttaaatctgttctag

SEQ ID NO: 42303 - DNA, 1083 bp, Artificial Sequence
  Description of Artificial Sequence: Synthetic coding sequence
atggccagccgggacttctgcaagagcttctggaagatctgcgtggaacaccacgcattcttcaggttgtttgaagagcctaaacccaaacccaaaccagttttgttctccaggggctccagtttccggttctctgggcgcacccagaagcaggtgctggattacgtgaaagagggcggacacaagaaagtccagtttgagcgcaagcattcaaagattcactctatccggtctctggccagccagcctacggagctcaactccgaggtgctggaacagtcacaacagagtacaagtttgacatttggcgagggtgcggaatcacctgggggacagagctgtaggcgaggaaaagagcctaaggttagcgctggggaaccagggtctcacccttcaccggcgcctagaaggtcccccgcaggaaacaagcaggcagatggcgccgcctccgctccaaccgaggaggaagaggaagtggtcaaagatagaacccagcagtctaaaccacagccacctcagccatctaccgggtcgttgacgggctccccccatttgtcagaactctctgtgaactcccaaggaggtgtcgctcccgccaacgttactttgtctccaaatctctccccagataccaagcaggcctccccgctgatatcgcctctcctcaacgatcaggcttgtcctaggactgacgatgaagacgaaggtagacggaagcgattccctacagataaagcatattttatcgctaaagaggtgtccactaccgagagaacctacctgaaggatttagaagtcatcacgagttggtttcagtctaccgtgtcaaaagaggatgcgatgccagaggccctgaagtccttgatctttccaaactttgaacctctgcacaaattccatacgaattttttaaaggagattgagcagcgcctggccctgtgggaaggacgttccaacgctcagatcagagattaccagagaataggcgatgtcatgctaaagaatatacagggtatgaaagctggcgttcagtggcgcgacctgggctctttgcagccaccccccccacggttcaaaccctag

SEQ ID NO: 42304 - DNA, 3231 bp, Artificial Sequence
  Description of Artificial Sequence: Synthetic coding sequence
atgggcgagatcgagcagcggcccacccccggcagccggctgggcgcgccggagaactctggcatttcgaccctagagagaggccagaagccacctccaacgccttcagggaagctggtctccatcaaaattcagatgttggacgatactcaggaagctttcgaggtgccacagcgcgcccctggcaaagtgctactcgacgccgtctgtaatcatctgaaccttgtcgaaggagattatttcggcctcgaattccctgatcacaaaaaaatcaccgtctggctggatctgctaaaacctatcgtgaaacagatcaggcgtccgaagcatgtagtggtgaaatttgtcgtaaaattttttccgcccgaccacactcaattacaggaggagctcacacggtatcttttcgctttgcaggtgaagcaggatttggcgcaagggcggcttacctgtaacgatacatctgccgccctcctgatcagtcacatcgtccagagtgagataggcgactttgacgaggccttagacagagaacacttggccaaaaacaagtatattccacaacaggatgcactagaggataagatcgtagagtttcaccacaaccatatcggacagacccccgccgaatctgactttcagctacttgagattgctaggagactggagatgtacggtatccgcctccatcctgctaaggaccgtgaggggactaaaataaacttggccgttgccaacaccggcatcttggtgtttcaagggtttactaaaatcaatgctttcaattgggctaaagtgagaaaactaagttttaagaggaagcgattcctcatcaagcttcggccagatgctaattcggcataccaagataccctcgaattcctgatggcttctcgcgacttctgcaaaagcttttggaaaatctgcgtggagcatcatgcattttttaggctgtttgaggagcccaaacccaagcctaaaccagtgcttttcagtcggggcagttctttccggttttctggccgcacgcaaaaacaggtcctggactacgttaaggagggtgggcacaagaaagttcagttcgaaaggaagcactcaaagatccactctattcgctctctcgctagccaacccacagaactgaactccgaagtcctggagcaaagccaacagtccacaagcctcactttcggagaaggagcggagagccctggcggccagtcatgtagacgcggaaaagagcctaaagtgtccgcgggagagccgggatctcatccctcaccagctccgcgaaggtccccggccggaaacaaacaggccgacggtgctgcaagcgcacccacagaagaagaggaggaggtcgtaaaagaccggacacagcagagtaagccccagccaccacagccatccaccggatcccttacgggcagcccccatctgtcggagctcagtgtgaactcacaaggcggggtggctcccgcaaacgtaacactctccccaaacctgagcccagatacaaaacaggcttccccattgatttccccacttctgaatgatcaggcatgtcccaggaccgacgatgaagacgaggggcgccggaagcgtttccctactgacaaagcttactttattgccaaagaggtctccacaacagaacgcacctatcttaaggatcttgaggttattaccagctggtttcagtcaaccgtttctaaggaggacgctatgccagaagcactcaagtcattaatattcccaaatttcgaaccactccacaaatttcataccaactttctcaaggaaattgaacagcgcctggccttgtgggaaggtcgctcaaacgcccagataagggactaccagcggattggggatgtcatgctcaaaaacatccagggaatgaagcatctggccgcgcacctatggaagcatagcgaggctctcgaggcgctagaaaacggaatcaagagctcccgtagactagaaaacttttgccgtgactttgagctgcaaaaggtgtgctacctgccactgaatacgttcctgcttcggcctctccaccgcctgatgcactataagcaggtacttgaacgattgtgtaaacaccatcccccttcgcacgccgacttccgcgactgccgggcagcattggcagagattaccgagatggtagcccagctgcatggcacaatgatcaaaatggaaaatttccagaagctccatgaactgaaaaaggacctgataggcatagataacctcgttgttcccggtcgcccaggatcattttctctaatcaggactcctcatctaggccaagcaaggcgaattccctgcgctccggagcggagaccactactactggttaaggagtttatccgactggggagcctgagcaagctctctgggaaaggactgcagcagagaatgttttttctcttcaacgacgtactgctctatacaagccggggactgaccgcgtcaaaccaatttaaagtccatgggcagctgccgctttatgggatgacgatcgaagaaagtgaagatgagtggggagtgccccattgcttgacactccggggtcagcgtcagtcgattatcgtggccgctagcagccggtcagaaatggagaagtgggtcgaagatattcagatggccattgacctcgcagagaaatccagctctccagcaccagagttcctcgcttccagcccccctgacaacaaatcccctgatgaggcaaccgccgccgaccaggagtctgaggacgacctgagcgcttcacgcacatctcttgagaggcaagcaccccaccgggggaacactatggtacacgtgtgttggcatcgtaatacttcagtctcgatggtcgacttttctattgccgtggagaatcagctgtctggcaacttgctgagaaagttcaagaactctaatgggtggcagaaattgtgggtggtcttcaccaacttctgtctgttcttctataagtctcaccaagataaccacccactggcctcattgccactcctcggatattctctgaccatccctagcgagtcagagaatatccaaaaggattatgtctttaaactgcatttcaaatcgcacgtgtattacttccgagcggagtctgagtacacctttgagaggtggatggaagtgattcgaagtgcaacatctagtgccagccgccctcacgtactgagtcacaaggagtccctggtctactag

SEQ ID NO: 42305 - DNA, 462 bp, Artificial Sequence
  Description of Artificial Sequence: Synthetic coding sequence
tgactgtgcaagcaccacccccccagccacgccgacttccgggactgccgagccgcactggccgaaatcacagagatggtggcccagttgcacggcaccatgataaaaatggagaatttccagaagttacatgaattgaaaaaggacttaatcggaattgacaatctcgttgttccaggacgcgtgagctcctcaggactgactatgcactgcgctggtagtagaaaggaagcctccgaaggcctgactttcgaacctttcgaggagcgaccccttcagtcgaaaatgagtagtttccaccccccaggccgacaattagaaaagcacaattctgtcgtctcctcagaatccctgtgctcagaagaaatcaaacagagctcagaccttatcttctgcttctttagcctcagaggagactcccttctttacttgttcccttaccatatcccacaaaagatttag

SEQ ID NO: 42306 - DNA, 555 bp, Artificial Sequence
  Description of Artificial Sequence: Synthetic coding sequence
tgaagcctgaccggcagcccccacctgagcgagctgagcgtgaacagccaggggggagtcgccccggccaacgtgaccctgtctcctaacttgtcgccggacacaaagcaggcttctcccctaatcagcccactgctgaatgaccaggcatgtccaaggactgatgatgaggacgagggaagaaggaagaggtttccgacagataaggcatattttatagctaaagaggttagtactacggagcgcacctatttaaaggatctcgaggttatcaccagttggtttcagtcaacggttagtaaagaagacgctatgcctgaggcccttaagagtctgatttttccaaatttcgaacccctccacaagtttcacacaaacttcttgaaagaaattgaacagaggctggccctgtgggagggccgttccaatgcgcagattagggactaccagcggattggtgatgtcatgcttaagaatattcaagggatgaaggctggcgtccagtggcgggacctcggatctctacagcccccacctcctaggtttaagccatag

SEQ ID NO: 42307 - DNA, 3165 bp, Artificial Sequence
  Description of Artificial Sequence: Synthetic coding sequence
atgggcgagatcgagggcacctaccgggtgctgcagaccgccggcatgaggcttggggcacaaactcctgtaggcgtcagcactcttgagccaggccagactctccttccgagaatgcaggaaaaacatcttcatctcagggtgaagcttttggataacacaatggagatttttgatatcgaaccaaaatgcgatggccaggtcctgctcacacaggtttggaaacgactgaacctcgtggaatgtgactacttcggaatggaatttcagaacactcaatcgtattggatttggctggagcccatgaaacctatcatccggcagataaggcggcccaagaatgtagtcctgcgcctggcagtgaaattcttccccccagaccccggtcagctccaagaggagtatacccgttatctctttgctcttcaacttaaaagggacttattagaagagcggctgacctgtgcagataccaccgccgcattgctgactagccacctactccaatcagaaatcggggactacgatgagaccttggaccgcgaacacctgaaggtgaacgagtatctgcctggacagcagcattgtctggagaaaattctggagtttcatcagaagcacgtgggacagacgcctgcggaatcagacttccaagtgttggagatagccagaaaattggaaatgtatggcatccgctttcacatggctagtgatagggaagggacaaagatccaacttgctgtgagtcatatgggagttctggtgtttcagggcactaccaagataaacacgttcaactggagtaaggtgcgaaagctgagcttcaaacgtaaaaggtttctcataaaattgcacccggaggtccatggtccataccaggatacactcgaattcctgttaggttccagggacgagtgcaagaacttctggaaaatttgtgtcgaatatcacacattcttcaggcttctggatcagcctaagcccaaagccaaagctgtattcttttctcgaggcagcagcttccggtactccggtaggacccagaagcagttagttgactacttcaaggacagcggaatgaaacgtattccatatgagagacgccattctaagacccacacatcagtgcgggccctcacagcagacttgcccaagcaaagcatatctttccctgagggactgcggactcctgcttccccttcaagtgccaacgctttttactcactatccccgtctacactggtgccatctgggctgcccgagtttaaggattcatccagctcacttaccgacccccaggtgagctacgttaagtccccagcggcagaacggcgatccggcgccgtagccggcggaccagatacaccatctgcacagcctctaggcccccccgctttacagccaggtccagggttaagtactaagtctccccaacccagcccttcatcccgaaagtccccactcagtctgagtcccgcattccaggtccccttaggaccagcggagcaaggctccagtccactgctctctcctgtgctatccgacgcaggcggtgcaggaatggactgcgaagagccccggcataagagggtgcccgctgacgaagcgtacttcattgtgaaggagatcctggcaactgagaggacatacctgaaggacctcgaggtgataactgtttggtttaggagcgcagtggtgaaggaagatgccatgccagcaactctgatgaccctgctttttagtaacattgatcccatatatgagtttcaccgaggttttcttcgagaggtagagcagaggctggcgctgtgggaaggaccgtccaaggcccatacaaaaggatcccaccaacgcattggggatatcttgcttcgcaacatgagacagctgaaagagtttacatcttattttcagaggcatgacgaagtgctgacagagctggaaaaagctactaagcggtgtaagaaattagaagctgtgtacaaggaatttgagcttcagaaagtctgctacctgccattaaacacctttcttctcaaacctatccagcggctgctacactaccggttgcttctgcggagattgtgtggccattacagtccaggccaccatgactacgctgattgccacgatgctcttaaagctataacagaggtgacgaccacacttcaacacattctgatcaggctcgagaatttgcagaaactgaccgaactacagcgggatctcgtcggtattgagaacctgatcgctccagggagggaattcatcagagaaggatgcctgcacaagctcacaaagaagggactgcagcagcgaatgtttttcctgtttagcgacatgctcctttatacctccaaaggagtcgccgggacatctcactttcgcatacgcgggctgctgccactccagggtatgcttgtagaagaaagtgacaatgagtggtcagtgccccactgctttacaatctatgccgctcagaagaccatagtggtcgcggcttctacccggctggagaaggagaagtggatgctcgacctaaatagcgcaatccaagctgccaaatctggaggcgatacagctcccgccctgccgggacgcacagtctgcacacggccaccaagatcaccaaatgaggtctcattggaacaagaaagcgaagatgacgctcgtggagtgcgttctagccttgaagggcatggtcagcaccgagccaacaccaccatgcatgtctgctggtaccggaacacctccgtgtctcgcgcggatcactccgctgccgttgagaatcagttgagtgggtacttactgcgaaaatttaaaaattctcatggatggcagaagctgtgggtagtctttaccaacttctgtctttttttttataagacacatcaggacgattaccctctcgcaagtcttccgctgttgggctacagcgtgagcattccgagggaagcagatgggattcacaaggactacgtgtttaagctgcagttcaagagtcatgtttacttctttcgcgccgagagtaagtacactttcgagcggtggatggaggtgattcagggagcaagttctagtgcagggagagcgccctcaattgtgcaggatggccctcagcctagcagtggcctggagggtatggtccgggggaaagaggaatag

SEQ ID NO: 42308 - DNA, 1944 bp, Artificial Sequence
  Description of Artificial Sequence: Synthetic coding sequence
atgggcgagatcgagggcacctaccgggtgctgcagaccgccggcatgcgtttgggagctcagacccctgtgggggtcagcaccctggagcctggccaaactttgctgcctcgtatgcaggagaagcatcttcatctccgcgtgaagcttttagacaataccatggagatcttcgacatcgaaccaaaatgtgatggccaggtgctgctcacccaggtctggaaacgactgaatctagtggagtgcgactatttcggtatggagttccaaaacacacagagttactggatatggctggaacctatgaaacctatcatccgccagatccgccggcctaagaacgttgtgctgaggctggccgtgaagttcttcccacccgaccccggccaactgcaggaagagtacaccaggtacttattcgctctgcagttgaaacgcgacctgctggaggagaggcttacctgtgccgataccactgccgcgctcctgacgagccacctgctgcagagcgagatcggagactatgatgaaactctcgaccgtgaacacctaaaggttaatgaatacctccccgggcagcagcactgcctggaaaaaatccttgaattccaccagaagcacgtaggtcaaacgccggccgagtccgatttccaggttctggagattgcgagaaagttggaaatgtacggtattcgatttcatatggcctctgatcgcgaggggactaagattcagctagccgtgagtcacatgggcgttctcgtgtttcagggaaccacaaaaatcaatacatttaactggagcaaggtgagaaagctctcatttaagcgcaaacggtttctcatcaaattgcatccggaggtacacggcccttaccaggacactctagaatttcttctcgggtccagagatgagtgcaagaatttctggaaaatctgcgtagagtaccacaccttcttcagactcctggaccagccgaaacctaaggcgaaagccgtcttcttctcccggggcagctcttttaggtacagcggtcgcacccagaagcagctcgtcgattacttcaaggattcaggcatgaagaggatcccatatgagagaaggcatagcaagacacataccagtgtgcgagccctcaccgccgatttgcctaagcaaagtatctcgttccccgaaggcctgcggactcccgcttcccccagttccgccaatgccttttattctctgagtccgagcactctggtgccatccggacttcccgaattcaaggatagttcttccagtctcacagaccctcaggtgagttatgttaagtcccctgcagctgaaagacgttcaggcgcagtggcaggcgggccagacactcccagcgcacagcctttaggaccacccgcactgcagcctggacccggtttgtccactaaatccccgcagcccagtccatcttcgcggaaatcccccctctctctctcacccgccttccaagtgccactgggccccgctgaacaaggtagctccccattactgtcacccgtgctttcagatgccgggggcgccggtatggattgcgaggaaccaaggcacaaaagagtgccagccgatgaggcctattttattgtgaaggagatcctcgcaacagagagaacataccttaaggacctggaggttattaccgtctggttccggagtgcagtcgtcaaggaagacgccatgcccgccacacttatgacgctgctcttctccaacattgatccgatatatgaatttcaccgtggcttcctacgcgaagtggaacagcgcctagccctctgggagggaccttcaaaggcacacacgaaggggtcccatcaaaggataggtgatatactgctgaggaacatgagacagttgaaagtgtttcaactgcacgagggacatgtcgccggcgtcacgaaaatggagtag

SEQ ID NO: 42309 - DNA, 171 bp, Artificial Sequence
  Description of Artificial Sequence: Synthetic coding sequence
tgaaagagccacgtgtacttcttccgggccgagagcaagtacaccttcgagcgatggatggaagtgatccaaggggcctcttcctcagccggccgcgcaccctcaatagttcaggatggcccacagccttctagtggcctcgaagggatggttaggggcaaggaggaatag

SEQ ID NO: 42310 - DNA, 405 bp, Artificial Sequence
  Description of Artificial Sequence: Synthetic coding sequence
atgggcgagatcgagggcacctaccgggtgctgcagaccgccggcatgcggttgggcgcacagacacctgtcggagtgagtacactggagcctggtcagacactcctacctaggatgcaggagaagcatcttcacctgagggtaaagcttttagataacactatggaaatcttcgacattgaacctaagtgtgacggacaggtgctactgacccaagtttggaagcgccttaatctggtagagtgcgactatttcggaatggaatttcaaaatacccagtcttattggatctggcttgaaccaatgaaacccataatcagacaaatcaggaggcccaagaacgtagtgcttagactggcggtgaagttctttcccccagaccccgggcagctgcaggaagagtag

SEQ ID NO: 42311 - DNA, 282 bp, Artificial Sequence
  Description of Artificial Sequence: Synthetic coding sequence
atgggcgagatcgagggcacctaccgggtgctgcagaccgccggcatgagactgggtgcccagactccagtgggtgtaagcactctggaaccaggccagaccctgcttccaagaatgcaggagaagcacctacacctgcgcgtgaaactgctagataacacaatggaaatcttcgacattgagccaaagtgcgatggccaagtcctgctgacccaggtctggaagaggcttaacttagtggagtgcgactatttcgggatggagtttcagaacacgcagtag

SEQ ID NO: 42312 - DNA, 1917 bp, Artificial Sequence
  Description of Artificial Sequence: Synthetic coding sequence
atgggcgagatcgagggcacctaccgggtgctgcagaccgccggcatgagattgggtgcccagacacctgtgggagtttcaactctggagcccggccagaccctactacctaggatgcaggaaaaacacctccacctgcgggtgaagctgctggataacactatggagattttcgatatagagcccaaatgcgacggccaagtgcttctcacacaggtgtggaaaaggcttaacctcgtggagtgtgattatttcggcatggagtttcaaaatacacaaagctactggatctggctggagccaatgaaacctatcatccgccaaatccgacgtccaaagaatgtggttctgagattggccgtcaagtttttcccccccgatccagggcagctccaggaggagtacacacggtaccttttcgctctccagttaaagcgggacctgctagaggagaggcttacctgcgctgatacaactgctgctcttcttactagccacctccttcagagcgaaattggggactatgacgagaccctggatagagaacatctcaaggtcaacgaataccttcccggacagcagcactgcttagagaagattctggagttccatcaaaaacacgttggccagacgcccgctgagtcagacttccaggttctggaaattgcccgcaagttggaaatgtatggcattagatttcacatggccagcgacagggagggcaccaagatacagttggcggtgagtcacatgggagttctcgtctttcaggggaccactaagattaacaccttcaattggagcaaagtgcgcaagcttagctttaagcggaagagattcttgattaagctgcatcccgaagtgcacggtccataccaggacactttggagtttctgcttgggtcaagggatgagtgtaaaaacttctggaagatctgcgtggagtatcataccttttttaggctgttagatcagccaaaacccaaggccaaggcagtatttttcagtcgcggatcgtcattccggtattctgggagaacgcaaaaacagctcgtggattatttcaaggactctggcatgaagcgcataccctacgaacgacgccactccaagactcatacctctgtcagggcactgacagccgatttgcctaagcaatccatttcctttccagagggtttaagaacccccgcttctccttctagcgccaacgcgttttactccctaagcccctcaaccctcgtaccttccggcctacccgaattcaaagacagctcctcctccttaaccgatccccaggtgtcatacgtgaagagccccgccgccgaacgcagaagcggcgccgtcgccggcgggcccgatacacctagcgcccagccacttggccccccagcactgcaacctggacctgggctgagcactaagagccctcagccctccccttcatcaagaaaatccccgctatctttatccccagccttccaggtccccctagggcccgctgaacaaggctctagccccttactcagtccagtgctgagtgacgccgggggagcggggatggactgtgaagagccccgccacaagcgcgtccccgccgatgaggcttattttatcgttaaagagattttggctacagaacgaacatatctgaaagacctggaggttataactgtctggttccgatcagcagtcgtgaaggaagatgcaatgcctgccactttgatgacactcctgttctcaaacatcgatcctatatatgagtttcatagagggtttctacgggaagtggaacagcgtttggccctgtgggaggggccatctaaagcccacacaaaggggtcacatcaaagaataggggacatactcctgaggaatatgagacagctgaaagcagctcatgaatttactacatag

SEQ ID NO: 42313 - DNA, 1155 bp, Artificial Sequence
  Description of Artificial Sequence: Synthetic coding sequence
atggccgcccagaacggcaacaccagcttcacccccaacttcaaccctcctcaggatcatgcctcttccctctcttttaatttcagctatggggactacgatctccccatggacgaagacgaggatatgaccaaaacccggacatttttcgctgccaaaatagtcataggaatcgcactcgccggcataatgctcgtatgcggcattggcaacttcgtatttatcgcggccctgacacgctacaagaaacttaggaatctgactaacctgctaatcgccaacctagccatatctgactttcttgtagccatcatttgctgtccatttgaaatggattactatgtggttcgacaactgtcatgggaacacggccatgtgttatgcgcttccgtgaattacctcagaactgtgtcgctgtatgtctccactaatgccctgctggctattgccatcgacagatatctggcaatcgtgcatccacttaagcctagaatgaactatcagaccgcttcgttcctcatcgccctggtctggatggtgagcatactgattgcgatcccctcagcctattttgccaccgaaactgttctgttcatcgttaagagtcaggagaaaattttttgcgggcagatatggcctgtggatcagcagctgtattacaagagctactttctgtttatcttcggggttgagtttgtaggcccagttgtaaccatgacgctttgttacgcacgaatttcccgcgagctgtggtttaaagccgtcccgggtttccagactgagcagattagaaaacggctgagatgcagaagaaaaaccgtcctggtcttgatgtgcatactgacggcctatgtgctctgttgggccccattttacggtttcactatcgtgcgcgactttttcccaaccgtttttgtgaaggagaagcattatcttacggcgttttacgtcgtggagtgtatcgccatgagcaatagtatgatcaacacagtttgtttcgtcacagtcaagaataatacaatgaagtatttcaaaaaaatgatgcttctgcattggcgccctagccagcggggctccaagagctctgcagacctggatctgcgtactaacggtgtcccaaccactgaagaggtcgactgtatccggctcaagtag

SEQ ID NO: 42314 - DNA, 1668 bp, Artificial Sequence
  Description of Artificial Sequence: Synthetic coding sequence
atgctgagcagcaccgacttcaccttcgccagctgggagctggtggtgagggttgaccaccccaacgaagagcaacaaaaagatgtcaccctgagggtgtcgggagatcttcatgtgggcggagtcatgctcaagcttgtggaacagattaacatttcgcaagattggtcggatttcgcactgtggtgggagcagaagcattgttggctgctgaagactcactggactctcgataaatacggggtacaggctgacgctaagctgctgttcacaccccagcataaaatgcttaggctgcggttgccaaatcttaagatggtgaggctgcgcgtttctttttcagctgtggtcttcaaagccgtctctgacatttgtaagattctcaacatcagaagatctgaggagctgtctctcctaaagccgtctggcgactactttaaaaagaaaaagaagaaagataagaacaacaaagagccaatcatcgaggatatcctgaacctggagagcagccctaccgcatccgggagctcagtctcccccggcctgtacagcaaaacgatgacccctatctacgatcccatcaacggcaccccagcatcaagcacgatgacctggttctcagattcgccactgaccgagcagaattgcagcatcctggccttttcacagccccctcagtcgcccgaggctctggccgatatgtaccagccccgatctctcgtggacaaggcgaagttaaatgcaggatggttggatagttcaaggtcccttatggaacaaggtattcaagaggatgagcaactgcttctacgcttcaaatattacagcttcttcgacctgaaccccaagtatgatgccgtgagaatcaaccagttatatgagcaggcccggtgggccatactccttgaagagatcgattgtaccgaagaggagatgctaatcttcgcagcgttacaataccacatcagtaagctgtccttgagcgctgaaacacaggacttcgccggcgagagtgaagtcgatgaaattgaggccgccttgtcaaacttggaagtcaccctggagggaggcaaagccgacagcctgctggaggacataaccgatataccgaagctggcggacaaccttaaactctttcggcccaaaaaactcctgcccaaagcattcaaacagtattggtttatctttaaggatacctcaatcgcgtacttcaaaaataaagagctggaacagggcgagcctctggaaaaacttaatttgcggggctgcgaagtcgtgcctgatgtcaacgtagcaggccgcaaatttgggatcaaactattgattcccgtcgctgatggtatgaacgaaatgtacttgcgctgcgatcacgaaaatcagtacgcccagtggatggcggcatgtatgcttgcctctaaggggaaaactatggccgactcgagttatcagccggaagtgctcaatattctgtcttttctgcggatgaagaacagaaattcagccagccaggttgccagctcgctcgagaacatggacatgaaccccgagtgtttcgtttcgcccagatgcgctaaacggcataaatctaagcagctggcagcaaggatactggaagcacaccacctgcaggctccttttcattcttaccgcagcttgtcccatttatag

SEQ ID NO: 42315 - DNA, 441 bp, Artificial Sequence
  Description of Artificial Sequence: Synthetic coding sequence
atgctgagcagcaccgacttcaccttcgccagctgggagctggtggtgagggtcgatcaccccaatgaggaacaacagaaggatgtgacactaagagtatctggtgacctgcatgttggcggagtaatgctgaagctcgtggagcaaattaacatctcacaagactggagtgattttgccttatggtgggagcaaaagcattgttggttactgaagacccactggacactcgataaatatggagtccaagccgacgccaagctcctgttcacaccgcaacataaaatgctgcgtctgcgtctgcctaatttaaaaatggtcagactacgcgtcagcttttccgccgtagtgtttaaggctgtgtctgatatctgcaagatcctgaacatccgcagaagcgaggaactctcccttttgaaaccctctggggactacttttag

SEQ ID NO: 42316 - DNA, 1263 bp, Artificial Sequence
  Description of Artificial Sequence: Synthetic coding sequence
atggagcagggcatccaggaggacgagcagctgctgctgcggttcaaatattattcattctttgatctcaatccaaagtacgacgccgttagaatcaaccaactctatgagcaggcccggtgggcgattctgctcgaagaaattgattgcacggaggaagagatgctgatcttcgcagcactgcagtatcatatctcaaagctctcgctcagtgcagagacccaggattttgcaggggagagtgaggttgacgagatcgaagctgctttgtcaaacctggaagtaacactagagggtgggaaggcagacagcttactggaggatatcacagatattcccaaactggcagataacctgaaactattccgccccaagaagctcctgcccaaggccttcaagcagtactggtttatcttcaaggacacatccatcgcttattttaaaaacaaggaactcgagcagggcgaacccctggaaaagcttaacctgaggggatgtgaggtcgttcccgacgtgaacgtagcgggccgtaaattcggaatcaagctgctcatccccgtcgccgatggcatgaatgagatgtacttgaggtgtgaccatgaaaatcagtacgcacagtggatggccgcctgtatgctggccagcaaaggcaagacgatggcagacagtagttaccaacccgaggttctgaacatcttgtcgttccttcggatgaagaatcggaacagtgcttcccaggtagctagttctcttgagaacatggacatgaaccccgagtgtttcgtgagtcctagatgcgcaaagcgtcacaagagcaagcagttagccgctcggattctggaggcgcaccaaaacgtagcccagatgcctctggtggaggcgaaactgagattcatccaagcctggcagagcctgccagagttcgggctgacctactatctagtcagatttaagggtagcaagaaggacgacatcttaggcgtttcatataacagacttattaaaatcgacgccgccactggtatcccagtgacaacttggcggtttactaatatcaagcagtggaatgtgaactgggaaacacgccaggtagtgatcgaattcgatcagaacgtgttcactgctttcacatgcctatcggctgactgtaagattgtgcacgagtacattggagggtacatctttctgagcactaggtctaaggaccagaatgagacgcttgatgaggatctctttcacaagctgaccggaggccaggactag

SEQ ID NO: 42317 - DNA, 552 bp, Artificial Sequence
  Description of Artificial Sequence: Synthetic coding sequence
atggccgccagcatggcccggggcggcgtgagcgcccgggtgctgcttcaggccgctcgaggaacatggtggaaccggccaggcggcaccagcggctccggcgagggcgtcgctctgggcactacccgaaagtttcaagcgacaggctctcggccagctggcgaggaagatgccggagggcctgagcgtcctggggacgttgtcaacgtagtatttgtcgaccggagtggccagcggatccccgtgtctgggcgtgtgggtgataacgtcctacacctcgcacagcgtcacggagttgatttagagggcgcttgcgaggcatctctggcgtgttcaacttgccacgtctacgtgagcgaggatcacctggacctcctgcctccacccgaggaacgggaagatgacatgctggacatggcccccttactgcaggagaattctcgtctcggctgtcaaatcgttctgacaccagaactggagggagccgaatttaccttgcccaaaatcactagaaatttttatgtggacggtcacgttcctaaaccgcattag

SEQ ID NO: 42318 - DNA, 438 bp, Artificial Sequence
  Description of Artificial Sequence: Synthetic coding sequence
atgcacgtgatggccgccagcatggcccggggcggcgtgagcgccagagtgctgctccaggccgcccgaggcacgtggtggaaccgccccgggggtacctcaggttccggggaaggagtggcactcggaactactcggaagtttcaagcgacggggtctcgacccgcgggagaggaggacgctggtgggcctgagcgaccaggggatgtggtgaatgtggttttcgtagacaggtctggccagagaatacccgtgtctgggagagtgggcgacaacgttctgcatctagcacaacgccatggcgtggacctcgaaggagcctgcgaagccagcctcgcctgttcgacttgccacgtgtacgtctctgaggatcatttggatttgctgcccccgccagaggaacgcaggacacggggctgggcggcccggctgtgctag

SEQ ID NO: 42319 - DNA, 552 bp, Artificial Sequence
  Description of Artificial Sequence: Synthetic coding sequence
atggccggcggcccccccaacaccaaggccgagatggagatgagcctggcggaagaactgaaccacgggcggcaaggcgaaaaccaagagcacttagttatcgccgaaatgatggaactcggaagcagaagcagaggcgccagtcagaaaaagcagaaacttgagcagaaagcggccgggtccgcctccgctaaacgcgtgtggaatatgaccgccacacggccaaagaagatggggtctcagctgccaaagcccagaatgctcagagagagtggccacggtgacgcccacttgcaggagtatgcaggcaatttccagggaatcagatttcactacgacaggaatcccgggactgacgctgtcgctcagactagccttgaagaatttaacgtgctggaaatggaagtgatgcgacgccagctttacgcagtgaaccgccgtctgagagccctcgaagaacagggtgcaacttggcggcatcgcgagaccctgattatcgctgtgctcgtgagcgcgtccatagctaacctctggctgtggatgaatcagtag

SEQ ID NO: 42320 - DNA, 1527 bp, Artificial Sequence
  Description of Artificial Sequence: Synthetic coding sequence
atgggcagctgctgcagctgccccgacaaggacaccgtgcccgacaaccataggaacaagttcaaggtgattaatgtagatgatgatggaaacgagctcgggtcaggtattatggaactaactgatactgagcttatcctttatactaggaaacgtgattcagtgaaatggcattacctctgtctgcgccgctacggctatgactcaaacctcttttcgttcgaatccgggaggcggtgccagaccgggcaaggtattttcgcttttaaatgcgcaagagccgaagagttgttcaacatgctccaggaaatcatgcaaaataattccatcaacgtggttgaggagcccgtcgtcgaaagaaacaaccatcagacagagttggaggtcccacggacccctagaaccccgacaactcctggctttgccgctcagaacctgcccaacgggtacccgcgatatccctccttcggggatgcatcaagccaccccagttcacgtcacccttcagtcggcagcgcccgcctgcccagtgtgggcgaggagtccacacatcctctgctcgtcgccgaggaacaggttcacacttatgtcaacaccacaggggttcaggaggagagaaagaataggacaagcgtccacgttccattagaggccagggtgtctaatgccgagagctcaacaccaaaggaagaaccctcatctatcgaggatagagatcctcagattttacttgaaccagagggcgtcaagtttgtcctcggtcccacaccagtccagaagcagctgatggagaaggagaagctcgagcagttgggaagggaccaggtgtcaggctcaggcgctaataataccgagtgggacactggctatgactcagacgaacgacgcgacgctcctagtgtgaacaaactggtgtacgagaatattaatggactttctattccaagcgcatctggcgtaaggagaggtcgcctcacatctacgtccacttcagatacacagaatattaataatagcgcacagcgcaggactgcactcctgaattacgagaacctgcccagtctcccacctgtgtgggaggctaggaagttgtctcgcgatgaagacgacaacctggggccaaaaaccccttccctgaacgggtatcataacaatctcgatcccatgcacaattatgtgaatactgagaatgtgaccgtccccgccagcgcccacaaaatagaatatagtagacggcgcgattgtacccccacggtctttaactttgacatccgaagaccttcactggagcaccgccagctcaactacatccaagtggatctcgagggaggatccgactcagataacccgcaaaccccaaagaccccaaccacccccctgccccaaacgcctacccggagaactgagttatacgccgttattgacatcgagcgaaccgccgcaatgtcaaatctgcagaaagccttgccacgagatgacggcacctcccgcaagacgcgtcacaactccactgatttaccgatgtag

SEQ ID NO: 42321 - DNA, 1527 bp, Artificial Sequence
  Description of Artificial Sequence: Synthetic coding sequence
atgggcagctgctgcagctgccccgacaaggacaccgtgcccgacaatcaccggaataagttcaaagtgattaatgtggacgatgatgggaacgagttaggcagtggcattatggagctcaccgatactgagcttatcctctatacccgaaaaagagactctgtcaaatggcattatctgtgtttaagacgctatggatacgatagtaacctgttctccttcgagtctggacgccggtgccagacaggacagggaatcttcgcgttcaaatgcgcacgagccgaagaattgttcaacatgctccaggagataatgcagaacaactcaatcaacgttgtggaggaacccgtggtggagcgaaacaaccaccaaacggaacttgaggtgcccaggacccctcgcaccccaaccacacccggatttgccgcacaaaacttgccgaacgggtatcctcgctatccgtccttcggcgatgcttcctcacacccatcgagtcgacacccttcagtgggatccgcccgccttccttccgtgggcgaggagagcacccatccactgctcgttgcggaagaacaggtgcatacttacgtgaatacaacgggcgtccaagaagaaagaaagaaccggacatccgttcacgtgcccttagaagcccgcgtgtccaatgcagagagcagtacccccaaagaggaaccgtccagcattgaggacagagacccacagatcctgctggagccagaaggcgttaagtttgtcctaggaccgacccccgtccaaaaacagctgatggaaaaggagaagctggaacagttggggcgcgatcaggtatcaggcagtggcgcaaacaacacagaatgggacacaggatacgacagtgacgagagacgtgatgcaccatccgtgaacaagcttgtttatgagaatatcaacggcctgagtatcccgtctgccagcggtgtaagaagggggagactgaccagtacaagcacatctgacactcagaacattaataactccgcccagcggcgtaccgctttgctgaattatgagaatcttccatcattaccccctgtctgggaagctcgaaagctgtcacgcgacgaggacgacaacctgggtccaaaaaccccatcgctcaacggttaccataacaatctggaccccatgcataattacgttaacaccgagaatgtaacagttcctgcatctgcccacaaaatcgaatattcccgtaggcgggattgtactccgactgtgtttaattttgatattaggcgaccctcactggagcatcgacagctgaattatatccaggtcgatctcgagggggggtccgatagcgataacccccagacacccaaaactcctaccacaccactccctcagacaccaactcggcggactgaactgtacgcggtgattgacatagaaaggaccgccgccatgtctaatttacagaaagccctgccccgtgatgatggaactagtaggaagacacggcataacagtacagatctacccatgtag

SEQ ID NO: 42322 - DNA, 111 bp, Artificial Sequence
  Description of Artificial Sequence: Synthetic coding sequence
atgggcagctgctgcagctgccccgacaaggacaccgtgcccgacaaccatcgcaataagttcaaggtaatcaatgttgatgatgatggcaatgagctgggatccggctag

SEQ ID NO: 42323 - DNA, 123 bp, Artificial Sequence
  Description of Artificial Sequence: Synthetic coding sequence
atgggcagctgctgcagctgccccgacaaggacaccgtgcccgacaaccaccggaacaaatttaaagtcatcaacgttgatgacgacggcaatgaacttggatctggcatcatggagttgtag

SEQ ID NO: 42324 - DNA, 102 bp, Artificial Sequence
  Description of Artificial Sequence: Synthetic coding sequence
atgggcagctgctgcagctgccccgacaaggacaccgtgcccgacaaccatcgcaataagttcaaggtcattaatgtggatgacgacgggaacgaactctag

SEQ ID NO: 42325 - DNA, 1527 bp, Artificial Sequence
  Description of Artificial Sequence: Synthetic coding sequence
atgggcagctgctgcagctgccccgacaaggacaccgtgcccgacaaccaccggaacaagttcaaagttataaacgtcgacgacgatggaaatgagcttggctctgggatcatggaactgactgacaccgaactgatcctgtacaccaggaagcgggatagcgtgaagtggcactatctttgtctgagacgatacggctacgactcgaatctgttctcattcgagtcaggaagaaggtgtcaaacgggacaggggatctttgccttcaaatgtgccagagctgaggagcttttcaacatgcttcaggaaatcatgcagaacaactccattaatgtagtggaagaacctgtggtggaaagaaataaccatcagactgaactagaggtgccaaggacgccacgaacacctactacccctggtttcgcagcacagaaccttcctaatggctatccacgctatccctcattcggtgacgctagttcccaccccagttccagacacccaagcgtgggctccgcaaggttaccctccgtgggggaggagtcgacccaccctcttttggtcgccgaggagcaagtccacacctacgttaacacgacaggggtgcaggaggagaggaagaaccgcacctccgtgcacgttccactggaggcccgggtttctaatgcagaaagtagcactcctaaggaggagccatcgtctatcgaagatcgagacccacagattctcctggaaccagagggtgttaagttcgtgttgggtccgacaccagtgcagaaacagttaatggagaaagagaagctggagcagttgggacgcgatcaggtgtccggaagcggtgccaataacaccgagtgggacactggatacgactccgatgagcggcgggatgcccccagcgttaacaaactggtatatgaaaatatcaatggtttgagcattccaagtgcctccggagtgcgacgcggacggctgacttccacgagcacatccgatactcagaacattaacaactcagcgcagagacgaaccgcactcctgaactacgagaacctgccatcactgccccctgtctgggaagcgagaaaactgagccgtgacgaagacgataacctggggcctaagactcctagccttaacgggtatcacaacaatttagatcctatgcacaattatgtgaacacggagaacgttacagtcccggcaagtgcccataaaatagaatactcccgccgacgcgattgcactccaacagtcttcaattttgatatacggcgcccctctcttgagcaccggcagctaaactatatccaggttgacttggaagggggatcagactctgacaacccccaaacaccaaagacacccacaactcctctgccacaaacacccacacgcaggactgagctttatgccgtcattgacattgaacggacggcagctatgtccaaccttcaaaaagcccttccccgggacgatgggactagccggaaaacccggcacaattctaccgacttgccaatgtag

SEQ ID NO: 42326 - DNA, 33 bp, Artificial Sequence; identical to SEQ ID NO: 18362
  Description of Artificial Sequence: Synthetic coding sequence

SEQ ID NO: 42327 - DNA, 39 bp, Artificial Sequence; identical to SEQ ID NO: 18363
  Description of Artificial Sequence: Synthetic coding sequence

SEQ ID NO: 42328 - DNA, 1527 bp, Artificial Sequence
  Description of Artificial Sequence: Synthetic coding sequence
atgggcagctgctgcagctgccccgacaaggacaccgtgcccgacaatcaccgtaataagttcaaggtcatcaatgtcgatgatgacggtaacgaactgggcagcggaatcatggagctcacagataccgagttgatcttgtacacccgtaagcgagattctgtgaagtggcattatctgtgcctgcgccggtacggctatgactcaaacctgtttagctttgagtcaggccgacggtgccagactgggcagggaattttcgctttcaagtgcgccagagccgaggaactattcaacatgcttcaggagatcatgcagaacaatagtatcaatgtcgttgaagagccagtagttgagcgcaacaaccatcaaacggaactcgaagtgccccgaacgccccggacacctacaacgccaggcttcgcagcgcagaacctgcccaacgggtatcctcggtacccaagcttcggtgatgcttcctcgcacccatccagccgacacccttcggtaggaagcgcccgcctcccatctgttggtgaggagagtacacaccctctgctcgtggcggaagagcaggttcacacctatgtaaatacaaccggggtgcaggaagagcggaagaaccggacttctgtccacgtgccactggaggctcgggtctccaatgctgagagctcaacccctaaagaggaaccctcttctatagaggacagggatcctcagatcctgctggagcctgagggagtcaagtttgtgttgggcccaacaccagtgcagaagcagctgatggaaaaggaaaaactggaacagctagggcgcgaccaagtgtcggggagtggcgcaaataacactgagtgggacaccggctacgactccgacgaacgacgggacgctccgagcgttaataagctggtctatgagaatatcaacggtctgtccataccaagtgcttccggggtgagacgtgggaggctcaccagcacctcaacctcagatacccagaatattaacaactccgcccagagaaggaccgcactgctgaactatgagaacctcccaagtctcccacccgtgtgggaggcacgcaagctgagtcgtgatgaggatgacaacctgggacccaaaaccccgtctcttaatgggtaccataataacttggacccgatgcacaattatgtgaacaccgaaaatgttactgtgcctgcctctgcgcataagatcgaatactcaagacggagagactgtacacccaccgtgttcaacttcgatattaggcgacccagcttggaacatcgccagttgaactatatccaggtggatcttgagggcggatccgactccgacaatccgcagacacccaaaacacccacaacaccgctgcctcagacaccaacccgcagaaccgagctctatgctgtcatcgatatcgaacgtaccgccgccatgagcaacctgcagaaagctctgccacgagacgacggaacatctcgcaagacacggcacaacagcacggacctgcccatgtag

SEQ ID NO: 42329 - DNA, 276 bp, Artificial Sequence
  Description of Artificial Sequence: Synthetic coding sequence
atgggcagctgctgcagctgccccgacaaggacaccgtgcccgacaaccatagaaataaatttaaggtgattaatgtcgacgacgatgggaatgagctcggaagcggtatcatggaactcaccgacaccgaattgattctatatacccgcaaaagggatagtgtaaagtggcactacctctgcttgaggcgctatgggtatgacagtaacctgttcagctttgaatctggtagaaggtgccagactggacagggcatctttgcctttaagtgttag

SEQ ID NO: 42330 - DNA, 552 bp, Artificial Sequence
  Description of Artificial Sequence: Synthetic coding sequence
atgggcagctgctgcagctgccccgacaaggacaccgtgcccgacaatcatcggaataaattcaaagtgatcaacgtcgacgacgatggcaatgagctggggtcaggtattatggagctgaccgacacagagttaatcctgtacacaaggaaaagggatagcgtgaagtggcattacctgtgcctccgacgctatggctatgatagcaacctgttttcattcgagtccgggcggcgctgccagacagggcaaggaatctttgccttcaagtgtgctcgtgctgaagaactgtttaacatgctgcaggaaatcatgcagaataactctatcaacgtggtcgaagaaccagtggtggaacgcaacaaccaccaaaccgaactcgaagtgcctagaactcctcgaacgccaactacccccggattcgcagctcagaatttgccaaatggataccctagataccctagctttggcgacgccagttcccaccctagttcccgccatccctccgttggatcggcccgcctccctagtgtaggtgaggaaagcacttag

SEQ ID NO: 42331 - DNA, 1479 bp, Artificial Sequence
  Description of Artificial Sequence: Synthetic coding sequence
atgggcagctgctgcagctgcctgaaccgggacagcgtgcccgacaatcacccaaccaagttcaaagtcacaaacgtggatgacgaaggcgtggaactgggcagcggagtgatggagcttacccagtccgaactcgtgctccacctgcatcggagagaggctgtgaggtggccgtatctatgtctgcgcaggtatggctacgacagtaacttattttctttcgagagtggcaggcggtgccagacagggcagggaatctttgcgtttaaatgcagcagggcagaagagatcttcaaccttctccaagaccttatgcagtgtaatagcattaatgtgatggaagaaccagtcatcattacccgcaactcacatccagccgagctggacttaccccgagctcctcagccccctaacgccttaggatatacagtctcgagcttcagtaatggctgtcctggtgagggacccagattttcggcccccagaagactcagcacatcaagtttacgacacccttctctgggagaggagtcaacccacgcgctgatcgcccccgacgaacagtcacatacttatgtaaatacccccgcctctgaggatgaccatcgtcgaggacgccattgcctccagcctttacccgaaggccaggcacctttcctgccgcaggcgcgcggccccgaccagagagacccgcaggtgttccttcagcctggccaggtcaagtttgtcttgggcccgacacctgctcggagacacatggtgaagtgccaaggcctttgtccgagcctgcatgatccgccacatcacaacaataacaatgaggcaccctctgaatgtcccgcccagcctaagtgcacctacgagaatgttactgggggtctttggcgcggtgcgggttggcgtctcagtccagaggaacccggttggaatggactggctcatcgtagggcggcgctccttcattatgaaaatctcccacctctcccaccagtttgggaatcacaggcacagcagctcggaggcgaggcgggcgatgatggcgattcccgcgacggattgacgccaagttcaaatggtttccccgatggagaagaggacgaaaccccacttcagaagcccacctcgacacgcgcagcgatcagatcccatgggtctttcccggttcctctcacgcgccggcgggggagcccccgcgtcttcaatttcgattttagacgccctggtcctgaacccccaaggcagttaaactatattcaggtcgagctcaaagggtggggaggtgacagacccaagggaccccaaaatcctagctccccacaagctcctatgcccacaacacatcccgccaggtcctcggattcatacgccgtaatcgatctgaaaaaaacagtcgcaatgtcaaatctgcaaagagctctgccccgggacgatggcacggctaggaaaacaagacataactcaaccgatctccctttatag

SEQ ID NO: 42332 - DNA, 1479 bp, Artificial Sequence
  Description of Artificial Sequence: Synthetic coding sequence
atgggcagctgctgcagctgcctgaaccgggacagcgtgcccgacaatcaccctaccaagttcaaggtgactaatgtcgacgatgaaggtgtagaactgggttcaggcgttatggagctcacccagagcgagttggtactgcacctccataggcgagaagccgtaaggtggccctacttgtgcctccgtcggtatggctacgactcaaatctattttctttcgagtcaggcaggagatgtcagaccggccagggtatattcgcattcaaatgctcacgggcagaagagatcttcaacctcctccaagacttgatgcagtgcaactcaatcaatgtgatggaggaacccgtgatcattactcgcaatagccaccccgccgagcttgaccttccacgggcaccccagcctcctaacgccctcggatatacggtgagcagcttctccaatggctgtcccggcgagggccctcggtttagtgcacctaggcgcctgtctaccagttccttgagacacccctcccttggggaggagtccactcacgccctcattgcgccggacgaacagagccacacatatgtgaatacacctgctagtgaggatgaccatcgaagaggccgacactgtctccaaccgctgccagagggtcaggcccctttcctgcctcaggcgcggggacccgaccagagggatccccaggtctttctccaacctggccaggtgaagtttgtgctgggtccgacaccggcgagaagacatatggtgaaatgccaaggcctttgcccttccttacacgacccaccacaccacaataacaataacgaagcacccagcgaatgccctgctcaacccaaatgcacctacgagaacgtgactggtggactgtggcgcggcgccggatggaggctgtcccccgaggaacccggttggaacggtctcgcccatcgtagggcagccctcctccactatgagaacctaccacccctacctcccgtctgggaatcacaggcccagcagttgggcggagaagccggtgatgacggtgacagccgggatggcttaacaccctctagcaatggctttccagatggagaggaggacgagactcctctgcagaagcccacgtctacacgcgctgccattagatcacatgggtcttttccagtcccccttacccgacgcagggggtcacctcgggtgtttaactttgatttccggagacccggaccagagccccctcgccagctgaattacattcaggtggagctcaagggctggggaggagaccggcctaaaggcccacagaacccatctagtccacaggccccaatgcctacaacgcatccagcaaggagtagcgattcctacgcggtgatcgacttgaagaaaacggtggccatgagcaacttgcaaagggccctgccacgggacgatgggactgccagaaagaccagacacaactcaactgaccttccactctag

SEQ ID NO: 42333 - DNA, 111 bp, Artificial Sequence
  Description of Artificial Sequence: Synthetic coding sequence
atgggcagctgctgcagctgcctgaaccgggacagcgtgcccgacaatcaccccacaaagttcaaggtgactaatgtggacgacgagggcgtcgaactggggagtggttag

SEQ ID NO: 42334 - DNA, 444 bp, Artificial Sequence
  Description of Artificial Sequence: Synthetic coding sequence
atggagaccccccggcgggcccggagccccgtgagcccccagttccccggacaagccggctgcagtgatactatgggatcctgctgttcatgcctgaatcgggactccgttcccgacaatcatccaaccaagttcaaggtcacaaatgttgatgatgagggagttgaattggggtctggggttatggagttaactcagagcgaactggtactccatcttcataggagggaagccgtccgctggccttatttgtgtctccgcaggtacgggtacgattcaaacctattttcctttgaatccggcagaaggtgccagacaggccaggggatctttgcctttaaatgctcacgcgcagaagaaatcttcaacctattacaggacctcatgcaatgtaatagtatcaatgtgatggaggaacctgtcatcatcacacgtaactcatag

SEQ ID NO: 42335 - DNA, 3405 bp, Artificial Sequence
  Description of Artificial Sequence: Synthetic coding sequence
atgatgagccccaacggcagcgtgccccccatctacgtgccccccggctatgcaccgcaggttatcgaggacaacggggtacgacgggtggtggtcgtaccccaggctcccgaattccacccgggtagccatactgtgttacacagaagccctcaccccccactcccaggattcattcctgtacccaccatgatgccgcctcccccccgacacatgtactcaccggtcaccggcgctggggacatgacaactcagtacatgccgcagtatcagtctagccaggtctacggggacgtcgatgcgcactccacacacggccgaagtaactttagggatgaacggtcctctaagacatacgaaagattgcagaagaagctcaaagatcggcagggaacgcagaaagacaaaatgtccagcccaccatcatcgccccagaagtgcccctcacctattaacgagcacaacggtttgataaagggacaaatcgcggggggcatcaataccggctccgcaaagatcaaaagtggcaaaggcaagggcggcacacaggttgatacggagatagaagaaaaagacgaagagacaaaggctttcgaagcactcctctcaaacatcgttaagcccgtagcgagtgacatccaggcccgtacagtagtccttacttggtcaccgccttcaagcctcatcaacggagaaacagacgaaagctcagttccagaactatatgggtatgaggtgctgatttcatctaccggaaaagatgggaaatacaaatctgtttacgtcggcgaggagacgaatatcacgctcaacgatctgaaacccgctatggactatcacgctaaagtgcaggccgaatataactcaatcaagggcactccgagtgaggccgaaatttttacgaccctgtcttgtgagcctgatatccctaatcctccccgaatcgctaataggaccaaaaatagtctgaccctgcaatggaaggcaccctcggacaacggaagcaagatacagaatttcgtgctggaatgggacgaaggtaaaggtaacggagaattctgccaatgttacatgggctcacagaagcagtttaaaattacaaagctcagccctgctatggggtgtaaatttaggctctctgcgcgaaacgattatggcactagcggcttcagtgaggaagttctatattatacctccggttgtgctccatccatgccagcctctcctgtactgaccaaagcgggaattacctggctgtcattacaatggtctaagccaagcggcactccatctgacgaggggatcagttacattctcgagatggaagaggaaacatctggctacggctttaagccaaagtacgatggagaggatctggcttataccgttaaaaatcttaggcgctccactaaatacaagtttaaagtgatagcctacaactcggaaggaaagagcaacccaagtgaggttgtggagttcaccacatgccccgacaaaccagggatccccgtgaaaccctctgtcaagggaaagattcatagccatagcttcaaaatcacatgggatcccccaaaggacaacggtggagccacaattaacaagtacgtagtggagatggctgagggcagcaatggtaacaagtgggagatgatttatagcggggcgaccagagagcacttatgtgaccgactgaacccaggctgtttttacagactacgggtttactgtatatctgacggaggccagagcgccgtttcagaatccctgcttgtgcagacccccgcagtgcccccaggcccatgcctgcctcctcgcctgcagggtaggcccaaagcaaaagagatccagcttcggtggggccctcctctggtcgacggcggctccccaatctcttgctatagtgtcgagatgtcgcccatcgagaaggacgagcccagggaggtgtatcagggttccgaagtagaatgcaccgtctcttccctgctgccagggaaaacttactcatttagactaagagccgctaataagatgggtttcggcccatttagcgagaagtgcgacatcactactgcccccggtccgcccgaccaatgcaagcctccccaggttacatgtcggagcgctacctgtgcccaggtcaattgggaggtaccattgtccaatggaacagacgtgactgagtatcggctggaatggggtggggtggagggaagtatgcagatttgctactgcggacccggactgtcctacgaaatcaagggcctctcgccagctaccacatattattgccgcgtgcaggctttgtcagtggtgggggccgggcctttctccgaagtggtagcttgcgtaaccccaccctccgtgcccggcattgtgacctgcctccaggagatcagcgacgacgagatcgagaacccacattatagtccttctacttgtctggcaatatcctgggaaaagccatgcgatcacggcagcgagatcctggcctactccatcgatttcggagataaacaatctctgacagtgggcaaagtgacatcttacattattaacaatctgcagcctgacacaacctaccgaatccgcatacaggctctgaatagtctgggcgctggcccattcagtcatatgattaagctaaagacgaagcccctgccccccgatccacccaggctggagtgtgtggccttttcacaccagaacctgaaactgaagtggggcgagggcaccccaaagactctatcaaccgactccattcaataccacttgcagatggaggataaaaacgggagatttgtgagcctttatagaggcccatgtcacacctacaaggttcagagactgaacgagtccactagttataagttctgcatccaggcttgcaatgaggctggagagggccctttatcccaggaatatatattcactacccccaagagcgtgccggctgccctcaaagcgccaaaaatcgagaaagttaatgatcacatctgtgagattacctgggaatgcctccagcccatgaagggtgaccccgttatctacagtctgcaagtcatgcttggaaaggactccgagttcaaacaaatttataaaggcccagactctagctttcgttattcatcactccaactgaattgcgaatatagattcagagtttgtgccattcggcagtgccaggactccctggggcaccaagatctcgtgggaccatacagcaccaccgtgctttttatttcacagaggacagagccacccgcctccactaaccgtgacacagtcgagtcgaccaggacgcgccgcgcgctgagcgacgagcagtgcgccgccgtgatcctggtcctattcgccttcttttctatcctgatcgcgttcattattcagtattttgtgatcaagtag

SEQ ID NO: 42336 - DNA, 3429 bp, Artificial Sequence
  Description of Artificial Sequence: Synthetic coding sequence
atgagcggccccgcccaggtgcccatgatgagccccaacggcagcgtacctcccatctatgtgcctccgggctatgcgcctcaggtaatcgaggataacggggtgcgccgggtggtggttgttccccaagctcccgagtttcacccagggagccacaccgtcctgcataggtcgccacatcccccacttccaggtttcattccagtccctaccatgatgccccctcccccacgacatatgtattcaccagtgactggggctggtgatatgactactcagtatatgccccagtatcagagcagccaggtgtatggggatgtcgatgctcatagtacacatggtcggtctaatttccgggacgaacggagctctaagacctacgaacgtctccagaaaaagctcaaagatcgccagggtactcaaaaggacaaaatgagctccccaccatcatcccctcagaagtgccctagccccatcaatgaacacaatggccttatcaagggacagattgcaggaggtatcaatacagggtcagcgaaaatcaagtctggaaagggcaagggggggacccaagtcgataccgaaatagaggagaaagatgaagagaccaaggctttcgaagcactactctccaatattgtcaaacccgtcgcatcagatattcaggccaggactgttgttctgacgtggtctcctccttcctcactgatcaacggagagactgacgaaagctccgttcctgagctctatgggtatgaggttctaatatcttccaccggcaaagacgggaagtataagtcagtctatgtgggggaagagaccaatatcactctgaatgatctcaaaccagccatggattatcatgcgaaggttcaggctgaatataactctattaagggaacgccttcggaggcggaaatattcacaaccttgtcttgtgaacccgacatcccgaatcccccaaggatcgccaacaggaccaaaaacagcctgactctccagtggaaggcgcccagtgacaacggcagcaaaatacagaatttcgttctggagtgggatgaaggtaagggaaacggggagttttgtcagtgctacatggggtcccagaagcagttcaaaatcacaaagctctcccctgccatggggtgtaaatttcgcttaagtgcaagaaatgactatggtacatccggatttagtgaagaggtgctgtactataccagtggttgtgcgccctctatgccagcaagccccgttctgacaaaagctggcatcacttggttgagcctacaatggtcaaagccttccgggaccccctctgatgagggcatctcttacattttggagatggaggaggagacatcaggctatggcttcaaacccaagtacgacggagaggatctggcctacactgtgaaaaatcttaggagatctacaaaatataaatttaaggtcatagcctacaactcagaggggaagtctaatccttcagaggtcgtggagtttaccacctgccccgacaagcctggcatacccgtcaaaccatctgtgaagggcaagattcattctcacagtttcaagatcacatgggatcccccaaaagacaacggaggcgccaccattaacaagtacgtcgtggaaatggctgagggctccaacgggaacaagtgggaaatgatatactccggtgcaacccgggaacacttgtgcgatagactgaacccaggttgtttctataggttacgagtgtattgcatatcagacggcggacagtctgccgtcagcgagagcctgttggtccagacacctgccgtgccccccggaccctgcctccctcctcgcctccaaggacgcccgaaagccaaagagatccaactcaggtggggacccccactggtcgacggcggatctcccatcagctgttatagtgtggagatgagccctatcgagaaagatgaaccaagggaggtttatcagggttcagaagtcgagtgcaccgtctcatccctactgcccgggaagacctactcctttagactccgagccgctaataagatgggattcgggcctttcagtgagaaatgtgacatcaccactgctcctgggccccccgatcagtgtaagcctccacaggttacatgcagatctgcaacgtgcgcacaggttaactgggaagttcctctttccaacggaaccgacgtgacagaatacaggctggaatgggggggtgttgaggggtcgatgcagatctgctactgcggtcccggcttatcctacgaaattaaaggtttgagccctgccactacgtattattgtagagtgcaggcattgtcagtggtcggcgccgggccatttagcgaggtggttgcttgtgttactccaccctcagtgcctggaatcgtgacatgtcttcaggaaattagtgacgatgagatagaaaatccccattactcacctagtacatgcttggccatttcatgggaaaagccatgcgaccacggaagcgaaatacttgcatatagcatcgattttggcgacaagcagagcctaactgttggtaaggtgacttcttacattatcaataacctacagcctgatactacctaccgcattagaattcaggcgttaaattcccttggcgcaggaccctttagccatatgattaagctcaagactaaacctttaccccccgatccacctcgcctggaatgcgtcgcattctctcaccagaatctcaagctcaagtggggtgaaggaactccgaaaaccctgtccacagacagtatacagtaccatctgcaaatggaagacaagaatgggaggtttgtgtctctttaccgcggaccttgccacacctacaaggttcagaggctgaacgagagcacttcctataaattctgtattcaagcatgcaacgaggcaggagagggccccctgtcacaggagtatatctttaccacccccaagtctgtgccagcagcattgaaggcgccaaagattgaaaaggtcaatgatcatatctgtgaaataacttgggaatgcctccaacctatgaaaggcgaccccgtcatttacagtctgcaagtgatgctgggcaaggattcagagtttaagcagatatacaaagggccagacagcagctttcgttatagttccctgcagctcaattgcgaataccgttttcgggtttgcgctatcaggcagtgccaggactcacttgggcaccaggaccttgttggaccgtattcaacaaccgtgctgtttatctctcagagaactgaaccgcctgcttctacgaatcgcgacactgtggaaagtacacgaactaggcgtgccctgtccgacgagcagtgtgctgcggtaatacttgtactgtttgcttttttcagcatcttgatagccttcattatccagtacttcgtgatcaagtag

SEQ ID NO: 42337 - DNA, 3597 bp, Artificial Sequence
  Description of Artificial Sequence: Synthetic coding sequence
atggccgagcacccccccctgctggacaccacccagatcctgagctccgatatttctctcctgtcagctcctattgtgagcgctgacgggactcagcaagtaattctcgtacaggttaatccgggcgaggccttcaccattcgccgggaagacgggcagttccagtgtatcaccggcccggcgcaggtgcccatgatgagtccaaacggcagcgtgccccctatttacgtccctccaggctatgctccacaggttattgaggacaatggtgtgcgccgagtagtagtggtaccacaggccccagagttccatcctgggagccatactgtgctgcatcggtccccacaccccccgctgccagggttcatccccgtgcctaccatgatgcccccacctccacgccatatgtacagtcctgtgacaggtgctggagatatgaccactcaatatatgccacaatatcaaagctctcaggtgtatggggacgtggacgcacactccacccacgggaggagtaacttcagggacgaacgctcatctaaaacttatgaacgcctgcagaagaagctcaaggaccgccagggcacgcaaaaggacaaaatgtcatctcctccctcatcaccacaaaaatgcccctcacccataaatgaacacaacggtctcattaagggtcaaatcgccggcggaataaataccggatccgccaagatcaaatccggcaaaggtaagggcggcactcaggtagacacagaaatcgaggagaaggatgaggaaacgaaggcttttgaggctctgctgtccaatatcgttaaaccagtggcctcggatattcaggcccgaacggtggtcctcacatggagcccccccagtagtctgattaatggagaaaccgacgagtcatccgtgccagagctgtacgggtacgaggtgctgattagtagcacgggaaaggacggaaaatacaaatccgtttacgtcggcgaagaaactaatattaccctgaacgaccttaaaccagcaatggactatcacgccaaagtgcaagccgaatataacagtataaagggaaccccgtcggaagctgaaattttcacgacactgtcttgtgagccagacattcccaaccccccgagaatagcaaataggaccaagaatagcttgacattgcagtggaaggccccatcagacaacggtagcaagatacagaatttcgttctggagtgggacgaaggtaagggaaacggcgagttctgccagtgctacatgggaagtcaaaagcaatttaagattacaaaactgagccctgcgatggggtgcaagttcagactgtccgcccggaatgattatggaacgtcaggcttttctgaagaagtgctttactatacttctggttgcgcacctagcatgccagcaagtccggttctgactaaggccggaattacctggctctcgcttcaatggtcaaagccctctgggacaccatctgatgaaggcatttcctacatcctcgagatggaggaagagacctcaggctacgggtttaagcccaagtatgatggagaagacctcgcctatactgtgaaaaatttgcggagaagcacaaagtataagtttaaagtcatcgcttataactccgagggtaagtcgaatccctctgaagtggtggagtttacaacctgtccagacaagcccggcattccggtgaagccgtctgtgaaaggcaagatccacagtcacagcttcaaaatcacctgggatccccccaaagacaacggcggcgcgactatcaacaaatatgtggtggaaatggctgagggatccaacgggaacaaatgggagatgatttacagcggcgcaacacgcgagcatctgtgtgaccgtctcaatcccggctgtttctaccgattgcgggtgtattgtattagtgacggcgggcagagcgcggtgagtgaatccttattggttcagacgcctgctgtccctcccggaccctgcctcccgccccgattacagggacggccaaaagctaaggaaatccagctgaggtggggccctccacttgttgatggcggatccccaatcagctgctactccgtcgagatgagtccgattgaaaaggacgagcctagggaggtttatcaaggttctgaagttgagtgcaccgtgtcatctctcttgcctggcaaaacatatagtttcagactgcgggctgccaacaagatggggtttggcccattttcagaaaagtgtgatataacaacggcccctggtcctcctgaccaatgtaagcctccacaagtcacttgccgctccgctacatgcgcacaagtgaattgggaggtacccctttcgaacggaacagatgtcaccgagtacaggctggagtggggaggcgtcgaagggtctatgcagatttgttactgtgggccaggattgtcttacgagattaaagggctgtcccccgctacgacgtattactgccgggtgcaagccctctccgtggttggagcaggaccttttagcgaggtggtggcatgcgttacccccccttctgtgcccggtattgttacatgcctgcaggaaatctccgacgacgagattgaaaatcctcactacagcccatccacatgcctcgccatcagttgggaaaagccctgtgaccacgggtcagaaatcctcgcatactcgatcgactttggggacaaacagtctctgaccgtggggaaggttacttcatacatcattaacaacctccagcccgacactacgtaccggatcagaatccaggcattaaatagtctgggggcagggccttttagccatatgatcaaactgaagactaagccacttccccctgacccccccaggcttgagtgcgtggccttctcacatcagaacctgaaactgaagtggggcgagggtacacctaaaacgctttcgaccgactctattcaatatcacctgcaaatggaggataaaaacgggaggttcgtgagcctctatcgcgggccctgtcacacctacaaggtgcaacgcctgaacgaaagtacttcatacaagttttgcattcaggcctgcaacgaagcgggggagggaccgctttcgcaggaatatatattcactacacctaagtctgttcccgcggcgctgaaagcccccaagatcgagaaagtgaacgaccacatctgcgaaatcacctgggagtgcctccagcccatgaagggggatccagtcatttatagcctgcaggtgatgttgggaaaggatagcgaatttaaacaaatttacaaaggacccgactcgagctttcgctattcgtcactccagctgaattgtgaatacaggttcagggtgtgtgctatccgccagtgccaggattccttaggtcatcaggacctcgtaggcccttactctactacagttctattcatcagtcaacgtactgaaccacccgccagcactaaccgcgatacagtggaatccacccggacaagacgagcactctccgacgagcagtgcgcggccgtgatactggtcctgtttgcctttttctctatcctcatagcgttcataatccaatactttgtcatcaaatag

SEQ ID NO: 42338 - DNA, 3597 bp, Artificial Sequence
  Description of Artificial Sequence: Synthetic coding sequence
atggccgagcacccccccctgctggacaccacccagatcctgagcagtgatattagtctgctttcagcccccatcgttagtgcagacggcacacaacaggtaattctggtgcaggtcaatccaggcgaggcatttactatccgtagagaggatggacagttccaatgtatcaccggacccgcccaagtgcccatgatgtcaccgaatggctccgtgccgcccatttacgttccccctgggtacgcgccacaggtcatcgaggacaacggggtgcggagagtggtcgtcgtgccacaggcccctgagttccaccctggctcccataccgtgttacatcgctctccacacccccctcttcccggttttatccccgtccctacaatgatgcccccgcctccaaggcacatgtattcccccgtgaccggagccggcgatatgactacccagtatatgccacagtaccaatcaagccaggtgtatggtgatgtcgacgctcacagtacacatggtaggagcaacttccgggatgaacgttcctcaaagacatatgagcggcttcagaaaaagctcaaggaccgccagggaacccaaaaagataagatgagctccccacccagcagtccccagaagtgtcctagccccatcaatgaacacaatgggctgataaaaggccagattgcaggaggaattaataccggatccgccaagataaagtctggcaaaggtaaggggggcacccaggtggataccgagatcgaagagaaagacgaagagactaaggcttttgaggcactcctgtctaacatagtgaaacctgtggcaagtgacattcaagcgagaaccgtcgtgctgacatggtccccgcctagctccctgatcaacggagaaaccgatgagtcttctgtccctgaactatatggatatgaagtgcttatctccagcaccggaaaagacggaaagtataaatcagtgtatgtgggggaagaaaccaacatcacactgaacgatcttaagcctgctatggactatcacgcgaaggtccaggcagagtataactcaatcaaagggacaccttcagaggccgaaatttttacaaccctgagctgcgaacctgacatacccaacccaccacggattgctaatcggactaaaaacagcctcactctgcagtggaaagccccatctgataacggaagcaaaatccagaactttgtcctggagtgggatgagggcaaaggtaatggagaattttgccagtgttacatggggagccagaagcaatttaagatcacaaaactgagtccagccatgggctgcaaattccggctgagcgctcgaaacgactacggcacaagtggcttctcggaggaagttttgtattatacgtccggctgtgccccttcgatgcccgcttctcctgtgctgacgaaagcgggaataacatggttgtccctgcaatggtctaaaccatccggcacaccctcagatgaagggatttcctacatccttgagatggaggaagaaacaagtgggtacgggtttaagccaaagtatgatggggaggacctggcatataccgtcaaaaacttaaggcggtccacaaagtacaagtttaaagttattgcatacaacagtgagggcaaatcaaatccatccgaagttgttgagttcactacgtgccccgacaagccaggtatcccagtgaagccttctgtaaaaggaaagattcattcacattcgtttaagattacctgggatccccccaaagacaatgggggcgctacaataaacaagtatgttgtggagatggctgaaggatctaatggcaacaagtgggagatgatctatagtggcgcaaccagggaacatctctgcgacagactcaatccggggtgcttctaccgtctgcgggtctactgcatttctgatggtggacaaagtgccgtgagcgaatctttgctggttcaaactccagcagtgccccccggcccatgtctgcctccgcgcctgcaaggcaggcccaaggcaaaggagatccagctgagatgggggcccccactggtggatggggggtctccgattagttgctactctgttgagatgtcccctatcgagaaggatgaaccgagggaagtctatcagggcagtgaagtggagtgcactgtttcatccctgcttccagggaagacatacagctttaggctgcgtgccgccaacaaaatgggttttggcccgttctccgaaaaatgcgacatcaccactgccccaggaccacccgatcagtgtaagccccctcaggttacctgcagatccgcgacttgcgcacaggtcaactgggaggtgcccctgagcaacggcacagacgtgaccgaatataggctggagtgggggggcgttgagggttctatgcagatttgctactgcggacccggcctgtcctacgagattaaggggctaagcccagccaccacttactattgcagggtgcaggcactgtctgtggtcggcgccggacccttctcagaagtagttgcctgcgtgactcctccctcagtccctggtatcgtgacatgcctccaggaaatctctgatgacgaaatagagaacccgcattactcacctagcacgtgcctggctatatcatgggagaaaccatgcgatcatgggtcagagattctggcctactcaatagactttggggataaacagtctctcaccgtgggaaaggtaacctcgtacatcattaataatctgcagcccgatacaacatataggattaggatccaggccctgaattccctgggtgcaggcccgttttcccacatgatcaagctgaaaactaaacccttacctccagacccgcccagacttgagtgcgtggcattttctcaccagaatttgaaactgaagtggggggaaggcactcccaagaccctctccacagacagtattcagtaccacctgcagatggaagacaagaatgggagatttgtgagcctgtatcgaggcccctgtcatacttataaagtgcagaggctgaacgaaagtactagctacaaattctgtatccaggcatgcaacgaggctggcgaaggtccactctcccaagagtacattttcaccacacccaaatccgtccctgcagctctcaaagctccaaagattgaaaaggtcaacgatcatatttgcgaaattacctgggagtgccttcagcccatgaaaggggaccctgtgatttatagcctgcaggttatgttgggaaaagactccgagttcaaacagatttataaagggcctgactcctccttcaggtatagctctctccaactaaactgtgaatatcgcttcagggtgtgtgctattcgacagtgtcaggattctttggggcatcaggaccttgtgggcccatatagcaccaccgtattgttcatctctcagcggaccgaaccaccggcttctaccaatagggacacggtagaaagcaccaggacgagaagagcgctgagcgatgaacaatgcgccgcagtgatccttgtgctctttgcatttttctctatcctgatcgccttcatcatacagtacttcgtgataaagtag

SEQ ID NO: 42339 - DNA, 2055 bp, Artificial Sequence
  Description of Artificial Sequence: Synthetic coding sequence
atggccgagcacccccccctgctggacaccacccagatcctgagctctgatataagccttctgagcgcccctattgtctccgctgatggcacacagcaggtcattctggtgcaggttaaccccggggaggcatttactattaggcgggaggatggtcaatttcaatgtatcacaggacctgcacaggtgccaatgatgtctcctaatgggagtgtcccgcctatatatgttcctccaggctacgctccgcaagtcatcgaggacaacggagtgcgaagagtggtggtggttcctcaggccccagagtttcatcctgggtcccacacagtgcttcatcgttcgccacaccctcccctgcccggcttcatacccgtccctactatgatgcccccccctccacggcacatgtatagtcccgtaaccggagctggcgatatgactactcaatacatgccgcagtaccagtcttctcaggtatatggagatgtggacgcgcactctacccacgggcgttcaaatttccgcgacgaacgaagttctaagacgtatgaacggctgcagaagaaactaaaagacagacagggcacccagaaagataaaatgtcttcgccgccctcttcgccacagaaatgtcctagccccattaatgaacataatggccttatcaaaggacagatcgccggtggcatcaatactgggagtgccaagatcaaatccgggaagggcaagggtggcactcaggtggacaccgaaatcgaggagaaagatgaggagacgaaggcgtttgaggcacttctgtccaacatagtgaagccagttgcttcagatatccaggcccgtacagtcgtgctcacctggagccccccatcaagtttgattaacggcgagacggacgaatctagtgttcctgagctctatggctatgaggtgttgatttcgagcaccggcaaagatgggaaatacaaaagcgtctatgtgggcgaggagacaaatataacgttgaatgatctaaaaccagctatggactatcatgcgaaggtgcaggctgagtacaacagcatcaaggggactccatccgaagcagaaatcttcaccacactctcctgcgagccagacatccctaaccccccacgaattgccaaccggaccaagaacagcctgaccctccagtggaaagccccctcagacaatggttctaaaatccagaattttgtgttggaatgggacgaaggcaagggaaacggagagttttgtcaatgttacatgggctcacagaagcagtttaagatcactaaactatcaccggcaatgggatgcaaattccgtctgagtgcgagaaacgattacggcacttctggcttctctgaagaagtactttactacacttctgggtgtgccccttccatgccagctagtcctgttctgactaaagccggcatcacatggctgtcacttcagtggagcaaaccctcaggcactccatcagacgaggggatctcctacattctcgaaatggaggaggaaacctccggttatggattcaagcccaaatatgacggagaggacctggcatacacagtcaagaatctgcgcaggtcaacaaagtacaaatttaaagtcatagcctataattctgaaggtaagtcaaacccatcagaagttgtggagttcacaacctgccccgacaagcctggaattccggtgaagccctctgttaagggaaagattcattcccactcatttaagatcacttgggatccccccaaggataatgggggagcaactatcaacaaatacgtcgtggagatggcggaaggttcaaacgggaataaatgggaaatgatctattccggggccaccagggaacacctctgcgacaggcttaatcctggctgtttctacaggttacgggtttattgcatctcagatggcggacaatctgccgtgtccgaatctctgctggtgcaaacccccgctgttccacctggcccttgtctacccccaagactgcaagggaggcctaaagctaaagagatccaaactcctagtggatag

SEQ ID NO: 42340 - DNA, 675 bp, Artificial Sequence
  Description of Artificial Sequence: Synthetic coding sequence
atgaacatcgaggtgggcaacatcagctacaccggcgccatcatctcctggagttccagtgaaccatgcctcgaagattattaccacataatgtacagacccaattggaattccatcttttctggatacctgcgttactctttccatcatgaggaaaaagtgccgcgaacaattagctccgtagtcttggagcatctggcaccctccacgctgtacttcttgtgtatttcctgcaagaaagccgccttcccataccgacactattgtacgatgtttcacactctggacaaatcacctctggcccccgggtcttcactcgttgatccccaaatctctctgtgggtgctgatggctattctcttagcgtgtttcaccgccgtcctggccttcatctgcttgcagttttggtgcgtgcgatgtcatgagcctaggtggtcctatagggcaggccacatggaggaggccaacgggctcgtgcggtggcccgaagaagctccggacctgggacagcgtgaagaggatctccagggtttgccgctggtcgaaatgcctcgaaagaactcccgagatggtgctgaacttgaccccgaggctaatcaggatgcgcccgacgcgggagctctacagcgtggcggtggtgacccacccgccatacttcctcactgtggcgaatag

SEQ ID NO: 42341 - DNA, 543 bp, Artificial Sequence
  Description of Artificial Sequence: Synthetic coding sequence
atgaacatcgaggtgggcaacatcagctacaccggcgccatcatctcgtggtcctcttccgagccttgcttagaggattattaccacatcatgtaccgaccaaattggaattctatcttttcagggtacttgcgctacagcttccaccatgaggaaaaggtgcctaggacaatctccagtgttgtgctggaacacctcgcccctagcacactgtacttcctgtgcatctcgtgcaagaaagccgctttcccatatcggcactattgcaccatgtttcacactctggacaagtccccccttgccccaggatcaagtttggtcgacccgcagattagtctgtgggtgttgatggccattttacttgcttgcttcaccgcggtgctcgcctttatctgcttacaattctggtgtgtgcggtgtcacgagcctcgttggtcctaccgtgcgggacatatggaagaagccaacggactggtccggtggccggaggaggcccccgatctcgggcagcgggaggaagatcttcagggcctccccttgtag

SEQ ID NO: 42342 - DNA, 10401 bp, Artificial Sequence
  Description of Artificial Sequence: Synthetic coding sequence
atggagctgtacctgggcgcctgcagcaagcccgccaaggtggccgttaccaagacagtagcctccgtcttggctgccgacacccagcagtgtagggatggggtgcacaaaactcattttgcgggtgttggacccgcccagctactggatctgcctctgggcgtaaagctccccgtaatccctggttcgaacgccgtgttctacacaacaaactttggcgagaagcttttccgcccgtcttatgggtttaacctaacagacccatactgtcgcctactggagaaccagtataagagcctgcatgacccacacttgaaagcctattataaacgaaaggacatcctcaaacgcttgaagaagggaggctacattacctctaacaacaaagtggtgtgcacactccgagagcttaacaaatataggcagtacctgaccagcctgaagctcgacttcgagagaaactacatcaaagagcagcgaattttagcaaaacagctgcacaatatcccggagaacaaccagatcccccagcattgcgacgttgcacaggtgcagaattggcttctgaaggaaggcaccgaaagtattaaggaccaggaaagactcatgagacacaggtacttggatatgatttcaaggaagctcgaacagcttgaacgaacagctgaggaacagcgcctgtttctcatggatagggaggaacggaggcagcgtgagcatacccggagaaagctaacactccgccggaaaatagaagaggaatggaagaccaaagagatgctgctcctgaccaggatggcagaggatgtaaagcgcgaagagcggatagaggagcagcagcatcgtaatagggaggagtcagacaggaaaaagcaagatctcctcgaaaaaaagatggcttaccacctacagaagatgcaggatacaggattcaacggagaagacatagggaaaaatacgttcaaataccggggtcaggatgggacgcacgcttccccaaagaacaagaagaagacgtccgaagacattatgctggtatatcctgcaggagatcagaatacgtacaaagaaacacacggccatacagctaacgctgcccatcaacgacagaacagttctaacaattttacaaagaaaaacagcgcctccgtggtctaccaggcggacgtgcaggacaacggtattaatcagaagagagacgggatggtgtctaagaattctagtatttttgacgaccggggcggtatcaatatcagcggacaagggagtatcatttccgcccaagtctcacctaccagaaatttcagccgagtcagtcaggcgttcctagatcccagcaaggaggaaaaagaaaccaatgctgattgggatggtcggcccaccaaacgaagcagttatctgtgtgagtccgggccccaggcacatgccaccgatccaggcattttttcgagtccagtgtacaccaatatgcagcagaatttactacagaactgtttacaggagaaggtgacctcggaagagcttaatattattattcagaacgtcatgacctgggttgtggctactgtgactagtatactgtaccctgccatcaccaaatacgagaagcgtttacagaataacacttatcccgtcagcgacgacagtatcctatcatccgattccagctctttctgtagtacctgctctgaagactttacctatagaagttatacatcggccaccaccaagacttttcaggccgaaccgtgcgcctttgtggttgacacttccgttaggcgacccactacccccataaaaccaccaccagcccatgtagagaagaccgtcgtcggcaagacctgccacattaagggacagtcaatcattagtaaacataagtacaacaagacaaacctcctttactcctacccgaaacttaggtcctgcaagtctgactcacatcttctggcaagcttcgagaccgggaccaaaaaatcaaaggacgcgacaacggagactgacagtttggggagctccctgcactgtgataaaaccgcgaaagcgatggatgagatgaaaaatctgaagaatgtgttcgttaacttcaaatgctatctgaagggagaaaccgaggtgatccttgagtcaatcctccgggaaatcatgagtgatctgacccaggctatcccatccttatcttctgtcacagcagaggtcttcgtggagcagtgtgaacgggagaaagagatcctactctctaacgcccatataccctcagtggccagcgaaatcgttgagaacatgctggagaaattggagagcgcagtggaaaaaaagtgtgtggaaatgttctcccaggacttgtcggtagacattaaaccatcccttgccgcatccgatgagcttctgacaagcagcaacggaaagcccctaaaaaactccatgcctcatacccttgacccaatgtgcgatatcgccgaggatatggtccatgcaattctggagaagttgatgacgctggtgagctttaagcagaacgagtttctgcacctcaaggatactaataagctgtcctgccagcaacataagaccgatccaatttgtatgttcttgcagcgcgccgggaaaaataagagttctctggagtcggatgaggcctcgctaatcgtgaatgaggaggttcagaacttgattagtaacatcttctcccagagttccctcgtggcctacatcgaggaggccattaacgcaatcctggggtatattcagaccgaactaaataacgaaagaataatcgcctccgaagagacagtggtgttactgcagttgctcgaagatatcctgtttcagttacaccaagaacccgtcaacgagtcctttcagaaatcccgccagcctagaatctcttcgccctccgacacaaaagagaaatatcgccttacgggaaccaggctcagcaactctcctcggagcgggagacctttccccccaataaatgttcctgggatggtcctgtattctgacgatgaaaacgaggagattgacaatatcgttaagaatgtgctggattccacttttaaagatgagaaagtgaaatcacaggaacagatccctaatcactggtttactaagggaaacacatgtttcgagtgtaagaggaacataaaacctccaacaaagcctggaagtcgcagcaaagcagcatttcacgattgggagctaaaaacagagcccccaagtacaaatcacgaagatatacttaagaagaagctcagtagcaataaggacatctccactttctcccaggaccaaaagcatcaaatcgaaaaagcaagcgagaacatcgtcacatcaattctgaaggaaatgttaaaagacattagctccgtgccgtttggccatctggatagtaagacgggatccgaggcttctgtcctcgtaagtgagaaaccccaagggctgagccaccaggaatggattgaccagatgttttccgtgtctgaaatcagtacagtagctcaggagatcaccgattcagtgctgaatattctgcataaggcctctaattacatctccaatactaccaagtctagtatttcgagctcagtacaccaaataagtctccataatagcgataccgaacatatcgtgaaggaggccccaaacaaatacccccttaagacatggtttgattctgaaaaaaagatgaaatacctaagccttttcgatgttgatccagagaagcccccatggctcaagtccgggaagtcagagccaaagccagtagacgacattaatgacaagattatccgcaccatattcaagaggcttaagtccttcatatgtcctaaactgcatatgggatttaagagcagcctgcgctctcaactttcgaaatacacagctaaaattgtgaatatagtgctgtgtgcaatccagaacgaactggaacttcataaggagaacctcaatctccgcgaaatcgatcacacgaagtccctgaccgataaaggctttttcgccaatacagataagaagctcgaaagcctggtgacaagcattgacgacgacatcctcgcatcgcctctccttacatgtatttacgacatgcttttatcatctgagaacgcacaccagcggagcatttccctgtctagtcgtaagcccaaaagcgcaaccgactctgttgacgtgcagtccattctgcccaatagacaagacaaaaagtcattccataagtatctcgcaacaccatgtactcatcattccgtgaatggcggcaaccatatcaaagagaacgccaaactccaggtgttagagcgaatcggcgaaacactccatgagatgttgtcgaagcttttgggcactcacctgcattcccagctctcctgtagccaacagagccgcgaaatgaccaacaagaatcagaagatggccgctgcgctccaatcaaatatccagctcatcagtaaggcaatcctggactatattctggccaagttgtgtggcgttgatatggacacctcctttgcgagctgcgggctcaaggccataagtgaaagcctggacattgacaacccctcatttgcatcaattatcgagaagatggcaaagagcaccaagatcatatccagcattgtgtcgcgtcgcgtccaagaggacaacaaggaggaaacgaaaagcaaagccaaaccagtcgcgcctgtttccagcaagactccgtctacaaaggagatgcaccctaacaagctgaaagcagtggccagtgacatcttgaatatggtgttcgccaaactagaaggttttgcgaatggccacctcgaaatcttaggagcgattaacgacggtaacaagaagtccaataagatcggctgggagtatgagtcaaccaatatcagtcgggatacccacgaggcatcatttcttagcgctctttacatgcacgccaagaaggtcagcagtgccattcttaaagtgatccagaccgagctgaatgtaacctcttcggacctgaaaacttctgtggaaaaccccccacccgagacgcagatcctaaagtatgtagtcaagttgatcttagatgcagtgtcatctgatatgtttaacgaaatggagtctgagggcgggggcatcgagacatatcgataccgacctacttatggctcactaccagggggagctgaatctgatagcttcttggaagacgatgcatatactgctaagaagattattgatgagagaagcccccaacgtgaggaagtgaaaacacgatccctcaaacagtgggccctagaaaaaacactcaataagatagaggtaaagctcaaggagccccacatcagcccaatcgcacctataatccgaaatattctgaacgagatattccagagcacccttatcaatcagctgaatgtgctgagtttgtctcacagcaattttaacggcatgccacacaacgttgatgagcctactccccagacatccgtgcagtttatggacaagatgatggatcctttactcagcgaagccgatattacaattgtgaccgacaatattgttcggactgttttccataaactctactccgcggcaatgacagagagaaacgttcgcgagaaccgatataagaccattacattctctgccaatgtaagttctcatgaacatacatataagggcaagagcagcgtcactgctctagacgaaaacccatgcactttccaatcaagattctcggtggccgataaggagactaaagttaatctggcagaggacattgtccaggccattcttactaatctggagacattcgctacgtccaaagtcaagagcctcttttattcccaggtcaatttcactgtccctgtggccttaccaattcagcaagatcatagtaccttgtccaaagctctgagtgctaaagacagctattctgatgagcaatttagctgctgcagcgtcgaccatactaagagtggaaagactaatttgtgtcagttgagtctttctaagttgaatacatatgctcttcaggtggctcggcgcaacctacagggcatcaagcaagaacttgacaaagagagagaaaacccattcctgactcacgacatcggaatttcggagagcatcgccagccaaattgtaaatgccctgctggatatcatcagcaggaaaggaaagtgcgataaaaattcatcagacaaggagatcgacctcgatcagcagaagggtgtgattgagaaactgctgaacgagacaaagtataggaaggtgctgcagcttcagatacaggataccatcgagggcattctgtgcgatatctacgagaagaccctgttccaaaacaacctatcttttgccacccccacactgaaatgttcgattgccgacaagcactccgaggaaaattcagaaatgttcatggagggtgccaacaagataattcctaaactgtctgttccaaagagcgatgtgatcttgattagcaacgatatagtgaacatcgtcttgcataacctttctagcgcggctacgctagtgataaatgctaaaaatcctacatccgcaaggctgcccctgacattttgcgatacatttccaaaaatcgattgccagcagcccctcaagggctctaaaactgagcggaaaactgaacgcttctcatatagtaggaatcagaagagcgcttacgcagatgacaatcagataacagtggtggagaaggaagacactcagaagtccgcaactgatagttgtgaggagaacgcgaatttcatcaccaaaactatctttaagcgtctggaatctttcgccaccgaacgcatcgactcactgattacccttgcctttcagtctaaagaaaaaagcttcgttattccagagctggaaaactgcaagcagaacgacagtattttctacgattccagtcaggtagagtccgacgtgaatgtgctcaaaatctcagctaccgaaaccattctgagccaggagctgaccgacttcacctttgtgggaagacgtgagaagctcgggtccactatacatttatcccaggcccggctgaagacctatgccgatgtgatcgcttcagccatcctcaaactcataaaaaacgacctcgatttggagatacagaaaatttacccctatcaaaacaatatcctctttcaggaaaatattatagtcagcgagattgtggacagcatgctcaagatgctggacgataaaaggagtgtgaaggagatatgcttcaattccaaagagaactctaacttttctcagttggccttgtccaacgagatcctactcgggcacaaagaaaaggaaaggtcaaccaaacagtccctatttaccaagtatcccttagagcagaatcagatgatcttggagaacaaacgtcagatcattgtgcttgaagagattttcatgagaaacggggagtcgaagaacaaagaaaagggcgagctgcttatcgccgtggaggaattgcttaataaactttatcagagagtccgtgaagtgaccggtcacctcccccccctaaacgagaccgccaatttcattagcaactcaaagattaaaacctctgacactacacagaagaattcattccagtcccacattaattcagttgccaatgacattgtggaatcagttctgggtaaaatgtacttggtggtggttacttctctgtatgagaataataagtcaagaaccgaagtcgagatcagcgatcataacgactctctgctgatgaagccgttacggtttcgcgaaaccaaacaggctggcaaaatcagtaattcgccacggtacgccattagccaggcctactcatacgtggattcacagaatattagcgtcatggagaataccctcctcccctatctgcccctccaggtgaaaaaggacctgattcagatggttcttaacaagatcactaattttgtgtcgctgccgcttaaagtatcacctaaagataatcccaagccatgtttcaaggcgcatctcaaaactcggagtaagatcaccaccctgcccaagtttaccaagaagacgcacctcggcttgtccgctgcaaaggccaagagcaagacaaagctcggccctggagaaaaaaccctaaaggacagccggtcaaaaactgctatagggctgtcacatatcatgtctgctggtgacgctaagaatcttctagacactaagctccctactagcgaattgaagatctatgccaaggacatcatcatcaatattctggagacaattgtaaaggaattcggaaaggtcaaacagactaaagcacttccatccgaccaaatcattgcagctggaaaaattgtgaatacagtactccaggaactctatgtgaccaacaactgtaacctcgcttacccaatgaaaagctcacatctcaggctctctcaggggaacatcggaaccgggagtctccccaaacagcaggcctgcttttatctggaaaatgtgtcaagccagctcgagcatatttttccaagagaagggatcttcaagaagttatttgacaagtggcagacagagtctaatgacaaagagaacgaaaagtgcaaactgctgatgatcgcagagaatgtgctcactgaaattagtatcaaagccaaggaactggagtactctttatctctccttaatttgcctcccctggaaaactgtgagagcagattttacaaccactttaaaggggcatccacgcgtgccgaggacactaaagcacagatcaatatgttcggccgagaaatcgtcgaaatgctcctggagaagttacagctgtgctttctgagccagattcccacccccgacagcgaagagaccttgtccaattcgaaggaacacattactgctaaatccaaatacgggttccccaacaaacatagcctatcatcactacccatttataacacgaagacaaaagatcaaatttctgtggggtctagtaatcagattgtgcaggagatcgtcgagacagtattgaatatgctcgagtccttcgtggatctccagttcaagcacatcagtaaatacgaattctccgaaattgtgaagatgcctattgaaaacctgtcatctatacagcagaagttgctcaacaagaagatgttgcctaaattacagccactgaaaatgttttccgacaagtcagaaagcaacacaattaactttaaggaaaacatccagaatatcctcctacgggtgcactccttccatagccagttgctgacctatgctgtaaacatcatatctgatatgctggctgtgattaagaataaactggataacgagatttctcaaatggagccgagcagcatatcgattctgaaagaaaacattgttgcatccgagatcatcggcactcttatggatcagtgcacttatttcaacgagtccctgatccagaacctatcccgcgaatcattgttccagggtgccgagaacgcttacacggtaaatcaagtggagcttgccacaaacatgaagatgtttacctcaaagttaaaggagggaagcctgggcatcaatccatcccaggtgtctaagaccgggttcgtgttttgctcggacgaggacatgaaagaaaaatatcgggtcagctccgatctccccacatcagtgcgttccagcgtggaggacaccgtgaagaattcggagcctacgaaacgaccagacagcgagacaatgccttcatgtagtaccagaaacaaggttcaggatcacagacctcgcgagtctaattttggctccttcgatcagacgatgaaagggaacagttacctcccagagggcagtttcctgcaaaagctgctgagaaaggcatccgacagcacagaggctgccctcaagcaagtcctcagctttatcgagatgggcaaaggtgaaaacctccgcgtcttccactacgagaacctgaaaccagtcgtggagcccaatcagatacagacaaccatcagtcccctgaagatttgcttggcagctgagaatatcgtgaatacagtcctcagtagctgcggtttcccgagtcaaccacacacgaacgaaaaccgtgaaatcatgaagcccttctttatctcgaagcagagttccctttccgaggtgtctggcgggcagaaggacaatgaaaagtccctcctacgaatgcaggacaaaaagattaattatatccccgaagaggaaaacgagaatttggaggctagcagagaggactcttccttcttgcagaagctcaagaagaaggaatacccaaaaatcgagacggtgaaggaagtggaagccttcacattcgccgaccacgagatgggatcgaatgaagttcacctgatagcccgacatgtgacaaccagtgttgtgacttatctgaagaactttgagacaacggggaaatgttag

SEQ ID NO: 42343 - DNA, 20991 bp, Artificial Sequence
  Description of Artificial Sequence: Synthetic coding sequence
atgaagttccagctgtggagcagccagatccggcccctgggccccatcttcccagccctgcgtgcgctctacgccctggcaagagccgcaccccaggaagcaactgccttgctgggtccgctgcctcttgaagcatggaatgctggtgggggggccgaggtcgtgggcttgtggcctttcctggttcgctcaggacagagagacaatggggtcctggagaaagaatcaggggccggcgaggaaggtgccgagggcgctgtgcccgctatggaattgtatctcggcgcgtgcagcaaaccggccaaggtcgccgtaacaaaaacagtcgcaagtgttcttgccgcagatacacagcagtgcagggatggagtacacaaaacacacttcgcgggagtcggaccggcacagctcctagatctgccattgggcgttaagctgcccgttatacctggtagcaacgccgtcttttataccacaaatttcggcgaaaagctgttcaggccatcatacggcttcaacctgacagacccatactgtcgacttcttgagaaccaatataagtctctccatgacccacacttgaaggcatattataagagaaaagacattcttaagaggctaaaaaagggaggctacattacctcaaataataaagtggtgtgcaccctgagggaattaaataaatacagacagtaccttacatccttgaaactggatttcgaaagaaattacattaaggaacaaaggatccttgcgaaacagctgcacaacataccagaaaacaatcagattcctcaacactgcgatgtggcacaggttcagaactggctactgaaggagggaactgaaagtataaaggatcaggagcggcttatgagacataggtacttagatatgatctcaaggaagctggaacagctggagcgaactgctgaggagcaaagattattcctgatggaccgtgaggaacgacgacagcgagagcatacaaggcgaaagttgaccctgaggcgcaaaattgaggaggagtggaagacgaaggaaatgctgctcctgaccagaatggctgaggacgtgaagcgggaggaacgcattgaagagcagcagcacagaaatagagaagagtctgaccggaagaaacaggatctgctggaaaagaaaatggcttatcatctgcagaagatgcaggacaccggctttaatggagaagatatcgggaagaacactttcaagtatcgtggacaggacggcacccatgcgtctccgaagaacaagaaaaaaacgagcgaggacattatgttggtttatcctgcgggcgaccagaacacctataaggagacccacgggcataccgcgaacgccgcccatcagagacagaactcttcaaacaactttactaaaaaaaactctgcaagcgtcgtctatcaggcagatgtgcaggataacggcattaaccaaaaacgcgacggtatggtgtcaaaaaactcctctattttcgatgatcggggaggcataaatatctctggccaggggagcatcatttcagcacaggtgtcgcctacacgaaactttagtcgggttagtcaggccttcctggacccttctaaggaagagaaggagaccaatgccgactgggatggcagacccacaaagcgctcgagctacttatgcgagtctggcccgcaggcgcatgctaccgatcccggtatcttttcttcccccgtgtataccaacatgcagcagaacctactgcagaattgcctccaagagaaggtgacctcggaagaactgaacataattattcagaatgtaatgacatgggtagtggcaaccgtgacttccattctgtatccagccattaccaagtacgaaaagagactgcaaaataatacatatcctgtcagcgatgacagtattctcagctccgatagcagcagcttctgtagcacttgctctgaagactttacttataggtcttacacatctgcaactaccaaaacgtttcaggcagagccctgtgcatttgtcgtcgacacaagtgtgcgacgaccaacaactccaatcaagccccccccagcccatgtggaaaagactgtcgtaggcaaaacatgtcatatcaaggggcaatctataattagcaagcataagtataataagacaaacctgctgtattcttatcccaaacttcggtcctgcaaatcagattcacacttgctggcttcatttgaaacagggactaaaaagagcaaagatgccacaaccgagactgattcactcggctcatccttacactgcgacaaaaccgctaaagccatggacgagatgaaaaacctcaaaaacgtattcgtcaacttcaaatgctatctcaagggcgaaaccgaggttatcttggaaagtatcctgcgcgagatcatgagtgatctgacacaagccatcccttccctgtcaagtgtgactgccgaggtgtttgtcgagcaatgcgaaagagagaaagagatcctgctgtcaaatgcccatatcccttcggttgcctccgagattgtggagaacatgcttgagaaacttgagagtgcggtggagaagaagtgtgtcgagatgttcagccaggatctctccgtcgatatcaagcccagtctggccgcttcggacgaattactaacttcctcgaacggaaagcccctgaagaacagtatgccacacactctggatccaatgtgtgatatcgcagaagatatggtccacgccattttggaaaaactcatgactctggtcagctttaagcagaatgagttcttacacctcaaagatacgaacaaattgtcgtgtcagcagcataaaaccgatcccatttgcatgttcctacagagagccggcaagaataagagtagcctggagagcgacgaggcaagtttgattgtaaatgaggaagtccaaaacttgatctctaacatcttttcgcagtctagtttggttgcatatatcgaagaagcgattaacgcaatcctcggatacatacaaaccgaactgaacaatgagagaattattgcctctgaagaaaccgtggtgctgctgcagctgcttgaggatatactatttcaactccaccaggaacccgtgaacgagagctttcagaagagcagacagccccgcataagttccccaagcgacaccaaggagaaataccggctcacggggactcgcttgagcaatagtccgcgctccgggaggccctttccgcccatcaacgtgccgggaatggtgttgtattcggatgatgagaatgaggagatcgataatatagtaaagaacgtactggacagcaccttcaaggacgaaaaggtcaaatcccaggaacagattccaaaccactggttcactaagggaaacacctgtttcgaatgcaagagaaacattaagcctcctaccaagccggggagtcgctctaaagccgcttttcacgactgggaacttaagacagagcccccgtccaccaatcacgaggatattcttaaaaaaaagttgtcttctaacaaagacatttcaaccttcagccaagatcagaaacatcaaattgaaaaggcatcagagaacatagtgacatctattctgaaggagatgctgaaggacatttcaagtgtgccatttggacatctcgactccaagactggctctgaggcctccgtcctggtatccgaaaaaccacaggggctctcgcatcaggaatggattgaccagatgttttcagtaagcgaaatttcaacagtcgcacaggagattaccgactcagtactgaatatcctccacaaagcttcgaactacatctccaatactaccaagagttctatatcctctagtgtgcaccaaatcagcttacataatagcgacactgaacatattgtcaaagaggctcctaacaagtatcccctgaaaacatggttcgatagcgagaagaagatgaagtatctgagtttgttcgacgtggatccggaaaagccaccatggctcaagtccgggaaaagtgagcctaagccagtggacgacatcaatgataagatcattcggactatttttaagagactgaagtcatttatctgtcccaagctgcacatgggatttaaatcgtcacttaggagtcagctgtctaaatataccgctaagatagtgaacattgtcctgtgcgctatccaaaacgaacttgagctgcacaaagagaacctgaaccttcgcgaaatcgaccacaccaaatccctgactgataagggattctttgcgaacaccgacaagaaactcgaatcccttgtcacttctattgacgacgatatcctggcctccccattactcacgtgcatctacgacatgctgttatccagtgagaacgcccaccagaggtccatctccttgagtagcaggaagcccaaatccgccacggatagcgtagatgtgcagagtattcttcccaataggcaggataaaaagtccttccacaagtatctggcaaccccctgtacccaccactccgtcaacggtggtaatcacatcaaggagaatgcgaagctccaggtattagagcgaattggcgaaacattacacgaaatgctgtctaaactcctcggaactcatctgcactctcagttgagctgctcacaacagagtagggaaatgactaacaagaatcagaagatggcggccgccctgcagtcaaacattcaacttatttcaaaggcaatactggactatattctggctaagctgtgtggagtcgacatggatacttcttttgcttcctgcggactgaaggctataagcgaaagcttggatattgacaacccttcttttgccagtattattgagaagatggcaaaaagtacgaaaattatctcctccatagtgagcagacgagtacaggaagataataaagaagagactaaatcaaaggccaagcccgtcgcacccgtgtcttccaaaacccccagtacgaaagagatgcatccaaacaagctgaaggccgtggcctccgatatcctaaacatggtgttcgccaaactcgaaggcttcgctaatggtcacctcgaaatactgggagcaataaacgatggcaataaaaaaagcaataaaataggctgggagtacgagagcaccaacatctcccgggacacacacgaagcctctttcttatccgcactctatatgcatgccaagaaggtcagtagtgcgattctgaaagtgatccagactgagctgaacgtgacgtccagtgatctgaagacctctgttgagaatcctcccccggaaactcagatcctgaagtatgttgtcaaactcattctggatgcagtctcttctgacatgttcaacgagatggagtctgaaggaggaggtattgaaacttaccgataccgtcccacgtatggatcactccctggtggcgccgagtccgactccttcctggaggacgacgcttacacagccaagaagataattgacgagcggagcccacagcgcgaggaagttaagacacgaagcttgaagcaatgggcactcgaaaaaaccttgaataaaatcgaggtgaagctgaaagaacctcatatctcgcctattgccccaatcatcaggaatatcttaaatgagattttccagagcacccttattaatcagcttaatgttctgtccctgtctcactctaatttcaatggtatgcctcacaacgtagacgaacctacaccccagacatccgttcagttcatggataagatgatggacccactcctgagtgaggctgatattactatcgtcaccgacaacatcgtgcggacagtctttcacaagttgtacagcgcagcgatgaccgagcgcaacgtgcgcgagaatcggtataagacaatcaccttctcagctaatgtctcctcccacgaacacacttataagggcaaatccagcgttaccgctctggacgaaaatccgtgtaccttccagtcaagattctctgtagccgataaggagaccaaggtgaacttggccgaagacatcgtccaggccatccttacaaatctggaaacttttgcaacctccaaggtaaaatcattattttacagccaggttaattttaccgtgcccgtagcactacctatacagcaggaccattccaccctgagtaaggctctctccgcaaaagactcctacagcgatgaacaatttagttgctgttccgttgatcatacaaaaagcggaaaaacaaatctttgtcagctatccctgtctaagctgaacacctacgccctgcaagttgcaagaagaaatttacaggggattaagcaggagctggacaaggaaagagaaaaccctttcctgacccatgacatcggtatcagtgaaagcattgcgagccaaatcgtcaacgcactgctggacattatctcccgtaaaggcaagtgcgacaagaatagcagcgacaaggaaattgacttggatcagcagaagggcgtgattgagaaacttctgaacgaaaccaagtatcggaaggtcctacagctgcagatccaggacacaattgaggggatcctctgcgacatatacgagaagacattgttccagaataacctgagcttcgctacccccacgcttaagtgcagtatagcggacaagcactccgaggaaaattctgagatgttcatggaaggggccaataagataattcccaagttatctgtccccaaatcagatgtgatactgatctcgaatgatatcgtgaacattgtgctgcataatttgtcctcagctgctacccttgtgatcaacgctaagaaccctacgtctgcgcgtctgcccctgaccttttgtgatacattcccaaaaatcgattgccaacagccgctcaagggctctaagacagaaagaaagacagaacgattcagctactctcggaaccagaagtctgcctatgccgacgacaatcaaattacagtggttgaaaaggaggatacccagaagtcagccaccgattcgtgtgaagagaatgccaattttatcacaaaaactatctttaagcggcttgagagctttgcaacagagcggattgactccttgatcaccctggctttccagagtaaggaaaaatcttttgttatccctgagcttgaaaactgcaaacagaacgatagcatattctacgactctagtcaggtcgagagcgacgtcaatgtgctgaagatatctgcgaccgagactatactgtcgcaagagctgaccgacttcacgtttgtgggacggagagagaagctgggttccactattcatctgtcacaagcgcgcctgaagacctatgccgacgtgatcgcaagcgcaatcctaaagctcattaaaaatgaccttgacctcgaaatacagaagatttacccctatcaaaataacatcctcttccaagagaatatcattgtctcagaaatcgtggactctatgctcaaaatgctggacgacaagcgaagcgtcaaagaaatctgcttcaatagtaaagaaaattccaacttcagccagctcgcacttagcaatgaaattctcttaggacataaagagaaggagagaagtacaaagcaatcgctgttcaccaagtacccactcgaacagaaccaaatgattctggagaacaaacgtcagatcatcgtgctcgaggagattttcatgcggaacggcgagtccaagaataaagaaaaaggcgaactactgattgctgtcgaggagcttctcaataaattgtaccagcgggtgagggaggtgacaggccacctgccgccacttaacgagacggcaaatttcatcagtaacagtaaaatcaagacatccgacactacacagaagaacagcttccagagccacataaacagcgtcgcaaatgacatcgttgagagcgtgctgggaaaaatgtatctcgttgtggtgacttcgctctatgagaataataagagcaggaccgaggtggagattagcgatcacaatgatagcctgctcatgaagcctctgcgttttagggagactaaacaggccggaaaaatctctaactccccacggtacgcaatttcacaggcttacagctacgtggatagtcagaacatcagcgtcatggaaaatacactgctgccgtatctgcccctgcaggtgaagaaggatctgattcaaatggttctaaacaaaattaccaatttcgtgagcttgccgctcaaggtgtcccctaaagacaaccctaagccctgcttcaaagctcacttgaagacaaggagcaaaatcaccaccctccctaagttcactaaaaagacccatcttggcttgtccgctgccaaagcaaagagtaagaccaagctgggccccggagagaaaactctgaaagatagcaggtcaaaaacagctatcggcctctctcacatcatgtctgccggagatgcaaaaaaccttctggacaccaagctgccgaccagcgagctcaagatatacgcgaaagatatcataattaatattcttgaaaccatagtgaaagagtttgggaaggttaagcagactaaggccctgcctagcgaccaaattatcgctgcgggtaaaattgtaaacacagtgcttcaagagctctacgtaaccaacaattgtaacctagcatatcccatgaaaagcagccacctgaggctcagccagggcaatataggaacgggatcactgcctaagcagcaggcatgcttctacctggagaatgtttccagtcagctcgaacatatctttcccagggaggggatcttcaaaaagctttttgacaagtggcaaacagagtccaacgataaggagaacgagaaatgtaaactcctgatgatagctgaaaacgtcctcacggagatatcgatcaaggccaaggaattggagtactcgttatctctcttgaatctccccccccttgagaactgcgaaagccggttctacaatcacttcaaaggcgcttcaacacgtgccgaggacactaaggcccagattaacatgttcgggcgagagattgtggaaatgctgctggagaagcttcagctgtgcttccttagccagatccctacacctgattctgaagaaaccctgtccaatagtaaggagcacatcaccgcgaaaagcaagtatggcttcccaaataagcacagcctctccagtctaccaatttacaacactaaaactaaagaccagatatccgtgggtagctccaaccaaatcgttcaggagatcgtcgaaacagtcttgaacatgctggagagctttgttgatctgcagttcaagcatatctctaaatacgagttctctgagatcgtcaaaatgcccattgagaacctgagcagcatccagcaaaaacttctcaataaaaaaatgttgcctaaacttcagcccctgaagatgttttcagacaagtccgaaagtaatacaatcaatttcaaggagaacatccagaacattctgctgagagtgcactcctttcatagccagcttctaacttatgccgtgaacataattagtgacatgctcgcggtaattaagaataagctagacaacgagatcagtcaaatggaacctagttctattagcatcctcaaggagaatattgtggcatctgaaatcatcgggaccctgatggaccaatgcacctatttcaatgaaagtcttattcagaacctttccagggaatcactgtttcagggagccgaaaatgcttacacggtcaatcaggtggaactggccacgaacatgaagatgtttacatccaaactgaaggaggggtctctgggaattaacccctcccaagttagcaaaaccggattcgtgttctgctcagatgaggacatgaaggagaaataccgcgtttctagtgatctgcctacttcggttcggtcaagcgtagaggacactgtgaagaatagcgagcctacaaagcggcccgacagcgagaccatgccaagctgctccacaagaaataaggtgcaggatcatcgtcctcgcgaaagtaatttcggctcatttgatcaaaccatgaaaggaaatagttacctgcctgaaggatccttcttgcagaagctcctccgtaaagcatccgattcaaccgaagcagctctgaagcaggtgctctccttcatcgagatgggaaagggcgagaacctgcgagtgttccattacgagaacctaaagcctgtcgtagagcctaatcaaatccaaaccaccataagccccctcaagatatgtctggccgccgagaatatcgtcaatacagttctatcttcgtgtggctttccatcacagcctcataccaacgagaacagagaaattatgaagccttttttcatttctaagcagtcttctcttagcgaggtgagtggcggccagaaggataatgagaaaagcctcctgagaatgcaggacaaaaaaattaattatatccctgaggaggagaatgagaacttagaggcctcacgtgaagatagtagtttcctgcagaaacttaagaaaaaagaatacccgaaaatagaaacagtgaaggaggtggaggcatttaccttcgctgaccatgaaatggggagcaacgaggtccacctcatcgctcgtcatgtcacgaccagcgtcgtgacttatctgaagaattttgaaactacagtctttagcgaggagaaaatgagcgtgtccacgtggtccagaaagaagtacgaatcaaagcagtttctgcgaaatatttatgatgattccagtatttaccagtgctgtgaacatcttacagagagcgttctgtaccatctcacatcctccatttccgacggaaccaagaaaggtagagagaaggagaaggcctgggaaatccaagaggcaactttcagcaaaataatttctatccattcccaggtgttcgaaagccggagcatttcaattggggagctggccttatgtataagtgaaattattatcaagatattatttaacaacaaaataattcaggctgacatcgcccaaaagatggtcgctatccctactaagtacacatattgccccggaatagtgtcagggggattcgatgatttgtttcaggatttgctggtgggcgtgatccacgtactgagcaaggagatcgaagtggattatcatttcgagtccaacgttcgcaacaagtctttttccatgcaccgcaacaattctgtgccgctttgcaataagattaaccggcaggcctcacccagggactggcagttctctacccaacagatagggcaactgttccaaaagaataagctgtcctacctcgcttgtaagctcaattctttagttggcaaccttaagacctcagagtctaaggaggtggtaaacaaagtgttcaacatagtgtctgatcttttctctcctgatgaatgtctggataccggtatggattcgggaaaaatccagcgaacttacttttattccagcaataatgagcagcccaattccatcctgacgaacaacctccagctctctagtaaatcagtgtttctcctgaatgtagtttgcgaaaagctgatccgaatccttttggaagaatgcacgtcgacagctttcccagataaaggctccgtctccgaggaaaccagcgccgaagagtgtcagctccttaagatgctacaaagtgtggaggatggaaagtccgattacaggaaaggcggcatggactgcgaatgcttacaggtggactacatgtcggatctcctcgagaatgtcgctgagattgatcaagatctgttgactagtgactctatgttgactatcatctctcacagcctggtgaaatcacttatggacaaactcagtcacagcattcagcaggccccagagtcattacctttcgcgaacaaacatttgaattaccgcacacgggagatccagtcttcttttattaaggctcggaaatccgaattgattgaactcggacagagtaaaagttctcttgagctcaggtcttacgatagcaattctctgacagtcagcctgaacaacccttcagtggtttccagtaaaattcaggccccattcaacaaacattgtgcagtgaagtccagctccgtcagcccattcgagcggcaaagaacaaaagagatggacaaagtggctattcacaataagctgcaccaggagggaatttatgctggcgtatactctgcaacgttcttggagggaataatttcagagttgttctttaacctttccatgagcctgtgggggaagaataagaacattactgtctcttggctgaacgaaatgaacacactctttgtcaacaatgtcgttaacgaattcaacaacgcacaggtgactgtgctgcgcaatgcagaagagcgtctctgctttcctccggtccacacggaaaccgtgagcaagatagtcgactcagtttactacgacgttctgcagcagtacgagctgaaggttgcctgcggaaacaatccggtttacgacaatgcctctattgcagaacagataactaacggtatcctactggagattttggactataaattgccttcctgcttcaaggaacacctgataccacactcgtattacccgctgaagcctgaaatcatactccagaagttgcaatccaacctgaccgaatttacaagtctgccgagaagcagtagcgactactccacgatgttaagccattcatttctggaagacgtcattagaaggctgctgtcacagcttataccaccaccgataacatgtagctcgctagggaaaaagtatctgatgtctagcgacttcaacgaaatgagcacgtgcataattaataaagtgatgagcgctatcagtaaacataagatatggttcacaatctatgacaaccaatacttatacactggtaagaacctgcagaaaatggtcgactcagtttactgtaatattcttcagatgtcagattcactcgtctccatccagaaatctattgtatccaggtcacccatcatgattgaccagatcgcaagcttcattatccaggagattatcgaaaatcacctacagccctttctctcaggcgaggtactgtgccacccccgcacacccttagaccctgtgtctaccattgttacgcaagttcttagcgaagtgatcgagtctcaccggcctcagaagcagtctccccttgacattcacctggattctttcgttagggagatcgtagcccgcctgctttcaaaaattttcagcccaaaacacaatacagagatcgagctgaaaaacatgactcagcggattgtcaactctatcaaccggcactttaacaaagcaaaaatccacatcctgtatgacgacaaagagcaagcattcttctcgttcaatactgatatagtggatgaactggccacctccgtgtacaggaatgctctgaaacagcacggcctggacctagccgtggacaaggagtccgaagactccgggatcttcgtggaaaatattacaaacctgatcgtggcagcgatatccgactaccttctgcacccactgtttagtggagatttttccgcaagcacatactcaaacagtgtcgccgagaacatagttcaggacattctgagtaacatcagcaagagcaccgagccaagccaatctgtgcccctctacaacaccctgttgccatatacattcctggaggacatgattagagtcctcttgtcaaagctgttttcaagcgcctccagcttagtcttaaatagagacacgcaaaaggatatttctagagtaaatttcaacgacattgcgagtaacttggttagcgacattaggatgaaggtgtcccagcatgaaatccgcttttctaaagaggaggaggagacgaaatttatctactctgaagatgatatccagcacctggttgattctgtgttcgcgaacgtcgtgcagactagtggcagtcaggagtcagccgtccagaacataaccagctcgaatgacatactcattgatcgcattgccggattcatcattaagcatatttgtcagaagcacttgcaacccttcgtgagcgggaagtctctctcatctagtgacacctactttgacgatgagcgccggcagctcttctatacgtctgtgtactcttcaaccttcctggaggatgtgatttcaggtgtgttaaggaagatatttcatcgtgttgtgggtattgtgcagaccaagagcattagggactccgaagacgagctctttgaaaaagcggaagagctaattcacctgataaccggcgagttttccaaagcccaggtcagcatcatcgataacacagaagagcggctgtgccttccacccgtggagcgtgacgttgtgaaaaccatcgtggacatggtttactccaaagtgctgcaggagtacgagatggaggtggtgcccaataaggattttttgaacgacactaaaacactagcggcccgtattactaatattatcctggctgagattttcgattttcaaattcacccggatctgattgctaacttgcccttcaaatcccattcgaagctgtccgctaatgtgctcatacagcgtgtgcagtacgacatatcaaaatcccggtttcaacgacaagcctcaacgatgtataccactatgcttagtcacagccacctggagaagatagtcacccagttgacctcccagatcagcccactgaatacatctgctgagcaatctgacacgaccaagtccgacctctcaaataccgtaattaaactcataaatgaaataatgtctatcataagtaagcacgagatttgcatcataaagtatggaaataagaagcagtcaatgattagtgccaaggatatccagagcatggttgacagcatctacgccgacctgtcccactctaacatataccagtccatcacgaaagacaagaagtcgatctcagatattcctgtttcaaagattgcttcctttattattaaagagattttcaaccaccacatccagagctttttgtctgaggacaagacactcctgttagctgcggtagatcagacttataagttgaaggcgattgacccgaagcagcgcgagctgtcttttatcgtgaactcctctgtcttcctcgaggaggttatcagtgaactgttatgcaagatcctatacgccttctctcataacatgctagtcaccgaaaaccccgacagagtcaagctcaaactgaccagaatcgtgaccactttggtgaactctattgtgctggagttcacaacaagcgagatcctggtcgccgacaacttcgacaaaaatttgtgcttctctgaaaggtataaggagatggttcaaaagatcgtgaactcagtgtacggaaaagtgctagaccagtataagagccttatacagattcatcgggtgatccagtctgacacaatttgctttggtcgcaagatttattatctattgctcgaggagatttatgactatcaggtgcaatctctcgtctctggggagctggaaagtagcagctatagctatccccaggcagataacattattcggaatgtgctgaacattatcactaaggattcacacgccctcccgccttacattacagtgttgccccacagcctcctcgaagatatggtttataggttattaggacacgtgtttccttcaacccatacagagaatgaattaaaggagaagaaatttccccctgatgatgagtttgtcgaagctgcaagcaagctaactgatgagattataaaggagattagcgaacacgaaatacgactgtccatggccgaggacaacgcggaaagcatgcaactcgagccaatcgagaatctcgttgacagcatctgcaataacatcttgaagacgtctgaatttcaggctgaagtccagaaggacgctgataaaaaaggctgtagcttcctgagtaagctcgccggattcatcatgaaagaaattatgtatcaccatctccagccgtttttgcatggcgaggagtctagtttttccgacttgtctgactacgatcatgtttccgaactggcgaagtccggtaaagagaaaacccaaccatcactctatagtgccacattcctggaggacatcatcatagatctggtgcacaaattctgctccctgctgatcatcaccgaagacagcaaaaagaacgagatggccgagctggatataatgggtttggcattaaagctggccaattccctgatcagggaattcaaaaagtctgatattaaagtgttgccgaatgctgagaagatgttctcttttcctcccattgacaaagagactgtggataagatcagcaatttcgtctatgagcagttcattgagaagtgcacaagccacgacatccaaaagggcgacgagagcaacatagcaatcggcatgatcgcagccttaacacaaaaggccatttccgcgttccgcatccagccactcttctccggcgactggagcagcacctttttttcttttctaaaccctgacaatatcacgcagcgcgtccaacatcttccgcagaacacattcactcagattagtagatgcgctaaggagaaccaactgagcctccccgatcagtcttacaaagacacttcttccacaccggattgtaaaaacatgatgagtacactggaaataaatcggggtactatgaaccgaaagaagagttttaagactaaggatacctctgtgaagaaaggggacattcagaaccccgttctgagcagcatcaacgctatcatgaaatccggaatgattaatctaactagcggtctggcaaccggcgtgaccaataagaaagaagtagatgagaacaaggtgggcatctgtacgcaaaagcactcagagaacgtcagtaaggtgacctcaaccaccactgtgaagtctaaggacactcaggaacctaacttgagtgaaacgtttaacaataatgaaatcgaaaaaaagagaaacctgattccaacggacaaaaagggcaaggacgacgaaatctacactcacttctcgttgatcatcgatgatactgaatatgagaaggaagtactgggctccgacagtgaaattggctacaagaagaaaattgataacgctagagagagctctttcaaaaaagatgataagctgttccaactgtcaagcctcaaatcgaaacgaaatcttggaacgactactgacacacttgagataaggatccgaacgagttctaatgagggacgcagggattccccaacacagacctgccgggacgaagagcatcatagcgattatgaacacgtccagaatgtgatcgagaatattttcgaggacgtgctggagctaagtagtagtccagaacccgcctattattccaagctgtcttatgaccagagtcctccgggggacaacgtgctcaatgtcatccaggagatcagcagagactcggcccagtctgtcactacaaaaaaggtttccagctctacaaacaaaaatatttctgccaaggagaaggaggaagaagagcgggaaaaagagaaggtgcgtgaggagattaagagtgagccctccaagccagatgacccccagaaccagcgagagtcgaagcctggtatattcccggctaagtttcttgaggatgtcattacggaaatggtgaagcagttgatctttagctctattcccgagacccagatacaagataggtgccaaaacgtgagcgacaaacagaaccaagctaagctgtacgacacagccatgaaacttatcaattctcttttgaaagagttcagtgatgcacagattaaggtttttagacccgacaagggaaaccagtttccaggcggcaaggtatcttcagtgcccaaagtccccccacgttataaagaacccactacagacgaagccccttcttccattaaaattaagtctgccgacaagatgcctccaatgcacaagatgatgagaaaaccatcatccgataaaatcccatctatagacaagacactcgtaaacaaggtggtacacagcagtgtgtgtaatatcttaaatgactatggctcccaggacagtatttggaaaaacataaactccaatggggaaaatctcgcaaggcggttgacctccgctgtaatcaacgagatcttccaaagacaagttaacctgatcttctgcgacgaggtgtccgtgagtgcttgcctaccactggagagcaaagacgtagtgaaaaaagttcaaaagctcgctcagactgcttccaaagagtgccagactagttcgccttataccataatcctcccccacaaattcctggagaatgttatctcagccctgttctcgaagatcttcagtacaataagttcgacgaaaaccaaggagccagaagacaatctctcaactgagctgaacttcttgcaaatgaaattggtgtctgccgtcgctaccgagatatctcaggacaagtatatgacaattcagtatgtggagacgcttcagtccgatgatgacgagatcattcagctcgtggtccaaagcgtgtataacaatttgctcccacagtttggaagccaagaaattattcagaactgtgttacaagcggatgcaagattctctctgagaatatagtggacctggtcctgcgggaggtcgcatccaaccagctgcagagttatttttgtggcgaattgaccccacaccagtgcgtggaggtggaaaacatcgtggaaaagattctcaaagacgtttttcagactactgatgtccccttaccaaagcctagccatgctgataaactcagctataacatcatagaggagattgccgtcaagttcctatccaagctgctgtctatcttcccaaaagtgcataaggagcgcactaaatccctggagacagacatgcaaaaaattactagcaaagtactcaactcagttcaggaatttattagcaaatccaaaatcaagcttgtgccacctaccaaggaatcaccaaccgttcccgttgcggataatgcgactatcgaaaacatcgtgaattccatctacacaagtgtgctgaagcactcgggcagttacacttccgtatttaaggacctgatgggaaaatctaatgtcctgtcagacacaatcggattcctgatggtaaacgccatcagtaactccgagttccagccacaggttgaggaagaggtttccaactccgaactggttctagaggctgtgaagatcatggaaaaagtgatcaaaataattgacgagctgaagagtaaagagaagtcttcttccaggaagggactgaccctggatgcgaaactgttggaggaagtcctggccctgttcttagcgaagctgattagactgccgtcatcctccagcaaagatgagaaaaacctctctaaaacagaactcaacaagatcgctagccaactaagcaaactggtgacagcggagataagcaggtcctccatctcactgattgcttccgaccctgaagagcattgtctgaaccctgagaacactgagcggatttatcaggtggtggattccgtttatagcaatattttgcagcagagcggtacaaataaggagttttactatgatatcaaagacacaaatacggcattccccaaaaaagttgcctcactcatcatcgacggcgtgtcttctttcccgttagacactatcaattcgactatttccaatgcagatctgagcggcgagctcgacgtgaacagaatcgtccagaaggcacaggagcatgcattcaatgtaatccctgagttggagcaggaaaaattagaccagaatctctctgaggaggagagccccataaagatcgtcccccatgtcggaaaaaagcccgtgaagattgatcccaaaatcatttcagaacacctggcggtaatcagcatcaaaacacagcctctggagaaactcaagcaggagtgcctgaagaggaccggacacagtatcgctgaattgagaagggcttccatttccggacgaaattactccttggggtcaccagacttagagaagaggaaaaccgagaggcgcacctctttagacaaaaccggaaggctcgatgttaaacctctagaagctgtggcccgcaactcctttcagaacatcaggaaaccagatattaccaaagtggaattgttgaaggatgtgcagtcaaaaaatgacctcattgttcgacttgtcgctcatgacattgaccaggtgtatctagagaactacataaaagaagagcgggactcagatgaagacgaagtggtgcttacgcagactttcgcaaaggaggaggggatcaaagtttttgaggaccaagtcaaggaggttaagaaaccgatccaatcaaagctgtctcccaagtctaccttgagcacgtctagtttgaaaaaattcttatcactttcaaaatgctgccagacaacagcttctgctaatatagagtctaccgaggctatcagcaatcaagtgatcgaatctaaagaaacccacgtgaagcgtgcagtagcagagctggatatggccactcccaaaacgatgcccgagactgccagctcttcttgggaggaaaagccccaatgcaagaaagaggagaagaacctcgttaccgaaccaacacattactttattcaccgcattatgagcagctccagttataatcaggaagatttaatctcgtctaccggagaggcggaagattgtcactccgacccttcagccaagatcctggaagagagttcacaagaacagaagcccgaacacggaaattccgtgaaatttatcaccattttcgagcgatccaaggatgttttagggtctgctaaccccagcaaagaagtgatcagcgagacacccaaacccgacgtttccaaacagggttcaaaaatgctcaccaaaatgagcagtacactgagcaaggtcttctcccagtgcaataccaatatctctcggagttcatcacccgctcatcaggacgaacattag

SEQ ID NO: 42344 - DNA, 20724 bp, Artificial Sequence
  Description of Artificial Sequence: Synthetic coding sequence
atggagctgtacctgggcgcctgcagcaagcccgccaaggtggccgtgaccaaaacagtggctagcgtcctagctgccgacactcagcaatgtcgggacggcgttcacaaaacacatttcgccggtgtgggtcccgcccagttgctggatctgccccttggcgtaaagctccccgtgattcccgggagcaacgccgtattttataccacgaattttggtgaaaagttattccgaccttcctacggattcaacctgacggacccatactgtcggctgctggagaatcaatataaaagcctgcatgaccctcatctgaaagcttattataaaaggaaagatatcttgaagcgacttaagaaaggcggctatataactagcaacaacaaggttgtatgtaccctgcgcgagttaaataagtaccgacagtatctcacttcactaaagctggatttcgaacgcaattacattaaggagcaaaggatactggcgaagcagctgcacaacatacctgaaaataaccagataccccaacactgtgatgttgcgcaggtccagaattggctgttaaaagaggggactgaaagtattaaagatcaggagcgcctcatgcggcatcggtacttggatatgatcagcaggaagttggaacagctggagaggacagcagaagagcagcgtttgtttctcatggatagggaggagcggcgccagagagaacacactcgccggaagctcactctgcgtcgcaagattgaggaggagtggaagaccaaggagatgcttttactcaccagaatggcagaagatgtgaaacgcgaggaaaggattgaagagcagcagcaccgtaatagggaggaaagtgaccgcaaaaagcaagatctccttgagaaaaaaatggcctatcatctccaaaagatgcaggacacaggattcaatggtgaggacatcggcaaaaatacttttaagtaccgtggtcaagacgggacgcacgccagccccaaaaataaaaaaaagacgtccgaggacattatgctggtgtatccggccggcgatcagaatacatacaaggaaacacatggccataccgccaatgctgctcaccagaggcaaaatagcagtaataattttactaaaaaaaactccgcaagcgtggtctaccaggctgatgttcaggacaacggcattaaccagaaaagggatggaatggtttcaaagaattcatctatcttcgacgatagaggaggtattaatatctctggccagggttctataatctcagcacaggtgtctccgacacgtaattttagtagggtttcccaagcttttctagatccatcgaaggaagaaaaagaaaccaacgccgattgggatggacggcccactaaaagatcctcctatctgtgtgaaagcgggcctcaggcccacgcgaccgaccctgggatcttcagcagtccagtgtacactaatatgcagcagaatctgctacaaaactgtctccaagagaaggtgacatccgaggaattaaacattattatccagaatgtgatgacctgggtagtggctaccgtgacatcaatcctctatccagcgattaccaagtacgagaaaaggctgcagaacaacacatacccagtctcagatgacagcatcttgtccagcgattcatctagcttctgttcaacatgttctgaagactttacttatcgcagctacacctccgctacaaccaagacctttcaggcagaaccatgtgctttcgtcgtcgacaccagcgtacgcaggccgaccacccctatcaagcctccgcctgctcacgtcgagaagactgtggttggcaagacctgtcacatcaagggacagagcattatctccaaacacaagtacaacaagaccaacctgctctatagctatccaaaattacggagctgcaagagtgattcacatctcctggcgagctttgagaccgggaccaaaaagtctaaggacgcgaccaccgaaacagattctttgggatccagcctgcattgcgacaaaacggccaaagccatggacgagatgaagaacctcaaaaacgtgttcgtgaattttaagtgttaccttaaaggtgagactgaggtcattttggaatcaattttgcgcgaaatcatgtccgacctcacccaagctatcccttccctgtcctccgtcaccgcagaggtttttgttgaacagtgtgagcgtgagaaagagattctgctgagcaacgcacatatcccgtcagtggcttccgaaattgttgagaacatgcttgaaaagctggagtctgccgtcgagaaaaagtgtgtagaaatgttctctcaagacctctcggtggacattaagccatctctagcagcaagcgacgaactactgacgtcatcaaacggtaaaccacttaaaaattcgatgccccacaccctagaccccatgtgcgatatcgctgaagacatggtccacgcaattctggaaaagctgatgactctggtgagctttaagcagaacgaatttctccacttaaaagacacgaacaagctatcctgccaacaacacaaaaccgatcctatttgtatgtttctgcagcgcgcaggcaaaaacaaaagttccctcgaatccgacgaggcctccttaatcgtgaatgaagaagtgcaaaatcttattagcaatatttttagtcagtcttcgctggtggcctatattgaggaagcaataaacgctatcctggggtatattcaaacagaactgaataatgaacggattattgcaagcgaggagacggttgtgctcctgcagctgttggaggatattctgttccagctgcaccaggaacctgtcaatgagagcttccaaaagagtcggcagcccaggatctccagtccatcagacacaaaggagaagtacagactcactggcacccgcctgagcaactcaccccgctccggtagaccatttccccccattaacgtgcccggcatggttctgtactctgatgacgaaaacgaagagattgacaatatagttaagaatgtcctcgattcaaccttcaaagatgagaaggtgaaatctcaggagcagatcccaaatcactggttcactaaggggaatacttgcttcgagtgcaaacggaacatcaagccccccactaagccgggttctagaagcaaagctgcattccatgattgggagctgaagactgaacctccgtcaaccaaccatgaggacatcctcaagaaaaaattgtcctctaataaggatatatccaccttcagccaggaccaaaagcatcagatagagaaagcgagtgagaacatcgtcacatccattcttaaggaaatgcttaaagacatttcctcagtccctttcgggcacctcgactctaaaactggcagcgaggcctcagtactggtgagcgaaaaaccccagggtctgtctcatcaggaatggatcgaccagatgttctctgtgtcggagatttccaccgtagcccaggagatcacagacagcgtgctcaatatattacataaggcatccaattacatcagcaatactacaaaatcctctatctcttcttccgtgcaccagatttcactgcataactcagacactgagcatatagtcaaagaggcccctaataagtatcccctgaagacctggtttgacagtgagaagaaaatgaagtacttaagtctctttgacgttgacccagagaagccaccatggctcaagagtgggaagtctgagccaaaacctgtcgacgacatcaacgataaaatcatccgaacgatcttcaaacgcctcaagtcctttatttgtccaaaattgcacatgggtttcaaatcaagcctcaggtcccagttgtctaagtacactgccaaaattgtgaacattgtcttatgcgcgatccagaatgaactcgagcttcacaaagaaaacctcaatcttagggaaattgatcacaccaagagtctaactgacaaaggattctttgcgaatacggataaaaagctggagagcctggttacttcgatcgatgacgacattctcgctagtcctctactcacctgcatttacgatatgctgttgtcaagtgagaatgctcaccaaagatccatcagcctgtccagcaggaagcctaagagcgcaaccgattctgtggacgttcagtcaatcctccccaacagacaggataagaaaagcttccacaagtacctggctaccccatgcacccatcacagtgtgaatggtggaaatcacattaaggagaacgccaagctgcaagtcttggagaggattggagagaccctgcacgaaatgctgtcaaaacttctgggaacacacttgcactcacagctgagttgcagtcagcagtccagagaaatgaccaacaagaatcagaaaatggcggctgcactgcagagcaatattcagcttataagtaaagctatactcgactacatcttagccaagttatgcggtgtggatatggacacctctttcgcttcatgcgggttgaaggccatcagtgagagcctggatatcgacaacccttctttcgcctctattattgagaagatggctaagtcaacaaaaatcattagcagcatagtctctcgtagagtccaggaagacaacaaagaagagactaagtctaaagcgaaacccgttgctcccgtctcaagcaaaaccccttcaacgaaagaaatgcatcccaacaaactgaaagccgtggcaagtgacattctgaatatggtattcgcaaaactcgagggctttgcaaacgggcatcttgaaatactgggggctatcaacgacggaaacaaaaaatccaacaagataggctgggaatatgagtcaaccaatatcagtcgtgacacgcacgaggcttcattcttatctgcactgtacatgcatgccaagaaggtgagttcagcaatcctcaaggtgatccagaccgagctcaacgtgaccagttcagaccttaaaaccagtgttgaaaacccaccgcccgaaacgcagatcttaaagtacgtggtcaagctgatcctagacgccgtgtccagtgatatgtttaatgagatggagtctgaaggcggaggcattgagacttacaggtatcgtccgacctatggctctctccctgggggggctgagtcagacagttttctggaggacgacgcctataccgcgaagaaaattatagatgagcgcagcccacagcgagaggaggtcaaaactagaagtctaaagcagtgggcgttagaaaagacacttaacaagatcgaggtgaagctgaaggagccacacatatcaccaatagctcccatcattagaaatattctgaacgagatctttcagtccaccttgatcaatcagctgaatgtcctcagcctgtcacactccaattttaatggtatgccccacaatgttgatgaaccgactccacaaaccagtgtccaattcatggataaaatgatggatccgctcctttccgaagctgatatcacaatcgttactgacaatatagtcagaacggtctttcacaagctttatagtgccgccatgactgagaggaacgttcgggagaaccggtacaaaaccatcacgttctctgccaatgtgtcaagccacgagcacacctataaggggaagagcagcgttactgcattggatgaaaacccctgtacattccaaagtcgttttagcgtcgcggacaaggagacaaaagtgaatctggccgaagatatcgtccaggcgattctcactaatctggagacattcgctacttccaaggtgaaaagtcttttttattctcaggtgaatttcaccgtgccagtcgcactgcccatccaacaggaccactctaccctgagtaaggcactttcagcaaaggacagctactcagatgaacagttctcatgttgctcagtggaccacacgaagagtggaaagaccaacttgtgccagttgtccctatccaaattaaatacctacgctctgcaagtggcgcggaggaaccttcagggaataaagcaggagttggataaggaaagagagaatccatttctcactcatgatattgggattagtgaatccatagcttctcagatcgtcaatgccctacttgacataatcagtcgcaaaggcaaatgcgataaaaatagcagtgataaggaaatcgatctggatcagcagaagggggtgattgagaagctgctgaatgaaacaaaatatcgcaaagtgctgcagcttcaaattcaagacacgatagaggggatcctctgtgacatttacgaaaaaacactgttccagaataacctgagctttgcaactccaactctgaagtgctcaatagcagataagcacagcgaggaaaactctgaaatgttcatggaaggcgctaataaaatcatacccaagttgtccgtccccaagtccgacgtgattctcattagtaatgacatcgtgaacattgtattgcataatctctcatctgccgccacacttgtgatcaacgcaaaaaaccccacgtctgccaggcttcctttgacgttttgcgatactttcccaaagatcgactgtcagcagccactgaagggctcaaagaccgagaggaaaaccgaacggtttagttattctagaaaccagaagagcgcctacgctgatgataaccagattacagttgtggaaaaagaagatactcaaaaatcggccactgatagttgtgaggagaacgccaatttcataactaaaactatcttcaaacgacttgaaagtttcgccacagagcgcatcgattctctcatcactttggctttccagtctaaggagaagtccttcgtgatacccgaattggagaattgcaagcagaatgactccatcttctacgactcgtctcaggttgagagtgacgtgaacgtgctcaagatttctgccacagagaccattctgtcacaggagctcaccgactttacttttgtgggaagacgcgaaaagctgggcagcactattcacttgtcccaggctcgccttaagacatacgctgacgtcattgcctctgcaattctgaagctcatcaaaaacgatctagatctggaaatccagaaaatttacccatatcagaataacattctcttccaagagaacatcatcgtttcagaaattgtggattccatgttgaaaatgttggacgacaagcgatctgtcaaagaaatctgtttcaatagcaaggagaactccaatttcagccagttggcactctctaatgagatcctgctcggccacaaagagaaagagagatctacaaaacagtcactattcaccaagtaccctttggagcaaaaccaaatgattctcgaaaataaacgccaaataatcgtattggaggagatcttcatgcgcaacggcgaaagcaaaaacaaagaaaagggggaattactgatcgccgtcgaagagctgctcaacaaattataccagagggttagagaggtgacagggcatctgcccccactaaacgagactgctaattttatttcgaacagcaagatcaagaccagtgacactacccagaaaaacagcttccagagccacataaactctgtggccaacgatatcgtagaaagtgtcctgggcaagatgtacctggtggtggtgacctccctgtatgaaaataacaagtcacgcactgaggtggaaataagtgatcacaacgattcattgctgatgaagcccctgagattccgagagacaaaacaagccgggaagatatccaattcgcctcgatacgccatctcgcaagcttattcgtatgtggactcccagaatattagcgtgatggaaaatacgctcctcccctatctgcctctccaggttaagaaagacctcatccagatggtactgaacaagataacgaactttgtttccctccctctgaaagtctcaccgaaggataaccccaagccgtgcttcaaggcacatctgaagactcggagtaagatcaccaccctgcctaaatttacaaagaagacccatcttggtctgagtgctgctaaagccaagtctaagacaaagctagggccgggagaaaagaccctgaaggactcccgcagcaaaacggctatcggcctttctcacattatgagtgcaggagatgctaaaaatctgctcgataccaagctgccgacctctgaactaaagatatatgccaaggatattataattaacattctggaaactatcgttaaggagttcggcaaagtgaaacaaaccaaagctctgccctcagatcagattatagcggccgggaagattgtgaacaccgtgctgcaagaactgtatgtaacaaataattgtaatcttgcctatccaatgaagagttctcatctgcggctgtcgcagggaaatatcggcacgggttctcttcccaagcaacaggcttgtttctatctggaaaatgtgagcagtcagcttgagcatattttcccacgggaggggatttttaagaagttgttcgataagtggcagaccgagagcaacgataaggaaaacgagaagtgcaaactgcttatgattgctgagaatgtgctgactgaaatttctatcaaggcaaaggaactagaatacagcctgagcctcctcaacctgccacctctggagaattgcgagagtcgtttttataatcacttcaaaggggcaagtactcgcgcagaggataccaaggctcagatcaatatgtttggtcgcgagatcgtggaaatgcttctggagaaactgcagctgtgtttcctgtcacagattcccacccctgattctgaggaaactctatcaaatagtaaggagcacataacagcaaaaagcaaatatggatttcccaataagcactccttatctagcctgcctatttataacactaagacgaaagaccaaatcagcgttgggtcaagcaaccagatagtccaggagatcgtagaaactgtgttgaatatgttggagtcattcgtcgacctgcaatttaagcatatctctaaatatgaattttccgaaattgttaaaatgcccatcgagaatctgtcttccatccaacaaaaactattgaacaagaagatgctacccaaattacagcccctgaagatgttctcagacaagtccgagtcaaataccatcaacttcaaggaaaacattcagaacattctgctgcgcgtgcacagcttccattctcagctgctgacttatgccgttaacatcatttctgatatgttagctgtcatcaaaaataaattagataatgaaatatctcagatggaaccttcttctatctccattctgaaggaaaacatcgtagcatctgagataataggaaccctcatggaccaatgcacttattttaacgaaagcctgatccaaaacctctctagagagtctttgttccagggagcggagaacgcatatacagtgaatcaggtagagcttgccaccaatatgaaaatgttcaccagtaagcttaaggagggttccctaggcataaatccaagtcaagtgtcaaagactgggtttgttttttgcagtgacgaggacatgaaggaaaagtatagagtctcttccgatctcccaacaagtgtccgcagttcagtcgaagataccgtgaaaaactcggagcctacaaaacggcccgacagtgagactatgccatcatgttcaacgcgcaataaggttcaggatcaccgcccccgggagagcaacttcggctcgtttgatcaaaccatgaagggaaacagctatcttcctgaagggagtttccttcagaaacttctgaggaaggcatctgacagcacagaggcggcccttaaacaggtcctgagctttatcgagatgggaaaaggggaaaatctgagggtcttccactacgagaatctcaaacccgtggttgagccaaaccagatacagaccactatatctcccctgaaaatctgcctcgcggctgaaaatatcgtgaataccgtactatcaagctgtggcttcccatcacagccgcacaccaacgaaaacagagaaattatgaaaccattctttatctccaagcaatcgtcccttagtgaagtctctgggggacagaaagacaacgaaaagtctctgttgagaatgcaggacaaaaaaataaactacatcccggaggaggaaaacgagaacctggaagcatcacgggaagatagttccttcttgcaaaagctgaaaaagaaggagtacccaaaaattgagacggtgaaagaggtggaagctttcacctttgctgatcacgagatggggtcgaacgaggtccatctgatcgctcgacatgtgaccaccagtgtcgtcacgtacctgaaaaattttgaaaccacagtgtttagtgaggagaaaatgtccgtctccacatggagccgcaaaaagtatgagtccaagcagttcttacgcaacatttatgacgattcttccatttaccaatgttgtgaacacttgaccgaatcagtgttgtatcatctcacctcctccatctctgatggaaccaagaaggggagggaaaaagagaaagcgtgggaaatacaagaggccaccttttcaaagataatcagcattcacagccaggtgttcgaaagtaggtcaatttctatcggcgagctggccttatgcattagcgagattattatcaagattctgttcaataacaaaataattcaagccgatatcgcccagaagatggtggctattcctactaaatatacctattgtcccgggattgtgtccgggggttttgacgacctctttcaggacctgttggtgggcgttattcacgtcctgtcaaaggagatcgaagtggattaccatttcgaaagtaatgtccgaaacaagagctttagcatgcaccggaacaatagtgtgccactgtgtaacaagattaatcgccaggcctctcctcgggactggcagttctcgacacagcaaatcggccagctcttccagaaaaacaagctgagctaccttgcctgcaagctcaatagcctggtggggaacctaaagacttccgagtccaaagaggtcgtcaacaaagtgtttaatattgttagtgacctcttctctcccgacgaatgcctagacaccggcatggattccggcaagatccagaggacatatttctactccagtaacaatgaacagcccaactctatactgacaaacaatcttcagctttcaagcaagagtgtgttcttgttgaatgtcgtgtgcgagaagctgatccgcatactacttgaggaatgcacctcaaccgccttcccggataaggggagtgtgtctgaggagacctctgcggaagagtgtcagcttcttaagatgcttcagtccgtggaagacggaaaatcagactataggaaaggggggatggattgtgagtgcctccaggtcgattatatgagtgatctcttagaaaatgtggccgaaattgaccaggatctgttgactagcgactcaatgcttaccatcatttcccactctttagttaaatccttgatggataaactgtcacattcgattcagcaggctcccgaaagcctcccatttgctaacaaacacttgaactataggacacgtgagatccagagctcatttatcaaggcgagaaagtcggaattaatcgaactggggcagagcaagtctagccttgagcttaggagctacgatagcaattccctcacagtctcacttaacaacccctccgtcgtctctagtaagatccaagcacctttcaacaaacattgtgctgtgaagtcttctagtgtttcacccttcgagagacagaggaccaaggagatggataaagtcgctattcacaacaagttacatcaagaaggcatttacgccggcgtctactctgcgactttcctggaagggattatatccgagctttttttcaacctctctatgtccctgtggggcaaaaataagaatattacagtttcatggttgaacgaaatgaatacactttttgtaaacaatgttgtgaatgaattcaataacgcccaggtcaccgttctccggaacgccgaagagcgtctctgtttcccaccggtccatacggagacagtctccaaaatcgtcgattccgtttattatgacgtgctacaacagtatgaactgaaagtggcatgcggcaataatccagtgtacgacaacgccagcattgcagagcagattaccaacggcatcttgctcgaaatactcgactataagcttccgtcctgtttcaaggaacatcttatcccccacagctattatcctttgaagcccgagattattctccaaaagctccagtcaaatctgactgagtttacttctctgccccgcagtagctctgactactctaccatgctcagccactccttcctggaggatgtcattaggagactgctctcccagctgatccccccgccaattacttgttccagtctaggcaaaaaatacctgatgagttccgacttcaatgagatgtccacatgcatcattaacaaggtcatgagcgccatttcaaagcacaagatttggttcaccatttacgataatcagtacttatatactggcaagaacctgcaaaagatggtggattctgtgtattgtaacatcctccagatgtccgattcacttgtttcaatccaaaagtccattgtcagtaggtcaccaattatgattgaccaaatagcaagctttattattcaggaaatcatagaaaaccatttacagcccttcctgagcggtgaggtcctgtgtcatccacgaacgcccctggatcctgtgtccacgatcgtcacacaggtattgtcagaagtaattgagagccaccgcccacagaaacagtcaccattggacatccacctggatagtttcgtcagggaaatcgtggccaggctgctcagcaaaattttcagccctaagcacaatacagaaatcgaactgaagaatatgacacagagaatcgtcaacagcattaatcggcacttcaataaggccaagattcatatattatacgacgataaggaacaggcgttcttcagctttaacaccgacatcgtggatgaactagccacaagtgtgtacagaaacgcgctcaaacaacacgggcttgacctcgcagtcgacaaggaaagcgaggatagtggcatcttcgtggagaacataaccaatcttattgtggctgcaatatccgattatctcctccacccgttattctcgggtgatttctccgcctctacctattctaacagcgttgcagaaaacatcgtgcaggacattctgagtaacatctcaaagtccacagagccaagccaatccgtacctctgtacaacacgctgctcccctatacattcctcgaagatatgatcagggttttgcttagtaaactgtttagctctgcatcgagcctggtcctgaatcgggacacgcagaaggatatctcacgtgtcaactttaacgacatcgcttctaacctcgtgtctgacattcgtatgaaagtgtctcagcatgaaatcagattttccaaagaggaggaagaaactaaattcatatacagcgaggatgacattcaacacctggtcgattcagtgtttgctaacgtggtgcagaccagcggctctcaggaatctgccgtgcagaatattactagctccaacgatatcctcatcgaccgcatcgcaggattcataataaagcacatctgccagaagcacctgcagcccttcgtcagcggaaagtccctgtcaagctcagacacatactttgacgacgagcgccgccaactgttctatacttccgtctactcttctacttttctggaagatgtgatctcaggcgtcctccgcaagatattccaccgggtggtggggatcgttcaaactaagtccataagagattccgaggatgagctcttcgagaaagccgaggagctgatccacctcatcacaggcgagttctccaaagcccaggtaagtattatagataacactgaggagcgactgtgtcttcccccagttgagagggatgtggtgaaaactatagtcgacatggtctactcgaaggtgcttcaagagtatgagatggaagtggtcccgaacaaagatttcctgaatgacaccaaaaccctggcggcgcgcataactaatattatcctggcagaaatttttgacttccagatccaccccgatctaatcgctaaccttccatttaagagccacagtaagttgagcgcgaacgtcttgatccaaagggtgcaatacgacatctctaaatctcggttccagagacaggcctcaactatgtacactaccatgctttctcattctcaccttgaaaagatcgtgactcagttaacctctcagatttctccactcaatacttccgcagaacagtctgacactactaagtcagatctgtccaacactgtcatcaaactgatcaatgagattatgagcatcatttctaagcacgaaatatgcataatcaagtatggtaataagaagcagagtatgatctctgccaaagatattcagtcgatggtcgatagcatatacgccgatctgagtcacagtaatatctatcagtcaattaccaaggataaaaaatcaatctcagatattcctgtctcaaaaatagcctctttcataatcaaagagatttttaaccatcacattcagtcattcctctcggaggataaaactctcctgctggcagctgtggaccagacatataagctgaaggccatcgatcccaaacaaagggagctgtctttcatcgtgaacagcagtgtctttctggaagaggttatctcagagctcctgtgcaaaatattgtacgcatttagtcataatatgctcgttacggagaatcctgatcgcgtcaagctgaagctgaccagaatagtcaccacactggtgaactccattgtgctcgagttcacgacaagtgagatcctcgtggccgataattttgacaagaacttgtgcttctccgaacgctacaaggagatggtgcagaaaatcgtgaactccgtgtatgggaaagtgctggatcagtacaagtctctgattcagatccatagagtcatccagtctgacaccatatgctttggacggaaaatctactatttgctcctggaggagatttacgattatcaggttcagtctctggtttcgggagagctggaatcatcgtcctatagctaccctcaggctgacaatatcatccgtaacgtgttaaacattatcactaaagactctcatgctctccccccatacattaccgtgctcccccactccttgttggaggatatggtctatagactcctgggtcacgtctttccatctacacacactgagaatgagctgaaggaaaagaagtttcctcccgacgatgaattcgttgaagcagctagcaaacttacggacgaaatcatcaaggaaatctcagaacacgaaatcaggctgtcaatggccgaagataatgctgaatccatgcagctcgagcctatagagaacctcgtggactctatttgtaataacattttgaagaccagtgaatttcaggcagaagtacaaaaggacgccgataaaaaaggctgctccttcctctcaaaacttgcggggtttataatgaaggaaattatgtaccaccacctacagccttttctacacggcgaagaatcttccttttctgacctcagtgattatgatcatgtcagcgagcttgcgaagagcggaaaggagaaaacccagccctcactgtattccgctacattcctggaggacatcataatagacttggtacacaagttctgttccttgctgataatcactgaagatagcaaaaaaaacgagatggctgagctcgacatcatgggcctggccttgaagctggccaattcactaattcgagagttcaaaaaaagcgacattaaggtccttcccaatgctgaaaagatgttctcttttcccccaatcgacaaagaaacggtagacaaaattagcaattttgtgtatgagcagtttatagagaagtgcactagtcacgacatacagaaaggtgacgagtctaatattgctatcggcatgattgctgctttgacacaaaaagcaatatccgctttcagaattcaaccgctcttttccggggactggtcttcgactttttttagcttcctcaatccagacaacataacacagcgcgtgcagcacttgccgcaaaataccttcactcaaatcagtaggtgcgcgaaagaaaaccagctgtctctgcctgatcagtcatacaaggatacaagctcaacaccggactgtaaaaacatgatgagcactctggaaatcaaccggggtactatgaatcgaaaaaagagctttaagacaaaggatacatcagtcaaaaagggagacatccagaatccggtgttaagttccattaatgccatcatgaagagtggaatgatcaatctcacgtcaggcctcgcaacaggcgtgaccaacaagaaagaggtcgatgagaacaaagtgggcatttgtacccagaagcactcagagaatgtctcaaaagtgacttccactaccacggtaaaaagtaaagatacacaggaaccaaatctgagcgagacattcaataataacgagatagagaaaaagagaaatttaatccccacagacaaaaaaggcaaagatgatgagatatacacacatttcagccttattattgacgacactgagtacgagaaggaggtgctgggttcagattcagaaatagggtataaaaaaaagatcgacaacgcacgtgagtcctcatttaaaaaagatgacaaactattccagttgagttcgcttaagagtaaacgaaatttgggcacaactaccgacacactggagatccgaatcagaactagtagtaatgagggcaggcgagattcccccacccagacatgccgagacgaggaacatcacagcgactatgagcatgttcagaacgtaatcgagaatatcttcgaagatgtgctggagctgtcttcaagcccagagcccgcctattactcgaaactctcatacgaccagtcgccacctggggataatgtgttgaatgtgatacaagaaatctccagggacagcgctcagtcggtgactactaaaaaggtgagttcgtcaacgaacaaaaacatcagcgcaaaggagaaggaggaggaagagcgtgagaaggagaaggtgagagaagagatcaagtcagagccaagcaagcccgacgatcctcaaaatcagcgggaatccaagcctggaatctttccagccaaatttcttgaagatgtgattacagagatggtgaaacagttaatcttttcctccattccagagactcagatccaggacaggtgccagaacgtttccgataagcagaaccaagctaagttgtatgacactgcaatgaagctgatcaactccttactgaaggagttcagcgatgctcaaatcaaggtgttccgccccgacaaagggaatcagtttcccggcgggaaagtgtcttctgttccgaaggtacctcccaggtacaaagagcctaccaccgatgaagcgccatcttcaatcaagataaaaagcgccgacaagatgcctcccatgcataaaatgatgcggaagccaagctctgataaaatcccatccattgacaagactctcgtgaataaagtggtgcactcgtctgtttgcaatattcttaacgattatggatcccaggattccatttggaagaatattaatagtaacggggaaaatctggcacgaaggctgacatccgcagttattaatgagatcttccagaggcaggtgaacctcatcttttgcgacgaggtttcagttagtgcgtgtctgcccctggagtcaaaggatgtggtcaaaaaggtacaaaagttggctcagaccgcctctaaagaatgtcaaaccagctctccgtatacaatcatactgcctcacaagtttctggagaacgtgatctcagctttattctcgaaaatcttttccacaatttctagcacaaagacgaaagagcctgaagataacctatcaactgaactgaatttcctccagatgaaattagtgagcgccgtcgctaccgagatctcacaagacaagtacatgacgatccagtacgtagaaactctgcagtctgacgacgacgaaattatccagctggtagttcagtctgtgtacaacaatctcctgccccagtttgggtcccaggagatcatccagaattgtgtgaccagcggctgtaaaattctgagcgagaatatcgttgatctggtgttaagagaggtggccagtaatcaactccaaagctacttttgtggcgaactaaccccgcaccagtgcgtcgaagtcgagaatattgttgagaaaattctgaaggatgtgtttcagactacagacgtcccccttccaaaacctagtcacgctgataagctgagttacaatatcatcgaagagattgccgttaaatttttgtcaaaattgctgtctatctttcctaaggtgcacaaggaacgaactaaatcgctggagacggatatgcagaaaatcacctcaaaagtgcttaacagcgtccaggagttcatctcaaaaagcaaaattaaactcgtcccaccaaccaaggaatctccaacagtaccagtggccgataatgccacaatagagaatatcgtgaactctatctacacgagtgttctgaaacattccggatcatacacatctgtatttaaggatctgatgggaaaatccaatgtactgtcggatactataggattcttgatggttaatgcaatcagcaatagcgaatttcagccccaggtggaggaggaggtgagcaactccgagctcgtacttgaggctgtaaagatcatggaaaaagtgatcaagatcattgacgagctcaagtctaaagaaaagtccagttctcgcaagggactcactttggatgcaaagctactcgaggaggtgttggccctctttctcgcaaaactaatcaggctcccatcttcctccagtaaggacgagaaaaacctgagcaagacggaactgaacaagattgccagccagctgtctaaactcgtgacggccgagatctcgaggtcatctatttcactaattgccagtgatccagaagagcattgcttaaatcccgagaacactgagcgaatctatcaggtggttgatagtgtctattccaatatcttgcagcagtctgggaccaacaaggaattctactacgacatcaaagataccaacacggcttttccgaaaaaggtggcctcgctgataattgacggcgtatcgtcattccccctggatactattaacagcacaatctctaatgcagatctttctggcgagctggacgtgaatcgaattgttcagaaagcccaggagcacgcttttaatgtgatcccggagctggagcaggagaaacttgatcagaacctctcagaagaggagagccccataaagatagttccacatgtcgggaaaaaaccggtcaagattgaccccaagattatctcagaacatctcgccgtgatttctattaagactcagccgcttgagaaactgaaacaggagtgtctgaagcgcacagggcattctattgccgaactccgcagggcgtccatttcagggaggaattacagcctggggtcccctgatctggagaagagaaaaactgaacgcaggacaagtctggataagacaggccgcttggacgttaaacctctagaggccgtggctagaaactccttccagaatatccggaagcctgacattaccaaagtggagctgctaaaggacgtgcagagtaaaaatgatctaatcgtgaggctcgtggcccatgatatcgatcaggtttacctcgagaactacatcaaagaggagagagacagcgatgaagatgaagttgtactgacgcaaactttcgccaaagaagaagggattaaggtgtttgaggatcaggttaaggaggtgaagaaaccaatacaaagcaagctctcccccaagtctacacttagtactagcagtttaaagaagttcctgtcactttccaaatgttgccagactacggcaagtgctaatatcgagtcaaccgaggcgatttcaaaccaggtcattgagtctaaggagacgcacgtgaagcgagccgtcgcggagttagatatggccactcctaaaacgatgccagagactgcatcttcttcctgggaggagaagccacagtgcaaaaaggaggaaaaaaacttggtcacagagccaacgcactattttatacataggatcatgagttcttctagttacaatcaggaggatcttatatcttccaccggggaagccgaagactgccactcagacccaagcgctaagattttggaggaatccagccaggagcaaaaacctgaacacgggaatagtgttaagtttataacaattttcgaaagatcaaaagacgtcctggggtcggccaacccaagtaaggaagtgatctccgagacaccaaagcctgacgtgagcaagcaaggaagcaagatgctaaccaaaatgagctcaactctctcaaaagtgtttagtcagtgtaataccaacatcagccggtctagcagcccagctcaccaggatgaacattag

SEQ ID NO: 42345 - DNA, 411 bp, Artificial Sequence
  Description of Artificial Sequence: Synthetic coding sequence
aaggaccaggagcggctgatgcggcaccggtacctggacatgatcagccggaaactggagcagctcgaacgcaccgccgaagagcaacgcctgtttctaatggaccgggaggaacgacggcagcgtgaacatactcgccgtaaactgaccctgaggaggaagattgaggaggagtggaagactaaggaaatgttgttgttaaccaggatggccgaggacgttaagcgagaggagagaattgaagagcaacagcatagaaaccgggaggagagcgaccgaaagaagcaggatttgctggaaaagaagatggcataccacctgcagaaaatgcaagatactggcttcaatggggaagatatcggaaaaaatacctttaagtacagggggcaggatggcactcatggagaatag

SEQ ID NO: 42346 - DNA, 393 bp, Artificial Sequence
  Description of Artificial Sequence: Synthetic coding sequence
atgcggcaccggtacctggacatgatcagccggaagctggagcagctcgaacggaccgccgaggagcagcgtctgtttttgatggatagagaggagaggaggcagcgtgagcacacaagacgcaaactgactctcaggcggaagattgaagaagaatggaagaccaaggagatgcttttacttactaggatggctgaggacgtgaagcgggaagagaggatcgaggagcaacaacaccgcaatcgtgaggagtctgaccgaaagaaacaagatctgttggaaaagaagatggcctatcatcttcagaaaatgcaggacacaggatttaatggggaagacatagggaaaaacacctttaaatatcgaggccaggacggaacccatggagagtag

SEQ ID NO: 42347 - DNA, 1377 bp, Artificial Sequence
  Description of Artificial Sequence: Synthetic coding sequence
atgatgctgatccccatggccagcgtgatggccgtgaccgagcccaaatgggtgagcgtatggagccgattcttgtgggtcaccctattgagtatggtgcttggctccctgttggcgctgttgctccctcttggagctgtggaggagcagtgtctcgctgtgctaaagggtttatacctattgcgttccaaacctgacagagcacaacacgcagccacgaagtgtaccagcccatccacagagctgagcataacatcacggggagcaactctgctagtcgccaagaccaaggcgtcacctgcagggaagttggaggcccgcgccgccctaaaccaggccctcgagatgaaacgccagggaaagagagagaaggctcaaaagttgtttatgcacgctctgaaaatggaccccgactttgttgacgccctgaccgagtttggcatctttagcgaggaggacaaagacatcattcaagccgactatctctatacccgggctttgactatcagcccttaccacgagaaggccctggttaatagagatagaactctgcccctcgtggaggagatagatcagcgatacttcagcatcatcgacagcaaggtgaagaaagtgatgagtattccaaaaggaaattcagccctaagacgcgtgatggaggagacttattaccatcatatctatcataccgttgctattgaaggaaatactcttactctctccgaaatacgacacatactcgagacgcgctacgccgtgccaggtaagtcccttgaggagcagaacgaggtgattggaatgcatgctgctatgaagtatatcaacaccacactggtttctagaatcgggtcagtcacaatttccgatgttctggaaatccataggcgcgtcctaggatacgtagatcctgtcgaagcgggccggttccggaccacacaggtgttggttgggcaccacataccaccacatcctcaggacgtagagaagcagatgcaggaatttgtgcaatggctcaattcagaggaggctatgaacctacacccggtcgagtttgctgccttggcgcactacaagctggtctatatacacccatttatagacggtaacggaaggacctcacggttgctcatgaatctgattctgatgcaggcagggtacccccccatcaccattcgaaaagaacagcgttctgattactatcatgtcctcgaagcagccaacgagggtgacgtcagaccatttatcagatttattgccaaatgcacagaaaccacactggatacactcctgttcgctacaacagagtattctgttgcactgcccgaagcccagcccaaccatagtggatttaaggagacgttaccagtgaaaccttag

SEQ ID NO: 42348 - DNA, 831 bp, Artificial Sequence
  Description of Artificial Sequence: Synthetic coding sequence
atggccagcaagcccgagaagcgggtggccagcagcgtgttcatcacccttgcacctccccggagagatgtcgctgtggcggaggaggtccgccaggccgtctgtgaggctcgtcgggggcggccttgggaagctccagcccctatgaaaaccccagaggccggcctggccgggcgcccaagtccatggactacacccggcagagccgcagccacggttccagctgcccccatgcagctttttaatggggacatctgcgctttttgtcacaaaacagtcagccctcgtgaactggcggtcgaagccatgaaaaggcaatatcacgcacaatgcttcacttgccggacatgccggaggcaactggctggtcaatctttttaccagaaggacggtcggcccctttgcgaaccctgctaccaggacaccctcgaacgctgtgggaaatgtggggaagtagtgagagaccacattattcgagcactagggcaggcgtttcacccaagttgctttacttgcgtgacatgcgcccgctgcataggcgatgaatctttcgctttgggtagtcagaatgaggtttactgtttagacgacttctaccgtaaattcgcccctgtgtgctcaatttgtgaaaacccaataattcctagggatggaaaagacgcgttcaaaatcgagtgcatgggccgcaactttcatgagaattgttacaggtgcgaggactgccggattctcttgagcgtcgaacccaccgaccaaggctgttaccctctgaacaatcatctgttttgtaagccgtgtcatgttaaacgatctgccgccggttgctgttag

SEQ ID NO: 42349 - DNA, 1122 bp, Artificial Sequence
  Description of Artificial Sequence: Synthetic coding sequence
atggccagcaagcccgagaagcgggtggccagcagcgtgttcatcactcttgcacctccccgccgggacgtggctgtagccgaggaggtgcgccaggcggtttgtgaggcccgtcgaggacgaccatgggaagccccggccccgatgaagactccggaggctggcctagccgggaggcctagtccatggactaccccagggcgcgcagccgctaccgtgccagccgccccgatgcagctgttcaacggcgggtgcccgcccccaccccctgtcctagacggggaagacgttctgccagatctggaccttcttcctccgccgccacctccaccacctgtcctgctgccaagcgaagaggaagctcctgcgcctatgggggcatccctgatcgcggatctagaacaactccacctcagtcctccccctcccccgccccaggcaccagccgagggccccagcgttcaaccaggaccccttagaccaatggaggaggaattgccacccccacccgcagagcctgtggaaaaaggagccagcacagacatctgtgccttttgtcacaaaaccgtgtcacctagagagctggcagtggaggcgatgaaaaggcagtaccacgcccagtgcttcacgtgtagaacttgcagacgccagctggctggccagtccttctaccagaaggacggccggcctttgtgcgagccttgctaccaggacacgctcgagcggtgcgggaaatgtggtgaagtcgttcgcgatcacatcattcgggcactagggcaggctttccacccctcctgttttacgtgtgttacctgtgcaaggtgcattggagatgaatctttcgctcttgggtcgcagaatgaagtgtactgcctggacgacttctaccgtaaatttgccccggtctgttcaatttgcgaaaatcccataattcctagagatggtaaggacgccttcaagatcgaatgtatggggcgtaatttccatgagaactgctacagatgtgaagactgcaggatactgctttccgtcgagccaacggaccagggatgctatccgttgaacaatcacttattctgcaaaccgtgccacgttaagcgctctgccgccggctgttgttag

SEQ ID NO: 42350 - DNA, 1122 bp, Artificial Sequence
  Description of Artificial Sequence: Synthetic coding sequence
atggccagcaagcccgagaagcgggtggccagcagcgtgttcatcaccctagcgccccctcgtcgggacgtggccgtagcagaggaagtaaggcaagcagtttgcgaagcacggagaggaagaccttgggaggctcccgcccccatgaagacacccgaggcgggactggccgggcggccttctccatggactacccctggccgcgcagccgccaccgttcctgcagcccccatgcagctgtttaacggaggctgccctcctccacctccagtcctggatggtgaagatgtcctcccagacttggatctactcccaccccctccacccccaccccctgtgctgttgccatcggaagaggaagctcccgcccccatgggagcaagtctcattgccgacctggaacaactccatctttccccacctcctcccccacctcaagccccggccgagggtccttctgttcagccgggccctctccgacctatggaagaagaactccctcccccacctgcagagccagttgagaagggtgcatctacggatatttgcgcattctgccataaaaccgtttctcctcgggaactcgcagtggaagccatgaaacgccagtatcacgcccagtgctttacgtgcagaacctgtagaagacagttagcgggacagagcttttatcagaaagatggaagacccctgtgcgaaccatgctatcaagacacccttgaacgctgcggcaagtgtggcgaggtggttagagatcatatcataagagcactgggtcaggccttccacccatcttgtttcacctgtgtcacttgtgctcggtgcatcggggacgagtctttcgcactgggctcgcaaaacgaggtgtattgccttgacgatttttaccgaaaattcgctcctgtttgtagcatatgtgaaaatccaattataccgcgcgatggaaaggacgctttcaaaattgagtgcatgggtcgcaactttcacgagaattgttaccggtgtgaagattgcagaattctcttgagcgtcgaaccgaccgatcaaggctgctacccactaaataatcaccttttttgtaagccctgccatgtaaaaaggtcggcagctggatgctgttag

SEQ ID NO: 42351 - DNA, 831 bp, Artificial Sequence
  Description of Artificial Sequence: Synthetic coding sequence
atggccagcaagcccgagaagcgggtggccagcagcgtgttcatcacgctggctcctccacgcagagacgtggctgttgccgaggaggtgcgacaggccgtctgcgaggcccgcagagggagaccatgggaggcaccagccccgatgaaaactccagaggctggcctggcagggaggcctagtccatggactacacctggaagggccgcagctaccgtgccagcagcccctatgcagctgtttaatggcgacatctgcgcgttttgccataagacagtctctcctcgggagctcgcagtggaggcaatgaagcggcagtaccatgctcagtgtttcacctgtaggacctgccgtagacagctggccgggcagtcattctatcaaaaggatgggaggcccctgtgcgagccatgctaccaggataccttagaacggtgcggcaagtgcggcgaagtggttagggatcatatcattcgggcgctggggcaggccttccacccctcgtgttttacctgcgttacttgcgcgcggtgcatcggtgatgaatcattcgccctcggttcccagaatgaagtgtattgcttggacgatttttacaggaaattcgcccctgtgtgttcaatctgtgaaaatccgataataccaagagacggaaaggacgcgttcaagattgaatgcatgggccggaatttccacgagaactgttaccgatgtgaagactgcaggattttgctctctgtggagcctactgatcagggatgttaccccctgaacaatcatttgttctgcaagccatgccacgtaaaacggtcagccgccggttgttgttag

SEQ ID NO: 42352 - DNA, 54 bp, Artificial Sequence
  Description of Artificial Sequence: Synthetic coding sequence
atggccagcaagcccgagaagcgggtggccagcagcgtgttcatcaccctgtag

SEQ ID NO: 42353 - DNA, 315 bp, Artificial Sequence
  Description of Artificial Sequence: Synthetic coding sequence
atggccagcaagcccgagaagcgggtggccagcagcgtgttcatcacgttggctcctccacgtcgcgacgtggccgtggccgaagaggtcagacaggccgtgtgtgaggcgcggcggggccgaccttgggaggcccccgcacctatgaaaacacctgaggctggtttagccggcagaccctcgccctggaccacccctggcagggcggccgccactgtgccagctgcaccaatgcagctgttcaatggcggatgccccccccctcccccagtgttggacggagaagacgtattgccagacctggatttgctctag

SEQ ID NO: 42354 - DNA, 1125 bp, Artificial Sequence
  Description of Artificial Sequence: Synthetic coding sequence
atggccagcaagcccgagaagcgggtggccagcagcgtgttcatcacccttgcccctcctagaagagatgtggccgtggctgaggaagtccgccaggcagtttgcgaagctcgcagaggacgcccctgggaggccccagccccgatgaaaacgcctgaggctggtctcgccggacgccctagcccctggactacgccaggacgagcggctgccaccgtgcctgcagctcctatgcagttgttcaatggcggctgcccgccacccccgcctgttctggatggtgaagacgtcctccccgatttggaccttctcccacctcccccccctcccccacctgtgctgctgcctagcgaagaagaagctccggcccccatgggggcatctctgattgctgatttagagcagttgcatttgtcccccccaccccctccgccccaggcgccagccgaaggcccaagcgtccagccaggacctctacggcctatggaggaagaactccctcccccaccagcggaaccagtcgagaagggcgcgtcaacagatatctgtgccttctgccataagaccgtatcaccaagagaattggcagttgaggcaatgaaaaggcaataccatgctcaatgtttcacatgccgcacctgtaggaggcagctggcgggacagtccttctatcagaaggacggccggccattgtgtgagccttgttaccaagatacgctggagcggtgtggcaaatgtggggaggtcgtgcgggaccacatcatccgcgccctcgggcaggcttttcaccctagctgtttcacctgcgtgacttgcgcccgatgcatcggtgatgaatcctttgctcttggctctcaaaatgaggtttactgcctggacgatttctataggtacgaaaaaggactgtgcactgggtggggagccgggactgggagggatcctagccgggttaaggagctatcattgtcccctggatgttgggcacgcgtatcatgtctgttggtctattacaaagagtattaccgggccggattgggcgctgttgcccacgcatgcaatccttctaccctcggcggcaggggcggatggattactcgttccggtgacagggaccacccagggtag

SEQ ID NO: 42355 - DNA, 438 bp, Artificial Sequence
  Description of Artificial Sequence: Synthetic coding sequence
atggccagcaagcccgagaagcgggtggccagcagcgtgttcatcacactagctccaccaagacgggatgtggccgtcgccgaggaggtgcgccaggcggtatgtgaggctcgaaggggaagaccatgggaagccccagctcctatgaagacccctgaggcgggccttgctgggcgcccgagcccctggacgacaccaggcagggccgccgctacggtacctgcggctcccatgcagctgttcaatggaggatgcccaccccctcctccagtgcttgacggagaggatgttctccctgatctggatctgttgccaccccctccccccccaccccccgttctattaccaagtgaagaagaggcccctgcccccatgggcgcctctctgatagccgacttagagcagctccatctttcccctcctccacctccaccatag

SEQ ID NO: 42356 - DNA, 93 bp, Artificial Sequence
  Description of Artificial Sequence: Synthetic coding sequence
atggccagcaagcccgagaagcgggtggccagcagcgtgttcatcaccttagcaccccctcgcagggacgtcgccgtggcagaggaggtgtag

SEQ ID NO: 42357 - DNA, 96 bp, Artificial Sequence
  Description of Artificial Sequence: Synthetic coding sequence
atggccagcaagcccgagaagcgggtggccagcagcgtgttcatcacactggccccaccacggagggatgtcgctgttgcagaagaggtcaggtag

SEQ ID NO: 42358 - DNA, 435 bp, Artificial Sequence
  Description of Artificial Sequence: Synthetic coding sequence
atggccagcaagcccgagaagcgggtggccagcagcgtgttcatcacacttgctccccctcgtcgcgacgtggcagtggcagaagaagtacggcaagctgtgtgcgaagcaaggcgcggacgaccttgggaggctcctgcccccatgaagacacccgaggctggccttgctggcaggccgagcccttggaccacccctggaagggctgcagctaccgtccctgcagccccaatgcaacttttcaatggcgacatctgtgcattttgccataagacggtttccccgcgcgagttagcagtggaggccatgaaaagacagtaccatgcgcagtgttttacatgtcgtacttgtagaagacagctcgcaggccagtccttctaccaaaaggacggacgacccctgtgcgaaccttgttaccaggatactcttgagtag

SEQ ID NO: 42359 - DNA, 105 bp, Artificial Sequence
  Description of Artificial Sequence: Synthetic coding sequence
atggccagcaagcccgagaagcgggtggccagcagcgtgttcatcacgctcgcaccacctaggcgcgatgttgctgtcgccgaggaagtgcgccaggcagtttag

SEQ ID NO: 42360 - DNA, 237 bp, Artificial Sequence
  Description of Artificial Sequence: Synthetic coding sequence
atggccagcaagcccgagaagcgggtggccagcagcgtgttcatcacccttgctccaccccggagggatgtagctgtggcagaggaggtaaggcaagccgtctgcgaagcccgtaggggtaggccctgggaggctcctgcccctatgaagacaccggaggcaggcctcgctgggcgcccttccccctggacgactcctggcagagcggcagccacagtcccggctgcacccatgtag

SEQ ID NO: 42361 - DNA, 45 bp, Artificial Sequence
  Description of Artificial Sequence: Synthetic coding sequence
atggccagcaagcccgagaagcgggtggccagcagcgtgttctag

SEQ ID NO: 42362 - DNA, 300 bp, Artificial Sequence
  Description of Artificial Sequence: Synthetic coding sequence
atgtgcgtgggcgagaagcggcgggccatcatccccagccacctggcgtacgggaagcgcggcttccccccaagcgtgccagcagacgccgtcgtgcaatatgatgtcgagttgattgcacttatcagggcaaactactggctgaagcttgttaaaggcattctgcctctggtcggtatggctatggtgccagctctgctgggcctgattggataccatctctatcggaaggcaaacagacctaaggtgagcaagaaaaagctgaaggaagaaaaaaggaacaagagcaagaagaagtag

SEQ ID NO: 42363 - DNA, 441 bp, Artificial Sequence
  Description of Artificial Sequence: Synthetic coding sequence
atgaccctgcggcccagcctgctgcccctgcacctgctgctgctgctgctactttctgcagcggtgtgccgcgcggaggccgggctggagaccgagtcacctgttagaacacttcaggtcgagaccctggtcgaacccccagaaccctgcgccgagccagccgccttcggagatactctgcacatccattataccggttctctggtggacggtcgaataatcgatacttccctgaccagagaccccctggtgatcgaactgggccagaaacaggtgatcccgggcctagaacagtctctgctcgatatgtgcgtgggtgaaaagaggcgtgccatcatcccctcgcacctggcctatggtaaaagaggcttccctccttctgtcccaggcaccaaggacaacctgatgagaccgcctggcatgaccagcagtagccagtag

SEQ ID NO: 42364 - DNA, 606 bp, Artificial Sequence
  Description of Artificial Sequence: Synthetic coding sequence
atgaccctgcggcccagcctgctgcccctgcacctgctgctgctgctcctcctgagcgcagctgtttgcagggccgaggccggtctggagaccgaatctccagtgaggactttgcaggttgagactctggtagaacctcctgagccatgtgccgagcccgcagccttcggcgatacgctgcatatccactacacgggttcactcgtcgatggacgcatcatcgacacatctctaactcgcgatccactggttatcgagctcggccagaaacaggtgataccaggcctggagcaaagcctgctggatatgtgcgtaggggaaaagcgaagggctattatccctagccatctcgcctatggtaagagaggctttcctcctagcgttcccgctgatgccgtggtgcagtacgacgtggaattgatagccctcatcagagcgaattattggcttaaactcgtgaaagggattttaccactggttgggatggccatggttcctgccctgctcggcctgattggatatcacctgtaccggaaggcaaacagacccaaggtgtcaaaaaaaaaactcaaggaggaaaagcgaaataagagcaaaaagaagtag

SEQ ID NO: 42365 - DNA, 948 bp, Artificial Sequence
  Description of Artificial Sequence: Synthetic coding sequence
atgcgggccggccagcagctggccagcatgctgcggtggacccgggcgtggcggttgccaagagagggtctggggccccacggcccatccttcgctagagtccccgtagctccgagctcatcctccggaggacggggcggcgccgaacctcggcctttgccgttatcctatagactgctggacggcgaggccgcccttcctgccgtggtgttcctgcacggcttattcggcagtaaaacgaattttaacagcattgccaaaatcctagctcagcagaccgggcgccgagtcctgaccgtggacgctaggaatcacggcgattctccacactctccggacatgtcttatgaaattatgtctcaggatctgcaagacttgctgcctcagctgggcctcgtgccttgtgtggtggtggggcatagcatggggggaaagacagcaatgctgctggcgttgcaacggcctgagctggtagagagactaattgcggttgatatctcacctgtggaaagtactggcgtgagccattttgccacctacgttgccgccatgcgggccattaacattgccgatgaattgccacgaagccgtgcccgcaaactggccgatgagcaactgagtagtgtgatccaggacatggccgtacgccagcaccttcttaccaacctggtcgaggtggacggaagattcgtgtggcgcgttaacctcgacgcattgacccagcatcttgacaagattctggccttcccccagcggcaagagtcttatctaggcccgactctttttctcctgggtggtaattcccagttcgtgcatccttctcaccaccctgaaataatgcgactgttccctcgggctcagatgcaaaccgtccccaacgccggccattggatccatgctgaccgtcctcaggactttatcgcagctatacgcgggttcctcgtgtag

SEQ ID NO: 42366 - DNA, 1713 bp, Artificial Sequence
  Description of Artificial Sequence: Synthetic coding sequence
atggccttccggggctggcggcccccccccccccccctgctgctgctcctcctgtgggttacgggccaggccgcgcccgtggccgggttgggctccgatgcagagctgcagatcgaacgaaggttcgtgcccgacgagtgccctagaacagttcggagtggcgatttcgtgaggtaccattacgtgggaacatttcccgatggtcagaagttcgacagtagttatgatagggatagtacctttaacgtgtttgtgggtaagggacagctgataacaggaatggatcaggctcttgtgggaatgtgtgttaacgagcggcgattcgtgaagattccccccaaattagcctacggaaacgaaggggtcagtggggtcataccgcccaacagcgtgctccacttcgacgtgctgctgatggatatctggaatagtgaggaccaggttcaaattcacacatactttaaaccaccctcttgcccacgcaccatccaggtgtcagactttgttcgctatcattacaatggcacttttctagatggaactctcttcgacagcagccacaaccggatgaaaacttatgatacctacgtgggaatcggctggcttatccccggtatggacaaagggctgctgggtatgtgtgtgggggagaagcgaattatcacaatcccaccctttctggcctacggggaggacggagatggcaaggacattcccgggcaagcttctctcgtttttgacgttgccctcttagacctacataatcccaaggattcaatctctatcgagaacaaagtcgtgcccgagaactgcgaaaggattagccagtcgggggattttctgaggtatcattataacgggactttactggacggtacccttttcgactcttcttattcccgcaacaggacctttgatacatacatcggacaggggtacgtgataccaggaatggatgaaggtctactgggggtttgcatcggcgagaaacggaggatcgtggtccctccacacctggggtacggagaggagggacggggaaacatcccgggaagtgctgttcttgtgttcgacatccacgtcatcgattttcacaatccgtcagattctatctcaatcacttcccactataaaccaccggattgctctgtcttgtctaagaagggagactacctgaagtaccactataacgcctccttgttagatgggacgctcctggattctacatggaacctgggtaaaacatacaatatcgtgcttggttctggacaagtagtgttgggcatggacatgggactgagagaaatgtgcgtcggggaaaagcgcacagtaatcatcccgccacatctggggtatggagaggcgggcgtggacggcgaggtccctggatccgctgtcctggtttttgacatcgagctgctcgagctcgtcgctgggctacctgaggggtatatgtttatctggaatggcgaagtttcgccaaatttgttcgaggagatcgacaaagatggcaacggagaggtgcttctagaagagttttctgaatacatccatgctcaggtggcttctggtaaaggtaagctggcgcctggcttcgatgctgagttgatcgttaaaaacatgtttacaaaccaagaccggaatggtgatggcaaagtgaccgccgaggaatttaaactgaaggaccaggaggctaagcacgatgagttgtag

SEQ ID NO: 42367 - DNA, 1017 bp, Artificial Sequence
  Description of Artificial Sequence: Synthetic coding sequence
atggccggcaaggacatccccggccaggccagcctggtgttcgacgtcgcgctgctcgacctgcataatccaaaagattcgatctctattgaaaacaaggtcgtgccagagaactgtgaaaggatttcacagtccggtgatttcctaagataccactataacgggaccttactcgacggcaccttgtttgactcctcttattcacgcaacagaaccttcgacacatacataggtcaaggatatgtgatcccaggcatggatgaaggcttgctgggtgtgtgtataggcgaaaaacgcaggatcgtggtgcccccccacttaggatacggtgaggagggacgcggcaacattcctgggagcgcggttctggtatttgacatccatgtgattgacttccataaccctagcgacagcatctccatcacgagccactataagcccccagactgctcagtactatctaagaagggagattatctcaagtaccattataacgcttctctattggatggaacactgctggatagtacatggaacctgggaaaaacttacaatatcgtactgggctccggacaagtcgtgctcggcatggacatgggtctgcgagagatgtgcgtgggcgagaagaggaccgtgatcattcccccccacctgggttacggcgaggcaggggtagacggtgaggtgccgggatccgccgtgcttgtgtttgacattgagctcctcgagttggtcgctggcctacccgaaggatatatgtttatctggaacggcgaggtttcccccaacctgttcgaggagatagacaaggatggcaacggggaagtcctgctggaggagttcagcgaatacattcatgctcaggtcgcgagcggaaaggggaaactggcgcccggattcgacgccgaactgatcgtgaaaaatatgttcactaaccaggaccgaaacggggatggaaaagttacagccgaagagttcaaactgaaagatcaagaggccaaacacgatgagttatag

SEQ ID NO: 42368 - DNA, 1872 bp, Artificial Sequence
  Description of Artificial Sequence: Synthetic coding sequence
atggccttccggggctggcggcccccccccccccccctgctgctgctcctcctgtgggtgacaggccaagctgcccccgtagcagggctaggttcagatgcggagctccagatagaacgtagatttgtgcctgatgaatgtcctagaactgtccgttcaggcgacttcgttcgttatcactacgtgggtacattcccagacggacagaaattcgacagtaggtattgggatacagccgaggataaggccgacaagtcaccttgtcctcaagtgagggtaggggtgaacacctcccctagctgccgcctcaaacagaagggggtgggaatttattggaaggacctacagtttctggtccgcgttcaaaatcatggcctgagctacgatagggattccacttttaacgtgtttgtgggaaaggggcaacttattaccggcatggaccaagcactagtcggtatgtgcgtgaatgagagacgattcgtgaagatcccccctaagttggcatacggaaacgaaggcgtgagtggtgtaattcctcccaactcagtgctgcatttcgacgtgttgctgatggatatctggaatagcgaggaccaggtgcagatacacacatactttaagcccccatcttgtcctagaaccatccaggtgagtgatttcgtgcgttatcactataatgggacattcctggatggtacgctcttcgactcttcccataatcgtatgaaaacctacgacacctatgtgggtatcggctggctgatccctggtatggacaagggactactgggcatgtgtgtaggtgagaagaggataattacaattccgccctttttagcatacggagaagatggcgacggcaaagacatccccggacaagcctcccttgtttttgacgtggcattgctggacctgcacaatcccaaggattcaatttctatcgagaacaaggtagtgccagaaaactgtgagagaatttcacaaagcggagactttctgcgctatcattataatgggacactgttggatggcacactgtttgattcttcctatagtagaaatagaactttcgacacctacatagggcagggctatgtcattccaggaatggatgagggactacttggtgtgtgcattggcgagaagcgacgcatcgtggtacccccccatttgggctacggcgaggagggaagaggcaatatccccggatctgcagtgctggtctttgatatacatgttatagactttcataaccccagcgactcaatctctattacctcacattataaacccccagactgtagtgtcctcagtaaaaagggtgattacttgaagtaccactataatgcctccctattggacggaactttgctggattccacgtggaacttagggaagacctacaacatcgtgctgggatctggccaggtagtgctgggcatggatatgggcttacgcgagatgtgcgtgggcgagaagagaactgttattattccaccacacttaggatatggcgaggcgggggtagacggagaagtgccgggcagcgccgtactcgtctttgatatcgagctcctggagctcgttgctggattacccgaggggtatatgttcatttggaacggcgaagttagcccgaatctcttcgaagagatcgacaaggacggcaatggagaggtgctactcgaagagttcagtgagtatatccacgcccaggtggcctccggcaaaggaaagctcgcgccagggtttgacgcagagctcatcgtcaagaacatgtttacaaatcaggaccgcaatggggacggtaaagtgacggctgaagagttcaaactgaaggatcaagaggccaagcatgatgagttgtag

SEQ ID NO: 42369 - DNA, 1299 bp, Artificial Sequence
  Description of Artificial Sequence: Synthetic coding sequence
atggacatctggaacagcgaggaccaggtgcagatccacacctacttcaagcccccctcatgccccaggacaatccaggtctccgactttgtgagatatcactataacggcacatttctggatgggaccttgttcgattcttctcacaataggatgaaaacatatgatacttacgtaggcatcggctggcttatcccgggcatggacaagggcctgttagggatgtgtgttggagagaagcggatcattaccatccctccgttcctggcatatggcgaagatggagatggcaaagacatcccaggccaagcgagcctcgtttttgatgtcgctctcctggaccttcataatcccaaagattctatatcgattgaaaacaaagtggtgcccgagaactgcgagcggattagccaatctggggatttcttacggtatcattataatgggactctcctcgatgggacactgttcgactctagttactcgcgcaatcgaacatttgacacttatattggccagggttacgttatccctggaatggatgaaggcctactgggcgtttgtatcggcgagaaacgccgaatagtggtcccgccacacctggggtatggggaagagggacgggggaatatacctggctccgccgtgctggttttcgacatccatgtaattgatttccacaacccttctgactccatatccatcaccagccactacaaacctcctgattgcagtgtactatctaagaagggcgactacctgaaataccattacaatgccagcttgcttgatggaactctgctggatagcacgtggaacctcgggaagacttacaacatcgtcttgggatcaggacaggtggtcctcgggatggacatgggcctacgcgaaatgtgtgtgggcgaaaaaaggacagtgattatccctcctcatctgggatacggagaggcgggcgtggacggagaagtgccagggtcggctgtgctggtctttgatatcgaactgttggaacttgtggcaggcctgccagaaggatacatgttcatctggaacggtgaggtatctcccaaccttttcgaagagatcgacaaggacggcaatggggaggttctcctggaggagtttagtgagtacatccatgcccaggtcgcctctggcaaaggaaaactcgctccaggttttgacgccgaactaattgtcaagaacatgttcactaaccaggacaggaatggagacggaaaggtgactgcagaggaattcaaactgaaggaccaagaggcgaaacatgatgagttgtag

SEQ ID NO: 42370 - DNA, 1989 bp, Artificial Sequence
  Description of Artificial Sequence: Synthetic coding sequence
atggagggcacccactgcaccctgcagctgcacaagcccatcaccgagctgtgttacataagcttctgtctacctaaaggggaggtgaggggctttagttacaagggaaccgtaacgctggatagaagtaacaaagggttccacaactgctatcaggttcgtgaggaaagcgacatcatctcattatcgcaggagccggatgaacacccaggagatattttctttaaacagacgcccaccaaggatatccttacggagttatataagctgaccaccgagagggagaggcttctgactaacctgctgagctcggatcatattctgggtattaccatggggaatcaggagggcaaacttcaagagctgtctgtgtcactagcacctgaagacgactgctttcagagcgcaggtgattggcaaggcgagttgccagttggcccactcaataagcgctctacacacggtaacaagaaaccccggcggtcgtccggccggcgggaatcttttggagccctgccccagaagcgaacgaagaggaagggaagaggagggcgcgagtcagcccctctcatgggcaaagacaaaatatgttcctcacacagtttgcccttgtcccgcactcggcctaatctgtgggtgttggaagaaaagggaaatctgctgccaaatggagctctggcctgttcattgcagcggcgggaatcctgtccgcccgacattccgaaaacccccgatacagacctcggattcggatccttcgagaccgcattcaaggacacggggctaggacgtgaagtgcttccgcctgattgcagttcaactgaagcaggcggagacggtatcagaagaccgccatcagggctggaacatcagcaaacgggtctgtcggagagtcaccaagacccggaaaagcacccggaggccgaaaaagacgagatggaaaaacctgctaaacggacttgtaagcaaaaaccggtctcaaaagttgtggcaaaggtccaggatctgtcaagtcaggttcaacgggtcgtgaaaacccattctaagggcaaggagacgatcgctattaggccagcagcacatgccgagtttgtcccaaaagccgacttgctcaccttgcctggggccgaggccggcgctcacggatcaaggagacagggaaaggagcgccagggcgacaggtctagtcagtctcccgccggagagaccgccagcatttcttctgtttccgcttctgcagagggggccgttaacaaagtccccctcaaagtgatcgagtctgaaaaactcgatgaggcacccgaaggcaaaagattgggctttccagtgcacacttctgtgccacatacacgccctgagacacgcaataaacgccgcgcagggctgccattaggaggtcacaagagtctgtttctggacctgccgcacaaggttgggcccgacagttcccagccccggggggacaagaaaaagccatctcccccagcaccggccgctctgggcaaagtgtttaataacagtgcaagtcagagctccacccacaagcagacttctccagtgccttctcccctgtctccccggctgccatcacctcagcagcaccataggatactcagattgcctgctctcccaggggagagagaagctgcactgaacgattccccatgccggaagtcccgagtcttttcaggctgtgtgtctgccgacaccctggagcccccctccagtgctaaagtgactgagacaaagggggcgtcacccgccttcctcagggctggacaaccaagattggtgccgggggagactttagagaagtcacttgggccgggtaaaaccacagctgaacctcagcatcaatctccgcctgcatttcactgggatctccaacagcactttcaggagcctgtgatccgtactgtgtcaatctcgtgcgcctcgaacctgattaaggaggaggccgggaagggaaaggagagtcgttcagggtag

SEQ ID NO: 42371 - DNA, 3591 bp, Artificial Sequence
  Description of Artificial Sequence: Synthetic coding sequence
atggagaacgtggacaacagcctggacggcagcgacgtgagcgagccggccaaaccagaggctggcctagaggtcgcgcagtccatactgagtaaattcagcatgaagtccctttttggctttacatcaaagttggagtcagtgaacccagaggaggaagacgctgtgctcaaggcctttcattcacttgacgtcaatcccacttcccagcaggacgacagctctaatggtctcgatccacaagaagccggaagtagagtgtcccctgatctcggaaacgatgaaaagatcgcatccgtggaaactgagtccgaagggtcccagcgcaaagaggccggaacctctctccttgcacaggaattgttgcctctgtctaccctcaagggcactaaagatgatgtgatttgtgtccgcggtaccttagtccacaccaccagcgattccgacagcgatgacggcggacaggagccagaggagggatcctctactaatggacctaaatcaccttcaggagtcttgtcggagccgagccaggaaagcaaagagaatcctggagggttccgcgaaaacactgttactggcgaaatgaatggggctgaactatgcgctgaggatccacagaggatccccccagagatgtccagtaaacttgaggcagggaatggaggtctgcaaaccgagcggcgtcctagccaggatcaggtgggtgaggagggttctcaggatctgccagctgtgacgaaccagaatagttctgtaggaattaccgagagtgccagttccaaaaaggaggttagtggggagaaatctttccagttgccggccttcttcagtggtctgcgcgtcctgaaaaagggagctactgccgagggaggcgaaaccatcaccgagataaaaccaaaagacggagaccttgccctgctcaagctaacccagccagttcaaaaaagtctggtacaggctggcctccagaccgtcaaatcagaaaagaaagcaacagatcccaaggctacaccgactctcctggagcagttatcgctgcttctgaatatagacatgccaaaaaccgaaccaaagggtgcagaccctgaatcacccagaagggaggaaatgggttgcaacgcagatcaagaaagtcagtctggcccaggggtaccacaaacgcagggcggcgaggttaagccaaagtcaccggagacagccctagaagctttcaaggctttgttcattaggccaccgaggaaaggtaccaccgctgacacttctgaattggaggcactcaagaggaagatgaggcacgaaaaagagtcactccgagccgtgtttgagagatctaacagcaagcctgctgatggcccttctgattctaagagccccgatcactcccttaccgagcaggacgacagaacccccggacggttacaagccgtctggccccctcccaaaacgaaagatacagaggaaaaggtcgggctgaaatacaccgaggctgagtatcaagccgccattcttcacttgaaaagagagcacaaagaggaaatcgagaacctgcaagcgcagttcgagctacgggcctttcacataaggggcgagcatgcaatgataaccgcgcgtctggaagagaccatcgaaaatctgaagcatgagctagagcacagatggagggggggatgcgaggagcgtaaagacgtatgcattagcacagatgacgattgcccgcctaaaactttcagaaatgtttgtgtgcagacagaccgcgagacattcttaaagccatgcgagtctgaaagtaaaacaacccgcagcaaccaattggtgccgaaaaagttgaacatctcctctctgagtcaactctccccccccaatgatcacaaggatatacatgcagcactgcagccaatggagggcatggcctccaaccaacagaaagccttacctcctccaccagcatctatccccccaccgcctcccctgcccagcggattaggctctctttcccccgccccccccatgccgcctgtcagcgccgggccccctctgcctcctccccccccccccccaccgccactgcccccaccaagtagtgctggtcctccacctccgcccccacctccccccctccccaactccccagccccaccgaatcccggtggaccaccccccgcccctcctcccccgggcttggcgccgcctcctcctcccggactttttttcggcctgggttcttcctcctcccagtgccctcgaaaacccgccattgagccttcttgccccatgaaacccctctactggaccagaattcagatttctgatcgatcacagaatgccacaccaactctttgggactcactggaggaacccgatatcagggatccatcggagtttgaatacctgttctcgaaggacacgacacaacagaaaaagaaacctctgagcgagacgtatgaaaaaaagaataaagtgaagaagatcattaagctgctcgacggcaagcgcagccagactgtggggattcttatcagcagtctgcacttggagatgaaagatatccagcaggccatcttcaacgttgatgattcagtagtggatctggaaacccttgctgcactgtatgaaaatcgggctcaagaggacgagcttgtaaaaatacggaaatactatgagacgagcaaggaagaagagctgaagctacttgataagcccgaacaattcctgcacgagttggcacagatccccaactttgcagaacgcgcgcaatgtatcatctttcggagtgtgttttctgaaggcatcaccagcctacacaggaaggtcgagataattacccgtgcctctaaggacctgctgcatgtgaagagcgtgaaggacattctcgctttaatcctcgcctttggaaactatatgaatggcggaaataggacaagagggcaagcagatggttactcccttgaaatactcccaaagctgaaggatgtgaagtcgcgagacaatggcattaatctcgtcgattacgttgttaaatattacctccggtactacgaccaggaagctgggacagagaagtccgtatttccgcttcctgagccccaggacttttttctcgcctctcaggtgaagtttgaggatttgattaaggacttgcgaaagttgaagagacaactggaggcctcggagaagcagatggtggtagtgtgcaaggaatcacctaaagaatacctgcagcccttcaaggataagcttgaagaatttttccagaaggctaaaaaagagcataagatggaggaatcgcatctcgagaacgcccaaaagtcttttgaaacaacggtgaggtactttggcatgaagcccaaatctggagaaaaggaaataaccccatcgtacgtcttcatggtttggtatgaattctgtagcgacttcaaaactatctggaagagagaatctaagaatatctcgaaggaaaggttgaagatggcccaggagtctgtcagtaagctcactagcgaaaagaaggtggaaaccaagaaaatcaatcctacagccagtctgaaagagcggctccgccagaaggaggcttctgtcacaacaaattag

SEQ ID NO: 42372 - DNA, 1512 bp, Artificial Sequence
  Description of Artificial Sequence: Synthetic coding sequence
atggagaacgtggacaacagcctggacggcagcgacgtgagcgagcccgccaaacctgaggcgggactcgaggtcgcacaatccatccttagcaaattttccatgaaatcccttttcggctttacttccaaactggagtcggtgaaccctgaggaggaggacgcagtgctcaaagcttttcacagcttggatgttaacccaacgagccagcaggatgattctagtaacggtctggatccacaagaagccgggagtagagtttcacccgacctcggaaatgacgagaagattgcatcagttgaaaccgaatcggaaggttcgcagcgtaaggaggcaggaacttccctgctggcccaggagttgttgccactcagtacgcttaagggaaccaaggatgatgtcatctgtgtgagaggcactctcgtgcacacaacgagtgatagcgacagcgatgacggcggtcaagaacccgaggaggggagctcgacaaatgggcccaaaagtccttctggtgtcctgtctgagccaagccaggagtcgaaggaaaatccaggtggatttagggagaacactgtgaccggagagatgaatggggctgagctgtgtgccgaggatccacagcgcataccgccagaaatgtcatccaaactggaagcaggcaacggagggctgcaaaccgagaggaggccttctcaagaccaggtaggagaggaaggttctcaggatctgccagcagttaccaaccagaacagtagtgtgggtatcaccgagtcggcctcatcaaagaaagaagtttccggggagaaaagcttccagctcccagcatttttctccgggctccgggtccttaagaaaggagccaccgcagagggcggagaaaccattactgaaatcaagcccaaagacggggacctggcacttctgaaactgacccaacccgtacaaaagagcttggtccaggccgggctgcagacggttaagagcgaaaagaaggcaactgaccctaaggcaacaccaacccttctggagcagctgtccctcctgcttaacatcgacatgcccaagactgagccgaaaggcgccgatccagagagtccaagaagagaggaaatgggatgcaatgcggaccaggagagccagtcaggcccgggggtccctcaaacacagggcggcgaggtcaaaccaaaaagccccgaaaccgccctcgaagcattcaaggccctattcattcgccccccccgcaagggaaccactgccgatacaagcgaactagaggccctgaaaaggaaaatgaggcacgagaaggaatctctgcgcgcagtgttcgagcgctccaactccaaacctgccgacggtccatctgatagcaaatctcccgaccacagtcttactgagcaggacgaccgaactcctgggcggctgcaggctgtttggcccccccctaagacaaaagacaccgaggaaaaagtgggtcttaaatacacagaggctggcaacgttaagggctcttag

SEQ ID NO: 42373 - DNA, 4260 bp, Artificial Sequence
  Description of Artificial Sequence: Synthetic coding sequence
atggagggcacccactgcaccctgcagctgcacaagcccatcaccgagctttgttacatctcattttgcctgcccaaaggggaggtccggggtttttcctacaaaggtaccgttactctggatagaagcaataaggggttccacaactgctatcaggtacgtgaagaatccgatatcatttccttgtcccaggaacccgacgaacaccccggcgatatcttcttcaagcagactccgacaaaggatatcctgaccgaactgtacaaactgacaactgaaagggagagattactgactaatttgctcagttcagaccacattctgggtattacgatgggaaaccaggagggcaagttacaggagctctctgtgtctcttgcgccagaggacgactgctttcagtctgccggcgactggcagggagaactacccgtgggaccactgaacaagcgatctacacatgggaacaaaaagcctagaagaagctctggccgccgtgagagttttggagcccttccgcagaagagaacaaaacgcaaaggtaggggaggtcgcgaatcggctccgttgatgggcaaagataagatctgctcttcccatagcttgcccctttcccgcacccgacctaatctgtgggttctcgaggagaagggcaatctgctcccaaacggcgctctggcttgttccctgcagcgccgcgagtcatgtcccccagatattcccaaaactccagatactgacctgggttttggatcattcgagaccgcatttaaggacaccggtctgggacgcgaagtgctgccaccagattgctcctctacagaggctggcggcgatggaatacggagacccccctccggcctggaacaccagcagacaggcttatccgagtcacaccaggaccccgaaaagcatcccgaggccgaaaaggacgagatggagaagccagccaagagaacgtgtaagcagaaacctgtgtctaaggttgttgccaaggtgcaggatttaagcagccaggtgcagcgggtggtgaaaacacactccaagggaaaagagaccatagcaattcggcctgccgcccacgcggagttcgtgcctaaggccgatcttctgacgctccccggagcagaggctggggcccatggcagcaggaggcagggaaaggaaaggcagggcgaccgctcttcccagtcccctgcaggtgagacagcatctatcagctctgtatcggcctcagctgaaggagcggtgaataaagtgccactgaaggtcatcgagagcgaaaagctggatgaagcgcccgaggggaaacggcttgggttccccgtgcatacctcagtcccacatactaggccagagactcgtaataagcgccgagcggggctgccactcggcggtcataagagtctgtttcttgacttgccccataaagtcggaccagactcatctcagccacgtggtgacaagaaaaaaccatccccccctgctccagcggccctgggcaaagtgttcaataactccgcgagtcaatcctcaacccacaagcagacttccccggtgcccagtcctctcagcccacgcctcccatctccacagcagcaccaccgcatcctgaggctgcccgccctccccggcgagagggaggctgcattgaatgacagtccctgtaggaagtcccgtgtctttagcggctgcgtgagcgcagacactctggagccgccttcttcggcaaaggtcaccgagaccaagggcgcctcccctgccttccttagggctggacagcctcgcctggtcccaggtgagacactggagaagtctctcggtccaggtaaaacaaccgccgagcctcaacaccagtcccccccaggcatctccagtgaggggttcccttgggatggtttcaacgagcagacacccaaagacctgcctaaccgagacgggggcgcatgggtgctcggctaccgcgctggccccgcttgcccatttctactgcacgaggaaagggaaaaatccaacaggtcagaactgtacttggatttgcatcccgaccattctctgaccgagcaggatgaccgcacgcccgggcggttacaggctgtttggccaccccccaagacaaaagataccgaggaaaaagtagggctcaagtacacagaggccgaataccaggccgcgattctacacctgaagagggaacataaggaggagattgagaatctgcaggctcagttcgaactgcgggcctttcacattaggggtgaacatgcaatgataacggctaggttggaggagacgattgagaatctaaagcacgaattggagcaccgatggaggggcggctgtgaagagagaaaagacgtctgtatttccacagatgatgattgcccgccaaaaaccttcagaaatgtgtgtgtgcagactgatagggagacatttcttaagccatgtgaatcagaatcaaagaccactcggtcaaatcagctagtccctaagaaacttaatattagctcactcagccaactgtccccccctaacgatcacaaggacatccatgctgctctgcaaccgatggaaggaatggccagcaaccagcagaaggcgttaccacccccccccgctagcattcctccccccccaccgctccctagtggacttggaagcctgtctccagcaccaccaatgccgccagtgagtgctggacccccactccctccaccccctcctcccccaccccccctgccacccccgtcctccgccggacccccccctcccccgcccccaccacctcttcctaactctccagcaccccccaaccccggcggacctccccctgcaccccccccccccggactggcccctcctcctccgccaggcttgtttttcggcctaggcagttcttcatctcaatgcccccgtaaaccagcaatcgaaccctcatgccctatgaagccactgtattggacccgcattcagatctcagatcggtcccaaaatgcgacaccaacgctgtgggactcactggaggagccggacattagagatccatccgaattcgagtacctgttctccaaagataccactcagcaaaaaaaaaagcctttgagtgagacctatgagaagaagaataaagtgaagaaaatcatcaaactcctcgatgggaagaggtcccagactgtcggaattctcatcagttcgctgcaccttgagatgaaagacatccagcaggccatttttaacgtggatgatagcgtggtggacctcgaaacactagccgcgctgtatgaaaacagagcgcaggaagatgagttagtcaaaatccgaaaatactatgagacatcaaaggaagaggagctcaagctattggacaagcccgagcaatttctacacgaactggctcagataccaaacttcgctgagcgagcccaatgtatcatcttccgcagcgtgttttccgagggcattacctccctgcatcggaaagtggagataatcactagagccagcaaggatcttctgcacgtgaaaagtgtaaaagatatactggcactgatcctcgcattcggcaactacatgaacggggggaaccggacgagagggcaagccgacggttacagtctggaaattcttcccaagctaaaggatgtcaagagcagagacaacggcattaatctcgttgattatgtagtcaagtactatttacggtactatgaccaggaggcaggaaccgagaaaagcgtgtttcctctgcccgagccacaggactttttcctggccagccaagtcaagttcgaagacctgatcaaggacttgcgtaagctgaaaagacagctcgaggccagcgaaaagcaaatggttgtggtctgcaaggagtctccaaaagaatatcttcagccctttaaagacaagttagaagagttctttcagaaggcaaagaaggagcacaagatggaagagtcgcatctggagaacgcccagaaatctttcgaaactaccgtcagatattttggaatgaagcccaagagcggagagaaggagattaccccttcttatgtctttatggtttggtacgaattctgtagtgacttcaagaccatctggaagcgggagagcaaaaatattagcaaggagcggttaaaaatggcccaggagtctgttagcaagctgacttctgagaaaaaagtggaaactaagaagatcaatcccactgcctctctcaaggagagactgaggcagaaggaggcgtcagtcacaacaaactag

SEQ ID NO: 42374 - DNA, 768 bp, Artificial Sequence
  Description of Artificial Sequence: Synthetic coding sequence
atgagcagccaccggcggaaggccaagggccggaaccggcggagccatcgcgccatgagggtggctcatctagaactggctacgtatgagctggccgcgaccgagtcaaaccccgagagttctcatcctggctatgaagcggctatggccgacagacctcaacccggatggcgagagagcttgaagatgcgcgtttcaaaaccatttgggatgctgatgctcagcatctggatcctgctgttcgtctgttattacctaagctattacctatgtagcggatctagctattttgtgcttgctaatgggcacatcctccccaattcagaaaatgcccatggccagtctctggaggaggacagtgccctcgaggcgctcctgaatttcttcttcccaaccacttgtaaccttagagaaaatcaggtggctaagccttgtaacgaactccaagatcttagcgaaagtgaatgtctccgtcacaaatgctgcttttcctcctccgggaccaccagtttcaaatgtttcgcccccttccgagatgtgcccaagcagatgatgcagatgtttggcctgggagctatcagtttgatattggtctgcctgccaatttactgtagatcccttttttggcggtcggagccagctgatgacctccaacgccaagataaccgagtggtgactggcttgaaaaagcaaaggcgcaaaagaaagagaaaatctgagatgctgcaaaaggccgcccggggccgcgaggaacacggcgacgagtag

SEQ ID NO: 42375 - DNA, 903 bp, Artificial Sequence
  Description of Artificial Sequence: Synthetic coding sequence
atggacctgcccccccagctgagcttcggcctgtacgtggccgccttcgctctgggttttccactcaacgtgctggcaatccggggcgcaaccgcacatgcccggctgagactgactccctccctcgtgtatgccctgaacctgggctgttcagatttactcttgaccgtgagtttgccgttgaaagccgtggaggctcttgcaagcggagcttggccgctgcccgcaagcttgtgccccgtcttcgctgtcgctcacttcttcccactttatgccgggggtggcttcttggctgctctctccgcgggcaggtatttgggagcggccttccctttgggctatcaggccttcaggaggccatgttactcatggggcgtgtgtgccgccatctgggccctggtgctgtgccatctcggcctcgtttttggccttgaagctccgggaggctggctggaccatagcaacacgagcctgggaatcaacactcccgtcaacgggtcacccgtctgcctcgaggcttgggatccagcctctgccggtccagcaaggtttagcctttctttactgctgttcttcctgcctctcgccatcacggcgttctgttacgtgggatgcctcagggccttggcccggtcaggcctcacacacagacggaagttgcgtgccgcctgggttgctggcggagccctcctaactctcctgttgtgtgtgggaccatacaatgcaagcaacgttgccagcttcctgtatcctaatctggggggctcatggcggaagttaggactgatcacgggcgcatggagcgtggttctgaacccactggtcaccgggtacttggggaggggacccggcttgaaaaccgtgtgcgcagcccgaactcaaggagggaagtcacaaaagtag

SEQ ID NO: 42376 - DNA, 993 bp, Artificial Sequence
  Description of Artificial Sequence: Synthetic coding sequence
atgctgcccgactggaagagcagcctgatcctgatggcctacatcatcatttttttaactggcttgccagcaaatctgctggctctgcgcgcctttgtgggccgtatcagacagccgcaacctgcccccgttcacatcctgttgcttagtcttactctggcggatctactgttactcctcctcctgccctttaagattatcgaagccgcttccaatttcaggtggtatctccccaaggtagtgtgcgccttgacatcttttgggttttactccagtatatactgcagcacctggctgctagctggcatttccattgagcggtacctcggagtggctttccctgtccagtacaagctgagtaggcgccccctctacggggttattgcagctcttgtcgcatgggtgatgtcattcgggcattgcacgatcgtgatcattgtgcagtacctgaataccactgaacaagttcgcagtggtaatgagatcacatgttatgaaaattttaccgacaatcagctggatgtggtgctgccggtcaggcttgagttgtgtctcgttctcttcttcatacctatggctgtcacaatcttctgctattggagattcgtgtggatcatgttatcacagccgctcgtcggcgctcagcgacgaagacgcgccgtgggcttagcagtggtgaccctacttaacttcctggtgtgctttggcccttacaatgtgagccatttagtgggttatcaccaaagaaagagcccatggtggcggtccatcgcagtggtgttcagcagcctcaatgcatcactggaccctcttctgttctatttttcatctagtgtagtgcgccgggctttcggtcggggcctgcaggtcctccgaaatcagggctcttctctgctcggaaggagggggaaagatacggccgagggcaccaatgaagacagaggcgtcggacagggggaaggcatgccctcctcagattttactacagagtag

SEQ ID NO: 42377 - DNA, 1041 bp, Artificial Sequence
  Description of Artificial Sequence: Synthetic coding sequence
atggacaccggccccgaccagagctacttcagcggcaaccactggttcgtgtttagcgtgtatttacttacctttctcgtgggcctgccactaaatctcttggccttggtcgtatttgttggcaagctacagcgtcgccctgtcgccgtagacgttctcctcctgaacctgactgctagtgatctgctactcctcctttttcttccttttaggatggtggaagcggctaatggaatgcattggcccctaccctttattctgtgccccctgtctgggttcatcttcttcacaactatatatctgaccgcactgttcttagctgctgtgtccattgagaggtttctcagtgtggcacatcccttgtggtataagacaagacctaggctgggacaggctgggctggtgtctgtggcttgttggctcctggccagtgcccattgcagcgtggtgtacgtcatagagttcagcggagacatctcacattctcagggaaccaacggcacttgctaccttgagtttcgaaaggatcagctggctatactgctgcccgtgcgcctggaaatggcagttgttttatttgtggtgcccctgatcatcacgtcttactgttattctaggctagtatggatcctgggaaggggaggatcacacaggaggcagcgccgagtggcagggttattggctgctactcttctcaattttctggtgtgtttcggcccatacaatgtttctcatgtcgtcggatatatctgcggagaaagcccagcctggaggatctacgtcaccctgctctcaacactcaacagctgtgtcgatccctttgtgtactacttctcttccagcgggttccaggcggatttccatgagctgctgaggcggctctgtggactctgggggcaatggcagcaggagagcagtatggaactcaaagagcagaagggcggcgaagagcaacgtgcagaccgccctgcagaaaggaagacgagcgaacacagccaaggctgcggaacaggaggccaggtggcctgtgcggagagttag

SEQ ID NO: 42378 - DNA, 1758 bp, Artificial Sequence
  Description of Artificial Sequence: Synthetic coding sequence
atggcccggcccgaccccagcgccccccccagcctgctgctgctgctcctcgcccagctggtgggccgggcagccgctgccagcaaagcccccgtttgtcaggagattaccgttccgatgtgcagaggtatcggctacaacctgacccatatgcccaaccagtttaaccatgatacacaggacgaggcaggcctggaagttcaccaattctggcccctggtcgaaatccagtgctccccagacctccgcttcttcttgtgttccatgtacacccctatctgtttgcccgactaccataaacctttgcccccctgcagatcggtttgtgagagggccaaagcagggtgttcccctttgatgcgacaatacggctttgcctggccagagcggatgtcctgcgatcgcttgcccgttctgggccgagacgccgaggttctgtgtatggattacaatcgctctgaggctacaacggccccacctagaccctttcccgcaaagcctacactgcccggccccccgggagcacctgcctccggaggcgaatgtcccgcaggcgggcccttcgtgtgcaaatgcagagaacccttcgtgccgattctgaaggagagccaccccctgtataacaaggttaggaccggtcaagttcccaattgtgcagtgccgtgctaccagccatcgttcagcgccgacgagaggaccttcgccaccttctggattggcctgtggtcagtactgtgctttatctccacctcaaccactgtggcaacgttcctgatcgatatggaaaggttccggtatcccgagcgacccatcatttttctctctgcgtgctacctgtgtgtctctctgggcttcctggtgaggctggtggttggccacgccagcgtggcttgctcccgcgagcacaatcatattcactatgagactaccggacctgccctgtgcactatagtgttcctgctggtatacttttttggcatggcttcaagtatctggtgggtcatactgtctctgacttggtttcttgccgcagggatgaagtggggaaatgaagcaattgccggatacgcgcagtactttcacctggccgcgtggctgataccttcagtcaaatcaatcacagctctggcgttgtcttccgtcgacggggaccctgttgcggggatctgctatgtgggcaatcagaatctcaacagcctgcgggggttcgtgctaggacccttagtcctgtacttgctggtcggcaccctcttcctcctggccgggttcgtgagtctatttagaatcagaagtgttatcaagcagggcgggacgaagacagacaaactggagaagctgatgatccggatcggaatctttactctgctgtatacggttccagccagcatcgttgtggcatgttatctctatgagcaacattatagagaatcatgggaggcagccctcacctgtgcttgcccggggcatgacaccggtcagccccgggccaagcccgagtactgggtgctgatgctgaagtacttcatgtgtttagtcgtggggattacttccggtgtttggatctggagcggcaagaccgtggagagctggcgtaggttcacctcaagatgctgttgccggccgcgacgaggtcacaaatcgggcggagcaatggccgcaggcgactaccctgaggcaagcgccgctctgactggacggaccggtccccccggcccagctgccacctatcacaagcaggtcagtttgtctcacgtgtag

SEQ ID NO: 42379 - DNA, 2313 bp, Artificial Sequence
  Description of Artificial Sequence: Synthetic coding sequence
atgagcaagtgccggaagacccccgtgcagcagctggccagccccgcatctttcagcccggatatcctggccgacatctttgagttgttcgctaaaaatttctcatacggcaagcctttaaataatgagtggcagctgcccgacccttctgaaatatttacatgtgatcatacagaattgaacgctttcctcgatcttaaaaactcgctgaacgaagtgaagaatcttctgagtgacaaaaagctggacgaatggcacgaacatactgcttttactaacaaagccggaaaaatcatatcgcacgtgcggaagtctgtaaacgctgagctctgtacccaggcctggtgcaaattccacgaaattctgtgttcctttccgctaataccacaagaagcttttcagaacgggaaactgaatagcctccatctatgtgaagcccctggcgcattcattgcctccttgaatcattacctgaagtctcacaggttcccctgccactggtcctgggtcgccaatacactgaacccataccacgaggcgaacgacgacttaatgatgattatggatgataggctgatcgctaacacactgcattggtggtatttcgggccagacaacacgggggatatcatgaccctcaaatttctgacggggctccagaatttcatctcctctatggccactgtacatctagtgactgccgatggcagcttcgattgccaggggaacccgggcgagcaagaagccctggtttctagccttcactattgtgaggtagtgaccgcgctcaccacattaggaaatgggggatccttcgtgttaaaaatgtttactatgtttgagcactgtagtattaacctgatgtacctgttgaattgttgctttgaccaagttcacgtctttaaacccgccacatcgaaggctggaaattctgaagtgtatgtagtctgcttgcactataaagggagggaagctatacatccactcctaagtaagatgaccctgaattttgggacggagatgaaaagaaaggctctgttcccacaccacgtgatcccagactccttcctgaagcgacacgaggagtgctgcgtgtttttccataagtatcagctagaaactatttccgaaaacatccgactttttgaatgcatggggaaggccgagcaggagaagctgaacaacctacgggattgcgcaatccagtactttatgcagaaatttcaactcaaacacttgagtaggaataactggctagtgaaaaaaagttccataggttgctctactaatacaaagtggtttggccagcggaataagtattttaaaacctataacgagaggaaaatgctagaagccctgtcatggaaggacaaggtggccaaaggatattttaattcttgggctgaagaacatggcgtgtatcatcctggacagtcatcaatattagaggggaccgcctcaaatctagagtgtcatttatggcacattctcgaaggcaagaagctgcccaaggttaagtgttctccgttttgcaatggagagatcctcaaaactctaaacgaagccatcgagaagtccctcggaggtgcgtttaacctagattccaagttccgcccgaagcagcagtacagctgttcttgtcacgttttttctgaagagctcatcttttcagaactgtgttcattgacagagtgcctgcaagacgagcaggtggtggtgccctctaatcagattaaatgtttgctcgtcggtttttccaccctgaggaatattaaaatgcatatacccctcgaggttagattattggagagtgccgagcttacaacattctcttgctcgctgctgcatgacggcgatcccacataccagagactcttcctggattgtctgctgcactcactgcgtgagctgcacactggggatgtgatgatcctgccagtactcagctgttttactcgatttatggcagggttgatattcgtcctccacagctgcttccgtttcatcacatttgtctgtcccaccagctctgatcctttgagaacctgcgccgtgctgctgtgcgtgggatatcaggacttgccaaatcccgttttccggtacctgcagagtgtaaatgagttactctctaccctgcttaacagcgattctcctcagcaggttctccagttcgtgccaatggaggtgttgctgaagggagccctcctggacttcctgtgggatctgaatgctgcaatcgcaaaaagacatttgcactttattatccagcgtgagcgagaagaaatcatcaattccctacagctgcagaattag

SEQ ID NO: 42380 - DNA, 2313 bp, Artificial Sequence
  Description of Artificial Sequence: Synthetic coding sequence
atgagcaagtgccggaagacccccgtgcagcagctggccagccccgcatccttttcacctgacatactcgctgacatctttgaattgttcgccaaaaatttctcctatggaaaaccactgaacaatgagtggcagctgcccgaccctagcgagatctttacatgcgatcatacggagctgaatgcttttttagacctcaaaaactctttaaacgaggttaagaacctgttgtccgataaaaagctcgacgaatggcatgagcacactgcctttacaaacaaggccgggaagatcatcagccacgtaagaaagagcgtcaatgcagaactctgtacccaagcttggtgtaagtttcacgagatcttatgtagctttccactgattcctcaggaagcgtttcagaatgggaagttaaatagtctgcacctgtgcgaggctcctggtgcctttatagccagcttaaaccattacctgaaatcccaccgattcccctgtcattggagttgggtcgctaacactctcaatccttaccacgaggctaacgatgatcttatgatgatcatggacgacagactgatagctaatactctccattggtggtacttcggccctgacaatacaggagatataatgacactgaagttcttgaccgggttacagaattttattagctctatggccacagtgcacctcgtcactgccgacggctctttcgactgtcagggtaaccctggagagcaggaggcactcgtgtcttcgctgcactactgtgaagtggtcacggccctgaccacgcttggcaacggaggttctttcgtattgaagatgtttaccatgttcgaacattgttctattaacctgatgtatctgctgaactgctgtttcgatcaggtgcacgtgttcaagcccgcaacctctaaggctggcaactcggaggtgtatgtcgtgtgtctgcattacaagggtagagaggccattcacccccttttgagtaaaatgacgctgaacttcgggactgagatgaaacgtaaggccctctttcctcaccacgtgattcctgacagcttcctgaagaggcatgaagaatgctgtgtatttttccataaatatcaactggagaccatcagcgaaaatatccgtcttttcgaatgtatggggaaggcagaacaggaaaagctgaacaatctccgggactgcgccattcagtatttcatgcagaaattccagttgaaacatctctcaagaaataactggctggtgaagaaaagcagtatcgggtgctcaacaaatactaagtggttcggtcagagaaacaaatactttaaaacttataatgaacgcaagatgctcgaggctctgtcttggaaggacaaggttgcgaagggctactttaattcgtgggccgaagaacatggagtgtatcatcccggacagagctccatactggagggtacggctagcaatctggagtgtcatctatggcacattctggagggaaagaagctgcctaaagtgaagtgctcaccattctgcaacggagaaatattaaaaactctgaatgaagctatcgagaagtccctggggggcgcctttaatctggatagcaaattcaggccaaagcagcagtactcatgttcatgtcacgtgttctctgaagaattaatattctcagaactctgctcgcttactgagtgcctacaagatgaacaggtcgtggtcccatcaaatcagatcaaatgtctactcgtcggtttttcaactctgcgaaatattaaaatgcacataccgttagaagtaagactgctcgagagcgccgagctcacaacctttagctgtagcctgcttcacgacggtgatcccacctaccagcggttgttccttgattgtctcctgcattcactacgggagcttcatacaggcgatgtgatgattcttccagtattatcgtgttttacccgcttcatggcgggcctgattttcgtgctgcattcatgcttcagatttataacatttgtttgtcccacctccagtgatccactaagaacttgcgctgtgctgttgtgtgtggggtaccaggacctgccgaatcctgtgttccgctacttacagtcagtaaatgaactcttatccaccctcctcaatagtgactccccccagcaggtgttacaattcgttccaatggaggttctattaaaaggggccttgctggacttcctctgggatcttaatgccgcgattgccaagcgacacttacattttattattcaacgggagcgagaagagatcataaattccctgcagctgcagaattag

SEQ ID NO: 42381 - DNA, 1440 bp, Artificial Sequence
  Description of Artificial Sequence: Synthetic coding sequence
atggtgcggatccagcggcggaagctgctggccagctgcctgtgcgtgacggccaccgtttttttgcttgtcaccctccaggttatggtagagctgggcaagttcgagaggaaggaattcaagagtagcagccttcaagatggacataccaagatggaagaagctccgactcatctcaatagtttccttaaaaaagaaggcttgacctttaatcgcaagcgcaagtgggaattggactcctacccaatcatgctgtggtggtccccattaactggcgaaactggacgccttggtcaatgtggggcggatgcgtgcttctttaccattaaccggacctatctgcatcaccacatgacaaaggcctttcttttttatggcaccgactttaatattgactctttgcctctcccacggaaggctcaccacgactgggccgttttccatgaagaaagccctaagaataactataaactttttcacaagccagtgattaccctgttcaattatacggccacatttagtaggcattctcatctcccgttgactacacagtacctcgagtccattgaggtgctgaaaagccttagatatctggtcccactgcagagcaagaataagctacggaagcgcctggcacccctggtctatgttcagagtgattgtgatcctccttccgatagagattcctacgtcagagaattgatgacttatatagaagttgatagttacggggagtgtctcaggaacaaggacttgcctcagcaattgaagaaccctgccagcatggatgccgacggcttctatagaatcattgcccagtacaagtttatcctagcctttgagaatgccgtgtgcgacgactatatcacggagaagttttggcggccgctgaagctgggcgtggtgcccgtctattacggttctccgtctattactgactggctaccatccaacaaatctgccatccttgtttctgagtttagtcaccccagagagttagcgagttacattaggcgactcgacagcgatgacagactttatgaggcctacgtggagtggaagctcaagggcgagatttccaatcaaaggctcctgacagccttgcgagaacgaaagtggggggtacaagatgtaaaccaggataactacattgacgctttcgaatgtatggtgtgcacaaaggtgtgggccaacatccgactgcaggaaaagggtctcccccccaagcggtgggaggccgaagatacccacctctcctgccctgaacccacagtatttgcttttagtcctctgcgtaccccccccctttccagtttgcgggaaatgtggatcagctcctttgaacagagcaagaaagaagctcaagcccttagatggttggtcgatcgtaaccagaacttctcttctcaggaattttggggcttagtcttcaaggattag

SEQ ID NO: 42382 - DNA, 1074 bp, Artificial Sequence
  Description of Artificial Sequence: Synthetic coding sequence
atgggcatcggccagctgccccactacgccctggtggtgcccgccgacggaggagactgggaggtacgccctatgtggtcacgatgcttgtttttacaccaccagcccgacctgccacccagctcacatgaccagtccattccgctgctatggtctcaagaagagagcccaccccttgcggaaaacgacggcactgactttaatatcgactctctgccactaccccggaaggcacaccatgattgggcagtgtttcacgaggaatctccaaagaataactacaaactgttccacaaacccgtgattaccctgttcaactataccgccacatttagccgacattctcacctgccattgactactcaatacttggagagtatcgaggtactgaaatctctccggtaccttgtgccgctgcagtccaagaacaaactgagaaagcgccttgctccgctggtgtatgttcagtccgattgcgatcccccaagcgaccgggactcttatgttagagagctgatgacttacatcgaggtcgacagttatggcgaatgccttcgaaataaggaccttccgcagcagctaaagaatcctgctagtatggacgcagatggcttttatcggattatcgcccagtacaagtttattctggcgttcgagaatgctgtatgcgatgactatatcacagagaagttctggcgaccgctgaagctaggtgtggtacctgtgtattacggtagtccatcaataactgattggctgccatccaacaagtctgcgatactcgtatccgaattcagccatcctagagaactggcaagttacatccgtagattggactcagatgaccgcctgtacgaggcttacgtggagtggaagctgaaaggagagatttccaatcagaggctgctcacagccctgagggagagaaaatggggggtgcaggatgtgaaccaagacaattacatagacgccttcgagtgcatggtctgtaccaaagtctgggcgaacattcggcttcaggagaaggtgtccaagagtaaagtgggcattgaacccgctggatggccctcctag

SEQ ID NO: 42383 - DNA, 1566 bp, Artificial Sequence
  Description of Artificial Sequence: Synthetic coding sequence
atggtgcggatccagcggcggaagctgctggccagctgcctgtgcgttaccgccactgtgttcctgctggtaacactgcaggccctggatacagtcgaaaatctcatgaaggtgacagggccaccacaaggtgtcactgactcaatgcaatgttttaatgatcagaggcctctatctaatactcgatcatccgaacacatcaaggaggtcatggtggaactagggaaattcgaacggaaagagttcaagagcagttcattgcaggacggtcatactaagatggaagaagccccaacccatctcaatagttttctgaaaaaggaggggctgacgttcaaccgtaaaaggaagtgggaactagattcttatccgatcatgttgtggtggtcacccctaacgggcgaaactggacgactagggcaatgtggcgctgatgcctgcttctttaccataaatcggacctacctgcaccatcacatgaccaaggcttttctgttctatgggacagattttaacatcgactctcttccgctgccacggaaggctcatcacgactgggctgtttttcatgaggagagccccaagaataattacaagctgttccacaagccagtaatcacgctgttcaattacacagcgaccttctctcggcatagtcatctgccgttgacgacccagtacctggagtcgatcgaagtactaaagagtctcaggtacttagtgcccctgcagagcaagaacaaattaagaaaacgcttagcgccattggtgtacgttcagtcagattgtgaccccccatccgaccgggattcgtacgtacgcgagttgatgacgtacatcgaagtggactcttatggggagtgcctcaggaacaaagacctccctcaacagctgaagaacccggccagcatggacgctgatggcttctaccggattattgctcagtataaattcattttggccttcgagaatgccgtgtgcgacgattacatcaccgaaaagttttggcgccctctgaaattaggagtggtccctgtttactatggtagcccaagcattactgattggctgccctctaacaaatctgcaatcctcgtgtccgaatttagccatccccgagagctagccagctatatccggagactggacagcgatgatcggctctacgaagcatacgtggaatggaagctaaagggagaaatttctaaccagaggttgctaacagccttgagggagcggaagtggggggtacaggatgtcaatcaggataattatatagacgctttcgagtgtatggtgtgtaccaaagtgtgggccaacattcgccttcaggaaaagggattgcccccaaaaagatgggaagccgaggatacgcatctttcttgccccgagccaactgttttcgccttcagccccctccgcaccccaccactgtcatcattacgcgagatgtggatctcctcattcgaacagtctaaaaaggaagcccaggcactgcgatggctggttgataggaaccaaaatttctcgagccaggaattctggggcctcgtgtttaaggattag

SEQ ID NO: 42384 - DNA, 1479 bp, Artificial Sequence
  Description of Artificial Sequence: Synthetic coding sequence
atggccgccggccccatccgggtggtgctggtgctgctgggcgtgctcagtgtgtgtgctgccagcggacatggctctgtggctgagagggaagccgggggcgaggccgagtgggcagagccttgggacggcgcggtattccgcccaccgagtgctcttggcgccgtaggcgtgactaggtcaagcggtacaccaaggcccggaagagaggaagccggagacctcccggtcctgctgtggtggtcccctgggctcttcccacattttcccggtgatagtgaaagaatagaatgtgctcgaggggcctgcgtagcctcccggaatcggagggccctaagggacagccggactcgagccctcctgttttatggcacggatttccgcgccagcgccgcacctctccctaggctcgcgcaccagtcttgggcgttactccacgaagagagtccacttaacaattttctcctgagccatggccctggcattcgcctttttaacttaacctctaccttctccagacactccgattacccgttgtctctgcagtggctgccgggtacagcctacttacggcgacccgtccccccccccatggagcgagcggagtggaggagacggggatatgccccgctgctctaccttcagtcccactgcgacgtccccgctgatagggataggtacgtgagagaactgatgcggcacattcctgtggacagctacggcaagtgtctgcaaaatagggagctacccacagcccggctgcaggacactgctactgccaccacggaggatccagagctcttagcattcctttctcgctataagttccacttagccctggagaatgcaatttgtaatgactacatgaccgaaaaactctggcgcccaatgcatctgggggccgtgccagtgtatcgcggatcacccagcgtacgcgattggatgccaaacaaccactccgttattctgatcgacgacttcgagtcaccacagaagttggcagagtttatcgacttcctggacaaaaacgatgaggagtacatgaagtacctagcatacaagcagccaggtgggatcactaaccagttcttactggactccctcaaacaccgcgaatggggagtgaacgaccccctcctgccgaactacctgaatggctttgaatgtttcgtatgtgactacgagctcgccaggctagatgctgaaaaggcccatgctgccagccctggtgacagtccagtgttcgagccacatatcgcccagcccagccacatggattgtcccgtcccaacaccagggttcgggaatgtggaagaaatacctgagaatgactcttggaaggagatgtggctccaggactattggcagggcctggaccagggggaggcactgactgcgatgattcataacaacgaaactgaacagacgaaattttgggattacctgcatgagattttcatgaaaagacagcacttgtag

SEQ ID NO: 42385 - DNA, 1431 bp, Artificial Sequence
  Description of Artificial Sequence: Synthetic coding sequence
atggccgccggccccatccgggtggtgctggtgctgctgggcgtgctgtcggtctgcgctgcaagtggccacgggtcagtggccgagagagaagcagggggcgaagctgagtgggcggagccatgggatggggccgtgttcaggccccccagcgcccttggagccgtgggcgtcacacgctcctcagggactccccgacccggccgcgaggaagctggcgatctccctgtgttgctgtggtggagcccaggcctgtttcctcattttcccggtgacagcgagagaatcgagtgtgctaggggcgcgtgtgtcgccagccgaaatagaagagcgctccgggactccaggactagggctctgcttttctacgggactgacttcagagcgtccgccgcccctctgccgagactggcccaccaaagctgggctctgttgcatgaggaatcccctctgaacaacttccttctgagccatgggcccgggattcgactcttcaatctaacatccaccttttcccgtcatagcgattatcccctgagcttgcaatggctgccaggcacagcctacctgagacggcctgtgcccccccccatggaacgggctgagtggcgaaggcgtggttacgctcctctgctttatttacagtctcattgtgatgtgcctgccgatagagacaggtatgtcagagagcttatgcggcacatccccgtagactcctatggcaagtgcctgcaaaacagagaactccccacagcccggctgcaggacactgcaactgccaccacagaagatccggagctgttggcattcctaagtagatacaagtttcacctggctctggagaatgccatctgtaatgactacatgactgagaagctttggaggccaatgcacctgggagctgttcccgtttacaggggcagtccaagcgtgcgtgactggatgccaaacaatcatagcgtcatcctgatcgacgatttcgagagcccccaaaaactcgcagagtttatcgacttcctggataagaacgatgaagaatacatgaaatatctggcttataagcagcctggtgggatcaccaatcagtttctgctggattctttaaagcaccgtgaatggggcgtgaatgaccccctcctccctaattatctcaacgggtttgagtgtttcgtctgcgactacgaactggctcgactcgatgcagagaaagcccatgcggcctcacctggggactcccctgtgttcgagccacatattgctcagccgagccacatggattgcccagtgcctacccccgggtttggtaatgtggaagaaattcctgagaacgactcctctctggtgcaggttagagaccactgtatatgcttgagattcctgtggcctcactccgaaaagggtcgcacccataattatgctgccgtgccgtag

SEQ ID NO: 42386 - DNA, 570 bp, Artificial Sequence
  Description of Artificial Sequence: Synthetic coding sequence
atggagaccagcgccccccgggccggcagccaggtggtggccaccacagctcgccactccgcagcttatcgtgcggaccctctcagagtctcatccagggacaaactcaccgagatggccgcctccagccagggaaactttgagggcaactttgagagcttggacctcgcagaatttgctaaaaaacaaccctggtggaggaaactgttcggtcaggaatccggtccctctgccgaaaagtattccgtcgcaacccagctgttcatcggcggagttacaggttggtgcactgggttcattttccagaaggtgggcaaacttgcggctacagcggtgggcggaggatttttcttgctgcagctggccaaccacaccggatacatcaaggtggactggcaacgggtagaaaaggacatgaagaaagcaaaggagcagctcaaaatccggaaaagcaaccagatccctaccgaggtgcgctcgaaagcggaggaagtggtctcatttgtgaagaaaaatgtccttgtcaccgggggattttttgggggatttctgttaggaatggcatcctag

SEQ ID NO: 42387 - DNA, 1569 bp, Artificial Sequence
  Description of Artificial Sequence: Synthetic coding sequence
atggccctgaccgagacccagccccagctgctgagcgccgacctggtcctggctctccaggttctgatgttatgggaaatgaccgaggccaataaagtgctgaagagaagacagcacccccagcgctcacattgcatttcgagcaaaatactcgagtcgtatcccggggaaaagccactgaccaaatctctgcagcgtggcgaggacccccagtttgaccaagtgatctcttcaatgagttccctgtctgaatactgtctgccatctattctcagaactctgttcgattgcgacgagcagcagcgcgattacctgatggagcggcgagacctagccatagatttcatcttttctctcgtgctgattgaggtcctgaagcagggatcacttacctgcttgatcatcccctacctggggactctggtccctaccctggccatctgtatcctgtggcagacttgtatgcaaaaatccctagagtgttggcataagccatccaagtttcccgctgtgaagaagaaattcatggctgaactgaaggaactgaggcataaggagcagaatccgtatgtggtgcaatccatcatcagtctcatcatgggcatgaagttctttaggatcaaaatgtatccggtcgaggacttcgaggcttccctccagttcatgcaggagtgcgctcactactttctggaagtgaaagacaaagacatcaagcacgccttggccggtctgtttgttgaaatactggtgccagtagccgccgccgtaaagaatgaagtgaacgtgccctgcctgcggaattttgtcgagagtttatatgatactactttggaattatctagtcggaaaaaacactcgctggctctgtacccactcgttacatgcctactttgcgtcagtcaaaagcagttattcctcaatagatggcatatatttctgaataattgcctgtccaatctaaagaacaaggatcctaaaatggcacgagtagcactggagagcctttatagactcttgtgggtttacatgatccggattaagtgcgagagtaacacagccactcaatcacgcctgatcacgataattactacgctctttcccaagggcagccgaggagttgtacctcgggacatgcctctgaatatttttgtgaagattatccaattcatcgctcaggaaagactcgactttgcaatgaaagaaattatattcgacttcttgtgcgtgggtaagcccgcaaaggccttctctctgaatccggagaggatgaacattgggcttcgtgccttcctcgtgatagccgattccctgcagcagaaggacggggaaccaccgatgcctgtcactggtgccgttttaccatctggaaatacattgcgcgttaaaaagacttacctgtctaagacactcacggaagaggaagcaaaaatgatcggaatgtccctatattacagccaggttcgcaaggcagtggacaacatccttagacatctcgataaagaagttggaaggtgcatgatgctgaccaacgtgcaaatgctgaacaaagaacccgaagacatgatctag

SEQ ID NO: 42388 - DNA, 588 bp, Artificial Sequence
  Description of Artificial Sequence: Synthetic coding sequence
atggagagcctggcccagctggagctgtgccagcggctgtacaagctccatttccaactcctactgttgttccagtcttattgtaaattaattggccaggtacacgaggtctcttccatgcccgagctgctaaatatgtctcgagaactctcagacctgaagaagcatctgaaggaggctagcgccgtaatcgccgctgaccctttgtatagcgatggagcttggagtgagcctacattcacttctacagaagctgcaatccaatccatgctcgaatgcctgaagaacaacgaactgggcaaggctctccgacaaattagagaatgccgttccctatggccaaacgatattttcggctcgtccagcgacgacgaggtgcaaacactcctcaatatttactttcggcatcagaccttggggcagacaggtacgtatgcactggtgggctctaaccagagcctgactgaaatatgcaccaaattgatggaactgaacatggagatccgtgacatgatcagacgagcccaaagctaccgcgtgcttaccacatttcttcccgatagctctgtgtccggaacaagtctctag

SEQ ID NO: 42389 - DNA, 1278 bp, Artificial Sequence
  Description of Artificial Sequence: Synthetic coding sequence
atggccgtgacccggagcaccagcagcaccagcagcggcagcaacagtaatgtgctggtgccagtgtcatggaagcggccgcagtattcacagaagcgtactaaggagaagctcgtccacgttctcagcctgtgcggccaggaggtgggcctgtctaaaaacccctccgtgatcttctcgtcatgcggtgacctcgacctcctcgagcatcaaacgtctttagtgagtagcgaggatggcgcgcgcgagcaagaaaacatggacgatacaaatagcgagcagcaattcagggtcttcagggactttgattttctggacgtggagctcgaagacggggagggcttgagaggggagagcatggacaatttcaattggggtgttaggcgccggtcgctggactctctggataaatgtgatatgcagattcttgaagagagacagttgtctgggagcacaccgtcactcaataagatgcaccacgaagactctgacgaatcctctgaggaggaagacctgaccgctagccagatcctggagcacagtgacctcatcatgacgttgtcgccttccgaggaaacgaatccgatggagctgcttaccactgcctgcgattctaccccagccgaaccacactcatttaacacgcgaatgagctccttcgatgcctcactgcctgacatgaataatctccaaatttccgagggcagtaaagcagaggctgttcgggaagaggaagacacaacagtgcacgaagacgacctgagcagcagcattaacgagctgcccgctgccttcgagtgctcagactccttcagtctcgacatgactgaaggggaggagaaaggaaatcgggcacttgatcagtttactctcgcctcattcggagagggggaccggggggtttcaccacccccgagccctttcttttccgctatcttggcggccttccaaccagctgcctgcgatgacgctgaagaagcctggcggagccatatcaatcaactgatgtgcgattcagacggttcttgtgccgtctacacttttcacgtgttctcatcactcttcaagaatatccagaaaagattctgcttcctgacatgcgatgctgctagttacctaggggacaatcttcgagggatcggatccaaattcgtttcttcaagccagatgcttaccagttgctcagagtgtcgagcccaggttcagtgtgtcagaactgcacggattttcggatacctgcaacagcaggaaagaggacacactttatgtaagctgtag

SEQ ID NO: 42390 - DNA, 9042 bp, Artificial Sequence
  Description of Artificial Sequence: Synthetic coding sequence
atggccagccagcaggacagcggcttcttcgagatcagcatcaagtacctactgaagtcttggagtaacacaagccctgtcggcaatggatacatcaagccaccggttccgccagcaagcggcacacaccgcgaaaaggggccacccacgatgctgcccattaatgtggacccggattcaaagcccggagaatacgtcttaaagagcctgtttgtgaactttacgacacaggcggaaaggaaaataaggataatcatggcagaacccctggaaaaacctctgacaaaaagcctgcagagaggcgaagaccctcagtttgaccaagtaatcagctcaatgagctccctctccgaatattgtctccccagcatcctgcggacactgtttgattggtataagaggcagaacggaatcgaagacgagtctcacgagtaccgccccaggacctccaataagtcaaagagcgacgaacagcagcgggactatcttatggaaagacgtgatctggctatcgattttatattcagtctggtgcttattgaggtgcttaaacagattccgttgcatcctgttatcgactcactgatacacgacgttataaacctagcctttaagcattttaaatacaaagagggctacctgggaccaaacacgggaaatatgcacatcgtggcagacctgtatgccgaagttatcggagttttggctcaggctaaattccctgccgttaaaaagaaatttatggctgagcttaaagaactgcgacataaggaacaaaatccatacgtagtgcagtctattatcagcttgatcatgggaatgaaattttttagaatcaagatgtatccggtcgaggatttcgaggcaagtctgcagtttatgcaggagtgcgctcactacttcctggaggtgaaggacaaggatatcaagcacgccctagcaggtctgtttgtggaaatccttgtaccggtagccgcagccgtcaaaaatgaggtaaatgttccgtgcttgcgaaattttgtcgagagcctttacgacaccacgcttgaactcagtagtcgtaagaaacacagcctagctctttaccctttagttacctgtctgctgtgcgtttcccagaagcagctgtttctgaatcgctggcacatatttctgaataattgtctgtcaaatctgaaaaataaggacccgaagatggcacgcgtggccttggaatccctctacaggttgctgtgggtatatatgatacggataaagtgcgaatcaaatacagcaacccagtctcgcctcataaccatcatcacaactttgtttcccaaaggatcaagaggagttgttcccagagacatgccactgaatatcttcgtaaaaattatacaattcattgctcaggagcgcctcgatttcgccatgaaagaaatcatcttcgattttctgtgcgttggaaaacccgctaaggccttctcactgaatcccgaacgtatgaacattggcctgagagccttcctggttatcgccgacagtctccagcagaaggacggcgaaccacctatgccggtaacgggcgccgtcctgccatctggaaacaccctcagagtgaaaaaaacatacctttctaagacccttaccgaggaagaggcgaaaatgatcggcatgagcctgtactactcccaggtgcggaaagctgtggacaatatcctccgacacttggacaaagaggtgggtaggtgcatgatgttgacaaatgtccagatgctgaacaaggagccagaggatatgatcactggcgagcgtaagcccaaaattgatttattccgtacatgcgttgccgctattccacggctgctgcctgatgggatgtcgaaattggaactcattgatcttttggctaggctgtccatacatatggacgatgaactgcggcatattgcccaaaattcccttcagggcctgctcgtcgacttttcagattggagggaagatgtgctttttggattcaccaattttcttctgagagaagtcaatgatatgcaccacacgctgcttgactcatccctgaagctgctgcttcaacttctgacacaatggaagttagtgatccagacacagggaaaggtgtacgagcaggctaacaagatcagaaattccgagctgattgcaaatggaagcagccatcgaatacagtctgaacgcggcccacactgttccgtcttacatgccgtggaaggatttgccttggtgcttctctgcagcttccaggtggctactcgcaaactgtcagtcttaatccttaaagagattcgcgctctcttcattgcccttgggcagccagaagatgatgataggccgatgattgacgtgatggatcagctttcttctagcatcctggagtccttcatccacgttgccgtcagcgactcagcaacactgccacttacccataacgtggatctccaatggctggtggagtggaatgcagtgctggttaactcgcactacgacgtcaagagtccgtcccacgtctggatctttgcccagtccgtcaaagacccctgggtgttgtgtttgttcagcttcttgcgccaggagaaccttcccaagcactgtcctaccgccctgtcctatgcttggccttacgcattcactcgcttgcagtctgttatgcccctcgtggatcccaactctcccattaacgctaagaagacctcgaccgccggcagtggcgataactacgtaactctgtggagaaattatctgatcctgtgtttcggcgttgcaaaaccatcgatcatgtcaccagggcacttgcgggcctctacccctgaaatcatggctacaacccccgacggtacagtgtcttacgataataaggcaatcggcacgccatccgtaggcgttcttctaaagcagctagtccctctcatgcggttagagagtatcgagatcacggagtctttagtactcggattcggaagaacgaactctctggtcttccgggagctcgtggaagaactgcacccgcttatgaaagaagccttggagcgcaggcccgagaacaagaagcgaagggagcgccgggacctgcttagactgcaactgctgagaatctttgagctgctggctgatgctggagtcatctccgacagcaccaacggcgccctggagcgggacactctggcattaggtgcccttttccttgagtacgtggacctgaccagaatgctcctggaggctgaaaacgacaaagaagtggagattctgaaggatatccgagctcacttttctgccatggtggcgaatctgatacagtgtgttcccgtccaccaccgcagatttctctttccacaacagtccctgcggcaccacctctttattcttttcagtcagtgggctggccccttctcaataatgtttacaccactggatcgatattctgataggaaccaccagattacgagataccaatattgtgccttaaaagcaatgagcgcagttctatgctgcggccctgttttcgataatgtaggtttgtcccctgacgggtacctgtacaagtggctggataatatcttggcctgccaagacctgcgggtgcatcagctcggatgcgaggtcgtggtcctgctgctggagcttaatccagaccaaattaatctgtttaattgggctattgatagatgctacacaggcagttaccagctggctagtggctgcttcaaggcaatcgccacagtctgtggctctcgtaattaccctttcgacatcgtgacactgctgaatcttgtgctctttaaggcatctgacacaaaccgggaaatctatgagatatccatgcagctgatgcaaatactcgaggcaaagctttttgtttacagcaagaaggtggctgaacagcggccaggcagcatcctgtatgggacccacggccccctgcctccactgtattcggtcagcctggcattgctgagctgcgagctggcaagaatgtatcccgagctgacgctgcctcttttttccgaagtctctcagagatttccaactacacatcccaatgggcgccagattatgttgacttatctgctcccatggctgcataacatcgaattggtagattctaggttactcctgccgggcagctcccccagttcacccgaggacgaggtgaaggatagggaaggcgatgttacagcatcacacgggctacgtgggaacggatggggctcccctgaagccaccagtctcgtgctgaataacctgatgtacatgacagcgaagtacggcgatgaagtgcccggaccagagatggaaaatgcctggaatgccctcgccaacaacgaaaagtggtccaataatctgcggatcactctccagttcttgatctccctctgtggagtgtcatctgacactgtgctgctgccatatattaagaaagttgccatttacctttgtcggaataatactatacaaactatggaagagcttctcttcgaactccagcagaccgaacccgtgaatcccatcgtccagcattgcgacaatccgcccttttacagattcacagcctccagcaaggcatctgcagcagcatccgggactacaagttcatcgaatacagtggtggcggggcaggagaactttcctgatgctgaggaaaataagattttgaaagagtcggatgaaaggttttcgaatgtcattagagcccacacgcgcttagagtcccgatactccaactccagtggggggtcatatgacgaagataaaaatgacccaatctccccttacacagggtggctgctgaccatcactgagacaaagcaaccacagcccctgcctatgccttgcactggtggctgttgggcccctctggtggactatcttcccgagactattacccctagaggacctctgcatcgctgcaacatcgccgtcattttcatgactgaaatggtggtcgaccatagtgttcgcgaagactgggcacttcacttgcctctccttctgcacgccgtcttcctgggcctcgatcattatcgtcctgaggtgttcgagcacagtaagaagctcctcctacacttgctaatcgccctctcgtgtaactccaatttccactctattgcatctgtgttgctgcagactcgcgagatgggagaggccaagaccttgactgtgcagcccgcctatcagcccgagtacctctacaccggcggcttcgattttttaagagaagaccaatcctccccggtaccggatagcgggctgtcatccagctcgaccagctccagtatctcactgggcggatcatctggcaacttaccgcaaatgactcaagaggtggaggacgtagatacggcagcggagactgatgaaaaggctaacaaactaatagaattccttacgacccgtgcattcggaccattgtggtgtcacgaggatataacaccgaaaaatcaaaattccaagagcgcagagcagctaacaaactttctgaggcatgtggtgtctgtgttcaaagactctaagagcggtttccatctagaacatcagctgtcagaggtggccctgcagactgccctcgccagttcatcccggcattacgcggggaggtctttccaaatattccgtgcattaaagcaaccactgtcggcccacgcactcagcgacctcctctctcggctggtggaagtgattggcgagcacggggacgagatacagggatatgttatggaggccctgcttaccctggaggcagcagtggacaacttgagcgactgtctgaagaacagcgacctcttgactgtgctgagccgctcctcttctcccgacctgtcctcttcttcaaagctgacggcctcgaggaaaagtacgggccaactgaacatgaatcccggaactacttccggcaacacagccaccgccgaacggagtaggcatcagaggtcattctctgtgcctaaaaaatttggcgtaattgaccggtctagcgatccacctcgcagcgccaccctggaccggatacaggcctgcacccagcagggcctgtcttctaagaccaggtcatcatctagccttaaagacagccttactgacccttcacacattaaccaccccaccaatctgctggctacaatcttttgggtgactgtcgcactgatggagtccgactttgagttcgagtacttgatggccctgagacttttgtccaggctgctggcccacatgcctcttgacaaagccgaaaaccgggaaaagctcgaaaaattgcaggctcagttgaaatgggctgacttttctggattacagcagctccttctgaagggttttaccagtttaaccacaacagacctgactttacagctcttttcactcctgacccctgtgtcaaagatttccatggtagatgccagccatgctattggctttcccctcaatgtgctctgtcttctcccacagctcattcagcacttcgagaatcctaaccagttttgtaaggatatcgccgagcggatagcccaagtatgtctcgaagagaagaatcctaaactgtccaacctggcccacgtcatgactctttacaagactcatagttacacccgcgattgtgcgacctgggtgaatgtcgtatgccgctatttgcacgaggcttacgctgacattacactgaacatggtgacctacctcgctgagttgttagaaaaaggcctgcctagcgttcagcaacctctgctccaggtaatctacagtttgctgtcatatatggatcttagtgtcgtacccgttaaacaatttaatgtagaggtcctgaagactattgagaagtacgtgcagagcgtacactggagagaggccctgaatatccttaaactggtggtgagtagatccgcttcactggtgttgccatcatatcagcattccgatctgagcaagatcgaaatccaccgagtctggacgagcgccagcaaggaactccctggcaaaacactagactttcactttgatatatctgagacacccatcatcgggagaaggtacgacgagctccagaattccagtgggcgggacggaaagccacgtgccatggcagtcacccgcagtacatcttctacatcctctggctctaattcgaatgtgctcgtgccagtgtcgtggaagcggccccagtatagccagaaacggacaaaggaaaagcttgttcatgtgcttagcttgtgtgggcaagaggtcggactgagcaagaatccctctgtaatcttttcatcatgcggcgacctcgacctactggagcatcagacctcgttggtcagtagcgaggacggagctcgggaacaggagaacatggatgataccaactctgagcagcagtttcgtgtttttcgcgattttgattttctggatgtcgaactggaagatggcgaaggcgagtcaatggacaatttcaattggggcgtgagacgccgtagccttgattctctcgacaagtgtgacatgcagattttagaggaaagacagctgtcaggtagtacaccgtctctcaataaaatgcaccatgaagattctgacgaaagctctgaggaagaagacctcactgcctcccagattcttgagcacagtgacctcataatgacactcagccccagcgaggagactaaccctatggaattgctaacaaccgcctgcgattccactcccgccgagccacacagttttaacaccagaatgagcagcttcgacgcttccttacctgatatgaacaacctccagatatcggaaggaagtaaagccgaggccgtccgcgaggaagaggacaccaccgtgcatgaggacgacctgagcagctcaattaacgagctgccagcagcctttgaatgttccgactctttctcgctcgacatgacagagggagaagaaaaaggaaaccgggctctggatcagttcacacttgcctccttcggggaaggagacagaggcgtgagccccccgcctagccccttctttagcgcgattctggcggccttccagccagctgcatgtgacgacgccgaagaggcatggcggtcacatatcaaccaactcatgtgcgatagcgatggtagttgtgcagtctatacctttcatgtgttttcttcactgttcaagaatattcaaaaacggttctgcttcctaacatgcgacgctgcctcttatctcggggacaatctccgcgggatcgggagtaagtttgtctcgtcctctcagatgttaacctcgtgtagtgaatgcccgaccctgtttgtggacgctgaaacgctgctgtcctgcgggctgctggataagttgaagttctcagttttggagctccaggagtacttggacacatacaataacagaaaggaggctaccctctcctggctggccaactgtaaggcgacattcgccggcggctcgcgtgacggcgttattacctgccagcctggagactcagaggaaaagcagctcgaactctgtcagcgactatataaattgcacttccaactgctgctactgttccaaagttactgtaaactgatcggccaggtacacgaggtctcatccatgcccgaactgctgaacatgtcccgcgagctttccgatttgaaaaagcatctgaaggaagcctccgccgtgatagccgccgaccctctctatagcgatggcgcctggtctgagcccacattcacctctactgaagccgctatccagagcatgctcgagtgtttgaaaaacaacgagctcggaaaagctctccggcagattcgggagtgtcgctccctctggccaaatgacattttcggttcttcaagcgacgacgaagtacaaactctactgaacatttattttagacatcaaaccctgggacagacgggcacttacgccctcgtagggagcaatcaatccctgacagagatatgcaccaagctaatggagctgaatatggaaattcgtgatatgatcagacgggcccaatcttacagggtcctgacaacctttctgcccgactcctcagtgtcaggtacatcgttgtag

SEQ ID NO: 42391 - DNA, 3849 bp, Artificial Sequence
  Description of Artificial Sequence: Synthetic coding sequence
atgagcgccgtgctgtgctgcggccccgtgttcgacaacgtgggcctgagcccggacggttacctttacaaatggttagacaacattctggcgtgtcaggatctcagagtccatcaactggggtgtgaggtcgttgttctgctcctcgagctcaacccagaccaaattaacctcttcaactgggctattgaccgctgttacacgggcagctaccagctggcatctggatgctttaaagccatcgcaaccgtctgcggatcccggaactatccgtttgatatcgttaccctcttgaacctagtgttgttcaaggcctccgataccaatagagagatatacgagatttccatgcagctcatgcaaatcctcgaggcgaaattgttcgtctacagcaagaaggttgcggaacagaggccaggctctatcttatacggaactcacggtccgctgccacccctttattccgtgagcctcgctctgctctcttgtgaactggcccgtatgtatcctgagttaaccctccctctgttttctgggaaacctgccatcccacacaatactcctcaaagagccccagaccacgcctatcttcccgctgctcttgctgctcagcatcgtgccggcgggcagcaggccccaccacctggatcccctagcagcccggaagacgaagtcaaggatagagagggcgacgttacggctagccacggtctaaggggaaacggttggggcagccctgaggcaactagcctggtgctcaataatctgatgtatatgacagctaagtatggcgacgaggtcccaggtcccgagatggagaacgcctggaatgcactcgcaaataatgaaaagtggtccaacaacctcagaatcaccttgcagttcctcatttccctgtgcggggtttcttctgataccgtccttctaccctacatcaagaaggtggctatctacctgtgccggaataacacaattcaaacaatggaggagctgctgttcgagctccagcagacagagccagtcaatcccattgtacagcactgcgataacccccctttctacaggttcacagcgagtagtaaagcaagcgccgccgcgagcggtactacatcctccagtaatacagtggtggccggccaggagaactttcctgacgctgaggagaacaaaatcttgaaagaaagtgatgagcggtttagtaatgtaattagggctcacacacggctggaatcacgctactctaattcctccggtggctcatacgatgaagacaaaaacgaccccataagcccatataccggttggctgctgactattacagagaccaagcagccacagcccctccctatgccttgcacagggggctgctgggctccacttgtcgattatttgccagagacaatcaccccccgtgggccgctgcacaggtgtaatatagccgtgattttcatgaccgagatggtcgtcgaccatagcgtgagagaagattgggctctccacctcccactccttctgcacgcagtgtttctgggactggaccactacagacccgaggtctttgagcattccaaaaagctgttattacacctcctcatcgcattgtcctgcaactctaactttcattccattgccagcgtcctgttgcaaacccgggagatgggcgaggctaagactctgacggttcaaccagcctaccaaccggagtacctgtacactggaggatttgacttcttaagagaggatcagtctagccctgtcccagactcagggctctcctcttcaagtacctcaagtagcatcagcctgggcggatccagcgggaacctaccacagatgacacaagaggtggaggatgtcgatacggcagcagagaccgacgagaaagctaacaaacttatcgagttccttacaactcgcgcttttggaccactgtggtgtcatgaagacataacacctaaaaatcagaatagcaagagcgcagaacagctgaccaattttctcagacatgtagtttccgtgttcaaagattccaaatctggctttcaccttgagcaccagctgagcgaggtggcccttcagacagccctggcgtcgagcagtcggcactatgccggaaggagttttcaaatattccgggccctcaagcagccattgtctgcgcatgctctttcagatttgctgagcaggttggtggaagttattggagaacatggtgatgaaatccagggatatgtgatggaagctctgctgacactcgaagctgccgtcgataatctaagtgactgcctgaagaactccgacttattaactgtcctgagtaggtcatccagcccagacctgtcttcaagcagcaaactcacagcctcgcgaaagagcactgggcagttgaacatgaaccctggtactacttctggcaacactgcaaccgccgagaggtcaaggcatcaaagatccttttctgtgcccaagaagtttggggtcatcgatcgttctagtgatcctcctcgcagcgctacacttgatcgcatccaggcctgtacacagcaagggctttctagtaaaactcgcagtagctctagcctgaaggattcacttaccgatccgagtcacatcaaccatcccactaacctgctagccaccatcttttgggtaaccgtggcactgatggagtctgattttgagtttgaatacctaatggccctccgactgctttcgaggttgctcgcccacatgccgctggacaaggccgagaaccgggagaagctcgagaagctacaagcacagctcaagtgggctgactttagtggactccagcagctgctgctgaaaggcttcacgagtctgaccacaactgatctgacgcttcagttattcagcttgcttactccagtctctaaaatttcaatggtggacgccagtcacgccatcggtttccctcttaatgtgctgtgtcttcttccacaactgattcagcacttcgaaaaccccaaccagttctgtaaggacatcgctgagagaatcgcccaggtttgcctggaggagaagaacccaaagctttccaacctcgcccacgtgatgaccctgtacaagacgcactcatacaccagggattgtgccacttgggtgaatgtggtatgcagatatctccatgaggcttatgccgacatcaccctgaatatggtaacttacctggctgagcttctggagaagggactgccatctgtccagcagcctttactccaagtgatctacagccttctcagctacatggatctgagtgttgttccagtcaaacagttcaacgtcgaagtcctgaaaactatcgaaaagtatgtgcagcatagcgatctgtctaagattgaaatacatagggtgtggacatcagccagcaaagagctgcctggcaagactctggattttcatttcgacatatctgaaacgcccatcattggccgaagatatgatgagctccaaaacagtagcggacgagatggaaagccacgcgcaatggcagttacacggtccactagctctacttctagcggatcaaactcaaacgtgctcgtgccagtctcttggaaaagaccacaatattcccaaaaacgcacgaaagagaagctcgtgcatgtgctgtcactgtgcggccaagaggtggggctctctaagaatccctccgtgatcttcagctcctgcggtgacttggatctcctcgaacaccagacatcgctggtctcctcagaggacggcgctcgcgagcaagagaatatggacgataccaattctgaacagcagtttagggtgttcagagactttgacttccttgacgtggaactggaggacggtgagtag

SEQ ID NO: 42392 - DNA, 453 bp, Artificial Sequence
  Description of Artificial Sequence: Synthetic coding sequence
atggagatcaccaccgcctgctggcggcggagctgcgtgatcagctttataaaagggctagcctcaccagttgggaatggttacatcaaaccacctgtgcccccagcctcaggcacgcaccgagagaaggggccacccaccatgctaccaataaatgtcgacccagatagcaagcccggagaatatgtgctgaagtccctgtttgtgaatttcaccacacaggcagagagaaagatacgcataataatggccgaaccgttagagaagccactgactaaaagtttacagcgcggggaggatccgcaatttgaccaggtgatttcctcgatgagcagtctgtcagagtattgtctgccatcgatcctacggactttattcgattggtacaagaggcagaatggcattgaagatgagagccacgagtacagaccacgcacttctaacaagagctag

SEQ ID NO: 42393 - DNA, 1152 bp, Artificial Sequence
  Description of Artificial Sequence: Synthetic coding sequence
atgaccgagggcgaggagaagggcaaccgggccctggaccagttcactctggcctccttcggagaaggggatcgtggcgtatctccaccaccttcaccattcttctcagccatcttggctgccttccagcccgctgcctgtgacgatgctgaggaagcgtggaggtcccacataaatcaattaatgtgtgacagcgacggctcttgcgctgtatacacgttccatgtattttcatcactcttcaaaaatatccaaaaacgtttttgtttccttacctgtgacgctgcatcttaccttggtgataacttacggggcattggtagtaagttcgtaagctccagtcagatgctgacctcttgcagtgaatgccctactctgtttgtggatgccgagacattactatcctgtggcctgttggataagttgaagttctcagtgctggaattgcaggaatacctggatacctataataatcggaaagaagccacactatcctggttggctaactgcaaggctacgttcgccggtggaagtcgggacggcgtgatcacttgtcagcctggcgactccgaggagaagcagctggaactgtgtcagaggctgtataaacttcacttccagctactgcttctgtttcagagctattgcaagcttatcgggcaagtccacgaggtctcaagtatgccagaactgcttaacatgtcgagggagctctcggatcttaagaagcatctgaaggaggcaagcgccgtgattgcagccgaccccctatactcagatggtgcgtggagcgaacccacattcacttccactgaagcagctatacagtctatgctggagtgtttgaagaataatgagctcggaaaagccctgaggcagatacgtgagtgtaggagcctctggcccaatgacatttttggttcaagttccgacgacgaggttcaaaccttgctgaatatttacttccgccaccagacattgggccagacaggcacctacgccctggtgggtagtaatcaatcgctaactgagatctgcacaaaattgatggaactaaatatggagattcgagacatgatacgacgagcacaatcttacagggtgctaacaacctttttgccggatagtagtgtgagcggcacctctctctag

SEQ ID NO: 42394 - DNA, 270 bp, Artificial Sequence
  Description of Artificial Sequence: Synthetic coding sequence
atggagcgggtgaccctggccctgctgctgctggccggcctgaccgctttggaagccaacgatccattcgccaacaaggatgatcccttctactacgattggaaaaacctgcaactgagtgggctgatttgcggaggcctcctggcgattgctggaattgcagcggtgctgtctggtaaatgtaagtgtaagtcatcccaaaaacagcacagcccagtgcctgagaaagctatacctctcatcaccccaggcagcgctactacctgctag

SEQ ID NO: 42395 - DNA, 270 bp, Artificial Sequence
  Description of Artificial Sequence: Synthetic coding sequence
atggagcgggtgaccctggccctgctgctgctggccggcctgaccgcactcgaggccaatgatcccttcgcaaacaaagatgacccattctactacgactggaagaacttgcagctctctggcctgatttgtggaggcctattagccattgcgggcattgctgctgtgctgtcgggcaagtgcaagtgtaagagctctcagaagcaacattcgccggtacccgaaaaggctatcccgctgattacccccgggtctgctactacctgttag

SEQ ID NO: 42396 - DNA, 2340 bp, Artificial Sequence
  Description of Artificial Sequence: Synthetic coding sequence
atgctgaccaacctgcggatcttcgccatgagccaccagaccatccctagcgtatacatcaataacatctgctgctataagattcgggcctcattgaaacgcctcaaaccccatgttccgctggggcggaattgcagcagcttgcccggactaattggcaatgatatcaagtcactacattctatcattaatcctcccattgctaagataaggaatatcggaatcatggcacatatcgatgctggaaaaacaacaaccaccgaaagaatcttatactatagcggatatacgcgaagtctgggagacgtcgacgatggagatacagtgactgattttatggctcaggagagagaaaggggcattactattcagagcgctgctgtgacctttgattggaagggctaccgggtgaatcttatcgatacaccaggacatgtggactttaccctggaggtggagcggtgcctgcgcgtcctcgatggcgccgttgccgtattcgatgccagtgctggggtggaggcccagactcttaccgtctggcgccaagcagataaacataacatccctcggatctgcttcctgaataagatggacaagaccggcgcaagctttaagtacgcagtggaaagcattagggagaaactgaaagcaaaaccactcctcctgcagcttcccattggtgaagctaaaaccttcaagggcgtggtcgatgtcgtcatgaaggaaaagttgctgtggaactgtaactctaatgatggtaaagactttgaacgcaaaccactgctggagatgaacgacccagagctgctgaaagagaccaccgaggcgcgcaacgccctgatcgaacaagttgctgacttggatgacgagtttgcggatctagtgctggaggagttcagcgagaattttgacctcctgcctgcagagaaattgcaaactgccatacatagagtaacacttgcccagaccgcagtgcctgtcctgtgtggctcagctttaaaaaacaagggcattcagcccctgttggatgcggtgaccatgtatctgcctagtcccgaagagcgcaactacgagttcctgcagtggtataaggacgatctctgtgctctagctttcaaggtcctgcatgacaaacagcggggaccactcgtattcatgaggatttattctgggactatcaagccacagctcgctattcacaatatcaacggaaattgcacagagaggatcagtcggttgctgctcccattcgcagaccagcacgtagagatccccagtctgacagctggtaatatcgccctgactgttgggttgaagcacacagcaactggcgatacaatcgtgagctcgaagtcatcggcgctggccgcagctaggagggccgagcgggaaggggagaaaaagcacagacaaaacaacgaagccgagagacttctactggcaggcgtggagatcccagagcctgtgttcttctgcaccatagaacccccctctttaagtaagcaacctgatctcgaacacgctctgaagtgcctgcagcgcgaggaccctagcttaaaggttcggctggacccagatagcggccagacggtactttgtggcatgggtgaattgcatatcgagattatacacgacagaattaagcgagagtacggcctagagacgtacttggggcctctgcaggtcgcctatcgtgaaacaatacttaattccgtgcgtgccaccgacaccctcgaccgcacgttgggagataagagacacctggttacagtggaggtcgaggcaagaccaatagaaacttcttctgtgatgcccgtcatcgaatttgaatatgccgaatcaattaatgagggcctgttgaaagtctcccaagaagctattgagaacggcatccattccgcatgtctgcagggccccctgcttggatctcctatccaggacgttgctataacactgcactcgctgacaatccatccaggaacaagtacgactatgatctcagcttgtgtatcccgctgtgtgcagaaagctcttaagaaagccgacaagcaggttttggagcccctcatgaacctcgaagtcactgttgccagggactatctgtccccagtgctcgctgacctggcgcagagacggggcaacatccaggaaatccagactcgccaagacaataaagtggtgatcggcttcgtccctctggctgagatcatggggtactctacagtgcttagaaccctgacaagcgggtcggcaacttttgccttggaactgtccacatatcaagccatgaatccccaggaccaaaacacattgctcaaccgcagaagcgggctgacttag

SEQ ID NO: 42397 - DNA, 2199 bp, Artificial Sequence
  Description of Artificial Sequence: Synthetic coding sequence
atgctgaccaacctgcggatcttcgccatgagccaccagaccatccccagtgtgtacatcaataacatttgttgttataagataagagcatctctcaaaagactgaagcctcacgttccactgggaagaaactgtagcagcctgccagggctgatagggaacgatataaaaagcctgcatagcatcattaaccctcccattgccaagatccgtaacattgggatcatggcacacatcgatgccggcaagacgaccacaacagaaaggattctgtattactcagggtacactcgctcattaggcgacgtggatgacggcgacacagtgactgactttatggcccaggagcgcgaaagaggaattacgatccagtctgcagctgttacatttgattggaaaggttatagggtcaaccttatagacacccccggacacgtagattttacacttgaggtggaaagatgcttgcgggtgctggatggcgctgttgcagtctttgatgcttctgcgggtgtggaagcacaaacacttaccgtatggaggcaggccgataagcacaacatccccagaatctgctttctcaacaaaatggacaaaactggtgcctccttcaaatacgccgtggaaagtatacgggagaagctgaaagctaaacccttgttgctgcagttacccattggggaagcaaaaacgttcaaaggggtggttgacgtggttatgaaggagaagctgctgtggaactgcaactctaacgacgggaaggacttcgaacggaaaccactgctggaaatgaatgacccagaactactgaaagaaaccactgaggccagaaatgctcttattgagcaggtagctgatctggacgacgaatttgctgatctggttctagaagagtttagcgagaattttgacctgctccccgccgaaaagctacaaaccgcaatccacagggtcaccctggcacagactgcagtgccagtgctgtgcggatctgcactcaaaaacaaaggtatccaacccctgttagacgcggtcacaatgtatctgcctagccccgaggagcgtaactacgaatttctggagcgcatatcaaggcttctgctgcccttcgctgaccagcatgttgagattccaagcctgaccgcaggcaatatagccttgactgtcggattgaaacacaccgcaacgggcgacaccatcgtatccagcaagagctctgctctggccgcagccagacgtgctgaaagggagggggaaaagaagcacaggcagaacaacgaagcagaacgccttctcctcgccggggttgagattcctgaaccggtctttttttgcaccatcgaaccgccaagcctatctaaacagcccgacctagaacacgcgctgaagtgtttacagagagaagacccatccctcaaagtgcggctcgatcctgattccggccagaccgtcctgtgtggcatgggagagctgcacattgagattattcacgacagaatcaagcgtgagtacggtctggagacatacctcggacctttacaggtggcatatcgggagactattttaaactctgtgagggctacagacaccctggatcggaccctgggcgacaaacggcatctcgtgaccgttgaggttgaagctcgccctattgagacatctagcgtcatgccagtgattgagtttgagtacgccgaaagtattaatgagggtttactgaaagtgtcacaagaagccatcgagaatggcattcattccgcctgtttgcagggcccactcctcggtagtcccatccaggatgtggctataacattgcattcgctaactattcacccaggaacctctacgacaatgatcagcgcatgcgtctcccggtgtgtccaaaaggccctcaagaaggcagataaacaggttctcgagccactgatgaatctggaagtcaccgtggcacgggattacctgtcacctgtgctcgccgacctcgcacagagacgcggcaacatccaggagatccagaccagacaggataataaggtggtgattgggtttgtccctctggcagagattatggggtattcaactgttttacgcaccttgacaagcggatcggcgacatttgccctggaactgagtacctaccaagcaatgaacccccaggatcagaacactctgctcaataggagaagcggcctgacatag

SEQ ID NO: 42398 - DNA, 1542 bp, Artificial Sequence
  Description of Artificial Sequence: Synthetic coding sequence
atgctgaccaacctgcggatcttcgccatgagccaccagaccatccccagcgtgtatattaacaacatatgttgctataaaatcagggcttctctgaagaggctgaagccacacgttcctctgggccgtaactgttctagtctgccgggcctgatcggaaatgatattaagtcactgcatagcataataaatccacccatagccaaaatccgcaacattggcattatggcccatatcgatgctgggaaaacgactacgaccgaaagaattctctattatagcggttacaccaggtcattgggagatgtggatgacggggacacggtgaccgactttatggcacaggaacgggaacgcgggatcacgattcagtccgccgcagttactttcgattggaaaggttacagagttaacctgatcgatacaccagggcacgtcgatttcaccctggaggtcgagcgttgtctgcgcgtgctggacggcgcggtcgcggtgttcgatgcctctgccggagtcgaggctcagactctgacagtctggagacaggcagacaagcacaacatccccagaatatgtttcctgaataagatggataagacaggagctagctttaagtatgcggttgagtccataagagagaaactgaaagccaagccactgctgctccaactccccattggggaggctaagacattcaagggcgtggtggatgtcgtcatgaaagaaaagctactgtggaattgtaattccaatgacggtaaggactttgagaggaaacccctgttggagatgaatgaccctgagctgctgaaggaaactaccgaagcccgaaacgctttaattgaacaggttgctgacctcgacgatgagttcgctgacctggtgcttgaggagtttagtgagaacttcgacctgctgccggcggagaagctccagacagctatacatcgcgtgacactcgctcagacagccgttccggtgctatgcggctccgccctgaagaacaaagggattcagccactgctggacgcagtgactatgtacctgcctagccctgaagaaagaaactacgaattcctgcagtggtacaaggatgatctttgtgcactagcatttaaagtcctacacgataagcagaggggaccgctggtctttatgcgcatatattctggcacaattaagcctcagctggcaattcataacattaacggcaactgcacggagagaatctccagactgctccttccctttgctgatcaacatgtggagattccatcgttgacggccggcaatatcgcgcttactgtcggactgaaacacaccgctaccggcgacacaattgtgtcttcgaaatcctcagcactggccgccgctcggcgggcagagcgggagggcgagaaaaaacaccgacagaacaatgaggctgaaaggctgcttctcgccggcgtggagatcccagaacccgtattcttttgtactattgagccccctagcctaagtaaacagccgggaatcaacggactcagcgtcagcactaactag

SEQ ID NO: 42399 - DNA, 2340 bp, Artificial Sequence
  Description of Artificial Sequence: Synthetic coding sequence
atgctgaccaacctgcggatcttcgccatgagccaccagaccatccctagcgtttacatcaataacatctgttgttacaaaatccgcgcgtccctgaagcggctcaagccacacgtgcctctggggaggaattgtagcagtctccctggacttattgggaatgacatcaaaagccttcactcaatcatcaacccgcccattgccaaaattaggaacattgggatcatggcacacattgacgccggaaagaccaccaccacagaacgaatcctttactactctggctatacgcgcagtctgggggacgtggacgatggcgacaccgtgacggattttatggctcaggagagggaacgcgggataacaattcagagcgctgcagttacctttgactggaagggctaccgggtcaatctcattgatacaccaggccatgttgacttcacacttgaggtggaaagatgccttcgcgtgcttgacggagccgtggcagtgtttgatgcctccgctggtgtggaagcccagactctgacagtgtggcgacaggctgataaacataacattccccggatctgctttttaaataaaatggacaagactggggccagcttcaagtatgccgtggaaagtatcagggagaagctgaaagccaagccactcttacttcagctgcccatcggagaagccaagacttttaagggcgttgtggacgtggtgatgaaagagaagcttctgtggaactgcaattccaatgacggcaaggacttcgagcgcaaaccactcctggagatgaatgaccccgagctactgaaagagactactgaggctcgtaacgcccttatcgaacaggtggctgatctcgacgatgagtttgctgatttggtgctcgaggagttctcagagaactttgatctgctgccagcagagaaacttcagacagctatacaccgggtgacacttgctcagactgccgttcctgttctctgcggatccgcactgaagaacaagggcatccaacccctactcgacgctgtgacaatgtatttaccttcacccgaagagcggaattatgaattcctacaatggtataaggacgacctatgcgccctcgcattcaaggtgcttcacgataagcaaagaggtccgttggtcttcatgcgcatctacagtggcactataaaaccccagttggcgatccataacatcaatggcaattgcacagagaggatttcaaggttactcttacctttcgccgaccagcatgtggagatcccctcacttacggcaggcaatatcgcattgactgttgggctgaagcatacggccacgggcgatacaatcgttagctccaaatcaagcgctttagctgccgcccgacgggctgagagggaaggggagaaaaaacataggcagaacaatgaggcggagcgcctgctgctcgctggggttgagatccctgagccagtcttcttctgtaccattgaaccacctagtttgtctaaacagcctgacctggaacatgccctgaaatgcttacaaagagaggacccttccttgaaggtacgcctagatccggattccggtcagacagtcctgtgtggcatgggagagctgcacatagagattatccacgaccgaataaaacgtgagtacggactggaaacctaccttgggccactgcaggttgcctaccgggagacaattctgaactccgtaagagccacagacacgctcgaccgtaccttgggcgacaagcgccacctcgtgaccgtggaggtcgaggcccggcccatcgagacctctagcgtgatgcctgtgattgagttcgagtacgcagagtccattaacgagggcttgctgaaagtgagccaagaagctatagaaaacggaattcattctgcatgcttacagggaccgttactgggaagtcccatacaggacgtcgcaatcacactccactccttgaccatccaccccgggacatctactaccatgatttctgcttgcgtttcccgttgtgtccaaaaagccctgaagaaagcagacaagcaagttcttgagccacttatgaacctcgaggtcaccgtggcacgggactatctgtctccagtgcttgccgatctggcgcaaagacgtgggaacatacaggaaatccagacccggcaggataataaggtcgtgattggatttgttccgctggcagagataatggggtacagcactgtcctaaggacgttgacatccggatcagcgactttcgcccttgagttaagcacctaccaagccatgaatccccaggatcagaacactcttttgaaccgaagatcagggctaacctag

SEQ ID NO: 42400 - DNA, 1806 bp, Artificial Sequence
  Description of Artificial Sequence: Synthetic coding sequence
atgctgaccaacctgcggatcttcgccatgagccaccagaccatcccctctgtctatatcaataatatctgttgttacaagattagagccagtctgaaaagactgaagcctcatgtgccattaggaaggaattgctcctctctgccaggacttatcgggaacgacattaagtccttgcatagcataatcaatcctccaatagcaaaaattcggaatataggtattatggctcacatcgacgcagggaaaaccaccaccaccgagaggatactttactacagcggatatactcgctccttgggcgatgtggacgatggcgacacggtgactgatttcatggctcaggagagagaacgaggcattacaattcagtctgctgctgtcactttcgattggaagggttatagagtgaacctgatcgatacgccaggacatgtagattttacactggaagtggaacggtgcttgcgtgtcctagatggagctgtcgcagtgtttgacgcctccgccggcgtcgaggctcagacattaaccgtgtggcggcaagccgataaacataacatcccccgtatatgtttcctgaacaagatggacaagaccggagcctccttcaagtatgcggtggagtccatccgcgagaaacttaaagccaagccgctgctcctacagctacctatcggggaggcgaaaactttcaaaggcgtcgtcgatgttgtgatgaaggagaagctgctctggaattgtaatagcaatgacggtaaggactttgaaagaaaaccccttcttgagatgaatgatccagaactactgaaggagactacagaagcccgcaatgcactcatagagcaggtcgccgatctcgatgatgagtttgcagacctcgtgttggaggagtttagcgagaactttgacctgctccctgcagaaaaactccagacagctatacacagggtcacactggctcagaccgccgttccggttttgtgcggttctgcgctcaagaacaaaggcatacagcccctccttgatgctgtgaccatgtacttaccaagtccggaggagcggaactacgagtttttgcaatggtacaaggacgacctgtgtgctctggctttcaaagttctgcacgataaacagagggggcccctcgtcttcatgcggatctatagcggcactatcaagccgcaactggctatccacaacatcaatggcaattgcaccgagcgcatttcccgcttgctcctccccttcgccgaccagcatgtggaaattccttcgcttactgctgggaacatcgccctgactgtgggcctgaaacacaccgcaacaggagacactatcgtgagctctaaatcttctgctctggccgcagcccgcagggcggagagagagggagaaaaaaagcaccggcagaacaacgaagccgagagacttctcctggccggagtagagataccagagcctgtgttcttctgtacaattgaaccacctagccttagtaaacaaccggacctagaacacgccctcaagtgtctgcagagggaagaccccagtctcaaggtgcgactggatccggactctgggcaggtagctcagcgcagaggcaatattcaggagattcagactagacaagacaacaaggtggtcatcggcttcgtgcctctggcggaaatcatgggctacagtacagtgctgaggaccctcactagcgggtctgcaacatttgcgctagagttatcaacataccaggctatgaaccctcaggatcagaatactctgctcaatagacggtccgggcttacatag

SEQ ID NO: 42401 - DNA, 948 bp, Artificial Sequence
  Description of Artificial Sequence: Synthetic coding sequence
atggccagcgccgtgctgagcagcgtgcccaccaccgccagccggttcgctctgctgcaggtggattcaggctccggcagcgactcagagccaggtaaaggcaagggcaggaataccggcaagagtcagaccctgggctccaaaagcacaacgaacgaaaagaaacgagaaaaaaggcggaagaagaaagagcagcagcagtctgaggctaacgagcttaggaatctggctttcaaaaaaatcccccaaaaaagctcacacgcagtttgcaacgcccagcacgacctccccctctcaaaccctgtccagaaggatagccgagaggaaaattggcaggaatggaggcagcgcgatgaacagctgactagcgaaatgtttgaggccgaccttgagaaagccctgttgcttagcaaactggagtacgaggaacataaaaaggaatacgaggacgccgagaacacgagcactcagagcaaagtgatgaacaagaaagataaaaggaaaaaccatcagggaaaagaccggcctctaacggtctctctcaaagattttcattcagaggaccatatctcaaaaaaaactgaggaggtcgtgctgaaagatggtcgaattgagcgactgaagttggagctggaaagaaaagacgctgaaatacaaaagctaaagaacgtgatcacacaatgggaggctaagtataaggaagtgaaagccaggaatgcacagttgcttaaaatgctgcaggaaggcgaaatgaaggataaggcagagattctacttcaggtagacgagagtcagtccatcaagaacgaactaacaattcaggttacaagcctacacgctgctctggagcaggagaggagtaaagtgaaagttttacaggccgagctggctaagtaccaaggcggcaggaagggcaagagaaattcggaatctgaccagtgcagatag

SEQ ID NO: 42402 - DNA, 1101 bp, Artificial Sequence
  Description of Artificial Sequence: Synthetic coding sequence
atggccagcgccgtgctgagcagcgtgcccaccaccgccagccggtttgctttgttgcaggtggactctgggtctggttcagattccgagcctggtaagggtaaaggccggaatacaggaaagtctcaaacactgggaagcaagagcaccactaacgagaagaagagagaaaaaaggaggaagaagaaagaacagcagcagagtgaggcaaacgagctgagaaacctcgcctttaagaaaatcccacagaaaagctcccatgcagtctgtaatgctcaacacgatctaccactgtcaaaccccgtgcagaaagattctagggaggaaaattggcaggagtggcgacagcgagacgagcagctcacaagcgagatgttcgaggctgaccttgagaaggcgctgttgttatccaagctggaatacgaggagcataagaaggagtatgaggacgcagaaaacacctctactcagtctaaggttatgaacaagaaagacaagagaaaaaaccaccagggtaaggatcgcccgctaaccgtgagcctaaaagacttccattctgaggaccacatttcaaagaaaactgaggagctgagctcctcgcaaacactctcacacgacgggggcttcttcaacaggcttgaggatgatgtgcacaagattctcatacgggaaaagcggcgtgagcagctgacggagtataatggcaccgacaactgcactgcccatgaacacaaccaggaggtggtgctgaaagatgggcgtattgagagactaaagctcgaactggagagaaaggacgccgaaattcagaagctgaaaaacgtaataacgcagtgggaggccaaatataaagaggttaaggcccggaatgcacagttgcttaagatgctccaggagggtgagatgaaagacaaagcggaaatccttttacaggtggatgagagccagtccattaaaaacgaattaacaattcaagtgacgtcactccatgccgccctggagcaggagaggtcaaaggtcaaggtgctccaggctgagctggcaaaatatcagggcggtaggaaaggaaagcggaactctgaatctgaccagtgtcgatag

SEQ ID NO: 42403 - DNA, 381 bp, Artificial Sequence
  Description of Artificial Sequence: Synthetic coding sequence
atggccagcgccgtgctgagcagcgtgcccaccaccgccagccggttcgccctgctccaggtcgactcgggcagtggcagcgactctgaaccagggaagggaaagggcaggaacacggggaaaagccaaacattgggctccaagtcaacaacaaacgagaagaaaagggaaaagcgcaggaagaagaaggaacagcaacagagcgaagccaatgaattaaggaacttagctttcaagaagatcccccagaagtccagccacgccgtttgcaatgcccagcatgatctgcccctctcaaatcctgtccagaaggatagccgggaggagaactggcaagagtggcggcagcgggacgaacagatgggctctagaagacaatag

SEQ ID NO: 42404 - DNA, 165 bp, Artificial Sequence
  Description of Artificial Sequence: Synthetic coding sequence
atggccagcgccgtgctgagcagcgtgcccaccaccgccagccggtttgctcttttacaggttgacagcgggtctggaagcgattcagagcccggcaaaggcaaaggtcggaacacaggcaagagccagacccttggatcaaaatcaactactaatgagaagtag

SEQ ID NO: 42405 - DNA, 3027 bp, Artificial Sequence
  Description of Artificial Sequence: Synthetic coding sequence
atggacaccgccgaggaccccgcctggctgcagctgctgcagaaggatagctcccctcctgggccaagacccacggcttttttttgcccacaggacggcagtctcggggctggtagcagcgccatgcgtgattattgcccctcacaacagaaagcttcccctgccccacctcgacatacacccgaccagagtccaggaatggagtctcgtcaccgcagccctagcggagcaggcgagggggccagttgctcagacggccctcgtggcagtctggcttgtccatctccaacgtgtttcagtccccaggaatctccgtcaaaagaaacacttgaggcacacggggcctcaataagtggcacacccgaagccaccacatcggggaaacccgaacccgtgtcgtccgtgaaaactgaacccaaatcctccgatgaccgtaatcctatgtttctcgagaagatggatttcaagagcagcaagcaggccgattccacgtccataggaaaagaagaccccggttcttctagaaaggcggaccccatgtttacaggcaaggcagagccagagatcctgggcaagggcgaccccgtggccccagggcgcatggatcccatgactgtcagaaaggaagacctggggtctcttggcaaggttgaccccctgtgttcatccaaaacatataccgtgtctccacgaaaagaggatcctggaagtcttaggaaggtcgaccctgtgagcagcgataaagtcgaccccgtattcccccgcaaggaggagcccaggtacagcgggaaagagcacccagtctcctccgagaaagtggctcccacgagtgccgaaaaagtcgatctcgtcctcagcgggaagagagacccaggaccgtccggtaaagcggatccgatgcccctcgaatccatggattcagcaagtacgggcaagacggaacccggactgctgggtaaactgataccggggagttcaggcaagaacggccctgtatcatcaggcacaggcgcccccgggagcctcggcaggctggacccaacctgtctgggcatggccgatccagcttctgtgggcaacgtcgaaaccgtcccagcaaccaaagaggatagcaggtttcttgggaagatggatccagccagcagtggcgaagggagacctgtctctgggcacacagatactacagcctccgccaagacagacctgacctctctgaagaatgtggaccctatgtcttccggaaaagtcgatcctgtcagcctggggaagatggaccctatgtgctctggaaagccagagctcctctcacccggccaggcagagcgggtgtcagttggcaaagccgggaccgtctctcccggaaaagaggaccccgtaagctccaggcgcgaggaccccatttccgcaggttcccgaaaaactagctcggagaaggttaacccagagagcagcggcaagacgaatcccgtgagttctgggcctggcgatcccagaagtctggggacagccgggcccccttcagccgtcaaggccgagccagcaacaggaggcaagggtgatccactttcatccgagaaggcaggtctggtagcttccggcaaggcagccccaaccgcatccggtaaggccgaaccgttagcggttggtaaagaagatccagtgagtaaaggcaaggccgacgctggacctagtggccagggtgattctgtgtctatagggaaggtggtgtccaccccaggaaaaaccgtgccggtgccctccggcaaggtagaccccgtgtcactcggtaaggccgaagccatcccagagggaaaggtcggttctttgcccctggagaagggatcgccagtgaccaccaccaaagcggacccacgggcctctggaaaggcccagcctcaatccggtggcaaggcagagactaaattgcccggccaggagggagctgcagcccctggtgaggctggcgctgtgtgcctgaagaaggaaaccccccaggctagcgaaaaagtggatcctgggtcctgtaggaaggcagagcctcttgcctctggaaaaggtgagccagtgagcttaggcaaagcagatagcgcgccaagtcgtaagaccgaaagtccatcccttggaaaggtggtccccctgtccctcgagaagacgaaacccagctcttcatccagacaattggacagaaaggcactcgggtcagcccgcagtccggaaggcgcacgcggctccgaaggacgagtagaaccaaaagcagagcctgtctcatcaacggaagcatcctctctggggcagaaagatctagaagccgccggagctgagagaagtccttgccctgaagccgctgcacccccgcccggcccgagaaccagggataatttcactaaagcgccctcttgggaggcctctgcaccacccccacccagagaggatgcaggcacacaggctggtgcacaggcctgtgtgagcgttgctgtgtcccccatgtctccacaagacggtgctgggggatctgccttcagcttccaagcagctccacgtgccccatcacctccatcccgacgagacgctggtctgcaggtgagcctgggagccgctgaaacaagatctgttgctaccggaccaatgactccccaggcagctgcgccgccagcgtttcccgaagtgagggtgcggccaggcagcgccctcgcagccgcggtggccccgcctgagcctgcagagcccgtgcgggacgtctcctgggacgagaagggtatgacatgggaagtctatggggccgcaatggaggtcgaagtgctggggatggcgattcaaaaacacctggaacgccaaatcgaagaacacggtcgacagggtgcaccagcgcccccaccagctgctagagccggccccgggcggagcggcagcgtgagaacagcaccccccgatggcgcagccaagcgaccccctgggctctttcgcgctctgctgcagagcgtaaggcgaccccgctgctgctctcgggccgggcctactgctgagtag

SEQ ID NO: 42406 - DNA, 2397 bp, Artificial Sequence
  Description of Artificial Sequence: Synthetic coding sequence
atggacaccgccgaggaccccgcctggctgcagctgctgcagaaggactcatctcctccaggacccaggcccactgcgttcttctgtccgcaggacggctctctgggagctggatcctccgcaatgcgcgactactgtccaagccagcagaaggcttctccagcacccccgagacacacgcccgaccagagcccaggcatggagtcacgccataggtccccttccggcgccggtgagggagcctcatgttcggacggccccaggggctctctggcatgccctagcccaacctgttttagtcctcaagaatcaccatccaaagaaactctcgaagcccatggagcttccatttctggaacccccgaggccacaacctccggaaagcccgagccagtatcctccgttaagacagagcccaagtcaagcgacgacaggaatcctatgtttctggaaaaaatggatttcaagagttccaaacaggctgactctacttctattggtaaagaggacccagggagttctaggaaggccgatcccatgtttactggtaaggctgagcctgagatcttgggcaaaggtgacccggtggctcccggacgaatggaccctatgacggttcggaaagaggatttagggtcgcttgggaaggtggatccattgtgtagttccaaaacatacaccgtttctcctcggaaagaagacccgggatcactacggaaagtggaccctgtgtcctctgataaggtggatccggtcttcccaaggaaagaggaaccacgctacagtggcaaggaacatcctgtgtcttccgagaaagttgcaccaacgagcgccgagaaagttgatctggtgttgtcaggaaagagggatccagggccgagcggcaaggccgaccctatgcctctcgagtcaatggactcagcctctaccgggaaaacagagccgggactcctgggcaaactaatcccgggatcatctggcaagaacgggcctgtgagttcggggaccggggctcccggtagcctgggcaggcttgaccctacatgtctaggcatggctgatcccgcctcggtggggaacgtagagactgtgcctgcaaccaaagaagactcaagattcctaggcaagatggatcctgcctctagtggggaaggccgtccagtttccggacacactgacacaactgcttctgccaagactgatttgacatcactaaagaacgttgatcctatgagcagtggcaaagttgatccagtgtctttaggaaagatggaccctatgtgttctggcaagcctgagttgttgtcgcctggccaggcggaacgtgtgtccgtgggcaaggcagggacggtctctccggggaaagaagaccctgtatcatctcggagagaggaccccatctccgcaggctccaggaagacctcttccgagaaagttaatcctgaatctagcggaaaaaccaatccggtatcatctggcccaggagacccacgctcccttgggacagccgggccaccatcagctgtgaaggctgaacctgccacaggtggtaaaggcgatcctctgagctccgaaaaggccggactggtcgctagcgggaaagccgcccctaccgccagcggtaaggccgagccactagcagtggggaaggaagatccagtttccaagggcaaggcagacgcggggccttcaggacagggagattctgtcagtatcggtaaggttgtcagcacccccggaaaaactgtgcccgtgcccagtgggaaggtggatccagtatcactaggaaaggccgaagccatcccagagggtaaggtcggaagcttgcccctcgaaaaaggtagtcctgtcacgactaccaaggctgacccccgggcaagcgggaaggcccagccccaatccggagggaaggccgagactaagcttccgggccaggagggggcagccgcgcccggagaagccggcgccgtgtgtctgaaaaaagagactccccaggcctctgaaaaagtcgatcctggaagttgccgcaaggccgaaccacttgcttctgggaagggcgagccagtgtcactgggtaaggccgacagtgctccatcacgcaaaactgaaagtccgtctctgggaaaggtggtgcccttgagcctggagaagaccaagcctagcagtagttcacggcaactcgaccggaaggctctaggttcagcgaggtccccagaaggtgcacgcggttctgaaggacgacaggcctccgcaagacctgtgcctagagccgcagccgaatgtgcacccgcagctgttttgctggccgggggaactcacggtagggttatttgcccacactttgttaggccgtcttttcgaccaagtcaggcacccttcctgattaccggtccctag

SEQ ID NO: 42407 - DNA, 1659 bp, Artificial Sequence
  Description of Artificial Sequence: Synthetic coding sequence
atggccgccctggcccccgtgggcagccccgccagccggggcccccgccttgctgctggattgcgccttctcccaatgcttggtcttctgcagctcttggctgagcctggtctgggtcgggttcaccacctcgctctgaaggacgatgtgcgacacaaggtacacctgaatacatttggctttttcaaagatgggtacatggtggtaaacgtgagttcactgagtctgaatgagcccgaggataaagacgtcactataggctttagcctcgatcggaccaagaatgatggatttagctcatacctggacgaggatgttaattactgcattcttaagaaacagtccgtctccgtaactttactgatcctagatatctcaagatcggaagtgcgggtgaagtcccctcctgaggcagggactcagctgccgaaaatcatattctctcgcgacgaaaaggtgctcggacaatctcaggagcctaacgtaaatcctgccagcgcaggaaaccagacacagaagacccaggacggcgggaagtcaaagcgatcgacagtggacagtaaggctatgggagagaaatcatttagtgttcacaataatggaggggcagtgagcttccagttctttttcaatatttctacggatgaccaggaaggtttgtattccctttattttcacaagtgcctgggtaaggaactgccgtccgataagtttacattttccctcgacatcgagattaccgaaaaaaatcctgattcttacctcagcgccggcgagataccgctgccgaaactttacatttctatggctttcttcttctttttatcaggcaccatctggattcacatattacggaaacgcaggaacgacgttttcaagattcactggctgatggccgccctaccattcaccaagtccctctctctggtgtttcatgccatcgactaccattatatctctagccagggatttcccatagagggctgggccgttgtttattacattacacatctgcttaagggagccttgttattcattacaatcgctctaattggaaccgggtgggcattcattaaacacattctgagcgataaagacaagaaaatcttcatgatcgtcataccactgcaggtccttgctaatgtggcctatatcatcatagagagtaccgaggaaggcaccacagaatatgggctgtggaaggactccctctttttggtcgaccttctatgctgcggagcaatcctgtttcccgtagtatggtccattcgacatttgcaggaagccagcgcaactgatggcaaggcggcgattaatcttgcaaagctgaagctgttcagacattattacgtcttgatcgtttgttacatctactttacacgcattatcgcattcctcctcaaactagccgtcccattccagtggaaatggctatatcagctgctggacgaaaccgcaacactggtttttttcgtgttaacaggctacaagttcagacccgcctccgacaacccctatcttcaactgtcccaagaggaggaggatctagagatggagtctgtggtgacgacctcgggcgtgatggagagcatgaagaaggttaaaaaggtgacgaacggatcggtggagcctcagggggaatgggagggggccgtatag

SEQ ID NO: 42408 - DNA, 1803 bp, Artificial Sequence
  Description of Artificial Sequence: Synthetic coding sequence
atggccgccctggcccccgtgggcagccccgccagccggggcccccgactggctgccgggttacgcctgcttccaatgctggggctcttgcagctcctcgcagagccagggctcggaagggtccatcacctggccttaaaggacgacgtgaggcacaaagtgcacctgaacacgttcggcttctttaaagatggttacatggtcgtcaacgtctccagtttatctctgaacgaaccggaggataaggatgtgacgattggattttccctggacaggacgaagaatgacggcttctcttcgtacctggatgaggatgttaactattgcattttgaaaaaacaaagcgtgtcagtgactttactgatactcgacatctcccgctcggaagtcagggtgaagagcccacccgaggccggcacgcagttgccaaaaataattttctctagggacgaaaaagtgttgggccaaagccaggagcccaacgtgaatcctgccagcgcgggcaaccagactcagaagacacaggacgggggaaagagcaaacggagcactgtggacagcaaagcaatgggtgagaaatcattttctgtacacaataatggaggcgccgtaagctttcagttcttctttaacatctcgacggatgaccaggagggcctctatagcctgtactttcacaaatgcctcggcaaggaactgcctagcgataagtttaccttttccctcgatatcgagataactgagaaaaaccccgacagttatctgtccgcaggcgagatccccttgcccaagctgtacatatctatggcctttttctttttcctgtccggtacaatatggatccatattcttcgcaagcgccggaatgatgtgttcaagatccattggctgatggcggccctgccctttactaagtcactgagcctggtttttcacgccattgattaccattacataagctcccagggatttcctatagaagggtgggccgttgtatattatatcactcacctcctgaagggcgcccttctatttattaccatcgccctgatagggacgggatgggcctttataaagcacatcctcagtgacaaagataagaagatctttatgattgttatccccctgcaggtgttggcaaacgtcgcatacattattatcgaatccaccgaggagggtacaacggagtacgggctgtggaaagacagcttgttcctggtggaccttctctgttgtggggccatcctgtttcctgtggtctggtctattagacacctgcaggaggcatcagcaaccgatggaaaaggggattcaatgggtccacttcaacagcgggccaatctccgagcgggtagtaggatcgagagtcatcactttgctcaggcagatctggaattgctcgcatcaagctgtcccccagccagcgtctcccaacgtgccgggattaccgctgctatcaatcttgccaagctgaagctgttcaggcactactacgtcctgattgtgtgttatatctacttcacccggatcatcgcctttcttctaaagcttgctgtcccattccaatggaaatggctctatcagttgctcgacgagacggccactcttgtgttttttgtgttaactgggtacaagttcagaccggcatctgataatccctatctccagctctcccaggaggaggaagatctggaaatggagtctgtggtcaccacaagcggggttatggagtctatgaaaaaagtaaagaaagtgacaaacggcagcgtcgagcctcaaggtgaatgggaaggagccgtgtag

SEQ ID NO: 42409 - DNA, 1716 bp, Artificial Sequence
  Description of Artificial Sequence: Synthetic coding sequence
atggccgccctggcccccgtgggcagccccgccagccggggccccagactggcagcaggcctcaggttattacctatgcttgggcttcttcagcttctggcggagcctggcttgggcagggtgcaccatctcgctttgaaggatgatgtaagacacaaggtacatctgaacacattcggcttcttcaaggatggatacatggtggtgaatgtgagtagcctgagtctgaatgagcctgaggacaaggacgtgactatcggtttcagcctggataggacgaaaaacgacggcttttcttcctatcttgacgaggacgtcaattactgcatacttaaaaagcaatccgtgtccgtgacgctgctaattttggacatctctcgttccgaggtgcgcgtcaaatctccaccggaagccgggacccagctgcccaagattattttctcccgcgatgagaaggtgttgggccaaagccaggagccgaacgtgaatcctgcctcagccggtaaccaaacgcagaagacacaggacggcggtaagagcaaacggtccaccgtcgattctaaggctatgggcgagaaaagcttcagtgtccataataacgggggagcagtttccttccagtttttctttaacatatcaaccgacgaccaggaaggactgtattccctttacttccacaagtgcctgggtaaagagctgccaagtgacaaattcacatttagtctcgatatcgagatcaccgagaaaaatcccgactcatatctttccgcgggtgaaataccattgcctaaactttatatctctatggccttcttcttctttctctctggcactatttggatccacattctcaggaagagacggaatgatgtcttcaaaattcactggttgatggccgcgcttccattcacaaagagtctgtccctggtatttcatgcaattgattaccactatatcagctcccaaggcttccccattgaaggatgggcagtggtttattacatcacccatttgctcaaaggcgcactcctgttcatcactatagcactgataggaactggttgggcgtttataaagcacattctgagcgataaagacaagaaaatcttcatgatcgtgatccccctgcaagtgcttgccaacgtggcgtatatcattatcgagtcaacggaggagggcacgactgagtatggattgtggaaagattccctctttctggtcgacctactgtgttgcggcgccatcctgtttcccgtggtgtggagcattaggcacctgcaagaggcaagcgctactgacggcaaaggtgacagcatgggcccacttcaacagcgagctaatctgcgtgccgggtccaggattgctgccatcaatttggcaaagctgaagctcttccggcattactacgtccttatagtatgctacatttattttactcgtattatagcctttcttctgaaactagccgtgccatttcagtggaagtggctttaccagctcttggatgagacggcgacattggtgttcttcgtgttaaccggatataagttccggccagcgagtgataacccctacctgcagctgagtcaggaagaagaggacctcgagatggaaagcgtggtgactaccagcggtgtcatggagtccatgaagaaggtaaagaaggtaaccaacggcagcgtcgaaccccagggagagtgggaaggtgcagtgtag

SEQ ID NO: 42410 - DNA, 1140 bp, Artificial Sequence
  Description of Artificial Sequence: Synthetic coding sequence
atggccgccctggcccccgtgggcagccccgccagccggggcccccgtcttgccgccggcctccggctattgccgatgctggggcttctccagcttcttgccgagcccggactggggagagtgcaccacctcgccctcaaagatgatgtgcgccataaagtgcacctcaacacattcggatttttcaaggatggctacatggtcgtgaatgtatcatccctctctttaaatgaacccgaagacaaagatgtgacaatcggctttagcttagatcgcacgaagaacgatggcttctcctcttatttggatgaggacgtaaactactgtattcttaagaaacagtctgtgagcgtgaccctcctgatcctggatatatcccggtcagaggttagggtcaaatcaccaccagaagcgggcactcagctccctaaaatcattttctcccgggatgagaaagtccttggccagtcccaggagccaaacgttaacccagcctccgctggaaatcagacacagaaaactcaggacgggggaaagagtaaacgctcgactgtggattctaaggccatgggtgaaaagtctttctctgtacataataatggcggggcggtgtcctttcagttctttttcaacatctcaaccgacgatcaagagggactctatagcctctatttccacaagtgcctcggcaaggaattgccctctgacaaattcacattctcactggatattgagattacagagaagaaccctgatagttacctatctgctggcgaaattcctcttccaaaactgtacatttctatggccttcttcttctttctgagcggcactatatggatccacatactacggaagcggcggaacgacgtgttcaaaatacactggttgatggctgcattacccttcactaagagcctctccttggtgtttcacgccatcgactaccactacattagttcacaggggttcccaatcgagggctgggccgttgtttactatattacccatctcttaaaaggagccctgctcttcatcacaatagctctgattggcactggatgggctttcataaagcatatccttagcgacaaggataagaaaatctttatgatagtgatccccctgcaggtactgtag

SEQ ID NO: 42411 - DNA, 1632 bp, Artificial Sequence
  Description of Artificial Sequence: Synthetic coding sequence
atggccgtgagcgagcggcggggcctgggccggggcagccccgccgagtggggccagcggctgctcctggtcctcctgctgggagggtgcagcggccggatccatcaactggccctcaccggcgagaagagagccgatatccaattgaatagttttgggttctacacaaatggatcactagaagtggaactttccgttctgaggttgggccttcgggaagccgaggaaaagtcactgctggtgggcttttccctatcccgcgtccgtagcggcagggtcagaagttattcaacacgggacttccaggattgcccactgcagaaaaatagctcaagctttctggtgctgtttctgatcaacaccaaagatcttcaggttcaggtgagaaagtacggcgagcagaagacactgttcattttccctggccttcttcccgaggcaccttccaagcctggactgcctaagcctcaagccaccgtgccccggaaggtggatggcggaggcaccagcgccgcctcaaagccaaagtccacccctgctgtcattcaagggccatccgggaaagataaggacctcgtgctcgggctgagtcatctcaacaattcctacaacttttctttccacgtcgtgataggaagccaggcggaagagggccagtacagcctcaacttccataattgcaacaactcagttccaggcaaagaacatcccttcgatattaccgtgatgatccgcgaaaagaacccggacgggttcttgtcagctgccgagatgccgctttttaaactgtatatggtgatgagtgcttgctttctggcagcaggtatcttttgggtgtctatcctctgccgcaacacgtatagcgtcttcaagattcattggctcatggcagcgttggccttcaccaagagcatctcactgttgttccattcaatcaactattatttcataaacagccaaggacatccgatcgagggcctcgctgtgatgtactatattgcccatttgttaaaaggggccctcctttttatcacaatagccctcattggatccggctgggcatttattaagtatgtcttatcggacaaggagaaaaaagtgtttggcattgttattcctatgcaagtcttggccaacgttgcctatataattattgagagcagagaagaaggtgcctcagattacgtgctctggaaggagatattgttcctcgtcgacttgatctgttgcggtgccatcctgttccctgtcgtgtggtcgattagacacttacaggacgctagcgggacagatggtaaggtggcagtgaacctggcaaagctcaagttgtttcgccattattatgtcatggtgatttgttacgtgtacttcactagaatcatagctatcttgctgcaggtcgctgtaccttttcaatggcaatggctataccagttactagtggaaggtagcactctagcgtttttcgttcttacggggtacaaattccagcccacgggcaacaatccttatttacagctgccccaggaggatgaggaggacgtccagatggagcaggtgatgacggacagcgggtttagagaaggactctccaaagtcaacaaaaccgcttcaggacgcgagctgttatag

SEQ ID NO: 42412 - DNA, 906 bp, Artificial Sequence
  Description of Artificial Sequence: Synthetic coding sequence
atgatccgggagaagaaccccgacggcttcctgagcgccgccgagatgcccttgtttaaactttacatggtcatgagtgcctgtttcttagccgcgggcattttttgggtttcaatactgtgcagaaatacgtactcagtgttcaaaattcattggctcatggcggccttagcatttacaaagtccatttctctcctgttccacagcataaactactactttattaactcacagggtcacccaatagaggggctggcagtgatgtactacatcgcccaccttctaaaaggagctctcttattcataaccatcgccctgattggatcaggttgggcattcatcaaatacgtgctcagcgacaaggagaagaaagttttcggaatcgtcattccaatgcaggtcttagcaaacgttgcttacatcatcattgagagccgcgaagagggcgcctcggattatgtcctttggaaggagattctctttctggtggatcttatttgctgcggtgccatcttgttccctgtggtctggtctatccggcacttgcaggacgctagtggaacagacggaaaagtggcagtgaatctcgccaagctaaagctcttccggcactactatgtgatggtgatttgctatgtctactttacgaggatcatcgccatcctcctgcaagttgcggtgcctttccagtggcagtggctgtaccagcttctcgttgagggttcgacgctggcgttctttgtgctgacaggctacaaattccagcctactggcaacaacccatatctacagctccctcaggaagatgaagaagatgtccagatggaacaagtgatgacagactccggatttcgggagggactgtctaaagtaaataagacagctagcgggagggaactcctatag

SEQ ID NO: 42413 - DNA, 2142 bp, Artificial Sequence
  Description of Artificial Sequence: Synthetic coding sequence
atggacatcagcatccagcggaacggcagcatcgtggccggctacgaggtggtcggatcaagcagcgcctcagagcttctgagtgccattgaacatgtcgctgagaaagcaaagacggcgcttcataagctgtttccactggaagacgggtcgtttagggttttcggaaaagctcaatgcaatgacatcgtgttcggcttcggctccaaggacgatgagtacacgctcccatgttcgtcaggataccgtggcaatatcaccgctaaatgtgagtcaagcgggtggcaggtaatacgggagacatgcgtccttagcctgctagaagagttgaacaaaaactttagcatgatagtaggaaacgctacggaggccgccgtgtctagctttgtgcaaaacctgtccgtgatcatcagacaaaaccctagtaccacagtcgggaacctggcctctgtcgtttccatcctctccaatatatccagcttgagtcttgctagtcactttagagtctccaacagcacaatggaagatgtgatatctatcgcggataacatcctgaactctgcctctgttaccaattggaccgttttgctgagagaagagaaatatgcttcctcccgcctgctagagactctggagaacatctccacattggtccctccaacggcactgccactgaactttagtcgaaaatttattgactggaagggtataccagttaacaaatcacagctgaaacgcggatactcataccagataaagatgtgtccacagaatacatccatccccatcagagggcgcgttctaattggcagtgatcaattccagaggagcctgcctgagaccattatctccatggcatctcttacgctgggcaatatactgcccgtatccaaaaacggtaatgcccaagtgaatgggcctgtaataagcacagtaatacaaaactactcgattaacgaggtatttctctttttcagtaaaattgagtctaatctctcacagccccattgtgttttttgggactttagtcacctccaatggaacgacgcgggctgtcacctcgtgaacgaaacgcaggacattgttacatgtcaatgtacgcatctaacatctttctcaatactgatgagcccattcgttcccagtacaatctttccggtggtgaagtggattacatatgtgggcctggggatcagtattgggagcctgatcctttgcctcatcattgaggcattgttctggaagcagatcaagaagtctcagacttcacatactaggcggatctgcatggttaatatcgccctctcgctcctaatcgcagacgtgtggttcattgtgggcgccacagtggacacaaccgtgaacccgtcaggcgtctgcactgccgccgtgttttttacgcattttttctacctgtcccttttcttctggatgttgatgttagggattctgcttgcctacaggattatcctggtatttcatcatatggcccagcacctgatgatggccgtagggttttgcttgggctatggctgtccattgataatctccgtcattacaatcgctgtaacacagccgtctaacacatataaaagaaaagatgtttgctggttgaattggtcgaacgggagtaagcccctgttggctttcgtagtgcccgctctggccatcgtggccgttaactttgtggtggtgctgctcgttttgacaaaactgtggcgcccgaccgtcggcgagaggctctctagggatgacaaagccaccattatccgcgtggggaaatcgttgctcattcttaccccactcttaggtttaacctggggcttcgggattggcaccattgttgactcccaaaacttagcttggcacgtcattttcgccctattgaacgcgttccagggcttcttcatactgtgtttcgggatactgctcgattcaaagctgcgacagctcctgtttaacaaactcagcgcgctgagttcctggaagcagacagagaagcagaactcttccgacttgtcagccaagcccaagttttctaaaccttttaatccactccaaaacaaagggcattatgcattttcccatactggggattcttccgacaatataatgctcacccagttcgtttcaaacgagtag

SEQ ID NO: 42414 - DNA, 657 bp, Artificial Sequence
  Description of Artificial Sequence: Synthetic coding sequence
atgaaggtgggcgtgctgtggctgatcagcttcttcaccttcaccgacgggcacgggggcttcctgggcaagaatgacggtattaagaccaagaaggagctcatcgtgaataagaaaaagcacttaggccccgtggaagagtatcaactgcttctgcaagtgacctaccgggattcaaaggagaaacgagacctgcggaattttctgaagctgctgaaacctcccctcttgtggtcccatgggctgatacgtatcatccgagctaaggctaccaccgattgtaacagcctcaatggagttctgcaatgcacgtgcgaggactcatatacatggttccctccatcttgccttgatccacaaaactgttatctgcacaccgcaggcgccctaccgagttgtgagtgccacctaaacaatctgagtcagtcagtgaacttttgcgaaagaacgaaaatctggggcacctttaagattaatgagcgcttcactaatgatttgttgaatagtagctcagccatctattccaaatatgcaaatggcatcgaaattcagctcaaaaaggcttacgaaaggatacagggttttgaatccgtccaggttacccagtttcggatgagcctgcttagtccaaaactggagtgtaatggtaccatctag

SEQ ID NO: 42415 - DNA, 1890 bp, Artificial Sequence
  Description of Artificial Sequence: Synthetic coding sequence
atgaaggtgggcgtgctgtggctgatcagcttcttcaccttcaccgatggccatggcgggttcttggggaagaatgacggcattaaaacaaagaaggaactgatcgtcaataaaaaaaagcatctgggtccagtcgaggagtaccaattgttgctgcaagtgacataccgagatagtaaagagaagcgggacctgcgcaacttcctcaaactgctgaaaccacctttgttgtggagtcacggtctaattcggatcatacgcgcaaaagccaccacagactgcaattctctgaatggagttctccagtgcacctgtgaggattcctatacctggtttcccccaagttgcctagatccacagaattgctacctgcatactgcgggagcgctgccttcatgtgaatgccatctcaataatctgagtcaatccgtgaatttttgcgaacggactaagatctggggaacgtttaaaataaatgagaggtttactaatgacttactgaattccagcagtgctatatacagcaaatatgccaacgggatcgagattcaactcaaaaaggcatacgaaaggattcagggctttgagagcgttcaagttacacagtttaggaacgggtctattgttgcagggtacgaggtcgtcggctcttcatccgccagcgagcttctatccgccatcgagcacgtggccgagaaagctaagaccgccctgcacaaattgttccctcttgaagacgggtcctttagagtttttgggaaagcacagtgcaacgacatcgttttcggttttgggagtaaggacgatgagtacaccctgccttgctcctccggctataggggaaacattactgcaaaatgtgagagctcaggatggcaggtgattagagagacctgtgtcctgagtctgctcgaagagttgaacaaaaacttctccatgatagtgggcaatgctacagaggcagctgtgtccagtttcgtccagaatctttctgtgataatccgacaaaaccccagtacaactgttgggaatctcgcctctgtggtctctattttgagtaacatttccagcttgagtctcgccagtcatttcagagtctccaacagtacgatggaagatgtaatcagcatagctgacaacatcctgaacagcgcctccgtgacaaattggacagtgctattgagagaggaaaagtatgccagctcacgcctacttgaaacactggaaaatatatcaaccctggtgccccccacagccctcccgctgaactttagccggaaattcattgactggaaggggattcccgtgaacaagagtcagctcaagagaggctattcctatcagatcaagatgtgccctcagaacaccagtattccaataagaggacgcgtcctgattggaagcgatcagttccaaaggagcctgccagaaacgatcattagtatggctagtttgaccttggggaatatcctgcccgtaagtaagaacggcaacgctcaagtcaatgggcccgtcattagcacagtgatccagaattactccattaatgaggtgtttcttttcttttcaaaaatcgagtccaatctgagccagcctcactgtgtgttttgggatttcagccacttgcagtggaatgacgccggatgccacctggtgaacgagacacaggatatcgtgacctgccagtgcacccacctgacttcattctccattcttatgtctcctttcgtgccatcgactatcttccccgtggtgaaatggatcacatacgtgggactaggaatctctatcggcagtctgatactttgcctgattattgaagctctgttttggaagcaaatcaaaaagagccagacgtctcacacgcgtcagaggaaaaagaaacagtag

SEQ ID NO: 42416 - DNA, 2733 bp, Artificial Sequence
  Description of Artificial Sequence: Synthetic coding sequence
atgaaggtgggcgtgctgtggctgatcagcttcttcaccttcaccgacggacacggtggctttctcggaaaaaatgacggaattaaaaccaagaaagaacttattgtgaacaagaaaaagcacctcggtcccgtcgaagagtatcagctcttgctgcaagtcacttacagagattccaaggaaaaacgcgacctcagaaactttttgaaattacttaagccccctctcctctggtcccatggccttatacgaattatccgtgccaaagcaacaacggattgtaattctctcaatggtgtattacagtgcacctgtgaggacagttatacctggtttcctccgtcatgcctggacccccagaactgctatcttcacaccgctggtgcattgcccagttgtgaatgccaccttaacaacctcagccagagcgtcaatttttgcgagagaaccaaaatctgggggacctttaaaatcaacgaaaggttcaccaatgatctgcttaattcttctagcgcaatatactccaagtacgctaatgggattgaaatccagctgaagaaagcatatgagcgtattcagggcttcgaatccgtgcaagttacacagtttaggaacggatccatagtcgcgggctacgaggtcgtcggttcaagctccgcaagcgagcttctgtccgccatagagcacgtggccgaaaaagctaagacggctcttcacaagttgttccccctggaggacgggagctttcgggtattcggaaaggcccaatgcaatgatatagtgtttgggtttggaagcaaagacgatgagtatacgctaccttgtagttcggggtatagaggcaacatcactgccaaatgtgagtccagcggatggcaagtcatacgggaaacttgtgtgctgtccctattggaggaactcaataagaacttcagtatgattgtcggaaacgccactgaggctgccgtgagcagcttcgttcagaacctatcggtcattatcaggcaaaatcccagtacgaccgtgggtaatttagcttccgtagtgtccatactgagtaacatttcatcactgtctctggcgtcccacttcagggtgagcaatagcacaatggaggacgtgatcagcatcgcggataatatccttaacagtgccagcgtcacaaattggacagtcttgctgagggaggaaaaatacgcctcttctaggctactcgagacattggaaaacattagcacgctggtaccacctaccgctttgcctctcaatttttccaggaagttcatcgactggaagggcataccagtcaacaagagccaactgaaacgcggttactcctaccagataaagatgtgcccccagaatacatctatccccatcaggggacgtgtcctgatcggctctgaccaatttcagaggtctctaccagagaccatcatttccatggccagtctgactctgggaaatatcctaccagtgtctaaaaatggaaacgcacaggttaatggtcccgtgatttcaacagtgatccagaactactcaataaatgaggtctttctgttttttagcaagatcgagagcaacctttcacagccccattgcgtcttctgggatttcagtcatctgcaatggaatgacgcaggatgccatctagtgaatgagactcaggacattgtcacctgccagtgtacacacttgacgtcttttagcattttaatgagtcctttcgtgccctccacaatcttcccagtagtgaaatggataacctacgtgggcctcggcatcagcattggaagcctcatactgtgtctcataattgaggcactcttttggaagcaaattaagaaaagccaaaccagtcacacgaggcggatttgtatggtgaacatcgctctgagcctgcttattgcagatgtttggttcatagtcggggcgaccgtggacactaccgtgaacccttccggagtgtgtacagctgccgtgttctttactcattttttctacctttctctttttttttggatgttaatgttgggaatcctcttagcctaccggattattctggtcttccatcatatggcacagcatctcatgatggccgttgggttctgtctgggttacggctgccccttgatcattagcgtgataaccatcgcagttacacaaccttcaaacacctataagcgcaaggacgtatgttggcttaattggagcaacggctctaaacccctgttggcgtttgtggtacccgcactggcgattgtggcggtcaatttcgtggtcgtgctgctggtgctcacaaaactctggcgcccaactgtaggtgagcgcctttcacgcgatgataaagctacaatcatccgcgtcggaaagagtttgcttatcctcaccccgctgcttggtctgacatgggggttcggtataggcactattgtggattcacagaatctggcctggcatgtaatcttcgccttattgaatgcctttcaaggcttctttattctctgttttgggattctcctggattccaagctacggcagctcctgttcaacaagttgtctgccctgtctagctggaaacagactgagaagcaaaacagctcggacctgtccgccaagcccaagttctccaagccttttaaccccctccagaataaagggcactacgctttttcacatacaggggacagcagtgacaacatcatgttgacccaatttgtgtcaaacgagtag

SEQ ID NO: 42417 - DNA, 2127 bp, Artificial Sequence
  Description of Artificial Sequence: Synthetic coding sequence
atgggcctgaccgcctacggcaaccggcgggtgcagcccggcgagctgccgttcggcgcgaacctgacactgattcatactcgggcccagcctgtaatatgtagtaagcttctactgaccaagcgcgtatccccgattagtttcttcctgagcaaatttcagaattcatggggcgaggatgggtgggttcaattggatcagttgccttccccaaatgcagtctcaagtgatcaggtccattgttcagccggctgcactcatagaaagtgcggatgggcagcatccaaatctaaagagaaagtgcctgcgagacctcacggcgtttgcgatggcgtttgcacggactatagtcagtgcacgcagccatgtccccctgacactcagggcaacatggggttctcttgtcggcagaagacatggcataagattacagacacttgccagacattaaacgccttaaacatttttgaagaggatagccgattggtacagccctttgaggacaatatcaagatctcagtgtacacaggaaagagtgaaacaatcactgacatgctactacagaagtgccccactgatctgtcctgcgttattcggaatatccagcaaagcccgtggatccccggaaacatcgcagtgattgtccaactgttgcataacatttccacagcgatctggacaggagtcgacgaggccaaaatgcagtcttactccactatcgctaatcatatactgaacagcaaatccatcagtaattggaccttcattccagaccgtaactctagttacattttactccattcggtgaacagcttcgccaggaggctgttcattgacaagcacccagtagatatctccgacgtgtttatccatactatgggtacaaccatcagcggggataacattggtaaaaacttcactttcagtatgcgcatcaatgacacaagtaatgaagtcaccggcagggttttgattagtcgggacgaattgaggaaagtccctagccctagccaggtgatttcaatcgcatttcctactataggagccattctggaggcatctctgcttgagaacgtgaccgtcaacggcctggtgctgagcgctatcctaccaaaagagctgaaacgcatctctcttatctttgagaagatttcaaagtccgaagagaggcgtactcagtgcgtgggatggcacagcgttgagaatcgctgggaccagcaggcttgtaagatgattcaggagaactcacaacaagcagtgtgtaagtgccggcccagcaaactattcacaagtttctctattctgatgtcaccccatattctagaaagtcttattctaacgtacatcacctatgtcggactcgggataagtatatgctctctcatcttgtgtctgtcaattgaagtgttagtttggtcgcaggtgacaaaaaccgagatcacttatttgagacacgtgtgcatagtcaacattgcagccacgctcctgatggccgacgtgtggtttatcgtggctagcttcctgtccggaccaattacacaccacaagggctgtgtcgctgctaccttttttgtgcatttcttctatctcagtgtgttcttttggatgttggcgaaggcccttctgattctgtacgggatcatgatcgtgtttcacaccctgcctaaaagcgtgttggtggcttcactttttagcgtgggatacggatgtcccctcgccatcgccgctatcaccgtggcagcaaccgagccagggaaagggtatctgcgtcccgagatttgctggctgaattgggacatgaccaaagccctgctcgcattcgttattcctgcactcgctatcgttgtggttaacctgattacagtgactttggtcattgtgaagactcaaagagccgcaataggcaacagcatgtttcaggaggtgcgtgctatagttagaatttctaaaaatattgccatcctaacccctctcttggggctgacatgggggtttggagtcgccaccgttatcgacgacagaagcttggcttttcatatcatattcagcctgttgaatgccttccaggtgagtcccgacgccagcgatcaagtacagagcgaacggattcacgaagatgtgctgtag

SEQ ID NO: 42418 - DNA, 1929 bp, Artificial Sequence
  Description of Artificial Sequence: Synthetic coding sequence
atgacccacatcctgctgctgtactacctggtgttcctgctgcccacagagagctgccggaccctctaccaggccgcctctaagtccaaggagaaggtacccgccagaccacacggtgtgtgcgatggcgtgtgcaccgattatagtcagtgtacccagccctgccctcccgatacacagggcaatatgggtttttcctgtaggcagaagacatggcacaaaattacagacacttgccagacactgaacgccctcaacatcttcgaagaagactctaggctggtgcagccatttgaagataatatcaagatttcagtctatactggcaaatcagaaaccatcacagacatgctgctccagaaatgtcctactgacctttcctgcgtcataagaaacattcagcaatcaccctggattccaggtaatatagctgtgatcgtgcagttgttgcataacattagtaccgccatttggacaggcgtggacgaagccaaaatgcaatcctacagcacgatcgctaaccacatcctcaattctaagagcattagcaattggacttttatccccgacagaaactcaagttacattctgctgcattccgtgaattcgttcgcccggcgcttatttatcgacaaacaccccgtcgatatctctgatgtctttatccacaccatgggcacgacaatcagcggtgacaacatcgggaagaatttcacgtttagcatgcggatcaatgacacctccaacgaagttactggtcgcgtgctcatttcgagagatgaattgcgaaaagtgcctagcccaagtcaagttattagtatcgcatttcccacaatcggggcaatcctggaggcatctttgctcgagaacgtgaccgtcaacgggctggtgctgagtgcgattcttcctaaggaactcaagagaatttcgctgattttcgagaaaatcagcaaaagcgaggaacgccggacacagtgtgtcggttggcattccgtagagaatcgatgggatcaacaggcatgcaaaatgatacaagaaaatagtcaacaagccgtgtgcaagtgccgcccctctaagctttttaccagctttagcatcttgatgagccctcatatcctggagagcctcattctgacatatatcacctacgtgggcctgggtatatccatctgttccctcatcttatgcttgagcattgaggtgcttgtatggagtcaggtaaccaaaacagagattacctatcttcggcacgtctgcatcgtgaatattgcggcgaccctgttgatggcagatgtctggtttattgttgcctcatttctgagtggaccaattacacaccataaggggtgcgtggccgccacgttttttgtccattttttttacctgtcagttttcttttggatgttagccaaggcccttttaattctgtatgggatcatgattgtgttccacacccttccaaaatcagtcctggtggctagcctgttctccgtgggttatggctgtccgctggcaatcgcagctattacagtagccgctacagagcctgggaagggttacctgcggccggagatatgctggctgaactgggacatgacaaaagcgctacttgccttcgtaatcccagcccttgctatcgtggtagtcaacctgatcactgtcacattggtcatagtcaagacacagcgggcggccatcgggaattcaatgttccaggaagtccgggccatcgttcgaattagtaagaacatagctattctgactccactgctcggactgacttgggggttcggggtggctacagtgatagacgatcgcagccttgcttttcacatcattttttctctgctgaatgcctttcagggcttctttatcctggtcttcggaaccatccttgatcctaaaattagggaggccctaaagggctag

SEQ ID NO: 42419 - DNA, 1929 bp, Artificial Sequence
  Description of Artificial Sequence: Synthetic coding sequence
atgacccacatcctgctgctgtactacctggtgttcctgctgcccacggagtcatgcagaacactgtatcaagcagcgagcaagagtaaagagaaggtgcctgcccgccctcacggcgtgtgtgacggtgtgtgcaccgactatagccagtgcacgcagccctgcccccccgacacacagggaaatatgggtttttcttgtaggcagaagacttggcacaaaattaccgatacgtgccagactctgaatgctctcaacatcttcgaagaggactctcgtctggtacagcctttcgaagataacataaagatctccgtgtacactggtaaaagcgagaccataacagacatgctgttgcagaaatgcccaaccgacctgagctgcgtcattcgcaacattcaacaatctccgtggatcccaggcaatatcgcagtgattgtccagctactgcacaatataagcaccgccatctggacgggagtcgatgaagccaagatgcagtcatattcaacgatcgccaaccacattctgaacagcaaaagtatctctaactggaccttcattccagacaggaactcctcttacattctcttgcattccgtgaacagttttgctcgccgactgttcatcgacaagcatccagttgatatcagtgatgtcttcattcataccatggggactacaattagcggcgacaacattggtaagaattttactttctctatgagaattaatgacacttccaatgaggtgaccggaagagtgcttatttcgcgcgacgagttgaggaaagtccccagcccaagccaagttatttctatcgcatttccaaccataggagcaatcctggaggcatccctcctggaaaatgtaactgtgaacgggttggttctctcagctatcctgcccaaagaactaaaaagaatcagcctcattttcgagaagatctcaaaatcagaagagcgccgcacacagtgcgtcgggtggcacagtgtggaaaatcgatgggatcagcaggcctgcaagatgatccaggagaacagccagcaagcggtgtgtaagtgtcgtcctagcaaactgttcacatccttttccatcttgatgtccccacacatcctagagtctctcatcctgacctatataacatacgtcgggcttggcatttctatatgtagccttatcctttgccttagcatcgaggtgctcgtctggtcccaggtaaccaagaccgagattacctacttacggcacgtgtgtatagtgaatattgcggctacgctcctcatggcagatgtgtggtttatagtcgctagctttttgagcggcccaatcacccaccataagggttgtgtggcagctacctttttcgtgcactttttttacctctccgtgttcttttggatgttagctaaggcactgctcattctgtacggaatcatgatcgtatttcataccttgccaaagtccgtgctggtcgcctcacttttttccgtgggatacggctgccccctggcaatcgcggccataacagtcgctgccacagaaccgggcaagggttacctcagaccagaaatatgttggctgaattgggatatgaccaaggcactcctcgcatttgtcattcctgccttggcgatcgttgtggtcaatctgatcacggtgacattggttatcgtgaagacacagcgggctgccatcggcaattctatgtttcaggaggtgagagctattgtgaggattagtaagaacatcgccattctgacccccctacttggtctcacttggggctttggagtcgcaaccgtgatcgacgacaggtccctggcttttcatatcatattctcactattaaacgcttttcagggattttttatcttggtctttgggactatcctggatcccaagatacgcgaggctttgaaaggttag

SEQ ID NO: 42420 - DNA, 8415 bp, Artificial Sequence
  Description of Artificial Sequence: Synthetic coding sequence
atggacgacaacagccggtactggatggccttcagctacatcaccaacaacgcgctgctgggccgcgaggatattgacctgggactggctggggatcaccagcaactaattctctaccgccttggcaaaactttcagtatacggcatcacctggcatcctttcaatggcatactatttgtctgatttgggacggggtgaagggcaagctggaactctttctgaataaggaacgtatcctcgaagtgaccgatcagccccataacttgactccccacgggaccctttttcttggtcactttctgaagaatgaatcgtcagaagttaagagtatgatgcggtcatttcctgggagtctctattacttccagctgtgggatcacatccttgaaaatgaagagtttatgaaatgcctcgacggtaatatcgtgagctgggaagaagatgtttggctggtgaataaaattataccaacggttgatcgcactctgcgttgttttgtacccgaaaatatgactattcaggaaaagtccaccacagtgtcacagcagatcgacatgacaactccatcccagataaccggagtgaaaccccaaaatactgctcatagctcaactttgttgagtcagagcattcccatctttgccacagactacacgactataagctactcaaacactacgagtcctcctctcgaaaccatgactgcccagaagatcttaaaaacgttggttgatgaaacagccaccttcgcagtcgatgtgctgagtacctcttccgcgatcagcttacccacccaatctatttccatagataacactaccaactcaatgaagaaaacaaagtctccctcatcagaatcaactaaaaccacgaaaatggtggaagcgatggccacggagatcttccagccccccacaccttcaaatttcctcagcaccagcaggtttacaaagaatagcgtggtgtctactacgtccgccattaaaagccagagcgccgtcacgaaaaccaccagtctgttctctactatcgaaagcacgtctatgagcaccactccttgcctcaagcagaaatctacgaatacaggtgccctccctattagcactgcaggtcaggagtttattgagtctaccgctgcaggaaccgtgccatggttcacagtggagaagacatccccagccagcacacatgtcggtaccgcttcatcctttcctcctgagcccgtgcttatatctaccgcggccccggtggattccgtatttcccaggaatcagaccgcttttcctctggccaccaccgacatgaagatcgccttcaccgtgcactcattaacactgccaacccggctaatcgagaccacccctgctccaaggaccgccgagacagaacttacctcaacaaacttccaagatgttagtctgccgcgcgtggaggatgctatgagcactagtatgtcgaaggaaacctcatctaaaactttcagcttcctgaccagcttcagtttcaccgggactgaatctgttcaaacggtgatcgatgctgaagctactcgcacagctctgacccccgaaatcaccctggcgtcgactgttgccgagacgatgctgtcctccactatcacaggacgggtttatacccagaacactccaaccgctgacgggcaccttctgactctcatgtccaccaggtccgcctctactagtaaagcacccgagtccgggcccacctctactacagatgaggccgctcacctgttctccagtaatgaaacaatttggacatccagacccgaccaggccctgttagcgtcgatgaacactaccactatactgaccttcgtccctaatgagaacttcaccagcgcctttcatgagaatactacctatacagaataccttagtgctacgacaaatatcacaccgctgaaagccagtcctgagggcaaaggcacaactgccaatgatgcgaccactgcccgatacaccaccgctgtgtcaaaactgacttctccatggttcgctaatttcagcattgtgtctggaactacgtctattaccaatatgcccgaattcaaactcacgactctgttgctgaaaaccattcccatgtccaccaaaccggccaacgagctcccactgaccccccgcgaaactgtggtgccttctgtcgacatcatctccaccttagcgtgtatccaaccgaacttttcaacagaagagagtgcttcggaaaccacgcagaccgagattaatggcgctatcgtgttcggggggacgaccacacctgttccaaaaagtgctacaacccagagattgaacgccaccgttactagaaaggaggcaaccagtcattatctgatgaggaaatcgacaattgccgcagtcgccgaggttagtcctttcagtactatgctagaggtcaccgacgagagcgcgcagagagttacagctagtgttacagtgtccagtttccccgacattgaaaaattgtcgactcctcttgacaataagaccgcaaccacagaggtacgagagagctggctgctcactaaattagtgaaaacaaccccgcgtagcagttataacgaaatgacggagatgttcaacttcaaccatacctacgtggctcattggacatccgagacatccgaaggaatttctgccgggtcccccacgtccggttccactcacatcttcggagagcctttaggagcctccaccacacgcattagcgagacctctttctcaacgacgccgactgatcggaccgctacttccctctctgatggaatactccccccgcaaccaactgccgcccacagctccgctacccccgtgcccgttacccacatgttctctttacctgtgaatggaagcagtgtcgtggcggaggaaaccgaggtgacgatgtcagaaccatcaaccttggcacgcgctttctctacctctgtcctctcagatgtttccaatctgtcaagcaccacaatgaccacggcgctcgtccctccactggatcaaacggcatccacaactatcgtcatcgtacccacccacggagaccttatacgaactaccagcgaagcaaccgtaatcagcgtccgcaagacatctatggccgtgccctcactgacagagaccccgtttcatagtctgagactgtccactcccgtcacagctaaggccgagaccacccttttttccacatctgtcgatacggtgacaccttctacgcatactcttgtgtgttccaagccccctcccgataatatccccccggctagctccacacatgtcatatcgactacctcgactccagaggccacacaaccaattagccaggtggaggaaacttcaacttacgcgctctcttttccctacaccttttcaggagggggagtcgtggccagcctggcaaccggcacaactgagaccagcgtcgtcgacgagacgacaccttcccacattagtgcaaataaattgacaacatcagttaactcccatatatcaagcagcgctacttaccgggtgcacactcctgtgagcatccagctcgtgacctcaacatctgtgctttcttcggacaaggatcagatgaccataagtcttgggaaaactccaagaaccatggaggtcactgaaatgtccccctctaagaattcctttataagctatagcagagggaccccatcgctggaaatgaccgacaccggcttccctgaaactacgaaaattagtagccatcagacccactccccgtcagaaatcccactcggaactcccagtgatggaaatctcgcctccagccccactagtgggagcacccagattacacccacgttgactagcagcaatacagttggagtgcacattcccgaaatgagcacaagtctgggcaaaaccgcccttcccagtcaggcgcttacgatcaccacttttctatgtccagaaaaggagagcacctccgccctgccagcttacacgcccagaaccgtagagatgattgtgaattcgacttacgtgacgcatagtgtgagttacggtcaggacacttcctttgttgacacgacaacatcgtcaagcacacggattagcaatcccatggatatcaacacgactttttcgcatctgcactctcttcggactcagccggaggttaccagcgttgcgagctttattagcgagtctacacagactttccctgagtcattatcgctttccacagccgggctgtataacgatgggttcacagttttgagcgaccggattaccaccgccttctcagtacctaatgttccaaccatgttgccaagggagtcttctatggccacatctaccccaatctatcagatgtcatctctgcccgtgaatgtcacagcgttcaccagtaagaaggtgagtgatactccgccgattgtgatcaccaagtcgagtaagacaatgcaccctggctgcctaaagagcccctgcacagcaaccagtggaccaatgtcagaaatgtcatccatcccagtcaacaattcagccttcactcccgccaccgtctcctccgataccagtactagggtgggtctgttcagtactttgctgtcctctgtgacgcctcgaaccaccatgaccatgcagacttctaccctggatgtgacaccagtgatttacgccggggccactagtaagaataagatggtgtcgagcgcctttaccactgagatgattgaagcaccttctcgaataacgcctactaccttcctctctcccacggagcctacactgccttttgttaagaccgtccctaccactattatggcagggatagtgacgccttttgtgggcaccaccgccttctcacccttatcttccaaaagcactggggctatcagctctatcccgaagacaaccttttcccccttcttaagtgccacccagcagtctagccaggcagacgaggcgacaacactcgggatcctgagcggaattactaaccggtccctgagcacggtgaatagcggcaccggggtcgcactgaccgacacttacagtaggatcacggttcctgaaaatatgctttcgcccactcatgcagattccctacacactagtttcaacatccaggtctcaccttccctgacctccttcaagtcagcgagcggacctacaaagaatgtgaaaactaccacaaattgttttagctctaatacacgcaagatgacttctctactggaaaaaactagcctcactaattatgctacttccctgaatactcccgtgagttacccaccctggacgccttcatctgcaaccctgcccagtttaacatcctttgtgtacagccctcacagcactgaggctgaaattagtacacctaagacatccccccctccaacatcccagatggtggagttccccgtgttgggcacgagaatgacatcgagtaacacccaacctctgctgatgacatcatggaacattcccacagccgaagggtctcagtttcccatctccactactatcaacgtacccacaagtaatgaaatggaaaccgaaacacttcatctggtccctggccctctgtccacatttaccgcaagccaaacgggcctcgtgtctaaagacgttatggctatgtcgagcattccgatgtcaggaatactgccaaaccatggcctttctgagaacccaagcctcagtactagcctgcgggccatcaccagtaccctggctgatgtaaaacacacctttgagaagatgacgacatcagtgacccccggcaccacccttcccagtattctgagtggggccacaagcggctcagtgatcagcaaatcccccatattgacatggctgctgagctctttgccctctggctcacctcccgccacggtatcaaacgcccctcacgtgatgaccagcagtaccgttgaggtgtctaagtctacatttctgacctctgatatgatatccgctcatccttttactaacctaaccacactgccttcggctacaatgtccactattctgactcggactattcctactccaacactcggcggaatcacaaccgggtttccaacctcactgccaatgtccatcaatgtgaccgatgacattgtttacatttccactcaccccgaggcttcttctcggactactatcaccgctaatcccagaaccgtctcacacccttccagctttagtcggaagaccatgagcccctccactacagatcacactttaagcgtcggtgcgatgcccctcccaagttccacaattacaagctcctggaatcgcatccctaccgcttcctcaccttctactttgattattcccaaacccaccttggacagtcttctgaacattatgacaacaacttcaaccgtgccgggcgccagctttccactgataagtacaggggtcacctacccctttaccgccacagtgtcctccccaatttccagcttcttcgagaccacctggttagacagcaccccaagttttctcagcaccgaggcctctacaagtccaacagccactaagtcgaccgagccgggcaactgtaaggcagacgagaccgcttccaaatacaagggaacctacaagtggctgctaaccaaccccacagaaacggcgcagacacggtgtattaagaacgaagacggaaacgcgacgagattttgctctataagtatcaataccggcaagtctcagtgggaaaaaccgaagttcaaacagtgtaagctactccaggaactgccagataagatcgtcgacctggccaacattacaatcagcgacgagaacgccgaagacgtggcagaacatatccttaaccttattaacgaatcccccgctctgggtaaagaagagaccaaaatcattgtgtcgaagatctccgacatcagccagtgcgatgaaatctcaatgaacctcacccacgtgatgctgcaaatcattaacgtggttctagagaagcagaacaatagcgccagtgacttacacgagatcagtaatgagatacttcggattatcgagagaaccggccacaagatggagttcagcggacagatcgcgaatctcaccgtcgctggcttagcgctggctgttctacgcggtgatcacaccttcgatggcatggctttcagtattcacagctacgaggagggaactgatcccgagactaagaatgtgaccaaggcgctgacgacctatgtcgtgtcggcctcaatctcagatgatatgttcatccaaaatttggcggacccagtggttatcaccctgcagcacatcggcggtaatcagaattatggacaggtgcactgtgcgttctgggactttgaaaataacaacggcctaggagggtggaactcgtccggatgcaaagtcaaggagaccaatgtcaattacaccatctgccagtgtgatcatctcactcactttggagtgctgatggatttgtcgagatctaccgttgactcagtgaatgagcaaattctggcactgatcacatacacaggttgcggcatctcttcgattttccttggggtcgcggtcgtgacctatattgcatttcacaagctccgtaaagactatcccgcgaagattctgatcaatctgtgtacagctctgctgatgctaaatcttgtgtttctgatcaactcttggctctcatctttccaaaaagttggggtgtgcattactgcagcagtagccctccactactttcttctggtatcatttacgtggatggggctggaggccgtgcacatgtacctcgctctcgtaaaggtgtttaacatctatatccctaattatattcttaagttctgcctcgtgggatggggaatcccagcgattatggtggctatcacagtttccgttaagaaggacctttacgggactctctccccaaccactcccttctgttggatcaaagacgactccatcttctacatatccgttgtcgcctacttttgtttgatcttcctgatgaacctgtctatgttctgtaccgtcctcgtgcaactaaatagcgtgaagtctcagatccaaaagaccaggcgtaagatgattctccacgacttgaagggcaccatgtcccttacattcctgcttggccttacatggggctttgcattttttgcctgggggcccatgcggaattttttcctctacttgttcgcaatattcaatacactacaggacggaagttcacggtgtcaaatcaaggttggatataagcaggaggggctaaagaagatcttcgagcacaaacttttaaccccatcattgaagagtacagcaacatcttcaacatttaagagcttagggtcagctcagggcaccccatctgagattagtttcccaaacgcgcctgagctttctgctctgcatgtcgtagcatccgagcctactacaggatag

SEQ ID NO: 42421 - DNA, 9243 bp, Artificial Sequence
  Description of Artificial Sequence: Synthetic coding sequence
atgaaggagcacatcatctaccagaagctgtacggcctgatcctgatgtcctcattcattttcctgagcgatactcttagtttgaagggtaaaaagctcgactttttcggcaggggagacacctatgtgagcctgattgacaccataccagagctctctcgatttaccgcttgtattgacctcgtctttatggacgacaattcgcggtactggatggccttctcttacatcactaacaacgctttgcttggccgcgaagatattgaccttggtcttgcaggcgaccatcaacaactgattctgtacaggctggggaaaacattcagcatccgccatcatctggccagttttcagtggcacactatttgtctaatctgggatggggtgaagggaaaacttgaactgtttctaaataaagaacgaattcttgaggtgactgatcagcctcacaacttgacacctcacggtacgttatttctgggccacttcctcaaaaacgaaagtagtgaggtcaaaagtatgatgaggtcatttcccggcagcctgtattactttcaactgtgggaccacatcctggagaatgaggagtttatgaaatgtctagacggcaatatagtttcctgggaggaggatgtatggcttgtgaacaagatcatccccactgtggacaggactcttcggtgctttgtgcctgagaacatgaccattcaggagaagagcactaccgtttcccagcagatcgatatgaccactccaagccagataactggcgtaaaaccacagaataccgcgcactcatctaccctgctgtcccaaagcattccaatttttgctaccgactataccactatctcctactccaataccacctcaccgccacttgagaccatgaccgcccagaaaattctaaagacactggttgacgaaaccgctaccttcgctgtcgacgtgctctctactagctccgcaatctctcttcccacacagtccatttccatagacaatacgacaaatagcatgaagaagacaaagagtccctcctccgaatcaacaaagaccactaaaatggtggaggctatggccactgaaatatttcagcctcccaccccgtctaattttttaagtacaagtaggttcactaagaatagtgtggtctccactacgtcagctataaaaagccagagcgctgtgacaaagaccacctcacttttctcgactatcgagtcaaccagtatgagtacaacaccctgtcttaaacagaagagtactaacacaggagccctcccgatcagcactgcaggacaggaattcatagagtctactgcagccggaacggtgccctggtttactgtcgagaagacttctcctgcctccacacacgtggggaccgctagctcgttcccccccgaacctgttctcattagcactgcggccccagtggacagcgttttccccagaaatcagacagccttccctcttgcgaccaccgacatgaagattgctttcacagtccacagcttaaccctgcctactagactgatcgagacaactccagccccccgaacagctgagacggagctcacgtcaaccaacttccaggatgtatctctgcccagagtagaggacgcgatgtccacctctatgtcgaaggaaacttcttccaagacgtttagcttcctcacctctttctcttttacgggcaccgagagtgtgcagaccgtgatagatgctgaggccacgagaacggccttaactccagagatcacactggcctccacagttgcagaaacaatgctctcctctaccatcactggtagagtttacacacagaatacgcctaccgccgacggccacctgctgaccctgatgtctacaaggtcagcctcaacgtccaaagcccctgagtcaggcccaacaagcacaacagacgaggccgcccatctgttctcctcaaatgaaacaatctggacctctagaccagatcaggctctgctggcgagcatgaacaccactaccatcctcacctttgtgcccaatgaaaatttcacatccgcttttcatgaaaacaccacttatacagagtatctctctgccaccacaaacattacccccctcaaggcatccccagaaggcaagggcacaacagcaaatgacgccaccaccgctcgttatactaccgccgtcagcaagttaacctcaccctggtttgccaacttttctatcgtgagcgggactacctctatcactaacatgccagaattcaaactgacaaccctgctcttaaagacaatccccatgagcacaaagcccgccaatgagcttccccttaccccccgggagacagtggttcccagcgtcgacatcatctccactttggcctgcatccaacctaactttagcacagaggagagtgcatccgagactacgcagacggaaattaatggagccatagtgttcggaggtaccactaccccagtccctaagtcagcaactacccagcgtctcaacgccactgtcacccggaaggaggccacatcccactacctcatgaggaaaagtacaatagctgcagtcgcagaggtgagtcccttttccacaatgcttgaggtgaccgacgagtccgcccagcgggtgacagcctccgttacggtgagcagttttcctgatattgaaaagctgtctacaccactcgacaacaagaccgcaacaacagaagtgcgggagagctggctgctgaccaaactagtgaagacaactccaaggagctcctacaatgaaatgacagagatgttcaactttaaccatacatatgttgcacactggacctccgaaacctcagagggcattagcgcggggagcccaaccagcggatctacccacatttttggcgagccacttggggcgtcaactacccgaatctcagagacttcattctcgacaacacctacggatcggacagcaacctcactgagtgatggaatactgcctccccagcctacggccgctcactccagtgcaacacccgtccctgtgacgcacatgttctccttgccggtcaacgggtcgtccgtggtcgctgaggagactgaagtgaccatgagtgagccatccacactcgccagagcctttagcactagcgtgctgtctgatgttagtaacctgtccagcacgacgatgaccaccgcactggttcctccgttggaccagacagcgagcactactatagtcatcgtgcctacccatggcgacctgattaggactacgtccgaggccactgtgatctccgtgcggaaaacaagtatggcggtgcccagcctgacggaaactccctttcactccctgcgtttatccactcccgtcactgccaaggccgagacaacactcttctctacatccgtggacaccgtgacaccttccacacacacccttgtctgctccaaaccgccacccgataacatacctcctgcttcatcaacgcatgttatctccactacctcgactccagaagccacccagcctatttcccaggtcgaggaaacctctacttatgcattgagcttcccctacaccttttcgggagggggggttgtcgctagtctggctacaggcaccaccgagaccagcgtggttgacgagactacccccagccatatttcggccaataagctgacaacctcagtgaacagccatatttcatcgtccgcgacatatagagtacataccccggtctcaatccaattagttacctctacttctgtgctgagttccgacaaggaccaaatgactattagcttaggcaaaacacctcggaccatggaagtgaccgagatgtcacctagtaagaacagtttcatatcctatagtaggggcacacccagtctggaaatgaccgataccgggtttccagaaacaaccaaaattagctcccaccagactcactctccctctgagatcccactggggactccctctgacgggaacctggcctcttcaccaacttctgggtcaactcaaattacccccacacttacctctagtaacactgttggggtgcatatccctgagatgagtacgtccctgggtaagaccgctctgccttcccaggccctgactatcacaacatttctgtgccctgagaaggagagtacaagcgctctgcctgcctatactcctcgaactgtagagatgattgtgaatagcacctatgttacccacagcgtgagctacgggcaagatacctcgtttgtcgacaccacaacttcttcaagtaccaggatcagcaacccgatggacatcaacacaaccttcagtcacctgcactccttacggacacagcctgaagtcacatccgttgccagcttcatatcagaaagcacccagacttttcctgagtccctttctctgtctaccgcaggattatacaatgacgggttcactgtcctgagcgatcgtatcaccaccgccttttcggtccctaatgtgccgaccatgctgccaagggaatcttctatggcgaccagcactcccatttatcagatgtctagcctcccggtcaatgttaccgcgttcacttccaagaaggtatccgacactcccccaatcgtgatcacgaagtcttcaaaaaccatgcatcccggctgccttaagtccccatgtacagccacttcaggacccatgagcgaaatgtcaagtatacccgttaacaattccgccttcactccagccactgtcagtagcgacacttctacacgggttggcctgtttagtaccctgctctctagtgttaccccccggactacaatgaccatgcagacttccacacttgacgtgacacccgtcatatacgctggcgcaacaagtaaaaataaaatggttagctccgcctttacaacggagatgatcgaggccccaagccgtatcacaccaaccacatttctgtcgccgactgaacccacactcccttttgttaaaactgtcccgactaccattatggccggcatcgtgactccattcgtcggcactacagctttctcacctttgtccagtaaaagcacgggagcaatcagttccataccgaaaacaactttttctcctttcctctcagccacgcagcaaagctcccaagctgatgaggccacgaccctggggattctctcaggaattactaaccgttctctgagcaccgtgaattcaggcacaggcgtggccctgaccgacacctacagtcggataacagttccagagaacatgctgtctccaactcacgccgacagtctgcacacctccttcaacatccaggtttcacccagtctcactagcttcaagagcgcttccggacccacaaagaatgtcaagacaacaacgaattgcttctcatctaatacaagaaagatgaccagcctgctggagaagacctctctcaccaactatgctacctctctgaatacacccgttagttatcccccttggaccccgtcatccgcaacacttccaagtctcacaagctttgtgtactcccctcacagtactgaagctgaaatatcaaccccgaagactagccccccccccaccagtcagatggtcgaattccctgtgctggggaccagaatgaccagttccaatacccaacctctcctgatgacaagctggaatatcccaacagccgaggggagtcagtttccaattagcactaccatcaacgtgcctactagtaatgaaatggaaacggaaactttgcacctagtgccgggcccactgtccactttcaccgccagccagaccggcctggtttctaaggacgtcatggcaatgagcagcattcccatgagcggtatcttgcctaaccacggtctgtctgagaaccctagtctttctacctctctgagggcgatcacaagtaccctggcggacgtcaagcatacattcgagaaaatgacaaccagcgtcacccccggcactactctaccttccatattgagtggggccacttccggcagtgtgataagtaagtctcctatattaacttggcttttaagcagtctgccttcaggctcccctcccgctacagtctccaacgcccctcacgtaatgacctcctctaccgtggaggtgagcaagtctacgttcctcacaagcgacatgattagtgctcacccttttacaaacctgacgacattgccctccgctacaatgtctaccatcctcactaggactattccaactcctactttggggggcatcacgaccggctttcctacttctctgccaatgtctattaacgttacagatgacattgtctatatcagtacacaccccgaggccagcagtagaaccaccatcactgccaacccacggacagtgtcgcacccctctagcttttcccgaaagaccatgtcccccagcactacggaccacactctgtccgtgggcgcgatgcccctcccttcttccacaatcacctcctcttggaatcggattcctacagcctcaagccccagcacgctgattatacccaagcccacactcgactcccttctgaatatcatgacgaccacatctactgttcccggagcatcatttccacttatcagtaccggcgtcacctacccttttaccgccacagtgagtagccctatatccagcttcttcgagacaacttggctagatagcacacctagttttctgagcacggaagcatccacatctcccacagctactaaatctaccgtctcgttctataatgtcgagatgagctttagcgttttcgttgaagagccaaggataccaattacgagtgtaataaacgagttcaccgagaatagcttgaattcaatttttcagaatagtgagttttccttggctactctggaaacccagatcaaaagtagagacattagcgaggaggaaatggtcatggaccgcgcgattctcgagcagcgggaaggccaggaaatggcaaccatctcgtacgtgccttactcgtgtgtctgccaggtgatcattaaggcaagcagctctttggccagcagtgagttaatgcgaaaaatcaaaagtaaaatccacggtaacttcacccacggtaattttacacaggaccagctaacactgctggtcaactgtgagcacgttgctgtgaagaagttggagccgggcaactgcaaagccgacgagactgctagcaaatataaaggaacttacaaatggctgctgacaaatcctacagagaccgcacagaccaggtgcattaaaaacgaggatggcaacgcgacaagattctgttccataagcatcaataccggtaaatctcagtgggagaagcccaagttcaagcagtgtaagttactgcaggagctgcctgataagatagtggatcttgcaaacataaccatcagtgatgagaatgccgaggatgtcgccgagcatatcttaaacctgatcaacgaaagtccagcactggggaaggaggaaactaagatcattgtcagcaaaatctcagatatttctcagtgtgatgaaatttctatgaatctaactcacgtgatgctgcagataattaacgttgtgttggaaaaacagaataacagtgcttctgaccttcatgaaatctctaatgagattttaaggataattgagcggaccgggcataaaatggaattcagtggacagatcgccaacttgactgttgcgggcctggccttggcggtgttacggggtgaccacaccttcgacgggatggccttctccatccatagttacgaagaaggcacagatcccgaaatattcctgggaaatgtccctgtggggggcattctggcatcgatctatctccccaagagcctaactgagaggatccccttgtccaatctccaaaccatcttgtttaatttctttggtcaaacctctctgtttaagaccaagaatgtgaccaaggcgctgaccacctatgtggttagtgcctccatttccgacgacatgttcatccagaatctcgcagacccagtggtaatcacactgcagcatataggcggaaaccagaattacggccaggtgcactgcgctttttgggatttcgagaataacaatggcctggggggatggaattcaagtggctgtaaggtgaaggagaccaacgtaaattatactatctgccaatgtgaccacctgacccacttcggagtgttaatggatctgtcacggagcaccgtggactctgtaaacgagcagatcttggcactcattacatacacgggctgtggcatctcttcgatttttttaggggtcgcagttgttacatacatcgccttccataagctgcggaaggactacccagctaaaattcttatcaatttatgcaccgcgttactgatgctgaatttggtgttcttaattaactcttggctttcaagctttcagaaagttggggtgtgtattacagccgcagtggccctccactacttccttttggtttcttttacctggatgggtcttgaagccgttcatatgtatctcgcgctcgtgaaggtgttcaatatctacatccccaattacatcctaaaattttgcctggttggatggggaattccagccattatggtggctattacagtgagtgtgaaaaaagacctgtacggcactctgagcccgacgacccccttttgctggatcaaagatgactcgattttctacattagtgtggttgcgtatttctgcctcatttttttgatgaacctgtctatgttttgtaccgtgctggtgcagcttaacagcgttaaaagccagattcagaagactcgccgaaagatgatactacatgatctgaagggcaccatgagcttgacatttttgctaggattaacctggggcttcgcctttttcgcttggggaccaatgagaaactttttcctttaccttttcgcaatctttaataccctgcagggtttctttatttttgtttttcattgcgtcatgaaagaatcagtgagggagcaatggcagatccacctgtgctgtggatggctccggctggataattcctctgacggctcatcccgttgtcaaatcaaggtcggttataagcaggaggggctaaagaagatctttgagcacaagttgcttaccccgtcactcaagtccaccgcgacaagctccacatttaagtccctgggctctgcgcagggaacaccctctgaaatctcatttccaaacgatgacttcgataaagatccctattgtagcagcccctag

SEQ ID NO: 42422 - DNA, 9243 bp, Artificial Sequence
  Description of Artificial Sequence: Synthetic coding sequence
atgaaggagcacatcatctaccagaagctgtacggcctgatcctgatgtccagtttcatctttctcagcgatactctgtcactcaagggaaagaaacttgatttctttgggcggggggatacctatgtgtccctcattgacactattcccgagttgagcaggtttacagcttgtatcgacttggtgttcatggacgacaattctcggtattggatggcattcagctacatcacaaataatgctttgctgggccgagaagatatcgatcttggcctagccggtgatcatcagcagctgatcctctaccgcctcggcaagacttttagcattcggcaccacttagcatcattccaatggcacactatttgtctgatctgggacggggttaagggaaaattagagctcttccttaacaaggagaggatcctggaagtcaccgatcagccccataacctgacaccgcatggtactctcttcctgggccacttcttgaagaacgagtcctctgaagtcaaatcaatgatgaggtcatttcccggttccttatactacttccagctttgggaccatattctggagaacgaggagtttatgaagtgcctggatggcaacattgtttcctgggaagaagatgtatggctggttaacaagatcatcccaaccgtggatagaacactgagatgtttcgtgcctgaaaatatgactattcaggaaaagtctactaccgttagccaacagatcgacatgaccaccccaagtcaaatcacaggtgtgaagccacagaacacagctcactcaagtactttgctgtcccagtctatccccatttttgcgacagactatacaacgataagttattctaatacaacgtcccctcctctggagaccatgacagcacagaaaatcctgaagacactcgtggacgaaactgcaactttcgctgtagacgtgctttctacctccagcgccatctcacttcctacccaaagcattagtattgacaacactacaaattccatgaaaaagaccaaaagtccctcttccgagagtaccaagaccaccaaaatggtcgaggccatggctaccgagattttccagccccctaccccgagcaatttcctgagcaccagcagattcaccaaaaactctgttgtgagtaccacttctgctatcaaatcccagtctgccgtgacgaaaactacctccttattctctacgattgagtcaaccagtatgtccaccacaccctgtctaaagcagaaaagcaccaatacaggcgctctcccaatctccacagcgggccaggagttcatcgaaagcaccgccgcaggcacagtcccctggttcaccgtggagaaaacatcgcctgcaagcacacatgtaggtacagcttcatcattcccaccagaacccgtgctcattagtaccgctgcccccgtggattcagtcttcccacggaatcagaccgccttccccctggctactaccgatatgaaaattgccttcaccgtgcatagtttgaccctgcccacacgcctgatcgagaccaccccagcaccgagaaccgccgagaccgaattgacctctaccaatttccaggatgtgagcctacccagggttgaagatgcaatgtctacgagtatgtccaaggaaacatctagtaagacgttttccttcttaacttctttttcttttaccggcacggagtcagtgcagaccgttatcgatgctgaggccacgcgcaccgcgcttaccccagaaattactctggccagtaccgttgccgagaccatgctgagtagcacaatcacaggaagagtctacacacagaacactccaaccgccgacggtcatctcctaacgttaatgagcactaggtccgcatccacaagcaaagccccagagtccggacccactagtacgaccgacgaagccgcccacctattttcttctaatgagacgatatggacatctagaccagaccaagctctgttggcgtccatgaacaccaccaccatcttaacattcgtgcccaacgagaactttaccagtgcattccatgaaaatacaacatatactgagtacctgtctgccaccactaacattacacctctgaaagcgtcacctgagggtaagggtaccaccgccaacgacgcaacgaccgccagatacacaactgcagtatcaaaactgacatcaccatggttcgcaaacttctccatcgtatctggcactacgtcaataactaacatgcctgaatttaaactgactacactcctactcaagacgatcccaatgtcgactaagccagcaaatgagctccctttaactccacgggaaacggtagtaccaagcgtggatattatctccaccctggcttgcatccaacccaattttagcaccgaagagagtgcctctgaaaccacccagacggagataaacggtgccattgttttcggaggaaccaccacgcccgtcccaaagtcagccactacccagcgactgaacgcaacagtcacacgaaaggaagccacatcacattatttgatgcgtaagtcaaccattgcagccgtcgccgaggtatctcctttctcaactatgctggaagtgacagacgagtccgcccagcgtgtgacagcctcagtgaccgttagctcctttcccgatattgagaagctttctacacctctggataacaagaccgctactacagaagtgagggagtcgtggcttctgacgaagctcgtcaaaaccacaccccggagctcttacaacgagatgaccgagatgtttaatttcaaccatacttatgtggcccactggaccagcgaaacatccgaagggatatcagctggcagtcccacgtcaggttcaacacatatctttggcgagcccctgggtgcatctaccacaagaatctccgagacgtcgttttctactacaccaaccgacaggaccgcgacaagccttagcgatgggattttaccccctcagcctaccgccgcccacagctccgctactccagtgccagtgacacacatgttcagcttacctgtgaacggatcatctgttgtagctgaggagacagaggtgactatgtctgagcctagcaccctcgctagagcgttctccacctctgtcctatcagacgtgtcgaatctctcctctacaacaatgaccacagctcttgtcccacctttggaccaaacagcttcaacgactatcgtgatagtgcccacccacggtgaccttattagaaccacatccgaagctacggtcatttcagtccggaaaacatcgatggctgttccttcactgaccgaaacccccttccactcacttagactttctacaccagtgacggcgaaggccgagacaacactcttcagtacaagtgtagacacagtgacaccttcgacccatactctagtgtgtagtaaacctcctcccgataacattccgccggcttccagcacgcacgttatcagtacaacatccacccccgaggctacccagccgatcagccaagtcgaggagacaagtacctacgctctgtcattcccctatactttctctggtggtggagtcgtcgcatccctcgccaccggaaccacggaaacatctgtcgtcgacgagacaacacccagccacatatctgcaaacaagctcacaacatccgttaacagtcacatctccagctccgccacgtacagagtgcacacccccgtttccattcagctggtaacctctacaagcgtgctgagcagcgataaagaccagatgacaatttccctcgggaagacaccgcgcacaatggaagtgaccgaaatgagtccaagcaagaactcctttataagttactcccggggcacgccgagcctggagatgacagacacgggcttcccagaaactaccaaaattagttcccaccagacacacagtcctagcgagatccccctggggacaccaagcgatggcaatttggcatctagcccaactagtgggtccactcagattacccctactctcaccagcagcaacacagtgggcgtgcacatccctgaaatgagtacgtccctggggaaaaccgcactgcccagtcaagcattaactattaccaccttcctctgtcccgagaaggaatccacatcggcattgcctgcatacacaccccgaacagtcgaaatgatcgttaattccacctatgtaacccactccgtgagttacggccaggacactagttttgttgatacaaccacaagctcctctactagaatctccaaccctatggatatcaataccacctttagccacttgcattcccttaggacccagcccgaagtaacatcagtagcttctttcatcagcgagtctacccagacattcccggagagtctaagtctctcgacagccggcttatacaatgatggctttactgtgctctccgaccgcatcaccacagctttctcagtacctaatgtaccaaccatgctgccacgggagtcaagcatggccacatcaacaccaatctaccagatgagttcactgccagtgaatgtaaccgcatttacttcaaagaaagtatctgacacccccccgattgtgatcaccaagagttcgaagacaatgcatcccggatgtctcaagtccccatgtacagccactagcgggccaatgagtgagatgagcagcatccccgtgaacaactccgcttttacacctgctacagtaagttcagatactagcacaagggttggcctatttagcactctgctgagttccgttacaccaagaactacaatgaccatgcaaacaagcaccctagacgtcacccccgtcatttacgctggggccactagtaagaacaagatggtgtcttccgccttcactactgagatgatagaagcaccgagtagaataacaccaaccactttcctgtccccaaccgagcccactctgcctttcgtgaagaccgttcctactaccatcatggcgggaatagtgacgcctttcgtgggtacaactgcttttagccctttgagttctaaatcgaccggcgcgatatcatctattcccaaaactaccttcagtcctttccttagtgccacacagcaatcttcccaagccgatgaggccacgactctgggaatactgagcggaattaccaatagatcccttagcactgtgaattccggcaccggcgtggccctaacagatacctattctcgcattacagtgccggagaatatgctttcccctacacatgctgacagtctacatacatcttttaacattcaggtgagcccatccctaacctcctttaaaagcgcctccggccccaccaaaaacgtgaaaactactacaaactgtttcagctccaacacccggaagatgacctccctcttagaaaaaacctccctgaccaattacgccacatccctgaatacgcccgtctcttaccccccatggacgccctctagcgccaccttaccatccctgaccagttttgtgtacagcccccattcaacagaggccgagatttcaactccaaagacatccccccctccaaccagtcaaatggtagagtttccagtactagggacccgaatgaccagctccaatacccagcctctcctgatgaccagttggaatatacccacagccgaaggctcccaattcccgatttcaactacaatcaatgtgccaacaagtaacgaaatggaaacagagacactgcaccttgtgccaggccctttgtcaaccttcacagccagccagacaggcctcgtgtccaaggacgtaatggccatgagttccattccaatgtccggtattttgcccaatcatgggctgtcggaaaatccgtcactttccacgtctctccgtgccataactagcacgctagcagatgtgaagcatacattcgagaagatgactaccagcgtcacacctgggacaaccctccccagcattctgagtggagctacctcgggatcagtgatcagtaagagccctatcctcacctggctcctgtcaagtttgccgagtggctcgccaccagctacagtaagtaatgcaccacacgtgatgactagctccacagtggaagtgtccaagtccaccttccttacatctgacatgatatctgcccacccttttacaaaccttacaacacttcctagtgccaccatgagcacaattctgacccggacaattcctaccccaacactgggagggatcacaacaggcttcccaaccagcctgccgatgagtatcaacgtcaccgacgatatcgtttatatttccacacacccagaggcctcgtcccggacaactattactgctaacccgcggactgtgagccacccaagcagtttctctaggaagaccatgagtcctagtacgacagatcatacactgtctgtgggtgccatgccactccctagtagcactatcacctcttcctggaaccgcatcccgactgcttcatccccatctacacttatcatcccgaaaccgaccctggattcattgctgaacattatgaccacaactagcaccgttcccggcgccagttttcccctcatttccacaggggtcacctatccatttacagcaactgtttcaagccctatcagtagtttttttgagacaacctggctcgactctaccccctcatttctgagtactgaagcttcaacatcgccaaccgcaaccaagtctacggttagcttctataatgtggagatgtcatttagcgtgtttgttgaagaacctaggatacccatcacctctgtcatcaatgaattcacggagaattccctgaattcaatatttcagaatagcgaatttagcctggctaccctcgagacgcaaatcaagtcacgcgacattagcgaggaagaaatggttatggatcgggcaatccttgaacaaagagaagggcaggagatggcaactatctcatatgttccgtatagctgtgtgtgccaagtgatcatcaaggcatcatcatctctggcgtctagcgagctcatgcggaagattaaatcgaagattcatggaaactttacccatggaaacttcacccaggatcaactgactctcctcgtcaattgcgaacatgtggcagtgaaaaaactggaaccgggcaattgtaaagcggacgagacagccagcaaatataaaggcacctataaatggctcctcaccaaccctaccgaaactgctcaaacaaggtgcataaaaaacgaagatggaaacgccacgagattctgcagtatctcaatcaacaccggaaagagtcagtgggagaagcccaagtttaagcagtgcaaacttctccaggaacttcctgataagatcgtggacctcgctaatattaccattagtgacgagaatgccgaggatgtggccgagcacattttaaaccttattaacgagtcccctgcgctaggcaaagaagagacaaaaatcatcgtgtctaaaatctccgatatcagccagtgcgatgaaatatcaatgaatctgacccacgtgatgttgcagatcattaacgtggtcctggagaagcagaataactctgcttcagacctccatgaaatctccaacgaaatcctgaggataattgagcggaccgggcacaagatggagttcagtggccaaatcgctaatctcactgtagccggactcgcgcttgcagtccttaggggggaccacacatttgatggaatggctttctccatacatagctatgaggagggaacagatcctgaaatctttttgggcaatgtgcctgtgggaggaatactggcatccatctatcttcccaaatctttaacagaaagaatacccctgtcaaatttacaaaccattttgttcaactttttcggccagaccagtctgtttaaaaccaagaatgttacaaaagcactgaccacatacgtagtgtcagcctcaattagcgacgatatgtttatccaaaacctggccgatcctgttgtcattaccctacagcacatcggaggcaaccagaattacgggcaagttcactgtgcattctgggacttcgagaataataatgggctaggcggatggaactctagcggatgcaaagtcaaagaaaccaatgtaaactatacaatttgtcagtgcgaccatctgacacacttcggggtgctcatggacctgtcccgatccaccgtcgattctgtgaacgagcagatacttgccctcatcacttacaccggctgcgggatctcctctatatttctgggggtagccgtggtaacatacattgcatttcacaagctgcggaaggactatccagccaagatcctcattaatttgtgcaccgctctgctcatgctgaacctggttttcctgatcaactcttggctgagttcctttcagaaagtaggtgtgtgtatcacagctgctgttgcactccactactttctactggtgtcctttacgtggatgggactggaggctgttcatatgtatctagccctcgtcaaagtgtttaatatatacattcccaactatatccttaagttctgtttagtaggctggggaattcctgctatcatggtggcaatcacagtttcggttaagaaagatctttacgggaccctttcacccaccacccccttctgttggataaaggacgactctattttttacatctcggttgtggcatatttttgcctcatcttcttaatgaacctctcgatgttttgcacagtactggtgcaactcaactctgtgaaatcccagatccagaaaacacgaaggaaaatgattctgcatgacctgaaaggaacaatgagtctaacctttctattaggactcacgtggggtttcgcgttctttgcttggggccccatgagaaactttttcttgtacctgttcgctatatttaacacactacagggtttttttatctttgtttttcattgcgtaatgaaagaatcagtgcgcgagcagtggcaaattcacctgtgttgcggctggcttaggttggataactcttccgatgggtcttcccgctgtcagattaaagtggggtacaagcaggagggcctcaaaaaaatcttcgagcacaaactactgacaccctctctgaaaagcaccgcaacttcctccacattcaaatcgctcggttccgcccagggaaccccgtccgaaatcagcttccctaatgacgacttcgacaaggatccgtactgttctagcccatag

SEQ ID NO: 42423 - DNA, 8628 bp, Artificial Sequence
  Description of Artificial Sequence: Synthetic coding sequence
atgaaggagcacatcatctaccagaagctgtacggcctgatcctgatgagctcattcattttcctgagcgtcgtccctgaaaacatgacgattcaagaaaaatcaaccactgtttcacagcagatcgatatgaccaccccttcacagattaccggcgtgaagcctcagaataccgctcacagcagcaccctcctcagtcaatccattcccatttttgctacggattataccaccatttcctactcgaataccacatctcctccgttagaaacaatgacggctcagaaaatactcaaaacacttgtcgatgaaaccgcgaccttcgccgttgatgtattgtccacctctagcgccatctctctaccaacacagagcatcagcatagacaacactactaactctatgaagaagactaagtcaccatcctccgaatcaacaaagaccaccaagatggttgaggccatggctaccgaaatttttcagccccccaccccttccaacttcctgtctactagtagatttacaaagaactctgtggtttctactacatccgctatcaaatcgcagtccgctgttacaaagactactagcctgttctctacaatcgagagcacatctatgagcacaaccccttgcctgaagcaaaagtcaaccaataccggggctttacctatatcgactgctggccaggaatttattgagtcaactgctgctggtacagttccgtggtttacagtagaaaagacctcacccgcatctacacacgtaggaaccgctagctcatttcctcccgaaccggtgctcatatccacagctgcccctgtcgactcagtcttcccacggaaccagactgcctttcccctggctaccacagatatgaaaattgcctttacagtgcattcactcactttgcctacccggctcatcgagaccacccccgcacctcggacagctgaaaccgaactaacctcaacaaatttccaagacgtctccttacctagagtggaggacgccatgtcaacgagcatgtcaaaggaaacgagctcaaagacattttcttttctgacttctttctcctttactgggaccgagtctgtgcagacggtgatcgacgcagaggctacaaggaccgcgctgaccccagagattacgctagcttcaacagtggctgaaaccatgctgtcctcaaccataacagggcgtgtgtatacccaaaacactcccactgctgacgggcatctcctgaccctgatgtccacacgaagtgcgagtacctccaaagcgcctgagtcgggcccaacctccactaccgacgaggctgcacatctcttctcatccaatgaaaccatttggaccagccggcccgatcaggcactcctagcttccatgaacaccaccaccatcctcaccttcgtgcccaacgaaaactttaccagcgcctttcacgaaaacacgacctataccgaatacttgagcgcgactacgaatattacaccgctcaaggccagccccgaggggaagggtacaaccgccaacgacgcgacaacggcgcggtataccaccgccgtgagcaagttaacatccccatggttcgctaatttttcaatcgtttccggcacaacctctataaccaatatgcccgagttcaaactgaccactctattgctgaaaaccataccgatgtctaccaagcctgctaacgaactcccattaacaccgagggaaacagtggtgccgtccgtcgatatcattagcactttggcttgtatacagccaaacttctcaactgaggaatccgcctctgaaactactcaaaccgagatcaacggagctatcgtatttggcggcaccacaacgccggtgccgaagtcagcgaccactcaacgtctaaacgctaccgttacccgaaaggaagccacaagccattatctcatgcgcaaaagcactatcgccgcagttgctgaggtatcacctttctccactatgcttgaggtgacagatgagtctgcccagagggtgacagcctccgttacagtcagcagctttcccgatatcgaaaagctgtcaacccccctagataacaaaacagcaaccactgaagtccgcgaatcttggttgcttactaaactagtaaagacgacccctcgctcaagctacaacgaaatgaccgagatgttcaacttcaaccacacatacgtggcccattggacttcggaaacttccgagggcataagtgctggctctcccactagtggtagcacccatatcttcggagaaccactaggcgcctccaccacacgcatttctgagacttcattttctactaccccaaccgatcgtactgccacgtcgctgtccgatgggatcctcccgccccagcctactgcggcacactcgtctgcgacacctgtaccagtgacacacatgttcagcttgcctgtcaacggctcttcggtggtggctgaggaaaccgaggtgactatgagtgaaccgtcgactctggcacgagccttcagtacatcggtcttgagtgacgtctcaaatcttagttccactacgatgaccactgctctggtgccaccccttgaccagacagcatccactacaatcgtgatcgtcccgacacacggtgacttgattagaacgacatctgaggctacagtcattagcgtccggaagacgagcatggccgttccctcgctgaccgagactcccttccatagtctgcggctatctacccccgtgaccgctaaagccgagacaacactcttcagcacctctgtggataccgtgacaccatccacgcacactttggtgtgttcaaagcctcccccagacaatatccccccggccagcagcacgcatgtgatatccacaacctccacacccgaggccacacagccaatctctcaggttgaggagacctcaacctatgcccttagttttccatatacattcagcggagggggcgtggttgcctcactggccacggggacgacagagacgtctgtcgtggacgaaaccacaccttcccatatatcagccaataagcttactacatccgtcaattcacacataagctcatccgccacatatagagttcataccccagtctcaatacaactggtgacttccactagcgtgctctcttcagataaggatcaaatgaccatctcacttggcaagacaccacgaacaatggaggtgaccgagatgagcccaagcaagaatagtttcatctcttacagtcgtggaactccatcgctggagatgactgacaccgggtttccagagaccaccaaaatttcctcccaccagactcactccccctctgaaatccccttgggcacgcctagcgacggaaatttggcatcctcgcccacctctggttcaactcaaatcacccctaccctgacttcttcaaacactgtcggagtgcatattcccgaaatgtcaactagcctcggtaaaacggccctccctagccaggcactcacgattactaccttcctttgcccagagaaagagagcacatccgcccttccggcctataccccccggacagtcgagatgattgtcaattctacctatgtcacacacagcgtgagctatgggcaggatacttcttttgttgatacgacaaccagttccagtaccaggattagtaacccgatggatattaataccaccttcagtcacctgcacagcctgaggacccagccagaagtcactagtgtcgcgtccttcatttcagagagcactcaaacgttccctgagagcctctccctgtccaccgctggcctgtacaacgacggctttactgtcctgtcagaccgtattactaccgctttctctgtgcctaacgtgcccactatgctgccccgggaatcctcgatggctacatcaactcccatttaccagatgtcttcgcttccagtgaacgtcactgccttcaccagcaagaaagtgagtgacaccccgccaatcgtgattaccaaatcaagcaagacgatgcatcctggctgcttgaagtctccgtgcaccgctacaagtggtcccatgtctgaaatgagcagcattcccgtaaacaatagcgcttttaccccagccaccgtgtcaagcgacaccagcacccgcgtgggtttgttttccacactactgtcatctgttacccctaggacaactatgacaatgcagacctccactcttgatgtcacgcctgtgatttacgccggggcgactagcaaaaacaagatggttagctccgctttcaccactgaaatgatcgaagccccgtcgagaattacccctacaacctttctgagtcctaccgagcctaccctgccttttgttaaaacagttccaacaactattatggccggtatcgtgactccatttgtgggcacgacggcttttagccctttatcatcaaaatcaacaggcgccatctcttccattcccaaaaccaccttttcaccgtttctgtcagcgacgcagcaatccagccaggcagatgaagccacaacccttggcatccttagcggcataacaaaccgtagcctcagcacagttaacagcgggaccggtgtggcccttacagacacttatagccgcatcactgtgcccgagaatatgctctctccaacccatgccgactcactgcacacctccttcaatatccaggtcagtccctctctcacctcattcaaaagcgcaagcggccccaccaagaatgttaagaccaccacaaactgtttctcatctaacacacgcaagatgactagcctcctcgagaaaacatcacttaccaattatgctacttcattaaacaccccggtttcttaccccccttggactcccagtagcgcaaccctcccgtctctgacaagcttcgtgtacagcccccacagcacagaagctgagatctcaactcctaagacttcccccccgcctactagccagatggtggagttcccagtgctggggacccgcatgacttcttctaatacacagcctcttctaatgacttcatggaatataccaactgccgaggggagtcagtttcccatttcaacaactatcaacgtccctacatcaaatgaaatggaaactgagacgctccacctcgttcctggcccactttcaacctttacagcgagccagaccggactggtgagcaaagatgtgatggcaatgtcatccattcctatgagtgggatccttcccaaccatgggctgagtgagaaccccagtcttagtaccagtctgcgcgccatcacaagtacgcttgccgacgtgaagcatacatttgaaaagatgaccacttccgttacccccggcacaacccttccaagtattctctccggtgccacaagcggctcagtcattagcaagtctcccattctgacctggctactgtcctctctaccgtccggaagcccccctgccaccgtgagtaacgcacctcacgttatgacttccagcaccgtggaggtttccaaatcaacttttctcactagcgacatgatttccgctcatccttttactaacttgacaacactcccatccgctacgatgtcaaccatcctgacaagaactatacccaccccaactctggggggtatcaccaccggttttccaacgagtctgcctatgtcaataaatgtgaccgacgatatagtgtacatcagtacccaccccgaggctagcagtcgcacaaccatcactgctaacccacgtacagtgtcccatcctagctccttctcccgcaaaacgatgagcccctctacaaccgatcacaccctgagcgtgggcgctatgcccctaccgtccagcacaataacgagctcttggaataggattccaaccgcctccagccccagcactttgatcatccctaaaccgacgcttgattctctgctcaacatcatgaccactacaagtacggtgccaggggcaagtttcccacttatttctacgggcgtgacgtatccattcacggccacagtctccagcccaatcagtagttttttcgagacaacatggctggatagtacaccctcttttctgtccacagaggcatccacttccccgaccgccaccaagtcaaccgtgagcttctataacgtggagatgtccttcagcgtgttcgtggaagaaccccggatccccataactagtgtgatcaacgagttcacagagaattccctaaattctatctttcagaatagtgagtttagcctcgcaactctggaaacacagatcaaatctcgcgatatatcggaggaagaaatggttatggaccgggcaatcctggagcaacgagaggggcaagagatggcaaccatttcctatgtgccatactcatgtgtgtgtcaggtgattataaaggcaagttccagtctggcctcgtcagaactgatgcgcaaaattaaaagcaagatccacgggaatttcacccacgggaatttcacacaggatcagctgacccttctggtgaattgtgaacacgtggccgtgaaaaaacttgaaccgggcaactgcaaggctgacgagaccgcctctaagtacaaaggaacttacaaatggctgctgacgaaccccactgagaccgcccagaccaggtgcataaaaaacgaggatggcaacgcaactaggttctgctctatctcaataaacaccgggaagagccagtgggagaagccaaaattcaagcagtgtaagctgctgcaggagctgccagacaagattgtcgacctggccaatattacaattagcgacgagaacgcagaggacgtagccgagcacatcctaaacctcataaacgagagtcctgccctcggcaaggaggagaccaagatcatcgtgtctaaaatctccgatatttcccagtgtgacgaaatctccatgaatctgacccatgtgatgctgcaaattatcaatgttgtactggagaagcagaacaattcagcttcagatctgcacgaaatcagcaacgagattcttcgaatcatagagcgcacaggacacaagatggagttctctggacagatcgccaaccttacagttgctggtctagcactcgcagttctaaggggcgaccatactttcgacggcatggccttctctatccactcctacgaagaagggaccgaccccgagatattcttaggaaacgtgcctgttggcgggatcttagcctccatttacctgcccaaatcgctcaccgagcggatacccctttccaatctacagactatactgttcaactttttcggacagacgtcgctgtttaagacaaagaatgtcaccaaggccctgacaacctatgttgtcagcgcatccattagcgacgacatgttcatacagaatttggcagatcctgtcgttatcacacttcagcacatcgggggcaatcaaaactatggccaggtacattgcgcattttgggacttcgaaaacaataacgggctcgggggctggaactcctccggatgtaaggttaaagagaccaacgtgaattacaccatatgtcagtgtgaccatttgacccactttggggtccttatggacctcagccggtccacggttgatagcgttaatgagcagatcctcgctctgattacctatacagggtgcggcatttcgagcattttcctgggggtcgctgtggttacatatatcgcctttcataagctcagaaaggattaccccgcaaaaatactgatcaatctctgtacagccttgctcatgcttaacctcgtgttcctgattaactcgtggctgagttccttccagaaggtaggcgtgtgtatcactgctgctgtggctctccactattttctcctagtgtctttcacctggatggggttggaggcagtacatatgtatctggctttggtgaaagtgttcaacatttatatccctaactacattttgaagttctgtttggtcggatggggcatcccggccattatggtggcgatcaccgtgagcgtaaaaaaagacttatacggcacactctctcctaccacaccattttgctggatcaaagatgactcaatcttttatatcagtgtcgtggcctatttttgcctaattttcttaatgaaccttagcatgttttgcacagtgctggtgcagctgaactccgtgaaaagccaaatccagaagactcggaggaagatgatcctgcacgatcttaagggtaccatgtccctcaccttcctgctgggactgacatggggcttcgcttttttcgcctggggcccaatgcggaatttctttctgtacctttttgctatcttcaatactttacaaggctttttcatctttgtctttcactgtgttatgaaagagtctgtacgcgagcaatggcagattcacctctgttgcggttggctgaggctggataacagtagcgacggtagcagtcgatgtcaaattaaagtcggatataagcaggaaggactgaaaaagatttttgaacacaagctgttaaccccatctttgaaaagcaccgccacaagttccactttcaagtcactggggtctgcacagggaaccccctcagagatctcttttcccaacgacgacttcgataaagatccttactgttcctccccctag

SEQ ID NO: 42424 - DNA, 3240 bp, Artificial Sequence
  Description of Artificial Sequence: Synthetic coding sequence
atggtgtgcagcgccgcccccctgctgctgctggccaccaccctgccactcctggggagcccagtagctcaggcatctcagcccgtatcagagactggtgtgcggccccgggagggtctccagaggagacagtggggcccactgatcggtagagacaaagcctggaacgaacggatagacagaccctttccagcatgtcctatccccctgagttccagtttcggtcgctggcctaaggggcagaccatgtgggctcaaactagcaccctgacacttactgaggaggaactcggccagtcacaggcagggggagaatctgggtcgggtcagttgctggatcaggaaaatggggccggcgagagcgcgctggttagcgtgtatgtacatcttgacttccccgacaagacctggccgcccgaactgtcacgcacactcactttgcctgccgcctcggcgtcctcaagcccccgccccctgttgactgggctcaggttaacaacagaatgtaacgtgaatcataaggggaacttttactgcgcctgtctatccggttaccagtggaacaccagtatctgcctccattacccaccttgccagagcctacataatcaccagccttgcgggtgcctcgtttttagtcaccccgagccaggttattgccagctgctcccccccggtagccctgttacctgcctgccagctgttcccggtatactgaatcttaacagccagttacagatgcccggtgacacattgtctctgactctgcacctgagtcaggaagccacaaatctcagttggtttttgaggcatccaggatctcccagcccgatcctgctccagcccggcacccaggtcagcgtaacctcaagtcatggccaggcggccctttctgtgtctaacatgtcacaccactgggctggggagtatatgagctgttttgaggcccaggggttcaagtggaatctatacgaggtggtgagagtccctttgaaagcaaccgacgtggccagattgccatatcagctttctataagctgtgccacctctcctggcttccagctgtcctgttgcattccatcaacgaaccttgcatacactgcagcatggagcccaggcgagggctcaaaagctagtagctttaatgaatccgggtcccagtgctttgttctggcggttcagcggtgtccaatggctgataccacctacgcatgtgatctccagtctctgggcctggcacccctcagggtgcccatatctattactatcattcaagatggagacatcacgtgccctgaggatgcctctgtgttgacatggaacgttactaaagccggccatgtagcgcaggctccctgccctgaatctaagagaggcattgtgcggagattatgtggcgccgacggagtgtggggccctgtccactcttcttgtacagacgctaggctcctggccctgttcacccgcaccaagctcctgcaggccggacaggggagcccagcggaggaagttccacaaattctggcccagcttcccggacaggcggccgaagcttcaagccccagcgaccttctcacattgttgtccaccatgaagtacgtggcgaaggtcgtggctgaggctcgcatccagctagatcgaagagcgctaaaaaatctactcatagccactgacaaggtcctcgatatggacacgaggtctttgtggacattagcacaggctaggaaaccatgggccgggtctacattactcctggcagtggagacgctggcatgctctctgtgtccgcaggatcacccctttgccttttccctgcctaacgtcttgttgcagagtcagctgtttggccctaccttccctgcagattacagcatttccttccctacccggccaccactccaggcgcaaattcctagacattccttggcacctctcgtccgcaatgggactgaaatctctatcacgtcgctggttctcaggaagcttgatcatctgctcccttccaattacggccaaggtctgggtgattcactgtatgccacaccaggtctcgtgctggtgatttccatcatggctggcgatagagccttttctcagggggaggtcattatggacttcggaaatacagacgggtccccccattgcgtcttttgggatcactccttgttccagggtcgaggcggctggtcgaaggaaggatgtcaggctcaggtggcttcggcttcccctaccgcacagtgtctctgccaacatctgacagccttctccgtgcttatgtctcctcacaccgttccggaagaacctgccctggctttgctcacccaggtaggtctgggggcttccatactcgctctgctggtgtgtctcggtgtgtattggcttgtgtggagagtcgtcgtgaggaataaaatctcttactttagacatgctgccttgcttaatatggtgttttgtctcctggccgccgatacatgcttcctgggggcccctttcctctcaccaggacctcgctcacccctctgtcttgccgcagcctttctgtgccactttctgtatttagcaacatttttctggatgctggcccaggcactcgttctggcccatcagttgctgttcgtattccatcagttggccaagcaccgggtgttacctttaatggtgttgcttggttatctgtgccccttaggccttgccggggttaccctcgggctatatcttccgcagggccaatacttgagggaaggtgagtgctggcttgatggaaaaggtggcgccctgtacacctttgtgggtcctgtacttgcgatcatcggcgtcaatggcctcgtgctcgcaatggctatgctcaagctgctgaggcccagtttgagcgagggcccgcctgctgagaaaagacaggccctcctaggagtgataaaggccttgctgatcctgactcccatattcggccttacctggggacttgggttggccaccctcttggaggaagtcagtacagtgccacactacatcttcaccatcctcaatacacttcagggagttttcatcttgctctttggttgtttgatggatagaaagattcaggaagctttaaggaaacggttctgccgcgcgcaagcaccgtcatcgaccatcagtctggtaagctgttgcctccaaattctctcctgcgccagcaagtcaatgtctgagggcattccctggccttcatctgaggatatggggacagccaggtcgtag

SEQ ID NO: 42425 - DNA, 2622 bp, Artificial Sequence
  Description of Artificial Sequence: Synthetic coding sequence
atgaccacccggaagctgagcgcccacagcgccgccacccccggctataaggctgtgacacacaagcaccacaccggctgggctagaatggctaagacaggcctccccgaaaaggggcagagccaggcgggcggggaatcgggttctgggcagttgcttgaccaggagaatggcgctggagaatcagcactggtgtctgtctacgtccacttagattttcctgacaaaacctggcctcccgaattgtcaagaactctgacactgccggcggccagcgccagcagtagtcccaggcctctgctgaccggcttaaggcttactaccggagagtacatgtcctgcttcgaggcacagggattcaaatggaatctatacgaggtcgtgcgtgtcccactgaaggcaaccgatgtggcgcggctgccgtaccagttaagcattagttgcgcaacatcccccggtttccagctctcttgttgcattccttcaaccaacctcgcttacactgctgcctggagtccaggggaggggtcgaaagcttcgtccttcaacgaaagcggatcccaatgtttcgtgctggccgtccaacgctgcccaatggcagataccacatacgcgtgcgatctacagtccctgggtttggccccactgagggtgcccatcagcataaccataattcaagacggagacattacatgccctgaggatgcgtcggtgctgacctggaacgtaactaaggcgggacacgtcgcgcaggctccgtgccctgaaagcaagcggggcattgtgagacgattatgcggagcagacggcgtttggggtccagtccatagcagctgcactgatgccaggctgctcgctcttttcacaaggaccaagctgctgcaggctggccagggctctcccgctgaagaagtgcctcagattctggcccagttacctgggcaggctgcagaggcctcatccccctctgacctgctgaccctgctgagtacgatgaagtatgtggccaaggtggttgcagaggcccgcattcagctggatagaagggcgctgaagaacctgttaatagctaccgacaaagtcctggacatggacactcgaagtctgtggactctcgctcaggccaggaagccttgggcgggctcaactcttcttctggctgtggaaactctggcctgttctttgtgcccacaggaccacccattcgcctttagtttgcctaacgttctccttcagagccagttatttggtcctactttccctgctgattacagtattagttttcccacacggcccccattgcaagcacagatcccacgccacagtctggctcccctcgttagaaatgggactgaaataagcattacatcattggtgctgagaaaactcgatcatctgttgccctctaattatggccaggggttaggggatagcctttatgccacacctggcctggtgctagtgatttccatcatggctggagatcgcgcattttctcagggggaggtgattatggactttggtaataccgacggttccccacattgcgttttctgggatcatagtctgtttcagggcagaggaggctggtcaaaggaggggtgtcaggcccaggtggcgtcagcgagtccgactgcgcagtgtctgtgccagcacctgaccgcgttttctgttctcatgtcgccacacaccgttcccgaggaacctgcacttgcacttctcacccaagtgggtctaggcgcctcgattcttgccctgctagtgtgccttggcgtctactggcttgtttggcgcgttgttgtaagaaataaaataagttattttagacatgcagcactgttaaatatggttttctgccttctagcagctgacacctgctttctgggagcaccctttctgagcccagggccacggtctcctctgtgcctggctgccgcttttctttgccactttctctatctggcgaccttcttctggatgctcgcccaggccctggtccttgcccatcagcttctatttgtcttccaccagctagccaagcaccgtgtcctgcccctgatggtgctgctgggttacctgtgtcccctgggattagccggggttacgctgggactatatctacctcagggacaatacttgagagagggggagtgctggctggatggtaaaggaggggcactatacacatttgtgggtcctgtactcgctatcattggggtcaatggtctagttctcgcaatggccatgctcaagctgctgaggccttccctgagcgagggacctccagctgagaagcgacaggcactcctgggagtcatcaaagcccttctaatactgacccctatattcgggctgacctggggcctggggcttgcaaccctgctggaagaggtgtctactgtcccgcattatatattcactatcctgaacacccttcagggagtatttatccttctttttggatgtctcatggaccggaaaatccaagaagctttgagaaaacggttttgcagagcccaggccccatcctccacgatcagcctcgccaccaacgaagggtgcattctggagcacagcaaaggaggaagtgacactgccaggaagacagacgcctcagagtag

SEQ ID NO: 42426 - DNA, 2028 bp, Artificial Sequence
  Description of Artificial Sequence: Synthetic coding sequence
atggccgacaccacctacgcctgcgacctgcagagcctgggcctggcgcccctcagagttcctatcagcatcacgattattcaagatggtgatatcacgtgtccagaggacgcgtcagtgctcacatggaacgtcaccaaggccggccacgtggcacaggccccatgccctgaatctaaaagaggcatcgttcggcgcctgtgtggggcagacggcgtgtggggaccagtccattctagctgtaccgacgctagattgctcgcgctctttacccgtacaaaattgctgcaggctggtcagggtagccccgctgaggaggtgccccagattctggcccagctgcccgggcaggccgctgaggcgtcctctccctctgaccttctaaccctgctgagcactatgaagtacgttgctaaagtggtggctgaggcaagaatccaactcgataggagagccctgaagaatttgctgattgccactgataaagtgctggacatggacaccaggtctctctggacattagcccaggcgcggaagccctgggctgggtctactttgctcctggccgtggagacgctggcatgttcgctgtgtccacaggatcatcccttcgcattctcccttcctaacgtgcttctgcaatcccaactttttgggcctacatttcccgctgactactcaattagctttcccacacggcccccccttcaggctcagataccccgccactcattggctccactggtgagaaacggaaccgaaattagcatcacctcccttgttttacgaaagctggatcatctactgcccagcaattatgggcagggcctgggggactcactctacgcaacacctggacttgtattagttatttcaatcatggcaggagatcgcgcctttagtcaaggcgaagtaatcatggatttcgggaacacggacggatccccccactgtgtattctgggaccactcactctttcaaggcagaggaggatggtccaaagagggttgccaggcgcaggtggctagcgcttcccccaccgcccaatgcctgtgccagcacctcacagcattttcagtgctcatgtctccacacaccgtccccgaggagcccgccctggccctcctgacacaggtgggcctgggcgcctctatcctcgccttgcttgtgtgcctgggggtatattggctggtctggcgcgtagtggtccggaacaaaatcagctacttcaggcacgctgctctcctgaacatggttttctgtttgctggcggctgatacttgcttcttaggcgctccctttctcagccccgggcccagaagtccgctgtgtttggccgctgcttttctatgccatttcctctacttagccacatttttttggatgttagcacaggcactggtcctcgctcaccaactgttgtttgtgttccaccagctggccaaacacagagtgctccctcttatggttctcttgggctatctttgccccctgggtctcgcgggcgttaccctgggtctttatctgccccaaggccaatatttacgggagggggagtgttggctggatggaaagggcggggctctgtatacgttcgttggcccggttctggccatcatcggggtgaatggcctagtgcttgcaatggcaatgctgaaattactccgcccttcacttagcgaaggacctcccgccgagaaaaggcaggcgctcctgggggtgatcaaggctctgctaatcttaacgcctatttttggcctgacttgggggctgggccttgctaccctactggaggaggtatctacggtgccccactatatttttaccatactgaacactttacaaggcgtgttcattctcctcttcggttgcttaatggaccgtaaaatccaggaggccctgcgtaaaaggttctgcagagctcaggctccctcctctacaattagcctggcaacaaacgagggctgtatccttgagcactcaaagggcggttccgataccgccaggaagactgacgcttctgagtag

SEQ ID NO: 42427 - DNA, 2994 bp, Artificial Sequence
  Description of Artificial Sequence: Synthetic coding sequence
atggtgtgcagcgccgcccccctgctgctgctggccaccaccctgcctctgctggggagccccgtggcacaagcatcccagcctgggcaatctcaggctggtggagagtctggatcgggccaacttcttgatcaggagaacggcgctggtgagagtgccttagttagtgtgtatgtgcatctggattttcccgacaagacctggcccccagaactttcaagaacccttacgttgcctgctgcctcggccagctctagccctagaccgctactcactggactccgcctaactacagagtgcaatgtgaatcacaaaggcaatttctactgcgcctgcctcagcgggtaccagtggaacacgagcatttgtctgcattatcccccatgccagagcctccacaaccatcagccttgtgggtgcttagtcttctcccacccagaacctgggtactgccagcttttgcctccgggctcccctgttacttgcctgcctgccgtgccgggcattctcaatctcaactcccagctccagatgcccggggacactctcagcctgactttgcatctgtcgcaagaggccactaacctgagttggttccttagacatccaggctcacctagcccaatcttgttgcagcccggtacccaggtgtcagtgacctcgagccacggacaggccgcgttatccgtatcgaatatgagtcatcactgggcaggggagtatatgagctgctttgaggctcagggatttaagtggaatttgtatgaagtcgtgcgggtaccattaaaagcaactgatgtggccaggctcccgtatcagctttcaatatcttgcgccacgtccccaggttttcagctaagttgttgtatccccagtaccaacctggcctatacagcggcctggtcaccaggcgaagggtcaaaggcatcctcctttaatgagtccgggagccaatgcttcgtcctggccgtccagcgatgtccgatggctgacacaacatacgcatgtgatctgcagagcctcgggctcgcgcccctccgggtgcccatttcaataacgataatccaggacggggatattacctgccctgaggatgcatcagtcctcacttggaatgtgactaaggcaggccacgtggctcaagctccgtgtccagaaagcaaacgcggtatcgttaggagactctgcggggcggatggggtttggggccccgttcatagctcatgcactgacgcaagattgctggccctgttcactaggaccaagctgctccaagccggacagggttccccagcagaggaagtcccacagatcttggcccagctgcctggccaggctgctgaagcctcttcgccttccgatctgctcacgcttttgagcacaatgaagtatgtggcaaaggtggttgccgaggcccgaattcagctcgataggagagccctcaaaaatctcctgattgctactgataaggttctggacatggatacacgaagcctatggactctggcccaggctcgtaagccatgggccgggtcaaccctgttgctggccgttgaaactcttgcctgcagcctttgtccccaggatcacccatttgccttcagcctcccaaacgtgttactgcagagccagcttttcggacccacttttcctgccgattactccatttcctttcccacccgcccacccctgcaggcccagatcccccgacacagtctagctccgctggtcagaaacgggacagaaatttctattacgagcctggtgctgcggaagctcgatcacctgctgcctagcaactatggtcaggggctaggggacagtctgtacgccacccctggcctagtccttgtcatctctatcatggccggagatcgcgcattcagccaaggcgaagtgatcatggactttgggaacactgacggcagcccacattgcgtgttctgggaccactccctgtttcaagggcggggcggctggtcaaaggagggatgccaggctcaagtggccagtgcatccccaacagcacagtgcctatgtcaacatttgactgctttcagtgtgctgatgagcccacacacggtgccagaggagcccgctttggccctattgactcaagtgggactcggtgcatctatcctagcgctgttggtctgtctcggcgtgtactggctagtctggagggtcgtggtccggaataagatctcatacttccggcatgccgccttgctgaacatggtgttctgcttgctcgcagctgacacctgctttcttggagctccttttctgtcacctggccctcgttcacctctgtgcctcgcagcagcttttctctgtcactttctctatctggcaacattcttctggatgttggcacaggccctggtgctagcccatcagctgctgttcgtgttccatcagctcgctaagcaccgtgtgctccccttaatggtactcctagggtacctttgcccattggggctcgccggggttaccctgggcttgtacctcccccagggtcagtatctcagggagggtgaatgttggcttgacggcaaaggtggtgccttatataccttcgttgggcccgttctcgcaatcatcggcgtgaatggattagtcctagccatggccatgctgaagttgctgaggcccagcttatcagagggccctcctgcagagaagagacaggccctgctgggtgtgattaaggcgctgttaatattaactccaatttttggcctaacttgggggttggggctcgccacactgcttgaggaagtatcaactgtcccccactatattttcaccatcctaaacaccctgcagggcgtttttatactgttattcgggtgtctaatggatcggaaaattcaggaggccctgcgaaaacgtttttgcagagcacaggcacccagttccactatttccctcgctaccaacgagggatgtatcttggaacattcaaaagggggatctgacacggcacggtag

SEQ ID NO: 42428 - DNA, 1587 bp, Artificial Sequence
  Description of Artificial Sequence: Synthetic coding sequence
atggaccactgcggcgccctgttcctgtgcctgtgcctgctgaccctgcagaatgctacaacagaaacgtgggaggaactgctttcatatatggagaatatgcaggtcagccgcgggagaagctccgtatttagtagccgacagctgcaccagctggaacagatgctcttgaacactagttttcctggatataatttgactctgcagacacccactatccagtctctagcttttaagcttagttgtgacttctcagggctgtcgctgacctctgcaacacttaagagggtgccacaagcaggtggccagcatgctaggggccagcatgccatgcagtttcccgccgagctgacacgcgatgcttgcaagacgcggcctcgcgagttacgcttaatctgtatctacttttctaatacacatttcttcaaagacgagaacaacagcagtttgttgaacaattacgtattgggggcccagctctcccatggccacgtgaacaatctccgggaccctgtgaacatttccttctggcacaatcaatcactcgaaggatacacactcacatgcgtcttttggaaagagggggccagaaaacagccatggggggggtggagcccggagggttgccgcacagaacagcctagccactctcaggtgctctgtcggtgtaaccacctcacttatttcgctgttctgatgcagctgagtcctgcccttgtgcctgcagagttgttggccccgctgacatacatatctctggtgggatgcagcatctctattgtcgcctcgctaatcacagtcttgcttcattttcacttcagaaagcagtcggacagtttaacccgcatacatatgaatctccatgcctctgtcttgcttctgaacatcgcattcctgctctctccagcattcgcgatgtctcccgtccccggttcagcttgcaccgctctggctgctgctcttcattatgcgctgctgtcctgcctgacttggatggcgattgaggggttcaatctctacctgctactaggacgggtctataacatctacatccggagatacgtatttaagctaggggtgctaggttggggcgcacccgccctgctggtgctgttgtccctgtccgtgaagagttcggtgtacggtccctgtacaattccagtgttcgattcctgggagaatggaactggcttccaaaacatgagcatctgttgggtcagaagcccggtagtccattccgttctggttatgggctacggggggcttacctctctttttaatctggtcgtgctggcatgggcactgtggactttgcgccgcctgcgcgagagggctgatgccccctctgttagggcctgccacgacactgtgaccgtgctcggcctgactgtgctgctcggaaccacctgggcccttgccttcttctcttttggcgtcttcctactgcctcagctatttttgtttaccatcctgaattcactctatggattctttctctttttatggttctgtagtcaacgatgcaggagcgaggctgaggccaaagcgcaaatcgaggcgtttagctcctctcagaccacccagtag

SEQ ID NO: 42429 - DNA, 1713 bp, Artificial Sequence
  Description of Artificial Sequence: Synthetic coding sequence
atggaccactgcggcgccctgttcctgtgcctgtgcctgctgacccttcagaatgcgaccaccgaaacttgggaagagctgctgtcctatatggaaaacatgcaggtatccagggggagatcctctgttttttcatctcgtcagctgcaccaactggagcaaatgctgctgaatactagtttccctgggtacaatctaaccctacagacaccgaccatacagtctctcgcttttaaattgagttgtgatttcagtggactcagtttgacaagcgcaactcttaagagggtgccccaggccgggggacagcacgcaagagggcagcatgctatgcagtttccagcggagctcactcgcgacgcgtgcaagactcgacccagggagctgcgcttaatctgcatctacttttcgaacacacacttctttaaggatgaaaacaacagctccctgctgaataactatgtgcttggagcacagctgtcccatggccacgtaaacaatcttcgagatcccgtgaacatttcattctggcataaccagtccctcgaggggtatactctgacatgtgtcttctggaaagagggtgctagaaagcagccttggggtggttggagtcctgaagggtgtcgcaccgagcagccttcacattcgcaggtcctgtgtcggtgcaaccacctgacctactttgccgtgctaatgcaattgagtccagctttagtcccagccgagttgcttgctccactgacttacatttccctcgtcggatgctcaatcagcattgtggcatccctcattaccgttctgctccacttccactttcgcaaacaatctgatagtctgactaggatccatatgaatttgcatgcttctgtactgttattgaacatcgcgttcctgctaagccctgcctttgctatgagcccggtgccaggctccgcttgcaccgctttggcagccgctttgcactatgcacttttgtcttgcctaacgtggatggccattgaggggttcaatctatatttacttctgggccgggtgtataacatctatataagacggtatgtgtttaagttaggcgtcctcggctggggggcccctgccctcctcgtcctgctgtccttatctgtaaagtcatccgtgtatggcccgtgtacaatcccggtgtttgattcctgggaaaacggcaccggattccagaatatgtctatctgttgggttagaagcccagtggtccattcagtgctagtgatggggtacgggggcctgaccagccttttcaacctagtggtcttagcctgggcgctttggaccctgcggagactgagggagagagctgatgcccctagcgtcagagcttgtcacgatactgtgacggtgttaggtctgaccgtgttgctcgggacaacctgggcactggctttcttctcctttggcgtgttcctgctaccccagttgtttctctttaccatcctgaactcattgtatggcaagggagggggcacggtttctaaaaaatcggatgacaccacagttttccttaagaatgatgagaccgcttggggcaagctgctttgtctcccttactcaggcttttttttcagcaagcccatttcttctcttgccatgattcggggaaatacacccgctcctgtgggtggagacgatatcccggctatctacgaagtggaacacttccagcaggagcaggtgtag

SEQ ID NO: 42430 - DNA, 1356 bp, Artificial Sequence
  Description of Artificial Sequence: Synthetic coding sequence
atggaccactgcggcgccctgttcctgtgcctgtgcctgctgaccctgcaaaacgccaccaccgagacatgggaagagcttctatcttacatggagaacatgcaggtgagcagggggagatcttccgttttttctagtcggcagctgcatcagctggagcagatgctcctgaacacaagctttccaggctataatctaacactgcagacgccaactatccagtccctggccttcaagctgagttgtgatttctccggcctatcgttgacatcagccactttgaagcgtgtgcctcaggccggaggccaacatgcccgaggtcagcatgccatgcagtttcctgccgaactgaccagagatgcatgtaaaaccagaccgcgggaacttagactgatttgcatctatttcagtaatacacactttttcaaggacgagaataactctagtctgctgaacaactatgtcctcggggcgcaactgagccacggacacgtcaacaatctgagagaccctgtgaatatcagcttctggcacaatcaatccctggaggggtacacactgacctgcgtgttttggaaggagggcgcaagaaaacagccgtgggggggatggtctccagaagggtgccgcacagaacagccaagccactcacaggtcttatgccgttgtaaccacctgacctattttgccgtcctcatgcaactgagtcccgctctggttccagcagaactgctggcccccttaacatacatcagcttggtgggatgtagtatctcaattgtggcctctttaattacagtgctacttcatttccatttccgcaaacagagcgacagcctgacccgcattcacatgaacttgcacgccagcgttctgcttttgaatatagcctttttactatcccctgctttcgcaatgtcgccggtcccaggtagtgcttgcaccgcattagcagccgccttgcattacgccttgttgtcatgcctcacttggatggccattgaggggttcaatctttatctgttgctcggacgcgtgtataatatctatattcgaagatatgtgtttaaactgggggtgttgggctgggacgccggatgcggagcaccatggtgcaccgtttcctggtcatgggcaacagcagctagccgcccttcgagcacttggtggtgttggcctggcaggtgcggcccctgcgctggctgtggttctggacgcatgcaccaggtaagcggccccgcaatgacactgagcctctgttgggcgtccccttgttgctgggaacctccgggaccctggcctagcttcctgctggcttcctcgtgctgcccttcatgtagctcttcacccagttag

SEQ ID NO: 42431 - DNA, 4041 bp, Artificial Sequence
  Description of Artificial Sequence: Synthetic coding sequence
atgaagagcccccggcggaccaccctgtgcctgatgttcatcgtgatatactcatcaaaagccgctctgaactggaactacgagtcaactatccatccactgtcgcttcatgagcatgagcccgcaggcgaagaagcgctacgccagaaaagagccgtggccaccaaatccccaactgctgaagagtatacggttaacattgagatatccttcgagaacgcttcttttctggaccctatcaaggcctacctgaacagtttatcattccccatccacggcaacaacacagaccagataaccgatatactgtccatcaacgttaccaccgtgtgccggcctgcaggtaacgaaatctggtgctcgtgcgagactgggtatggttggccaagggaaagatgcctgcacaatcttatatgccaggaacgggatgtcttcctgcccggccatcactgtagttgtcttaaagaattgcctcccaacggaccattttgtctcctgcaggaggatgttacgctaaacatgagagtcaggctgaatgttgggtttcaggaggacctgatgaatactagttccgccctgtaccgaagttacaagactgatctagagaccgcgtttagaaagggctacggcatcctaccaggatttaaaggagtcactgttaccggatttaaaagcggttctgtggtggtgacgtatgaagtaaaaaccaccccaccttctctcgagctgattcataaggctaacgagcaagtggtgcagagcctaaaccagacctataaaatggattacaattcattccaggcagtgactatcaacgagtcgaatttctttgtcactcccgagatcatcttcgaaggcgataccgtatccttagtgtgtgaaaaagaggtcctgtcctccaatgtgtcctggagatatgaggaacagcagttagagattcaaaatagctctcgtttttctatttatacagccctctttaataacatgacctctgtgtccaagctaactattcacaatattacgcccggagacgcaggcgagtatgtttgtaagcttatactcgatatctttgaatatgaatgcaagaaaaagattgatgtgatgccgattcaaatactcgcaaacgaggaaatgaaagtaatgtgcgacaacaaccctgtttcattaaattgttgtagccaggggaatgttaattggtccaaggtagagtggaagcaggaaggcaagattaatattccgggcacccccgagactgatatcgactccagctgtagtcgatacacactgaaggcggatggcacccagtgcccctccgggtccagtggaacaaccgtaatctatacatgtgaattcatctctgcttatggcgccagggggtcagcgaatattaaggtcacgtttatctcagtggccaacctgactatcacccctgacccaatatctgttagcgaagggcaaaacttcagtatcaaatgcattagtgatgtgtcgaattatgacgaggtctattggaacaccagtgctggcatcaaaatttaccagcgcttctatacaacacgtaggtatctcgacggtgcagaaagcgtcctcactgttaagacaagcacaagagagtggaacgggacttatcactgtatctttcgctataagaactcttactccatcgccaccaaagacgtgatcgtgcatcccctgcctctgaaactgaatatcatggtggacccactggaagcaactgtttcttgttccggctcccatcatataaagtgctgcatcgaggaagacggtgattataaggtgacattccacaccgggtcttcatctctgccagcagcaaaggaagtcaacaaaaagcaagtatgttacaaacacaatttcaacgccagtagcgtgagttggtgctcaaaaacagttgacgtgtgctgccactttacaaacgctgctaacaattctgtctggtcaccctcaatgaaactcaatctggtgccaggcgagaacattacttgtcaggatcccgtgattggcgtgggggaacctggcaaggtgattcagaagctttgccggttttcgaacgttcctagtagccctgaatcacctattggaggtaccatcacttacaagtgcgtcggctctcagtgggaagagaaacggaatgactgtattagcgcccctatcaacagcctgctccagatggccaaggccctgatcaagtccccttctcaggatgagatgctgccaacatatctaaaagatctgagcatcagcatcgataaggccgagcatgagatcagctcatctcctgggtccctgggcgccatcattaatattctggacttgttaagtacagtgcccacacaggtcaatagcgagatgatgacccatgtgctgagtaccgttaatgtcatattgggcaagccagtcctaaacacttggaaggtcctccagcaacagtggactaaccaatcctcacagctgttgcatagcgtggaaagattttcacaggctctccagtcgggggactctccaccactaagtttcagtcaaactaatgtgcagatgagttccatggtgattaagtccagtcaccctgagacctatcaacagaggttcgtgtttccgtatttcgacctctggggcaatgtcgttatcgataaatcctatctggagaatctgcagagcgatagcagcatcgtgactatggcctttcccactttgcaggcgattcttgctcaagacatccaagaaaataactttgccgagtccctggtgatgaccactaccgtttcacacaacacgactatgccattcaggatttccatgaccttcaagaacaactctccttctggtggagagaccaagtgcgtgttctggaatttccgactggctaacaatacaggcgggtgggactccagtggatgttatgttgaggaaggcgacggtgacaacgtaacgtgcatttgcgatcacttgaccagtttcagcatcctcatgtcaccagattcccctgatccgtcaagcctgcttggaatcctgctggacatcatcagctacgttggggtcggcttctctattctgtccttggcagcctgcctcgtcgtcgaggccgtggtgtggaagtccgtgactaagaataggacttcctacatgaggcacacatgcatcgttaatattgccgcctcactgctggtagccaatacatggtttatcgtcgtggccgctatccaggataatcgatacattctctgtaaaacagcttgcgtggctgctaccttttttatccactttttttacttgtctgttttcttctggatgctgactctgggattaatgctattttaccggctggtcttcatccttcacgaaaccagtcgatctacacagaaagcgattgctttttgtttagggtacggttgccccctggcgatctctgtgatcacgctcggtgccactcagccgagggaggtatatacaaggaagaatgtttgttggttaaactgggaggatactaaagcactcctggcattcgcaattccagctctgataatcgtggttgtaaatattaccatcacaattgtggttattacaaaaattctgcgcccttccatcggcgataagccctgcaagcaggaaaagtctagcctttttcaaataagcaaatctattggggtgctgaccccactcctgggcttgacttgggggttcggccttacaaccgtgtttcctggaacgaacctggtgtttcacatcatttttgctatcctgaacgtttttcagggtctctttatactgctcttcggatgtctctgggatttgaaggtccaggaagccctgctgaacaagtttagtctcagtcgctggtccagtcagcattcaaagagcacctccctgggcagtagcactccagtgtttagtatgagctcaccgattagccgaaggttcaacaacctgttcggcaaaaccggtacatataacgtgagcacacccgaggccactagctcttcccttgaaaatagtagcagcgccagctctctcctcaactag

SEQ ID NO: 42432 - DNA, 4041 bp, Artificial Sequence
  Description of Artificial Sequence: Synthetic coding sequence
atgaagagcccccggcggaccaccctgtgcctgatgttcatcgtgatttatagttccaaggcggccctgaattggaactacgaaagtacaattcaccccctgtcacttcacgaacacgaacccgccggcgaggaggccttgaggcaaaagcgggcagtggcaacgaagagtcctactgcagaagagtatacagtaaatatcgaaatctcgtttgaaaacgcatcatttcttgatccgataaaagcctatctaaatagcctgagtttcccaattcacggcaataataccgaccagataaccgatatacttagtatcaatgtgacaacagtctgtagaccagctggcaatgaaatctggtgtagctgtgaaacaggatatggctggccacgtgagagatgcctgcacaatttgatatgtcaggaaagggatgtcttcctaccaggacaccactgctcttgtctgaaagagctgcctcccaacgggccgttctgccttctgcaggaggacgtgactcttaatatgcgagtcaggctgaacgtggggttccaggaagacctgatgaacacgtcctcagccttgtaccgcagctataagactgatttagaaaccgctttccgcaagggctacgggattcttcccgggttcaagggagtcactgtgaccgggttcaagtctggctctgtggttgtgacatacgaagttaaaacaactccccctagcctggagctgattcataaagccaacgaacaggtggtgcagtctctgaatcagacctataaaatggactacaatagcttccaggctgtgacaattaacgaatcgaattttttcgtcactcctgaaatcatctttgagggcgacacggtttccttagtctgcgagaaagaggtgctgagcagcaacgtgagctggcgctatgaggagcagcagttagagatccagaacagctccaggttttccatctacactgccttgttcaacaatatgacctctgtatccaagctaacaatccacaacattacaccaggagatgctggcgaatacgtatgtaagctgatcttggatatttttgaatatgaatgcaaaaaaaaaatcgatgtgatgcccattcaaattttagcaaacgaggaaatgaaggtcatgtgcgataacaacccggtctccctgaactgttgtagccaggggaatgtcaattggtctaaagtggagtggaaacaggagggtaaaatcaacatcccgggcacccctgaaactgatatagattcctcctgttctcggtatactctgaaggcagatggcacacaatgcccgtccgggtcatcagggactacggtcatttatacttgtgaatttatctccgcatacggggccaggggaagcgcgaacatcaaggtgacgtttatttctgtcgccaatctgactattacacctgatccaatttctgtcagcgaaggtcagaactttagtatcaaatgtattagcgatgttagcaactacgacgaggtctactggaatacatcagccgggatcaagatctatcaacgtttctataccacccgccggtatttagacggcgctgagagtgtgcttaccgtcaaaacgagcacccgagagtggaacgggacataccattgcatttttaggtataagaatagctattccatcgctactaaggacgtcatagtgcaccccctgccgctgaagctgaatatcatggtggacccgctcgaggccacagtcagttgtagtggctcccatcacatcaagtgttgcattgaagaggacggagattacaaggtgaccttccacaccggcagctcgtctctacctgcagctaaggaggtaaataagaagcaagtttgctataagcataactttaatgcctcaagcgtgtcttggtgtagcaaaaccgtagacgtatgctgccactttacaaatgcagcgaacaattcagtgtggtcaccctcaatgaagctaaatctcgtgccaggtgaaaacatcacttgccaggaccccgtaatcggcgtcggagaacccgggaaagttatccagaaattatgcaggttcagtaacgtaccttcttcaccagaatcccctatcggaggcaccattacttacaagtgcgtgggcagccagtgggaggagaaacgaaatgactgtatttctgcccctatcaactctttgttgcagatggccaaggcattgatcaaaagcccctcccaggacgaaatgctgccaacctacctcaaggacctctccattagtatcgacaaggctgagcacgaaatttcatccagccctggttctcttggcgccattatcaacattttagacctgctgagcaccgttcctacccaagtcaatagcgagatgatgacccatgtattgagtacagttaatgtgatcctgggcaagccagtcctcaacacttggaaggtgcttcaacagcagtggaccaaccagagcagccagttactgcattctgttgagcgcttttcacaggcactacagagtggagactccccacccctgagcttttcacagaccaatgtgcagatgagctctatggtgataaaaagttcccatcccgagacttaccagcaacgtttcgtgttcccctatttcgatctctgggggaacgtcgtgatcgacaagagttatctggaaaatctgcagagtgattcaagcatcgtgacgatggcatttccaacacttcaagccatcctcgcacaggatattcaggaaaacaacttcgcagagtccctcgtgatgaccactactgtatcccataacacaactatgcccttccgcatatctatgacgtttaagaacaactctccgagcgggggcgagacaaagtgtgttttctggaatttcagactagctaacaatactggcggttgggacagctcagggtgttacgttgaggaaggagacggggacaatgtcacctgcatctgtgatcacctgactagtttttcgatactgatgagcccagattcccccgatccttcctctctccttggaatcctcttggacatcatctcatacgtgggcgtgggcttctccatactgtctctcgcagcctgcctggtcgttgaagccgttgtttggaaatcagttacaaaaaatagaacttcttacatgaggcatacttgtattgtaaacatcgccgcctctcttcttgtggccaatacatggttcattgtcgttgcagccattcaggacaatagatacatcctgtgcaaaactgcctgtgttgcggccacgttttttatccatttcttctatctgtccgtgttcttttggatgctcacactgggtctaatgttattttacaggttggtcttcattcttcatgagacctcccgttcaacacaaaaagcaatcgccttttgcctgggctacggttgcccactggccatttccgtgatcaccctgggggcaacgcaaccgcgcgaggtgtacacccggaagaacgtgtgttggctcaattgggaggataccaaggccttactcgcctttgcaattcctgctctgatcatagtggtggtcaatatcacaataaccatcgtggtcatcaccaagattttgcgccccagcattggagataaaccttgtaaacaagaaaaatccagcctctttcagatttcaaaatcaatcggggttctcacccccttactcggcctgacatggggttttgggctgaccacagtgtttccgggaaccaacttggtgtttcacattatatttgccattttaaatgtcttccaggggctcttcattttgctcttcggctgcctgtgggatctcaaggtacaagaggcactcttaaataaatttagtctgtcgaggtggagcagccagcactccaaaagcacttcccttggctctagcactccagtcttttccatgtcttcccccatcagcagacgttttaacaatttgtttggtaagacggggacctacaatgtcagcactcccgaagcaaccagttcttcactggagaattcaagttccgcctcttccctgctgaactag

SEQ ID NO: 42433 - DNA, 3981 bp, Artificial Sequence
  Description of Artificial Sequence: Synthetic coding sequence
atgaagagcccccggcggaccaccctgtgcctgatgttcatcgtgatttactcttccaaggccgcactcaattggaattatgaaagcacgattcatcccctttccctgcacgagcacgaacccgccggggaagaagctctgagacagaagagggccgtggccactaagagcccgacggcagaagagtacaccgtcaatatagagattagtttcgaaaacgcctcgttcctggatcccattaaggcgtatttgaactctctctcattccccatccacggcaataatactgatcaaatcacagacattctgtccatcaacgtgacaacagtctgccgacctgctgggaatgagatatggtgtagctgcgaaactggatatgggtggcctcgagaacggtgcctgcacaatcttatttgtcaggagcgggacgtttttctccccgggcatcactgttcttgtctgaaggagctccccccgaatggccccttctgtctgctccaggaagatgtgacccttaacatgagggtgagactcaacgttgggtttcaggaagacttgatgaatacttccagcgccctgtacaggtcatataaaactgaccttgaaacggccttccggaaaggctacggcatcttgcctggctttaagggtgtaacagtcactgggtttaaatccgggtccgtagttgttacgtacgaagttaagaccacccctccttctctggaactgattcacaaagctaacgagcaggttgttcaaagcctcaaccaaacctataaaatggactataactcctttcaggccgtgaccatcaacgagagcaatttcttcgtgacgccagagattatcttcgaaggcgatacagttagcctagtgtgcgaaaaggaggtcctaagttctaatgttagctggcgctatgaagaacagcagcttgagatccagaattcatcgcggttctcaatatatactgctttgttcaacaacatgacatctgtaagcaaactgactatccacaatataactcctggcgacgctggtgagtacgtgtgcaagctgatcctggacattttcgaatatgaatgcaagaagaaaatcgatgtgatgcctattcagatcctggccaacgaggaaatgaaagtgatgtgtgacaataacccagtaagcttgaactgttgttctcaaggcaatgtgaactggtccaaggttgagtggaaacaggagggaaaaatcaatatccctggcacaccggagacagatatcgatagttcttgttctcggtatacccttaaagcagacggaacccagtgtccttccgggtccagcggcaccaccgttatatatacttgtgaattcattagtgcctacggtgcgcgcggttccgccaacatcaaagtgacgttcataagtgtagccaacctgacaatcactcctgacccgatctccgtcagtgaaggccagaatttttcgatcaaatgcatttccgatgtgtctaattacgacgaagtgtactggaatacgtctgcgggcattaaaatctaccagcggttttatactactagacgctacctggatggcgccgaaagtgtccttacagtaaaaacttcgactcgcgagtggaacggaacctaccattgcatcttccgatacaagaactcttatagtatcgccacgaaggacgtgatagtgcacccactgcccctcaaactgaacatcatggtcgacccgctggaggcaacagtgtcctgttcaggctctcatcatatcaagtgctgtattgaggaggatggcgattataaggtaaccttccacactgggtccagtagcttgccagcggctaaagaagtaaacaaaaagcaggtgtgttacaagcacaatttcaatgccagttccgtatcttggtgtagtaaaactgtagatgtctgctgtcacttcaccaacgccgccaacaactcagtttggagcccatcaatgaagctgaatctcgttcccggggagaatataacatgccaggaccctgtgataggggttggtgaacctggaaaagtgatacaaaagttatgtaggttcagtaatgtcccctcatcaccggaatcccccattggaggcacgattacttacaagtgtgtggggagccaatgggaagagaaacgaaacgactgcatctctgctcctatcaactccctgttacagatggcaaaggcgctgatcaagtccccttcccaggacgaaatgttgcctacgtacttgaaggatctcagcattagtatcgacaaagctgagcacgagattagcagtagcccaggcagcctgggagcaatcatcaacattcttgacctactgagcactgtgcccacacaggtgaattcagagatgatgacgcacgttcttagcaccgtgaacgtgattctggggaaacccgtactcaacacctggaaggtgcttcaacaacagtggaccaaccagtcttcccagctgctccatagtgtggagcggttcagccaggcattgcagagtggagactcccctcctctcagtttctctcagacaaacgtgcaaatgtctagtatggtcataaaatcatcccacccagagacataccaacagcgctttgttttcccttacttcgacctgtggggaaatgtggttatcgataaatcttacctggaaaatctgcagtccgattctagcatcgtgactatggccttccctactctgcaggcgatcctggcccaggatattcaggagaacaattttgcagaatccctggtcatgacaactaccgtgagtcacaatacaacgatgccctttaggatcagcatgacgtttaaaaataattcacctagcggaggggagaccaagtgcgtattctggaacttccgcctcgctaataacacaggcggctgggactcaagcggctgttacgttgaagagggagacggtgataatgtcacttgcatctgtgatcatctgactagcttttctatcctaatgagtcctgatagccctgatccatcatccctgctgggaatcctcctggacataattagttatgttggagtaggatttagcattctgtcactcgccgcttgcctagtggtggaagcagtggtctggaagagtgtgaccaagaataggacatcctatatgaggcacacctgtattgtcaatattgcagcatccctcctcgtcgcgaacacttggtttatagtggttgcagccatccaagacaaccgatacattctgtgcaagactgcttgtgtggcagccacattttttatacacttcttctatctctccgtttttttttggatgttgaccctcgggctgatgcttttctaccgtcttgtgtttattttgcatgaaacttctcggagcactcaaaaggcgatcgctttttgccttgggtacgggtgtcccttggccatttctgtcataactttaggagctacacaacccagggaggtgtacacaagaaagaacgtctgctggttaaactgggaagacacaaaggccctgcttgcattcgcaatccccgccctgattatcgtggttgtaaatatcaccataactatcgtggtcattactaagattttacgccccagcattggcgataaaccttgcaaacaggaaaagagctctctgtttcagatctctaaaagcatcggggttctgacaccattgcttggtctcacttgggggttcgggctgaccacagtgtttccaggcaccaacctggttttccatataatttttgccatattaaatgtcttccagggtctctttattctgctttttggctgcctctgggacttaaagagcactagtttgggctctagcacacccgttttcagtatgtcaagtcctattagtagaaggttcaacaacctgttcggcaaaaccggcacttacaacgtcagcacaccggaagcaactagcagctcccttgaaaacagctcctccgcaagtagtttgttgaactag

SEQ ID NO: 42434 - DNA, 4041 bp, Artificial Sequence
  Description of Artificial Sequence: Synthetic coding sequence
atgaagagcccccggcggaccaccctgtgcctgatgttcatcgtgatctatagttcaaaagccgccctgaactggaattacgaaagcacaattcatccactttccctccatgagcacgagccggctggcgaggaagccttacgccagaagcgcgccgtggccacgaaatctcccacggccgaggagtacacggtgaatattgagatctctttcgaaaacgcatcctttctagatcccatcaaagcctatcttaattccttgtcctttcccatccacggtaataatacggaccagatcacggatatccttagtattaatgttacaactgtttgccgcccagctggcaatgagatctggtgcagttgcgagaccgggtacggatggcctcgcgagcggtgtctccataatctgatctgtcaggagagagacgtgttcctccctggacaccattgcagttgtcttaaagagctgccccccaacgggcctttttgccttctgcaggaggacgtgacattgaacatgcgcgtgaggctcaatgtggggttccaagaggacctgatgaacacctcatctgccttataccggagttacaaaacagacttggagactgcttttagaaagggatacggaatcttaccagggtttaagggcgtcactgtgactggctttaaatccgggtcagtcgtggttacctacgaggtgaaaacaactccgcccagcctggaactgattcacaaggccaacgagcaggttgttcaaagcttgaatcaaacctacaaaatggactacaacagcttccaggccgtgacaataaacgagagcaactttttcgtaacgccagaaataatcttcgaaggcgacactgttagtcttgtgtgtgagaaggaggtcttatccagcaacgttagttggaggtacgaggaacagcagctggaaatacaaaacagtagcagattcagcatttatactgcattgttcaacaatatgacatccgtttctaaactgacaatccacaacatcacccccggggacgccggcgaatatgtgtgtaaacttattttagatatctttgagtatgagtgcaagaaaaaaatagatgtgatgcctattcagattctggccaacgaggagatgaaggttatgtgcgacaacaacccagtttctctgaactgctgctcacagggaaacgtgaactggagtaaggttgagtggaagcaggaaggaaaaatcaacattcctgggactcccgaaacagacattgattcaagttgttcaaggtacacgctgaaggcggacgggactcagtgtccttccggtagctccggtaccacagtgatatatacatgtgaattcatctccgcctatggcgcgagagggtcggctaatatcaaggtgactttcatttctgtcgcgaatttgacgattacccctgaccctattagcgtctctgaaggccaaaatttcagcattaagtgcattagcgatgtgagcaactatgatgaggtgtattggaacacgtccgccggcatcaaaatttaccagcgcttttataccactagacgatatctggacggggccgaaagtgtcctaacagttaagacctcaaccagagagtggaatggcacttatcactgcatcttccgctataaaaacagctattctatcgcaaccaaggacgtaatcgttcatccattgcctctaaaattgaacattatggtggacccactagaggctactgtgagttgttcaggatctcaccatatcaaatgttgcatcgaagaagacggcgactataaagtgacattccataccggcagttcctctctcccagccgctaaggaggtgaacaaaaagcaggtctgctacaaacacaatttcaacgcatcttccgtgtcctggtgttctaagacagtcgatgtgtgctgccacttcaccaacgccgctaataattcggtgtggagcccctcaatgaaactgaacctggtcccgggcgagaatattacgtgccaggatcccgttattggcgtaggggaacctgggaaggtgatccaaaagttgtgccgtttctccaacgtcccatcgtctcccgaaagcccaattggcggtaccattacctataaatgtgtaggatcccagtgggaggaaaaaagaaacgattgtatctcggccccaattaacagtctcttgcagatggcgaaggctcttatcaagagtccttcccaggacgagatgctgccgacatacctgaaggacctaagcatctcgatcgacaaagccgaacatgaaatatcctcctcccctggcagtctgggcgccatcatcaacattttagacctgctgtcaacggtccccactcaggtcaactccgagatgatgactcacgttctgagtaccgtgaacgtcatccttggcaaacccgtcctgaatacttggaaggtgctacagcagcagtggacaaaccagtcaagccaactactccatagcgtcgaacgcttcagtcaggccctgcagagcggtgatagcccgccactcagcttttcccagaccaatgttcaaatgtctagcatggttattaaatctagtcaccctgagacatatcagcaaaggttcgtgttcccttatttcgatttgtggggtaacgttgtaattgataagagttatctggaaaacttacagagcgattcttcaattgtgacaatggcgttcccgacactgcaagccatcctggcccaagacattcaagagaataacttcgcagagtcactggtcatgactacaacagtctctcacaacaccacgatgccatttcggatttcaatgacgttcaagaataattcgccttctgggggcgagacaaagtgtgtgttttggaattttcggctggccaataacactggcgggtgggattcatccggctgttacgtcgaggagggggatggcgataatgtcacttgcatctgcgatcacttaacttccttttctatcctcatgtcgcctgattcaccggatccgtcaagcctgctaggaatcctgctggatatcatcagctatgtgggggttggattctctatacttagcttagccgcatgcctcgtcgttgaggccgtggtgtggaagtcagtgacaaagaaccgcacctcttatatgcggcacacatgcattgtgaatatagcagcctcgctgctcgtggccaatacatggtttattgtggtcgcagccatccaggacaatcggtatattctctgtaaaactgcctgtgtagccgccactttctttatccacttcttttacttatctgtgtttttctggatgctgacattaggcttgatgcttttctatcggttggtttttattctccacgaaacctcccggagtacacaaaaagccatcgctttttgcttgggctacggctgtccactggctatctccgtgataacgttaggcgccacgcagcccagagaagtgtacacacgaaaaaatgtttgttggctgaattgggaggacaccaaggccctactggcgttcgctattccagccctcataattgtggtcgtgaacattaccataactatcgtcgtgataaccaaaatcctacgcccctcaattggcgacaagccatgtaaacaagagaagagctctttgtttcagatctctaagtcgatcggggtcttaacccctctgctgggcctaacttgggggtttggcctgacgactgtgttccctggaactaatttagtgtttcatatcatctttgccatactgaatgtgtttcagggactctttatactgttatttggttgcttgtgggacctgaaggttcaagaagctctgttgaataaattctccttgtccaggtggtcctcacagcattcaaagtccacatctctgggatcctcgacacccgtctttagtatgtcatcaccgatctctcgtaggttcaataatcttttcggcaaaacgggaacttacaatgtatcaactcctgaggccacctctagtagtcttgagaattctagctcagctagttcactgcttaattag

SEQ ID NO: 42435 - DNA, 3615 bp, Artificial Sequence
  Description of Artificial Sequence: Synthetic coding sequence
atgaagagcccccggcggaccaccctgtgcctgatgttcatcgtgatatatagcagcaaagctgcattgaactggaactatgagtcaacaatccatcccttatccctccacgaacacgaacctgccggtgaggaagcattacgccaaaagagggcggtggccacaaaaagtccaaccgccgaggaatatacagtcaacatcgagattagcttcgagaatgcttcatttttagaccctatcaaagcatatttgaacagcctgagcttcccgatccacggcaataacactgatcagattaccgatattctttcaattaacgtcacgacagtgtgtagacccgccggaaatgaaatttggtgtagctgcgagacaggatatggctggcccagagaacggtgcctgcacaaccttatttgccaggagagagatgtgttcttaccagggcaccactgctcctgcttgaaagagcttccgccaaatggaccattttgcctactgcaggaagatgtgacattgaatatgcgagtgcggctgaacgtcggctttcaggaggatctgatgaatacttcttctgctttgtacaggagttataagacggacttagagaccgccttccggaaaggttatggaattctgcctgggtttaagggagtcacagtgactgggttcaaaagcgggtcagtcgtcgtgacctatgaagttaaaacaactccaccgtctctagaactgattcacaaggctaacgagcaagtcgtccagagcctgaatcagacatacaaaatggattacaatagctttcaggcggtcacgatcaggaccccagaaacagatatagactccagctgctccagatacactcttaaggccgacgggacacaatgtccgagcggatcttcgggaactactgtgatctatacttgcgagttcattagtgcatatggggcacgtggctctgccaacatcaaggtgacatttattagtgtagccaatttgaccattacgcctgacccaatcagcgtgagcgagggtcagaacttctcaattaaatgtatctctgacgtgtccaactacgatgaggtttactggaataccagcgccggaatcaagatttaccagcgcttctatactacccgcaggtacttggatggtgccgaatcggtcctgactgtgaagacgtcaactagagagtggaatggaacgtatcactgcatcttccgatataaaaatagttattcgatagccaccaaagacgtgatagttcatcctctccctctcaagctcaacatcatggtggatcccctggaggccactgtttcttgctccgggtcacaccacataaaatgctgcatagaggaggacggcgattacaaggtcactttccatacggggagctcctccctgcctgccgcaaaggaagttaacaaaaaacaggtgtgctataagcacaactttaacgccagctctgtgagctggtgtagcaaaacggttgatgtgtgttgccatttcaccaatgccgccaacaacagtgtttggagcccctctatgaagctgaacctagtaccgggggagaacataacttgtcaggatcccgtgataggcgtgggggagccgggtaaagttatccagaaactttgccgtttttccaatgtcccatcaagtccagagagccccattgggggaaccatcacctacaaatgcgtgggctctcagtgggaggaaaagcggaacgattgtatcagcgcgccaattaattccctgctccagatggccaaggcgctgataaaatccccttcccaggatgaaatgctgcccacgtacctaaaagatctgagcatatcaattgataaagcagagcacgagatttcatcttcgccaggctctcttggtgcaatcatcaacatcctggatttactaagcacggtacctacgcaggtgaactcggagatgatgacacatgtgctgagcactgtcaacgtgatcctcgggaagcccgtgcttaacacgtggaaggtgctccagcagcaatggacgaatcagtctagtcagttgctccactcagtggagcgattctcccaggccctgcagtccggagatagccccccactgagtttctcacaaacaaacgtacagatgtcctcgatggtgatcaagtcgtcccacccagagacatatcagcagcgatttgtgtttccgtactttgatctctgggggaacgtggtgattgacaaatcatatctagagaacttacaaagtgatagctccattgtgacaatggcctttcccaccctccaagcaattctggctcaagacatacaagaaaataattttgcagagtcactggtcatgaccaccaccgtttcccataacaccactatgcctttcaggatttccatgacctttaagaacaatagccctagtgggggcgagacaaaatgtgtgttttggaactttcgcttagctaacaatactggagggtgggacagcagcggttgttacgtggaggagggagatggagacaatgtgacatgcatttgtgaccacctaacctctttttccattttaatgtcccctgacagccctgacccaagttctctgcttgggatactcctggacatcattagctatgtgggcgttggcttcagcatcctgtctctcgcagcctgtctggtggttgaagccgtcgtgtggaagtcagtcacaaagaaccggacctcttacatgcggcacacctgcatcgttaatattgcagcatccctgttggttgccaatacgtggtttatcgtagtggcggccatccaagacaatagatacatcctttgcaaaactgcctgcgttgccgccacctttttcatccattttttctacctctctgtgttcttttggatgctcaccctagggctaatgctgttttacaggttggtgttcatcctacacgaaacgagtcgctcaactcagaaagctatcgcattctgtttgggatacggctgccccctcgcaatcagtgtgattacactgggcgccacccagccacgggaagtctatacacggaagaacgtctgttggctgaattgggaagacacaaaagctctgctcgcctttgccattcccgcacttattattgttgtggtaaacatcaccatcacaattgttgtcattacgaaaatactaaggcctagtattggcgataagccctgcaagcaagagaaatcaagcctgtttcagattagcaagtctattggtgtcctgaccccattgctgggacttacctgggggttcggattaaccaccgtgtttcctggcactaacctggttttccatattattttcgcaatactcaatgtgtttcagggcctcttcattcttctcttcggctgcttatgggacctgaaggttcaggaagccttactgaataagttcagtctcagccggtggagttcccagcactctaaaagtacatcgctagggagttcaaccccagtttttagcatgtcctcccccatatcacgacgcttcaataacctgtttgggaaaaccggtacatacaatgtttctacaccggaagcaactagctcttccttggagaatagtagcagcgcatcctccctgcttaattag

SEQ ID NO: 42436 - DNA, 2154 bp, Artificial Sequence
  Description of Artificial Sequence: Synthetic coding sequence
gactaccggagccaggtgcacgtggagagccgggagggcctgtggaagatcaaagggaagatcaaaaaactggggagcagcgaaaaagtgactgagagcaagggggaaaatattacctgtcaggacccagtgataggcgttggggaacctggtaaagtaattcagaaattgtgccgcttctctaacgtgccctcaagcccggaatcccctattggcggtacgattacatacaagtgcgtcgggagccagtgggaagaaaagcgcaacgattgtatttctgccccaatcaatagcctgcttcagatggccaaagcattaattaagagtccatcgcaggatgagatgctcccaacttaccttaaggacctctctattagcatagacaaggctgagcatgaaatatcatcctctcctggcagcctgggagcaataattaacattttggatctgctttcaacagtccctacccaagtgaatagcgagatgatgacgcacgtactgtcaactgtgaacgtgattctggggaagccagtcttgaacacctggaaggtactccagcagcagtggaccaaccagtcctcccagctgttgcactctgtggaaagattctcacaggcgttgcaatctggcgattctccccctctaagcttctcccagacaaacgtacagatgtcaagcatggtgattaaatcatcacaccctgagacatatcagcaaaggtttgtgttcccttactttgatctgtggggcaacgtggtgattgacaagtcctatttggaaaacctacagagcgattcttcaattgttacgatggcatttccaaccctccaggctattctggctcaagacatccaggaaaataacttcgctgagagtttggtgatgactaccaccgtgagccacaacacaaccatgccttttcgtatcagcatgaccttcaagaacaattctcccagtgggggagaaactaaatgtgtcttctggaatttcagactggccaacaacacaggcggctgggattctagtgggtgctatgtggaggagggtgacggagacaatgtcacatgtatttgcgaccacctaaccagtttcagcatcctgatgagtccagactcacccgacccatctagtctgttaggcattctcctggatattatcagctatgttggtgtgggcttttctattctttctctagcggcctgtctggtggtggaagccgtggtttggaagagtgtaacgaagaatcggacttcctacatgagacatacatgtattgtgaacatagctgctagcctgctggtcgccaacacatggttcattgtcgtggccgcgatccaggacaatagatatattctctgtaaaactgcgtgcgtggccgcaacattttttattcactttttttacctatcagtgtttttttggatgctgacgctgggccttatgctgttttaccgactcgtatttatcctgcacgaaacatctcgaagtacacagaaggctatcgcattctgtttggggtatgggtgccccctcgcaatctcagtgatcaccctcggcgcaacacagccgagagaagtttacacccgaaagaacgtctgttggctcaattgggaagataccaaggcacttctggcatttgcgatccctgctctgattatcgtcgtggtcaatatcacaatcacaatcgtggtcatcactaagatcctgcgcccttctattggcgacaagccatgcaaacaggagaagtcgtctctgtttcagatctctaagtctatcggcgtcctgacgccccttttgggacttacatggggatttggcctgacaaccgtgtttcccggtaccaatctagtgtttcacataattttcgctatcttaaacgttttccagggtctgttcattctgctgtttgggtgcctctgggatttgaaagttcaggaggccctactgaacaagttctctcttagtcgctggagctctcagcatagtaagtccaccagtcttgggagcagcacaccagtcttcagcatgagctctccaatcagccgacggtttaacaacctgttcggcaagacggggacctataacgtgtctacccccgaggccacatcgtcttcgctggagaactccagtagcgcatcttctttactaaattag

SEQ ID NO: 42437 - DNA, 2313 bp, Artificial Sequence
  Description of Artificial Sequence: Synthetic coding sequence
atggtggaccccctggaggccaccgtgagctgcagcggcagccaccacattaagtgttgtatcgaagaagatggcgattacaaggtcacattccacacaggcagctctagccttccagctgccaaggaggtgaacaagaagcaggtctgctataaacataattttaacgcatcatccgtatcctggtgttccaaaactgttgatgtgtgctgccattttactaatgctgctaacaactctgtgtggagcccgagcatgaaactcaacctggttcctggtgagaatataacctgtcaagatccagttattggcgtaggagagccggggaaagtcatccagaagctgtgccgtttcagcaacgtcccaagtagccccgaaagccctattggcgggaccataacatacaagtgcgtggggtcacagtgggaagagaaacggaatgactgcatatccgctccaatcaattccctgctgcaaatggctaaggccctgataaagagtccaagccaggatgagatgcttcctacctacctcaaggacttgagcatctctattgacaaggctgagcacgaaatcagcagctcccctggaagtctgggagccataataaacattttagatctgctgagcactgtaccaacacaggtgaacagcgaaatgatgacacatgtcctcagtacagtgaatgtgatcctcggcaagccagtgttaaatacctggaaggtgctgcaacaacagtggaccaaccagtcgagccagctactgcattccgtggaacgattcagtcaggcattgcagagcggggactccccccccctttcctttagccagaccaacgttcagatgtcctccatggtgatcaaatctagccaccccgaaacgtatcagcagcggttcgtcttcccttacttcgacctttggggcaacgtggtgattgacaagagctatttggagaatctacagagcgactcatccatagtgactatggcttttccgaccctgcaggcaatcctggcccaagacatccaggagaataactttgcagagtccttggtgatgacaaccactgtgagtcacaatacaactatgccattcaggatttccatgacatttaaaaacaactcaccctctggcggcgagacgaagtgtgtcttttggaacttcaggctggctaataacacaggcgggtgggattcttctggctgttatgtcgaagaaggggatggagacaatgtcacatgcatctgtgaccacttaacctctttctcaatcctgatgtctccggacagccctgatccaagctcactgctgggaatattgctcgatattatctcgtatgtcggggtgggattctctatactgagtctcgcagcatgcctcgttgtggaagcggttgtgtggaagtctgtcaccaaaaaccggacgtcttatatgaggcacacatgcattgtcaacatagctgcaagcctgctggtagccaacacctggttcatcgtggtggccgccatacaggataatagatatatcctatgtaagactgcttgcgtagctgctaccttttttattcattttttctatctgtccgtgtttttctggatgctgaccctgggcctgatgttattctaccgcctagtttttattcttcacgaaacatcacggagcacccagaaggccatcgctttttgcctgggctatggctgcccactggctattagcgtgattaccctcggcgctactcagccacgcgaggtgtacacccgtaagaatgtgtgctggttaaactgggaagacacaaaggccctgctggcgtttgctatccctgctttaatcattgtcgtggtcaacatcacaattactatcgtggtcataactaagattctgcgccctagtatcggggacaaaccttgcaaacaggagaagagcagtcttttccaaatttctaaaagcataggcgtgttaacacccttacttggccttacttgggggtttggcttaacaaccgtgtttcctggcaccaatctcgtgtttcatattatttttgccattttgaatgtgttccagggactttttattttgttgttcgggtgtttgtgggatttgaaagttcaggaggccctgctcaacaagttcagcctttcaagatggagttcccagcattcaaagtctacttcgcttggtagcagcacacctgtcttctccatgtccagccccattagcaggcgcttcaacaacttgttcggaaaaactgccgcgccaaagataccccccgggcacgacgggaatcttgtgtcaggagggagttcagccatatag

SEQ ID NO: 42438 - DNA, 1008 bp, Artificial Sequence
  Description of Artificial Sequence: Synthetic coding sequence
atggagagcagcttcagcttcggcgtgatcctggccgtgctggcctcattaatcatcgccacgaatacactcgtggccgtggccgtcctcctgctcatccacaagaacgacggagtgtccctgtgctttacactgaatcttgccgtagcagatacgttaatcggtgtcgcgatctccgggctgttgactgatcaattgagctcgccgtccaggcctacccagaaaactctgtgttccctgaggatggctttcgtgacctcttctgctgcagctagcgtactcaccgtaatgcttatcaccttcgacaggtacttggcaataaaacagcctttccggtatctgaaaattatgtctggctttgtggcgggggcttgtatcgcaggtctgtggctggttagctacttaatagggtttctgcctctgggaatccctatgttccagcagactgcctacaaggggcagtgctccttctttgctgtatttcacccccactttgtgttaaccctttcatgcgttggtttttttcccgccatgctgctcttcgtgtttttctactgcgatatgctgaaaattgctagtatgcattcccagcagatacgcaaaatggagcacgctggggctatggccggcgggtatcggtctcctcgcactccatcggacttcaaggcactgcggaccgtgtctgtgctgataggcagtttcgcgttgagctggacgccatttcttattacaggcatagtgcaggtggcatgtcaagaatgtcacctgtacctcgtcctcgaaagatatctgtggctgttgggcgtcgggaatagcctgctgaaccccctgatctatgcctactggcaaaaggaagtgaggctgcagttgtaccatatggcccttggcgtaaagaaagtcctgactagtttcctgctgtttctgtctgcacggaactgtggtcctgagaggccgagagagagtagctgtcacattgtgaccatctcctcctctgaatttgatggatag

SEQ ID NO: 42439 - DNA, 1485 bp, Artificial Sequence
  Description of Artificial Sequence: Synthetic coding sequence
atggaggagccccagcccccccggccccccgccagcatggccctgctgggcagtcagcacagtggcgctccctccgccgcgggtccgccgggtggcacttcctccgcggccacagcagccgtcttgtcattctcgacggtagcaaccgccgccctgggtaacctgtccgacgcatccggtggaggcaccgcggctgcgcctggcggcgggggattgggcggaagcggggctgcccgggaagctggggctgctgtgagaaggcctctgggtccagaagctgcacctcttttgagtcatggtgcggctgtggcagctcaggcactggtgctgctcctgattttccttttgtcttctctggggaactgcgctgtgatgggcgtcatagtgaaacataggcagctgaggacggtgaccaatgcctttatcctctctctcagtctgtccgatctcctgaccgctctgctgtgtctacccgctgcttttctggacctatttacaccacctggtgggtctgctcctgccgccgccgccggcccatggagaggattctgcgccgcttcccgtttcttttcctcttgtttcggtattgtgagtaccctcagcgttgccctcatttctcttgacagatactgcgctattgtgcgcccccccagagagaagattgggcggaggcgggccctgcaattgctggccggggcttggctgaccgccctaggcttctccctcccgtgggagctattaggcgcccctcgggagctagcagctgcccagagtttccacggctgtctctatagaacgtctcctgatcctgcccagctcggggcagcattctctgtggggctggtagtcgcatgctacttgctgccattcttactcatgtgcttttgtcattatcatatttgcaagacagtccgcctaagtgacgttcgtgttcgccccgtcaacacctatgccagagtgctccgtttctttagcgaggtccgaaccgctaccacagtcctaatcatgatcgtttttgtgatttgctgctgggggccgtactgttttctcgtgttgctggccgccgcccgccaagcccagacaatgcaagccccaagtcttctgagtgtcgtcgccgtctggctgacttgggctaatggtgcgattaatccagtgatttatgcaatccgtaaccccaatatcagcatgctcctgggtaggaacagagaggaggggtaccgcaccagaaacgttgatgcattcctgccctctcaagggccggggctgcaggccaggagtaggagccgtctgcggaatcggtatgctaaccgcctgggggcctgcaatcgcatgagttcttctaatcctgcttccggtgtcgcaggggacgtggctatgtgggccaggaaaaatcccgtggtcctgttttgtcgtgaaggacctccagagcctgtaacggctgtgacaaaacaaccgaagtccgaagcgggagatacaagcttgtag

SEQ ID NO: 42440 - DNA, 1485 bp, Artificial Sequence
  Description of Artificial Sequence: Synthetic coding sequence
atggaggagccccagcccccccggccccccgccagcatggccctgttgggaagccagcattcaggtgcaccatctgctgccggacctccagggggcacttcctcagctgccacggctgcggtcctgtcattttcaacggtggcaacagctgctcttggtaatctatcagatgctagtggaggcggaacagcagcagctccagggggaggaggtcttgggggctccggcgccgcgcgcgaagccggtgctgccgtaagaagacccctcggtccggaggcggcaccactcctgagccacggtgccgcagtcgcagcccaggcgttggttctactccttatcttcctgctgagctctctcggcaactgtgcagtgatgggcgtcattgtgaaacaccgtcaactacgcaccgtgactaatgcctttatactcagcttgtctctctccgacctcctcacagcactactgtgtctgccagcggccttcttggatctgtttacccccccagggggaagtgcccctgctgccgctgccggcccctggagaggcttttgcgccgcatcccgttttttctcaagttgttttggcatcgtgtcaacactgagcgttgccctgatatctctagatcgctattgtgctatcgtccggcctccccgagagaagatcggcagaagacgggccctgcaactcctcgccggagcctggctgaccgctctgggcttctcactgccttgggaacttctgggcgcaccaagagaattggcggcagctcaaagctttcacgggtgtttgtatcggacatccccagatcccgcccaattaggggctgcgttctccgtggggctggtggtcgcttgttacctgttgccattcctgctgatgtgcttttgtcattaccacatctgcaagacagtgcgtctcagcgacgtgagggtgcggcccgtgaatacatacgcccgcgtgctcagatttttttctgaggtacgtaccgcaaccactgtgctgattatgattgtgttcgtcatctgttgttgggggccctattgcttcctggttttgctagctgccgccaggcaagcccagactatgcaagctccgtctctgctgtccgttgttgccgtctggctgacctgggcgaatggtgctatcaacccagtgatctacgccatccggaatcctaatataagcatgctcctggggcggaaccgagaggagggctaccgcacaaggaatgtggatgcgtttcttcccagtcagggccctggtctccaggcacggtctcgaagcaggctgaggaaccgctatgctaatcggctaggtgcttgtaacaggatgagcagttctaatcccgcatcaggcgttgcaggagacgtggccatgtgggccagaaaaaatccagtggtgctcttttgccgcgaaggcccccccgagccagtcactgccgtcaccaagcagcccaagtcagaggcaggcgacacgtccctgtag

SEQ ID NO: 42441 - DNA, 969 bp, Artificial Sequence
  Description of Artificial Sequence: Synthetic coding sequence
atggccctgctgggcagccagcacagcggcgcccccagcgccgccggaccaccaggcgggactagctctgctgccaccgccgctgtgttatcgttttcgacagtcgctaccgctgcactaggcaatctgtctgacgcatccggggggggaacagccgctgctcccggaggcgggggtctgggaggctccggcgctgctcgggaggcaggagccgctgtccgccgacccctaggccccgaggctgcccccctgctgagccacggtgcagccgtcgcagctcaggccctggttctgctactgatttttttactcagttccctgggtaactgtgcagttatgggggtgattgtcaaacaccgccagcttcggaccgtgacaaacgcattcatcttatcactgtccctcagcgatcttcttaccgccctactgtgcctgccagccgcgttcctcgacctcttcactccccctggcggcagcgcccctgctgccgccgctggcccttggaggggtttctgtgcagcaagcaggttcttttcctcttgctttgggattgtgcatgctcagagaggcgcccacttggtcggacccttactgagatatcgtcggccgccacgagagaaaattggccgacgccgcgcactgcaattgctggccggcgcctggttgaccgccttgggattctcactgccctgggagctgttaggagctccacgcgagcttgccgcggcccaatctttccatggctgtctctaccgaacatctcctgaccctgctcagctgggggcagctttcagcgttggacttgttgttgcctgttacttgttgcctttcctcctaatgtgcttctgccactatcacatttgcaagactgttcggctcagtgacgttagagtgcggccggtgaatacctacgcacgcgtactgcgatctagcgccaggtgtgcacgcccacctccttctagctcctag

SEQ ID NO: 42442 - DNA, 1254 bp, Artificial Sequence
  Description of Artificial Sequence: Synthetic coding sequence
atggagagcaacctgagcggcctggtgcccgccgccggcctggtgcctgcactgcctccagctgtcactctgggcttgactgctgcctacactacactgtatgcccttctgttcttttcagtttacgctcaactttggctggttcttctatacggccacaagagactatcgtaccagacggtgtttctggccctttgtctgttgtgggccgcactcaggactaccttgttttccttctactttagagatacgccacgagctaacagacttggccccctccctttctggctcctttattgctgtcccgtatgtcttcagttctttacgctaacactgatgaacttgtattttgctcaggtagtgtttaaagcgaaggtgaaacggcgcccggagatgagccgagggctgctggctgtaagaggggcattcgtcggggccagcttactattcctgcttgttaacgtcctgtgcgccgtgctcagtcacaggagaagggctcagccctgggcgctactgctcgttcgcgtgcttgtgagtgacagcttgtttgtcatctgtgctctgtctcttgccgcttgtctgtgtcttgttgcaagaagagctccatctacttcgatatacctcgaggctaaaggcacctctgtgtgtcaggctgctgccatgggaggtgctatggtgctgttatacgcgtctagagcgtgttacaacctgaccgccctcgctctggctccccagtcaagactagacaccttcgactacgactggtataacgtctccgaccaagccgacctcgtgaatgacctgggtaacaaagggtacctggtattcgggttaatccttttcgtgtgggaactgctccctaccaccctcctggtcggattttttagagtccacagacctccccaggacctgtccacctcccacatattgaatggtcaggttttcgcttcaagatcatacttctttgaccgtgcagggcattgcgaggacgaagggtgttcttgggaacattctagaggcgagtccacgcggtgccaggaccaagccgctaccaccacagtgagcactcccccacacagaagagatcccccaccaagtccaaccgagtatcccggccccagtcctccccacccacggcctctttgccaggtgtgcctgccactcttagcgcaggaccccgggggacggggttatccattactttggccagcaccttgttgtagttgccatagcgaactcgttccgtctccctag

SEQ ID NO: 42443 - DNA, 1041 bp, Artificial Sequence
  Description of Artificial Sequence: Synthetic coding sequence
atggagagcaacctgagcggcctggtgcccgccgccggcctggtgcctgctcttcctcccgccgtcaccctgggcttaactgcggcttatactactctgtatgctctgttgttcttctccgtgtacgcacaactctggcttgtgctcttatacggccacaaacgactgtcttatcagactgtgtttctggcactttgcctcttatgggccgcccttcgcacaaccctgtttagcttctatttccgggacacgccccgagctaacaggctgggccccctgcctttctggctgctctactgctgcccagtgtgcttgcaattctttaccttgaccctgatgaatctctatttcgcccaggtggtcttcaaggctaaagtcaaacgccgccctgagatgtccagaggcctgctggctgtgcggggggcatttgtaggagcgagtctgctttttctcttggtcaacgtcctatgcgccgtcctgtcccatcgtcgccgtgcccaaccctgggctcttctgctggtgagggttttagtgagtgactccctttttgtgatatgcgccctttcccttgccgcatgtctctgtctcgtcgcaagaagagctccgagtactagcatttacctagaagccaaggccgacctggtgaatgatctggggaataaaggctacctggtgtttggcctgatcctgttcgtctgggagctgctgcctaccaccctactggtcggattcttcagggtccacagaccaccccaggacctgtctacatcacacattctgaatggccaggtctttgccagcagaagctattttttcgacagggcaggtcactgtgaagacgaagggtgttcatgggaacacagccgcggcgaaagcacttcgatgtcaggatctctgggctcgggctcgtggtatggcgctatcggcagggagcccggatggtatggcggcagccaaactaaaacgacgcccctgttattttcacaggtgccaggcccgggcggtcatcaccattccctgtatagcacaccacagacttag

SEQ ID NO: 42444 - DNA, 1428 bp, Artificial Sequence
  Description of Artificial Sequence: Synthetic coding sequence
atgctgtgggccgtgcggacccggtgctacgtggtgaaggcccagctggggcctactgttgccctagaaggcagggccccccgggcccccggacctagttgtttgggaaacgggaattgccagaggcctgggcctattacaagccgtaatgtcactagagcatctctgccagacatggagtccaacctgagcggactcgtgcccgcagcgggcctggtccccgccctgccgcctgctgtgactctggggttgacagccgcttacactacactgtacgccctcctctttttcagtgtgtatgcccagctttggctcgtgctactgtacggtcacaaaaggttatcctaccagaccgtgttcctagccctttgcttgctgtgggctgccctgcgcacgaccttatttagcttctacttcagggacacaccccgagcaaatcgtctgggacctttgcctttttggctgctgtattgctgtcccgtgtgtctgcagttctttaccttaactctgatgaatctgtattttgcccaggtggttttcaaagccaaagtcaagcggcgtcctgagatgtcgcgcggtctgctggcagtgcgaggggctttcgtgggggcttccctgcttttccttctggttaatgttttatgtgcagtgctatcccacaggcggagagctcagccctgggctctgctgctggtacgagtcttggttagcgacagccttttcgtcatttgcgccttgagcttggctgcctgtctatgtttggtggcccgcagagccccttcaacgtccatctacttggaagctaagggcacctctgtctgccaagccgcagccatgggaggggccatggttttactctacgctagtagggcctgctacaatctgactgctctagcacttgccccgcaaagcagactggatacatttgattacgattggtataacgttagtgaccaggcagacctcgtaaatgatctgggtaataaagggtatctggtcttcggactcattctttttgtttgggaattgctgcctacaacgcttcttgtcggctttttccgtgtgcaccgcccgccacaagacctatctaccagccacatcctcaatggtcaggtgttcgcgtctcgatcttactttttcgatagggcggggcattgtgaggacgagggctgctcttgggagcattctaggggtgaaagcactcgctgtcaagatcaagctgcaacaaccacagtcagcactcccccacaccggcgtgatcccccccccagtcccaccgagtatcctggacctagtccaccacaccctaggcctctgtgccaggtttgcttgcccctactggcccaggaccccggtggaaggggttatccactgctctggcctgcgccctgttgttcttgccactccgagcttgttccaagcccatag

SEQ ID NO: 42445 - DNA, 1191 bp, Artificial Sequence
  Description of Artificial Sequence: Synthetic coding sequence
atggagagcaacctgagcggcctggtgcccgccgccggcctggtgcccgctttgccccccgctgtcacactgggcctgaccgccgcctatactaccctctacgcactcttattcttttcagtttacgctcagctctggctggtgctgctctacgggcacaaacggctttcataccagaccgtgtttctggctctgtgcctcctgtgggccgccctccgcacaacattgttttcattttactttagggacacgccacgggccaatcgtctggggcccttgccgttctggctgctgtactgctgcccggtgtgtctgcaattcttcaccctcaccctgatgaacctgtacttcgcgcaagttgtgttcaaggcgaaggtgaaaagaagaccggagatgtcgcgcggcctgcttgccgtcaggggagctttcgtcggggcttccctcttgtttttgctggtgaatgtcctgtgtgcagttctcagtcaccgtaggagggcccagccctgggccttattgctggtgcgggtgctggtgtctgattcgctctttgtgatctgcgctctgtccctggctgcctgcttgtgcctggttgcccggagagccccctcaacgagcatctacctagaggctaagggaacctctgtctgtcaggccgccgccatgggcggagccatggtgcttctttacgcgtcaagggcctgctacaatctaactgccctggctcttgccccccagtcaaggcttgacactttcgattatgactggtataacgtgtcggaccaggctgatctggtgaacgatctcggaaacaagggatatctggtgttcgggctgatactgttcgtgtgggagctgctgcctacaacgctcctcgtggggttcttccgggtgcacagaccacctcaggacctctccacctcacacatactcaacggccaggtcttcgcctcgaggtcgtattttttcgacagagctggtcattgcgaagatgaaggctgcagttgggagcactctcgtggggagtctacatctatgagcggaagccttggtagtggtagctggtacggagctattggccgcgagccgggatggtatggcggttctcaaactaagactacccccttgcttttttcacaggtgcccgggcctggaggccatcaccacagtctttattctactccccagacatag

SEQ ID NO: 42446 - DNA, 399 bp, Artificial Sequence
  Description of Artificial Sequence: Synthetic coding sequence
atggagagcaacctgagcggcctggtgcccgccgccggcctggtgccagcacttccaccagcggtcacgctggggctgaccgctgcttataccaccctatatgccttgctattcttttccgtttacgcccaattgtggctcgtccttctgtacggacacaaaagacttagttatcaaacagtcttcttagccctctgcctgctgtgggccgcccttagaaccacgctattttccttttactttcgggacaccccccgcgccaaccgactgggcccactgccgttttggctgttatactgttgtccagtgtgtctgcaattttttacattgacactgatgaacctgtattttgctcaggttgtgtttaaagctaaagttaagcgccggcccgaaatgtag

SEQ ID NO: 42447 - DNA, 504 bp, Artificial Sequence
  Description of Artificial Sequence: Synthetic coding sequence
atggagagcaacctgagcggcctggtgcccgccgccggcctggtgcccgctctgcctccagcagtaactctcggactgactgctgcttacactactctctacgcgttgcttttttttagtgtctatgcacagctgtggttggtgctactgtatggccacaaacgactgagctaccagaccgtgtttttggcactctgtctactgtgggcagccctccggactactctgtttagcttctacttccgcgacacacctagggcgaaccgccttgggcccttgcctttttggcttctctactgctgtcctgtgtgcctacagttcttcacattaaccctgatgaatctctacttcgcacaggtggtcttcaaggcaaaggtaaagcgcaggccagagatgtcacggggcctgctggctgtgaggggagccttcgtgggggcttcactgctgttcctgttggtgaacgtgttgtgcgcagtgctgtcacataggcgccgagcacaatag

SEQ ID NO: 42448 - DNA, 192 bp, Artificial Sequence
  Description of Artificial Sequence: Synthetic coding sequence
atggagagcaacctgagcggcctggtgcccgccgccggcctggtgcctgccctgccgcccgccgtcacactcggcctaacggccgcctacactacactgtacgccctcctgttcttcagcgtgtacgcacagctgtggctcgtgctgctgtacggccacaagagactgtcttaccagactgtgttcctttag

SEQ ID NO: 42449 - DNA, 663 bp, Artificial Sequence
  Description of Artificial Sequence: Synthetic coding sequence
atggagagcaacctgagcggcctggtgcccgccgccggcctggtgcctgccctgccgccagccgttaccttgggattaaccgctgcttataccacactctatgcattacttttcttttctgtttatgcacaattatggctagtgctcctctacggccacaagagactgagctaccagaccgtgttcttggccctgtgtctgttgtgggctgctcttaggaccaccctgttctccttctactttcgcgacacacctagggctaacagactcgggccactgccgttttggcttctgtattgctgccccgtctgcttgcagttcttcacattaacgctgatgaatttatactttgctcaggtcgtcttcaaggccaaggtcaaacgaagaccagagatgtctcgcggtctgctggcagttcgaggcgcttttgtgggcgcgtccctactattcctgctggttaatgtcctttgcgctgtgctgtctcaccgccggagggctcagccgtgggcccttctactggtgagagtgttggtctctgatagcttgttcgtaatctgcgcgctgtccctggccgcatgcctctgcctcgtggctaggagagcaccctctacatcgatatatcttgaggccaaggggacatccgtgtgccaagccgccgcttag

SEQ ID NO: 42450 - DNA, 963 bp, Artificial Sequence
  Description of Artificial Sequence: Synthetic coding sequence
atggagagcaacctgagcggcctggtgcccgccgccggcctggtgcctgcattgccccccgcagtgactctcggactgacggctgcttatacaaccttatatgctttgctcttcttcagtgtctatgcgcagttgtggcttgtactgctctatggccacaaacgtttgagttatcaaaccgtattcctggcactatgtctcttgtgggctgctctcaggacaaccctgttcagcttctacttcagggatactccccgcgcgaacaggttaggccccctgccattctggttgctgtattgctgtcctgtgtgcctgcaattttttaccctaacactgatgaatttatatttcgcccaggtggtgtttaaggctaaggtgaagcggaggcctgagatgagcagagggctgcttgcagttcgcggcgccttcgtgggagcctcactgctgtttttgctggtgaacgtgctgtgcgctgtgctttcacaccgccgacgggctcagccttgggcattgcttctggtgagggtcttggtgtccgactcccttttcgtgatttgcgccctgtcactagctgcttgtctgtgcctggtagcacgccgggcaccttcaacatcaatctacctggaggctaaagggacatccgtttgccaagcagcagctatgggtggtgccatggtactcttgtacgcatctagagcttgttataacctcacggccctggccctggcaccacaatcacgtcttgacaccttcgactatgactggtataatgtatccgatcaggcagatctagtgaatgatctcgggaataaggggtatctagtgttcgggctgattttgtttgtgtgggagctcctccctacaactctgctggtcggtttctttagagtgcacagacctcctcaggatttgtatgtgggacaatcacgactatgggagcttgtgtggtgccacagggcctag

SEQ ID NO: 42451 - DNA, 237 bp, Artificial Sequence
  Description of Artificial Sequence: Synthetic coding sequence
atggagagcaacctgagcggcctggtgcccgccgccggcctggtgcctgccttacccccagctgtcacattgggattgactgcagcctacacgaccctatatgcgctgctttttttttccgtatacgcgcagctgtggctggtgctgctgtacggacacaagaggctctcttatcaaacagttttcctggccctgtgcctcctatgggccgcattgaggaccactctatttagttag

SEQ ID NO: 42452 - DNA, 636 bp, Artificial Sequence
  Description of Artificial Sequence: Synthetic coding sequence
atggagagcaacctgagcggcctggtgcccgccgccggcctggtgcccgccctgcccccagctgtcactctcggtctgaccgctgcatacacgacactctacgcactgttattcttctctgtgtatgctcagctgtggttggtcctactatacgggcacaaaagactgagttaccagacagtcttcctcgcgctgtgtctgctctgggcggccctgaggactacattgttctctttttactttagagataccccaagagccaaccgactcggacccctccccttttggctgctatattgttgtcctgtctgtctgcagttctttacacttaccctcatgaatctgtattttgctcaagtggtgtttaaggcaaaggtgaagagacgcccggaaatgtctcgaggcctgttggccgtgaggggtgcatttgtgggggcttccctactgtttctgctggtgaacgttctgtgcgctgttctttcccacagaagaagggcccagccttgggccctattactggttcgcgttctggtttcggactcccttttcgtgatttgtgccttgagtctcgcagcatgcttgtgtctggtcgccgggggtaggccaccccttgccagtacctggcgacccaggtag

SEQ ID NO: 42453 - DNA, 723 bp, Artificial Sequence
  Description of Artificial Sequence: Synthetic coding sequence
atggagagcaacctgagcggcctggtgcccgccgccggcctggtgccagctctccctccagccgtgacactcggcctgaccgccgcgtacactactctgtacgccctgctgtttttctccgtatatgcccaattgtggctagtattattgtacggccacaaaagattgagttatcagactgtgtttcttgcactgtgcttgctgtgggccgcgctcagaaccaccttgttctcattttacttcagagacacccctcgcgcgaatcgcctgggccccctccccttttggctcctgtattgttgccccgtgtgtctacagttcttcacgttgactctgatgaatctttatttcgcacaggttgtctttaaggctaaagtcaaacgccgccccgagatgtcgcggggcctgctggctgtgcggggagctttcgttggagcatcactactcttcctcctggtgaacgtcctgtgcgcagtactgagtcatcgaaggagagctcagccgtgggcgttgctgcttgtccgtgtcctagtttcagatagtctctttgtgatctgcgcactcagccttgccgcatgcctctgcctcgtggcgcgccgcgccccctctacatcaatttacctggaagccaagggcaccagtgtatgccaggccgccgcaatggggggggcaatggtgctgctctatgcaagcagggcctgttataacttaaccgcactctag

SEQ ID NO: 42454 - DNA, 702 bp, Artificial Sequence
  Description of Artificial Sequence: Synthetic coding sequence
atgcggcccgagcggccccggccccggggcagcgcccccggccccatggaaactccaccttgggaccccgctagaaatgattcattacctccaactctcacaccggcagtgcctccttacgtaaaactaggccttactgtcgtgtacaccgtcttttacgcccttttgttcgtgttcatttatgttcagttgtggttggtactgaggtaccggcacaaacgcctgtcttaccagtctgtgttccttttcctctgtttgttctgggcatctttgaggaccgtgctgttctccttctacttcaaggattttgtggccgccaactccctcagcccctttgttttctggttactgtattgcttcccggtctgtctgcagtttttcacacttaccctgatgaacttatatttcactcaaggtagttctgtgtgccaggtcactgccatcggagtgacagtgattctgctctatacgagtcgcgcttgttacaacctgttcattctgtcctttagccagaataaatcagtccattccttcgactacgactggtacaatgtatctgatcaggtatccggcggggcagaggaggttagtcccgaccaggggctcctggtttcaagcaggcactggttccaggaccctagaaagtaccaaaatctcgacgcacaggtgcccgatattaaatggtgttccatatgcatatag

SEQ ID NO: 42455 - DNA, 1200 bp, Artificial Sequence
  Description of Artificial Sequence: Synthetic coding sequence
atgcggcccgagcggccccggccccggggcagcgcccccggccccatggagacccccccctgggatcccgcgagaaatgattccttgccccctaccctgactcctgctgtgccaccatacgtcaagcttggcctgaccgttgtgtatacggtgttttatgcactcctgtttgtgttcatctacgtgcagctatggttagttctgagataccgccacaagagactgtcttaccagtccgtgtttctgttcctgtgtcttttctgggcttcgctccgtacagtgttgttcagcttctatttcaaggatttcgtcgccgcaaactctcttagcccctttgttttctggttgctgtactgctttcctgtatgtctgcagttctttactttaacactcatgaacctgtacttcacacaggtgatattcaaagctaaatctaagtactctcctgagctattgaagtacaggctgcctctgtatctagctagtttgtttatctcccttgtcttcctcctggttaacttaacctgtgccgtgctggtcaaaacaggaaattgggagagaaaggtgattgtgagcgtgagagttgccattaacgataccctgttcgtactgtgtgctgtttcactgtccatctgcctatacaagatttccaagatgtctcttgccaatatctatcttgaaagcaagggtagcagtgtgtgccaagtgaccgccatcggagtgacagtgatccttctgtatacaagccgcgcctgctataacttgtttatcctgagctttagccagaacaagtcagttcatagttttgactacgattggtacaatgtttcagaccaggcagacctgaagaaccaattgggcgacgctgggtacgtgctgtttggagttgtgttatttgtctgggagttgttgcctaccactctggtagtttacttctttcgcgttagaaaccctaccaaggaccttaccaacccaggcatggtcccgagtcatggattctcaccgagaagttattttttcgataaccccagacgttatgatagcgacgatgacctcgcatggaacatcgcccctcagggcctgcagggggggtttgccccagattactacgactgggggcagcagaccaactcctttcttgcccaggccgggaccctccaagatagcacactggaccccgataaaccatctctcggttag

SEQ ID NO: 42456 - DNA, 1197 bp, Artificial Sequence
  Description of Artificial Sequence: Synthetic coding sequence
atgcggggcgacccccggccccggggcagcgcccccggccccatggagacccctccgtgggaccccgcccggaacgatagcttaccaccaacacttacacctgcagtgcctccttacgtgaaactcggtctcacagtggtgtacactgtgttctatgcacttctgttcgtttttatctatgttcagctgtggctggtgctccgctatcgtcacaagaggctcagttaccaatccgtatttttgtttttgtgtttattttgggcttcactgaggacagtcctgttcagcttttacttcaaggattttgtggccgcaaacagtctgagcccattcgttttttggctcctgtattgtttccccgtgtgtctgcagttcttcacactgacattgatgaacctgtatttcacacaagtcatcttcaaagcaaaatcaaagtactcccccgaactcctaaagtataggctgcccctgtacctcgctagccttttcatctccctggtgttcctgcttgtaaacctgacatgtgccgtcctggttaagacggggaattgggagcgaaaagtgattgtgagcgttagagttgcaattaatgacacactgtttgtcctatgcgccgtgagtttatccatctgtttgtataagatttccaaaatgagccttgccaacatctatctcgagtccaaaggaagcagtgtttgtcaggtcacagcgattggggtgacagtcattctcctctacacaagtagagcttgttacaatctgtttattctttcgttcagtcagaataagtccgtgcactcttttgattatgactggtacaatgtttcagatcaagcggacctaaagaatcagttgggagatgcaggttacgtgctgttcggtgttgtgctcttcgtgtgggaactgctacccactacactggtcgtgtatttcttcagagtgaggaacccaaccaaggacttgaccaatccaggaatggtcccatcccatggtttctcaccacggtcgtatttctttgacaatccacgcaggtacgatagtgatgatgatctggcgtggaatatcgcgccacagggccttcagggagggttcgcacccgactattacgattgggggcagcaaactaactcattcctggcgcaggccggcacccttcaggactcaacactcgaccctgataagccgtccctggggtag

SEQ ID NO: 42457 - DNA, 387 bp, Artificial Sequence
  Description of Artificial Sequence: Synthetic coding sequence
atgagcctggccaacatctacctggagagcaagggcagcagcgtgtgtcaggtaactgcaataggggtgaccgtgatacttttatatacatctcgcgcatgttacaatttattcatcctgagcttctcccaaaacaaaagcgttcactcattcgactacgattggtacaacgtttcagatcaggccgacttgaagaatcagttaggggatgctgggtacgttttattcggagtggtcctgttcgtgtgggagctgctgcccactacgttggttgtgtattttttccgcgtcagaaacccaacaaaggacttgacaaatcccggcatggtcccttcacatggattttcaccacgctcctatttttttgacaacccccgccgctactag

SEQ ID NO: 42458 - DNA, 693 bp, Artificial Sequence
  Description of Artificial Sequence: Synthetic coding sequence
tgacaggtgatcttcaaggccaagagcaagtacagccccgagctgttaaagtacaggctccctctgtacctcgcctcactgtttatcagtctcgtgtttttgttggtgaatctaacatgcgcggtcctcgtgaagactggtaactgggagaggaaagtgatagtcagtgtgagggtcgcaattaatgatacactcttcgttctgtgcgctgtatccctctctatctgcctctataaaatctctaaaatgtccttagccaatatctatcttgagtctaaaggcagtagcgtgtgtcaggtgacagccataggggtaactgtgatccttctgtatacaagccgggcttgttataatctctttatcctcagcttcagccaaaataaatccgtgcactccttcgattatgattggtataacgtaagtgaccaggcagacctgaaaaaccaattgggagacgccgggtatgtgctgtttggtgtggttttattcgtctgggagcttctgccaacgacactggtggtgtatttcttcagagttagaaatcccaccaaggacctgactaaccctggtatggtgccaagtcacgggttttctcctcgttcctacttcttcgataatccaaggcgatatgacagcgacgatgacttggcctggaacatcgcaccccaggggttgcagggggggctactctag

SEQ ID NO: 42459 - DNA, 1290 bp, Artificial Sequence
  Description of Artificial Sequence: Synthetic coding sequence
atgcgggtgagcgtgcccggccccgccgccgccgccgcccccgccgctgggcgggagccgagtactccgggaggggggtccggaggtggcggcgctgttgccgccgcttccggagcagccgtgcccggtagtgtccaattggccctttccgtactccacgccctgttgtacgcggcactcttcgcgtttgcatacctgcaactctggcggctcctcttgtatagagagcgacgcctgtcttaccaaagcctctgcctgtttctctgcctgctgtgggcagccttgcgcaccaccctgttttcagcggccttttcactgtccggctctctcccgctgttaagaccacccgcacatcttcatttttttccacattggcttctctattgttttccgagctgcctgcagttttctaccctctgcctgctgaatttgtacctagctgaagtgatctgtaaagtccggtgcgcaaccgaacttgacaggcacaaaatactcctccacctgggctttatcatggcgtccctgctatttctggtggtaaatttgacctgtgccatgctggtgcacggtgatgtgccggaaaaccagctgaagtggacggtgttcgtacgcgccctgataaacgactctctctttattctgtgtgctatatcactcgtgtgttacatatgtaaaattacaaagatgtcctcagccaacgtatatcttgagtccaagggcatgagcctgtgccagacagtggtcgttgggtctgttgtgatcctcctgtattctagccgcgcatgctacaacctggtggtggtcacaatatcgcaggatacactggagagcccttttaactatgggtgggacaacctgtctgataaagcacacgtggaagacatttccggcgaggagtatatcgtgttcggcatggtactatttttgtgggaacatgtgccggcctggtctgtggtcctcttttttcgggcgcagcggctgaaccagaatctggctcctgccggtatgattaacagtcacagctatagctcccgtgcttatttttttgacaatccgcgacggtacgattccgacgatgacctccctaggctcggttcctcaagagaagggtcgttgccaaattcacagtctttaggctggtacggaacaatgaccgggtgtgggtcttcatcatacactgtgacgccccatcttaacggaccaatgacagacaccgctccgcttctctttacttgcagtaatctggacctaaacaaccaccattcgctttacgtcacacctcagaattag

SEQ ID NO: 42460 - DNA, 1062 bp, Artificial Sequence
  Description of Artificial Sequence: Synthetic coding sequence
atggagcacacccacgcccacctggccgccaacagcagcctgagctggtggagtcccgggtctgcttgtggcctgggatttgtgccagtggtgtattactcccttctcctctgcctgggactgcccgcaaatatcctgaccgtcattatcctgagtcagctcgtggcccgcaggcaaaagagcagctacaattatctgcttgccctggctgccgcagatatcttggtgctgttttttattgtgtttgtggattttttactggaagattttatcctgaacatgcaaatgccacaggtgcccgataagattatcgaagtgctcgaattctctagcatccacactagcatttggattacagtgccactcactattgacaggtacatcgccgtctgtcaccccctgaaatatcataccgtgtcgtatcccgcccggacacgcaaggtgatcgtgtcagtatatataacttgctttttaaccagcatcccctattattggtggcctaatatctggaccgaagactacatttccacaagcgttcaccacgtactcatttggatacactgcttcacagtgtaccttgtgccatgctcaatcttctttattttgaatagtattattgtgtataagctacgcagaaagtcaaacttcaggctcagaggctacagtaccggcaaaacgacggcaatacttttcacaatcacttctatatttgccactctgtgggccccccgaattattatgatcctttatcatctgtacggagcacccatccagaacaggtggctggtgcacataatgtccgacatcgccaacatgctcgctttacttaacactgctatcaatttctttctgtattgtttcatatccaagcgatttcgaacaatggcggccgccactctcaaggccttttttaagtgccagaagcaacctgtgcagttttatacaaaccataatttctcaatcacttcatcgccatggatttcaccagccaacagtcactgcatcaagatgctggtgtatcagtacgacaagaacggcaagcccattaaggtgtctccttag

SEQ ID NO: 42461 - DNA, 1062 bp, Artificial Sequence
  Description of Artificial Sequence: Synthetic coding sequence
atggagcacacccacgcccacctggccgccaacagcagcctgagctggtggtcgcccggctccgcctgtgggctggggtttgtacccgtcgtgtactatagtctgttactctgtctgggccttcctgcaaacattttaacggtgatcatcttatcgcagctggtggccaggcgccagaaatcgtcctataactacttgttggcacttgccgcagctgatatcttggtgcttttctttatcgtctttgtagacttcctacttgaagatttcattttaaacatgcagatgccccaggtgccagacaaaataattgaggtgctggagttcagcagtatccacaccagcatttggattacagtgccactaaccatagaccgttacatagcagtgtgccacccgctaaaataccataccgtttcatacccagcaaggaccagaaaagtgatcgtcagtgtctacatcacctgcttcctcacaagcatcccctactactggtggcctaacatttggacagaggactacataagtacatcagtgcaccacgtgcttatatggatccattgctttacggtgtatcttgtaccctgttctatattcttcatcctgaatagcataattgtgtataagctgcgaaggaaaagtaatttccggttgagagggtactctacagggaaaacgaccgcaatcctgttcacaattactagcattttcgcaacactttgggctccacgtattataatgatcttgtaccacttatatggagctcccatacagaatcgatggcttgtacacattatgtcggacatcgccaacatgctggctctgctgaacacagccattaacttctttctgtattgcttcatctctaaacgcttcagaacaatggccgcagcaaccctgaaagcattttttaaatgccagaaacagcccgtgcagttttataccaatcacaacttctccattacctcatcaccttggatctcaccagctaacagccattgtatcaaaatgctcgtgtatcagtatgacaagaatggcaagccgattaaagtcagcccctag

SEQ ID NO: 42462 - DNA, 918 bp, Artificial Sequence
  Description of Artificial Sequence: Synthetic coding sequence
atgcccggccacaacaccagccggaacagcagctgcgaccccatcgtgacccctcatctgatctcactctacttcatagtactgattggcggcttggtgggcgtaatttcaattctcttcctgctggttaaaatgaatacccgatccgtcacgacaatggccgttattaatctcgtagtggtccattccgttttccttctgacggtccccttccggcttacttatctgatcaaaaaaacatggatgttcggcctcccattttgcaagttcgtttccgcaatgctgcatatccatatgtacctgacgtttctgttttacgttgtaatcttagtaacgcgctacctgatctttttcaaatgtaaggataaggtggagttttacaggaaattgcacgcagtcgctgctagcgcgggcatgtggactctggtcatcgtgatcgtggtgcctctggtagtttcacgatatggtatccatgaagagtataatgaagaacattgcttcaaattccacaaagaactggcctacacatacgtgaagattatcaattacatgattgtgatttttgtgatcgccgtggcggtgatcctgctggtttttcaggtgtttatcatcatgctcatggtgcagaaactcaggcattcactgctttctcaccaggaattctgggctcagctgaagaatcttttctttattggagtgattctcgtgtgtttcttgccttaccagtttttccgcatttactacctgaatgtagtgacacactcgaacgcctgtaactccaaagtggccttctacaacgagatttttttgtcagtgaccgcaatttcgtgctatgatttgttactattcgttttcggtggtagccactggttcaagcagaaaatcattggcctgtggaattgtgtgttatgccgctag

SEQ ID NO: 42463 - DNA, 918 bp, Artificial Sequence
  Description of Artificial Sequence: Synthetic coding sequence
atgcccggccacaacaccagccggaacagcagctgcgaccccatcgtaacaccccacctcatctcgctgtatttcattgtgctgattgggggactggttggtgtgatcagcatcctgttcttgctggtgaagatgaataccagaagcgtgaccaccatggcagtgattaacctggtagtagtgcactccgtctttctattaaccgtgccttttcgactgacgtatttaataaaaaagacctggatgttcggcctgccattttgtaagttcgtatctgccatgttacacatacacatgtacctcacatttctcttttatgtggtcatcttggtgacacggtacctcatctttttcaagtgcaaggacaaggtggagttttatcggaagttacacgccgtcgccgccagtgccggtatgtggacactcgtcattgtgatcgttgtcccactggtcgtgagtcggtacggtattcatgaagaatataatgaggagcattgttttaaatttcacaaagaactagcttatacctatgtgaagatcattaactatatgattgttatattcgtcatcgcggttgcggtaatattactcgtgtttcaggtcttcattatcatgctcatggtgcagaagctccgtcattctctgctgtcccaccaggagttctgggcccagctgaagaatctgttttttattggggtcatcctggtctgctttcttccataccaattttttaggatctattaccttaacgttgttactcattccaatgcctgtaatagtaaagtcgcattctataatgaaatcttcttgagtgtgaccgccattagctgttacgacctactccttttcgtcttcggaggaagccactggttcaagcagaagatcataggactttggaactgcgtgctctgtcgctag

SEQ ID NO: 42464 - DNA, 315 bp, Artificial Sequence
  Description of Artificial Sequence: Synthetic coding sequence
atgcccggccacaacaccagccggaacagcagctgcgaccccatcgttactccccacctgatctccctgtatttcattgtccttataggtgggctggtgggcgtgatttctatcttatttctgcttgtgaaaatgaatactaggtcagtgaccaccatggccgttattaacttggtcgttgtccactccgtgttcctcctgacagtcccgttcagactgacctacctgatcaagaagacgtggatgtttgggctccccttttgtaaattcgtatcggctatgctgcacattcatatgtatctgacgttcctgtag

SEQ ID NO: 42465 - DNA, 1389 bp, Artificial Sequence
  Description of Artificial Sequence: Synthetic coding sequence
atgagcatcatgatgctgcccatggagcagaagatccagtgggtgccaacttccctgcaagacattacagcagtgctgggtacggaagcctacaccgaggaggacaagagcatggtgtcacacgctcagaagtctcagcacagttgtctgtctcatagccggtggttaagatcaccccaggtaacaggaggcagctgggatctacggattaggccgagcaaggacagctccagcttccgccaggcccagtgcctaagaaaagatcccggagctaataaccacttagaatcgcagggagtgcgaggaacggccggcgatgcggatagagaattgcgcggccccagcgaaaaggccacggccgggcagcctcgcgttacactgttgcccaccccacacgtctcgggtctctcccaggagttcgagtcgcattggcctgaaattgccgagcgttcgccatgtgttgcgggcgtgattcccgtgatctactactccgtcctgcttggtctcggactccctgtctcgcttttaacagccgtcgccctcgcaaggctcgctactcgcaccaggcgaccttcttactattatttgctcgccctgacagcctcggatattattattcaagtcgtgatagtttttgccgggttcttgcttcagggggctgtactcgctcgccaggtgcctcaagctgtggttcggacagctaacattctggaatttgccgcgaaccatgccagcgtgtggatcgccatcctcctgaccgtcgaccgctatactgctctgtgccatcccttgcatcaccgcgctgcttcgagcccaggacggacacgtagggccattgctgccgtactgagcgccgcgctgctgactggaattccgttttactggtggctagacatgtggcgggacactgattcaccacggaccctggatgaagtgctgaaatgggcccactgcttaaccgtgtactttataccctgcggtgtgtttctcgtcaccaacagcgccatcattcaccgcctccgacgacgcggacggtccggactccagccgagagtggggaaaagcacggccatacttctcgggatcacgacactgtttactttgctctgggccccccgcgtttttgtcatgctgtaccacatgtatgtcgcccctgtccatagggattggcgcgtccatctggcactggacgtggctaatatggtagcaatgctgcacaccgccgcaaacttcggcctgtactgctttgtgagcaaaacatttcgtgccacagtgcggcaggtaattcatgatgcatacttaccctgcacacttgccagccagcccgaaggcatggcagcaaagcctgtgatggagccccccgggctcccgaccggtgcagaggtctag

SEQ ID NO: 42466 - DNA, 2892 bp, Artificial Sequence
  Description of Artificial Sequence: Synthetic coding sequence
atggacgccccctggggcgccggcgagcggtggctgcacggcgccgcagtggataggtccggggtcagcctcggccccccaccaaccccacaggtgaaccaaggcactcttgggcctcaagtggcgcccgtcgccgccggcgaggttgtgaagactgccggtggcgtttgtaagtttagcggacagagactatcctggtggcaggcacaggagtcctgcgagcaacagttcggtcacctagctcttcaacctccagacggcgtcttagccagccggctgcgcgacccagtgtgggtagggcagcgggaggccccgctacgtagacctccccagcggagagcccgcaccactgccgtgctagtcttcgacgagagaacagccgacagggccgctcgcttacgatcaccactgcccgagctggcggccctgacagcctgtactcacgtgcagtgggactgcgcctctcccgacccagcagccctgttttccgttgcagccccagctcttccaaacgcgctgcaactgcgggcgttcgctgaaccaggcggagtggtccgggccgctctcgtggtcagagggcagcacgctccctttcttgcagctttcagggccgatggacgttggcatcatgtgtgtgccacatgggagcagcggggcggtagatgggcgctttttagcgacgggcgcaggcgggccggcgctcgaggcctaggggcagggcatcctgttccttccggcggcatactggttcttgggcaggatcaggactctcttggcggggggttctcagtccgccatgccctgagcggcaacctcactgactttcacttgtgggctagagcgctgtcaccagcacagctgcacagggctagggcctgcgctcccccttctgagggccttctctttcggtgggatcccggtgccctcgacgtgacaccgtctctactgcctacggtgtgggtgaggctgttatgccccgtgcctagcgaggaatgtcccacctggaatcccggcccccgctccgagggttctgagctgtgcctggagccgcaacccttcctttgttgctaccgtaccgagccctacaggagattgcaggatgcccagagctggcccggtcaagacgtcatctcccgtgtgaatgcccttgccaatgatatcgtgttactgcctgatccactcagtgaggtgcatggggctctgtcgcctgctgaagcctcctccttcttaggccttttggagcacgtgctcgccatggaaatggcccccctaggcccggctgccctcctggccgtcgtacggttcttaaaacgcgtcgtcgccctgggcgcaggagacccggagctgttgctcactggcccatgggagcagttatcccaaggtgtggtgagcgttgcctccttggtgctggaggaacaggtcgccgatacctggctttctctccgggaggtcattgggggccctatggccttggtcgcctccgtccagcgccttgccccgctcctcagcacctccatgacgagtgaaaggccaagaatgcgaattcagcatagacatgccggcctgtctggcgtgacagttattcattcgtggttcacgtctcgggtttttcagcacacattagaaggcccagacttagaaccacaggctccagcttcatccgaagaggcaaaccgcgtccagaggttcttgtccacacaggtcggtagtgccatcatctcctccgaagtgtgggacgttacaggggaggtgaacgtggcaatgacattccatttacaacaccgggctcaatctcctctctttccacctcatccccccagcccatacaccgggggcgcgtgggccaccacgggctgttccgtggcggctctttacctggatagtacagcatgtttctgtaaccatagtacatcatttgcgattctgctacaaatctacgaagtacaaaggggtcctgaagaggaatccctcctccgaaccctctccttcgtaggctgtggcgtctccttctgcgcactgactacgacgttcctcctgttcctggtagccggcgtcccaaagtccgagaggaccactgtccataaaaatctgaccttcagcttggcctcagccgaaggatttctaatgacgtctgaatgggcaaaggcgaatgaagtggcctgcgtggctgtcacggttgccatgcatttcctgtttttggtagcttttagttggatgttggtagagggactgctgctctggcgtaaggtcgtggctgtgagtatgcatccaggccccggtatgaggttgtatcacgcaaccgggtggggggttcctgtcggtatagtagctgttaccctcgccatgctgccacacgattatgttgcacctggccactgctggctgaacgtccatactaatgcgatctgggccttcgtggggccagtgctgttcgtgttgaccgccaatacctgcattcttgccagggtggtaatgattaccgtgtcttctgcgcgaaggcgggcaagaatgctgtccccccagccatgccttcagcagcagatttggacacagatatgggcaacagtgaagcccgtattagtcctactaccagtgttaggacttacttggctggccggcatcctggtgcaccttagccctgcctgggcgtacgccgctgtcggtctgaacagcattcaggggctgtacatctttcttgtttacgccgcatgcaacgaagaggtgaggagtgccctgcagcggatggcagagaaaaaggtagcagaggtgcttcgggcgcttggagtctggggtggcgccgccaaggaacatagtttgcctttttcggttttacctctgttcctgcccccaaagccctcaaccccgaggcatccactgaaagctccagcctag

SEQ ID NO: 42467 - DNA, 1104 bp, Artificial Sequence
  Description of Artificial Sequence: Synthetic coding sequence
ctgaccgacttccacctgtgggcccgggccctgagccccgcccagctgcacagagccagggcttgtgcccccccgagcgagggactgctgtttaggtgggacccgggcgcattggacgtaaccccctccctgcttcccacggtttgggttcgtttactgtgcccagagccttacagacgcctccaggacgctcagtcatggccggggcaggatgtaatctcacgggtgaatgccctggctaacgacattgtgctgctccctgaccccctttccgaggtgcatggggcactctcgccagctgaagcaagcagcttcctgggacttcttgaacatgtactggccatggagatggctccgctggggccagccgccctcttagccgtcgtcagatttctcaagcgtgtagttgcactcggagccggcgacccagagctgcttttgacaggaccctgggagcagctcagccagggagttgtttcggtggcttctctggtgttagaggaacaggttatcggaggacccatggctttggtagctagtgtacagcgactggctcctctactgtcgacgagcatgacatccgagcgccccagaatgaggatccagcaccgacacgccggactggaggttaggtcccttcggctgagggaggcctcaacacgcggctgtctgtttaccatgccgggaggcaggcccgaaggacccggccatatccatataccagcatctgaggtgcgcaggctcctgagaaaggggctgtccggcgtgaccgtcattcactcctggtttacttcaagggtgtttcagcacactttggaaggcccagacctcgaaccccaggctcctgccagctctgaggaggctaacagagtccaacgctttctgagcacgcaggtgggctcagctatcatttcatcagaagtctgggacgtgacaggggaggtaaatgtcgcgatgacattccatctgcaacatcgcgctcagcccatatatcggggttgcctcggtcaccatcgcttgttaaggggctgcccagttcccggccttcacaggctactactgcagcctcagcaccaactgtgtcacccagcggcaaatctctag

SEQ ID NO: 42468 - DNA, 393 bp, Artificial Sequence
  Description of Artificial Sequence: Synthetic coding sequence
agcggcggcatcctgctggacgccggcggcggcgccgccgccgtggaagagggtgggtcttgcgaacacgcgcctggacctcgacatgcagctctcccacgacaccgtttaggtgcgactgtgaaaccggtactggtactgcttcctgtccttggactgacatggcttgcagggattctggtacatctgtccccagcatgggcttacgcagcggtcggcctgaacagcatacagggcttatatatatttctggtgtacgcagcctgcaacgaagaggtacgcagtgcgctgcagagaatggctgaaaagaaagttgccgaaggacccatggccctggagctcccacagcattctccacccctccagacacgccgcgatcgcttatggaattag

SEQ ID NO: 42469 - DNA, 105 bp, Artificial Sequence
  Description of Artificial Sequence: Synthetic coding sequence
atgcaccccccccccagcctgctgagcttcctggcccccgtggccgctggagaagtagtgaagactgcaggcggagtgtgcaagtttagtgggcagcggttgtag

SEQ ID NO: 42470 - DNA, 1002 bp, Artificial Sequence
  Description of Artificial Sequence: Synthetic coding sequence
atgtggagctgcagctggttcaacggcaccggcctggtggaggagctgccagcctgccaggacctccagttgggactgtctttgctctccttgctggggctggtcgtcggcgtgcccgtcggtctgtgctataatgcactgttggtcttggcgaacctccacagcaaggcctccatgactatgcctgacgtgtattttgtgaacatggctgtggctgggctggtcctctctgctctcgcacctgtgcaccttcttggccctccctcatctaggtgggctttgtggagcgtgggaggggaggtccacgtcgccctccagatccccttcaatgtttcttccctggtcgctatgtattcaacagctttgctcagcctggaccattatatagagcgggccctcccacgaacatatatggccagcgtttacaacactcgccatgtatgtggcttcgtgtgggggggggctttactaacctcattttcttccctactgttttatatttgctcccatgtaagcactagggctttagagtgtgccaagatgcagaatgctgaggcagctgatgccaccctcgtgttcattggctacgttgtgcccgccttggctaccctgtatgcccttgttctcttgagcagggtgcggagagaggataccccgctggatagagatacgggaaggcttgaacctagcgcccacaggcttctggtcgccacggtttgcacccaatttggcctctggacccctcactatctgatccttctgggccacaccgtgatcattagcaggggcaagcccgtcgacgcccactatctgggcttgctccatttcgtcaaagatttttccaagctcctggccttcagtagcagcttcgtgactccactgctgtatcgctatatgaaccaatcgtttccgagcaaactgcagaggctaatgaagaagctgccttgcggcgatcggcactgtagccctgatcatatgggagtacagcaggtgctggcctag

SEQ ID NO: 42471 - DNA, 1002 bp, Artificial Sequence
  Description of Artificial Sequence: Synthetic coding sequence
atgtggagctgcagctggttcaacggcaccggcctggtggaggagctgccggcatgtcaggacctgcagctggggctgtcgcttctgtcattattggggctggtagtgggcgtccctgtgggcctttgttataacgctctgcttgtcctggcaaacctccattcaaaggcatcaatgaccatgccggacgtgtactttgttaacatggctgttgcgggacttgtcctgagcgctttggcacccgtgcatctccttggcccaccctcatctcggtgggccctatggtctgtgggtggcgaggtgcacgtcgctcttcagatcccattcaacgtgtcatcgttagtcgctatgtactctaccgctcttctatctctggaccattacattgagagggccctcccaaggacctatatggcatctgtgtacaacacaagacatgtctgcggcttcgtgtggggtggggctttgctgacctcattctccagcctcctcttttacatctgttctcatgtgagcacgagagccctcgagtgtgcaaagatgcaaaacgctgaagctgccgatgccacgctagtattcatcggatacgtggttccagcgctggccactttgtacgcactagtacttctgagtagggttagaagagaggacacaccacttgaccgtgatactggccgcctggagcccagcgcccaccgactgctggtggctaccgtctgtactcaattcgggctctggacaccccactacctgatattactgggacatactgtcataatcagccggggtaaaccagtagacgctcactacctgggcttactccactttgtgaaggactttagcaagctccttgcattctcttcatcctttgttacccccctgctctatcggtacatgaaccagtcattcccctcgaagctccagagactcatgaagaagctgccctgtggcgatcgtcattgcagccccgatcacatgggagtgcagcaggtgctggcgtag

SEQ ID NO: 42472 - DNA, 948 bp, Artificial Sequence
  Description of Artificial Sequence: Synthetic coding sequence
atgtggagctgcagctggttcaacggcaccggcctggtggaggagctcccagcctgccaggacctgcaactggggttatcgctgctctcattgctgggattggttgtgggcgtacctgtcggcctgtgctacaacgctttgctagtgttagcgaacctgcacagtaaggcaagcatgactatgccggacgtgtattttgtgaatatggctgttgccggcctggtactgtctgctctggctccagtccatctgcttgggccaccatctagcaggtgggccctgtggagcgtgggcggcgaagtacacgttgctctgcagatcccttttaacgttagttcactggtcgctatgtactcaactgcactactgagtctggaccattacattgaaagagcgttaccgcgtacatatatggcttcggtttacaatactcggcacgtgtgtggttttgtgtggggaggagctctgctgacatccttcagttctttgcttttttatatttgcagccacgtttccaccagggcccttgaatgcgccaaaatgcagaacgctgaagcggctgacgctacgttagtcttcatcggctacgtggtaccggctctcgctaccttgtacgctctcgtattgttgtcccgcgtcaggcgcgaggatacccccttggacagagatacaggaagactcgagcctagcgcccaccgcttgttggtcgctacagtatgtacccaatttgggctgtggactcctcactatctgattctgctgggccacaccgtcattatctcaagaggaaagcccgttgatgcacactaccttggcctactccactttgtgaaagattttagcaaactgctcgcattctcaagcagtttcgtcacacccctgttgtatcggtacatgaatcaaagcttcccatccaaacttcagaggttgatgaagaagctgccgtag

SEQ ID NO: 42473 - DNA, 756 bp, Artificial Sequence
  Description of Artificial Sequence: Synthetic coding sequence
atgctgctgggcccccccagcagccggtgggccctgtggagcgtgggtggagaggttcatgtggcgttacagattcctttcaacgttagcagcctcgtagctatgtactcaacagccctccttagcctggatcattacattgaaagggcccttccaagaacatatatggccagcgtttacaatactagacacgtctgtgggttcgtgtgggggggagcgctgctgacaagtttctcctcactcttattctacatctgcagccatgttagcactagggccctggagtgtgccaagatgcagaatgcagaggccgctgacgctactttggtttttataggttatgtcgtgccagcacttgctacactctacgctttggtcttgctctcaagagtgagacgggaggatacgcccttggacagagatacgggtcgtctcgaaccatccgctcacagactgttagtggcgaccgtctgcacgcagttcgggctttggactccccactacctgatcctgcttggtcataccgtgattatttcgcgggggaagcccgtggatgctcactatctgggacttctccattttgtgaaggatttttccaagctgttggcatttagtagtagcttcgtgaccccactgctttatcgctacatgaatcagtcatttccctcgaagctgcagcggctgatgaaaaaactgccctgtggcgatcggcattgcagcccagaccacatgggagtccagcaggtgttggcctag

SEQ ID NO: 42474 - DNA, 1044 bp, Artificial Sequence
  Description of Artificial Sequence: Synthetic coding sequence
atgggcgacgagctggccccctgccccgtgggcaccaccgcctggcctgcgcttatccagctgatctctaagacaccctgcatgccacaggctgcaagtaatacatctctgggccttggcgatctgagagtgccttccagcatgctgtactggctcttcctgcctagttccctgctggccgccgccacactggccgtctcaccgttgctgctggtgaccatcctgagaaaccagcgcctccgacaggaaccccactacttgctccccgccaatatactgcttagcgacctcgcctacattctgttgcacatgttaattagttcgagcagcctgggcggttgggaactaggaagaatggcatgcgggattctgactgatgccgtttttgcagcatgcaccagtacgatcctgtccttcaccgccatcgttctccacacataccttgccgtaatccatccgctacgttatctatcctttatgagccatggcgcggcctggaaggctgtggcgctgatctggctcgtggcttgctgttttcccacattcctgatatggctctccaagtggcaggacgcgcagctcgaagagcagggcgccagttatatcctgcccccatctatggggacccagcctggatgcggactgctggtgattgttacttacacgtctatactctgcgtattgtttctttgcacagccctcattgctaactgcttctggcgcatttacgctgaagccaagacctcgggcatatggggtcagggctattcaagggccaggggaacgttgctgatacatagtgtcttgatcacgttgtacgtatctaccggagttgttttttctctcgatatggttctgactagataccatcacatcgactccggtacccatacatggctgctggctgccaacagtgaagtcttaatgatgttgccacgcgcgatgctgacctacctctacttactccgctacaggcaactgctcggaatggtgcgaggccacctccctagtcgtcgccaccaggcgatttttacaatcagctag

SEQ ID NO: 42475 - DNA, 2196 bp, Artificial Sequence
  Description of Artificial Sequence: Synthetic coding sequence
atgagcctgttcctgagcaacctgagcaccaacgacagcagcctgtggaaggagaaccacaactctaccgacttgttgaatccgcccgggacattgaacatttacctgttttgcctcacttgtctgatgacctttgcagctttggtaggaagcatctattccctgatctccttgcttaagatgcagaaccggacagttgtttctatgctggtcgcctcttggtctgtggacgacctgatgtcagttctttcggttactatatttatgtttttacagtggcccaatgaagtgcccggctatttccagtttctttgtactacatccgccctcatgtatctgtgccagggtcttagcagtaatctgaaggcaacattactagtctcctataatttttatacaatgcatcggggagtcggcagccagactgcatcaagaagatctggccaggtgctgggcgtggtgctcaccgtctgggcagcgagcctgctactctctgcccttcccctgtgcgggtggggcgcattcgtgcgaacgccctgggggtgtctggtcgactgctcctcttcctatgtactgttcctctccatcgtgtacgccctggcatttggactccttgtgggacttagtgttcccttgacacaccggcttctttgttctgaagaaccgccccgtctgcactccaactaccaggagatttcccgcggagcctctatacccggaacgcctccaacagccggaagggtggtgagtctatcccccgaagatgcacctgggccatccctgagacgttcgggcggctgcagtccaagcagcgacactgttttcggccccggagctccagcagctgctggagccgaggcatgtcgaagggagaatcgcggcactctgtacgggacccgctcctttaccgtctcagttgcgcagaaaagattcgcactgatccttgccctgaccaaggtggtgctctggcttccaatgatgatgcacatggtcgtccaaaatgtcgtgggctttcagtccctgcctttggaaacatttagtttccttcttacgctgctggcaaccacggtaacccccgtatttgttctctccaagcgatggacccacctgccctgtggatgcatcatcaactgcagacaaaatgcatacgctgtagccagcgatggcaaaaagataaagaggaagggattcgagtttaacctgtcttttcagaaatcctatgggatctacaagattgcccacgaagactattacgatgacgatgagaactcgatcttttaccacaacctaatgaattcggagtgcgagaccacaaaggatcctcagcgggacaaccggaatatcttcaatgctattaaagtagaaataagcacaaccccctctctggattccagcacccagcgcggcatcaataaatgcacaaacaccgacatcacagaggctaagcaagactcaaataacaaaaaagacgccttctccgacaaaacaggaggagatattaattacgaggaaaccactttctctgaaggtccagaacgccggctgagtcacgaggaatcccagaaacctgacctgtctgactgggagtggtgccgctcgaaatcagagcgaactcctcgtcagcgctctggctacgccctggccattcctctgtgtgcctttcaggggactgtgtctcttcacgcgcctacgggaaaaacactctccctgtctacatatgaggtctccgccgagggacaaaaaatcacacctgccagcaagaagatcgaggtttacagaagcaaatctgttggccacgagccaaattccgaagacagctcttctaccttcgtggatacttcagtcaaaattcacctcgaagttcttgaaatttgtgacaatgaggaggccctagacactgtttccatcattagcaacatttcacagtcctccactcaggtgcggagccccagtctgcgatattcccgcaaagagaatcggttcgtgtcttgtgatcttggggagacagctagttattccctctttctgccaacatctaatcccgacggtgatattaatataagcatcccagacacagtcgaagcacatagacagaactctaagcggcaacaccaggaacgcgatggctaccaggaggagatccagctgctgaataaagcttacaggaagcgcgaggaagaaagtaagggaagttag

SEQ ID NO: 42476 - DNA, 1305 bp, Artificial Sequence
  Description of Artificial Sequence: Synthetic coding sequence
atggaggacctgttcagccccagcatcctgccccccgcccccaacatcagtgtgcccatcttgctcggttggggactgaatcttacattggggcaaggggcaccagcatccggcccaccaagccggcgcgtgagactcgtgtttcttggggtgattctggtcgtggccgttgccgggaatactactgtcctgtgcaggctgtgcggagggggtggcccatgggcgggccctaaaagaagaaagatggacttccttctagttcagctcgcactggcagatttatatgcctgcggcggcactgcactgtcacagcttgcgtgggagctgctgggggagccccgggcagccacaggagacctggcatgtcggttcctgcagctgctccaggctagcggcaggggcgctagcgcccatttggtagtattaattgccctggagcgccggcgcgcagtcaggttgccccacggaaggcctttacccgccagggcgctggccgcgctcggatggctactggctctcctgttagctctacctcctgccttcgttgtgcgtggtgattccccttctcctctgccacctccaccccccccaacaagcctacaaccaggggcccctcctgcagcccgtgcttggccgggtgaacgacggtgtcacggcatctttgctcccttgccgcggtggcatcttcaggtgtatgcattttacgaagccgtggctggttttgtcgctccagtgaccgtgctcggggttgcatgcggtcatctgctcagtgtgtggtggcggcatcgtccgcaagcccctgccgcagcagccccatggagcgccagccccggccgtgcccctgcaccctctgcattgccccgtgccaaggtccaatcccttaaaatgtcacttctgctggcactccttttcgtggggtgcgagctgccctactttgcagcacgtttggccgcagcttggtctagcggaccagctggagattgggagggtgaggggctgtctgctgctcttagggtcgtcgccatggcgaacagtgctttgaatccctttgtgtacctgttctttcaagctggtgactgccgcttacgccggcagctgcgtaaaagactggggtcactctgttgtgcgccccagggcggggcagaagacgaagaaggtcccagaggccatcaagctttatataggcagaggtggccacatcctcattatcatcacgctcgccgcgaaccactggatgaaggcggtctgcgaccgcctccaccgcgccctagaccactgccctgctcatgcgaaagtgctttctag

SEQ ID NO: 42477 - DNA, 1260 bp, Artificial Sequence
  Description of Artificial Sequence: Synthetic coding sequence
atgctggccgccgccttcgccgacagcaacagcagcagcatgaacgttagctttgcacatctgcacttcgctggaggctacctgccatcagatagccaggattggcggacaattataccagcactgttagttgccgtttgcctggtcggctttgtaggcaacctttgcgtgatcggtatcttattgcacaatgcttggaaggggaagcctagtatgattcatagtctgatactgaatctctccttggccgatctcagccttctcctgttttccgcgcctatccgtgccaccgcctactccaaaagcgtatgggacctagggtggttcgtctgcaagagcagtgattggttcatccatacttgtatggccgccaaatcacttaccatagtggtagtggccaaggtctgcttcatgtacgccagcgatcctgccaagcaagtgtctatacacaattatacaatttggtcagtcttggtggccatctggaccgtcgcgagcctgctcccactgcctgaatggttttttagtacgattcggcaccatgaaggggttgagatgtgccttgtggacgtcccagcagtggcagaggagtttatgagtatgtttggcaagctatatccccttctggctttcggtctccccttattctttgccagcttctacttctggcgcgcgtacgaccagtgtaagaaaaggggaactaaaactcagaatctgcgcaaccagatccgttctaagcaggtgacagtcatgctcttatcaatcgccattatttccgctttactgtggctcccagaatgggtggcatggctctgggtttggcaccttaaggccgcaggacccgctccccctcaggggttcatcgctctgagccaggtgctcatgttttccatttcaagcgctaatcctcttatcttccttgtcatgagtgaagagttcagagaaggtctaaaaggcgtatggaaatggatgataaccaagaaaccccctacggtgtccgaaagccaggagacacctgccggtaacagtgagggcctccctgacaaagtaccatcaccggaaagccccgcaagtattcccgagaaggaaaagccgagctctccttccagtggaaagggtaaaaccgagaaggctgagatccctatactcccagatgtggaacaattttggcacgagcgcgacaccgtcccatcagtccaggataatgacccaataccttgggagcatgaagatcaagagacaggcgagggcgtgaagtag

SEQ ID NO: 42478 - DNA, 1413 bp, Artificial Sequence
  Description of Artificial Sequence: Synthetic coding sequence
atggacaccaccatggaggccgacctgggcgccaccggccaccggccgcgaaccgagctggatgacgaggattcttatccacagggcggctgggacactgtgtttctggtcgcgctactcctgcttggccttcccgctaacgggctcatggcctggctggctggtagccaggcgcgtcatggggcaggcaccaggctagctcttttactgttgtccctcgctctgagcgatttcctttttttagctgcggccgcattccaaatcctcgaaattcgccatggaggtcattggcctctggggaccgctgcatgccggttttattactttctgtggggggtgtcatatagctcaggcctctttctgctggcagccctttctttagacaggtgcttgctggccttgtgcccccactggtatcccggtcatcgtccagttaggctgcccctgtgggtgtgcgcaggggtctgggtactggccacgctgttctccgtgccttggctcgtgtttccagaagccgcagtgtggtggtatgatctggtcatttgcctcgatttttgggattcagaggaattgagccttcgtatgctcgaggtgcttggcggtttcctgccctttttactcctcctagtgtgccacgttttaacacaagcaacggcctgcagaacatgccataggcagcagcagcccgcggcttgcagagggttcgctcgggtagcccggacaattctttccgcctatgtcgtgctaagacttccttaccagcttgcccagctgctgtacttggcttttctgtgggacgtgtatagcggatatctcctgtgggaggctctggtgtattctgactacctgatcctgctgaattcttgcctatctccatttctctgcctcatggcctcagctgacctgaggactctgctcaggtctgtcttgtcttcctttgccgcagccctgtgcgaggagcgccccggttcatttacacctacagaacctcagactcaactcgactctgaggggcccactctgccagaaccaatggctgaggcgcagagtcaaatggatccagtggctcagccccaggtcaaccccacactgcagccacggtctgatcctacagctcagccacaactcaatccgacggcacagccacagtccgatccgaccgcacagccacaactgaatttgatggcccagccccagtccgactctgtcgcacaaccccaggccgacactaacgttcaaacaccagcccccgccgcctcctctgtgccctcaccctgtgacgaggcctccccgacgccttcatctcaccccacccccggagcactggaggaccccgccaccccccccgcttcagagggcgagtccccatcctctacccctcctgaagcggcacccggtgccgggccgacttag

SEQ ID NO: 42479 - DNA, 2613 bp, Artificial Sequence
  Description of Artificial Sequence: Synthetic coding sequence
atgaacagcaacctgcccgccgagaacctgaccatcgccgtgaacatgactaaaacactccctactgcagtaacacacggcttcaatagtacgaacgatcctccttccatgagcattacccggctgtttcccgctttactagagtgcttcggtattgtcctgtgtggatacattgctggccgggccaacgttatcacttcaacccaggccaagggacttggcaacttcgtcagtcgtttcgccttgccagccttgctgttcaagaacatggtggtgctgaacttttcgaacgttgattggtctttcctttactcgatcctcattgctaaggcttccgtctttttcatcgtctgcgtgctcacccttctggtcgccagccctgattcaaggttctctaaagcagggttattcccaattttcgccactcagtctaacgactttgccctagggtaccctatagtcgaggctctgtatcaaaccacttaccctgaataccttcaatatatctatctggtcgcccccatatccctgatgatgctgaatcccatcgggttcattttctgtgaaatccagaaatggaaagatacacagaacgcatcccagaataaaattaagatcgtgggtttaggcctactgagagtgctccagaaccctatcgtgtttatggtgtttataggcatcgccttcaactttattttggaccgtaaggttccagtctatgtggaaaactttcttgatggcctggggaatagttttagcggaagtgccttgttttacttaggcctgacaatggtgggcaaaatcaaaagactgaaaaaaagcgcattcgtggtattaatcctcctcataaccgcaaagctcctggttcttccactgctctgtagagaaatggtggagttgttggacaaaggcgatagtgtcgtgaaccacacttccctgagcaattacgcattcctatacggagtgtttccagtggcccccggcgttgccatcttcgcaacccaattcaacatggaggtggaaatcatcacctcaggtatggtcatctcaacctttgtgagcgcgcctattatgtatgtcagtgcctggctgttgaccttccccaccatggaccccaagcccctggcttacgccatccagaatgtctcctttgatatttctattgtgtcactcatcagtttgatttggagtctggcgatcttgttgctaagcaagaaatacaaacagttacctcatatgctcaccacaaacttgttgattgcccaatctattgtttgtgccggaatgatgatatggaattttgtgaaggagaaaaactttgtgggccagatcctggtcttcgtgttgctgtattcctccctgtacagtacgtacctgtggaccggactcctggccatcagcctgttcctgctgaaaaaacgagagcgtgtgcagatccccgtaggcataatcattatttctgggtggggcattcctgccctcctggtgggggtactgttgataacgggcaagcacaatggtgattccattgattccgcattcttttacggcaaggagcagatgattacgactgctgttactctgttctgctctattctcatagccggtatctcacttatgtgtatgaatcagaccgctcaggctggtagttatgaaggttttgatcagagtcagtcacataaggtggttgaacccggcaatacagctttcgaagagtctcctgcacctgtgaacgaaccggagctgttcacctcaagcatccccgagacatcatgctgcagttgctcaatggggaacggcgagctgcattgtccttctatagaacccatcgccaacactagtactagtgagcctgtgattccaagcttcgagaagaataaccactgtgtgtccaggtgtaactcccagtcttgtatcttggctcaggaagaggagcagtaccttcagagcggagaccaacagttaacacgacatgtcttgttgtgcctgcttctcatcatagggttattcgccaacctttcttcatgcctgtggtggctgttcaatcaggaacctgggcggctgtacgtagagctccagttcttttgcgctgtgttcaatttcggccaggggttcatttccttcgggatttttggactggacaagcacctcattattctccccttcaagcgcagacttgaattcttgtggaacaacaaagacaccgccgagaacagggattctcccgttagtgaagagattaaaatgacatgtcaacaattcatccattaccatcgtgatctctgcatccgcaatatagtcaaagagcggcggtgcggcgcgaagacatcggcaggcaccttttgtggttgcgacttagtgtcctggttgatagaagtgggactggcctcagaccggggcgaggctgtgatctacggcgataggttagtgcaagggggagtcatccagcatattaccaatgaatatgagtttagggatgagtaccttttttatagattccttcagaagtcgccggaacaatcacctccagcgattaatgcaaatacacttcaacaggagcgctataaagagatcgagcactctagtcctcccagccatagtcccaaaacatag

SEQ ID NO: 42480 - DNA, 2613 bp, Artificial Sequence
  Description of Artificial Sequence: Synthetic coding sequence
atgaacagcaacctgcccgccgagaacctgaccatcgccgtgaacatgactaaaacactccccacagctgtcacacatggctttaattcaacaaatgaccctccttccatgagtatcactcgtctgtttccagcgctgttagagtgcttcggcattgtcttgtgcggttatatcgccgggagagcaaacgtgattactagcacacaggccaaggggctgggcaactttgtatcccgttttgctctgcccgctcttttgttcaaaaatatggtcgttcttaacttttccaacgtggactggtcttttctatactcaatactcatagctaaggcttctgtctttttcatcgtttgcgtcctcacccttctcgtcgcatcccctgactcccggttcagcaaggctggcctctttcctatcttcgccacccagtcaaatgacttcgccctgggttaccccattgtagaggcactgtaccagaccacataccccgaatacctgcagtacatatacctggtcgccccaatcagcctgatgatgctgaatccgattggcttcatcttctgcgaaatacagaagtggaaggatacccagaacgctagtcaaaacaagattaagatcgtggggttgggcctactgagagtgctgcagaaccccatcgtgtttatggttttcatcggcattgccttcaacttcatcctggatcgaaaagtgccagtgtatgtagaaaatttcctggacggattggggaattcgttttccggatccgcgctgttttatctgggactgacaatggtcggaaaaattaagcggttaaaaaaatctgcgttcgtcgtacttatcctgcttattactgccaaattgctggtactgcctctattgtgtagggagatggtggaactgttggataagggagattctgtcgtgaaccacacaagtttgtcaaattacgcattcctgtacggagtgttcccagttgcccccggcgtagcgatctttgcaacacaatttaatatggaggtggaaattattaccagtggaatggttatctcgacttttgtgtccgccccaatcatgtatgtgagcgcttggctgctaacatttcctacaatggacccaaagcccctggcttatgccattcagaatgtttccttcgatattagcattgtatctctgatttcgctgatttggtcactggccatcttgctgctgagcaaaaaatacaagcagttgccccacatgttgacaacaaacctcctaatcgctcagagcattgtctgcgcaggcatgatgatttggaattttgttaaagagaaaaattttgtggggcaaatcctggtatttgtgttactctactcaagtctgtacagtacatacctttggactggattattggccatatccctgtttctgttaaagaagcgcgaacgcgttcagattccagtaggcattataatcatttctggatggggtattccagccttgctggtgggtgtcttgttaataactggcaaacacaatggggatagtatcgactctgcctttttttacggcaaggaacagatgataaccacagcagtaactctcttttgctccatccttatcgctgggatctccttgatgtgcatgaaccaaaccgcccaggccggctcatatgaggggtttgatcagtcacagtctcacaaggtcgtggagcccggcaataccgcattcgaggagtcgcccgccccagtgaacgagccagagttatttaccagctctatcccagagacttcatgctgtagctgcagcatggggaacggagaattgcactgcccttccattgaaccgattgcaaatacctcaaccagtgagcccgtgatcccaagttttgaaaagaataaccattgcgtgtctaggtgtaactcacagtcgtgcattttggcacaggaggaggagcagtacctgcagtctggtgaccagcagctgaccaggcatgtactgctgtgcctgctcctgatcatcgggctcttcgctaatctatccagctgcctgtggtggctgttcaaccaggaaccgggccgcctctatgtagaacttcagttcttctgcgcggtcttcaacttcggccagggctttatatcatttggaatattcgggcttgataagcacttgatcatcctgccttttaagaggcggctggaatttctgtggaataacaaggatacggccgagaatcgcgactccccagtctctgaggagataaagatgacctgccagcagttcatacactaccaccgggacctgtgtatccgaaacattgttaaagaacgcaggtgtggtgccaaaacatcggccggcacattctgcggttgtgatctggtatcatggctgatcgaggttggcctcgcatcggatcggggagaggccgtcatatacggtgacagattggtgcagggtggcgtgatccagcacattactaacgagtacgagttcagagacgagtatctgttttatagatttctgcagaaaagtcccgagcagtccccgccagccatcaatgcaaacaccctgcagcaagaacggtacaaggagatcgagcactcctcccctccctcccacagcccaaagacttag

SEQ ID NO: 42481 - DNA, 2613 bp, Artificial Sequence
  Description of Artificial Sequence: Synthetic coding sequence
atgaacagcaacctgcccgccgagaacctgaccatcgccgtgaacatgacaaaaactttgccaactgctgtaacccacggcttcaactctactaacgatcctccttctatgtcaatcaccaggttatttcccgccctcttggagtgtttcggtatcgtgctttgtggatacattgcaggaagagcgaatgtgatcacgtctacacaggccaagggactcgggaacttcgtgtcccggttcgccctacccgcactacttttcaagaatatggtcgttctgaattttagcaacgtcgattggagtttcctgtatagcatcctgatagccaaggccagcgtcttttttatagtctgcgtgttgaccctgttggttgcgtctcccgatagtagattctccaaggccggcctgtttcccatttttgcgacccagagtaatgacttcgctttgggttacccaatcgtcgaggctctgtatcaaaccacttacccagagtacctgcagtatatttacttggtggctccgatatctttgatgatgttgaatccgataggatttatcttctgtgaaattcagaagtggaaggacacacaaaatgccagccagaacaagatcaaaatagtgggtctcggactgctgagggtgctacagaaccctattgttttcatggtgttcattggcattgccttcaattttatactggatcgcaaggtgcccgtatatgtggagaatttcctggacggcctagggaacagctttagcgggtctgcactcttctatctggggcttacaatggtgggcaaaataaagaggctgaaaaagtctgcctttgtggtcctgatcctgctgatcacggctaagctactggtgctccccctgttatgcagggagatggtggagctcctggacaagggagacagcgtcgtcaaccatacttccttgtcaaactacgccttcttgtacggagttttccctgttgcgcccggggtagctatcttcgccacacagtttaacatggaggtcgagatcatcaccagcggcatggtgattagcacattcgtgagtgcgccaataatgtatgtgagtgcctggcttctcacgttcccaactatggaccctaagccactggcttacgccattcagaacgtttcatttgatatatcaattgtgtccttgatttccctgatctggtcccttgccatcttacttctctcgaagaagtacaaacagctgccgcatatgctgacgacaaacctactgatcgcacagtccattgtatgcgccgggatgatgatttggaatttcgtgaaggagaagaattttgtgggacagatcctggtgttcgtccttctgtactccagcctttactctacttacttgtggaccggattactcgcaatctccctgttcttgcttaaaaagagggagcgagtccagatcccggtcgggatcattattatctccgggtggggcattccagccctcctcgtgggcgtacttctgattacgggcaagcacaacggagatagtattgatagcgcattcttttacggtaaggaacaaatgataaccaccgcagtgaccttgttctgcagcattctgatcgcgggtattagtctgatgtgtatgaaccaaacagctcaggcggggagctatgaaggatttgatcaatctcagagccacaaagtagtagagccaggcaatacagcttttgaagagagtcccgctcccgttaatgagcctgagttgtttaccagctctattcccgagacttcttgctgcagctgctccatgggaaacggcgagttacactgcccaagtatagagcccatagccaatacttcaactagcgagcctgtgattccgtcttttgagaagaacaatcattgtgtttcgcggtgcaattcccagtcctgcatcctcgcgcaagaagaagaacagtacctccagtccggcgatcagcaactaacacgtcacgttttgctctgtttgctgttgatcatcgggctgttcgccaatctatccagctgcttgtggtggctgtttaaccaagagcccggccgcttatatgttgagttgcagtttttttgcgccgtcttcaactttggtcaagggttcatttcctttggtatatttggcctggacaaacacctgatcattctacctttcaaaagacggctagaatttctgtggaacaataaggacacggccgagaacagggattcacctgtctccgaggagatcaaaatgacctgtcagcaattcatacattatcacagggatctgtgtattagaaatatcgttaaggagcgacgttgtggggcaaagaccagcgccggaactttctgtgggtgcgaccttgtgtcttggctcattgaggtgggcctggcgagcgataggggagaggctgtgatttatggcgacagactagtccagggcggtgtgatccaacacatcaccaatgaatacgagttccgggacgagtatctcttctacagatttctgcaaaaatcgcctgaacagtcaccgcctgcaattaacgcaaatactttgcagcaagaacgctataaagaaatagaacacagcagcccaccttcccactcccccaagacttag

SEQ ID NO: 42482 - DNA, 795 bp, Artificial Sequence
  Description of Artificial Sequence: Synthetic coding sequence
atgatcaccaccgccgtgaccctgttctgcagcatcctgatcgccggcatatcactcatgtgcatgaatcagactgctcaggccggttcgtatgagggctttgatcagtctcagtcccacaaggtggtcgaacccggcaatacggcctttgaagagtctccagcaccggtgaatgagcctgagctgttcacttcttcgattcccgagacatcatgttgtagttgctccatgggaaacggggagctgcattgtccctctatcgaacctattgcaaacactagtacctccgagccggtgatcccttctttcgaaaagaacaatcattgtgtctcaaggtgtaacagtcagtcctgtatattggcacaggaagaagaacagtatctacaaagcggcgaccaacagctgaccagacacgtactcctttgcctcctgcttatcattgggctttttgccaatttgagcagttgtctgtggtggctgttcaatcaggagcccggccggctttacgtcgaattgcagtttttctgtgcagtgttcaacttcggtcaggggtttatctcattcggcatctttgggctcgacaagcatcttatcatacttccgttcaagagaagactcgaattcctctggaacaacaaagatacggcagagaacagagatagcccagtgtccgaggagattaagatgacgtgccagcaattcatccactaccatagggacctctgcatcaggaacatcgttaaggaaaggcggtgcggagccaaaacaagtgctggaaccttttgcggatgttag

SEQ ID NO: 42483 - DNA, 417 bp, Artificial Sequence
  Description of Artificial Sequence: Synthetic coding sequence
ttccgggcccggggccccgacggccggggcagcggccggacccgggctggccgggcccccggccgggagccacgagctcctaggtgtcctgacggtggcggcgttgcggcgagggccgcccgactattgtcatcaaggcgctccggcagctggcccccgacccacgctttgtggcctgatcttaggagccgcgccagacgcctgctgctgttcctaagtctggctgatctgctgtcagcacgttgcccacccagtcctacacccgcccccagtagtggcccttggcctttgagaagcacatgcacctccgccagctccgctccacgtgcaggactcgctcagatagcttgttttggcccttctatgtccagtgcaggcgggtccaggtggagctcactttggcagccttccccatag

SEQ ID NO: 42484 - DNA, 1008 bp, Artificial Sequence
  Description of Artificial Sequence: Synthetic coding sequence
atgcagcccagccccccccccaccgagctggtgcccagcgagcgggctgtcgtgttgctttcctgcgctttatcggccctggggagcggtctgctggtggccacacatgctctgtggccagatctgcgtagcagagctcgccgcctgctcctgttcctgtccctcgctgacctcctgtccgctgcttcctacttttatggtgtgttgcaaaacttcgcaggacctagctgggattgcgtgttgcaaggagctctgtcaacgttcgcaaacacttcctcattcttctggactgttgccatagcattgtacctgtatttatctattgtgcgcgcagcacggggaccacgcacagaccggttgctctgggcgtttcatgttgtgtcttggggggtgcccctggtgataactgtagccgcagtcgccttgaaaaagatcgggtatgatgcgtccgatgtatcagtggggtggtgttggattgacttagaagcgaaagatcacgtcctctggatgctgttaacaggcaagctttgggaaatgcttgcatacgtgctgcttcccttactgtacctgttggtgagaaaacacatcaatcgggcgcataccgctctgagtgagtataggcccatactttcccaggagcatcgcctgcttcgacacagctccatggccgacaaaaaactcgtgttgatacccctaattttcatcggcctgcgggtttggagcacagttagatttgtgctgacactgtgcggatccccagcagtgcaaacccctgttcttgtcgtgttgcacggcatcggtaacacatttcaaggaggagccaattgcatcatgttcgtcctgtgcactagagccgtgagaacaagactgtttagtctgtgctgctgctgctgttcttctcagccccctactaagtcccccgccggaacacctaaggccccggcaccatcaaagcctggggagtcccaggaaagccaaggtaccccgggcgaactcccttcaacgtag

SEQ ID NO: 42485 - DNA, 813 bp, Artificial Sequence
  Description of Artificial Sequence: Synthetic coding sequence
atgcagcccagccccccccccaccgagctggtgcccagcgagcgggccgtggtccttctgtcatgtgccctgtcggctcttggatctggcctgctggtggccactcatgccctgtggcctgatctaaggtcgagggcaaggcgattgctgctcttcctgagtctggcagacctcctttccgccgcttcttatttttatggtgtccttcagaacttcgcgggccctagttgggactgcgtgctgcaaggtgcactcagcacattcgccaatacctccagcttcttttggaccgtggcaattgccttgtatctttatctgtccattgtccgggcagcccggggacctcggactgatcgacttctgtgggctttccacgtcgtgtcatggggcgtgccactggtgattaccgtggctgccgtggctctgaagaaaattggttacgacgcaagtgacgtctccgttggatggtgttggattgacctggaggcaaaagaccacgttctgtggatgttgctcaccgggaaactgtgggaaatgcttgcttacgtgcttcttcctctactgtacttactggtcaggaagcacattaaccgcgccggcattggtaatacctttcagggaggcgccaattgcattatgtttgtactgtgtacaagagccgtgcggaccaggctctttagtttgtgttgctgctgctgtagcagccagccacccaccaagagccccgctggcactccaaaggcccccgcccccagcaaacccggcgaatcccaagagtcacaggggacgcctggcgaactcccgtccacgtag

SEQ ID NO: 42486 - DNA, 3648 bp, Artificial Sequence
  Description of Artificial Sequence: Synthetic coding sequence
atgggcgccatggcctaccccctgctgctgtgcctgctgctggcccagcttggcctgggagcagtcggagcctcaagagatccccaaggccgcccggatagtcctcgagaacggacaccaaaaggaaagccccatgcacagcagcctggaagagcaagtgcctctgactcctctgctccttggtccaggtccactgatggaacaatcctggctcaaaaacttgcggaagaagtgccgatggacgttgcctcctatctgtacactggagactcacaccagctgaaacgcgcgaactgttccggccgctacgagttggccgggctccccggaaagtggcctgcactggcttctgcccacccgtccctgcacagagctttggacaccctgacccacgctaccaatttcctgaatgtcatgctccagtccaataaatcccgggagcagaatctacaggatgatttggattggtatcaggccctcgtctggagtctgttggagggagaaccaagcatttctagagcagctattacgtttagcaccgactcactgtcggctcctgcccctcaggtctttctccaagccacacgcgaggaatcacggattctcctccaagacctgagctctagtgctccacacctagccaatgcgacacttgagacagagtggtttcatggtctgaggcggaaatggaggccacatttgcatcgcaggggccctaatcagggacctagaggacttggccattcttggagaaggaaggatggccttggaggcgataaatctcacttcaagtggagccctccttatttagagtgcgagaacggatcttacaagcctggctggttggtaaccctatccagcgcaatctatggcctgcaacccaacctggtccccgagttccgaggtgttatgaaagttgacattaatcttcaaaaggtggatatcgatcaatgctctagtgacggttggttctcgggcactcataagtgccacctcaacaacagcgagtgcatgcctattaaggggctcggatttgtgctaggggcatacgagtgcatctgcaaggctggattttatcatccaggggttttgcctgtgaacaacttcaggaggagaggccccgatcaacatatatccgggtcaactaaagatgtgagtgaagaggcatacgtctgcttaccctgtagagagggctgcccattctgcgccgacgattcaccttgcttcgtacaggaggacaagtacctgcgactggccatcatttctttccaagccctgtgcatgctgctggattttgtgagcatgttagtagtgtaccacttcagaaaagcgaagtctatcagagccagtggactcattctgctggagactattctgtttgggagtctcctgctctactttccggtcgtgattttgtactttgaaccgtccactttccgctgcatcttactacggtgggcgagacttcttggatttgctacagtgtatggcacagtgacgctgaaactacaccgcgttctcaaagttttcctgtctcgtactgctcagcgcattccttatatgacgggaggacgcgtcatgcggatgctcgccgttatcttgctagtggtgttctggtttctcatagggtggaccagctcagtctgccagaatctggagaagcaaatcagcttgatcggacaaggcaagacctcggaccacctgattttcaatatgtgccttatcgacaggtgggattacatgacagccgttgctgaattcctattcctgttgtggggcgtctacctgtgctatgcagtgcggaccgtgccaagcgcatttcacgaacctagatacatggctgttgcagtgcataacgagctgatcatcagcgccattttccacaccattcgttttgttctggcctccagactgcagagcgattggatgctaatgctatacttcgcccacacacacctcactgtgacagtcacgatcggactgttgctcatccccaagttttcccactcatcaaataatccaagggatgatatcgcaactgaggcctatgaggacgagcttgatatgggccgcagtgggtcatacctgaactccagtatcaatagtgcctggagcgaacactccttggacccagaagatatcagggacgagcttaagaaactgtacgctcagctggagatctacaagcggaaaaaaatgattaccaacaatccacacctacaaaagaaaagatgcagcaaaaagggattagggaggagcatcatgaggaggatcaccgagatacccgaaacagtcagtcggcagtgttccaaggaagataaagaaggagccgaccacgggaccgctaaaggcacagccctaattcgcaaaaacccaccggaatcctccggtaacactgggaagagcaaggaagaaaccttaaagaatagggtgttctctttgaaaaagtcacacagcacatatgaccatgtcagagaccagactgaagagtcatcctcccttcctacagagagccaagaagaggaaacgacggagaattccactctggagtccctgagcggaaaaaagttgactcagaaacttaaggaggattctgaggcagaatcaacggaatcagtgccattggtctgtaagagcgcaagcgcacataacttgagtagtgaaaagaaaacaggtcacccccggacgtctatgcttcaaaaatccctgagtgtgattgctagcgctaaggagaaaaccttaggtctggctggtaaaacccagaccgctggggtcgaggagcggactaagagtcagaaacctctgccaaaggacaaggaaaccaatagaaatcactcgaactccgacaacacggagacgaaagaccccgctccccaaaatagcaatccagccgaggagcccagaaaacctcagaaaagcggtatcatgaaacaacagcgggtgaatcccactaccgcgaatagtgatctgaaccccggcaccacacagatgaaagataatttcgacattggcgaagtatgcccatgggaggtgtatgatctcaccccaggcccagtaccttccgagagcaaggtccagaaacacgtgagcattgtggcatctgagatggagaagaatccaaccttttctctcaaagaaaaatctcatcacaagcccaaggctgccgaggtgtgccagcagagcaatcagaaacgaattgacaaagcagaggtgtgcctgtgggagtcacagggacagagtattctcgaagatgaaaagctgctcatttcaaagacccctgtactacccgagcgagcaaaggaggaaaatggtggccagccaagagcggcaaatgtttgcgccggacagtctgaagaactaccacccaaggcagtggcctctaaaacagagaacgaaaacttgaaccaaatcggacaccaagagaaaaagacaagcagttccgaggagaacgtgaggggaagctataatagcagcaataattttcaacagccgctgaccagtagggccgaggtctgcccatgggagttcgagacccctgcccaacccaacgcaggtcggagcgtcgccctgcccgcctcctccgctctgagcgctaataaaattgcagggcccaggaaggaagaaatctgggattcttttaaggtgtag

SEQ ID NO: 42487 - DNA, 1017 bp, Artificial Sequence
  Description of Artificial Sequence: Synthetic coding sequence
atgaccgccctgagcagcgagaactgcagcttccagtaccagctgaggcaaaccaaccagcccttggacgtgaattatctgttatttctgatcattctgggaaagatcctcctgaatattctcaccttaggtatgcgacgcaaaaacacatgccaaaattttatggagtatttttgcatctccctggcatttgtggacctgctactgcttgtaaatattagcatcatactctacttcagagactttgtgttactatctatcagattcacgaagtaccatatctgcttgtttacacagattatttctttcacatacggcttccttcattaccccgtctttctgactgcctgtatcgattattgtttaaatttcagtaaaacaaccaaactgtccttcaagtgccagaagctcttttacttttttaccgtcattctgatttggatttcagttctggcatatgttctgggagacccggccatttatcagtcactgaaggcccagaatgcgtattctcgccattgcccgttttacgtcagtattcagtcttactggctaagttttttcatggtgatgatcctgttcgtcgctttcattacttgctgggaggaggtgaccaccctcgtccaagccattcggattacatcctatatgaacgagactatactgtatttccccttttcttcccatagctcatatacagtgcggtcgaagaagatctttcttagcaagctaatcgtgtgctttctctccacctggctcccattcgtgttacttcaagtaatcatcgttttgctgaaggtccagattcctgcgtatatagagatgaatattccatggttatacttcgtgaacagtttcctgattgctacagtctactggtttaattgccataagctcaacctgaaggacatcggtttgcccctcgatcctttcgtgaactggaagtgttgttttatccctctgaccattcccaatctagagcagatcgaaaaaccaattagtattatgatctgctag

SEQ ID NO: 42488 - DNA, 432 bp, Artificial Sequence
  Description of Artificial Sequence: Synthetic coding sequence
atgaccgccctgagcagcgagaactgcagcttccagtaccagctgcggcaaaccaaccagcccctagacgttaactatttgttgttcttgattattctggggaaaatccttctcaacattcttacgttgggcatgcgccgtaagaacacctgccaaaatttcatggaatatttctgcattagtctggcttttgtggatttgctgctgctggtgaatatttccatcattctgtattttcgcgacttcgtgttactctcgatcaggtttacaaagtaccacatctgcctgttcacccagataattagttttacgtatggtttcctccattatcccgtgttcctaacggcctgcatcgattactgcctcaacttcagcaagactacgaaactctcttttaagtgccaaaaacttttttactttttcacggtgtag

SEQ ID NO: 42489 - DNA, 267 bp, Artificial Sequence
  Description of Artificial Sequence: Synthetic coding sequence
atgaccgccctgagcagcgagaactgcagcttccagtaccagctgagacagacaaaccagccgctggacgtcaactatctgttgttcttgatcatcctcggcaaaattctgctcaatattctgaccctgggcatgaggaggaaaaatacttgccagaatttcatggagtatttctgcatcagtcttgctttcgtggaccttctccttctagttaacatttccattattctgtactttcgcgactttgttttgcttagcattcggtag

SEQ ID NO: 42490 - DNA, 102 bp, Artificial Sequence
  Description of Artificial Sequence: Synthetic coding sequence
atgaccgccctgagcagcgagaactgcagcttccagtaccagctgcggcagaccaatcagccacttgacgtaaactatctcctttttctcatcattctctag

SEQ ID NO: 42491 - DNA, 1767 bp, Artificial Sequence
  Description of Artificial Sequence: Synthetic coding sequence
atggcccggggcggcgccggcgccgaggaggccagcctgcggagcaatgctctgagttggctcgcctgcggtctcttagccctgctggcgaatgcctggattatattatccatcagcgccaaacagcagaaacacaaaccattagagctgctcctctgttttctcgccgggactcacatactgatggccgccgtgccactgactaccttcgccgtggtgcaactgagacggcaggcgagctctgactacgactggaatgagtccatctgtaaagtcttcgtatcaacctactacacacttgccttggcgacgtgcttcacggtggcttcactgtcataccatcgcatgtggatggtcagatggccggtaaattatcggttgtctaatgccaagaagcaggccctgcatgctgtgatgggcatctggatggtttccttcatactgtctacattgccctccattggatggcataacaacggagagcgatactacgcccgcggttgccagttcatcgtgagcaagatcggactggggttcggtgtgtgtttttcgttacttctgctcggtggtattgtcatgggacttgtgtgcgttgcaattactttctaccagacactttgggcaaggccaagacgcgcccgccaggcacgccgggtgggcggcggtggaggcactaaggctggcgggcccggggccttggggactagaccagccttcgaggtccccgcaatcgtggtggaggatgcccgcggtaaacgtaggagcagcctggatggctccgaaagtgctaaaacatctctgcaggtaaccaacctggtgtctgcaatcgtattcctttacgactcactgactggagtgccaatccttgtcgttagcttcttttcattaaaatccgactctgctcctccctggatggtgcttgcggttctgtggtgctcaatggcccagaccctactcctgcctagttttatttggtcatgcgaacgctaccgagcagatgtgaggactgtttgggagcaatgtgtagctatcatgagcgaggaggacggcgatgacgacggaggctgtgacgattatgccgaagggcgcgtgtgcaaagtgcggttcgacgccaacggtgccactgggcccggatcccgggatccagcccaggttaaactcctgcctggccgccacatgctgttcccgcccctcgaacgtgtccattatctccaggtccccctgtccagacgcctgtcacatgacgaaactaatatcttttcaaccccgcgggagcctggcagttttctgcacaaatggtccagctccgacgacattcgggtccttccggcccaatcaagagctttggggggccctccagaatatcttgggcagcggcacaggctggaggatgaagaagatgaggaggaggcggaaggtggcgggcttgcctcacttagacagtttctagagagcggagtgctgggatctggtggcggcccacccagaggaccaggcttcttccgcgaggaaataacaacattcatagatgagacacccttgccgtctcccactgcctctccagggcattcaccccgaagaccccgaccactgggtctgagcccccggcgactgtccctaggttcccctgagtctcgtgctgtgggattacctctgggccttagcgccggccgccgatgtagtttgaccgggggggaggagtctgccagggcatggggtgggtcttggggaccaggaaatcctatatttcctcaactgacactctag

SEQ ID NO: 42492 - DNA, 915 bp, Artificial Sequence
  Description of Artificial Sequence: Synthetic coding sequence
atgctgagcaccggcgtggtgagcttcttcagcctgaagagcgactccgcacccccttggatggttctggccgtgttgtggtgttccatggcccagacgctcctgctcccatccttcatctggagctgcgagagataccgggctgatgttcgaaccgtttgggagcagtgtgtggccatcatgtccgaagaggatggcgacgacgacggcggatgcgatgactacgcagagggtcgggtatgtaaagtgcggtttgacgcaaacggggcaaccggccctggttcccgggatcctgcccaggtgaaactgcttccgggacgacacatgctgtttccaccgctggaaagggtgcactatctgcaagttccactgtccaggcggttatcccatgacgaaacgaacatattttctactccccgcgaaccgggcagcttcctgcacaagtggtcttcctctgacgacatacgcgtgttgcctgcccagtctagggcgttgggcggacctcccgaatatctcggccaacgccacaggctggaagatgaagaagacgaagaggaagccgaggggggaggactggctagtctcagacaattcctggagagcggagtgctgggtagtggcggtggaccccctagagggcccggattctttcgtgaagagatcaccacctttatcgatgaaacaccactaccttctcccacagcatcccctggccattcaccacggagaccaagaccacttggactgagcccaaggcggctgagtctggggagccctgaatccagggcagttggtttgcccctggggctgagcgccgggagacggtgctcgctcacaggaggcgaagagtcagcccgggcctggggtggttcttgggggccggggaaccctatctttccgcagctgacactttag

SEQ ID NO: 42493 - DNA, 960 bp, Artificial Sequence
  Description of Artificial Sequence: Synthetic coding sequence
atgaccaacagcagcttcttctgccccgtgtacaaggacctggagccttttacatacttcttctaccttgtgttcttagtcggcatcattgggtcctgctttgcgacttgggcatttattcagaaaaacactaatcacagatgcgtttccatatacctgatcaatttgcttacagccgatttcttgctcactctcgccctgcccgtcaaaattgtggtcgatctcggggtcgcaccatggaagctaaaaatcttccattgtcaggtcaccgcgtgtctgatctacataaacatgtatctttctattatttttctggcatttgtgagcatcgaccggtgcctgcaactaacccatagctgtaaaatctaccgtatccaggagcccggctttgcgaaaatgatctcaactgtagtctggcttatggtgctcctgataatggtccctaatatgatgattcctataaaagatattaaggaaaagtcgaacgtggggtgtatggagttcaaaaaagaattcggccgcaattggcatcttctgaccaacttcatatgtgttgccatcttcctcaacttctcagctatcatcctcatctccaattgcttagtgattcgccagctgtataggaataaggataatgagaattatcctaacgtcaagaaggccctgatcaatatcctgcttgtgacaacaggatacattatctgtttcgttccatatcatattgtgagaatcccttacacccttagccaaacagaggtgattacggactgttcaactcggatttccctcttcaaggcaaaggaggctactctgctcctggcagtttccaatctctgcttcgatccaatcctttactaccacttgagtaaagcttttaggagtaaagtaactgagacatttgcgtctccgaaggagacaaaggctcagaaagaaaaacttagatgtgaaaacaatgcctag

SEQ ID NO: 42494 - DNA, 57 bp, Artificial Sequence
  Description of Artificial Sequence: Synthetic coding sequence
atgaccaacagcagcttcttctgccccgtgtacaaggacctggagccatttacgtag

SEQ ID NO: 42495 - DNA, 1122 bp, Artificial Sequence
  Description of Artificial Sequence: Synthetic coding sequence
atggccaacaccaccggcgagcccgaggaggtgagcggcgccctgagcccaccttcggcaagcgcctatgtgaaactagtgctactgggcctgattatgtgcgtgtctttagccggtaatgcaatcctgagtctgctggtgcttaaggaacgagcattgcacaaggcaccttactattttctgctggatctctgcttggccgacggcatcagatccgccgtgtgtttccctttcgtgctggccagtgtgagacatggctcctcttggactttctccgccctgtcttgcaaaatcgtggcctttatggcggtcctgttctgcttccatgcagcttttatgctcttctgtatctcagtcactcgctacatggccattgcccatcaccgattttacgccaagcggatgacactttggacgtgcgcggctgtgatttgtatggcttggaccttatctgtcgccatggcctttcctcccgtgttcgacgtgggaacgtataagttcatcagagaggaagatcaatgtatcttcgaacatcgctactttaaagccaatgataccttaggtttcatgctcatgctggccgttctcatggccgccacacacgccgtttatgggaagctacttctcttcgaatatcgacacagaaagatgaagcccgtacagatggtgcccgccatttcccagaattggacgtttcacgggccaggtgccactgggcaagccgccgctaattggatcgctggcttcggaagaggcccaatgcctccgaccttgctcggtattcggcaaaatggccacgcagcctcacgtaggctcctcggcatggatgaggtcaagggtgaaaaacagctcggccgaatgttttacgcgatcacgctgctgttcctattgctatggtcgccctacatcgtggcttgttactggagagtgtttgtcaaagcgtgtgcggtaccacatcggtatttagcaaccgccgtctggatgagtttcgcccaggctgctgtgaaccctattgtgtgcttcttgctcaacaaggacctaaagaagtgtttgcgaactcacgcaccctgctggggaacgggtggggcaccggcaccccgagagccttactgtgtcatgtag

SEQ ID NO: 42496 - DNA, 159 bp, Artificial Sequence
  Description of Artificial Sequence: Synthetic coding sequence
atggccaacaccaccggcgagcccgaggaggtgagcggcgccctgagtcccccatccgcctccgcctatgtgaagttagtgctccttggcctgattatgtgcgtgtcactggctggcaacgcgattttaagcctgctggtgctgaaagaaagagcctag

SEQ ID NO: 42497 - DNA, 1002 bp, Artificial Sequence
  Description of Artificial Sequence: Synthetic coding sequence
atgcccgccaactacacctgcacccggcccgacggcgacaacaccgacttcaggtatttcatatacgcggtgacttacactgtgatcttggtgcctggcctgatagggaacattctggccctgtgggttttctatggatacatgaaggaaactaaaagggcagtcatatttatgatcaacctcgctattgccgacctcttgcaagtgctgagcctgcctctgagaatcttttattatctaaaccacgattggccctttggccccggtctgtgcatgttttgtttctacctgaagtatgtcaacatgtatgcttccatatactttcttgtgtgtatttccgtcagaagattctggtttttaatgtacccttttcgcttccacgattgcaaacagaagtacgatctgtacatctccatcgccgggtggttgataatatgcttagcctgcgttttgttccctctgctgcgaacgagtgacgacacgagcgggaaccgcaccaagtgcttcgtcgatctgcccacgagaaatgttaatctcgcacagtcagtggtgatgatgacgataggggaactcataggattcgtgacccccttacttatcgtgctgtactgcacttggaaaacagtcctctctctgcaggacaagtatccaatggcccaggacctaggggaaaagcagaaggccctgaagatgatactgacctgtgcgggagtgtttctgatatgctttgctccataccacttttcgtttccactggattttttagttaagagcaatgagattaagagctgcctcgcccgcagggttattcttatatttcattccgtggccctttgcctggctagtctgaattcctgcctcgatcccgttatttattatttctctaccaacgagtttcgcagacgcctaagtcgacaggacttgcatgactcgatccaattacacgctaagagcttcgtgtctaaccatactgcttcgactatgactccagagctgtgttag

SEQ ID NO: 42498 - DNA, 7104 bp, Artificial Sequence
  Description of Artificial Sequence: Synthetic coding sequence
atgggcacccggggcgccgtgatgcccccccccatgtggggcctgctaggctgttgttttgtgtgcgcttgggctctgggaggccccaggcctattaggtccctgcctcccctcagcagccaggtgaagccgggcagcgtgcccatgcaagtgcccctcgaaggggccgaggccgccctcgcatatctctatagcggcgacgcccagcagctatctcaggttaactgttctgaacgctacgaggctcgaggagcaggcgccatgcccggcttaccaccctcactacagggtgcagccgggacactggcccaggcagccaacttcttgaatatgctgctgcaggcgaatgacattagggaaagcagcgttgaagaagacgtggaatggtaccaggccctcgtcaggagcgtggctgaaggcgaccctcgggtgtatagggcactgctgaccttcaaccctcccccaggcgccagccatcttcagctggcactccaggctaccagaactggagaagagaccattctccaggaccttagcgggaactgggtgcaagaggagaacccacctggagacctagacacgcccgccttgaaaaagcgcgtcctgaccaatgatttgggatccctgggcagtcccaagtggccgcaggctgacggctacgtcggagacacccagcaggtgagactgtctcccccttttctcgagtgccaggaggggcggcttcgtccggggtggctcattactctgagcgccacattctacggactgaagcctgatctgtcccctgaggtgagggggcaagtacagatggacgtagatctgcagagcgtcgatataaatcagtgcgcaagtggacccgggtggtacagcaacacgcacttgtgcgatctgaattccacccagtgcgttcctctagagtcgcagggctttgtcttgggccggtacctgtgcaggtgccggcccgggttttatggtgcttccccttccgggggcttagaggaaagtgattttcagaccactggccagttcggtttcccagagggccgaagcggtcgtctgctgcagtgtctgccatgtcctgagggatgtaccagctgtatggatgccacgccttgcctggtggaagaagccgccgttctgagggctgctgtccttgcctgccaggcctgttgcatgctggcaatcttcctgtcaatgttagtgagttatcgctgcagacggaacaaacgcatttgggccagcggcgttgtgctgttggaaactgtgctcttcggattcctgttactgtacttccccgtgtttattttatactttaagccaagcgtattccgctgcattgctctcagatgggtgcgtttgctggggtttgctattgtctacggcacaatcatcctgaaattgtatcgagtgctccagctattcctgtcacgaactgcacaaaggtccgcactcctctcatctggtcgcctgctgcgacggctcggcttactcttgctcccggtcctcggttttcttgcagtctggaccgtgggagccctggaacgtgggatccagcatgcgcccctcgtgatccgaggccatacaccctcgggcagacacttctacctgtgccatcacgaccgttgggattatattatggttgttgcagagctgctgctgctgtgctgggggagttttctctgttatgccacacgcgctgtgctgagcgcctttcacgagcctcggtacatgggaatcgctctgcacaacgagcttttacttagtgccgcatttcatactgcacgctttgtgcttgttcctagcctgcatcccgattggacgctcctgttgttcttcttccacacacactctacggtcacaaccaccctggcactgattttcataccaaaattctggaagctgggcgcaccgcccagggaagagatggttgacgaagtctgtgaagacgaactagacctccagcactctggttcctaccttggcagcagcattgcatctgcctggtcagagcacagtttggacccgggcgacattagggatgagctgaagaagctatatgcgcagttggaggtgcacaaaactaaagagatggccgctaacaacccacacttgcctaagaagcgcggctcgtcatgtcagggcctcggacggagctttatgcgatacctggccgagttcccagaagccctggctcggcagcactctagggattcgggcagcccgggccacggttccttaccaggcagcagtagacgccgtctcctgtcttcaagccttcaggagccagaaggcacaccagccctacacaaaagtcgctccacctatgaccagaggcgggagcaggacccacctctactagactctctgctgcgtcgtaagctggcaaaaaaggcctcccgcactgagtcaagagaatccgtggaaggacctcctgccttaggattccggtctgcctcagctcacaacttgaccgtgggcgagcgcctgccacgagcccggcctgcttccctgcagaagtccctgagcgtcgcctccagtagggaaaaagcgttgctaatggctagccaggcatacctggaggaaacatatcgacaggctaaagagcgggaggagagaaaaaaggccaaagcggcaatggccagcctggtgcggaggccaagtgcccggaggctggagagaccacggggcgctcctctctccgccccgccttcccccgccaaaagtagctctgtggacagtagccataccagcgggcgtctgcacgaagaagctcgtagacgtcttccgcatcctcccattagacaccaggtgagcacccctatactggcgctgtcaggcggactgggcgagccacgaatgcttagtccaactagcacactggctccggccctcctccccgcattagctccaacacctgccccagcactggctcctgtgcccgtcagcccccagtcacctaacctgctgacctacatttgtccttgggaaaacgccgaactccccgcaaaacaggaaaatgtgcctcaggaggggccatcggggcccgagagagggcatcacagccccgcacctgccagagcccgactgtggcgggcgttatcagtggctgtggaaaaatctcgagcaggtgagaatgagatggatgccgaagacgcacatcaccaacgggaagccaacgatgtggatgaagatcggcccaagatttttcctaagtcccactctcttaaagcaccagtgcagcagggatcgatgcgctcgctgggcctggccatcaaagcactcactcgatctcgcagtacttatcgggagaaagagtcggtcgaggaatccccagagggtcagaatagtggaactgctggggagtccatgggcgctccaagccgttcgccgagattgggtagacccaaggccgtgtcaaaacaggccgcccttatcccttctgatgacaaggaaagcctgcagaaccagcagaatgcgcatactagcaggatgcttcaggtgtgccagagagaggggtcaagagaacaggaggacagaggacgaagaatgacgcaggggctgggcgaaaggaaggctgagagagcggggaaaaccggactggctatgctgcggcaggtcagtagagataaaaatatcaaacaatccaaagaaactccagtggggtggcaggagcttcctaaggccgggctccagagcctgggatccgccgaccatagagtcgccgaggtctgtccttgggaagttacggagagcgagactcgtcagcccgacagcgggaataaagccgagatctgcccttgggagaccagtgagggagcccctgaatcccgggctcttcgtcaggaccccggcgatagccagaagaaacggggtgaagcaaggggaaaatccgagcctatagacgtcgtgcctatgatgagaaagaaacctgaacgcctggtacgtgagcaggaagccgtgtgtccttgggagtctgccgatcggggcggcctgtctcccgggagcgccccacaggatcctggtagaattagggacaaatccgaagcaggtgactcagtggaggcacgcaaagtggaaaaacctggttgggaagccgccggtccggaagcccatacacctgatattacaaaagccgagccttgtccttgggaagctagcgagggtggagaagacggcaaacccgctcaggaagcagttaaagatctacctcaggagaagcagaagactcgcaaggcaactttctggaaggagcagaaacccggaggagatctggaatcattgtgcccgtgggagtctacggacttccggggaccctctgccgtgagcattcaggccccggggagtagcgagtgctccggctctctcggtagcggcatcgcagaagtttgcctctgggaagccggagacgcacccgccatccaaaaagctgaaatatgcccctgggaattagacgacaacgtgatgggccaagagatgttgtccttgggcaccggccgcgagtcactgcaggagaaagagaaagccagtcgcaaaggctcattcggcgagatgggggagcagactgtgaaagccgtccagaaactctctcaacaacaggagtcagtctgtccgcgagagagcactgtcccagggcactcaagcccctgcttggataacagcagctccaaagcaggttcccagtttttatgcaacggaggctcaagagctacccaagtctgtcctcaagaggacctacgtcccgaggcacaagaagccaccccagcgaaaaccgagatatgtccttgggaagtgaacgaaaggactcgcgaggagtggactagcgcccaggtcccccggggcggggaaagtcaaaaagacaaggaaaaaatgcccggcaagtcggaaattgaggacgtaacagcctgggagaaacctgaaggccagatacagaagcaggaggctgtgggaccttgggagagtgttgatccgggatccttttcaccacagcccagaccccaggacactgaaagacctcagacattgctgcaaatgtctggctcagtcggcagcaaggcggctgacatctgccctcttgatgtagaagagaacctcactgcgggcaaggccgagatttgcccctgggaggtgggtgctggtgctggcgaggaaagggctctgggggccgaagctattcgcaagtctccaaacgatactggcaaggttagcgcagatctggggccaagggagcgcgcggtcacagcccccgaaaagccccagaaacctacgcctgagtgggaagtggcctgtccgtggggctctgttggtcctggcgcttgcagtcaacacccgggcaccctcgatgccgatggccccaaggcgggcttccaggagctagatcacatgggctgccggcctggagaggtgtgtccctgggaggcccaggaagcggctacttcggaaaaggcaaagatctgcccatgggaagtgagcgaggggaccaccggaaaggggcttgatcagaaagctggttcagaaagtgctgaacagagagagaaggccttggaaaagggacgtctgaccagtctgggtgaggacgtgtcgaagggaatggctaaactatgccaacaacaggagactatttgtatctgggaaaacaaggatctgagggagtcccccgcccaagcccctaagattagcgatctgccgagttctatgtcctctgaagtcgctgaggggcactctctggaggcgacagagaagggagacctgaggcaggaccctaaaactgggtcttttccagaacacatcactcaggagaaagctcccgctgccgatactgaggagtttaccaccgaggacggcgaaaagacctcgcacgagctccagtcagtttgcccctgggagaccacggccccagccgacagtgtttctcacctggatcgacaaagaccagaccaaccaaaagctagttctcaaaggctcgttagcacagggggaagagctgccgatgtgtgcccctgggatgtgcctgacgctggtgtatataaatcagatagcagtgccaaggctgagacttgcccttgggaggttacagagcggatacctgtgaagggtgtcagtcgccaggatggaaagggtgactcccaggaagaaaagggccgggctcctgagaagtcagagcccaaaggcgtgcctgttcaaaagaagcctgaaatggccgactttagacagcaggaagcagtctgcccctgggaaagtcaggacgggaagggactgtctccacaacccgcccccgacgccagcgaccgatccaggggcagctccgaggccgctggaagtgtggagactcgtgtggctgaggtatgtctttgggaggtagttgaagccccatccgccaaaaaagccgagatctgtccatgggaggccggcggaggcgccgctgaagagggcgaacaagaacgcgaaagccaaggacaaggggagatgttcctccaaaaagctggacctggaggtacagaggagcatttttccaaagcggccgcgaagcccagagaacaggaggccgtctgtcccggcgagggaacgggcagtggcgggttgctaccgcaatcgggagctctcgacccagaattaaaagtgtcacccaaggaagctggatctatgggctcaagaatggcagagttatgtcagtgggagatcaccgatccagaggggaacaagattaagggaacaatggccgacatttgccctggagaagaaacaggcgtgccctcagaagaatctggactgctggccctcactgctacgagacgggagttcttccctacagctcctgagaagccgttgtgtttacttgtgcacggcccactggatcacttctttccagagagcaaaataccctgccctaaggtaagtagacccgccagtaccttcaccctggagggcgtcagagagctgcagggaccttcaggactggagccaagaacatccctggcgcccgaaccatccttgcaggaagctgagtctcaatcttcctccttgaccgaagattctggtcaggtggcttttgaagcacagtacgaagagtttaccccccctacggtgtatccgtgggattgggagtag

SEQ ID NO: 42499 - DNA, 1323 bp, Artificial Sequence
  Description of Artificial Sequence: Synthetic coding sequence
atgggcggcctgcggctgctggccgtggccctgacctgctgctggtggcctcaggggagccagggaaaaacccttagaggaagcttctcctcaaccgcagcccaggacgcgcaggggcagcggattgggcacttcgagttccacggcgatcacgctctgctctgtgttcggattaataacatcgctgtcgcggtagggaaggaagcaaagctgtacctctttcaggcccaggagtggcttaagctccagcaatcttcccacgggtatagctgcagtgaaaagctgtcaaaggcacagctgacaatgaccatgaaccagaccgagcacaacctcactgttagccagattccctcgccccagacctggcacgtgttctacgccgacaaatacacgtgtcaggatgacaaggagaactcacaggtggaggatattccctttgaaatggtactgcttaatcctgacgcagaagggaatcctttcgaccacttctcagccggcgagagcggacttcacgaattctttttcctccttgtgctggtgtactttgtgatcgcatgtatttacgcacagtctctctggcaggctatcaaaaaaggcgggccaatgcatatgattctgaaggtgctgacaacagctctgctgttacaagccgggtcagccctggccaattacatccactttagcagctattctaaagacggcattggagttccgttcatggggtccctggcagaattcttcgatattgcaagccagattcagatgttatacttgctattgtccttgtgcatggggtggacgattgtgaggatgaaaaaaagccagtctcgtcctctccagtgggactcgacccctgcttcaacaggcatcgccgtttttattgtaatgactcagagcgtcctgctgctgtgggagcagtttgaagatatatctcaccacagctatcactctcatcacaacctcgctggcatcctcttaattgtactaaggatttgcctggccctgtctctgggctgcgggttgtatcaaatcattaccgtcgaacgcagtactttgaagagggaattctatattacattcgctaagggctgtattctgtggttcttatgtcatccagtgctggcttgtatctcggtcatcttctcggactatcagcgggataaggtgattaccatcggcgttatcctgtgtcagtccgtgagtatggtgatactctaccgtttattcttgagtcattcactgtattgggaagtttcgtctctgtcttcagtgacactccctctgaccatcagctctggccacaagtcaaggcctcacttctag

SEQ ID NO: 42500 - DNA, 1215 bp, Artificial Sequence
  Description of Artificial Sequence: Synthetic coding sequence
atgagcgtgaagcccagctggggccccggccccagcgagggcgtgactgccgtccccacatccgacctcggagagatccataattggaccgagctacttgatttgtttaaccatactttgtctgaatgtcacgttgagctgtcccagtcaacaaaaagggtggtccttttcgcactctacttggccatgttcgtggtgggactcgttgaaaatctgttagtcatatgcgtgaactggagaggtagtggtcgtgctgggctgatgaacctatacatcttaaacatggcaatagccgacctcggcattgtgctgtcactgccggtatggatgctggaagtgaccctcgattacacctggctctggggcagctttagctgcagattcacacactacttttactttgtgaacatgtactctagcatcttctttcttgtgtgtctttctgtggacagatatgtgacacttactagcgcttccccatcctggcagaggtaccaacatcgagtaaggcgggctatgtgtgctggaatatgggtgctgtctgccatcatccccctaccagaagtcgtgcacatccagctcgttgaaggtcctgagcccatgtgtctgttcatggcaccttttgagacgtactctacctgggccctggcggtcgccctgagcacaacgatcctaggatttttgctgcccttccccttgattaccgtgttcaacgtgctgacagcttgcagactacggcagccaggccagcccaaaagtagaagacactgcctcctcttatgtgcctacgttgcagtctttgtaatgtgctggctaccttaccacgtcacactgctccttctgaccctgcacggtacccacatatctctgcactgccatttggtgcacctgttgtattttttctacgacgtgatcgactgtttctccatgttgcactgcgttattaatccaattctgtataatttcctatcaccacacttccgcggccggctccttaatgcggtggtgcattacctaccaaaagaccagactaaagctggaacttgtgcgagttcttccagttgctcaacccagcattcaattatcattacaaagggcgactcgcaacccgccgctgccgctccacaccccgagccctccctgtctttccaagctcatcatctgctgccaaacacttcccccatctcaccaacgcagccgctgaccccttcttag

SEQ ID NO: 42501 - DNA, 1446 bp, Artificial Sequence
  Description of Artificial Sequence: Synthetic coding sequence
atgcggtggctgtggcccctggccgtgagcctggccgtgatcctggccgtcggtctttccagagtctcgggcggtgcccccctccacctggggaggcatcgagcggaaacacaggagcagcagagcaggtcaaagagaggcacagaggatgaggaagcaaagggtgtgcagcagtacgtgccagaggaatgggccgaataccccaggcccatccaccctgcggggctgcaacccactaagcctctcgtggctacaagccccaatcctggaaaagacggtgggacacctgattctggacaagagctacgggggaatctaaccggcgctcctggccagcggctgcagatccagaacccgctctatccagtgactgaatcttcttattcagcatatgccataatgcttcttgctcttgtggtcttcgctgttggcattgtgggaaatctgagcgtgatgtgtattgtgtggcactcctattatcttaaatcggcctggaatagcatcctagcttctctggccctgtgggatttcctcgtcctctttttctgtttgccaattgtgatctttaatgagataacaaaacaaagactgttgggggacgtgagttgccgcgccgtcccatttatggaagtatcttcccttggtgtcacaaccttctcactgtgcgcccttggcatcgatcgattccacgtggccacctccactctccctaaggtcaggcccatcgaacgctgtcaatccattcttgcaaaactggccgtcatctgggtgggcagtatgaccttggccgtgcccgagctgctcctctggcagctggcccaagaaccagcaccaacgatgggcacattagactcgtgcattatgaaaccctcagcgtcgctgcccgagagcctctattctctcgtcatgacctaccagaatgctcggatgtggtggtacttcggatgttatttttgtctgcccattttgtttacggtcacatgccagctcgtgacatggcgagtccgtggcccacccggaagaaaatcggagtgtcgagccagtaagcacgagcagtgtgagtctcagcttaattccacggtggtaggattaacagtggtgtatgctttctgtaccctgccagagaatgtctgcaacatcgtcgtggcatatctgagcaccgaactgaccaggcagactctggacctgcttgggcttataaatcaattcagtactttcttcaagggcgccatcacccccgttctgttgctatgtatttgcaggcccttggggcaggcattcctggactgctgttgctgttgctgctgtgaagagtgcggtggcgcaagtgaggctagcgccgccaatggctcagacaataaattaaaaacggaggtgtcctcatcaatctattttcacaaacctcgggagagcccccctcttcttccactcggcaccccttgttag

SEQ ID NO: 42502 - DNA, 1047 bp, Artificial Sequence
  Description of Artificial Sequence: Synthetic coding sequence
atgctgctggccctggtggtgttcgccgtgggcatcgtgggcaacctctctgtgatgtgcatagtgtggcactcctactatctgaagtctgcctggaattctatattagcctctctggcgctgtgggatttccttgtcctgtttttctgcctgccaatcgtgatattcaatgaaatcacaaaacagcgcctgttaggggacgtaagctgcagggcagttcccttcatggaagtgtcctccttaggagttaccaccttttcattatgcgccttgggtattgaccggtttcacgtggcaacatcaaccctgcctaaggtgcggcccatagagcgatgccagagcatcctggcaaagctggcggtgatctgggtaggcagtatgaccctggcagtccctgagctacttctgtggcagttggctcaagagcccgcacctaccatgggaacactggacagctgcataatgaagccgagcgcaagcttacctgagtccctgtatagtctggtgatgacgtaccaaaatgcgagaatgtggtggtattttggctgctacttctgcctccctattttattcaccgtgacgtgtcaactggtgacctggagagtgcgtggcccacctggtcgaaaaagcgagtgccgggctagtaagcacgagcagtgtgagagccaactgaattctaccgtcgtagggctgaccgtagtttatgccttttgtaccttgccagaaaacgtttgcaatatagtggtggcctatctgtccacggagttgaccaggcaaactctggatctcttaggcctaattaaccagttctccacatttttcaagggagcaattactcctgtcctgcttctctgtatatgtaggccgttagggcaggccttccttgactgctgctgctgttgctgctgcgaagagtgcggcggcgcgagtgaggcaagcgcagctaatggctccgacaataaactaaaaaccgaagtctccagcagtatctattttcacaagccccgcgaatctcctccgctgctgcctcttggtacaccttgctag

SEQ ID NO: 42503 - DNA, 1014 bp, Artificial Sequence
  Description of Artificial Sequence: Synthetic coding sequence
atgggcaacgacagcgtgagctacgagtacggcgactacagcgacctcagcgaccgacctgtagactgtctagatggggcttgtctggcaatagaccccttaagagtggccccactacccctgtatgccgcaatctttctcgtaggagtgcccggcaacgccatggttgcctgggtggccggaaaggtggcccgacggcgcgtaggtgccacatggctgctgcatctggcagtggccgatctgctgtgttgtctatctctgcccatcctggcggtcccaattgcccgagggggacattggccctatggcgcagtgggttgccgggcactcccttccatcatcttgttgactatgtacgcctctgtgctgttgctcgcggctctcagcgctgacttatgctttttagccctgggcccagcctggtggtctaccgtgcagcgggcttgtggcgtgcaagttgcttgtggggccgcatggactttggccctgctgctcactgtgccatctgccatttatcgaaggctgcatcaggaacatttcccggcccggctccagtgtgtggtcgactacggagggtcatcgagcacggagaatgctgtgacagctatcaggtttcttttcgggttcctgggaccccttgtagccgtggcaagctgccattcggctttactgtgctgggccgcaagacgatgccggccactgggaacagctatcgtcgtcgggttttttgtgtgctgggcgccataccatctgcttggactagtgctgaccgtggccgctccaaatagcgctctcctcgcccgagctctgagggctgagccgctcatcgtgggcctcgcgctggctcactcgtgtttaaatccaatgctgttcctgtacttcgggcgagctcagttgagaagaagtctccccgccgcatgccattgggccctgagggaaagtcagggacaggatgaatccgtggattcaaaaaaaagtacttctcatgacttggtctcggaaatggaggtctag

SEQ ID NO: 42504 - DNA, 1014 bp, Artificial Sequence
  Description of Artificial Sequence: Synthetic coding sequence
atgggcaacgacagcgtgagctacgagtacggcgactacagcgacctgtcggacaggcctgtggattgcctggacggggcctgtctagccatcgaccctctcagagttgcaccgctgccgttgtacgccgcaatatttttggttggtgtgcctggaaacgcgatggttgcctgggtggcgggtaaagttgctagacgaagagtgggtgcaacttggctccttcaccttgcagtggcagacctcctgtgctgcctgagcctccccattctcgcggttcccatagccagaggaggccattggccctatggggcagtaggctgccgggccctgccttctatcatactgttgaccatgtacgcctccgttctgttactggccgctctcagcgccgatctgtgctttctggcactaggcccggcttggtggtccacagtgcaacgggcctgcggagtccaggtggcctgtggagccgcctggacactcgctctgcttctgactgtcccatctgctatttacaggcggttgcaccaagagcattttccagctcgccttcagtgcgtagtcgattatggcggctcctccagcacagagaatgccgtaaccgctatcaggttcctttttggatttctcgggccgctggtggccgtggcctcgtgccactccgcactactgtgttgggctgcccgtcgctgccgcccactgggtaccgctatcgtagtgggctttttcgtgtgttgggcaccctaccatctcctagggctggtgctgacggtcgcagcccccaactccgccttattggcacgtgctttgcgcgctgagcccctcattgtaggactggctctggcacacagctgtttgaatcctatgctattcctgtactttgggagagctcagctccgccggagcctaccggccgcttgtcactgggctctgcgcgaatctcaaggacaggacgagtccgttgactctaaaaagtcaaccagtcatgacctggtatccgaaatggaagtatag

SEQ ID NO: 42505 - DNA, 1155 bp, Artificial Sequence
  Description of Artificial Sequence: Synthetic coding sequence
atgaccaacagcagcagcaccagcaccagcagcaccaccggcggcagtctcctacttctgtgcgaagaggaggaatcatgggctgggagacgcattcctgtttctctcttgtattctggcctagccataggaggcaccctggccaatggaatggtgatttacctggtgagcagctttcggaagctgcagacaacttctaatgctttcatcgtgaacggatgtgccgccgatctctcagtttgcgccctgtggatgcctcaggaggccgttcttgggcttttacctacaggctccgccgaacccccagccgactgggatggcgccggcggctcataccgactcctacgaggggggctactgggtctcggactgacagtgtcattgctttcccactgcctggtggcgctgaatcgctatcttctgataacccgagcgcccgccacctatcaggccttatatcagaggcggcatactgcgggaatgctagccctgagttgggccttggcccttggccttgtactcttgctaccaccatgggccccgagacccggggcagcacccccccgtgttcattaccctgcactgcttgccgcggctgccctgcttgcccagacagccctgcttctacactgctacctagggattgtcaggcgcgtccgtgtgagcgtcaagagagttagtgtactcaactttcacctgctccatcagcttcccggatgtgccgccgccgcagcggcgttccctggggcacaacatgcccccggccccggcggcgcagcacaccccgcccaggctcagcccctgccacccgcactgcaccctagacgggctcaacggaggctgtctggtttatcagtattactgctgtgttgtgtcttcctgctcgcaacacagcccctcgtttgggtgagtctcgcgtcaggcttcagcctgcccgtgccttggggggtgcaggctgctagttggctactttgctgtgctttgtccgctctgaacccgctcctttatacctggagaaacgaagaatttagacggtccgtccgttccgtgttaccaggtgtgggcgatgctgctgccgccgctgtggcggcaaccgctgtccctgctgtctcccaggcccagctgggaacacgggcagccggtcagcattggtag

SEQ ID NO: 42506 - DNA, 963 bp, Artificial Sequence
  Description of Artificial Sequence: Synthetic coding sequence
atgttcctgggcatcctgagcatcgagcagctgatcagccgggtgggtgtcatcggcgtcaccctaatggctttattgagcggcttcggcgcggtgaattgcccttatacatacatgagctactttctcaggaacgtgacagacaccgatattcttgcattagagcgtcggttgcttcagacaatggatatgattattagcaagaaaaaacgcatggccatggccagacgtacaatgttccagaagggggaagttcacaataagcctagcggtttttggggaatgatcaagagcgtgaccaccagcgcttcaggctccgagaacctgaccttgattcaacaggaagtggacgccttggaagagttatcccggcagctgttcctggaaaccgcagacttatatgccactaaagaaagaatcgagtactccaagacctttaagggcaagtacttcaattttctcggatactttttttctatctattgcgtctggaaaatattcatggccacaatcaacatcgtattcgacagggtcggaaaaaccgatccagtcactagggggattgagattacggttaattatctgggcatccaatttgatgtgaagttttggtcccagcatatttccttcatcctcgttggaatcattatcgtgaccagcattcgaggcttgctcatcacactcacgaagttcttctatgctatctcctcttccaaatcgtctaatgtgatcgtgctcctactcgcacaaattatgggcatgtattttgtttccagcgtcctcctgataagaatgagtatgcccctcgaatacagaacaataatcaccgaggtgttgggcgaacttcaatttaacttttaccataggtggttcgacgttatttttttggtgtccgccctgtctagcatactatttttgtatctggctcacaagcaggcccccgaaaaacagatggcgccatag

SEQ ID NO: 42507 - DNA, 1173 bp, Artificial Sequence
  Description of Artificial Sequence: Synthetic coding sequence
atgaccctgacctgcgtgttctgggacgtgaccaagggcaccaccggggactggtcctctgaagggtgttcaaccgaggtaaggccagagggcaccgtatgttgctgtgatcatctgaccttctttgctctgttgctgaggcctactctcgaccagtctaccgttcatattctcacaaggatctcacaggccggttgtggtgtttctatgatcttcctcgctttcaccatcatcctatatgcgttcctcagattgagcagggaacgcttcaagtctgaagatgccccaaagattcacgttgccttaggcgggtcacttttcctgctcaatctggcgttcctggtgaacgtgggctctggcagcaaaggctccgacgccgcatgctgggcaaggggcgctgtattccattacttcctcctgtgtgcctttacgtggatgggccttgaagcatttcacttatacctgctggcggtgagagtgttcaatacatattttggacattacttccttaagcttagtctggttggatggggtttaccggcactcatggtaatcggaacaggttccgctaattcctacgggctctacacgatccgggatagagaaaaccggacctctcttgagctgtgctggtttcgggaaggtacgactatgtacgcattgtacattactgtacacggttacttcctcatcactttcctgttcggcatggtagtgctcgcactcgtcgtgtggaaaatatttacattaagccgggccacagccgtcaaggaacgtggtaagaaccggaaaaaggtgctcactctgttggggctcagtagcttagttggcgtgacttggggtcttgctatctttacacctttgggactgtccaccgtctatatttttgctctcttcaatagtctgcaagggtctagtgtggattgtcaggctctcagtgccggtgagaaactgctcagtctgctgggccttccccaacagccttggaagctaagggctgctgctcatctgccagtgaggatgctcggagcagatgttgattgtaaatggatgcgattcgcttctcctccttcaccacaagcggtggaaaggcaggagggcgggccctccctttacgccagaaggtgtgtgcctgggagggagattttggggcgggggcattgcattatttag

SEQ ID NO: 42508 - DNA, 1650 bp, Artificial Sequence
  Description of Artificial Sequence: Synthetic coding sequence
atggccaccccccggggcctgggcgccctgctgctgctgctgctgctcccaacctctggccaggagaagcctactgaagggcccagaaatacctgcctgggaagcaataatatgtacgacatttttaatctgaacgacaaggccctgtgctttaccaagtgtaggcagtctggaagcgattcctgcaacgtagagaacctccagcgttattggttaaactacgaggcacatttgatgaaagaaggtctgactcagaaggtcaacacaccctttttgaaggctttggtacaaaacctgtctaccaacaccgcagaggatttctatttcagtctggagccgtcacaggtcccgcgccaggttatgaaggacgaggacaaacccccagacagagttcgcctgccaaagtcattgttccggtctctgccgggcaataggagcgtcgttcgactggcagtgacaattttggatattgggcctgggacgttgttcaaagggccacgactgggcctcggcgacggctccggggtcctgaacaataggctcgtaggtctgtctgttggtcaaatgcacgtgaccaaactcgctgaacccctggaaatcgtttttagtcaccaacggcctcctccaaacatgactctgacctgcgtgttctgggacgtgacgaagggcacgactggggattggagtagtgagggctgtagtactgaagtgagaccagaagggacggtttgctgttgcgatcatctgacattcttcgccctgctgctcagaccaacactcgatcagagtaccgtgcacatcctgactcgaatctcccaagcaggctgtggggtatccatgatcttccttgcatttacaatcatcctctatgcatttttgcgattgtctcgggagaggtttaaatccgaggatgcccccaaaattcacgttgcactcggtggttcgttatttctgttaaacttagcattcttggtcaacgtcgggtctggctccaaaggctcagatgctgcctgctgggctagaggagctgtcttccattattttctgctttgtgcctttacatggatgggactggaggcctttcacctgtatctacttgcagtcagggtgttcaacacctattttggtcattatttcctgaagctgtcgcttgtcggatggggattacctgccctcatggtcattgggaccggttcggcaaacagctatggtctctacacgatcagggatcgcgaaaatcgcacttccctggagttgtgctggtttagagaaggcaccaccatgtatgccctatacatcacagtccatggttatttccttatcactttcctattcggaatggtggttctcgcgctggttgtatggaaaattttcactttgagccgggctaccgctgtgaaggaaagaggcaaaaatcgaaagaaggtgttaacgttactaggtctcagcagcctggtgggtgtcacgtggggacttgcaatctttacgccccttggattatcaactgtctacattttcgcattgttcaatagcctacagggcgtgttcatttgctgctggtttaccatactgtacctcccaagccagagtactaccgtgtcgtcatccaccgcccgtctggatcaggcccactcagcctcacaggagtag

SEQ ID NO: 42509 - DNA, 1290 bp, Artificial Sequence
  Description of Artificial Sequence: Synthetic coding sequence
atgaaggacgaggacaagccccccgaccgggtgcggctgcccaagtccctcttcaggagccttccaggtaatagaagtgttgtgaggcttgctgttaccatccttgacatcgggcccggcaccctgtttaagggtcctcgactcgggttaggagacggaagcggagtcctgaataaccgactggttggactctctgtcgggcagatgcacgtaaccaaactggccgaaccccttgagattgtgttcagtcaccagagaccccctccaaacatgaccctcacgtgcgtcttctgggatgtaactaagggcacaacaggtgattggtcctctgagggttgcagcacagaggtcaggccagaaggtaccgtttgctgctgtgaccacctgacattcttcgctctgctgttgcggcctacactggaccaatcgaccgtgcacattttaacaaggatttcgcaggccggatgtggcgtctctatgatatttctggcgtttaccatcatcctgtatgcatttctgcgcctcagcagggaacgatttaagagtgaggacgctccgaagattcacgtggccctggggggctctctgtttctcttaaacctggcgtttctggtgaacgtgggcagcggaagtaagggttctgacgccgcttgctgggcccggggcgcagtgtttcactactttctgctttgtgcatttacatggatgggtctggaggcgttccatctctacctgttggccgttcgcgtgttcaacacatacttcggtcactacttcctgaaattgtcactcgtgggatggggactgcccgcactgatggtgattgggactggtagcgcaaactcctacgggctgtatacaattcgcgatcgggagaacaggacctccttagaactgtgctggttccgcgagggaaccactatgtacgctttatacatcacagtccatgggtactttttgattacattcctgttcggaatggtggttctggcacttgtggtgtggaaaattttcacactctcgcgggccactgccgtcaaagaaagaggcaagaacagaaaaaaagtcttgacgctgctgggcctttcctctctggtgggggtgacttggggactcgctatttttacccccctgggcctgtctacggtgtacattttcgcactctttaactccttacagggggtcttcatttgttgttggtttacaatcctctacttacccagtcagtccacgacagtttccagttcgactgcccgactagatcaagcccactctgcgtctcaagaatag

SEQ ID NO: 42510 - DNA, 1074 bp, Artificial Sequence
  Description of Artificial Sequence: Synthetic coding sequence
atggccaccaccgtgcccgacggctgccggaacggcctgaagagcaagtattacaggctgtgtgacaaggcagaagcttggggcattgtgctggagactgttgctacagctggggtcgtaactagtgttgcatttatgctgacactcccgattcttgtctgcaaagtacaggatagcaaccgcagaaagatgctgcctacccagttcctgtttcttctcggcgtactcgggatattcggcctgactttcgcctttattattggcctcgatgggtctaccggtccaacacgttttttcctgtttggcattttattctccatttgtttttcctgtcttctggcacacgccgtcagcttgactaagttagtaaggggaagaaagcccttatcactcctagtgatcctcggcctggccgtgggattttccctcgtccaggacgtgattgccatagagtatattgtgcttaccatgaaccgtaccaacgtgaacgtgttttcagaactctccgcacccagaaggaatgaggacttcgttctcctgctgacttacgtgctttttctgatggcacttacgtttcttatgtccagcttcacattctgtggctcattcaccgggtggaaacgtcatggcgcccatatctatctgacaatgttactgtccattgctatctgggtggcctggattacattgcttatgctaccggacttcgacaggcgatgggacgatacgatactcagctccgcacttgcggccaacggctgggtgttcctgctggcatacgtgagtcccgaattctggttgctcaccaaacagaggaatccaatggactatcccgtggaagatgccttctgtaagccccagttggtgaagaaaagctacggagtggaaaacagagcctactcccaagaggaaattacccagggtttcgaagagaccggagataccctgtacgctccatatagcacacatttccagctgcagaaccagccaccccagaaagagttctcaatcccacgtgcccacgcatggccatctccttataaagactatgaggtcaagaaggaaggcagctag

SEQ ID NO: 42511 - DNA, 825 bp, Artificial Sequence
  Description of Artificial Sequence: Synthetic coding sequence
atggccaccaccgtgcccgacggctgccggaacggcctgaagagcaaatactaccggctgtgcgacaaagcggaggcctggggcatcgtgctggaaaccgtggccacagcaggggtagtcaccagcgtggcattcatgctgaccctgcctatccttgtgtgcaaggtgcaagattccaatcggagaaaaatgctccctacacagtttctgtttctgctaggtgttcttggcatattcggacttacatttgcctttattataggactggatgggagcaccggtccaactagattctttctgttcggtatactctttagtatctgcttctcctgtctcttagctcacgccgtgtccctgactaagttggtgcgaggacgaaaacctctgagtctgctggtgatcctcggcctggccgtcggcttctcactcgtgcaggacgtcatagctatcgagtacatcgtgctcacgatgaatcgaacaaatgtgaatgttttctcagagctaagcgctccccggcgtaatgaagatttcgtgttattgttaacatacgtgctgtttctgatggccctgacatttctcatgtccagcttcaccttttgtggatccttcacgggctggaagcggcatggagctcacatttacctcaccatgcttctcagtatcgcaatctgggtcgcttggattactctcttgatgcttcctgacttcgaccggcgatgggacgacaccattctgagttccgcactcgctgcaaatggctgggtattcttgctcgcctacgtgagcccagagttttggttactgactaagcagaggaacccttag

SEQ ID NO: 42512 - DNA, 2781 bp, Artificial Sequence
  Description of Artificial Sequence: Synthetic coding sequence
atggccttcctgatcatcctgatcacctgcttcgtgatcatcctggcaactagtcaaccctgtcaaacccccgacgatttcgtggcggctactagtcccgggcatattatcataggtgggctctttgcgatacatgaaaaaatgctatcttcagaggatagtccgaggagaccgcagatccaggagtgtgtagggtttgagatctccgtctttctccaaacgttagccatgatccactctatagagatgataaacaactccacccttttgcccggcgttaaactggggtatgaaatatatgatacttgtaccgaagtaaccgtggccatggccgctacattacgcttcttgagcaagtttaattgtagccgagagactgtagaatttaagtgtgattactcaagttacatgccacgtgtgaaagctgtcatcggctccggttatagtgaaatcactatggccgtcagtcgaatgctcaacctgcagctgatgcctcaggtcggctacgaatccactgccgagattttgtctgataagatcagattcccgtctttcctgagaacagtgccatccgattttcaccagatcaaggcgatggcgcacttgatccagaaatcagggtggaattggatcggtataattacaaccgacgatgattacggtcgactagcgctgaacactttcatcattcaggcagaggccaacaatgtgtgcatcgcattcaaagaggtgctgcccgcctttctgtcggacaatacaattgaggtgcggatcaatcgcactttgaagaaaatcatccttgaagctcaagtgaatgtgattgtggtgttcctgcggcagttccacgttttcgacttattcaataaagcgatagaaatgaacattaacaaaatgtggatagccagcgataactggagcacggccactaagatcaccacaatacccaacgtaaaaaagatagggaaggtcgtgggatttgcctttaggagaggcaatatctccagcttccatagtttcctgcagaatcttcatctgctgccttccgactcacacaagcttctgcacgagtacgccatgcacctgtctgcctgtgcgtacgtgaaggatacagacctttcccaatgtatcttcaaccactcacagaggaccctggcctataaagctaataaagctatcgaacggaactttgtgatgagaaacgattttttatgggattatgctgaaccagggctgattcattctatccagctggccgtgtttgccctgggatacgctattagggacctgtgccaggccagagactgccaaaatccaaacgcgtttcaaccgtgggagctcctcggcgtcctaaagaacgttaccttcactgatggctggaattcctttcattttgacgcccacggagacctgaatacaggatatgacgtggtgctctggaaggagattaacggccacatgactgtgacgaagatggctgagtacgatctgcagaatgacgtatttatcatccctgatcaggaaaccaaaaacgagttccgaaacctgaaacaaattcagtcaaaatgctctaaggaatgtagcccgggtcagatgaaaaaaacaacccgaagccagcatatctgttgttatgaatgtcagaattgccctgaaaaccactataccaatcagacggacatgcctcactgtcttctctgcaacaataagacccactgggctcctgtccgcagtaccatgtgttttgagaaggaggtcgagtatctaaattggaacgattccctggctatattgcttctgatcctaagtctactcggtatcatttttgtcctcgttgtcgggattattttcacgcgaaacctcaatactcccgtggtgaaatcttccgggggcctgcgcgtctgctatgtgatcctcctgtgtcatttcttgaacttcgcctctacctccttcttcattggcgagccacaagatttcacttgtaagacaagacagactatgtttggcgtgtccttcaccctctgtatctcttgtattcttactaaaagtctcaagattcttttggcattctcatttgaccctaagctgcagaagtttctgaagtgcctgtataggcctatccttatcatcttcacctgcacagggattcaggtggtgatctgcaccctatggttgatctttgctgctcctaccgtggaagtcaacgttagccttccacgggtgatcattctggagtgcgaggagggctcaattctggccttcggcacgatgttgggttatatcgccatcctggcatttatctgcttcatctttgcttttaaaggcaagtatgagaactataatgaggccaagttcattacttttggtatgctcatttattttatcgcatggattacttttatacccatctacgcaaccactttcgggaagtatgtgccagccgttgaaattatcgtgatccttatatcaaactacggcatcctttattgtactttcatcccaaagtgttacgtgatcatctgtaagcaagagataaataccaaatccgcctttctgaagatgatttactcctactccagccatagcgtgtctagtatcgcactatctccagcgagtcttgatagtatgtccggaaatgtgaccatgaccaatccctcgtccagcggtaagagtgctacctggcagaagtcaaaagacctacaagcccaggcctttgcccacatttgcagagaaaacgcaaccagcgtctccaaaacactgccccgcaaacggatgtcatccatctag

SEQ ID NO: 42513 - DNA, 2568 bp, Artificial Sequence
  Description of Artificial Sequence: Synthetic coding sequence
atggccttcctgatcatcctgatcacctgcttcgtgatcatcctggctacgtcccagccatgccagactcctgatgacttcgtggccgcaacctcccctggccatattataattggagggctattcgccatacatgagaaaatgctgtcttctgaggacagtcctcggagaccacagattcaggagtgcgtaggttttgagatttccgtgttcctgcagaccctggctatgatccatagcatcgaaatgattaataatagcactcttttgcctggagtcaagctgggctacgaaatctatgatacgtgtactgaggtcaccgtggccatggctgccaccctgcggtttctcagtaagtttaactgttcgcgcgagacggtggagtttaagtgtgactacagtagttacatgccccgcgtgaaagctgtaattggcagcgggtattcagaaattactatggctgtgagtaggatgctgaatctgcagctgatgcctcaggtcggctacgagagcactgccgagattctgtcggacaagatcaggttcccctctttcttacgcacagtccctagcgatttccaccaaattaaagcaatggcacacctgatccagaaaagtgggtggaactggataggcatcatcaccacggacgacgactatggccggttggctctcaatacctttatcatccaggccgaggcaaacaatgtgtgtatagctttcaaggaagtactaccggccttcctctcagacaacaccattgaagtgcgcatcaacaggaccttaaaaaaaattatattggaggcacaggtgaatgtaatcgttgtcttcctcagacagttccatgtgttcgacttgttcaataaagctatcgaaatgaatatcaacaagatgtggatagcttcagataattggtctactgcgacaaagatcaccaccattcccaatgtgaagaagatcggtaaggtggtggggtttgcgtttaggcgggggaacattagttcatttcacagttttctgcagaatcttcatctgttaccctccgattcacataagctgctacacgagtatgcaatgcatttgagcgcctgtgcatacgtaaaagatacagacctgtcccaatgcatttttaatcactcccagcggacccttgcgtataaagcgaataaggccatagaacgtaacttcgttatgcgcaacgacttcctttgggactacgccgaacctggccttattcattcgatccaactcgccgtgtttgcactgggttacgccattcgcgacctgtgtcaggcacgtgattgccagaaccctaatgcctttcagccctgggagcaaattcagagcaagtgttccaaggagtgctctcccggccagatgaaaaagacaacacggtcgcagcacatttgctgttatgaatgtcaaaactgtccagaaaaccattatacgaatcaaactgacatgcctcactgtctgttgtgcaataacaagacgcattgggcacctgttagaagcactatgtgcttcgaaaaggaggtcgaatatcttaattggaacgattcactcgctatactgcttcttatcctcagcctcttggggataatcttcgtactcgtcgttgggatcatctttacgcgcaacctgaatacccccgtagttaaatcttcaggaggcctgcgggtctgctacgtgatcttactgtgtcacttcctgaacttcgcatctacttctttttttattggcgagcctcaagatttcacttgtaagactcgtcagactatgttcggagtgtccttcacgctctgtatttcgtgcatactgactaaatcgcttaagatcctgctggccttctcctttgaccccaagctgcagaagtttctaaagtgcttatacagacccatcctcattatatttacttgtaccggaattcaggtcgtgatctgtacactatggctgatttttgccgcccccacagtggaggtgaacgttagcctgccacgggtgattatacttgaatgtgaagagggatctatcctggccttcggaaccatgctgggatacatcgccattctggcctttatctgttttattttcgccttcaagggcaaatacgagaattacaatgaagccaagtttatcacgttcggtatgttaatatacttcattgcctggattacatttattccaatctatgcgacaacgttcgggaaatacgttcccgcagtggaaattatcgtgatcttaatttccaattacggaatactgtactgcacctttatccctaagtgttatgtaatcatctgtaaacaggaaataaacacaaaatctgcgtttttgaagatgatttattcctacagctcacactccgtcagcagtatagcactctctcctgcctcccttgatagcatgagcggcaacgtgacaatgacaaacccatcctcatctgggaagtcagccacctggcagaagagtaaagacttgcaagcccaggcttttgcgcatatctgtagggaaaacgccacctcagtgagtaagaccctgccccggaagaggatgtccagcatctag

SEQ ID NO: 42514 - DNA, 2256 bp, Artificial Sequence
  Description of Artificial Sequence: Synthetic coding sequence
atggccttcctgatcatcctgatcacctgcttcgtgatcatcctggcaacttcccaaccttgccagactccagacgatttcgtcgctgcaacttctcctggccacatcatcataggcgggttgttcgccattcacgagaagatgctgtcctctgaagacagtccccggagacctcagatccaagaatgtgtcggcttcgaaattagtgtttttcttcaaacgcttgcaatgatccactccatagaaatgatcaacaattccacgctgctgcccggggtgaagctgggctatgaaatatatgacacctgtacagaagtgacagtggcgatggctgctaccctgaggttcctgtctaaatttaattgtagtagggagaccgtagagtttaagtgcgactacagttcctatatgccaagagtcaaagcagttattgggtctggctattccgagataaccatggcggtctcccgtatgctgaacctccaactgatgcctcaggttgggtacgagtccactgctgagatcctttcagacaagatccgttttcccagcttcttgagaacagtgccctcagacttccaccaaatcaaggcaatggctcacctaattcagaaatccggatggaattggatcggtattataacaacagatgacgactatggtaggttagccttaaacacgttcattatccaggctgaggcaaacaatgtttgcattgcctttaaagaggtgctacctgctttcctttccgacaatacaatagaggtaaggatcaacagaactctcaagaagattatcctggaagcacagctgctgggcgtattgaaaaacgtgacgtttactgatgggtggaattcctttcacttcgacgctcatggtgacctgaatacagggtacgacgtggtgctctggaaggagatcaatggacacatgactgtcaccaagatggctgagtacgatctgcagaacgacgtgttcattattcccgatcaggagacaaaaaatgaattcagaaatctgaaacagatacagtccaaatgctccaaagagtgtagcccagggcaaatgaaaaagactacgagaagccagcacatctgctgctacgagtgtcaaaactgtcctgaaaaccattacactaaccagactgacatgcctcactgcctcttatgcaacaataagacccattgggccccagtacgctccactatgtgctttgagaaggaagtcgagtaccttaactggaatgacagcctcgcaatcctgctgctcatcctttctcttctgggcatcattttcgtgctggtcgtggggattatcttcaccagaaacctgaataccccagtggtgaagtctagtgggggcctccgggtctgttacgtaattctcctgtgtcattttctgaactttgcatctacgagcttttttatcggtgagccgcaggactttacttgcaagacccggcagactatgttcggtgtttcttttacactgtgcatctcgtgcatcctgacaaagtcactgaagattttgcttgcattcagcttcgacccaaagctgcagaagttcctgaagtgtctctaccgccccatactgataatttttacctgtacgggtatacaggtggtgatctgtacactgtggttgattttcgctgcccccaccgtagaagtaaacgtctccctgcctagggtgattattttggaatgtgaagaaggtagtatcttggcctttggcactatgttgggatatatcgcaatcttggcattcatatgtttcatttttgcctttaagggcaaatacgaaaattacaacgaggctaagtttatcaccttcggcatgctgatttatttcatcgcttggatcactttcattccaatttacgctacgacctttggtaaatacgtaccagcagtcgagatcattgtgatactcatctcaaactacgggatcctgtattgtacattcataccgaagtgttatgtgataatatgcaaacaggaaatcaacacaaaatccgctttcctgaaaatgatctattcctattcctcgcatagcgtgtcctctatcgcccttagccccgcaagtctggacagcatgtcagggaatgtgaccatgaccaacccttctagcagtggaaaatcagccacctggcagaagtccaaagatctccaggcgcaagcctttgcgcacatttgcagagagaacgccactagcgtctcgaaaactctccctaggaagaggatgtcttccatatag

SEQ ID NO: 42515 - DNA, 330 bp, Artificial Sequence
  Description of Artificial Sequence: Synthetic coding sequence
atgaaggaggaggacagcagcttcaagctgtgcgtgcccggcatcgttgcactgcagagtccgcccaacaaggcctttcggagtactgatactgttggctttctggagtcggaactgaagaaacttctgggaatgcaacaggaatctcggctgtggaaactgggtagtcaagaaggcagggagctacttaccaggccagaaatcaccgtagtcgagggcgagggctacgaagtccaaagaagactgcgtcatctgccgagcccgatctcagtggctcagtgcctgcttttggaagagaaaggcgaaatgggtaattggcctccggagtag

SEQ ID NO: 42516 - DNA, 2886 bp, Artificial Sequence
  Description of Artificial Sequence: Synthetic coding sequence
atgctgctgctgctgctgctggcccccctgttcctgcggccccccggagctggtggcgtacagaccccaaatgctaccagcgaaggctgtcaaatcatccacccaccatgggaggggggcatccggtatcgaggcctgacacgggatcaggtaaaagctatcaacttcctgcccgtcgattacgagatagagtacgtttgccgtggggagcgcgaggtggtgggccctaaagtgcggaaatgcctcgccaatggaagctggaccgatatggataccccatcccgctgcgtccgcatttgctccaaaagttatcttaccctcgaaaatggaaaggttttcctaaccggaggcgatctgcctgcactggatggcgcccgggtggattttcgatgcgatcccgacttccatttagttggaagctcacggtcaatctgttcacagggccagtggtccacacccaagccccactgccaggtgaacaggactcctcatagtgaaagaagagccgtgtacattggtgccctcttcccgatgagtggcgggtggccagggggccaagcatgccagcctgctgtagagatggcgttggaagacgtcaatagcagacgggatatcctccccgattatgagcttaagctgatccaccatgattccaagtgtgacccaggccaggccacaaaatacctgtatgagttgctgtataacgatcctattaaaataattctcatgccaggctgctcatccgtttctaccctcgtcgccgaagctgccaggatgtggaacctgatcgtgctctcttacggtagctcttctcccgctctgtctaacagacagcgctttccaacgttcttccgcacacacccatctgcgacactgcacaaccctacaagagtcaaattgtttgaaaagtggggctggaagaagatcgcaacgatccaacaaactaccgaagtgtttactagcactcttgatgacctcgaggagagagttaaagaagccggaattgaaatcacctttcgccagtcgtttttctccgatcctgccgtccctgtcaagaaccttaaacggcaggacgctcggatcattgtaggactattctacgagacagaggctcgaaaagtattttgcgaggtgtacaaggagaggctgtttggtaaaaagtacgtatggttcctaattgggtggtatgccgataactggtttaaaatctacgatccgagtattaactgcacagtggatgaaatgaccgaagccgtggagggtcatatcactactgagattgtaatgttaaaccccgccaacactagatccatcagtaacatgactagccaagagttcgttgaaaaacttaccaaacgactgaagcgacacccggaggagaccgggggcttccaggaggccccgctcgcttacgacgcaatctgggctttggccctggcattgaataaaacaagtggaggtgggggccgcagcggagtgaggctcgaagacttcaattacaacaatcagacaataactgatcagatctaccgggcaatgaatagctccagtttcgaaggcgtgtccggacacgtcgtatttgacgcctccgggtcccgtatggcttggacactcatagagcagctccaaggcggttcctacaagaaaatcgggtactacgacagcaccaaggatgatcttagctggagcaaaacagacaagtggattggtgggtcacctcctgctgatcagacacttgtgataaaaaccttcagattcctctcccagaagttgttcataagcgtttccgtgctttcttcgttgggcatcgttctggccgttgtctgcctgtctttcaatatctataacagccacgtgcgctacatccagaattcccagcccaatctaaacaacttgactgccgtgggctgtagccttgctctggccgcggtgtttccactagggcttgatggctaccacattggcagaaaccagtttccctttgtctgtcaggcccgtctgtggttactaggcctggggttctcgctgggctacggctcaatgtttacaaaaatctggtgggtccatactgtgtttactaaaaaggaggagaaaaaagaatggcgcaaaacacttgagccctggaagttgtatgctaccgtgggactgctggtaggtatggacgtgcttaccctcgccatatggcagatcgtggatcctctccacaggacgatcgaaaccttcgcaaaggaagaaccgaaagaggacattgatgtctctatactgccacaactcgagcactgcagtagtcggaagatgaatacttggcttggcatcttttatggatacaaaggacttctgctgctcttagggattttcttagcttatgaaactaagtcagtcagtacagagaaaatcaacgaccaccgcgccgtggggatggccatctacaacgttgcagtgctttgccttatcacggcccctgtgaccatgatcctaagctctcaacaggacgcagcatttgccttcgcctctttggccatagtctttagttcttacatcacgctggtggtgctgttcgtgccgaagatgaggagattgattacgcgcggggagtggcagagcgaggcgcaggacactatgaaaaccggttcttccacgaacaacaacgaggaggagaagtcccgactactggaaaaagaaaatagggagcttgagaaaataattgctgagaaggaagaaagggtgagcgagctgagacaccagttacagtcccggcagcagctccgcagccgtagacaccctcctacccctccggaaccgagcggagggctgcccaggggccctcctgaaccacctgatagactgtcctgtgacggttctagggtccatctcttatacaagtag

SEQ ID NO: 42517 - DNA, 2700 bp, Artificial Sequence
  Description of Artificial Sequence: Synthetic coding sequence
atgctgctgctgctgctgctggcccccctgttcctgcggccccccggagcaggtggcgtgcagacacctaacgccaccagcgagggatgccagataatccaccccccctgggaggggggcatcagataccggggactcacgcgggaccaggtgaaagctatcaattttctacccgtggactacgagattgagtatgtttgccgaggagaaagggaagtggtcggtcccaaagtccgaaaatgtcttgcaaacgggtcttggactgacatggataccccttcacggtgcgttaatcggacccctcacagcgaacgaagagcggtgtacattggagctttgttcccgatgagtggcggttggccgggtggtcaggcgtgccaacccgccgtggaaatggctttagaagacgtgaactctcggcgagacatcctgcccgattatgagctgaagctcattcatcacgacagcaagtgtgatccgggtcaggcgacaaagtatttgtacgaactgctctataatgatcctatcaaaattattttgatgcctggatgctccagtgtttctacgctggtggccgaggcagcacgcatgtggaatttgatagtattgagttatggctcctcctcccccgccctatctaaccggcagcggtttccgacctttttccggactcatccatccgctaccctccataatccaacccgcgtgaaactatttgagaagtggggatggaaaaagattgccacgattcaacagacaacagaggtttttacgtcaaccttggatgatcttgaagaacgggtcaaggaggctggcatcgaaatcacttttcggcagtccttcttttctgaccctgccgttcctgtgaagaacctaaagcgccaggatgcccgaattattgtaggcttattttatgagactgaagcaagaaaagtgttttgcgaggtttacaaggagaggctctttggaaagaagtacgtctggtttcttatcggatggtatgccgataattggttcaagatatacgaccccagcatcaactgcaccgtggatgagatgactgaagccgttgagggccacataaccacggaaatcgtcatgctcaaccctgccaacactcgatctataagtaatatgacgtcacaagagtttgtggagaagcttacaaaaagactgaagcgccacccagaggaaacaggcggattccaagaagctcccctggcttatgatgccatttgggctttggctctggcactgaacaagacaagtggggggggaggccgctctggggttagactggaggacttcaactataataaccagacaatcactgaccagatctatcgcgcgatgaactcttctagcttcgagggggtctccgggcatgtagtattcgacgcgtccgggtcacgtatggcatggacattaattgagcagcttcaggggggctcttacaagaaaattggatattatgacagcacaaaggacgacctgtcttggagtaaaaccgataagtggatcggagggtcgcctccggcagatcaaacccttgttatcaagacctttaggtttctgtcccagaagttgttcatctccgtgtcagtcctgtccagtcttggcatagtgcttgccgtggtgtgtctctcttttaacatatacaatagccacgtgcgatatattcagaactcccagcccaatttaaacaatttgaccgccgtaggttgttctctggctctggcagccgtatttccactcggcctggacggttaccacatcggcagaaaccagtttcccttcgtttgtcaggcacgtctctggctcctaggtctcggattcagtctgggatacgggagcatgttcaccaaaatctggtgggtacacacagtgtttaccaagaaggaagagaaaaaggaatggaggaagaccctcgagccgtggaaattatacgcaaccgtgggcctcctggtgggtatggatgttttgacgctggccatatggcagattgtcgaccctctgcatcgcactattgagacattcgcaaaggaggagcctaaggaagatattgacgtgtccatccttccacagctggagcactgtagctctagaaaaatgaatacgtggcttggaatcttttacggctataaaggcctgctcctgcttctgggtatatttttagcgtacgagaccaaaagcgtatcaaccgaaaagattaatgaccatcgtgcggtgggaatggctatatataatgtggctgtcctgtgcttaatcaccgctccagtcacgatgatcctttcttcccagcaggatgccgccttcgccttcgcctctctggccattgtcttttccagctacatcacacttgttgtgctgtttgttccaaagatgaggcggctgattacccgaggcgagtggcagtctgaagcgcaggataccatgaagacaggaagttccactaacaataatgaggaagagaaatcccgactgctggagaaagagaatagggaactcgagaaaatcatagcagaaaaagaggagcgagtctcagagcttcgccaccaactgcagtctcgacagcagctgagaagtcggcgccacccccccactccccccgagccctcaggaggcttgcccaggggtcctcccgaaccccccgaccggctgagctgcgatggatcacgtgtgcatctattgtataagtag

SEQ ID NO: 42518 - DNA, 2535 bp, Artificial Sequence
  Description of Artificial Sequence: Synthetic coding sequence
atgggccccggcgcccccttcgcccgggtgggctggcccctgcccctgctcgtggtgatggccgcaggtgttgcacctgtgtgggcctcacattccccccatcttccgaggccccattctcgggtcccgccgcatccttcctcagagaggcgcgcagtctacataggggccctttttcctatgtccggaggatggcctggaggacaggcctgtcagcccgccgtcgaaatggccctcgaagacgttaattcaaggcgggacatcctgcccgactatgagctgaagttgatccaccacgacagtaagtgcgaccctgggcaggctactaagtatttgtacgagctgctctacaacgacccgattaaaattatcctcatgcccggatgttcttccgtgagcacacttgttgcagaggcagctcgtatgtggaatctgatagtgttgagctatggctctagtagccctgccctgtcaaaccggcagcgattccctacattcttccgtacccacccaagcgctacgctccacaaccccacccgtgtgaaattgttcgaaaaatggggctggaagaagatcgcgaccatacagcagacaaccgaggtgttcacgagcaccttggacgacctggaggagcgagtaaaagaggccggaatcgaaatcacctttcgacagagcttcttttcagatcccgccgtgcctgtaaaaaatctgaagaggcaggacgcgcgcatcatcgtcggcctgttttacgagacagaggcgagaaaagtcttctgtgaggtgtataaggagcgccttttcggcaagaagtacgtgtggttcctaatcggttggtatgcagacaactggttcaaaatttacgatcccagcattaattgcactgtagatgagatgacagaagcggtggagggccatattaccacggagatcgtcatgctgaacccagcaaatacgcgctcaatttctaatatgactagccaggaatttgtcgagaaacttacaaaacggctcaagagacaccctgaggaaacgggtggattccaggaagcacctctggcatatgacgcgatttgggctctggcactagcattgaataaaacctctggtgggggtggaaggtccggggtcaggctggaagatttcaactataataatcagaccataaccgatcaaatttatagggctatgaacagttccagtttcgagggagtgagtggccatgtggtcttcgacgcaagtggatccaggatggcatggactttaattgagcaactgcaggggggctcctacaagaagattggatattacgacagcacaaaggatgatctgtcttggtccaagaccgataagtggatcgggggttcaccacctgctgaccagaccctggtcattaaaaccttccgcttcctctcgcagaagctctttatctctgtctccgtgttgtccagtctcggtatcgtactggccgttgtatgcctctctttcaatatctacaatagccatgtccggtacatccagaacagccagcctaatcttaacaaccttaccgcagttgggtgtagccttgctctggccgcagttttcccgttaggtctcgatggctaccacataggcaggaaccagtttccatttgtgtgtcaggccaggctgtggctgctgggacttggtttcagcctgggctatggaagtatgtttactaagatatggtgggtccacacggtttttacaaagaaagaggaaaaaaaagagtggcggaaaaccctggagccttggaagctgtatgccacagtcggcctgttggtgggaatggacgtgcttacgctcgccatttggcagattgtggaccccctgcaccgaacaatcgaaactttcgctaaggaagaaccaaaggaggacattgacgtgtccatattgcctcagcttgaacattgcagctctaggaaaatgaatacctggctcggcatcttttatggatacaaagggctgctgctgctgctgggcatctttctggcctacgagacaaaatccgtgtccaccgagaagatcaacgaccaccgcgccgtcggaatggctatctataatgtagccgtactgtgcttaatcacggcccccgtgactatgattttaagctcacagcaggacgccgcattcgctttcgcctcccttgcgatagtgtttagcagctacattacactggtagtgttgttcgtgcctaaaatgcgacgcctcattactcgaggcgaatggcaatcagaggcacaggatactatgaagacaggatcaagtaccaataataacgaagaagagaagagtcggctgttggagaaggagaacagagagctggagaagattatcgcggagaaagaagagagagtatccgagctccgtcaccagctccagtctcggcagcagttgcggtctagacggcatccacccacaccccctgagccatcaggaggcctccctaggggccctcccgagccacccgatcgtctgtcttgtgacgggagccgggtgcaccttttgtacaagtag

SEQ ID NO: 42519 - DNA, 2535 bp, Artificial Sequence
  Description of Artificial Sequence: Synthetic coding sequence
atgggccccggcgcccccttcgcccgggtgggctggcccctgcccttacttgtggtcatggccgccggtgtggctcccgtgtgggccagtcacagcccccacctgccaagacctcactcgcgggtgccaccccacccatcttccgagagacgagctgtgtatataggcgctctcttcccaatgagtggtgggtggcctggtggacaggcctgtcagcccgccgtggagatggctttagaagatgttaactctaggagagatatcctgccagattacgaactcaaactgatacaccacgattctaaatgtgacccaggccaagccacaaaatacctgtatgagcttttgtataatgacccgattaaaattattttgatgcccggctgttccagtgtttccactctggtggccgaagccgcaagaatgtggaacctgattgttctgagctacggctcttcttctcccgcactgtccaatcggcagcgcttcccaactttcttccgcactcatccgtcggccacactgcataatcctacccgcgtgaagttgtttgagaaatggggttggaaaaagatcgctacaatccagcaaaccactgaagtttttacgagcacattggacgatcttgaggaacgggttaaggaggctggcatcgagatcacattcaggcagtccttttttagcgaccccgccgtacccgtgaaaaatctcaaaagacaggatgcccgcataatcgtgggcctcttctatgaaacagaggctagaaaagttttttgcgaagtgtataaagagagactgtttggcaagaaatatgtgtggtttctcataggttggtacgcagacaattggtttaagatctatgacccaagcatcaactgtacagtggacgagatgaccgaggcggttgagggccacattactacagagatagtcatgctcaaccccgcgaacactagaagcatcagcaacatgacctcacaagagtttgttgaaaaacttactaagagactcaaacggcaccctgaggaaaccgggggatttcaggaggctccccttgcgtacgacgctatctgggctctggccttggccctgaataaaacttcagggggcggcggccgcagcggagtgcgtctagaagattttaactacaacaatcaaactatcactgaccaaatttacagggccatgaattctagttcttttgaaggcgtgagtggccacgtggtgtttgacgcctccgggagccggatggcttggacattgatcgagcaactccaaggcggctcttataaaaaaataggatactacgatagtacaaaggatgacctgtcttggagtaaaaccgataagtggatcgggggaagcccccctgccgaccaaacactggtgattaagaccttcagatttctgtctcagaaactgtttattagtgtctctgttctgagcagcctgggtattgtgttggcagtcgtttgtctgagctttaatatttataactcccatgtgagatatatccagaactctcagccgaaccttaacaatctgacagctgtcgggtgctcattggcgctggcagctgttttccctctcggcctggacggatatcacatcggtagaaaccaatttccattcgtttgtcaggccaggttgtggctcctcggcctgggcttctcactggggtacggttcaatgtttaccaagatctggtgggtgcatactgtgttcactaaaaaagaagagaagaaagagtggaggaagaccctcgagccttggaagctctatgccacagtgggcttgctggtgggaatggacgtgctcacgctggctatctggcagattgttgacccacttcatcgtacaattgagacattcgcgaaggaagagccaaaagaggatattgatgtgtctatattacctcagttggaacactgctcatcaagaaagatgaacacctggttgggcattttctatggctacaagggacttctgctgctccttggcattttcttagcttatgaaactaaaagtgtgtctactgagaaaataaacgaccatagggctgtgggcatggccatctataacgtggcagtcttgtgcttgattacagcacccgttacaatgatcctttccagtcaacaggatgccgcctttgcgttcgcaagcctggccattgtgttttcctcgtacattaccctggtggttcttttcgtgccaaagatgcgcaggctcattacaagaggagagtggcagagtgaggcccaagacacgatgaagacaggttcttctaccaataataatgaagaggaaaaatccaggttgctcgagaaagaaaatagagaactggagaagatcatcgcggaaaaagaggagagggtgtccgaactaaggcatcagttacaatcaagacagcagctccgcagtcggaggcaccccccaacgcctcctgagccatccggcggcttgccacgcggtccacccgaacctccagaccgactatcatgcgacgggtcccgagtacacttgctttacaagtag

SEQ ID NO: 42520 - DNA, 1737 bp, Artificial Sequence
  Description of Artificial Sequence: Synthetic coding sequence
atgctgctgctgctgctgctggcccccctgttcctgcggccccccggtgccggcggggttcagactccaaatgccacaagtgaggggtgccagatcatccatccaccttgggaaggcggcattcgctacagaggcctcactagagaccaggtgaaggcgataaacttcctgcccgtggactatgagatcgaatatgtgtgtaggggtgaaagagaagtcgttgggcctaaagtccgtaagtgtctggccaatgggtcttggacagatatggacaccccttctcgctgcgtaaggatttgttctaaaagttacctgacactggagaacggaaaagtcttcctaaccggcggcgatctacctgcgcttgacggagcaagagtcgatttcaggtgcgatccggactttcatcttgtcggatctagccggagtatctgcagtcaaggtcagtggtccaccccaaagccccattgccaagttaacagaacaccacattccgagcgacgggccgtttacatcggagccctttttccgatgtctgggggttggcccggcggccaggcatgccagcccgccgtcgaaatggccctggaagacgtcaatagcaggcgcgacatactgccagattatgagcttaaacttattcaccatgacagcaagtgcgatccaggccaagcaacaaaatatctttacgaactactttataacgaccctatcaaaattatcctcatgcccggctgctcttctgtgtcgactctcgtggcagaggccgcgcgtatgtggaatttgatcgtcctgtcatacggaagcagttctcctgccttgtcaaaccgtcagagatttcccactttctttcgaacccacccctccgccactctgcacaaccctacgcgcgttaagctgttcgagaagtggggctggaaaaaaatagccaccattcagcaaactaccgaggtcttcaccagcactctggatgatcttgaggaaagagtgaaggaggctggtatagaaattaccttccgccagtccttttttagcgaccctgccgtccccgtgaagaacctaaagcgccaggacgctaggattatcgtcggcctcttttatgaaaccgaggcccgcaaagttttttgcgaggtttacaaagagagactgttcgggaagaaatatgtgtggttcctaatcggttggtacgctgataattggtttaaaatttacgatccctcaatcaattgcacagtggatgaaatgacagaggccgttgaggggcacatcacaacagagattgtcatgctgaatcccgctaatactcggagcatatccaacatgactagtcaggagttcgtggagaaactgactaaacgtttaaaacgacaccctgaggagactgggggtttccaggaagctcccctggcctatgatgcaatttgggccttagcactggcacttaacaaaacctccggcggcggaggcagatctggagtgaggctggaggactttaattacaataaccagaccattaccgatcagatatatagggccatgaattctagctcttttgaaggagtgagtggacacgtagtctttgacgcgtctggtagccggatggcttggacattgattgagcagctgcagggagggagctataagaagatcggttactatgatagcaccaaggatgacctgagctggtcaaagacagataagtggatcgtcataagtcgtactcattctccaacctag

SEQ ID NO: 42521 - DNA, 1989 bp, Artificial Sequence
  Description of Artificial Sequence: Synthetic coding sequence
atggccgccgagaacgaggccagccaggagagcgccctgggcgcctattctccggtggattacatgagcatcaccagtttcccaagactccctgaggatgaacctgcgccggctgcccccctgcgcggaaggaaggacgaggacgccttcctgggcgaccccgacaccgatccggattcatttctgaaatccgcccgactgcagcggctcccctctagcagttctgagatggggtctcaggatggttctcccctgagggaaacccggaaagacccttttagcgccgctgccgctgaatgctcctgccgtcaggacggcttgaccgttattgtgaccgcatgcctgacctttgccaccggggttacagtggcgcttgttatgcagatctattttggggacccgcagatcttccaacagggcgcagtggtaactgatgcggcccgctgcacctcactcggcattgaggtgctgtcgaagcagggatcttctgtcgatgccgccgttgccgccgcactgtgtctcgggattgtcgcccctcacagttcgggtctggggggcgggggcgttatgctcgttcatgatatcaggaggaacgagagtcatttaattgattttagagagtctgctcctggcgcgttacgggaagaaacactacaacgcagctgggaaacaaagcccggattgctagtcggagttccaggtatggttaaagggttgcacgaagcacaccagttatatggacggctgccttggagccaagtgttagccttcgctgctgcggtcgcccaggatggatttaacgttacccacgatttagcccgtgctcttgccgaacagttaccgccgaacatgagcgagcggtttagggagacatttcttccgtccgggaggcctcctctcccaggcagtctcctgcacaggccagacttagccgaagttcttgacgtcttgggcaccagtggtcccgctgcattttacgcaggcggaaaccttacactggaaatggtcgcggaggcacaacacgccgggggcgtgattacggaagaagactttagcaactatagcgctctggtggagaagcctgtctgcggcgtgtatcgaggacacctcgtgctctcccccccaccacctcatactggccctgccctcatctctgctctgaacatcctggaggggttcaaccttacctccttagtgagcagagagcaggccttacattgggtggctgaaacactgaagatagcgttggcacttgcttctcgcctgggcgatccagtctatgactcaaccatcactgagtccatggatgatatgctgagtaaagtggaggctgcgtacctgagagggcacatcaacgattcccaggcagcgccagccccactactacctgtctacgagttggacggtgcccctactgccgcgcaagtcctcatcatggggcccgacgactttatcgtggctatggtgagcagcctgaaccagcccttcgggagcggactcattaccccatcgggaattctcctgaactcccaaatgcttgatttctcctggcccaacaggactgccaatcactcggcaccttccttggagaactctgtccagccaggtaaacgccccttgtcttttctacttccgacggtggttaggcccgcagagggactttgtggcacttacctcgcattgggggctaacggtgccgcccgcggactttcgggtctcacacaggtgcttctaaacgtcctcaccttaaaccggaaccttagcgactctctggctcgaggacgacttcacccagaccttcagagtaatctcttacaggtggattccgagtttaccgaagaggaaatcgaattcctagaagcgaggggtcaccatgtggaaaaggtagacgtgctatcctgggtgcacggcagcagacgaaccaacaatttcataattgccgtcaaagacccgaggagcccggacgctgccggcgcgaccatcttgtag

SEQ ID NO: 42522 - DNA, 1185 bp, Artificial Sequence
  Description of Artificial Sequence: Synthetic coding sequence
atgatcgtgttcatcttcctggccatgggcctgagcctggagaacgaatatacaagtcagacaaacaactgtacttacctgcgcgagcagtgtttacgagacgcgaacggctgtaaacacgcctggagagttatggaggatgcgtgtaatgacagtgacccgggtgatccctgtaagatgagaaacagctcatattgcaatctgagcatccaatatcttgtcgagtccaatttccagtttaaagagtgtctttgtactgatgacttttattgtaccgtcaacaagctcctgggcaagaaatgcattaacaagagcgataacgtcaaagaggataagttcaagtggaacctgacgacacgatctcatcacgggtttaagggcatgtggtcgtgcttggaagttgcagaagcatgcgtgggagatgtagtttgtaacgcacagctagcctcttatttgaaagcatgttcagcaaacggcaatccatgtgacctgaaacagtgtcaagcggcaattcgatttttctaccaaaacattcccttcaacatagcacagatgctcgcgttctgcgactgcgcccagtcggatatcccgtgccaacaaagcaaagaggccttacatagcaaaacttgcgccgtcaacatggtgccgccccctacgtgcttgtccgtaatccggagctgtcagaacgatgagctctgtcggaggcactatcgtacatttcagtccaaatgttggcagcgcgtaacccggaagtgtcacgaagatgagaactgcatctctacgctgtcaaagcaggatttgacttgctcagggagcgatgactgcaaggctgcctatatcgatatcttgggcaccgtgctacaagttcaatgtacgtgtcgcacaataactcagtccgaggagtccctctgtaaaatctttcagcacatgcttcacagaaaaagctgcttcaactaccccactcttagcaatgtgaagggaatggccctgtatacacggaaacacgctaacaaaatcaccctgaccggcttccattcccctttcaatggggaggtcatttacgccgccatgtgtatgaccgttacatgcggtatattattactggttatggtcaagcttcgcacgagccgaatcagctccaaggccagagatccatcttccatccaaatccctggggagctgtag

SEQ ID NO: 42523 - DNA, 1593 bp, Artificial Sequence
  Description of Artificial Sequence: Synthetic coding sequence
atgctgctgtggcccctgctgctgctgctgctgctgctgcccaccctcgcactgctccgtcaacagcgatctcaggacgcccgcttgtcatggctggccgggctgcaacatcgcgtcgcatggggggccctcgtgtgggccgcaacttggcagagacgtagacttgaacagagtactttacacgtccatcaatcccagcagcaggctttacgctggtgcctgcagggtgctcagagaccacattgttcactgagacgatccaccgatatttccaccttcagaaatcacttgccgttgacaaaagcatcacaaactcagcaggaggatagcggcgagcagccgctgccacccacttccaatcaggatttaggagaggcttccctgcaggctacattactcggtctggcggcccttaacaaggcctatccggaggtgctggcccagggacgcacagccagggtcactctcacttcaccatggcctcgccctctgccctggcccggcaatacccttggacaagttggcaccccaggaactaaagatccccgcgcccttctgctcgacgcactgagaagcccgggcctgagagctctggaggcgggaaccgctgtggagttactggacgtgttcctggggctggaaactgacggcgaagagttagccggtgccattgccgctggcaaccccggcgcccccctgagagagagggctgccgagttgcgggaagctttggaacaggggccacgaggcttggcgctgaggctatggccaaaattgcaggtagtggttactttggacgctggagggcaggccgaggccgtggccgccttgggagccctctggtgccagggcctggccttcttctcccccgcatacgccgcatctgggggagtcttagggctgaatctgcagcccgaacaaccccacggtctttacctactacctcccggagcaccattcatcgagctgctcccagttaaggaaggcactcaggaggaggccgcttccactctgcttctcgccgaggcccagcagggcaaggaatatgagctcgtcctgaccgatcgcgcctcccttacacggtgtagattgggagatgtcgtcagggttgttggcgcatataatcagtgcccggtggtgcgctttatatgcagactggaccagacacttagcgtgcggggtgaggacatcggcgaagaccttttttctgaagccttggggagagcagtgggtcaatgggccggcgccaagctccttgaccatggatgcgtggaatcttcaattctcgattcctctgcaggcagcgcgccgcattatgaagtgtttgttgcgctgcgcggcctccgaaatctctctgaggaaaacagagacaagctggaccactgtctgcaggaggcaagcccaaggtataagtcacttaggttctgggggtctgtcggccctgctcgcgttcacttggtggggcagggagcctttagagctctgcgcgccgccctggctgcctgcccatcatcacctttcccccccgcaatgcccagagtgctgcggcacagacacttagcacagtgtctccaggagcgggtggtgtcatag

SEQ ID NO: 42524 - DNA, 1425 bp, Artificial Sequence
  Description of Artificial Sequence: Synthetic coding sequence
atgctgctgtggcccctgctgctgctgctgctgctgctgcccaccctcgccctgctccgccagcagcggcctcactgttcactaaggaggtcgactgatatctctacttttagaaaccacctgcctctaactaaggcttcgcagacacaacaggaggatagcggagaacaacctctcccccccacgtcgaaccaagacctgggagaggctagtcttcaggcaacactcctaggcctggccgccttaaacaaggcttatccagaggtgctggctcaggggcgaactgcaagggtcaccctgaccagcccatggccccgcccccttccttggcctgggaacacattggggcaagtggggacccccggaacgaaagacccgcgcgccttactgttggacgcacttaggtctcccggccttagggctttggaagcgggaaccgcagtcgagcttctggacgtgtttctgggtctggagacggatggggaagagctggcaggcgccatcgctgccgggaacccaggcgcacctctgagggaaagggctgccgagctgagggaagccctggagcagggaccccgcggccttgcattgcgtctgtggccaaagctgcaggtagtcgtcaccctcgacgcaggcggtcaggccgaggcagtagccgctctcggcgcactgtggtgccagggactagcgttctttagcccagcatacgcagccagtggtggcgtgttgggactgaacttacagccagagcagccacacggactttacctgctgcccccaggtgctccatttattgaattattacccgtcaaggaagggacacaagaggaggccgcctccacactcctgctggccgaggcgcagcagggaaaagaatatgagttggtgttgaccgatagggccagtctcacacggtgtcgcctgggggatgtcgtccgcgtggtgggagcatataaccaatgccctgtggtcaggtttatatgtcgacttgatcagacattatcagtgaggggggaggacattggggaggacttgtttagtgaggccttaggtagggccgtcggccagtgggctggcgccaagctccttgaccacggctgcgtggaatccagtatcctggacagctcagccggcagcgcgccccactatgaagtcttcgtagccctgagggggctcagaaatctctccgaggaaaacagggacaaactcgatcactgcctgcaggaagcttccccccgatataaatcactgaggttttgggggagtgtgggtcccgctagggtgcatctcgtcggccagggcgccttccgtgccctgcgggccgccctggccgcctgtcccagttccccttttccgcctgcgatgccacgggttctgcgccatcgccacctagcccagtgtctccaggaaagggtcgtgtcttag

SEQ ID NO: 42525 - DNA, 1425 bp, Artificial Sequence
  Description of Artificial Sequence: Synthetic coding sequence
atgctgctgtggcccctgctgctgctgctgctgctgctgcccaccttggccctgcttagacagcagcggagtcaggatgcccgactcagctggttggcaggcctgcagcaccgggtggcatggggagcgctggtgtgggctgcaacttggcagaggaggcgactggagcagtccacactacatgtacaccagagccagcagcaggcactgcgctggtgcttgcaaggcgcacagagaccccactgcagcctccgtcgttccacagacatttctaccttcagaaaccatctgcctctgacaaaggcctcccagacccagcaggaggatagcggagagcagcccctgccccccaccagcaaccaggatctgggagaagcctcccttcaggccactctgttggggttagcagctctcaacaaggcttaccccgaggtcctggctcagggccgaaccgccagggtgaccctcacatccccatggcctcgacccttgccctggcctggaaatacgttgggacaggtggggactccaggtaccaaggatccccgcgcactccttcttgacgccttacggagccctggcctacgcgctctggaggccggcaccgctgtcgagttgctcgatgtttttctgggcctcgagaccgatggcgaggaactagccggcgctatcgccgcaggcaatcccggtgcccccttgcgcgagcgagccgctgaactgagagaggcactcgaacaggggcctcgcgggttagccctacgactgtggcccaaacttcaggtggtcgtgaccctggacgccggtggccaggctgaggcagttgcggctttaggggcactttggtgtcaggggttagcattcttttctcccgcctacgcagcaagtggtggtgtgctaggcctcaatctccaaccggagcagccacatggactgtacctgctcccgcccggggccccatttattgaactcctgccggtgaaagaaggcacgcaagaggaggccgcaagcaccctcctgcttgcggaagcccagcaaggaaaggaatatgaacttgtgctaaccgatagagcttcactaacacgctgtcggctcggagatgtggtgcgggtcgtgggtgcttacaaccaatgcccagtcgttcggtttatatgccggctcgaccagacactctccgtccgcggagaggatataggggaggacctgttctccgaggcacttggcagagctgtcggccaatgggctggggcaaaactccttgaccacgggtgcgtagaatcaagcatcctcgaatggggccgcactgatcgggcagaggacaccaggttgggatcatgcccttttaccggctccatgtgtgctcacggcgtgtactcccagatcccattgagggctttgctgccgaccacacgatgcttgtggcgctag

SEQ ID NO: 42526 - DNA, 1476 bp, Artificial Sequence
  Description of Artificial Sequence: Synthetic coding sequence
atgctgctgtggcccctgctgctgctgctgctgctgctgcccaccttggctctcctgcggcaacagcgatcccaggacgcccggctgagctggttggcagggctgcagcatcgcgtggcatggggtgccctggtgtgggccgccacctggcagcggcgccggctcgaacagtcaacactccacgtccatcagagtcaacaacaggcgctgcgttggtgcctccaaggcgctcagaggcctcattgctctctgcgccggtctaccgatattagcacttttagaaatcatctaccattaacgaaagcgtatccagaggttctcgctcagggacggaccgcgcgggtaactttgacttcgccctggccgcggccactgccttggccaggcaatactctaggccaagtcggtactcctggaacaaaagaccctcgagcactgctcctcgatgccctgcgaagtcctggtcttagggctctcgaggcagggaccgccgtcgagttacttgacgttttcctgggcttggagaccgacggcgaagagttagctggggcaattgccgctgggaacccaggcgcgccactccgggagagagcagcagagttgcgcgaggcactggaacagggaccacggggactggctctccggctgtggcccaagctacaggtggtagtgacccttgacgcaggcggacaagcagaggccgtggcagctctgggagcactgtggtgccaggggctggccttcttttctccagcctacgccgcctctgggggagttctgggactgaatctgcagcccgaacagcctcacggactgtacttattgcctcccggcgcgccattcatcgagctgttgcccgtgaaggaaggaacgcaagaagaagccgcctctacgcttctgcttgctgaagcacaacagggcaaggagtatgagctcgtgttaacagacagagcttccctgacccgctgtcgactaggggacgtggttagggtcgtgggggcatataaccaatgtcctgtggtgagatttatttgccggctagatcagacccttagcgttaggggggaagacattggcgaagacctgttcagcgaggcactgggcagggctgttggacagtgggccggcgccaagcttctcgatcatggatgcgtagaatcaagtattctggactcttctgctgggtccgcaccgcactatgaggtttttgttgcattgcgagggctgagaaatctaagcgaagaaaacagagacaaactcgatcactgcctccaagaagctagcccccggtacaagtcactaaggttttggggctctgtcggacctgcccgcgtgcaccttgtggggcagggcgcttttagagccctaagagccgcattagccgcgtgcccatcatctcccttccccccagccatgccaagagtccttcggcacagacatctggcccagtgcctgcaggagagagtggtgtcctag

SEQ ID NO: 42527 - DNA, 1425 bp, Artificial Sequence
  Description of Artificial Sequence: Synthetic coding sequence
atgctgctgtggcccctgctgctgctgctgctgctgctgcccacccttgccctcctcaggcaacaacgaagccaggacgcccgcttgagttggctggccggcctccagcatcgggtagcctggggagccctggtgtgggctgccacatggcaaaggcggcgtcttgaacagagcactttgcacgtccaccagtctcaacagcaggccttaagatggtgcctccagggagcccaacgcccacattgtagtctccgacgcagcaccgacatcagcacattccggaatcatctccccctgaccaaagcgagtcagacccagcaggaagactctggagaacaacctctgccaccaacaagcaaccaagacctaggtgaagcctcactgcaggcaacactgctgggcctggccgctttgaacaaagcttaccccgaggtgctggcccagggcagaacagccagggtaacattgacatccccctggccgaggcccctgccctggcccggtaatacactgggacaagttggcaccccgggcacaaaggaccccagagcactgctgctcgacgcccttcggagcccgggactgagggcactcgaagcaggaaccgccgtggagctcctcgacgtgttcctgggattagagaccgatggcgaggagcttgctggtgccatagctgcagggaacccaggagcccctctgcgggaaagagctgctgagcttagagaggctctggagcaggggccaaggggcctagctcttcggctctggcccaaactgcaagtcgtggtcacgttggacgcgggaggacaggccgaggccgtcgcggccctgggagcgctatggtgtcagggtcttgctttcttttcccctgcttacgctgcgagcggaggagtcctggggttgaatctccaaccggaacaaccacatggactgtatctactgccacccggggcccccttcatagagttactgcccgtaaaggagggcacccaggaggaggcagcttcaacactgctgctggctgaagcacagcaaggcaaggagtatgagttggtgctaactgaccgggccagcctcactcggtgtcggctgggagatgtggtgcgcgtggtcggagcctacaaccagtgtccagtggtgagattcatctgccgacttgaccagacattgagtgtccgcggcgaggatatcggggaagacctgttttccgaggccctgggtcgggcagttggccagtgggccggtgccaaactgcttgatcatggatgtgtcgagagctcgatcctggagtgggggagaactgatcgcgccgaggataccagattgggaagttgtccatttactgggtctatgtgcgcccatggcgtctactctcagattccactaagggccctcctgcccacaacgcgatgcctctggaggtag

SEQ ID NO: 42528 - DNA, 1593 bp, Artificial Sequence
  Description of Artificial Sequence: Synthetic coding sequence
atgctgctgtggcccctgctgctgctgctgctgctgctgcccaccttagccctcttgcggcagcaaagatctcaagatgcgcggctttcctggctggctggcctccagcatcgtgtcgcatggggagcactggtgtgggccgcaacttggcagcgaaggagactggaacaaagcactctccatgtacaccaatctcagcagcaagcactgcggtggtgtctgcagggggcccaaagaccccactgttctctcagacggtccactgacatttcaacatttcggaatcacctacccctgacaaaggccagccagacccagcaggaagattctggagaacaacccctgccccctacttcaaatcaggacctgggcgaggcatcccttcaggccacactcctaggtctggctgctctgaacaaagcataccccgaagtgttagctcaaggccgaactgctagagtgacccttaccagcccctggcctagacctctcccttggccgggcaatacacttggccaggtgggtaccccaggcacgaaggatcccagagcgttgttgctggacgccctgcgtagtcccggcttgcgcgctcttgaggcagggactgcagtcgaactgttggacgtttttctgggtctcgagaccgatggagaggagcttgctggtgcgatcgctgcaggcaatccgggggctccactgcgggagagagcagctgaacttagagaggcactggaacagggtccccgaggactggcactcagactatggccaaaattacaggttgtggttactctggacgctgggggccaggcagaagcagtggccgccttaggggccctttggtgtcagggcctggccttcttcagtcccgcttatgctgccagtggtggagtcctcggcctgaacttgcagcctgaacagccccatggcctgtatctgctgccgcccggcgctccttttattgaactgctgcccgtaaaagaggggactcaggaagaggctgcaagcactctgctattggccgaggcccaacaaggcaaggagtatgagttggtcctcaccgacagggcctcgctgacccgatgtagactcggggacgtcgtgagagtcgttggggcttataaccaatgccctgtcgtacggttcatctgccgtttagatcaaacgttgtccgtgaggggggaagatattggcgaggacctgtttagcgaggccctcggccgggcagttggacagtgggcaggcgccaaacttcttgaccacggttgtgtggagagcagtattttggactccagcgctggtagcgccccacactacgaggttttcgttgctctgcgcggcctgagaaacttgtctgaggaaaacagggacaagctggaccactgcctccaggaagctagtccacgctacaagtcactgagattctggggctctgtcggacctgcccgagtgcacctggtgggccagggcgcatttcgcgctctccgggcagcgctggctgcttgccccagcagcccttttccccccgcaatgcctcgggtgcttaggcacagacaccttgctcagtgtctgcaggagagggtggtgtcatag

SEQ ID NO: 42529 - DNA, 1002 bp, Artificial Sequence
  Description of Artificial Sequence: Synthetic coding sequence
atgcccctgggcctgggccggcggaagaaggccccccccctggtggaaaatgaggaagccgagcctgggagagggggacttggcgtgggagaacccggcccactaggcggcggtggtagtggcggtcctcagatggggctgccccctccaccccccgccctgcgcccacggctggtgtttcatacccagctggcgcatgggtcccctacaggccgcatagaagggtttactaatgtcaaggaactgtacgggaaaatcgccgaggccttccgcctgccgaccgccgaagtaatgttctgtacactgaacacgcataaggttgatatggacaagctgttgggtggtcagatcgggttggaggattttatattcgctcacgtgaaggggcaacgcaaggaagtggaggtgtttaaatcagaagacgcactggggcttacaatcacagataatggagcaggttatgcctttataaagcgcatcaaggaaggttccgtaatcgatcacatacacctgatctctgtgggtgacatgattgaggctatcaacggacaatctttactcgggtgtaggcattatgaggtggcgaggttgctaaaagagctgcctcgaggtcgcacctttactctgaagcttaccgaacctagaaaggcattcgatatgatctctcagagatcagctggcggcaggccagggagcggaccacagctgggaacagggaggggcactctgagactgcgcagtcgaggacccgctactgtagaggacctgccatccgccttcgaagagaaggccatagagaaagtcgacgaccttctcgaatcttacatgggcattcgtgacacagaactcgcagccactatggtcgagctgggtaaagacaagcggaatcccgacgagctggctgaagccttagatgaacggctgggcgatttcgcctttcctgacgagttcgtcttcgatgtctggggcgccataggcgacgccaaggttgggcggtattag

SEQ ID NO: 42530 - DNA, 1002 bp, Artificial Sequence
  Description of Artificial Sequence: Synthetic coding sequence
atgcccctgggcctgggccggcggaagaaggccccccccctggtggagaatgaggaggcagagccaggccgcggcggattgggggtaggggagcctggccctctcgggggtggggggagcggcggccctcagatgggcttgccccctcctcccccagccttaaggcctcggctggtgttccatactcagctagctcacgggtcgccaaccgggcggatagaagggttcacgaatgttaaggagctttacggaaagattgcagaagcattcaggctccccaccgccgaagttatgttctgtacattaaacacccacaaagttgacatggacaaactgctgggtggccagattggcctggaggacttcattttcgcacatgttaagggtcaacgcaaagaagtcgaagtgtttaagtctgaggatgcgctagggctgacgatcaccgacaatggtgctggttatgcctttatcaagcggatcaaggagggctctgtgattgatcatattcatctgattagtgtcggcgacatgattgaggcgattaacggacagagtctgctgggatgccgtcattatgaagttgcaagactgctgaaggaactgccccggggaagaacctttacactcaaattgactgagccaaggaaggcctttgacatgatcagccagagaagcgctgggggacgcccaggctcaggaccgcagcttggcacgggacgggggactcttcgccttcgatcacggggacctgctactgtcgaggacctgccaagcgcttttgaggaaaaggccatcgagaaggtggacgacctgcttgagagttatatgggtatcagggatacggaattggctgccaccatggtcgaacttggaaaggacaagaggaaccccgacgaactggccgaggcactggatgaacgattaggtgacttcgctttcccagatgagtttgtgttcgatgtatggggggccatcggggatgccaaagttgggcgttactag

SEQ ID NO: 42531 - DNA, 711 bp, Artificial Sequence
  Description of Artificial Sequence: Synthetic coding sequence
atgttctgcaccctgaacacccacaaggtggacatggacaagctgttgggcggacagattggcctggaggactttattttcgcccatgtgaagggacagagaaaagaggtagaggtttttaagtcagaggacgctttggggctgaccatcaccgacaacggagccggctatgcttttattaaaaggatcaaggagggatcagtaatcgatcacattcatttaatatccgtgggcgacatgatagaagctataaatggccagagtttgcttgggtgccgtcactatgaagttgcccgcctgttgaaagagctccccagggggcggacgttcactctgaagctgacggaacctcggaaggcctttgacatgatctctcaaagatcggccggtggccgcccaggctctgggccacagcttggcaccgggaggggcacactccggctccgatccagaggcccagcaactgtcgaggatctaccttccgcgtttgaagaaaaagccatcgagaaggtggatgatttgttggagagctacatgggtatacgtgacacagagctggccgcgacaatggtggagctcggcaaagataagaggaatccagacgaattggctgaggccctggacgagaggttaggggactttgcatttccggatgaattcgtgttcgacgtttggggtgccataggtgacgccaaagttgggaggtattag

SEQ ID NO: 42532 - DNA, 711 bp, Artificial Sequence
  Description of Artificial Sequence: Synthetic coding sequence
atgttctgcaccctgaacacccacaaggtggacatggacaagctgcttggcggacaaatcgggttagaggacttcattttcgcccatgtaaaagggcagaggaaagaggtggaggtgtttaaaagtgaagacgctctcggactgacgattactgacaacggggcaggctacgcctttattaaaagaatcaaggaaggctccgtaatcgaccatattcatctgatctcagtcggcgacatgatcgaggcaattaacggacaaagcctcctcggatgccggcattatgaggtagcccgcctcctgaaggaactgcccagagggaggacattcacattgaagctcaccgagccccgtaaggcttttgacatgatctctcaacgttccgccggtggccgcccggggtccggaccacagctgggcactggcaggggtacactaagactgcggtcccgagggcctgctaccgtcgaagacctccccagcgcctttgaggagaaggcaattgagaaagtggatgatctgctagaaagctacatgggcatccgtgataccgaactggccgccaccatggttgaactgggtaaggataaacgaaatccggatgagctggccgaagcactcgacgaacgtctgggggattttgccttcccagatgaatttgtcttcgatgtgtggggtgccataggggatgcaaaggtgggacgctattag

SEQ ID NO: 42533 - DNA, 1002 bp, Artificial Sequence
  Description of Artificial Sequence: Synthetic coding sequence
atgcccctgggcctgggccggcggaagaaggccccccccctggtggagaacgaagaggctgaacccggccggggaggccttggagtcggcgagcccggcccactcgggggtggcggcagtggcggcccccaaatggggctgcctccccccccacctgctctgcgtcctagactggtgtttcacacccagctcgctcacggcagccccacaggccgcattgagggcttcactaacgtgaaggagctgtacggtaagatcgctgaagccttccgactaccaactgcagaggttatgttctgtaccctaaatacacataaggtcgacatggacaaattgttgggcggccaaataggattagaagatttcatctttgctcacgtgaaaggccagaggaaagaagtcgaggtgtttaaaagcgaggacgcacttggcctcaccataaccgataatggagcaggatacgcatttatcaaaaggattaaagaaggatccgttatcgaccacattcatttgatctcggtcggcgacatgatagaagctattaacggacagtcactgctgggctgtaggcactatgaggtggcacgtctcctgaaagagctgcctcgagggcgcacctttaccctaaagttgaccgagccacggaaggcgttcgatatgatctcccagcggagcgccgggggacgaccggggtctggtccgcaactcggcaccgggcgagggaccttgagactgcggtctagagggccggcaactgtagaagacctaccctcagcttttgaggagaaggcaatcgagaaagtagatgacctcctcgagtcctacatgggtatacgagacactgagttggcagccacgatggttgaattaggaaaggacaaacgtaacccagacgaactggccgaggccctggatgagagactgggcgatttcgcatttcctgatgagtttgtcttcgacgtgtggggcgccattggggacgccaaggttggcagatactag

SEQ ID NO: 42534 - DNA, 762 bp, Artificial Sequence
  Description of Artificial Sequence: Synthetic coding sequence
atggaggccgcccggcccttcgcccgggagtggcgggcccagagcctgccactcgctgtggggggagtgctgaaactcaggctgtgcgagctgtggctactacttctgggttccagcctgaatgctcgtttcctgccagacgaagaggatgtggacttcatcaacgagtatgtgaatcttcataacgaactgaggggggatgtcatccctcgagggagtaatctcaggttcatgacttgggacgtggcactcagtaggacagcacgggcatggggtaagaaatgtcttttcacacataatatctacctgcaggatgttcagatggtgcatccaaaattctacggcattggcgagaatatgtgggtgggtccagagaatgaatttactgccagcattgctattagatcttggcacgccgagaaaaaaatgtataattttgagaacggcagttgcagtggggattgcagcaactacattcagctggtatgggatcattcatacaaagtgggatgtgctgtaacgccctgtagcaaaattggccacattatccatgccgccatcttcatctgtaactacgctccagggggtacgcttactcgtaggccgtatgaacctggcattttttgtacacggtgtggccgacgcgataaatgcaccgactttttatgctctaagattaaaaaaattaatatgaagaaaatgcataatgggctcgacaagaagaacaagaggctgaacacatcatttctgtggtcttgttag

SEQ ID NO: 42535 - DNA, 321 bp, Artificial Sequence
  Description of Artificial Sequence: Synthetic coding sequence
atggaggccgcccggcccttcgcccgggagtggcgggcccagagcttaccactggctgtgggaggcgtcttgaagctgcgattgtgcgaactgtggctcctgttactgggcagttcactgaatgcgaggtttcttcccgatgaggaggacgtggactttattaatgaatatgtgaacctgcacaacgaacttcgaggcgatgtgatcccccgaggcagcaacctgcggtttatgttgtggtactgctgcgatagcgacggttctcgcttcattatcgggttccccaatctcagtcccagaactcccagtgctcccctgtag

SEQ ID NO: 42536 - DNA, 714 bp, Artificial Sequence
  Description of Artificial Sequence: Synthetic coding sequence
atggtgcaccccaagttctacggcatcggcgagaacatgtgggtgggcccagagaacgagtttacggcctccattgctattcgttcatggcatgcagaaaaaaaaatgtacaacttcgaaaacggttcatgtagcggagattgcagtaattatattcagttggtctgggatcattcttataaagtcggttgcgccgtaacaccctgcagcaaaattgggcatattattcacgccgctatctttatatgcaattacgccccagggggcaccctcacccgccggccatatgagcccggcatcttttgcaccaggtgcggacgaagggacaaatgtactgatttcctctgctctaacgcggaccgggatcaagccacttattaccggttttggtatccaaagtgggagatgcccagacccgtggtatgtgatcccctgtgcacttttatcctcttgctccgaatcctctgttttatcctatgcgtaataaccgtcctgattgtccagtctcagtttcctaacatcctgcttgaacagcagatgattttcacgccagaagagtctgaggcgggtaatgaagaggaagagaaggaggaggagaaaaaggagaaggaagagatggagatggagatcatggagatggaagaggagaaagaagagcgggaggaagaggaagaggaaactcagaaggaaaagatggaggaggaagagaaatag

SEQ ID NO: 42537 - DNA, 507 bp, Artificial Sequence
  Description of Artificial Sequence: Synthetic coding sequence
atggaggccgcccggcccttcgcccgggagtggcgggcccagagcttacccttggctgtagggggggtcttaaaattaaggctttgtgagctctggctcctccttctcggatcttccctgaatgctagattcctgccggatgaggaggacgttgactttattaatgaatacgtgaatctccacaatgaactgaggggtgatgtcattccgcgggggtccaatctgagatttatgacgtgggacgtagcgctgagtcgcacagctcgggcttggggaaagaagtgtctatttactcataacatttatctccaagatgtccagatggtccacccaaaattctatggaattggggagaatatgtgggtcggcccagagaatgagttcacagctagcatagctatacgatcctggcatgctgagaaaaagatgtacaattttgagaacggaagctgctccggagattgcagtaactatatccagaggaatacagacgagaaaactctttag

SEQ ID NO: 42538 - DNA, 840 bp, Artificial Sequence
  Description of Artificial Sequence: Synthetic coding sequence
atgctgatcaccatgatcctgcaccgggcccggaccaagacctgggacgtcgcactctcaaggactgctcgtgcatggggaaagaaatgcctcttcacacataacatctatttgcaggatgtccagatggtgcaccctaaattctacgggataggggagaacatgtgggtgggacccgagaatgagtttaccgcttccatcgctatccggtcttggcacgccgagaaaaagatgtataactttgagaacgggtcctgctccggtgactgctctaactacattcaattggtgtgggatcattcctacaaagtaggctgtgccgtgacgccctgctcaaaaatcggccatatcattcacgcagcgatcttcatctgcaactatgccccaggaggaacattaacacgtcgtccttacgagcctggcatcttctgcactcggtgcggcaggcgagacaaatgtacagacttcctttgttccaacgccgatagagatcaggcgacctactatcggttttggtatccgaaatgggagatgccccggccagtagtttgtgatcccttatgcaccttcatcctgctgcttcggatcctctgcttcatactttgtgttatcacggtgctgattgtgcaatctcaattccccaatatactactggagcagcagatgatctttacccctgaggagagcgaagcggggaacgaggaggaggagaaggaagaggagaagaaggaaaaggaggaaatggagatggagattatggagatggaagaggaaaaggaggaacgagaggaggaggaagaggagacgcagaaggagaagatggaagaagaagagaaatag

SEQ ID NO: 42539 - DNA, 1035 bp, Artificial Sequence
  Description of Artificial Sequence: Synthetic coding sequence
atggaggccgcccggcccttcgcccgggagtggcgggcccagagcttaccattagctgtcgggggggtccttaagctgcgactctgcgagctttggctgctgctattgggttccagtctgaacgctcgctttctcccagacgaagaggacgtggattttattaacgagtacgtgaatctccataacgagctgcgcggcgacgttatcccaagaggaagtaacctgaggttcatgacatgggacgtggcattgtcccgaacagcacgtgcttggggaaaaaaatgcctatttacccacaatatttatctgcaggacgtgcaaatggtgcaccccaagttttacggcatcggtgagaacatgtgggttggcccagagaatgaattcaccgctagcattgccatcaggtcatggcatgcggagaagaagatgtataactttgaaaacgggagctgctcgggcgattgctccaattacattcagttggtgtgggatcactcctataaagtgggatgcgcagttacaccatgttctaaaataggtcacatcatccatgcggcaatctttatatgtaattatgctcccggtggcactctgacaaggcgaccctacgagcccggtatattttgcacgagatgtggaagacgagataagtgtacggattttctgtgctccaacgccgacagagaccaagccacatactacaggttttggtaccccaagtgggaaatgccccgcccggttgtgtgcgaccctctgtgcacatttatacttctgctgcgaattctgtgcttcattctctgtgtgattaccgtgctgattgtccaaagccaatttcctaatatacttctagagcagcagatgatctttactcctgaggagtctgaggccggaaacgaagaggaggaaaaggaggaggaaaagaaggagaaggaagaaatggaaatggagatcatggagatggaggaggagaaggaagagagagaggaagaagaggaagaaacacagaaagagaagatggaggaagaggaaaagtag

SEQ ID NO: 42540 - DNA, 2544 bp, Artificial Sequence
  Description of Artificial Sequence: Synthetic coding sequence
atggccaagcccctgaccgaccaggagaagcggcggcagatcagcattcgcggcatcgtgggtgtggaaaatgtagctgagctgaaaaaatccttcaatcggcacctccacttcactctggtgaaggatagaaatgtggcgacaacaagggactattacttcgccttagctcacacggtgcgagaccacttagtgggtaggtggatccgaacacagcagcattattatgataaatgtcccaaaagggtgtactacctgtctctcgaattttatatgggccggactctgcagaatactatgattaacttaggcttgcagaatgcctgtgatgaagcgatctatcagctggggctagatattgaggaactcgaagagattgaagaagacgcgggcctggggaacggcggcctcgggagattagcagcctgctttctggacagcatggctaccctgggccttgccgcctatgggtatggaatccgttacgaatatgggatctttaaccagaagattcgcgacggatggcaagtcgaggaggccgatgattggctgcgctacggtaacccctgggaaaagagcaggcctgaattcatgctgcccgtccacttttacggcaaggtcgaacacacgaacacggggaccaaatggatcgatactcaggtggtgctggccctgccgtatgatacccccgtcccaggatacatgaacaacaccgttaacactatgcgactgtggtcagctagggccccaaatgactttaacctgagggactttaacgtgggcgactatatacaggcagtcctcgaccggaatctcgccgaaaacatttcgagagtcctgtaccctaacgataatttttttgagggtaaggagctcaggttgaaacaggagtacttcgtcgtcgcggctaccctccaagatatcattcgtcgcttcaaagcttcaaagttcggctccactcggggcgccggcacagtgttcgacgcctttcctgatcaggtagctattcagttaaacgacactcaccctgctttagccattcctgagcttatgagaatctttgtcgatatcgaaaaattgccgtggagcaaggcctgggagctgacccagaaaacgttcgcgtacacaaatcatacggttctcccagaagcccttgaacgctggcccgtggatctcgtggagaagctgttgccgcgtcatttagaaattatctacgaaatcaatcaaaagcatttagaccggattgtggctctattcccaaaggatgtcgaccgactgcgcagaatgagcctgatagaagaggaaggctcaaagcgcatcaacatggcccacttgtgtattgtgggatctcacgcagtgaacggagtggcgaagattcactcggacatagttaaaacaaaggtgttcaaggatttcagcgaacttgaaccagataagtttcagaacaagacaaacgggatcactcctcgaaggtggctgctgttgtgtaatccaggactcgctgaactcatagccgaaaaaattggagaggattacgtcaaagatctaagtcagctcactaagctgcatagttttctcggcgatgatgtctttcttcgcgagctggccaaggtgaagcaggagaataagttaaagttttcccagtttcttgaaacggagtataaggtgaaaattaatccttcaagcatgttcgatgtccaagtgaaaaggatccacgagtataaacgccaactccttaattgcctccatgtcataaccatgtataataggattaagaaggatccaaagaaactgtttgtcccacgtacagtgatcataggtggaaaagccgcgcccgggtatcatatggcaaagatgatcataaaactgattaccagcgtggccgatgtggtcaataacgaccctatggtcggatccaagctcaaggtgatcttcctggagaattaccgagtgagcctggctgagaaggtgatccccgccactgacttgagcgagcagatcagcactgccgggaccgaagccagtggcacagggaacatgaaatttatgttaaacggagcccttaccattggcactatggatggagccaatgtggagatggctgaagaggccggggaggagaacctgttcatctttgggatgcgaattgacgatgtggccgcgcttgataagaagggctatgaggctaaggaatactacgaggcgctgccagagctaaaacttgtgatcgaccagatcgataacggattttttagccccaagcagcctgacttatttaaggacataattaacatgctgttctatcatgatcgcttcaaggtgtttgccgattatgaagcctatgttaagtgtcaggacaaggtttcccaattgtacatgaatcccaaagcttggaacacaatggtccttaaaaatatcgctgcatcaggtaagttttcttctgataggacaattaaggaatacgctcaaaatatctggaatgtggagccaagcgacctgaaaatctccctaagcaatgagtctaacaaagtaaacggcaactag

SEQ ID NO: 42541 - DNA, 492 bp, Artificial Sequence
  Description of Artificial Sequence: Synthetic coding sequence
atgaagcccgacgagacccccatgttcgaccccagcctgctgaaggaagtggattggtctcagaacaccgccacattttcacctgctatcagccctactcaccccggtgagggactggtgctaaggcccttgtgtaccgccgacctgaaccggggattcttcaaggtgctcgggcagctcacagagactggggtggtgagccctgaacagttcatgaaaagctttgagcacatgaaaaaaagcggcgattactacgtcactgtggtcgaggatgtcacccttggacagattgtggctactgccacccttatcattgaacacaaattcattcacagctgcgcgaagaggggcagagtcgaggacgtggtggtcagcgacgagtgccgaggtaaacaattaggtaagcttctgctctccacactgaccctgctgtcaaagaagttgaattgctataagatcaccctggagtgtctgcctcaaaatgtaggatag

SEQ ID NO: 42542 - DNA, 1362 bp, Artificial Sequence
  Description of Artificial Sequence: Synthetic coding sequence
atgaagatcttcaagtgctacttcaagcacaccctgcagcagaaggtgtttatcttgtttctaacactttggctcttgtccttgttaaaactgttgaacgttcgaaggctgtttccccagaaggacatttatctcgtagagtatagcctatctacgtcaccatttgtacgcaaccgctacacccatgttaaagacgaggttcgatatgaagttaactgcagtggtatttacgagcaggagcccctggagatcggcaagagcttggagatccgccgaagagacattattgacctagaagatgacgacgttgttgctatgacttcggactgcgatatctatcagacactaaggggctatgcacagaagctggtcagcaaagaagaaaagtctttcccaatcgcttattcactggtagtgcataaggacgcgatcatggtcgaaagactgattcatgctatatacaatcagcacaacatatattgcattcactacgacaggaaggcacccgacacctttaaggtggccatgaataaccttgccaagtgcttcagcaatatcttcattgctagcaagcttgaagccgtggaatatgctcatatctcccgtttgcaggccgacctgaattgcctaagcgacctgctcaaaagctcaatacagtggaagtacgtcattaacctctgtggacaagactttcccttgaaaagcaactttgagctcgtgtcagaacttaagaaactcaatggcgctaacatgctcgaaaccgttaaacctcccaatagcaagctcgaaaggtttacttaccatcatgaattgaggcgcgtgccatatgaatatgtgaagctgcccataaggacaaacatctcaaaagaggcccccccacataacattcagatcttcgtgggctctgcttacttcgtcctctcccaagctttcgtaaaatacatttttaataacagcattgtccaggacttcttcgcctggtcaaaagatacatatagcccagacgagcatttttgggccacccttatcagagtgccggggatcccaggcgagattagcaggtctgctcaggacgtgtcggatcttcagtctaagacccgcctggtaaaatggaattattacgaaggatttttttacccaagttgcactgggtcacatctgcgatcagtgtgcatctatggcgctgctgagttgagatggcttattaaggatgggcactggtttgctaacaagtttgatagcaaggtcgaccctattcttatcaagtgtctcgcggagaaattagaggagcaacagagggattggattactcttccctctgagaagctgtttatggacaggaacttaaccaccaccagctag

SEQ ID NO: 42543 - DNA, 927 bp, Artificial Sequence
  Description of Artificial Sequence: Synthetic coding sequence
atgttcgtgcagctgctgcgggccatctacgtgccccagaacgtgtactgcattcacgtcgatgagaaggccccaatgaaatataagactgccgtacaaacactagtaaattgctttgagaatgtatttatctcatctaaaacagaaaaggtggcttatgctggatttacccgtttgcaggccgacattaattgtatgaaggtgctggtccactctaagtttcagtggaattatgttattaatttgtgcggacaggatttccctatcaagaccaatagggagataattcactacatcagatcaaaatggtctgacaagaacatcaccccgggagtcatacagcctctgcacattaaatctaaaaccagccagtcccacctcgaattcgtacccaaggggagcatctacgctcctccgaataacaggtttaaggataagccaccacacaacctcacaatttatttcggatctgcttactacgtactgacacggaagttcgtcgaattcatcctcaccgacatccacgctaaagacatgctgcagtggtccaaggatatccgaagtcctgaacagcattattgggtcacgttaaatagactaaaggacgcgcctggcgctacaccaaacgctggatgggagggaaacgtcagggcaatcaaacgcaaatctgaggagggtaatgtgcacgatggctgtaaaggaagatacgtggaagacatctgcgtttatggacctggcgacctgccttggctcattcaaagtccgtctcttttcgccaataaattcgagcccagcaccgacccacttgtcgttacatgcctggagaggagacaccgccttcaagtgttgaggcaggccgaagttccaatcgaaccacactggcattttcagcagcagtctcattttaacatgagactgaatcgctag

SEQ ID NO: 42544 - DNA, 519 bp, Artificial Sequence
  Description of Artificial Sequence: Synthetic coding sequence
atgcgggactgctgcggcatggtgagcagcggcagcctgagcagcctcaaagccgcagaacgtaccccgggcgcgctttttttctccagtagtacaccgggcaggtattacaattacgatagttcttcccggccgcagtcccgctcagtaatgtctgaccagtgtgccggccagtggttcttaaaggcttgcggccttggagagggcgatacagaggttttcccaacgcagcacgttgtgagagccttgcagaccattttcgaactgaatgttcaagccttcgccggaggtgctatgggggctgtaaatgggatgcagccgcatggcgtcccagacaaatccagtgtccagtctgacgaagtatgggttggcgtggtgtacggtttagcagccacaatgattcaggaggtgatgcacagcttttctcacctcagtactatttgtattctcgcacagaagacctcctctaccactaagtttttgcagggtattacacagtgtcatctggtacgcctgtag

SEQ ID NO: 42545 - DNA, 2634 bp, Artificial Sequence
  Description of Artificial Sequence: Synthetic coding sequence
atgggcacccaggaccccggcaacatgggcaccggcgtgcccgcctcagaacaaatctcctgcgccaaggaggacccgcaggtctattgccccgaggagaccggcgggactaaggacgtgcaggtgacagactgtaagtctcctgaagattccaggccccccaaggaaacagactgctgcaatcccgaggatagcgggcagttaatggtcagttacgaaggtaaggctatgggctatcaagtccctccattcggctggcgtatctgtcttgcgcatgaatttaccgagaagcgcaagccattccaagccaataacgtgagcttgagcaatatgatcaaacatattggtatggggctgcgttacctgcagtggtggtaccgaaagacacatgtggagaaaaaaaccccatttatagacatgataaacagtgtgccactgcggcagatttacgggtgtcccttgggtggtataggtggtggaaccattacacgaggctggagggggcagttttgtagatggcagcttaatcctggcatgtaccaacatcggactgtgatcgcagaccagttcacagtatgtctccgcagagaagggcagaccgtctaccagcaagttttatctctcgagcggcctagtgtgctgcggtcttggaattggggcctctgtggctacttcgctttctatcacgctctgtatccccgagcatggactgtgtatcagctccctggacaaaacgtaacactgacatgccgacagattacaccgatactgccgcacgattaccaagattcctctctccctgtgggcgttttcgtttgggatgtggagaacgagggggacgaagcactggatgtgtctatcatgttttcaatgcggaatggactgggagggggtgacgacgcaccaggcggcctgtggaatgaacctttctgcctggagaggtctggtgaaaccgtcagaggcctactgctgcatcaccctactctgccgaacccatacactatggcagtcgccgcacgggtgaccgctgccaccacggtaacgcacatcaccgctttcgaccctgactctacaggccagcaagtgtggcaggatctccttcaggatggccagcttgactccccgacgggacagtcgacacccacccagaaaggagtaggaatagctggggcagtgtgcgtgtcatctaaactgcgccccagaggccaatgtcgcctggagtttagcctggcatgggacatgccccgaataatgtttggagctaaaggccaggtgcattacaggagatatactcgcttcttcgggcaagacggggacgccgcccctgccttaagccactacgcgctgtgtcgctatgccgagtgggaggaaaggatcagcgcctggcagagtccagtccttgatgacagatctctcccagcatggtacaagagtgctctgttcaacgagctttatttcctagctgacggtggtactgtttggctcgaggttctggaggatagtttacctgaagagctcggccggaatatgtgtcaccttcgccctacccttcgtgactacggtcgatttggttacctagaggggcaggaataccgcatgtataacacgtacgatgtccacttctacgcctcatttgcactaattatgctttggccaaagctggagctcagtctgcaatacgacatggcccttgctaccctgcgagaggacctgacccggcgccgctacttaatgagcggggtgatggccccagtgaagcgcaggaacgtgatccctcacgatataggggaccctgacgacgagccctggcttcgagtaaacgcctacctgattcacgatactgctgattggaaggacctgaacctgaagttcgtcctacaggtataccgggattactacctaaccggagatcagaattttctgaaggatatgtggccagtatgtctcgccgtgatggaaagcgaaatgaagttcgacaaggaccacgatgggctgatcgagaacggcggttacgctgaccagacttacgacggatgggtaaccacaggcccaagcgcatactgcgggggcctgtggctggccgccgtagccgtgatggtgcagatggccgccctgtgcggggcccaagatattcaagataagttcagctctatcctttcacggggacaggaagcctacgaaagactactttggaacggtaggtactataactatgattcaagcagcaggccccaaagcaggtcagtgatgtcagaccagtgtgcaggccaatggtttctcaaggcctgtggactgggcgagggggatactgaggtcttccccacccaacacgtagtccgagccctgcagacaatcttcgaactgaacgttcaggcgttcgccggcggagccatgggggccgtcaacggcatgcaaccacacggcgtacctgacaagtcttcggttcagtcagacgaagtgtgggtgggagttgtgtacggccttgccgccacaatgatccaagaactgctgccctcaggcttctgcctttgggtcatagtgatatcatccacatgctgggaattactggaagggaaggactccacggccagtatttaccccgtggaagtggccctccagcgggtccctagttag

SEQ ID NO: 42546 - DNA, 2784 bp, Artificial Sequence
  Description of Artificial Sequence: Synthetic coding sequence
atgggcacccaggaccccggcaacatgggcaccggcgtgcccgccagtgagcaaatctcctgtgcgaaggaggacccgcaggtttactgtccagaggaaaccggtggcactaaggatgttcaagtgaccgattgtaaatcccccgaggactccagaccccctaaggagacagattgttgtaatcctgaggattcggggcaactcatggtgtcttatgaaggaaaagccatgggctaccaggtgccaccttttgggtggagaatttgcctggcccacgagtttaccgagaagagaaagcccttccaggcaaacaatgtgagtctctctaatatgattaagcacattggaatgggtctgcgctatctccagtggtggtatagaaagacccatgtggaaaaaaagactccgttcatcgatatgatcaacagcgtacctctgaggcagatatacggatgtcccctgggaggcatcggcgggggcactattaccaggggatggcggggccaattctgtcgctggcagttgaatcctggcatgtaccagcacagaaccgttatcgccgaccagttcacggtgtgcctccgccgggaggggcagactgtctaccagcaggtgctaagtctcgaacgcccatcagtgttgcgtagctggaattggggcctctgtgggtactttgccttctatcatgccctttatccccgagcatggaccgtgtaccaactgcccggccagaacgtgacactcacttgcaggcagatcacccccatcctgccacacgattaccaagatagcagtcttcctgtgggagtttttgtctgggatgtagaaaatgagggggacgaggccctggatgtgtccataatgtttagcatgaggaacgggctggggggaggagatgacgcgcccggagggctctggaacgagccattctgcctggagcgctctggggagaccgtgcgaggattactcctccatcatccaaccctcccaaacccgtatactatggctgtcgctgcccgggtaaccgcagccacgaccgttacacatattacagcttttgaccctgacagcacggggcaacaggtttggcaggacctccttcaggatggacaactcgactcccctactgggcaaagcaccccaacacaaaaaggagtggggattgccggtgctgtatgcgtaagctctaagctgaggcctcggggccaatgcagactggaattttccttggcatgggacatgccccggatcatgtttggggccaaaggacaggtgcactatcggagatatacccgattctttggacaggacggcgacgctgcccctgctcttagtcactacgcactgtgccgttatgcggagtgggaggaaaggatcagcgcatggcagagccctgttctggacgatcgttccttgccggcatggtataaatcggccctgtttaacgaactgtactttcttgctgatggcggaaccgtgtggctggaagtgttagaggactctctgcctgaggaactcgggcgtaatatgtgtcaccttaggcctactctccgggactatgggcgcttcggatacctggaggggcaggaatatcgaatgtacaatacctacgacgtgcatttttatgcatccttcgctttaataatgctgtggcccaagctggagctgagcctccaatatgatatggctctggccaccctgagagaggatctgactcgtcggcgttacctgatgagcggcgtgatggcacccgttaaaagacggaacgtgataccccatgacatcggcgatcccgatgatgagccatggttgcgggttaacgcttacctgatccacgacaccgcagattggaaagatctgaatctgaaattcgttctccaggtctaccgtgattactacctgactggagaccagaattttctgaaggacatgtggcccgtttgcttggcagtgatggagtctgagatgaagtttgataaggatcacgacggactcattgagaacgggggttacgctgatcaaacatatgacggatgggtaacgacagggccaagcgcctactgcggcggcctttggctggccgctgtcgccgtgatggtgcaaatggcggccctatgtggtgctcaagacatccaggacaaattttcctcaatcctctctcgcggtcaggaagcttatgaaaggctgctgtggaacggaagatactacaactatgatagcagttcccgaccacaatctagatcggtgatgtccgatcagtgcgcaggtcagtggttccttaaagcctgtgggctcggagaaggtgacacggaggttttccctacccagcatgttgtacgcgctctgcagaccatcttcgaacttaatgtacaggcattcgcagggggtgccatgggagccgttaatgggatgcagccacacggggttccagacaaatcctcagttcagtcagatgaagtgtgggtgggcgtcgtgtatggactggctgcaaccatgatacaggaggggctcacttgggagggatttcaaacagccgagggatgttaccgcaccgtctgggagcgactgggcctggcctttcagaccccggaggcctattgccagcagcgtgtgtttaggagcctggcttacatgcgccctctgtcgatatgggccatgcagctggcactgcaacagcagcagcataagaaggcctcttggcccaaagttaagcagggcacaggcctgcggaccggacccatgtttgggccaaaggaggctatggctaacctgtcaccggagtag

SEQ ID NO: 42547 - DNA, 2802 bp, Artificial Sequence
  Description of Artificial Sequence: Synthetic coding sequence
atgggcacccaggaccccggcaacatgggcaccggcgtgcccgcctcagaacagatttcatgtgctaaagaagatcctcaggtctattgtcccgaagagacaggcggcaccaaggacgtgcaagtaacagactgtaaaagccctgaggacagccgaccgccaaaggagacagactgctgtaaccctgaggattctggccagctaatggtgtcctatgaagggaaagccatgggctaccaggtgccacccttcgggtggagaatctgcctggctcacgagttcaccgaaaaacggaagcctttccaggctaacaatgtgtccctgtctaacatgatcaaacacataggcatgggcctcagatatctccagtggtggtataggaaaacacacgtcgaaaaaaaaacgccattcatcgacatgatcaatagcgtacctctgcggcagatatatggatgtcccctggggggcatcgggggcggcacaatcactcgaggctggaggggacagttttgccggtggcagctgaatcctggcatgtaccagcacaggacagtgatcgctgatcagcctatatgcccgcttaaatttacagtttgcctcagacgggagggtcagacagtctaccaacaagtgctctctctcgagcgcccaagtgtcttaagatcttggaactggggactttgcggttattttgcgttctaccacgcactctatccccgtgcttggacagtctatcagctgcccgggcagaatgtaacccttacttgtagacaaatcacacccattctgccccacgactaccaggattcttcgcttcccgtcggcgtattcgtttgggacgttgagaacgaaggcgacgaggccctcgacgtttccatcatgtttagtatgcgcaacggcctgggcggaggagatgatgctcccggcgggctgtggaatgaacccttctgtcttgagcgctctggcgaaacagtcaggggactgctccttcaccatcctacgctgccgaacccctacactatggccgtggctgcccgggtaactgcagctaccacagtgacccatattactgcctttgaccctgacagtacaggccagcaagtgtggcaggacctgctgcaagatggccaacttgacagccctaccggccaaagcactccgacccagaaaggagtcggcatagccggcgccgtctgcgtgtcgtcaaaactgagaccaaggggacaatgccgcctggagttttctcttgcctgggacatgccccgaatcatgtttggagcaaagggacaggtgcactacaggagatatacaagattctttggacaggacggggacgccgcccctgccctgtcacattacgctttgtgcagatacgctgaatgggaggagcgcatcagcgcttggcagtctccagttctggatgacaggagtctgccagcctggtacaagtccgcactgttcaatgagctgtactttttggcagatggcggcaccgtctggctggaggttctggaagatagcctgcccgaggagctggggaggaatatgtgccacttacgtccaaccctgcgcgattatgggaggttcggttatctcgaagggcaagagtacagaatgtataatacgtacgatgtgcatttctatgcaagctttgccctgattatgttatggcctaaactagaacttagtctgcagtacgacatggctctggctaccctgagggaagacctgacacgcaggcggtatttaatgtccggcgtaatggcccccgtgaagaggaggaatgttatcccacacgatatcggtgacccagacgacgagccttggctccgcgtcaacgcttacctcatccacgacactgcagactggaaggatttgaatttaaagtttgtccttcaggtataccgtgattactacttaacaggagatcagaacttcttgaaggatatgtggcccgtctgtttggctgttatggagtccgagatgaaattcgacaaggatcatgacggcctgattgagaacggcggttacgccgaccagacgtatgatggatgggtgactaccggcccatccgcctactgtggagggctgtggctggccgcagtggcagtgatggtacagatggccgctctctgcggagctcaagacattcaagataagttctctagtatcttaagcagaggacaagaggcatatgagcggctgctctggaacgggaggtattataattacgatagttcttcacgaccccagtcgcgatcagtgatgtcggatcagtgtgccgggcagtggttcctaaaagcctgcgggttaggagagggcgatacagaggtcttcccgacacagcacgtggtgcgagccctgcagaccatcttcgagctgaatgtgcaggcatttgctggtggcgctatgggggcggtcaatggaatgcagccccacggggtgcccgataaaagctctgtgcaatctgacgaagtgtgggtaggggtagtctatggcttggccgctacgatgatccaagagggactgacatgggagggctttcaaactgccgaaggctgctaccgaacggtctgggagaggcttggcctcgcatttcaaacccccgaagcctactgtcagcaacgtgtgtttcggtctcttgcatatatgcgccctctgtccatctgggcaatgcaattggcactgcagcagcagcagcataaaaaagcatcctggcctaaagtcaaacagggcaccggattacgtacggggccaatgttcggacctaaagaggccatggccaacctgagcccagagtag

SEQ ID NO: 42548 - DNA, 3636 bp, Artificial Sequence
  Description of Artificial Sequence: Synthetic coding sequence
atggccaccaccgccacccccgccaccaaccagggctggcccgaggactttggcttcaggttgggaggatcagggccatgctttgtgctggaggtggctaagggatcctcagcccatgctggaggtctgcgcccgggggaccagattctcgaagtggaaggcctggctgttgggggtctgagtagagaaaggctggtccgcttagcacggcggtgtcctcgggtgcccccctctctcggggtcttgccagctccagacggggggcctgggcctggttccggcccggccgctccaacaaccgtgctaagggcccctcgctgcggacgtggcctcgcccttggaagagaacttctgcgcctagcaggtagaaaaagaccggacgctgttcaccgagaacgaaggagaaaggcacaagagtttagtcggaaggtagatgagatcttgggagatcaacctaccgctaaggagcaggtgtttgcagctctcaaacagtttgctgccgagcagcgtgtggatgatcttgtgtggaccttgactcttgccctcccgagggaggcttgcgggcccctgctagataaccttaggattttcattccaaagaagcacagagcaagatttgacgaggttgtcagtcaggggttgctcggcaagttatgtagggctcgccgggcccagggagcgcagaggctcagaagatcacggagcgaggagcgtccagaacggctgctcgtcagcacacgcgctagcgctcccccccgtcgccccgacgagccaccaccccgccgggcttccctcctggtgggaggcctcgccggaccgggaggggcccgacgcaccgtccgggtatacaaaggcaacaagtcttttgggttcactctgagggggcatggacctgtgtggatagaatccgttcttccaggctcaccagctgacaacgccgctttgaagtccggcgatcgcatcctgtttttaaacgggctagacatgagaaactgctcacatgacaaggtggtatccatgctgcaagggtccggggccatgcctactctggtggtcgaagagggcctcgtgcccttcgcatcagattccgattcactagattctcctaatccatcttcagccctgacctcactgcagtgggttgcagagatccttccatctagtatacgcgtgcaggggcgcaccttctcccagcagctggagcacctgctgacaccacccgagcggtacggcgtgtgcagggccctggagtcattttttcagcatagaaatatcgatacgctgattgtggacgtgtatcccgtgttggacacacccgcgaagcaggtgctttggcagttcatctaccaacttctgacctacgaggagcaggagctgtgtcaggagaaaattgcctgttttttgggatacactgccatgacggccgaacctgagccagagctggacctcgaaagtgaacccacacctgagcctcagcctcggtcctcgctgcgcgctagctccatgtgccgcaggagcttgcgctctcagggactagaagcaggtctgtcctgcggtccatccgagtgcccggagatgcccctgccactcattcccggtgagcgccaggcaggcgatggcacgagcctgcctgaaaccccgaatccaaaaatgatgtccgcagtatatgcggagctggaatcccgcttgaattccagcttcaagggtaagatgggcacggtctccaagtcacgagcgtctcctcctgggccttcgcccgccgttacaaccggccctcggactttatccggcgtgtcatggccctccgagagacttttacccagcccttgttatcatccgctgtgtagcggcgggctcgccagtccttccagctcagagtctcacccatacgccagcctcgatagtagtcgggcaccttcaccacagcctggtccaggtcccatttgccccgactcacctccaagcccagaccctacacggcccccgagcaggaggaagttattcaccttctcacaccctgtgcgatcacgcgataccgacaggttccttgatgtgctgagtgagcaattaggcccacgggtgactattgtcgacgactttctcacaccggagaacgactacgaagaaatgtctttccacgacgatcaggggtcttttgtcacaaacgaaaggtctagtgcgagtgactgtatttcgtcctccgaagaaggaagttctttaacttactcctcgattagcgatcacatccctccccccccactgtcacccccaccaccaccgcctctgccctttcacgacgccaagccaagttcccgctcctcagatggctccagaggacccgcccaggccctcgcaaaacctcttacacagctttcacatccagttccccctcccccacctcctccccttcccccaccggtgccatgcgccccacccatgctctcccggggattgggacaccgtcgatccgagacaagccacatgagcgtcaagcggttacgctgggagcaagtggaaaactctgagggcaccatctgggggcaacttggagaggacagtgactacgacaagctgtcagacatggttaagtacttagacctcgaacttcactttggtacccagaagccagcgaagccagtgccgggtccggagcccttcaggaaaaaggaagtggttgaaattctatcacacaagaaagcttataacacctctattctgttagcccatctcaaactgagtcctgccgagttgcgacaagtgttgatgagcatggagcctaggcgtcttgagcccgcccatcttgcgcagctgctgctgtttgcccccgatgccgatgaggaacaaaggtaccaagcttttagggaggcccctggtcgacttagtgaaccggatcagttcgtccttcagatgctttccgttcccgaatacaagacacgcctccgctcactacattttcaggccactcttcaagagaagaccgaggaaattcgaggaagtcttgagtgtctgcgacaggcgtctctcgaactgaagaattcaagaaagctggctaaaatactggagtttgtcctggccatggggaattaccttaacgacggacaacccaagactaacaaaactacaggatttaagatcaatttcctaaccgagcttaattcaacaaaaacagtggacggcaagtctacattcctgcatatactcgctaaatccctctcacagcacttcccagagttgctgggcttcgcccaggacctccctacggtaccgttggcggctaaggtgaaccaacgggctttgacctctgatttagctgacctgcacggcacgatctcggaaatccaggatgcctgtcagtctatcagccccagctcagaggacaaattcgctatggttatgagctcatttctggagactgcccagcctgctctgcgtgcgttagacggattgcagcgagaagcaatggaggaactggggaaggcactggcgttctttggcgaggattccaaagctacaacatcggaggccttttttggcatttttgccgaatttatgtccaagttcgagcgtgccctgagtgatctccaggcaggggagggtctgaggagcagtggcatggtttccccactggcatggtag

SEQ ID NO: 42549 - DNA, 1197 bp, Artificial Sequence
  Description of Artificial Sequence: Synthetic coding sequence
atgcacaccgtggccaccagcggccccaacgccagctggggcgcccctgccaacgcctctggttgccctggatgcggagcaaatgctagtgacggaccagtgccatcacctagagcggtggacgcctggcttgtgcccctcttcttcgccgccctgatgttgctgggcctggttggaaattctctggtcatatatgtgatttgccgtcataaaccgatgcgaaccgtcactaacttctacatcgccaatttagccgcaacggatgtgacatttctgctctgttgtgtgccattcactgctctgctgtacccattacccgggtgggtgctgggtgactttatgtgcaagtttgtgaactacatccaacaggtgagtgtccaagcaacctgcgctacccttacagccatgtctgtggatcggtggtacgtcacggtgtttcccctacgcgcgcttcacagacgcacccctcgcctagctttggctgtttccctcagtatttgggtggggtctgccgctgtaagcgcccccgttctggcactgcaccgcctatcccccgggcctagagcctattgttctgaggcttttccctctcgggccctagagcgcgcattcgccctgtacaacttacttgcactctatctgttacctttgttggccacatgtgcctgttatgcagcaatgttacgacacctgggccgggtggctgtccggccagcgcctgccgactcagcactgcaggggcaagttctggcggagcgcgccggcgccgtccgcgccaaagttagccggctcgtagcggcagtcgtccttctatttgctgcatgctggggtcccatccagttgtttctcgtcctgcaggctctgggtcctgctggtagctggcatccacggtcttacgccgcatacgccctcaagacgtgggctcattgcatgagctactccaactccgccctcaaccccttgctttacgcattcctgggatcacacttccggcaggccttccgacgcgtgtgcccctgcgcccccagacggccacgcagaccccgcaggcctggaccatctgatcctgccgcaccgcatgcagagctcctccggctgggctcccacccggctccggctagggctcagaagcccggctcgtccggtctcgcagcacgaggcctgtgcgtgctgggcgaggacaacgcaccattgtag

SEQ ID NO: 42550 - DNA, 3543 bp, Artificial Sequence
  Description of Artificial Sequence: Synthetic coding sequence
atggtgctgctgctgatcctgagcgtgctgctgctgaaggaggacgtgcgcgggtccgctcaaagctccgagagaagggtggtggcccacatgcccggtgacattattatcggtgctctcttttctgttcaccatcagccgacagtggacaaggttcacgagcgcaagtgcggagcagtgcgagagcagtatggaattcagagagtagaagccatgcttcatactctcgaacgcatcaattccgaccctacactcctgcctaatattacactgggttgtgagatcagagactcctgctggcattctgccgtcgcactcgagcagagtatcgagttcatccgcgattccctcataagctcagaggaagaagaagggttagtgaggtgcgtcgacggaagttcgtcttcattcagaagtaagaagcctattgtgggtgtgatcgggccaggatcctcctcagtagcaatccaggtccagaacctgctacagctgtttaatattccccagatcgcctacagcgctacaagcatggatcttagcgataaaactctctttaagtattttatgagagtcgtgccaagcgatgcccagcaggctcgggcgatggttgatattgtgaaacggtacaattggacgtatgtgtctgccgttcatacagagggcaattatggtgagtccgggatggaggcatttaaagatatgagcgcaaaagagggaatttgtatcgcccactcatataagatctacagtaatgctggagaacagtctttcgataaactgttgaagaaactgacaagtcacctgccaaaagctagggtagtggcctgtttttgcgaaggaatgaccgtgagaggattgcttatggccatgcgccgcctgggtctggccggcgagtttcttttgctgggctcagatgggtgggcagacaggtacgacgtgacagacgggtatcagcgcgaggcagtcggagggattaccatcaagcttcagagccccgacgttaagtggttcgacgactactacctaaagctgcgcccagagacgaaccaccgcaatccttggtttcaggaattttggcagcaccggttccagtgcagattggagggattcccccaggagaacagtaagtacaacaagacatgcaattcaagtcttacattgaagacacatcatgtgcaggatagcaagatggggttcgtcattaatgctatttactcaatggcatatggtctccataacatgcagatgtcgctgtgccccgggtatgcaggattatgcgacgcaatgaagcctatagatggccgcaagctcctcgagagtctaatgaaaaccaatttcaccggagtgtccggggacaccatcctctttgacgaaaatggggacagtccaggcagatacgaaataatgaacttcaaagagatggggaaagattactttgactatataaacgtgggctcttgggacaatggtgaactcaaaatggacgacgatgaagtgtggagtaaaaagtctaacataatccgttctgtctgttccgagccttgcgagaagggacagattaaggttatcaggaaaggggaggtctcttgttgctggacatgtactccctgcaaagagaacgagtatgtgtttgacgagtacacctgcaaggcctgtcaacttgggagctggcctactgatgaccttactgggtgtgatctgattccggtgcagtacctgcgctggggcgatcccgaaccgattgctgcagtcgtgtttgcttgtctgggtctgttggcaacgctattcgtgaccgttgtcttcattatttatcgcgatactccggtggtcaagtcatccagccgtgaattgtgctatattatcttagccggcatttgtctgggttacttatgtactttctgcctgattgctaagcccaaacagatctactgttacttgcagaggataggaatcgggttgagtccggctatgagttacagcgctcttgtaactaaaacgaatcgtatcgcacgcatccttgctggtagcaaaaagaaaatctgcactaagaagcctcgatttatgagcgcctgtgctcagcttgtgatagccttcattctcatctgtattcagctggggataatcgtcgccctgtttatcatggagccacctgacatcatgcacgactatccttcaattagggaggtatatctgatctgcaataccacaaacctgggagtcgtcaccccactggggtacaacgggctactgatactgtcctgtacgttctatgcttttaaaacgcggaacgttcctgccaatttcaacgaggcaaaatatatcgcattcaccatgtacactacctgtatcatctggctcgcctttgttccaatatattttggtagtaactataagatcatcactatgtgtttctcggtgtcactttccgctaccgtcgctctgggttgcatgtttgtccccaaagtatatatcatccttgccaaacctgaacgcaacgtgcgatctgcttttacgacctcaacagttgtgcgcatgcacgttggggatggcaagagttcatctgctgcctctaggtcgtcttccctcgttaatttgtggaagcgccgcgggtctagcggcgaaaccctgtcctcaaacggtaaatcggtcacatgggcccagaacgaaaaatcttcaaggggccagcacctgtggcagaggttgagtatccatatcaacaaaaaggagaaccctaatcaaaccgccgtgatcaaaccatttcctaaaagcacagaatctcgtggccttggtgcaggcgcaggcgcgggtggcagtgccgggggggtgggcgccacaggtggggctgggtgcgcaggagctggaccggggggtccagaatcccctgacgctggccctaaggctttgtacgatgtcgccgaggcggaagagcatttccccgctccggccaggccgagatccccttctccaatcagtaccctgtctcacagagcgggcagtgcctctaggactgatgatgatgtcccgtccctgcactcagagcccgttgccaggagctcgagctcccagggtagcttaatggaacaaatcagctctgtggtcacccgattcacggccaatatttccgaactgaattccatgatgctctccacagctgctccctcccctggagtaggggcgcccctatgctcttcttatctaattcccaaggagatccagctgcctacaactatgactacattcgctgaaatacagcccctccctgctatagaggtaaccggcggagcccagccagccgccggcgcgcaggcagctggagatgccgcaagagaaagtcctgccgcaggcccagaggccgctgcagccaagcctgatttggaagagttggttgccctcacacctccctccccttttcgtgacagcgtggatagcggctcaaccactccaaacagccccgtgtcggagtctgccctgtgcatcccttcctccccaaagtatgataccctgataattagggactatacccagagctcttcctcactgtag

SEQ ID NO: 42551 - DNA, 3639 bp, Artificial Sequence
  Description of Artificial Sequence: Synthetic coding sequence
atggtgctgctgctgatcctgagcgtgctgctgctgaaggaggacgtccgtggatctgctcagtcttcggaacgtcgcgtagtggcccacatgcccggggatataatcattggtgctctgttctccgtgcaccatcagcccactgttgataaagttcacgaacgtaagtgcggggccgtgagagaacagtatgggatacaacgcgtagaagccatgctgcatactctggagcgtatcaatagtgatccaaccctgcttccaaacattaccctaggctgtgaaattcgtgattcttgttggcactcagcagtggcgctggagcagagcatcgaattcatccgagacagtttaatctcttccgaggaagaggaaggtctcgtgagatgcgtggacgggtcatccagctcctttaggtcaaaaaagcccatcgtcggggtgatcgggccaggttcctcgagcgttgccatccaggtccaaaacttgttgcagctgttcaacattcctcaaattgcgtatagcgccacttcaatggacttgtcagacaagaccctctttaaatacttcatgagggtggtgccctccgatgcccaacaggcaagagcgatggtcgatatcgtcaaacggtacaattggacttacgtttcagccgtccataccgaggggaattatggagaatcaggaatggaagccttcaaggacatgagcgctaaggaaggtatttgcattgcacactcctataaaatttactccaatgcaggtgaacaatctttcgacaagctgttgaaaaaactcacttcacatttacctaaggctcgggtggtcgcttgtttttgcgaaggcatgacggtaaggggtttgttaatggcaatgaggcgcttgggtctggcgggcgaatttctgctcctaggctccgacggatgggccgacaggtacgacgtaacggatggctaccagcgcgaagccgtcgggggaatcaccataaaacttcaaagccccgatgttaagtggtttgatgactactatctcaagctccggcccgaaaccaaccaccgtaacccgtggtttcaggaattctggcagcacagatttcagtgccgtttagagggatttccacaagaaaattctaaatacaataagacctgcaactcctctttgacactgaagacccaccacgtccaggattctaaaatggggttcgtcattaacgccatctactcgatggcttacgggctgcacaacatgcagatgtctctgtgcccagggtatgccggactgtgcgacgcaatgaagcccatagatggtagaaagctgctggagtccctgatgaagaccaattttacaggagtgagtggggataccatcctgttcgacgagaatggggactcccctggacggtacgagattatgaactttaaggagatgggtaaggactatttcgactacataaacgtgggaagctgggataacggcgagttgaagatggacgacgacgaggtgtggtctaaaaaaagcaacattatccgctctgtgtgcagtgaaccatgcgaaaaaggccagattaaggtcatccgcaaaggtgaagtctcatgctgttggacttgcaccccatgcaaagaaaatgagtacgtgtttgacgagtacacgtgcaaggcctgtcaactaggttcttggcccaccgatgacctgaccggctgcgatctgatccctgtgcaatacttacgctggggcgatcccgagcctattgccgcggtggtgtttgcatgcctgggtctcttggccaccctcttcgtaacagtcgttttcatcatctaccgtgatacgcctgttgttaagagtagtagccgtgagctttgttacattatcctggccggcatctgtcttggttacctgtgtactttctgcctcattgctaagcctaaacagatctactgttacttacaaaggattggcatcgggctgagtccagctatgagctacagcgctctcgttaccaagacaaatcgtattgcaagaattttggccggatccaaaaaaaagatttgtacaaagaagcccaggttcatgtccgcatgcgcccaacttgtgattgcttttatcttgatctgtatccagctcggaattattgttgcacttttcataatggagccacccgatatcatgcatgactacccaagtatccgggaggtgtacctcatctgcaacaccacgaacctgggggtagtcacacctctgggttataacggattgctcatccttagctgtacgttttatgcgtttaaaacccggaacgtgcccgccaatttcaatgaggctaagtatattgcttttactatgtacacaacttgcatcatttggctggcattcgtgccaatctacttcggttcaaattacaagattatcactatgtgctttagcgtgagccttagcgcaacagtagcccttggatgtatgttcgtgcctaaggtgtacatcatactagccaaacccgaaaggaatgtacgatctgcattcacgacatcaaccgtggtgagaatgcatgtgggggacggcaaatcgagctcggccgccagtaggtcctcttcattggtgaacctttggaagcgaagaggctcttccggcgagaccttgcgatacaaagaccggcgccttgcccagcacaaaagcgagatagagtgtttcacgcctaaagggtccatgggcaatggaggcagagccactatgtccagctctaacggcaagtcagtgacctgggcccagaacgagaagtcttctcggggacagcacctgtggcaacgactttctatccacattaacaaaaaggaaaacccaaaccagacagcagtgattaaacccttccccaagtctactgagtcgagaggccttggggccggggcaggggccggcgggagcgccggtggggtgggagccacagggggagctggatgcgctggggcaggaccaggcggaccagagagcccagacgctggacccaaggcgctgtacgacgtcgcagaagccgaagagcattttccagccccagccaggcccagaagcccctctccaatctccaccctgagtcaccgggccggcagtgccagtagaaccgacgatgatgtgcctagcctgcatagcgaacctgtggcacgctcctcaagcagtcaaggctcactgatggaacagatctccagtgttgtaacgaggttcaccgcgaatatatccgagctgaactcaatgatgctctccacagcggccccatcccctggagtgggggcaccgctgtgcagctcatacttaatccccaaagagatacagctgcccacaacgatgacaacatttgccgaaattcaacccctgcccgcaatcgaggttactggaggcgctcagccagccgcaggggcccaggccgccggtgacgccgcgagagaaagccccgccgcaggccctgaggcagccgccgctaagcctgacctggaggagctggttgcattaacacctccatcaccgtttcgggactcggtggactccggcagcaccacaccgaattcgcccgtcagcgaatctgccctctgtattcctagttctcccaagtacgatacactaatcatccgtgactacactcagtcctcttcttcactctag

SEQ ID NO: 42552 - DNA, 2829 bp, Artificial Sequence
  Description of Artificial Sequence: Synthetic coding sequence
atggtgctgctgctgatcctgagcgtgctgctgctgaaggaggacgtgaggggcagtgcccagtcgagcgaaaggcgtgtcgtagcccacatgcccggggacattattatcggcgccttgtttagcgtacaccaccagcctaccgtggacaaagtccacgaaagaaagtgtggagctgtgcgtgagcagtatgggatccaacgcgttgaagctatgctgcatactctggagcggatcaactccgatcccacactgctccccaacatcacgctaggatgcgaaattagagattcttgctggcactctgcggtcgcactggaacagagcattgagttcattcgggattctctgataagctcagaggaggaggaaggactggttcggtgtgtggatggtagctcttcctcgttccggtccaagaaaccaatcgttggcgtcataggccccggatcctcctcagtggcgatacaggtacagaacctgcttcagctcttcaatattccacagatcgcatatagcgctacatctatggacctgtctgacaagacccttttcaagtattttatgagggtggtgcccagtgatgcacagcaggcccgcgcaatggtggacattgttaagcgctataactggacgtacgtgagtgccgtccatacagaagggaattacggcgaatcaggcatggaggcatttaaagatatgtcggccaaagaaggcatttgtattgctcacagctacaagatttactccaatgccggcgagcagtctttcgacaagctcctcaaaaaactcactagccatctgcccaaagcacgggtggtagcgtgtttctgcgaaggcatgaccgtgagaggcctgctgatggctatgagacggctgggactcgcaggggaattcttgctgcttggcagtgacgggtgggccgatcggtatgacgttactgatggctatcagcgagaggccgtgggaggcatcacaatcaaactacaatcccccgatgtgaaatggtttgacgactactacctgaagctccgcccggagaccaaccaccggaacccctggttccaagaattttggcagcaccgctttcagtgccgtttggaaggttttccccaggagaacagtaaatacaacaaaacctgtaatagttcactgactctcaagacccatcacgtacaagattcaaaaatgggcttcgttatcaatgcaatctacagcatggcatatgggctgcacaacatgcagatgtctttgtgcccaggatatgccggtctgtgcgacgccatgaaacctatcgacggcagaaagctcttggagtctctgatgaagaccaatttcaccggcgtatccggagacaccatccttttcgacgagaacggagatagccctgggagatacgaaattatgaatttcaaggaaatgggcaaggattacttcgattatatcaacgtggggagttgggacaacggggagttgaaaatggacgatgacgaggtgtggagcaagaaatctaacattatccggagcgtgtgctcagagccgtgtgagaaggggcagattaaggtgattagaaagggcgaggtgtcctgctgctggacctgcaccccctgtaaggaaaacgagtacgtgttcgatgagtatacatgcaaagcctgccagctcgggtcctggccaacggatgacctcaccggatgcgacctgatcccagtgcaatatctgagatggggcgacccggagccgattgccgcagtagtgttcgcatgcctcggacttttggcgactttgttcgtgactgtcgtattcatcatctatcgggacacgccagtagttaagtccagttcaagggaactttgctacatcattctggctggcatttgccttggatacctatgtactttctgcctgatcgctaagcccaagcaaatctattgttatcttcagcggatcggcatcggcctgagcccagccatgagctatagcgcacttgtgaccaagactaaccgaatcgcgcggatcctggctggctccaagaagaagatttgtacaaaaaagccgaggtttatgagcgcatgtgcccagctcgtgattgccttcattctaatatgcatccaattagggattatagtggccctgttcataatggaaccgccggacattatgcatgactacccatcgataagggaggtgtacctaatctgtaatacaaccaatctgggcgttgtcaccccacttgggtacaacggtctactgatactgagctgcacattttacgcctttaaaactcgaaatgtgcccgcaaacttcaatgaagccaaatacattgcatttactatgtatacaacttgcatcatttggctagccttcgtaccgatctattttggaagtaactataagatcatcactatgtgtttttcagtgtccctcagcgccacggtggcactgggctgtatgttcgtgccaaaggtctacattatcctcgccaagcctgagcggaacgtccgctcagcgtttacaacgtccactgtcgtaagaatgcatgtgggagatgggaaatcatccagtgccgcctctagatctagttctctcgtaaacctgtggaagcggcgtggatctagtggcgaaacattgcgttacaaggaccggagactggcccagcataagagcgagatcgagtgcttcactccaccttcaccctttcgtgatagtgtggacagtggttctacaacacccaactcccctgtcagcgagagcgccctctgcatcccaagcagcccaaagtacgacaccctgatcatcagggattacacccaaagctcaagttcattatag

SEQ ID NO: 42553 - DNA, 3639 bp, Artificial Sequence
  Description of Artificial Sequence: Synthetic coding sequence
atggtgctgctgctgatcctgagcgtgctgctgctgaaggaggacgtgcggggaagcgcccaaagtagcgaacggagagtcgtggcccatatgcccggcgatatcatcatcggcgctctgttttccgttcatcaccagccaacagttgacaaagtgcatgagcgtaagtgtggcgcagttcgggagcagtacggcatccagcgtgtggaagccatgcttcatacactggagaggataaattctgaccccaccctgctgcctaatattacactcggatgcgagattagagatagctgctggcatagcgctgtggctctggagcaatctatcgagttcattcgggacagcctcatctcatcagaagaggaggaaggtctcgttcggtgcgtggacgggtcatcctcatcatttcgatcaaagaaacctatagtgggtgtcatcggccccggatcctcctctgttgccatacaggtgcaaaacctgctgcaactgttcaacatcccccaaatcgcctactccgcgactagcatggatttgtcagacaagactctatttaagtattttatgcgagtagtcccatctgatgcacagcaggccagagctatggtagatattgtcaaacggtataactggacatatgttagcgccgtgcatacagaaggaaactatggcgaatctggcatggaagctttcaaagatatgagcgccaaagaggggatttgtatcgcccactcatacaagatttattcaaacgccggggagcaaagctttgacaagctgttgaagaaattaacgtcccacctccccaaggctagagtggtagcctgtttttgcgaaggcatgacggtgcgcgggctgttgatggccatgagaagacttggtctcgctggggagttcctgttgctgggcagcgatggatgggcggatcgttatgacgtcactgacggctaccagagagaagcggttggcggaatcacaataaagttgcagagtccagatgtgaaatggtttgacgattactatctgaagctgcggcccgagaccaaccacagaaacccctggttccaggagttctggcagcatcgctttcagtgccggttagagggatttccccaggaaaacagcaagtacaataagacttgtaattcgagccttaccctgaaaacgcaccacgtgcaggactccaaaatgggttttgtaatcaatgcaatctattccatggcctacgggctgcataacatgcagatgagtctatgccccggctacgccggactgtgtgacgctatgaagccaatcgatggaaggaagttacttgaatcccttatgaaaacgaacttcacaggcgtgagcggggacactattctatttgacgagaatggcgatagccctggccgatacgagatcatgaactttaaggaaatgggtaaggattatttcgactatattaacgtcggttcttgggataacggagaactgaaaatggacgatgatgaggtgtggtctaagaagtctaacatcatccgttcagtgtgcagtgagccttgtgaaaaaggccaaattaaggtgattagaaagggggaggtcagttgttgctggacgtgcaccccttgtaaagagaacgaatacgtgtttgacgaatacacatgtaaggcctgtcagttgggctcatggcccacggacgatctcaccggctgtgacttaattccagtccagtacctgagatggggagatcccgaacccattgctgcagttgtgttcgcttgcttgggattgctcgctacactcttcgtgactgttgtttttataatctacagggacaccccggttgtaaaaagttcatctcgcgagttatgttatatcattctggcaggaatctgtctgggctatctctgtacattctgcctgattgctaaaccaaaacagatctattgttacttacagaggatcggcattggcctcagcccggccatgtcatacagcgctctcgtgaccaagaccaataggatagcccggatcctggccggcagcaaaaaaaagatttgcacgaagaagcctcggttcatgtcagcttgtgcccaactcgtgatcgccttcatccttatatgtattcagctgggtataatcgtcgcactgtttataatggaaccacccgacattatgcacgactacccatcaatccgggaggtgtacctgatctgtaacacaaccaatctgggcgtcgtgaccccactgggctataacggacttctgatcttgagttgcacattttatgctttcaaaacgcggaatgtcccagccaactttaatgaagccaagtatattgccttcacgatgtacaccacctgcattatctggctggctttcgtccctatctacttcgggagtaattacaaaattattactatgtgtttctcagtctcactttccgcgaccgttgcactcggttgcatgtttgtgcccaaggtttacattatcctggccaagcctgaaaggaacgtgcggtctgctttcacgacaagcacagtagtcagaatgcatgtgggggacgggaaatcaagctccgccgcttcacgttcctcttcgttggtcaacctgtggaagagaagagggtcctcaggagaaaccctgaggtacaaggaccggaggttagcccaacacaagtctgagatcgagtgtttcacccccaagggctcgatgggcaatggtggacgcgcgaccatgtccagcagcaatgggaaatcagtaacgtgggctcagaatgaaaagagcagccgtggccaacacctatggcagagactgagcatccatataaataaaaaggagaatcccaatcagacagcagtgatcaagcccttccctaagtctacagagagtagaggactgggcgccggagccggcgcgggcggttctgccgggggcgttggtgctacagggggtgcaggatgtgccggtgcggggcctggagggccggagagcccagatgccggccccaaggcactgtacgacgtggcagaggccgaggaacattttccagcaccggcccgaccacggtccccgagtcccattagcacgctcagccacagagcgggctccgcctctcgcacagatgacgacgtgccgtcccttcatagcgagcccgttgcgcggtcttcttcatcccaggggtccctcatggagcagatttcgagcgtggttaccagattcacggccaatattagtgaactcaactctatgatgttgagcacagctgccccgtcgcccggggtcggtgcaccattgtgctcctcttacctcatcccgaaggagattcagttacctacaacaatgactacgttcgccgaaatccagcccctgccagctatagaagtcactggcggagcccagccagctgcaggcgcacaagctgcaggagacgccgccagggagagccccgctgccggcccggaggccgccgccgcaaagccagatctggaagagctggtcgccctgacacccccctcgcctttcagagactcagtggatagtggctctactaccccgaactcacccgtttcagaaagcgccctgtgtattccgtcctcacccaagtatgacacactcatcattcgcgattatactcagagctccagctctctgtag

SEQ ID NO: 42554 - DNA, 3543 bp, Artificial Sequence
  Description of Artificial Sequence: Synthetic coding sequence
atggtgctgctgctgatcctgagcgtgctgctgctgaaggaggacgtgcgcggcagcgcccagtccagcgaaaggcgcgttgttgcgcacatgccaggcgatattattattggagcgctgttttccgtgcatcatcaaccgacagtagacaaggtgcacgaaagaaaatgcggcgctgtcagggagcaatacggtattcagagagtggaggctatgttacacactctcgagcgtatcaactccgatcccaccctgctccctaacatcacgctgggatgcgagatccgcgattcttgctggcacagtgcagtggccttagagcaatctatagaattcatcagggatagcctcatcagcagcgaggaggaggagggtctggttagatgcgtcgatggatcctcttccagctttagaagcaagaagcccatcgtcggtgtcattggtccaggaagctcttcagtggctatccaggtccagaacctgcttcagcttttcaatatcccccaaatcgcgtatagtgctaccagtatggatctgtctgataagacccttttcaaatacttcatgcgggttgtgccttccgatgctcagcaggctagggccatggtcgatatagttaagcgctataattggacttatgtctctgctgtgcacaccgaaggaaactatggtgagtccggaatggaagcattcaaggatatgtccgccaaagaggggatctgcatcgcacactcatacaaaatctactctaacgctggagagcagtctttcgacaaactactgaagaagctgacgtctcacctgcctaaagcccgtgtcgttgcctgcttttgtgagggcatgacggtgagaggtcttctgatggctatgagacgactcggactggccggtgagttcttactgttggggtccgacggatgggccgacagatacgatgttactgatggttaccagagggaggcggtgggagggatcacaattaaactgcaatctcccgatgtgaaatggtttgacgactattacctgaagctgagacccgaaactaaccatcgcaatccttggtttcaggagttctggcagcatagatttcaatgtcggctggagggcttccctcaggagaattccaaatataataagacatgcaacagcagcttgaccctgaaaacgcatcacgtgcaggactctaagatgggcttcgtgattaacgcaatctatagcatggcgtacggcctgcataatatgcagatgtcattgtgccctggatacgctgggctgtgcgacgctatgaaacctattgatgggaggaaactgctggagtcactgatgaagacaaacttcacaggggtgagcggagacaccatactgtttgatgagaatggtgactctcctggccgttatgaaattatgaattttaaagagatggggaaagactatttcgactatattaacgtgggatcttgggacaacggggaactcaagatggatgatgacgaagtctggtcgaagaagagtaacattatcagatcagtttgcagcgagccttgtgaaaaaggccagataaaggttattcgtaagggggaagtgtcctgctgctggacatgcactccatgcaaagagaacgaatatgtgttcgatgagtacacttgtaaagcatgccaactcggatcctggcctacggacgacttgaccggctgtgatctcataccggtacagtatctacggtggggcgacccagaacctattgcggctgtagtcttcgcatgcttgggccttctggcgacgctgtttgtcacagtggtatttataatatatagggatacacccgtagtgaaatctagtagccgggagttatgttacattattcttgctggcatctgcttggggtatctatgtaccttttgcctgatagctaaaccaaagcaaatttattgttatctgcagcggatcggtattggactcagtcctgccatgtcttactctgccttagtgaccaagaccaaccggatcgccaggatcctggccgggtctaaaaaaaagatatgcaccaaaaagcccagattcatgtctgcctgtgcccagctggttattgcattcatcctcatatgtattcaacttggaatcatagtggccctgtttataatggagcctcccgacatcatgcacgactatccgtccatccgcgaagtttatctgatatgcaacaccacaaatctcggtgtggttactcccctgggatacaacggtctgctaatcttgagctgtacgttttacgctttcaaaactcggaacgtgccagcgaattttaacgaggcaaaatatatcgcattcactatgtacacaacatgcattatatggctggcctttgtaccaatatactttggctcaaactataaaattatcacaatgtgcttcagtgtcagcctgagtgccacagtggccctgggatgcatgtttgtgcctaaagtatatattattctcgccaagcccgagcgaaacgtgcggtctgccttcaccaccagtacggtagttcgcatgcacgtaggcgatggcaagtcgtcaagcgccgcctcgcgcagttctagcctcgtgaatctgtggaagcgccggggaagtagcggtgagaccttatccagtaatgggaagagcgtgacctgggctcagaacgagaagtcaagtagggggcagcacctgtggcaacgactgagcattcatatcaacaaaaaggagaaccccaaccagactgcagtaattaagccttttcctaaaagcactgagagtaggggcctgggtgccggagccggggccggcggatctgccggtggcgtcggagctactggaggagccggttgtgctggcgctggcccaggcggaccagagagtccagatgctggccctaaagccttgtacgacgttgcggaggccgaggaacattttccggcacccgctcgccctcgttcaccctcaccaattagtaccctgtctcatagagcgggctccgcatccaggaccgacgacgacgtcccatcattacacagcgagcccgtagccagatcttcctcttcccaggggtcactcatggaacagatctcatcagtggttacacggtttacggccaatatttccgaactgaacagtatgatgttgtccacagctgccccttcgcccggggttggcgcacccttgtgttcgagttacctgatccccaaagagatccagctgcctacaactatgacaactttcgccgagatacagcctttacccgccatagaagtgacgggtggtgcccagcccgctgctggcgctcaagctgcgggagacgccgcacgggaaagtcccgcggccgggcctgaggctgccgccgctaaacctgatctcgaagaattagttgcgctgacgcctccttcccctttccgagactcagttgattccgggtcgacaaccccaaatagtcccgtgtcggaatcagctctctgcatcccaagctcgccaaaatatgatacccttatcattcgcgattacacacagtctagttcatctttgtag

SEQ ID NO: 42555 - DNA, 1149 bp, Artificial Sequence
  Description of Artificial Sequence: Synthetic coding sequence
atgcggagcggcggccggggccggccccggctgcggctgggcgagcgcggactaatggagccacttcttccgcctaagcgccgcttactccccagagtccgcctgctgccactgttgttggctttagcggtcggttcggccttctataccatttggtctggatggcaccgccggacagaggagctcccgctgggtcgggaactaagagttcccctgatcggaagtctacccgaggccagactgagaagggtggtaggtcaactagatccacaacggctgtggagcacttaccttagaccactcttagtggtgaggactcccggcagccctggcaacctccaggtgagaaagttcctcgaagccacactgagatccctgacagctggttggcacgtggaattggatccgttcactgcctccactccgctgggccctgtggacttcggcaacgtagtcgcaacactggacccccgtgcggctcggcatctgacccttgcttgccactatgattccaagctctttccaccgggctctacgcctttcgtgggcgcaacggactctgcagtgccttgtgccttactattagagctcgctcaagccctggaccttgaactgagccgcgctaagaagcaggccgcaccagtaacattgcaactactgttcttggacggagaagaagcactcaaggagtggggccctaaagattctctctatggcagtcgtcatctggctcaactgatggagtccattcctcatagtcccggaccaactcggatccaagctatcgaactcttcatgctgctggaccttctgggtgcgcccaatcctaccttctacagccacttccctaggacggtgcggtggttccacagacttcgtagtatcgagaagcgcctgcaccggctgaatcttttgcagtctcaccctcaggaggtcatgtacttccagcccggcgagccatttgggagtgtcgaagacgaccacattccgttcctgaggcggggagtccctgtcttacatctgattagcaccccatttcccgccgtatggcacaccccggctgacactgaagtgaacttacatcccccaactgtccacaatctgtgcaggatactggctgtcttcctcgctgagtatttaggtctgtag

SEQ ID NO: 42556 - DNA, 867 bp, Artificial Sequence
  Description of Artificial Sequence: Synthetic coding sequence
atgcggagcggcggccggggccggccccggctgcggctgggcgagcgaggcttaatggaacctctgctccctccaaaacggagactcctgccacgcgtccgcctcttgcctttgcttctggccctggcagttggctccgccttctataccatctggtctggatggcacaggaggacggaagaactgcccctggggcgtgaactgcgggtgcctctaattggatcactgcccgaagctagactgagacgcgtcgtggggcagcttgaccctcaacggctttggtcaacgtacctccggcctttgctcgtagtgcggacccccggctcaccaggtaacctgcaggtgcgcaaggccgcccccgtcactcttcagctgcttttcctggacggcgaggaggctctgaaggaatggggccctaaggacagtctctacgggtctagacatctcgcccagcttatggagagcatcccccattctcccggtccgacaagaattcaagcaattgaattattcatgctactcgatcttctgggggctccgaaccctacattctactctcacttccccaggacagttcgttggttccaccgcctccgcagcattgagaagaggctgcaccggttgaacctcttgcaatcccatcctcaggaggtgatgtatttccagcccggtgagccattcggctcagtggaagacgaccacatccctttccttaggcgaggagtgcctgttctccatctgatctcgacaccattccctgcagtgtggcacactcctgccgatacggaagtcaatttgcaccccccaacggtgcacaacttgtgtcggatcctggccgtgttcttggcagaatacctaggcctgtag

SEQ ID NO: 42557 - DNA, 960 bp, Artificial Sequence
  Description of Artificial Sequence: Synthetic coding sequence
atgctgggccggagcctgcgggaggtgagcgccgccctgaagcaggggcagatcactccaacagagctgtgccagaaatgtctatccctgattaaaaagactaagttcttaaatgcttatattacagtgagtgaggaagtggctctgaagcaggccgaggagagcgagaaacgctataaaaatggccagagcctgggtgatctggacggcattccaatcgctgtgaaggacaacttctccacctcaggcatcgagaccacctgcgccagtaatatgcttaagggctacattcctccatacaatgccaccgtcgtccaaaagcttcttgaccagggggctctgttgatgggcaagactaacctagacgaatttgcaatgggatccggatccacagacggtgtatttggaccagtgaagaacccttggtcctactctaagcagtacagagagaagcgtaaacagaacccacactccgaaaacgaagacagcgactggcttatcactggcgggtcatccgggggatcggctgccgctgtcagcgcttttacttgttacgctgctctcggtagcgatacaggcggcagcacgcgcaaccctgccgcccactgcggactagtaggtttcaaaccgagctatgggctcgtatccagacatggcctaatcccacttgtgaactctatggatgtgccaggcatactcacccggtgtgtggacgacgctgctatcgttttgggcgccctggctgggcccgacccgagggattcaacgaccgtgcatgagcccattaataaaccctttatgctgcccagtctcgctgacgtctccaaactgtgcattggcatccctaaggtcaccttctctttccactactttactgagattctatctagccctattgaaagcaccgatttgggaggaggcctgggaggcttcgaaagcctgttgtgtcatttttattag

SEQ ID NO: 42558 - DNA, 1587 bp, Artificial Sequence
  Description of Artificial Sequence: Synthetic coding sequence
atgctgggccggagcctgcgggaggtgagcgccgccctgaagcaggggcagattaccccaacagagttatgtcaaaagtgcctgagcctgattaaaaagacaaaattcttgaatgcatacattacggtgagtgaggaggtggccctgaaacaggccgaagagtccgagaaacgttataagaacggacagtcactgggggacctggatggcattcccatagcagtcaaagataatttcagcacctctggtatcgagactacttgtgctagcaacatgctcaaggggtatatccctccttacaacgccactgtggtgcagaaactcctggatcagggagccctcctgatggggaagaccaatctagacgaattcgcaatgggatctggaagtactgatggggtctttggcccagtgaaaaatccctggagttattctaagcagtacagggagaaacgaaagcaaaacccacatagtgagaacgaagacagcgattggctaattacaggcggaagttccggtggttctgcagcagctgtctcagcttttacatgctatgccgctctggggagcgacaccgggggctcgaccaggaacccggctgctcactgcggcctagtgggattcaaaccctcctatggattggtgtcccggcacggtctcatccctctcgtgaattcaatggacgtgcccggaattctcacgcgctgcgtcgacgatgccgccatcgtactgggtgccctggctgggcctgacccccgtgacagcaccacggttcacgagccaattaataaaccctttatgctccccagtctagcagacgtcagtaaactgtgcattggaatccccaaagagtacctcgttcccgaactgagctcggaagttcagagcctctggtctaaagctgccgatcttttcgagagcgagggagctaaggtcattgaggtgtcactgcctcacacttcctactcaatcgtttgttaccatgtgctctgcacaagcgaggtagcctctaacatggcacgctttgacggcctccaatacgggcacagatgtgatattgatgtgagcaccgaggctatgtacgcggccaccagacgggaagggttcaacgacgtcgtgagagggcgtatccttagtggaaatttctttttgttgaaggaaaactacgaaaactacttcgtaaaggcccaaaaggtcaggcggctgatcgcgaatgacttcgtgaatgcctttaattccggcgttgatgtgctgctgacgccaaccacactgtctgaagctgtgccgtatctcgagttcataaaggaagacaaccgaaccagatcagcccaggacgacatttttactcaggccgtgaacatggccggtctacccgctgtgtctattcctgtggccctgagtaatcaagggctcccgatagggctccaattcatcggacgagccttttgtgatcaacagctgctgacggtagccaagtggttcgaaaaacaggtacagttcccagtgattcagcttcaggagctgatggacgactgttcggccgtactagagaatgaaaagctggcttccgtctccctgaagcaatag

SEQ ID NO: 42559 - DNA, 411 bp, Artificial Sequence
  Description of Artificial Sequence: Synthetic coding sequence
atgtggagccggctggtgtggctgggcctgcgggcccccctgggcggcagacagggcttcacatcgaaagcagatcctcagggatctggtcgcataaccgcagccgtcattgagcacttagagcgtctagcgctggtggatttcggatccagagaggccgtggctagactggagaaagcgatcgcgtttgcagatagattaagagcagtggacacagatggggtggaacctatggagagtgttctcgaggacaggtgtctgtacttgcggagcgacaatgtggtggaaggaaactgcgctgacgagctgctgcagaactctcatcgcgtggtggaggagtattttgtggctccaccagggaatatcagcttacctaaattggatgaacaggagccttttcctcacagctag

SEQ ID NO: 42560 - DNA, 630 bp, Artificial Sequence
  Description of Artificial Sequence: Synthetic coding sequence
atggagcccctggccgcctaccccctgaagtgcagcggcccccgggcaaaagtgtttgcagtcctgctgagtatagtactgtgcactgttaccctgttcctgctgcagctgaaattcctgaaacctaaaattaacagcttctatgccttcgaggtcaaagacgctaaaggaagaacggttagcctggagaaatacaaaggaaaagtttcattggtggtgaatgttgcctctgattgtcagttaacagatcggaattatctcggactcaaggaattgcataaggaattcggaccatctcatttttctgtgctcgccttcccttgtaatcagttcggagagtccgaaccccgacctagtaaagaggtcgagtcttttgcacgaaaaaactacggcgtgacgtttcccatctttcataaaattaagatccttgggtctgaaggcgagcctgcattccgatttttggtggactctagtaaaaaagagccgcgatggaatttttggaaatatcttgtcaaccccgaagggcaggtcgtcaaattctggaaacccgaagaacccattgaagttatccgccctgatatcgccgcgcttgtccggcaggtgattattaaaaaaaaggaggatctgtag

SEQ ID NO: 42561 - DNA, 2388 bp, Artificial Sequence
  Description of Artificial Sequence: Synthetic coding sequence
atggccaccatgctggagggccggtgccagacccagccccggagctcccccagcggtcgagaagcttccctgtggagctccggcttcggcatgaaacttgaagccgtgactcctttcctggggaagtatagaccgttcgttgggaggtgttgccagacttgcacacccaagagttgggaaagcctcttccatcgaagcattaccgacctgggcttttgcaacgtgatactggtcaaagaagagaacacccggtttcgtggctggctggtcaggcggctctgttacttcctttggtcgctcgagcagcacatcccaccctgtcaagacgtgccacagaaaattatggaatctaccggggttcagaatctcctgagtgggcgggtccccggaggcaccggagagggccaggtaccagaccttgtcaaaaaggaagtgcagcgaattctcgggcacattcaggctcccccacgacccttcttggtgaggcttttcagttgggcgcttcttcgcttcctcaactgcctctttctaaacgtgcagttacacaagggtcagatgaagatggtccagaaggccgcgcaggccggacttcctctcgtcttattgagcacacacaaaacactcctagacgggattctgctgccttttatgctgctgtctcagggtcttggtgttttgcgcgtggcttgggacagtcgtgcttgttctcccgccctgcgcgctctactaaggaagctaggcggactctttttgccacccgaggccagtttatctttagattctagtgagggactgctggcgagggctgtggttcaggcggtgatcgagcaactgttagtgtccggtcaacccctgttaatctttctggaagagccccctggtgccctggggcctcggctgtccgccctggggcaggcctgggttgggtttgtagttcaagcagtccaggtgggaatcgtccccgacgccctactggtacccgtcgctgtcacttatgatttggtgccagacgctccctgcgacattgaccatgcatccgccccactcggtctatggaccggagctctggccgtgctgcgctctctgtggtccaggtgggggtgcagtcatcgaatctgctcaagggtgcacctggcccagccgttcagcctgcaagaatacatagtatccgcgagatcttgctggggcggacgtcagacgttggagcagcttctgcagccaatagtgctcggacagtgtacggctgtccccgacacagagaaagagcaggagtggactcccatcaccggtccgcttttggccctgaaggaggaagatcagcttctggtgcggagactctcttgccacgtcctgagcgcctccgtgggttcatctgcagttatgagcaccgcgattatggcaacattgttattatttaaacaccaaaagctcctaggcgaattcagctggctgacagaggagatcctgctccgcggctttgatgtagggtttagtggtcaattgagaagtttgctgcagcacagtctgagtctacttagagcacatgttgctctgctgagaattcgccagggggacctgctggtggtacctcagccgggcccaggcctcacccatctggctcaactctcagctgaattattacccgttttcctgagtgaagcggtgggcgcctgtgcggtgaggggtttactggcaggccgagtgcctccccaaggaccctgggagctgcaggggattttgctgctttcgcaaaatgaactgtacagacagattttgctcctgatgcatctgttgccccaggacttgcttttgctcaagccttgccagagcagttactgctactgccaggaagttcttgataggctcatccagtgcgggctgctagtggctgaggagaccccaggctccagacccgcctgtgacactggaagacagcggctctctcgcaagctgctgtggaaaccttcgggtgactttaccgactccgacagcgacgacttcggcgaagccgatggacgctatttccgcctatcacagcaatcccattgcccggacttctttctgtttttgtgtcgcctactttccccgttgctgaaagccttcgctcaggctgcagcattcctcaggcaggggcaactgcccgacacagaacttggctacaccgagcagctgttccagtttttgcaggccacagcccaggaggaggggatttttgaatgcgcggacccaaagctagccatatctgcggtgtggactttccgggacctcggggtcctgcagcagacaccatcacctgcagggccgcgcttacacctgtcacctacctttgcatccctggataaccaagaaaaacttgagcagttcattagacaatttatctgttcatag

SEQ ID NO: 42562 - DNA, 2016 bp, Artificial Sequence
  Description of Artificial Sequence: Synthetic coding sequence
atggccaccatgctggagggccggtgccagacccagccccggagctcaccttccgggcgggaggctagcctttggtcctcaggcttcgggatgaagctcgaggcggtcacgccgttcctcggtaagtatcggcctttcgtcgggagatgctgccagacctgcacacctaaaagttgggaatccctgttccatcgttccattacggacctagggttttgcaatgtgatcctcgtgaaggaggagaacactaggtttagggggtggctggtccggaggctctgctacttcctttggtccctcgaacaacatatcccaccctgtcaggatgtgccgcagaagataatggagtccaccggggtacagaacttactgtctgggcgcgtccctggtggcaccggtgaagggcaggtgccagacctggtaaaaaaagaggtgcagcgcatactagggcacattcaagctcccccacgccccttcttagttcgcctcttcagttgggccctcctacggtttctgaactgcctgttcctgaatgtgcagctgcacaagggccagatgaaaatggtccagaaagccgcccaggccggacttcccctagtgttgttgtcaacccacaaaacactgctcgatggcattctgctccctttcatgctgctgtctcagggactgggcgttcttcgagtcgcttgggattcccgggcctgtagccctgccctccgagctctcctgagaaaactcggagggctatttcttccccccgaagcctcccttagcctggattctagtgaagggctgttggccagggcagttgtgcaagccgtgattgaacagctgctggtgagtggacaaccattgctcatttttctagaggaacccccgggtgccctcggccctcgcctgagtgcgttgggccaggcctgggtggggttcgtcgttcaggcagtccaggttggcattgtgccagacgccctgctcgtcccagtagctgtgacttacgacctggtgccagacgctccatgtgacattgaccatgccagtgccccgctcggcctctggactggggctctcgctgtcctgcggagcctatggtcacgctggggatgttctcaccgcatttgctcacgcgtgcatctggcacagcccttttctctgcaggagtacatcgtgtcagctcgtagctgttggggcggtcgacagacacttgagcaactcttacagccgatagtgcttggtcagtgcacagctgtaccagacaccgagaaggagcaggagtggactcctattacaggcccacttctcgctctcaaagaagaagatcagctgctggttagacgactcagctgtcatgtgctctctgccagcgtgggcagcagtgccgtgatgagcacagcaatcatggccacgctgttgctgtttaagcatcagaaattgctaggcgaattcagctggctcaccgaggaaattctactccgggggttcgacgttggcttcagtggacagcttaggtcgctgctccagcacagtctgtctctccttcgggcccacgtcgcgttgttgcggatccggcagggagacctgttggtggttccccagcccggtccaggattaacccacctcgcccaattaagtgccgagcttcttcctgtttttctctccgaggctgtgggtgcctgtgcagtccgagggctgttagcgggtagggtcccaccacaaggcccctgggagctgcagggaatcctgctcctcagtcaaaacgagctgtaccgccagattctgctactgatgcacctcttgccacaggaccttttactgctaaagccctgccagagctcatactgctattgccaggaggtccttgatcgactgatccagtgtggcttattggtggcggaagagtcgtgggcaacccaaagcagttgcagctcgtcttgtcggccaccccctagaaaaaaaggttccagttcagttcggacacaaagcagcccatcagttctgtcgggcccgagcgagacttag

SEQ ID NO: 42563 - DNA, 2388 bp, Artificial Sequence
  Description of Artificial Sequence: Synthetic coding sequence
atggccaccatgctggagggccggtgccagacccagccccggagcagtccttctggcagggaggcctcgctgtggagctcaggttttgggatgaagctcgaggcagtgacaccattcttgggcaagtaccggcctttcgtggggcgatgttgtcagacatgcactcccaagtcatgggaatccctatttcatcgaagtatcaccgatctgggcttttgcaacgtgatactcgtgaaagaggaaaacacaagatttcgcgggtggcttgttaggagactatgctactttctgtggtcgctggaacagcatattccgccctgtcaggacgttcctcagaagattatggagagcaccggggtccaaaacttgctgtcaggaagagtgcctggtggaacgggggaaggtcaggtgccggatctggtcaagaaggaggttcaaagaattctgggccatatccaggctccacctcggcctttcctggtgcggcttttctcctgggcactgttgcgcttcctgaattgtttgtttctgaatgtccagctgcacaaaggacagatgaagatggtgcaaaaagctgctcaagcaggtcttccactggtcctgttaagcacgcataagacactcctcgatggaatattgctgccttttatgctcctgtctcaaggcctgggcgttctaagggtggcctgggactcccgggcctgctcccccgctctgagagcactgctacgcaagctcggtgggctatttttacctccagaggcatctttgtcactggattcaagtgaagggttgttagcccgggctgtggtccaagcagtgatcgaacagctgctagtttcaggtcagcctttgctgatctttttggaggagccccccggagctttggggccccgcctgtcagctttaggacaggcctgggtgggatttgtggttcaagccgtgcaggtgggaattgtgccagatgccctgcttgtgcccgtcgctgtaacatacgatctggtcccggatgccccgtgcgatattgaccacgccagtgcgccccttggcctttggactggtgcgctcgcagtgcttcgaagcctctggagccgctggggatgttctcacagaatctgcagcagagtccatctggcccagcccttcagtctccaagagtacatcgtctcagctcgctcctgctggggaggaaggcagacactggagcaactgctgcagcctatagtgctcggtcagtgtacagcggtgcctgatactgagaaggagcaagagtggacccccatcacgggacccttactggctttaaaagaagaagaccagctccttgtgaggaggctctcttgccacgtgctttcagcctccgtcggctccagtgcagttatgtcaaccgccatcatggcgacccttctcttgttcaaacaccagaagcttctcggggaatttagttggctcaccgaggaaattctgctgcggggattcgacgtcggattttctggacagttgagaagcttattacagcactcgttgtccttgcttagggcccacgttgcactgctcaggatccggcagggggatctgctggtcgttccacaaccggggcccggccttacccaccttgcccagctgtctgcagagctcctgcccgtgtttctatcggaggcagtcggagcatgtgcagtgcgagggctgttggctggccgggttccccctcagggcccttgggaactccaaggtattttacttctgtctcagaacgagttgtatagacaaattttgttgctgatgcacctgttgccacaggatctgctcttgttgaaaccttgccagtctagttactgctactgccaagaagtcttagacagacttattcagtgcgggctgctcgtggctgaggagacacccggctcacggcccgcatgtgatactggccggcagcgcctgagtagaaaactgctttggaagccctctggagactttacggacagtgatagcgatgatttcggagaagcagatggccgctacttccgacttagtcagcaatctcactgccccgattttttcctattcttgtgtcgactcctgtctcctctcctgaaggctttcgcgcaggccgccgcgtttctgcgacagggacagctgcctgataccgagctgggatataccgaacagctgtttcagtttctgcaggctactgcccaggaggagggcatcttcgaatgtgccgacccaaagctggcgatttctgctgtgtggaccttcagggatctgggcgtgctgcagcagacaccaagtccagccgggccccgcctgcacctctcccccaccttcgcctctctcgataatcaggaaaagctggagcaattcatacgacaattcatctgctcttag

SEQ ID NO: 42564 - DNA, 483 bp, Artificial Sequence
  Description of Artificial Sequence: Synthetic coding sequence
atggccaccatgctggagggccggtgccagacccagccccggagctctccctcagggagagaggccagcctgtggtccagcggatttggcatgaagttggaagctgtcactccatttctgggaaaatatagacccttcgtcggcagatgttgccagacctgtacaccaaaatcatgggaaagcctgttccacaggtccattactgatctgggcttctgcaacgtgatcctggtcaaagaagagaacaccaggtttcgcggctggctagtaagaagactctgctactttctttggtcacttgaacagcatattcctccgtgtcaggatgttccacagaagattatggaatctacaggcgtccagaacttgttgtccggccgtgtaccggggggcactggcgaggggcaggtgcccgacctggttaagaaagaggtgcaaagaatactcgggcatattcaggcacctccccgacctttcttgtag

SEQ ID NO: 42565 - DNA, 2487 bp, Artificial Sequence
  Description of Artificial Sequence: Synthetic coding sequence
atggacgagagcgccctgaccctgggcaccatcgacgtgagctacctcccccactcaagcgagtacagcgtcgggcgttgcaagcatacgtcagaggagtggggagaatgcggcttccgccccacaatattcaggtccgccacgctcaagtggaaggagtccctgatgtctcgtaagcgcccattcgtcggccggtgttgctattcttgcactccccagagctgggacaagttttttaatccgagcatacctagtctcggcctacgaaatgtcatttacatcaacgaaacgcatacacggcacagaggatggctggctaggaggctcagctacgtgttatttatccaggagagagatgttcacaaggggatgttcgcgacaaatgtcactgaaaatgtgttaaattccagtcgggtgcaggaagccattgctgaagtggctgccgagctgaaccctgatggtagcgcgcagcagcagtcaaaagccgtgaacaaggtgaaaaaaaaggcaaaaagaatcctgcaagagatggtggctaccgtttcacccgctatgatccgcctcacaggatgggtccttcttaaactgttcaacagctttttctggaatatacagatccacaaaggccaactggagatggttaaggctgccacagagaccaatctccccctgcttttccttccggtccaccgttctcatatcgattatttgctactgaccttcatcctcttttgtcacaacatcaaagcgccttacatagcctccggaaacaatctgaacattcctatcttcagcactctgatccacaaactgggtggcttcttcattaggcgtagactggatgagacgccggacggccggaaggacgttctctatcgcgccttgctccacggtcacattgtggagttgctgcggcagcaacagtttttggaaattttcctcgaggggactaggtctagaagtggaaaaacctcctgtgcacgggctgggttgctcagcgttgttgtggatactttgtcaaccaacgtcattcctgacatactgatcattccagtcggtattagttatgatagaatcatcgagggacactataatggcgaacagctgggaaagcctaagaagaatgaaagtctgtggtccgtcgctcggggagtgattagaatgcttaggaagaattatgggtgcgttagggtggacttcgctcagcctttttctctcaaggagtacctcgagagccagagtcagaagcccgtgagcgcactgttatccctcgagcaggcattgctccctgctattttaccctcacggcctagtgacgctgccgatgagggaagggacacatccattaatgagtccagaaacgctacagatgaatcacttaggaggcggctgatagccaacctggctgagcacatcctgttcacagcaagcaaatcctgcgctattatgtctacccatatcgtggcttgtctgctcctctacagacatcgccagggcatcgacctctccactctcgttgaggattttttcgtgatgaaggaggaggtgcttgcaagggacttcgatttgggcttctcaggaaactctgaagacgtcgtgatgcacgcaattcagttgttgggtaactgcgtcaccattacccatactagtcggaacgacgagttctttataactccatctactacagtgccgtccgtgtttgaacttaacttttatagcaacggagtcctacatgtgtttatcatggaagctatcatagcatgtagtctgtacgcagtgttaaataagcgaggcctgggcgggcctacgagcacacctccaaacctgatcagccaggagcagctcgtgcgaaaggcagccagcctctgttatctcttaagcaacgagggcaccatcagcctgccctgccagacattctaccaggtctgtcatgagacagtaggcaaatttatccagtacggcattttgaccgtagccgaacatgacgaccaggaagatatctctccatccttggccgagcaacagtgggataagaaacttccagagcccctcagctggcgatccgacgaggaagacgaagacagcgacttcggagaggagcaacgcgactgttatcttaaagtttctcaatccaaagagcatcagcagtttatcactttcctccagagactgcttgggcctctgcttgaggcgtattctagcgctgcgatcttcgttcataatttcagtgggcctgtgccagaacccgagtacctccagaaacttcacaagtacctgataacaaggaccgaacgcaatgtcgcagtctatgccgagagcgccacctattgtctggttaagaatgctgtaaaaatgttcaaagatatcggggtgtttaaggaaaccaaacagaaaagagtatccgtcctcgagcttagttctacttttctcccgcagtgcaataggcagaaactgcttgaatatattctgtctttcgtggtactgtag

SEQ ID NO: 42566 - DNA, 2133 bp, Artificial Sequence
  Description of Artificial Sequence: Synthetic coding sequence
atggacgagagcgccctgaccctgggcaccatcgacgtgagctacctcccccacagctccgaatactctgtggggcgttgcaagcacacgagtgaagagtggggggagtgcggtttcaggccaacaatcttccggtccgcaacattgaagtggaaagaaagtctcatgagccgtaagcggcctttcgtgggaagatgctgttattcttgcaccccacagagttgggataaatttttcaatcccagtatacctagcttagggttgaggaacgtaatctatatcaatgagactcataccaggcaccggggctggttagcgagacgcctgtcctacgtcctgtttattcaagagcgtgacgtccataaaggaatgttcgccactaatgtgacggagaatgtgcttaattccagtcgcgtacaggaggctatagcagaagtagcagcagagttgaatccagatggttctgcacagcagcaaagtaaggctgttaataaagtgaaaaagaaagctaagcggatactgcaggaaatggtcgcaaccgtgagtcctgctatgatcagattaaccggctgggtgctgctcaaactttttaactcctttttttggaatatccagattcataagggccagttagagatggttaaggccgctaccgagacaaatctgcctctgctcttcctcccggtgcatagaagtcacatcgattacttgctgctcacgttcatcctattctgccacaacattaaggctccttacattgctagcggtaataacctgaatatcccaatttttagtaccctcatccacaaactgggtgggtttttcataagacggagattagacgagacacctgacggccgaaaagatgtattgtacagggctctgttgcacggccacatcgtggaacttctgcggcaacagcagttcctggaaatctttctggagggaacaaggagccgctctggtaagacctcatgcgcaagagctggacttctcagcgtggtggtggacaccctgtctactaacgtgataccagatattctcattataccggtgggtattagctacgaccgcatcatcgaggggcattataacggcgaacagctgggcaagcccaagaaaaacgagtctctgtggtctgtggctagaggcgtgattcggatgttgcgtaagaactacggatgtgtcagagttgatttcgcccaaccattctcgttgaaggagtacctcgaaagccagagccagaaacctgtttccgcactcttgagtttagagcaggccttgcttcccgctatcctgccatcacgcccatcggatgccgcagatgaaggcagggacacaagcatcaacgaatcgagaaacgccaccgacgagtctctgcggcgtaggctgattgctaacttggccgagcacatcctgtttacagcttctaagtcttgcgcaattatgtctacacacatagtagcctgcctcctgctgtatcgacacaggcagggtattgaccttagcactttggtggaggacttctttgttatgaaggaggaggtcctggcacgggacttcgatctgggcttctccggtaatagcgaggatgtcgtgatgcatgccatccagctcctcggaaattgtgtgaccataacgcatacctcaagaaacgatgagtttttcatcactccctcgaccacagttccatccgtgtttgagctgaatttttactcgaacggagttttacatgtgtttattatggaggctatcatcgcctgtagcctgtatgctgtgctgaacaagaggggcctgggcgggcccaccagtaccccacccaatttgatcagccaggagcaactggtcaggaaagcagccagcctctgttatttgctgtccaatgaaggcaccatctcactgccctgccaaacattctaccaggtttgtcacgagacggtcggaaagttcatacagtatgggatactgacagtggccgagcacgacgaccaggaggatattagtcctagccttgccgagcagcagtgggacaaaaagctgccagaacccctgagctggaggagtgacgaggaggacgaagatagcgatttcggagaagagcaacgtgactgttaccttaaggtcctgggttag

SEQ ID NO: 42567 - DNA, 2487 bp, Artificial Sequence
  Description of Artificial Sequence: Synthetic coding sequence
atggacgagagcgccctgaccctgggcaccatcgacgtgagctacctgcctcattcctcagagtactcggtgggtagatgtaaacacacgagcgaagagtggggcgagtgtggattcaggccgacaatctttaggtccgccacattgaagtggaaggaaagcctgatgtcccggaagcggccgtttgtgggacgatgctgctattcctgcacaccccagagttgggataaattcttcaaccccagcattcctagcctgggcttgcggaacgtgatttacatcaacgagactcatactaggcacaggggatggctcgcccgccggctgtcctatgtgttattcatacaagaacgcgatgtacataagggaatgtttgccacaaacgtgacggagaatgtgctgaatagcagtcgtgtccaggaggccattgcagaggttgcggcagagctcaacccggacggctctgcccagcaacagtctaaggctgtgaataaagttaagaagaaggccaagagaattctgcaggaaatggttgctaccgtgagtcccgcaatgatcagactcacaggatgggtgctgctgaagcttttcaactctttcttctggaacatccaaattcacaagggacaactcgagatggtaaaagcagccaccgaaaccaatttgcccttgctcttcttgccagtacataggtcacacatcgactacctgctcctgacgttcatccttttttgccacaacataaaagcaccatacatcgcctctggtaacaacttaaacattccgattttctccaccctgattcacaagctgggcgggttcttcattagacgccggctggatgagaccccagatggaagaaaggacgtgctttatagggctctcttgcacggtcacatagtagaattgctccgccagcagcagttcctggagatttttctggagggtactcggtctaggagcggaaaaacaagctgtgcacgagcggggctcctctcagtggtcgtcgatactctgagcaccaacgtcatcccagatatcctaatcatccccgtgggcatttcttacgatagaattattgaaggtcattacaacggcgagcagctgggcaagcctaaaaagaatgagagcctctggtcggtggctagaggcgtaatccggatgctgcggaaaaactacggctgcgtgagggtggatttcgctcagcctttttcactcaaggaatacctggagagccagtcacaaaagcccgtgagtgccttgctctctcttgagcaggccctgctcccagccatcttaccttctcggcccagcgacgctgcagatgaaggcagggacacttccatcaatgagagcagaaacgccaccgacgaatccctgaggcgtagactgatcgctaacctcgccgagcatatcctgtttacggcatcgaagtcatgcgccattatgagtacgcatatcgtagcgtgcctgttactttaccggcacaggcagggtattgacctaagcaccctggttgaagatttcttcgtgatgaaagaggaagttttggccagagattttgatctgggcttctctgggaactccgaggatgtggtaatgcacgccattcaactgctgggcaactgcgtcacaatcacacatacatccaggaacgacgagttcttcatcaccccctcaacgactgtaccatcagtgtttgaactgaacttctactctaacggcgtcttacacgttttcataatggaggctatcatcgcctgtagcttgtacgcagtgctgaataaacgtggtcttggaggtcctacctctaccccccccaatttgatcagtcaggagcagcttgtacggaaggcggcatctctgtgctatctgctgagcaatgaaggaactattagcctgccgtgtcagactttctaccaggtgtgtcacgagaccgttggcaaatttatacagtacggcattttaaccgtggccgaacacgatgatcaggaggacatatcaccctccctggctgaacagcagtgggacaagaagctaccagaacctcttagctggaggagcgacgaggaggatgaggatagtgactttggcgaggaacagagagattgctatctcaaggtctctcagtccaaagaacatcagcagttcattaccttcttgcagcggctgttggggccactgctggaagcctacagttccgccgcaatcttcgtgcacaatttctctggacccgtgccagaaccggagtatctgcaaaaactgcacaaatacctgattacacgtactgagaggaacgtcgccgtgtacgccgaatctgccacctactgtttagtgaagaacgctgtgaaaatgttcaaagatatcggtgtgttcaaggagactaagcagaagagggtcagcgttctcgaactgtcttcaactttcctaccccagtgtaaccgccaaaagctccttgaatacattctttcttttgtcgttctatag

SEQ ID NO: 42568 - DNA, 945 bp, Artificial Sequence
  Description of Artificial Sequence: Synthetic coding sequence
atgagcagcaccgccgccttctacctgctgagcaccctgggcggctaccttgtgaccagctttctcctgctgaaatacccaactttgttacatcaacggaaaaaacagagatttctgtctaagcacatctctcaccgtggtggcgcaggcgagaacttagaaaatacaatggccgcttttcaacatgctgtcaagatcgggacggatatgttggagcttgactgccatatcaccaaagatgaacaggtcgtcgtaagccacgatgagaatcttaagcgggccacaggggtaaacgtcaatatttcagatctgaagtattgtgagttgccgccctatctcgggaagttggatgtgtcattccagagagcctgtcaatgtgaaggcaaggataatcggatcccgctgttgaaggaagtgttcgaagccttcccaaacaccccaattaacattgacattaaggtcaacaataacgttttgattaagaaggtgtcagaactggtgaagaggtataatagggaacacctcactgtgtggggaaatgcgaattatgagattgtggagaagtgttataaggagaactccgacattcctattctattttctctccagagagtcctgctcatattagggctcttttttacaggattactgccgtttgttccaatcagagaacagttctttgaaattccaatgccatcaataatactgaagctgaaggagccccatacaatgagccgtagccagaagtttctcatttggctgtctgacctgctactgatgcggaaggctctgttcgatcatctgacggcccgaggaatccaagtctacatctgggttctgaacgaagagcaggagtacaagagagctttcgatctcggggctaccggagtgatgacagattacccgacgaaactaagggatttcttacacaacttttccgcctag

SEQ ID NO: 42569 - DNA, 870 bp, Artificial Sequence
  Description of Artificial Sequence: Synthetic coding sequence
atgagcagcaccgccgccttctacctgctgagcaccctgggcggctatctggtcaccagcttccttttattgaagtaccccaccctgctacaccaacgcaagaagcagcgcttcctctccaaacatatctcacaccgcggtggcgcaggcgagaacctcgagaatacgatggccgccttccaacacgccgttaaaatcggcaccgacatgcttgaactcgattgccacatcacaaaagatgaacaagtggtcgtgagccatgatgagaatcttaagagggcgacaggcgtgaacgtcaacatcagtgacctgaaatattgtgagctccccccttacctgggcaagctagatgtgagctttcagagggcatgtcaatgcgagggcaaagataaccggatccccttactgaaagaagtgttcgaggcttttcccaatacccctataaatatcgacattaaagttaacaataatgtactgatcaagaaggtcagcgaactggtgaagcgctacaaccgcgagcacctgaccgtatggggcaacgctaattatgaaatagtagagaaatgttacaaagagaatagcgacattcccatactattctcattgcagcgcgttctgctcatactcggtttgtttttcaccgggcttctgcctttcgtccctatccgagaacagtttttcgaaatacccatgccctctatcatcctgaaacttaaagaaccacatacaatgtcccgaagtcaaaaatttttgatatggctgagcgaccttctcttgatgcgaaaagcattgttcgagccccttcatcccgcatcaaagaggaacttcgaggggcactgctcttacttggtcgtgtcttgctacttttag

SEQ ID NO: 42570 - DNA, 873 bp, Artificial Sequence
  Description of Artificial Sequence: Synthetic coding sequence
atgagcagcaccgccgccttctacctgctgagcaccctgggcggctaccttgtgacttcattccttctcctcaaatatccgactctgctgcatcaacgcaagaaacagagattcttatctaaacacatatcgcaccgaggaggagctggtgagaacctcgaaaatacaatggccgcgtttcagcacgcagtaaagatcgggactgacatgctggaattagattgtcatatcactaaggatgaacaagttgttgtatcacacgatgaaaatcttaagcgtgccacgggggtgaatgtgaacatttccgacctgaaatattgtgaactccccccctatctgggcaagctagacgtgtccttccaacgcgcctgccagtgtgaaggtaaggacaatcgcattcctctgctgaaagaggtgttcgaggccttccctaatacacctattaacatcgatataaaggtcaacaataacgtgctcatcaagaaggtttccgaactggttaagaggtacaacagagagcatcttactgtctggggcaacgctaattacgagatagtggaaaaatgttataaagaaaatagcgacatccccatcttgttctcactgcagcgggtgctgcttattctgggcctgtttttcactggcctgttgccattcgttccgatccgagagcagtttttcgagatcccaatgccctctattatcctgaaactgaaagagcctcacactatgtccagatcacaaaaatttctgatctggctctctgatcttttgttaatgcgtaaagcgctttttgaccatttgaccgctagaggcattcaggtgagcttctggaatgatgcattctggaaacagcactcctccccagtctag

SEQ ID NO: 42571 - DNA, 1620 bp, Artificial Sequence
  Description of Artificial Sequence: Synthetic coding sequence
atggccgagagccccggctgctgcagcgtgtgggcccggtgcctgcattgcctttattcttgccattggagaaagtgcccacgagagcgtatgcagacttcgaaatgcgactgcatttggtttgggctgctatttctaaccttcctcctttcactgagctggttgtacatcggcttagtgttgctcaatgacttgcacaattttaatgagtttctgttcaggcgatggggccattggatggattggagccttgcctttctgctggtcataagtctgctagtgacttacgcttctctgttactggtcctggccctgcttctgcgcctctgcaggcagcccctgcacctccatagccttcataaagtgctcctactgcttatcatgctcttagtggccgcaggcttggttggtctggacatccagtggcagcaggaatggcatagtctgcgggtctctctccaagccaccgcccccttcctccacatcggggccgccgctggcatcgccctgctcgcatggcctgtcgccgacacattttaccgaatccatagaagagggcctaaaattctacttctcttactcttttttggggtggtgctggtgatctacctagctccactgtgcattagcagcccctgcattatggagcctcgcgaccttccgccgaagcccgggttggtgggtcacaggggtgccccgatgcttgctcccgaaaacaccctgatgtccctgagaaagaccgccgagtgcggagccaccgttttcgaaacagatgtcatggtttcatctgacggcgtgccatttctgatgcacgacgagcacttgagtcgaactactaatgtcgcaagcgtgtttcccacaagaattactgcccattctagtgacttttcttggacggagttgaagaggctgaatgccgggtcctggtttctggaacggagacctttctggggcgccaaacccctggcagggcctgaccagaaagaggctgaatctcagactgtgcctgccctggaagaactgctggaggaggccgctgcccttaatctttcaataatgttcgatctgcgcaggcctccccaaaaccacacctactacgacacctttgtgatccagacactagagactgtgctcaacgcgagagttccacaggctatggtgttttggctgcctgatgaagacagggctaacgtccaaagaagagctcccggcatgcgacagatctatggcagacagggagggaatcgtaccgagcgaccacaatttctaaatcttccttatcaagacttaccccttctggatatcaaggctctacacaaggataatgtatctgtgaacctgttcgtggtgaataagccttggctctttagtctgctttggtgcgccggggtggactccgtgacaaccaacgattgtcagttactacagcaaatgcgctatcccatatggctgatcactccccagacttacttgattatctgggtcatcacaaactgtgtgagtaccatgctgctactgtggacattccttctacaacgacggtttgtcaagaagagaggcaagacaggtttagagaccgcggtcttgctgactagaataaacaactttatgatggaatag

SEQ ID NO: 42572 - DNA, 1773 bp, Artificial Sequence
  Description of Artificial Sequence: Synthetic coding sequence
atggccgagagccccggctgctgcagcgtgtgggcccggtgcctgcattgcctgtatagttgtcattggcgcaagtgcccccgcgaacgtatgcagacatctaaatgtgactgcatctggtttggactgctctttttgacattcctgctgtcccttagttggctttatatcggacttgtcctgctcaatgatctgcacaacttcaacgagttcctgtttcggcgatggggccactggatggactggagtctggcctttttgttggtgatctccttgttggtgacatacgcttctctgttattggtgctagccttactcctgaggctgtgcaggcagcctttacacctgcatagtctccataaggtgcttctgctgctaataatgttgctggtcgctgccgggctcgtaggactggacatccagtggcagcaggaatggcactccctgagagttagtctccaggccacggcccccttcttacatattggcgcagccgccgggatcgcgctgctggcttggcccgtcgctgatacattctatcgcattcaccggcgtgggcccaagattcttttactgctgctgttctttggcgtggtgctggtgatctatctcgcccctttgtgtatttcatcaccgtgtataatggaaccacgcgacttgccgccaaagcccgggttagtgggccacagaggcgcacctatgctcgcccccgaaaacacgctgatgagccttcgcaagaccgccgagtgtggtgcaaccgtgttcgagacagatgtgatggtgtctagcgacggggttcctttcctgatgcatgacgaacatctgagcagaacaactaatgtggcctcagtgtttcctacccgcattactgctcacagtagcgattttagttggaccgaactgaagcggctaaatgccgggtcctggtttctggaaagaaggcccttctggggtgcaaaacccctagcaggcccagaccagaaagaggctgaaagtcagacagtcccagctctggaagaactgctggaggaggcagccgcattgaatctatccatcatgtttgacctgagacgtcccccccagaaccacacctattatgacacttttgttattcagactttggaaacagtattgaacgcaagggttccacaggcgatggtgttctggttgcctgacgaagatcgggccaacgttcaacgccgcgctccaggaatgaggcaaatctacgggcggcaaggcgggaataggaccgaaagaccccagttcctcaacctgccatatcaagatctgcccctccttgacataaaggataggttccttctgccagcccaggcaggactcaaactcctggcttccagcaacctgcccgcctcggccagccagtcagccggcattactgggctgagccattgtcctccacagcctccaggctacaagcatgaactgtcccatctcgcaatggcccttcacaaagacaatgtcagcgtgaacctatttgtagtaaataaaccatggttgttttcattgctgtggtgtgccggggtcgattccgtcacaaccaatgactgccagctgctgcagcaaatgcgttatcccatatggcttattacacctcagacatacttgatcatctgggttatcactaactgtgtcagcaccatgctgcttttatggactttcctgctgcagaggcgattcgtcaagaagagaggtaagaccggacttgaaactgctgtgcttcttactagaattaataactttatgatggagtag

SEQ ID NO: 42573 - DNA, 1383 bp, Artificial Sequence
  Description of Artificial Sequence: Synthetic coding sequence
atggactggagcctggccttcctgctggtgatcagcctgctggtgacatacgctagtttactgctggtgctggctcttctcctgcgactgtgcaggcagcctctccacttgcactctctccataaggtgttactcctgctaatcatgttactggtggccgcaggactggtgggcctggatatccagtggcaacaggaatggcactctctgagggtgtcattgcaggcgacagcaccatttctgcacatcggggcggcggcaggcattgccctgctagcttggcctgtggcagacacattttacaggatccaccgccggggacccaaaatcctgctgctcctcctcttttttggggtggtactcgtcatataccttgctcctttatgcatttccagcccctgtataatggagccgcgggatctgccaccgaagcccggcctggtgggccataggggcgcccctatgctggctcctgagaatacccttatgtccctcagaaagaccgccgaatgcggagcaacagtattcgagactgacgtgatggtgagctccgatggagtccctttcctgatgcacgatgagcatctgagtagaacgacaaatgtggccagcgtcttccccactaggattacagcccacagctctgacttttcatggacagaactgaagagactgaacgctggctcatggtttctggagcgcaggccattctggggagcgaaaccccttgctgggcccgaccaaaaagaagcggagagtcagaccgtgccagccctggaggaactgctcgaagaggctgccgcgctcaacctgtctattatgttcgacctgaggaggccacctcaaaatcacacctactacgatactttcgtcatacaaaccttagagacagtcctaaatgcacgggttccccaagccatggtgttttggctcccagacgaagacagggctaatgtgcagcgcagggcccccggcatgaggcaaatttatggccgccagggcggcaatcgcacggaacgtccacaatttttaaacctcccatatcaggatctgcccctgctggatatcaaggccttacataaagataatgtctccgtcaacctgttcgtagtcaataagccctggttgtttagtcttctgtggtgcgccggtgttgatagcgtaacaactaacgactgccagctgctgcagcagatgcggtacccaatctggctgatcacccctcagacgtacctcattatctgggtgataacaaattgtgttagcacaatgctcttactgtggactttcctcctccagcggaggttcgtcaagaaaaggggcaaaaccggacttgaaacagcagtgttgctgacacgcattaataatttcatgatggagtag

SEQ ID NO: 42574 - DNA, 1383 bp, Artificial Sequence
  Description of Artificial Sequence: Synthetic coding sequence
atggactggagcctggccttcctgctggtgatcagcctgctggtgacatatgccagcctgttgctagtcttagcccttctgctgcggttgtgtcgccagccgcttcacctgcactcactgcataaagtgttgctactgttaattatgctactcgtggctgccgggctggttgggctggacatccaatggcaacaggaatggcattccctgcgagtttcattgcaggctacggcaccattcttgcatatcggcgctgccgcaggtattgcgttgctagcctggccagtcgctgataccttctaccggatccatcgacgaggacccaagatattgttgcttttactgttttttggcgttgtactggtcatttacctcgcccccctttgcatttccagcccatgcatcatggagccccgcgacctgccacccaaacccggactggtcggacacaggggagctcccatgttagcacccgagaatacactgatgagtttacgcaagactgctgaatgcggggcaacagtctttgagactgacgttatggtgtcatccgatggggttccgtttttgatgcatgatgagcatttgtcaaggaccaccaacgtggcaagcgtatttcctacccggattaccgctcacagctcagactttagctggactgagcttaaacgcctgaacgccgggtcttggtttctggagcgtaggcctttttggggtgctaagcctctggccggacccgatcagaaggaagcggagagccaaaccgtgcctgctttggaggaactgctggaggaggccgccgccctgaacctatcaataatgttcgatttacgccgtccaccgcagaatcatacatactatgacacctttgtgattcagaccctagaaacagtcctaaacgctcgggtaccccaggctatggtgttttggctgccagatgaggaccgggccaatgttcagaggcgcgcccctgggatgaggcagatctacggccgccaaggtgggaatcgcacagagagaccccagtttctgaacctgccatatcaggacctgcccctgctggacatcaaggccttacataaagataacgtgtcagtcaacctgttcgtggttaataagccctggctcttctctttgctttggtgcgccggggtcgattcagtaactacaaatgattgtcagcttctgcagcaaatgaggtatcctatctggttaatcacaccacagacctacctcatcatatgggtcataaccaactgcgttagcaccatgctgcttctgtggacattcctgctccagagaagatttgttaaaaagcgcggaaagacaggcctggagactgcagtgctgttgactcgaattaacaatttcatgatggagtag

SEQ ID NO: 42575 - DNA, 771 bp, Artificial Sequence
  Description of Artificial Sequence: Synthetic coding sequence
atggcccagcggagcgacctgctggagctggactgccagctgaccagagacagagtagtggttgtcagccacgatgagaatctgtgcagacagagcgggctcaacagagatgtagggagcctggatttcgaagatctgcccctgtacaaagagaaactcgaagtctacttctcaccaggacacttcgcgcacggttcagatcgtaggatggtgcgactcgaagatctgttccaacgctttccacggaccccgatgtcagtggagatcaagggtaaaaatgaggagctgattagggagatcgccgggctcgtacgacggtatgatagaaatgagatcactatctgggctagtgaaaagtcctctgtgatgaagaagtgtaaggccgccaaccccgagatgcccctttccttcactataagccggggcttctgggtgctgttaagctactatctgggactccttcccttcattccgattccagagaaattctttttttgtttcctccccaacatcatcaatagaacctactttccttttagctgttcttgcctgaatcagctgctagccgtggtgagtaaatggcttataatgcgtaagtctctgatccgacacctggaggaacggggagtgcaggtggttttttggtgcctaaacgaggagtccgacttcgaagccgctttcagcgtcggcgccacaggcgtgattacagactatccgacggcactccgccattacctggacaatcacgggcccgccgcaaggacttcatag

SEQ ID NO: 42576 - DNA, 957 bp, Artificial Sequence
  Description of Artificial Sequence: Synthetic coding sequence
atgagcctgctgctgtactacgccctgcccgccctgggcagctacgccatgctgtctattttcttcctccgcagaccacacctgctccataccccacgagctcctactttccgaattcgcctgggagcccaccgtgggggatccggcgagctactcgagaacaccatggaggcaatggagaatagcatggctcagcgcagcgacttgctggaacttgactgtcaactgacacgggacagggttgtcgtggtgtcccatgacgagaatctgtgtcgacagtcaggattgaacagggatgtcggatccttagacttcgaggaccttccgttgtacaaggagaagcttgaggtctacttttctcctgggcattttgcccatggatcagaccggcggatggtcagattggaagatcttttccagcgcttccctcgcaccccaatgtccgttgaaataaagggcaaaaacgaagagttgattcgcgaaattgcgggcctggtgagaagatatgatagaaatgaaataacaatttgggcttcggagaaatcatcggtgatgaagaaatgtaaggcagcgaacccagaaatgcccctgtcctttacgatcagtcgggggttctgggttctgctctcatactatctcgggctgctgccattcatccccattccagaaaaattcttcttttgttttctgccaaacatcatcaataggacgtatttccccttctcgtgtagttgcctgaatcagctgctggcagtggttagcaagtggcttatcatgcgaaaaagcctcatacggcacctggaggagcgaggagtgcaggtggtgttctggtgtcttaatgaagagagcgatttcgaggcagctttctctgtgggagcgaccggggtgatcactgattaccccactgctctgcggcactacctagataaccacgggccagcagcccggacctcatag

SEQ ID NO: 42577 - DNA, 1563 bp, Artificial Sequence
  Description of Artificial Sequence: Synthetic coding sequence
atgctgctgttcctgtggatcgagaccagcagcgagtacttcaacttcgactgggtgacatttcttggtactgggtattggtttttctggagtatctttatcctgtccctggccaggatcttgacagcctactcttcattattactcctgttgggttttctccttctatgggagcggatcgagttgtacctgcacctgtgccacaagatattaattcttctcgtcatcttgctgtgtgtcatccttatgtttatcatttgtaagttctggaaggaaaggtggctagtagctggattgagcatgcaaatcttcgccccatacgtccacttagttagtattactgtgatggtcatattgttttggccggtcgctttctatgtagcctgtcttgagcgagaagtgcgcatgcggaggtaccggatgacacattccgaaaagaaaagactcaaacagtgcaacgtgattacccgccttcgcggccttcaggtgcccgttgggcttccattcttactgattttactcggattgtatctgatgcctcttggcatttattccccctgtatacaggaaaaagaaaacttggggccaaagcctaccatctttggacacaggggcgctcctatgttgggcccggagaataccatgatgtccttcgagaaggccgttgaacatggtgctcatggtctggaaactgatatacatctcagttacgaccacgtgccgtttctcatgcacgacttcgacctaaagcggactaccaatatcggcgaggtgcaacctgaatcagcctgtgagaatcctgcattcttcaactgggacttcctgtcaactctgaacgcaggaaagtggtttgttaagccagagttgaggcctttctataacatgaaaccattaagcgaggccgataaggaacgggcacggaatcaatctatccctaccttggccgatctgctgaccctggcagagaaagagcgcaagttcgtgattttcgacctacacaggccacctccaaagcaccccttgcggcacacctttgtgagacaggtggtatccgtaatattggcctcaaagatcgaacagcaccttattttctggttgcccgcccacgatagacagtacgtccgttccgtggctcccggtttccagcacgttggtcgcttagtgtcaatcgaaacccttgctaagaacaacatctccatcataaatgtggactataagaagctgttccccaacggcttgagggactacaaagcagccaacatacacattaacgtctacactgttaatgagccttggctgttttcactggcatggtgcagcagaatcaattcagtgaccaccgataatataggccttctgagtcagctcgatcacccccatttcttcatgacacccaaattttacgttttcatgtggctgctggccgatattatttcagtgcttttcatagtagcgatcttctgcttccattggcgccgtgagaccgaaaaggagaaattgttcgagacatcatcaactcgcactgatacgcagtctggtagtaagaatgaggaggaccggtag

SEQ ID NO: 42578 - DNA, 1872 bp, Artificial Sequence
  Description of Artificial Sequence: Synthetic coding sequence
atgctgctgttcctgtggatcgagaccagcagcgagtacttcaacttcgattgggttacctttctcgggacaggctactggttcttttggagtattttcatattgagtctcgccaggatcctgacagcctacagctcactcctgctgctcctcgggtttctcctactgtgggaaaggatagagctctatctccacctgtgtcataagattctgattctcctagtcatcctcttgtgcgttattctgatgttcatcatttgcaaattttggaaagaacggtggctcgtggcaggcctgagcatgcaaatctttgccccatacgtgcacctggtcagcatcacggtcatggtcatattgttttggcccgtggccttttacgtggcctgtctcgaacgggaggtgagaatgaggcggtatcggatgacacactcagaaaaaaagcgcttgaaacagtgcaacgtcataactagactgcgtgggttgcaggtgcccgttggccttcccttcctgcttatccttctcggtctctacttaatgcccctaggaatttattctccttgtattcaagaaaaagaaaacctcgggccaaagcccaccatatttggccacaggggggcccccatgctaggccccgagaacacaatgatgagttttgagaaagcagtggagcacggtgcgcacggcttagaaacagatatccacttatcttatgaccatgtccccttcctaatgcacgacttcgacctgaagcgcaccacaaacattggagaggtgcagccggaatcggcctgcgagaatcctgctttctttaactgggatttccttagtacactgaacgccggcaagtggttcgtgaaacccgagttacgtcctttttataacatgaaacccttgtccgaagctgataaggaacgcgcaagaaaccagtctataccaacactcgccgatctcctaacactcgcggagaaggaacggaagtttgtgattttcgacctgcaccggcccccccccaagcaccctctaagacataccttcgttaggcaagtggttagcgtcatcctagcctccaagatcgaacagcacctgatcttttggctgcctgcccacgaccgacagtacgtgcgtagtgttgccccgggttttcaacatgtaggccgcctcgtttctattgagacactagctaaaaacaacatcagtatcatcaatgtcgattataagaagctcttcccaaacgggctcagggactataaagctgcaaacatacatatcaatgtgtatacagtgaatgaaccatggctgttttcactggcatggtgttcacggatcaactctgtaaccaccgataacattgggttgctgtcccagctggatcacccgcacttctttatgactcctaaattctatgtgtttatgtggcttctggcggatatcatctcagtactatttattgttgccatcttctgtttccattggcgtagagagacagaaaaagagaaattgttcgagacctcctctacacgtaccgacacccagagtgggaaccttcatatcgccatgaagccgccggtcagggtcgtggagggcccatggacccttgctgctctgtatcccgcgttacccaaatcaggcaaggagcatcaagggcattttaatttcgcagctcccagcaaaaagctgctcccaattaaaaatgccgtcacaccactgaagcctggcaagcacgagatccagccccccatgccgaccgtagtttttgagctcacgcaagcccccacccggcaggccacttccgaggccacttttcagacaacacttcctacactgaaagtggataagccgacgatgcccagcatcgaggtcccatacccatag

SEQ ID NO: 42579 - DNA, 1254 bp, Artificial Sequence
  Description of Artificial Sequence: Synthetic coding sequence
atgaccaccctggtgcccgccaccctgagcttcctgctgctgtggaccctgcctggccaggtcttgctgcgggtggccctcgccaaagaggaggtcaaaagcggcacaaagggaagccagccaatgtcgccaagcgatttcctggataagctgatgggcaggacttcaggctatgatgcgaggatccgcccaaatttcaaggggcctcccgtgaacgtgacttgcaacattttcattaattctttctcatccatcactaagacaactatggactatagggtgaacgtgttcctcagacagcaatggaacgatccgaggctttcgtaccgagagtatcctgatgactcactggatctagatccttccatgttggactccatatggaagcctgatttgtttttcgccaacgagaagggtgctaatttccatgaggtgaccacagataataagctgctcaggatctttaagaatgggaacgttctgtacagcatcagactcaccttaatcctgagctgcctcatggaccttaagaactttcctatggacatccagacgtgtactatgcagcttgaatcttttggatataccatgaaggatctggtattcgagtggttggaagacgcccccgccgttcaggtggctgagggtcttactttacctcaatttatcttacgggatgagaaagacttgggatgctgcactaaacattacaataccggaaaattcacttgtatagaggttaagttccacctggaacgacagatgggatattatcttattcagatgtatatcccttctcttctgattgtgatactctcctgggtgtcattctggatcaatatggacgccgccccagcaagggtcggcctcggaataaccactgtcttaactatgacaacacaaagctccggctctcgggcctccctgcccaaagttagctacgtgaaagcaattgacatttggatggccgtttgtcttctgttcgtattcgcagcactgctagaatatgctgccatcaacttcgtctccaggcagcacaaagagtttatccgcctcagacgaagacagaggcggcagcggctggaagaggacataattcaggaatcacgcttctatttccgggggtatggacttggacattgtctgcaggcccgcgatggggggcccatggaggggtccggaatttacagcccacagcccccggcccctcttctccgcgagggggaaactacccggaaattgtacgtggactag

SEQ ID NO: 42580 - DNA, 1002 bp, Artificial Sequence
  Description of Artificial Sequence: Synthetic coding sequence
atgttcaagctgtgcagcaacaagatggtgagccaggagggcagcgaagtcgagcttctggtaagtccaggagctcgatcggaacacgggagatatctccaagatccaattgtttcaatagatctgagcgaatggctgcgtatcatcgagttcctactgcagggattgaaggtttacggaagtgtgtaccatataaaccacggcaacccctttaacatggaggtcctggtggactcttggcccgagtaccagatggtgatcataaggcctcaaaagcaggagatgacagacgacatggactcctatactaacgtgtacaggatgttctccaaggagccccagaagtctgaggaagtcttgaagaactgtgaaatagtgaattggaagcagcgattgcagattcaagggcttcaggaatccttgggtgaaggcattagggtggcgacgttctccaagagcgtgaaggtcgagcatagtagggcccttctccttgtgactgaagacattttgaaattgaatgcatcttctaaatctaagttgggcagctgggccgagacaggccacccagatgacgaatttgaatcggagacgccaaactttaaatatgcccagttagacgtgagttacagtgggctggttaacgacaattggaagcgcgggaagaatgaaaggagcttacactacatcaaacgctgcatcgaggatttaccggctgcctgtatgctgggcccagaaggggtgcccgttagttgggtgactatggatccgagctgtgaagtgggaatggcttactcaatggagaaataccgcagaacagggaacatggcgagggtaatggttcgatacatgaagtatctgcggcagaaaaatatccctttttatatatcggtgctggaagagaatgaggactcccgccgctttgttggtcagttcggtttcttcgaggctagctgtgaatggcaccagtggacgtgttatccccagaatctcgtccccttctag

SEQ ID NO: 42581 - DNA, 909 bp, Artificial Sequence
  Description of Artificial Sequence: Synthetic coding sequence
atgatcctgctgaacaacagccacaagctgctggccctgtacaagtcgctggcaaggtccataccagaatctctgaaggtatatggctctgtgtaccatatcaatcatggcaatccctttaacatggaggtgctcgtggatagctggcctgaataccagatggtgatcataagaccgcagaaacaagagatgacagatgacatggattcatacacgaatgtgtatcgaatgttttccaaagaacctcagaagtctgaagaggtcctgaaaaattgcgagattgtcaactggaagcagagactgcaaattcaggggctccaagagtcccttggtgagggtatccgggttgccaccttcagtaaatcagtcaaagtggaacacagtagagccctcctgctcgtgaccgaggacattctgaaactaaatgccagcagcaaatctaagttagggagttgggccgaaaccggtcacccagacgacgaatttgaaagtgagactcccaattttaagtacgcccaactcgacgtaagctactctggactggtcaacgataactggaagcgtggtaagaatgaaaggagtcttcattatataaaaaggtgcattgaggacttacccgccgcctgtatgctcgggcccgaaggcgtccctgtgtcctgggtaactatggatccctcctgcgaagttgggatggcatacagcatggaaaagtatagacgcactggcaacatggcacgagtgatggtccgatacatgaagtatctgcgacagaagaacattcctttttatatctcggtgcttgaggagaacgaggatagtaggagattcgttggtcagtttggttttttcgaggccagttgtgaatggcatcaatggacttgctaccctcagaatttagtgcccttctag

SEQ ID NO: 42582 - DNA, 840 bp, Artificial Sequence
  Description of Artificial Sequence: Synthetic coding sequence
atgatcctgctgaacaacagccacaagctgctggccctgtacaagtccttggcccggtctatacccgaaagcctaaaggtgtacggtagtgtttaccacattaaccacggcaatccctttaacatggaggtcctcgttgactcctggccagagtatcaaatggtaattatccggcctcagaaaagcgaggaagtacttaagaactgcgagattgtgaattggaagcaacgcctccagatccaggggctacaggaaagcctcggagaaggaatcagagtggcgaccttcagcaaatctgtgaaggtggagcacagccgtgcgcttttattggtgaccgaggatatcctgaagttgaacgccagctccaagtcaaaattggggtcctgggcagaaacgggtcatccagatgacgagtttgagagtgaaacacccaacttcaaatacgcccagctcgatgtgtcttacagtgggcttgtgaacgacaactggaagcggggcaaaaacgaaaggtctctgcactacatcaagcgatgtatcgaggacctgcctgctgcttgcatgcttggcccagagggcgtccccgtgtcctgggtaaccatggacccaagctgcgaggtgggaatggcttactccatggaaaagtacagaaggaccggaaacatggctcgggtgatggtaaggtacatgaagtacctgaggcaaaagaacatccctttttacatctcagtcttagaagagaacgaagattctcggaggtttgtcgggcagttcggttttttcgaggctagctgcgagtggcaccaatggacgtgctaccctcagaacttggttcctttttag

SEQ ID NO: 42583 - DNA, 207 bp, Artificial Sequence
  Description of Artificial Sequence: Synthetic coding sequence
atgatcctgctgaacaacagccacaagctgctggccctgtacaagtcgctagcccgttcaataccagaatcacttaaagtatacggaagtgtctatcatatcaaccatggtaatccattcaatatggaggttctagtggattcatggcccgagtaccaaatggtcatcattaggcctcagaagcaggagatgacggacgacatgtag

SEQ ID NO: 42584 - DNA, 240 bp, Artificial Sequence
  Description of Artificial Sequence: Synthetic coding sequence
atgatcctgctgaacaacagccacaagctgctggccctgtacaagtcattagctaggtccatccctgaaagtctgaaagtctacggaagcgtttaccacattaaccacggcaatcccttcaatatggaggtattagtagattcctggcccgaataccagatggtcattattaggccgcaaaagcaagagatgacagacgacatggacagttatacgaacgtataccgaatgttctcgtag

SEQ ID NO: 42585 - DNA, 885 bp, Artificial Sequence
  Description of Artificial Sequence: Synthetic coding sequence
atgctggtgctgcacaacagccagaagctgcagatcctgtacaagtccttagaaaagtcaatacccgagtcaattaaggtgtacggtgctatcttcaatattaaggacaaaaatccttttaatatggaagtgctagtggacgcttggcctgattaccagatcgtcattacgcgtcctcagaagcaggagatgaaagatgaccaggatcactatacgaatacatatcacatattcacgaaggcaccggataagctggaggaagtgttgagctattcaaacgtcatatcctgggaacagacgctccagatccaggggtgccaggaaggtttggacgaggccatacgcaaagtggccacttcaaaatctgtgcaagtggactacatgaagacgattctcttcatccccgagctgcccaaaaaacataagacctcgtccaatgataagatggagctttttgaggtcgatgacgacaacaaggagggcaacttctcgaacatgtttctcgacgcaagtcacgctgggcttgtcaatgagcattgggcttttggcaaaaacgaaaggagtctaaagtatattgagcggtgcctgcaggatttccttggctttggcgttcttggtccggaaggccaattggtgtcatggatcgtcatggaacaaagctgtgaactgaggatggggtacactgtccctaaatatcggcaccagggcaacatgttgcagattggctatcacctcgaaaaatacctttcccagaaagaaatcccattctacttccacgttgcagacaataatgagaagagcctccaggctttgaacaatctgggattcaaaatctgcccatgtgggtggcaccagtggaaatgtacccccaaaaagtactgctag

SEQ ID NO: 42586 - DNA, 885 bp, Artificial Sequence
  Description of Artificial Sequence: Synthetic coding sequence
atgctggtgctgcacaacagccagaagctgcagatcctgtacaagtcactagaaaagtccatccccgagtctatcaaggtatacggtgcgatttttaacatcaaggataagaacccctttaacatggaggttctggtggacgcctggcccgattaccagattgtcattacacgacctcagaaacaagaaatgaaggacgaccaggaccactacaccaacacataccacatcttcactaaggcccccgacaaactagaggaggtactctcatacagcaacgtcatttcctgggagcaaacactacagattcagggctgccaggagggactggatgaggccatacggaaagtggcgacctctaagagcgtgcaggtggactatatgaagactatcctgtttatccctgagttgcctaaaaagcacaaaacctcatctaacgataaaatggagctctttgaagtggacgatgataacaaggagggtaacttctctaacatgttcctcgatgcaagccacgccggcctagtcaatgagcattgggctttcggcaagaatgagcgttctcttaaatacatagagagatgccttcaggactttcttggcttcggtgtactcgggccagagggtcagctcgttagctggattgtgatggagcagagctgtgaattaagaatggggtatacagtgcctaaatataggcaccagggtaatatgcttcagatcggctaccatcttgaaaagtacctgagtcaaaaggagattcccttctactttcacgtcgccgacaataatgagaagagcctgcaggcgcttaacaatctggggtttaaaatatgcccttgtggctggcaccagtggaaatgcacgcctaaaaaatactgttag

SEQ ID NO: 42587 - DNA, 867 bp, Artificial Sequence
  Description of Artificial Sequence: Synthetic coding sequence
atgctggtgctgaactgcagcaccaagctgctgatcctggagaagatgcttaagtcatgtttcccagaatctcttaaagtatacggggccgtgatgaatatcaatcgaggcaatccatttcagaaagaagtagtgttggactcctggccagattttaaggccgttataacccggcgtcagagggaggccgaaaccgataatttggatcactacaccaatgcctacgctgttttctacaaagacgtacgcgcatacaggcagctgttggaggagtgcgacgtgttcaactgggatcaggtcttccagattcaaggacttcagtcagagctctacgacgtaagcaaagctgttgcaaactccaagcagctgaacattaaacttacatccttcaaggctgtgcacttttcccctgttagctcactcccagacacatctttcctaaaggggcccagtcctcggctgacatacttgtcagttgccaatgccgacttactcaataggacctggagtcggggtggcaacgagcaatgtctccggtatattgcaaacctgattagctgcttcccctcagtgtgcgtgagagatgagaaagggaatcctgtgtcttggagcatcacagatcagtttgctaccatgtgtcatggatatacgcttccagaacataggcggaaaggatatagcaggcttgtggctctgacgctcgctcgaaagctgcagtcacggggcttccctagtcaggggaatgtgctggatgataatactgcaagcatttcacttctgaaatctttacatgccgaattcctgccttgcaggtttcaccgattgatcctgactccagccaccttctcaggtttgccacacctttag

SEQ ID NO: 42588 - DNA, 471 bp, Artificial Sequence
  Description of Artificial Sequence: Synthetic coding sequence
atgctggtgctgaactgcagcaccaagctgctgatcctggagaagatgctgaagtcttgtttccccgaatccttaaaggtgtacggagccgtcatgaatatcaaccgaggtaacccatttcagaaggaggtggtcctggacagctggcctgactttaaggcggtgattaccagacggcaaagggaagcagaaaccgacaacctggatcactacactaacgcatacgcggtgttctataaagacgtaagagcgtacaggcagctgctggaggaatgcgacgtgtttaattgggaccaggtgtttcagattcagggacttcagagtgagctctacgatgtctccaaagcagtggccaacagtaaacaactcaatatcaagctcacaagtttcaaggcagttcatttcagccccgtctcaagcctccccgatacctctttcctgaagggcccaagtcctcggctgacatactag

SEQ ID NO: 42589 - DNA, 1683 bp, Artificial Sequence
  Description of Artificial Sequence: Synthetic coding sequence
atggagtgcctgtactacttcctgggcttcctgctgctggccgccagattaccactggacgccgcgaaaaggttccatgatgtcttggggaacgagcgcccttcagcctacatgcgggaacataaccagctgaatggttggagttccgatgagaatgattggaacgagaagttataccccgtttggaaaaggggcgatatgcgttggaaaaatagctggaaaggtggcagagtgcaggccgttctgacaagcgattcaccagctctggtgggatccaacataacctttgctgtcaacctcatcttccccagatgtcaaaaggaagacgctaacggcaacattgtttatgaaaaaaattgtcggaatgaagctggtctgagcgctgatccctacgtgtacaactggactgcatggtctgaggacagcgatggagagaatggtacagggcagagccatcataacgtttttccagatggcaaacccttccctcaccacccagggtggaggcgatggaatttcatttacgttttccacacccttggtcaatacttccaaaagctcggccgctgctccgtgcgcgtgagcgtgaacaccgccaacgtcacgctgggcccgcagttaatggaggtaactgtgtatcgtcgacacggccgggcatatgtgccaatcgctcaggtgaaggacgtctatgtcgtgaccgaccagattcctgtcttcgtaaccatgtttcagaaaaacgaccgtaacagtagcgacgaaacgtttctaaaagacttaccaattatgttcgacgttctcatccatgacccctcccacttcttaaactatagtacaattaattacaaatggagtttcggcgataatactggcctgttcgtcagtactaaccacacggtgaaccacacatatgtactgaacgggacgttcagtctcaacctcacagtgaaggccgccgcaccaggcccttgtccacctccaccgcccccacctcgaccttccaaaccaacccctagtttgggcccagctggggataatccactggagttgtcgaggatccctgatgagaattgccagatcaaccgatacggacatttccaggccaccattacaatcgtcgaaggcattcttgaggtaaacatcatccagatgactgatgtgcttatgcctgtgccttggcctgaatcttcgcttatcgattttgtagtaacctgtcaggggtccattcctaccgaggtgtgcacaataataagcgatcccacgtgcgagataacccaaaacaccgtgtgcagtcccgtggacgtggatgaaatgtgtctgttgactgtacggcggaccttcaacggaagcggtacatactgcgtaaatctcacacttggtgacgacaccagtctggccctgacatccaccctcatcagcgtgcccgatagggaccctgcgtcgcctctgcggatggctaacagtgctcttattagtgtggggtgcctggccatctttgtgaccgtaatctccttgctggtatacaagaagcacaaggagtataaccccatcgaaaactcccccgggaacgtggtaaggtcaaagggtctgtcggtgtttttaaatagggccaaagcggtctttttcccaggcaaccaagaaaaggatcccctgctcaaaaatcaggagttcaaaggcgtaagttag

SEQ ID NO: 42590 - DNA, 1719 bp, Artificial Sequence
  Description of Artificial Sequence: Synthetic coding sequence
atggagtgcctgtactacttcctgggcttcctgctgctggccgccagactgcctttggatgcggccaagcgatttcacgatgtgttaggaaatgaaagaccatccgcatacatgcgcgagcataatcaactgaatgggtggagctctgacgagaacgattggaacgagaagttgtaccccgtctggaagcggggcgatatgagatggaaaaattcatggaagggcggtcgagttcaagctgtgctgacatcagactctccagctctcgtgggatctaatataacctttgccgtgaacctaatattcccccgatgccagaaggaggatgccaacgggaacatcgtttacgagaaaaactgtagaaacgaagctggtttgagcgcagatccatatgtatataactggaccgcctggtcggaggatagtgatggtgaaaacgggaccggccagtcccaccacaatgtgttccctgacggcaaaccctttccacaccaccctgggtggaggcggtggaactttatctacgtgtttcatacccttggccagtactttcaaaaacttggtaggtgttccgtcagggtttcggtgaatacagcaaacgtgaccttaggtccccagctgatggaggtgacggtttataggcgtcacgggagagcgtacgtgccgatcgcccaggtgaaagacgtgtacgttgttacagaccaaattccagtgttcgtaacgatgttccagaaaaatgataggaatagctccgatgagacatttctgaaggacctgccgatcatgttcgatgtcctgatccacgatccttcccacttcctcaactacagcaccataaattataaatggagcttcggagacaatacgggtctgttcgtcagcactaaccacacagtgaaccacacatacgtgcttaatggaaccttttcacttaatctcacggttaaggcagccgcaccaggcccctgtccaccccccccacctccacccaggccgagcaagcccacaccttcactcgccacaactcttaagtcctacgactccaacacaccgggccccgcaggggataaccccctggagctctcccgaatccccgatgagaactgccagataaaccggtatggccatttccaggcaaccatcaccattgtggaaggtatcctggaggtaaacatcatacagatgacagatgttttgatgcccgtgccatggccagagtcaagcctgatcgacttcgtggtcacttgccagggatctatcccaactgaagtgtgtacgattatatcagacccaacatgtgaaatcacccagaatacagtttgtagcccagtggacgtcgatgagatgtgcctcctcaccgtgagacggaccttcaatggcagtggcacatattgcgtcaacctgacgctcggcgacgacaccagtctcgccttgactagtaccctgatcagtgtaccagaccgtgacccagcctcacctctgcggatggccaactctgcactgatctcagtgggttgcctcgctatctttgtgactgttatctcacttttagtgtacaagaaacataaagagtataaccctattgagaattcgcccgggaatgtcgtaagatccaaggggctgtcagtgtttctaaacagggcaaaggccgtgttttttcccggaaaccaagaaaaagaccccctgctaaaaaaccaagagttcaaaggggtctcttag

SEQ ID NO: 42591 - DNA, 621 bp, Artificial Sequence
  Description of Artificial Sequence: Synthetic coding sequence
atggagtgcctgtactacttcctgggcttcctgctgctggccgccagacttccgcttgatgcagctaagcgttttcacgatgtgctgggcaatgagcggccgagtgcttatatgcgtgaacacaaccagctgaacggatggtccagtgatgagaacgattggaacgaaaagttgtacccagtgtggaaaagaggagacatgcggtggaagaatagctggaagggggggagggtgcaggccgtattaacatcagatagtcctgcactcgtgggatccaacattacatttgcagtcaacctcatttttccgcggtgtcagaaagaagacgcaaacggcaacatcgtgtacgaaaaaaactgccgcaacgaggcgggtttgtccgccgatccttatgtgtacaactggaccgcctggtctgaggacagtgacggggaaaacggaacggggcagtcccaccataatgtctttccggacggcaaacctttcccccatcacccagggtggcgccggtggaactttatctatgtgtttcacacactcggttggcttttgcagacccctaagttgctcctctatctctcactgaaattccaacccagcttgttcctgctgtataattag

SEQ ID NO: 42592 - DNA, 1368 bp, Artificial Sequence
  Description of Artificial Sequence: Synthetic coding sequence
atggagtgcctgtactacttcctgggcttcctgctgctggccgccagattgccattggatgctgcaaagcggtttcatgatgtgttggggaacgagcgcccgagcgcctatatgagggagcacaatcagctcaacggctggtcctccgacgaaaacgactggaacttcatatacgtctttcacaccctcggccagtactttcaaaagcttggccgatgcagtgtaagggtctcagtgaacactgccaatgtcacgctaggtccgcagctcatggaagtcaccgtataccggaggcacgggagggcctacgtgccaatagctcaggtgaaagacgtgtatgtcgtaacggaccagatcccagtatttgtcactatgtttcagaaaaacgacagaaatagttcggatgagacctttttgaaagacctaccaatcatgtttgacgtccttatccatgatccctctcacttcctcaattatagcactataaactataaatggagcttcggtgataatacaggcctctttgtgagtaccaatcacaccgtgaaccacacatatgtgttaaatggcaccttctctttgaacctgacagtaaaggctgctgctcccggtccatgccccccccccccaccccctccaagaccctctaaacctacacccagtctggccactaccctcaagtcctatgattcaaatacccctggtcccgccggagacaacccattggagctgtcacgtatcccagatgagaactgtcagataaacaggtacgggcattttcaggctaccattacgattgtcgagggcatcctggaagtgaacatcatccaaatgacagacgtcttgatgcccgtgccgtggcccgaatctagccttattgattttgtggttacctgccagggcagcattccaaccgaagtctgtacaattatcagcgaccccacatgcgaaattacccaaaacaccgtttgttccccagtggatgtagacgagatgtgcctgctgacagttaggaggacgtttaatggctctggtacttattgtgtgaacctgactctgggtgatgacacgtcattggcgctgacaagcacactcatctccgtcccggaccgcgatccagcaagccctctgcggatggccaacagcgccttgatatccgtgggatgcctggctatttttgttacggtcatatcactcctcgtgtataaaaaacacaaagagtacaatccaatcgagaacagtccagggaacgtcgtgagaagtaagggcctatcagtgttcttaaaccgcgccaaagctgtgttcttcccaggcaaccaggagaaggacccgctactgaagaaccaagagtttaagggggtaagctag

SEQ ID NO: 42593 - DNA, 1824 bp, Artificial Sequence
  Description of Artificial Sequence: Synthetic coding sequence
atgatcctgcccgaggccctgtacctgatcaagatcgagcgggaggccccccaaatgcctgaggaacattgctgctcatggtggacaggtcccgaggaattttctatggagtgcctttactatttcctgggttttcttctcttggctgcacgcctcccacttgacgccgccaagaggttccacgacgttctcgggaacgaacgcccttccgcatacatgagggagcataatcagttgaatggctggagctccgatgagaacgactggaacgagaagttatatcccgtctggaagcgaggggacatgcggtggaagaattcctggaagggtggtagagttcaggcagttcttaccagcgactctccggcattggtcggcagcaatattacctttgctgtcaatttgattttccctcggtgccagaaggaggatgcaaatgggaatatagtttatgaaaagaactgtaggaacgaggccggcctttctgccgatccctatgtgtacaattggacagcctggtccgaagactccgatggtgagaacggcaccggccagtcacatcacaacgtcttccctgacggtaaaccgttcccccatcaccccggttggcgcaggtggaatttcatttatgtcttccacactttaggccagtactttcagaagctgggacgctgttcagttcgggttagtgttaataccgccaacgtgaccctaggcccacaactcatggaggtgaccgtgtatcgccggcatggccgggcctacgtccctatcgctcaagtgaaggatgtttacgtggtgacagatcagatacctgtgttcgtgaccatgttccaaaagaatgaccgcaattcgagtgacgagaccttcctcaaagatttacccatcatgttcgatgtgctgatccatgatccatcccacttcttgaattattccaccattaattacaagtggtccttcggagacaacactggattgttcgttagtaccaatcacacagtgaaccatacttacgtgctaaatgggacgttttcactcaacctcacggtgaaagctgcggctccagggccctgtcctcctccccccccccctcctcgtcctagcaaacccacaccaagccttgccacaacattgaaatcatatgatagcaacacccccggacccgctggtgataatccgctcgagctgtccagaatcccggacgaaaactgtcagattaacaggtacggccacttccaggccactatcacaattgtggagggcattctcgaagtgaatataatccagatgactgatgtgctgatgccagttccctggccagagagttctcttattgattttgtcgtaacctgtcagggctccattccgacagaggtgtgtacaattattagtgatccaacatgtgaaatcacacaaaacacagtttgttcccctgttgatgtggacgaaatgtgcttgttaaccgtgaggagaacattcaatggaagcggtacttactgcgtgaatctgaccctgggggacgacacaagcctcgcgctgacctctactctcatctctgtacctgatcgagatcctgcttcgccccttcgcatggctaactcagctttaatttccgtggggtgtcttgctatcttcgttactgtaatcagcctcttagtctataaaaagcataaggagtacaacccaattgagaattcccctggaaacgtggttcgctccaagggcctctcggttttcttaaatagggcgaaagccgttttcttcccgggcaaccaagaaaaagaccccttactgaagaaccaggagtttaaaggggtgagttag

SEQ ID NO: 42594 - DNA, 1545 bp, Artificial Sequence
  Description of Artificial Sequence: Synthetic coding sequence
atggagtgcctgtactacttcctgggcttcctgctgctggccgccagattgcccttggatgccgcgaagagatttcatgatgtactcggcaacgagaggccttctgcatacatgcgcgagcataaccaactcaacggatggtcctccgatgaaaacgattggaacgagaagctgtatcctgtgtggaagaggggtgacatgagatggaagaacagctggaaggggggtcgggtgcaggccgtattaacgagcgacagtcctgcactggtcggatcgaacatcacattcgccgtgaatctgattttcccccggtgccagaaggaggatgctaatggtaacattgtatatgagaagaactgtaggaacggtcaatattttcagaaacttggccgctgctccgtccgtgtatcggtcaacacagccaacgttacccttggaccgcagctcatggaggtgactgtttaccgtcggcacggacgggcatacgtcccaatagcacaggttaaggacgtctatgttgtgacagaccagatccccgtatttgtgacaatgttccagaagaacgacaggaattcatctgatgagaccttcctaaaggatttgccaatcatgttcgacgtgctgatccatgatccgtcccactttctgaactactcaacgatcaactataagtggtcatttggagataacacggggttgttcgtgagcacgaatcataccgtcaatcacacctatgtgttgaacgggaccttttctttgaacttgaccgtcaaggccgctgccccaggcccctgcccgcctccaccccctcctccacgccctagtaagcccactccctcccttgcaaccaccctcaagtcatacgatagcaatacacccggccccgccggtgacaatccattggaactgtcccgtatccctgacgagaactgtcaaataaataggtatggacacttccaggccacgattaccatagtggaaggcattctggaagtcaatattattcagatgactgacgtactgatgccagtgccttggccagagagctccctgatagacttcgtggtgacgtgccagggatctattcctaccgaagtgtgcaccattataagtgatccaacgtgtgaaatcacacagaataccgtgtgtagtcctgttgatgttgatgagatgtgtctgctaacagtgcgcaggaccttcaacggctcggggacctactgtgtgaacctcactttgggagacgacacgtccctggcactgacaagcactcttattagcgtccctgatcgcgatccagccagtccactcagaatggccaactccgctctgatctcggtgggctgtcttgctatctttgtaaccgttattagcctcctggtctacaagaagcataaggaatataaccctatcgagaatagccccggtaatgtcgtgcggtccaagggactgtcagtgttcttaaaccgagccaaggcggtcttcttccctggaaatcaagaaaaggaccctcttctaaagaatcaagagtttaagggcgtttcctag

SEQ ID NO: 42595 - DNA, 1386 bp, Artificial Sequence
  Description of Artificial Sequence: Synthetic coding sequence
atggagtgcctgtactacttcctgggcttcctgctgctggccgcccgcctacccctagacgccgccaagcaagccggactctccgccgatccttacgtctataactggactgcatggagcgaggacagcgatggcgagaatgggacaggacagtcacatcacaacgtgtttcccgacgggaaacccttccctcaccacccaggctggcgtagatggaatttcatctatgtgtttcacacactggggcaatactttcaaaaactgggtcgctgctctgtgagggtctccgtcaacacagcaaatgttactctgggcccgcaattgatggaagttactgtgtaccgaagacatgggcgtgcctacgtgcctatcgcccaagtgaaggacgtctacgttgtgacggaccagatccctgtgttcgtgacaatgttccagaagaacgaccgcaatagcagcgatgagacatttttgaaggacctgcctatcatgttcgatgtgctcatccacgatccctcccattttttaaattacagcacaattaattataagtggtcctttggtgataacaccgggttgtttgtgagtacaaatcacaccgtgaatcacacatatgtgcttaacggcacgttcagtctgaacctgacagtcaaggcagccgcaccgggaccttgcccaccacctcctccacctccacgtccttcgaagccgaccccctctctcggccccgccggggataaccctctagaactctcacggatccctgacgagaattgtcagattaatcgctacggccactttcaggccacaatcaccatcgtggaaggaattctcgaggtgaatataattcagatgaccgacgtgcttatgccagtgccctggccagagagcagtttgatcgatttcgtggttacctgccaaggcagcattccaaccgaggtgtgtactatcatctcggaccctacgtgtgaaatcactcagaacactgtctgctctcccgtggacgtcgatgagatgtgcctgcttactgtacggcgaacctttaatggtagcggcacatattgtgtaaacttaacattgggcgatgacacgagtcttgctctgactagcactcttatctcagtgccggaccgagatcctgcctcacctctgaggatggccaattctgccctgatctctgttgggtgcttggcaatcttcgtcacagtgatttctcttttggtgtataagaagcacaaggagtataatccaattgaaaacagcccagggaatgtggtgaggtccaagggcctttccgttttcctgaaccgggccaaggctgtgttctttccaggcaaccaggagaaagaccctcttctgaagaatcaggagttcaagggggtctcatag

SEQ ID NO: 42596 - DNA, 960 bp, Artificial Sequence
  Description of Artificial Sequence: Synthetic coding sequence
atggtgggcaagatgtggcccgtgctgtggaccctgtgcgccgtgagagtcacagtcgatgccataagcgtagaaacccctcaagacgttctccgagctagccagggaaaaagcgtgaccctgccgtgtacttatcatacaagtacaagcagccgagaggggctcatacagtgggacaagcttctgcttacccataccgagcgagtggtgatttggccgttcagcaataagaattacatacatggagagctttacaagaaccgcgtgagtattagtaacaacgcggagcagagtgacgctagtattaccattgatcagctgacaatggctgacaatgggacttacgagtgcagcgtgtctctcatgagtgatctggaggggaatactaagagccgggtgcgactgctggtcctggtgccaccctctaaacccgagtgcggtatcgaaggagagacgatcatcggaaacaacattcaactcacttgtcagagtaaggagggtagcccgacacctcagtactcttggaagaggtataacatactgaatcaggagcagccacttgctcagcctgctagcggacagcccgtcagtctgaagaatattagcactgacacatcaggctactatatctgcacgagctcaaatgaggaagggacacaattctgcaatattactgtggctgtgagatcgcctagcatgaacgtagcactgtacgtcgggattgccgtgggcgttgtggcggctctgattatcatcggaatcatcatctactgttgttgctgtagaggtaaggatgataataccgaagacaaggaagatgcgaggccaaatcgggaggcgtacgaggagccccccgaacagcttagggagctgtcccgcgagcgtgaagaagaggatgactataggcaggaagagcagaggagcactggcagagagtctccagaccacctcgatcagtag

SEQ ID NO: 42597 - DNA, 1683 bp, Artificial Sequence
  Description of Artificial Sequence: Synthetic coding sequence
atgctgcggggcaccctgctgtgcgccgtgctgggcctgctgcgggctcaacctttcccttgcccacctgcgtgcaagtgtgtgtttcgcgacgcggcccaatgtagtgggggggacgtcgccaggataagcgctctcgggctcccaaccaaccttacacatatcctgctctttggcatggggcggggggtcttgcagtcccagagcttcagcggtatgacagtcctgcagcggctcatgatcagtgactctcacattagtgccgtggcgccaggaaccttttccgaccttatcaaactgaagactctgaggctcagcaggaataagatcacccacttacccggtgcattactggataagatggtcctgctcgaacaactctttctggatcacaatgcactgcgcgggatcgaccaaaacatgttccagaaactggttaacctgcaagagctggcattgaaccaaaaccaactggacttcttaccagcttcactgtttactaatttggagaacctgaagttactggacttgtcagggaataacctgacccatcttcccaagggcctgctgggagcccaggccaagctggagagacttcttttgcactccaatagacttgtctctctggactctggtctgcttaactcactgggcgccctcaccgagctgcagttccacagaaatcatatacggagtatcgcccctggtgcgtttgataggcttcccaatttgtcctccctgaccctaagcagaaatcacctggccttccttccgagtgccctgttccttcattctcataaccttactctgctcacgctgttcgagaaccctctggcggagctccctggcgtcctgtttggggaaatgggagggctgcaagagctgtggctgaaccgaactcagctgcggaccctccccgccgccgctttccgaaatctatctcgattgagatatctgggcgttacacttagtccccgacttagcgccctaccccaaggggcattccaggggctaggggaactgcaggtattagcacttcacagcaacgggctaacagccctgcccgatgggctcctgcggggtcttggcaaactccgacaggtttctctaagacggaacagattaagggctcttcctcgcgccctgtttcggaatcttagctcactcgagtctgtccagctcgaccacaaccagctagaaaccctcccaggagatgttttcggagccctgcctaggttgacagaagttctactgggacacaattcttggcgatgtgactgtggtctgggtccttttctcggctggctcagacaacacctcggcttggtgggaggggaggagccccccagatgtgccggccccggggcacacgccggactccccctgtgggctctgcccggcggtgacgctgagtgcccaggcccaaggggcccccccccccggcctgccgccgattctagtagcgaagccccggtccacccagctttagctcccaacagctcagaaccttgggtgtgggcccagccagtgactactggcaagggtcaggatcatagtccattctggggattttactttctgttgctggcagttcaagcaatgatcaccgttatcatcgtcttcgccatgataaagataggtcagctgttcaggaaactcatcagagagcgcgccttgggctag

SEQ ID NO: 42598 - DNA, 1683 bp, Artificial Sequence
  Description of Artificial Sequence: Synthetic coding sequence
atgctgcggggcaccctgctgtgcgccgtgctgggcctgctgcgggcccagccgttcccatgtccacctgcctgtaagtgtgtgtttcgagacgcagcccagtgttcgggcggggatgtggctaggatctcagccttgggactcccaacgaacctgacacatatcctgttatttggaatgggccggggagtgctgcagtcgcaatctttctcagggatgaccgtgctgcagaggctcatgatctccgacagtcatatcagtgctgttgcgcctggcaccttcagcgacctgatcaaactgaaaactctaagactctcgcgcaacaagatcacgcatctccccggcgctctgctagacaaaatggttctgttggagcagctattcttggaccacaatgccctgaggggcatcgaccagaacatgttccagaagctggtaaacctgcaggagcttgctctgaatcagaaccagctggacttcctgcctgcttcactctttacaaatctggagaacctaaagttgttagacctgagcggcaataacctaacccatcttccaaaaggactgcttggcgcccaagccaaactcgagcgattgctgctccactcgaatcgtctagtgtcactagattcggggctgcttaacagtcttggcgccctgactgagttgcagtttcatcgcaaccatatccgcagtattgcccctggcgcctttgatcgcctgcctaacctctcctccctgaccttgagccggaaccacctggcattcctccccagcgccttgttcctgcattcccacaaccttacactgctcactctctttgagaacccactggcagagcttccaggggtgctcttcggcgaaatgggaggcctgcaggagctctggcttaaccgaactcaactgcgtaccctgcccgcagccgccttcaggaacttgtcccgtttgcgctatctgggcgtgaccctgagccctcgcctgtccgccctgcctcaaggtgctttccagggcctgggggagctccaagttctggctctgcactcaaatggcttgacagctctcccagacggactgttgaggggcctcggaaagcttagacaagtgtccctgaggagaaacagattgcgagcattacctcgggccctgttcaggaatctgtctagcctggaatccgtgcagttagatcacaatcaattagagaccttacctggagacgtgtttggggctttaccaaggttaacagaggtcctcttagggcacaactcatggaggtgcgactgcggactgggaccatttctgggatggctccgccagcatctcggcctcgtgggcggcgaggagcctcccagatgcgctggcccaggcgcccatgcaggactgcccctgtgggcactccccggcggagacgctgagtgccccggaccgcgagggcccccccctagacccgctgccgactcaagttctgaagcccccgtccaccctgccctggccccaaacagctcagaaccttgggtctgggcgcaaccagtgaccactggcaaaggacaggaccactcacccttctggggtttctacttcttgctcttggccgtgcaagctatgatcacggtgatcattgtgttcgccatgatcaagataggccagctgtttagaaagctgattagagagcgcgccctaggctag

SEQ ID NO: 42599 - DNA, 1869 bp, Artificial Sequence
  Description of Artificial Sequence: Synthetic coding sequence
atggccgccgccccccgggccggccggcggcggggccagcccctgttggctctgctgctgctactactggcaccactgcctcccggagcccctcccggtgccgacgcttattttccagaagagcgttggtctcctgagtccccactacaggctccccgtgtgctcatcgccctactcgcgcggaatgccgcccacgcactgccaaccaccctgggggccctggagaggcttcgtcaccccagagagagaaccgccctgtgggttgcgaccgatcacaatatggacaacacctccactgtcttgcgcgagtggcttgtcgccgtaaagtctctctatcattccgtcgaatggcgacccgctgaggaacccaggagctaccccgacgaggaagggccaaaacactggtccgattcaaggtatgagcacgtgatgaaactcaggcaggccgcgctgaagtcagctcgggacatgtgggccgactatatacttttcgtggacgctgacaatctgatcctcaaccctgacaccttgagccttctcattgctgagaataagacggtggtagctccaatgctggatagtagggctgcctatagcaacttttggtgtggcatgacctcgcagggctattacaagagaacgcctgcttacatccccatcaggaagagggacagaagaggctgcttcgccgtcccgatggtacatagcacttttctcattgatctcagaaaagccgctagccggaatctagctttttacccgcctcatccagactacacttggagctttgatgacattatcgtgttcgcttttagctgtaagcaggctgaagtgcagatgtacgtgtgtaataaggaagagtacggcttcctccctgtaccactgcgcgcgcactccactttgcaggatgaggccgagagtttcatgcacgttcagctggaggtcatggttaagcatcctcccgccgaaccctctcgattcattagcgcgccaacaaagacccccgacaagatgggatttgatgaagtgttcatgattaatttgaggcgtaggcaggatcgccgtgagcgcatgttgcgggcgctacaggctcaggagatcgaatgtcggctggtagaggccgtggatggtaaggccatgaacactagccaagtagaagctttaggaatacagatgctacccggatacagggacccttatcacggcagacctctgactaagggcgaactgggatgctttctatcacactacaacatttggaaggaagtggtcgatcggggtctgcagaagtcactcgtttttgaggatgaccttcgatttgagatctttttcaaacgacggctgatgaacctgatgcgggatgtagagcgtgagggacttgactgggacttgatttatgtgggccggaagaggatgcaggtggaacaccccgagaaagctgttcccagggtccgcaatctcgtcgaggctgattacagttattggacgctggcctacgtgatctccctgcagggcgcacgaaagcttcttgcggccgagcccctgtcgaagatgctgcccgtggatgagtttctccctgtgatgtttgataagcaccccgtgtcagaatacaaggcgcattttagccttagaaacctccatgctttcagcgtggaaccactactgatttatcctacccactacacaggagacgacgggtacgtgagtgacacagaaacaagtgtcgtgtggaacaatgaacatgtcaagaccgactgggaccgtgcaaaatctcaaaagatgagagagcaacaggcactctcacgagaggctaaaaactcagacgtcctgcagagccctctcgatagtgctgctagagacgagttatag

SEQ ID NO: 42600 - DNA, 702 bp, Artificial Sequence
  Description of Artificial Sequence: Synthetic coding sequence
atggtgcacagcaccttcctgatcgacctgcggaaggccgccagcaggaatctggccttttaccccccacatccggattatacgtggagctttgacgatattatcgtgtttgccttcagctgcaaacaggcagtcaagcatcccccagccgagccatcgcgtttcatctccgcaccgacaaagactcctgacaaaatgggttttgacgaggtgttcatgatcaatctgagacgtagacaggatcggcgggagcgtatgcttagagctctccaggcacaagaaattgagtgccggctcgtcgaggccgtggacggcaaagcaatgaatacatcccaggttgaagcgttaggaattcagatgctccccggttatcgagatccatatcatgggcgacctctgactaagggtgaactagggtgcttcctctcgcactataatatttggaaagaagtagtagatcgaggtctgcagaagtcactggtcttcgaggacgatctgagattcgagatctttttcaagcgtcgccttatgaacctgatgcgcgacgtggaaagagaggggctcgattgggatcttatttacgttggccgcaagagaatgcaagtcgagcaccctgaaaaggccgttccccgggtcaggaatttagtggaagcagattactcttactggaccgtactgccgggaatgaatagcgaaggatag

SEQ ID NO: 42601 - DNA, 1881 bp, Artificial Sequence
  Description of Artificial Sequence: Synthetic coding sequence
atggccgcccggcccgccgccaccctggcctggagcctgctgctgttgtcttctgcactgctgcgcgaaggatgtagggcacggttcgtggccgagcgcgattcagaagacgacggagaagaacctgtggttttccccgaatcacccctgcagtcaccgactgtgttggttgcggtcctggcacgaaacgccgctcatactctccctcattttctgggctgcctagaaaggctggattaccccaagtcccgtatggccatttgggcagctactgaccacaatgttgacaacaccacggaaatttttcgagagtggctgaaaaatgtgcaaaggctttaccactatgtcgaatggcgacctatggatgagcccgaatcgtaccccgatgagattggacctaagcattggccaacttcacggtttgcccacgtgatgaagctgaggcaagccgctcttagaactgcacgcgaaaagtggtccgattacatactcttcatcgacgttgataatttcctgaccaacccccagaccctgaatcttcttatcgctgagaataaaactatcgtcgcccccatgctggaatcccgcggcttatactccaacttctggtgcggcattacacccaagggcttttataagcggactcctgattacgtccagatcagagaatggaaaagaacaggctgcttccccgtgcctatggttcattcgacgttcctgatcgacctgaggaaagaggctagcgataagttgactttctaccccccgcaccaggactacacatggacctttgatgacatcatcgttttcgcgttttcctcacgccaggcaggaatccaaatgtatctctgtaatagagagcactatggctacctgcccattccgctcaagccacaccagacactccaggaagacatcgaaaacctgattcacgtgcagatagaagcaatgatcgatcggccccctatggagcccagccagtacgtgtccgtggtaccaaaataccctgataagatgggcttcgacgaaatcttcatgattaatctgaaacgcaggaaggaccggagggaccgcatgctgcgaacgctgtacgaacaagagattgaggtgaagatagttgaggcagtagatggtaaggccctcaacacatctcagctgaaggctctaaatatcgaaatgcttcccggctacagagatccttacagtagcaggcctctgactaggggcgaaataggctgtttcctaagtcattactccgtctggaaggaggtaatcgaccgggaactagagaaaacccttgtcatcgaggatgacgtacggtttgagcatcagttcaagaagaaattgatgaaactcatggataatatcgatcaggcccaacttgattgggagctgatttatattgggaggaagcgcatgcaggtcaaggagcctgagaaggctgtacccaacgtggccaacctggttgaggcagattattcctactggaccctgggatacgtgatatctctggagggcgctcagaagctagtaggtgcaaacccgtttggcaaaatgctccctgtcgatgagttcttacccgttatgtataataagcaccccgttgccgaatataaagaatactacgagagccgggacctgaaagcattttcagcagagcctctgcttatctaccctacacattataccggccaacctgggtaccttagcgatactgaaacttcaacaatatgggacaatgagactgtggcaaccgattgggaccgaactcacgcttggaaaagtcgaaaacagtccaggatttattctaatgctaagaacaccgaagcgctgcctccgcctacttccttggatacagtccccagccgtgacgaactatag

SEQ ID NO: 42602 - DNA, 1092 bp, Artificial Sequence
  Description of Artificial Sequence: Synthetic coding sequence
atgttcagcgactgctggctgtgccccagcctgggcagcagcggcattcagatgtacctatgcaatcgcgaacattatggatacttacccatcccgctcaagccccaccagacacttcaggaggatatcgaaaacctcattcacgtccagatagaggccatgatagatcgtccccccatggaaccttcacagtatgtgagtgtggtcccgaagtatcccgacaaaatgggcttcgacgaaatttttatgatcaatttgaagcgcaggaaggatagaagagatcgaatgctgcgcactctgtatgagcaggagatcgaagttaagatagtagaagccgtggatgggaaggctctgaacacctctcagctgaaggccttgaacattgaaatgctgcctgggtaccgcgacccttacagcagtcggccactgacccgaggagaaattggctgctttctctcccactattccgtctggaaagaggtaatagaccgagagctcgaaaagacccttgttattgaggacgatgtcaggtttgaacatcagttcaagaagaagctcatgaagctgatggacaacatagatcaggcacagctggactgggagctgatctatatcggcagaaagagaatgcaggttaaagaacctgagaaagcagtgcccaacgttgctaacctggtggaggccgattacagctactggacgctgggctacgtgatctctctcgagggggcgcagaagctggtgggcgcgaatccttttggcaaaatgcttcctgtagatgagtttctccctgtgatgtataacaagcatcccgtggccgagtacaaagagtattatgaatcccgggacctcaaagcattttctgcggaacctcttcttatctaccctacccactacacgggtcagccaggatacctgtctgatactgagacatcaacaatttgggataacgaaacagtcgctacagattgggacaggactcatgcgtggaaaagtcgcaaacaaagcagaatctattccaatgccaagaacacagaagcccttcccccacccacgagcctcgataccgttccatctagggatgaactttag

SEQ ID NO: 42603 - DNA, 705 bp, Artificial Sequence
  Description of Artificial Sequence: Synthetic coding sequence
atgctgcccggctaccgggacccctacagcagccggcccctgacccgcggggaaatcgggtgctttctgagtcattattctgtttggaaggaagtgattgaccgggagttagagaagaccctggtcattgaagacgacgtgcggtttgagcaccagtttaagaaaaaacttatgaaattgatggataacatcgaccaggcgcagctcgactgggaactgatatatattggacggaaaagaatgcaggtaaaggagccagaaaaagcagtgcctaatgtggccaatctggtggaagctgactacagctactggacactgggctatgtaatcagtctcgagggagcccagaagctggtgggcgcaaatccctttggcaagatgctgccagtggacgagttcctccccgtgatgtataataagcacccagttgctgagtataaggagtattatgagtctcgggatctgaaggcatttagcgccgaaccgctattaatctaccccacacattacacagggcaacctggctacctgtctgataccgaaactagcaccatctgggataacgaaacggttgcaaccgattgggatcggacacatgcctggaaaagtagaaaacagagccggatctattctaacgctaagaacacggaggcactgcccccgcccacatcactggatacagttccttccagagacgagctgtag

SEQ ID NO: 42604 - DNA, 1665 bp, Artificial Sequence
  Description of Artificial Sequence: Synthetic coding sequence
atggccgcccggcccgccgccaccctggcctggagcctgctgctgctgagtagcgcgcttctccgcgaaggatgcagggcccggtttgtcgccgaaagagattctgaggacgacggggaggaacctgttgtcttccccgagtcacccttacagagtcccactgtcttggtggcagtactcgcccggaacgcggcccatactctcccccacttcctgggctgtctcgagaggctagattatcccaagtcgagaatggctatctgggccgctacagatcacaacgtcgacaacaccaccgagatctttcgtgaatggcttaaaaacgtgcagcggctctatcattacgtggagtggcgtcctatggatgaacctgagtcctaccccgatgagatcggtcctaaacattggcccacctcacgcttcgcacacgtcatgaaactgcgccaagcagccctgcgtaccgctcgagagaaatggagcgattatattctttttatcgacgtggacaatttcctaactaacccccagacactaaacttgctcatcgccgagaataagactattgtggctcctatgctcgaatcgcgcggattgtacagcaacttttggtgcggtattactcccaaagggttttacaagcgcacccctgactatgtgcagattagggaatggaaaaggactgggtgctttcctgtcccgatggtccattctacgtttcttattgatttgagaaaggaagcaagcgacaagctgactttctaccctccacaccaggactatacatggaccttcgatgatattatcgtgttcgccttcagctcccgacaggcaggaatccagatgtatctgtgcaatcgggagcactacggatatcttccaatccccttaaagcctcaccagacacttcaggaagacatcgagaatcttatacacgtccaaattgaggccatgattgatagacctcccatggaaccttcccagtatgtaagcgtggtacctaaatacccggataaaatgggttttgacgaaatcttcatgatcaatctgaagaggagaaaagacagacgagacagaatgttacgcactctgtacgagcaggagatagaagtgaagattgtggaggccgtggacggcaaggccctgaatacctcacagttgaaagctctgaatatcgagatgctgccagggtaccgggatccctactcatcacggccccttactagaggtgagataggatgtttcctgtcccactacagcgtttggaaggaagtgatagatcgcgaactggaaaagactctggtaatagaggacgatgtgcggtttgaacaccagttcaaaaagaaacttatgaaacttatggataacatcgaccaggcacaactggactgggagttgatttatatcggtaggaaacgtatgcaagtcaaagaaccggaaaaggctgtgccaaatgtggccaacctggtggaggccgactattcttactggaccctcgggtacgtcatctcactggagggcgcacagaaactcgtcggagccaatccgttcggaaaaatgctccccgtcgacgaattccttcctgtcatgtataacaagcatccagtgttgttgtcctctcctcactgtcatctgttccagactctgtcagatgattgccaaaggtag

SEQ ID NO: 42605 - DNA, 1050 bp, Artificial Sequence
  Description of Artificial Sequence: Synthetic coding sequence
atggccctgctgcggaagatcaaccaggtgctgctgttcctgctgatcgtaacgctgtgcgtcattttgtataaaaaagtccataaaggcaccgtaccaaaaaatgatgccgatgacgagtctgaaacacccgaagagctcgaagaggagattcccgtcgtgatttgtgcagcagcggggcggatgggtgcaaccatggccgcgatcaatagtatttattccaatactgatgccaacatcctgttctatgttgtgggcctgcggaacactttgaccaggattcggaaatggatagaacattcaaagctgcgcgaaatcaacttcaagatcgttgagtttaatcccatggtgttaaagggaaaaattcgaccagactcaagtaggccagaacttctgcagcccctgaatttcgtgcgcttctatctgcctctgcttattcaccagcatgagaaggtcatttacctggacgatgatgtcatcgtccagggggatattcaggagctttacgacaccaccctggcgcttggacacgctgctgcattcagtgacgattgcgatctcccttcagctcaggacattaatcgcctggtcggactgcaaaatacttatatgggatatctggactacagaaagaaggcaatcaaagatctgggcataagcccctcaacttgcagtttcaaccctggagtgatcgttgccaatatgactgaatggaaacatcaaaggataaccaagcaactggagaagtggatgcagaagaatgtggaagaaaatttgtacagcagtagtctgggtggaggagtggccacaagtcccatgctcatcgtgtttcatgggaagtattcaaccataaatcctctttggcacataaggcatttaggttggaaccccgatgctcgctatagtgagcactttctgcaggaggccaaactgctacactggaatggacggcacaagccatgggactttcccagtgtgcacaacgacctatgggaaagttggtttgtgcctgatcccgctggcatctttaaactgaatcaccacagctag

SEQ ID NO: 42606 - DNA, 1050 bp, Artificial Sequence
  Description of Artificial Sequence: Synthetic coding sequence
atggccctgctgcggaagatcaaccaggtgctgctgttcctgctgattgtaacactgtgtgtaattctgtacaagaaagtccacaaaggtacagtgccaaaaaacgatgccgatgatgagtcggagactccagaggaactggaggaagagatcccggttgtcatttgcgccgcagcgggtaggatgggcgctacaatggctgccatcaattccatttatagcaatactgacgcaaacatcctgttttatgtggtcggccttcgaaacaccctgacccgcattagaaagtggattgagcacagcaagctgagagaaatcaactttaagatcgtggagttcaatcctatggttctgaaaggcaagattagacccgattctagccggcccgaattgctgcagccgttaaacttcgtgcggttttacctgcctttattaatccatcagcacgaaaaggtcatttatctggatgacgacgtgatagtgcaaggtgatattcaggaactgtatgacactaccctggcactggggcacgctgccgctttcagtgacgactgtgaccttccgagtgcccaggacataaaccggctcgtaggactgcaaaatacctatatgggttacctcgactaccgcaagaaagctataaaggacctcggtatctctccatcgacatgtagcttcaatcccggcgtcattgtagctaacatgacagagtggaagcaccaacggatcaccaagcaattggagaagtggatgcaaaagaacgttgaggaaaacctgtattcttcatctcttggcgggggcgtggccacatctcctatgctgattgttttccatggcaagtacagtaccataaacccgttatggcatatcagacatttgggatggaatcctgatgcccgatactccgagcatttcctgcaggaggctaagcttctgcattggaatgggcgccataagccttgggatttccccagcgttcataacgatttgtgggaatcatggtttgtgcccgatcccgcgggtatttttaagctgaatcaccactcttag

SEQ ID NO: 42607 - DNA, 1050 bp, Artificial Sequence
  Description of Artificial Sequence: Synthetic coding sequence
atggccctgctgcggaagatcaaccaggtgctgctgttcctgctgatagtgaccctctgcgtaatattatacaaaaaagtccataagggtacggttcccaagaacgatgcagatgacgaatcagagacccctgaggagctcgaagaggagatcccagtggtcatatgcgcggcagctggccggatgggggctacaatggcggccatcaactccatctacagcaataccgacgcgaatatcctgttttatgtggtcggcctgagaaacacacttactaggattcgcaagtggatcgaacattcaaagctcagggaaatcaattttaaaattgtcgagtttaatccaatggtcttaaagggtaagattcggccagacagcagcaggccggagttactccagcctctaaactttgtgcgcttttatctgcctctgctgatccaccagcacgaaaaagtgatctacctagatgatgacgtgattgtacagggtgatattcaggagttatacgacaccaccctagcgttggggcacgctgctgctttttcagatgattgtgatttacccagcgcccaggatattaacaggctcgtaggcctgcaaaatacatatatgggatatcttgattacagaaagaaggcgataaaagaccttggcattagccccagtacctgttcatttaacccaggagtgatagtggctaacatgacagaatggaagcaccagcggatcaccaaacagctggaaaagtggatgcaaaaaaatgtggaagagaatctgtacagctcttctctgggcggtggggttgcaacaagtcctatgctaattgttttccatgggaaatacagtactattaatcctttatggcacattaggcacctgggctggaaccctgatgccaggtattcggagcactttctccaggaggccaaacttttacattggaacgggagacacaagccttgggacttcccttcagtccacaacgatctgtgggagtcttggttcgttccagatcctgcgggcatttttaagctcaaccaccactcatag

SEQ ID NO: 42608 - DNA, 942 bp, Artificial Sequence
  Description of Artificial Sequence: Synthetic coding sequence
atggccgcccggcgggccctgcacttcgtgttcaaggtgggcaaccggtttcagacagcaagattctatagagacgtgctcggcatgaaagtcgaatcgtgttcagtggcccgcctggagtgcagtggcgccatatctgcccactgctccgactacacccggattactgaggacagcttcagtaagccatatgatggtaaatggagtaagaccatggtgggcttcgggcccgaggatgatcacttcgtggccgagttgacctacaattatggagtgggtgattacaaattaggcaacgactttatggggatcaccctcgcatcttctcaggcggtgtctaatgccagaaaattagaatggcccctgacggaggtggccgagggagtcttcgagaccgaggctcctggtggctacaagttctaccttcagaaccggagcttaccgcagtctgatcccgttcttaaagttacgctggcggtttctgatttacagaaaagcctgaactactggtgtaacctgctgggcatgaagatctatgagaaggatgaagaaaagcagcgcgcactattgggctatgctgataaccaatgtaaactggaactgcagggagtcaaagggggagtggaccacgcagccgcttttggtaggattgcattctcttgtccccagaaagaactccctgatctggaggatctcatgaagagggagaaccagaaaattttaacacctctcgtgtcgctggacaccccagggaaggctacagtgcaggtagtaatcctggctgaccccgacggacatgagatctgcttcgtgggggatgaagcttttcgcgagttaagtaagatggatcccgaggggtccaagctgcttgatgatgccatggccgctgacaagtcagatgagtggttcgcaaaacacaacaagcctaaagcatcaggatag

SEQ ID NO: 42609 - DNA, 897 bp, Artificial Sequence
  Description of Artificial Sequence: Synthetic coding sequence
atggccgcccggcgggccctgcacttcgtgttcaaggtgggcaaccggtttcaaaccgctagattttacagggacgtgctagggatgaaggtgctgcgccatgaggaattcgaggagggttgtaaagccgcctgtaatggcccctacgatggcaaatggtctaaaacgatggtgggattcggcccagaagacgaccactttgtcgcagaactgacctacaactacggcgtgggtgattacaaactgggcaacgatttcatgggaatcactctcgccagtagccaggccgtgtccaacgcacgcaaactagagtggccccttaccgaggtagccgagggggtctttgaaaccgaggctcctggtggctacaagttctatctccagaatagatccctgccccagagcgatcctgttctgaaagtgacacttgctgtgagcgaccttcaaaagtcgctcaattactggtgcaacctgctcgggatgaagatctacgagaaagacgaggaaaaacagcgggccctgctgggttacgcagacaatcagtgtaaactggagctacaaggtgttaagggcggcgtcgaccatgctgccgccttcgggcgcatcgcttttagttgtccccaaaaagaactgccggatttggaggatctcatgaagcgtgagaaccagaagatcctgaccccattggtgtctctagacacacccgggaaagccacagtgcaggtggtaatcctagccgatccggacggacacgagatatgttttgtgggcgatgaggcttttcgagagctgagcaagatggaccccgagggctccaagctgcttgacgacgcaatggcagccgacaaatcagacgaatggttcgctaagcacaataagccgaaggccagcggttag

SEQ ID NO: 42610 - DNA, 1506 bp, Artificial Sequence
  Description of Artificial Sequence: Synthetic coding sequence
atgcggctgacccccttcagcctgagcaccggcaacagcttccggtactctaggcgcctgaaaaagaacatatttggcaccgcaccggccctgcgtgctagcgaaatgagcttgcgcccttctagtcgcatttttccctgtttttcacgcaacggcttggactttacaatcgtgataactcttctgcaacctcccgtgcctgggatcagtttcattgtggctaaacctcgacttttcccaggcgccgggagcgctggatgtggactgttggaacgcctgttcctgtctcttctacttgggaccggactcagatggtgccggggctgctttcctggtgctagattctgctccacgacaagtccagagggtaacaccacgttcactgggttgcggcggtcagctagaacacagaggcttcagggcccaaaaccagggccgcccgcggcgacggtcgcaagacaaacttcccgcgtgtcacccgcacctccttgtagcttgaggcctgggctgagacatgagagcgctcccagtgccgccagcgacgtgacagcccggggtgcactgagaggcctcggatgtactgtaagggtgaccgctgcgtgcggcggcaatcatggatgctcacagctgcacttcgtcttcaaggtgggtaatcgctttcagaccgctcggttttacagagacgtcctgggaatgaaggttctgcgccacgaggaattcgaggagggctgtaaggcggcttgcaacgggccctacgacggaaagtggtctaaaaccatggtcggattcggccctgaggatgatcacttcgtcgctgagctgacttataattatggcgtaggagattacaagctcgggaatgacttcatgggtattacactggcgtcatcacaggcagtgagcaacgctcggaaactggagtggcctctcaccgaggttgcagaaggggtattcgagacagaggccccaggggggtacaagttttatctccagaatcgttccctccctcagagcgaccccgtgcttaaggtgactcttgctgtgtccgacctgcagaaatccctgaactattggtgtaacttattgggaatgaaaatatatgaaaaggatgaggagaaacagcgcgcattgctgggctacgctgataaccagtgcaagctggaactccagggggtcaaaggaggagtcgaccacgctgctgcatttggccgcatcgccttctcttgtcctcaaaaggaactgccggacctggaagatctgatgaagagagagaaccagaaaatcctcaccccactggtctcgctggacacgccagggaaggccacagtgcaagtcgtgatcctggcagatcccgatggacacgagatctgtttcgtgggggatgaagctttccgtgagttgtctaagatggatccagagggcagtaagctgctggatgatgccatggcagcagacaagtctgatgagtggtttgccaaacacaataagccaaaagcctcaggctag

SEQ ID NO: 42611 - DNA, 870 bp, Artificial Sequence
  Description of Artificial Sequence: Synthetic coding sequence
atgcggaacctgaagaaggccgccaagctgcccgtgatgggcatgattccttgctttttgaagtccccgctcggatctgactacactagaataacggaagacagcttctctaagccctatgacggcaaatggtctaaaacaatggtcggcttcggacctgaagatgatcacttcgtggctgagctgacatacaattatggagtcggggattacaagctggggaacgatttcatgggaatcactctcgcctccagccaagccgtatcaaacgcccgcaagttggaatggccccttactgaagttgctgagggagtgttcgagactgaggccccgggaggatataagttttatttacaaaataggagcctgcctcagagcgacccagttttgaaggtcacgttggccgtgagcgacttgcaaaaatccctgaactattggtgcaacttactgggcatgaagatctatgagaaagatgaggagaagcagagagcactgttgggctatgccgacaatcagtgtaagttggagttacagggagttaaagggggagtagaccatgcagctgcatttggcagaattgctttctcgtgtcctcagaaagaactgccggatcttgaggatttgatgaaaagggagaaccaaaaaatcctgacccctctagtcagcctcgacacacccggaaaggcaaccgtgcaggtagttatccttgctgatcccgacggccacgagatatgtttcgtgggcgacgaagcattccgagagcttagcaaaatggatcctgaaggttccaaactgctcgacgacgctatggccgcggacaagagcgatgagtggtttgcaaaacataacaagcctaaagcgtcggggtag

SEQ ID NO: 42612 - DNA, 5850 bp, Artificial Sequence
  Description of Artificial Sequence: Synthetic coding sequence
atgggcaacagctacgccggccagctgaagaccacccggttcgaggaagtgctgcataattccatcgaggcctccctgaggtccaacaatctggtgcccagaccaatcttctcccagctataccttgaagctgaacagcagctggccgcactcgaaggcggatcacgggtcgacaacgaggaggaagaagaggagggcgagggggggctggaaaccaacgggccgcctaacccatttcagctccatcctctgccggagggctgttgtaccaccgatggcttctgtcaggctgggaaggatcttagacttgtctctatcagcaacgagccaatggatgtacctgccggattccttttggttggggttaaatctccttcactgcctgaccacctgttggtctgtgccgttgacaagcggttcctgccagatgacaatggtcacaatgccctcttgggcttttcagggaactgtgtgggttgtggcaagaaaggattttgctactttactgagttttcaaaccacataaatcttaagctcactacccaaccaaagaaacagaagcacctgaaatattacctcgtaaggaacgcacagggcaccttaactaagggacctctcatttgctggaaaggctcggaatttaggtcccgccagattcctgcgagtacatgctcaagctctctctttcccgcactggagagtaccgccgccttcccatccgagcctgtcccagggactaacccaagtatcctgatgggggcccagcaggccggacccgcgtctgaccatccttccctgaatgcggcgatgggacccgcggtgttcaacgggaaggacagtcccaaatgtcagcagctggctaagaataacctgctcgccctgcccagaccaagtgcgctcgggatcctgtctaacagcggacccccaaagaaacgccacaaaggatggtcgccggagagtccatccgcccccgatggcggttgtccccaggggggtgggaaccgagcaaagtatgagtcagctggaatgtcatgcgtgccacaggttggcttggttggcccagcatccgttacattccccgtggttgcaagcggtgaacccgttagtgtccccgataacctcctaaagatatgtaaggccaaacccgtgatattcaagggccacggaaattttccttacctgtgcggaaatcttaatgacgtcgtagtcagcccacttctgtacacctgctatcagaattcgcagtctgttagcagagcctatgaacaatatggggctagtgccatacagccgatatccgaagaaatgcagttgctcttgaccgtttattacctggtgcagctcgctgctgatcaagtgcccttgatggaggacctagagcagatcttcctccgcagttggagggagagtcacttgacagagattagacagtaccagcaggctccccctcagccattcccccccgctccgtctgcagcggccccagtcacctctgctcaactcccatggctggcgagcttagcagccagctcttgcaatgattcggtgcatgtgatcgaatgcgcctattcactggctgaagggctgtcggagatgttcaggttgttagtcgagggtaagctggcaaagacaaactatgttgtcattatctgcgcatgtaggtcagctgctatcgatagttgcattgctgtgactggcaaatatcaagcccggatcttgtccgaatctctcttgacgcctgctgaatatcagaaagaggtcaactatgagctggtgaccggcaaggtggacagccttggagccttttttagcactctgtgccctgagggggacatcgacattctcctggacaagttccatcaggagaaccaggggcacatctcatcctctctggcagcatcaagtgtgaccaaggccgctagtctggacgtgtcaggtacacctgtatgtacaagttacaacctggagccacactccattcgaccgttccaattagccgtcgctcaaaagcttctatctcatgtctgctctattgctgattcaagcacgcaaaatctggacctggggagttttgaaaaggtggactttcttatttgcattccgccttcagaggtcacatatcagcagacgcttctgcacgtgtggcacagtggtgtcctgctggaacttggcctgaaaaaagagcatatgacaaaacaacgggttgagcagtacgtgttaaagctggataccgaggcccaaacgaagttcaaggcctttctgcaaaatagctttcagaatccccatactctgttcgtgttgattcatgatcacgcccactgggacctcgtgtccagtacagttcataatctgtattctcagtccgaccctagcgtcggactggtggacaggctgctcaattgccgggaagttaaggaggcaccgaacattgttacgttacatgtgacctcattcccttatgctctccagacccagcatactctgatcagcccatacaatgaaatacattggcccgctagctgtagtaatggcgtagacctgtaccatgagaataagaagtatttcggcctgagcgaattcattgagtcgactctttctggacactcactgcctctcctgcgatacgatagcagctttgaagctatggtgacggccctgggcaagcggtttccccggttgcatagtgctgtcatccgaacgttcgtcttagtccagcactatgcggcggcactgatggcggtctctgggctgccacagatgaagaactatacatcagtggaaacacttgagatcacccagaacctattgaatagcccaaaacaatgcccttgtggacatgggctgatggttctactcagagtcccctgtagtcccctggctgtcgtcgcttatgagcggctagctcatgtgagggcgaggctggctttggaagagcactttgaaattattctcggctccccgtcttccggggtgacagtgggaaaacatttcgttaagcagctgcggatgtggcaaaaaatcgaggatgttgagtggcggccgcaaacctatcttgagctcgaggggctcccttgtattctcattttctcaggcatggatccgcacggcgagtcactaccaagatcactccggtattgtgacctgcgcctcatcaactcttcctgccttgtgaggacggcgctcgagcaggagttggggctggctgcctacttcgtttcgaatgaagttcccctggagaaaggagcccgtaatgaggcactggaatccgatgctgaaaagctttcttcaacagacaacgaggacgaggagttggggacagagggatccacctctgagaaacggtcacctatgaaacgggaacgtagccggtcccacgattcagcatcctcttctctgtctagcaaggcttccgggagcgctctggggggcgagagttccgcccagccaacagcacttccacagggagagcatgctagatctccacagcctagaggtccagcagaagaggggcgagcccccggagagaaacagaggccccgcgcatcccaggggccacctagtgctatctcaaggcactcaccaggtccaacgcctcagccggattgtagcttaaggacgggacagaggtccgtgcaggtgagcgtgaccagttcctgttcccagctgtcgtccagctcgggctcctcatcctcaagcgtggcacccgccgctggcacgtgggtgttgcaggcaagccagtgcagcttgacaaaagcttgccgtcagcctccaattgtgtttcttcccaagctcgtgtatgatatggtggtgtctacagactctagtgggcttcccaaggcggcatccttgctgccttctcccagcgtgatgtgggcatcgtcatttcggcctctactatccaagacaatgacctccactgagcaaagtctctattaccgccaatggaccgttccccgcccttcccatatggattacggcaatcgcgccgagggcagagtcgacgggttccatcccaggcggctcctcctgtcggggccaccacaaattggtaaaaccggagcctacttgcagtttcttagcgttctgtctcggatgctggttcgcctgacagaggtagacgtttacgacgaggaggagatcaatattaacctaagggaggaaagtgactggcactatctacagcttagcgatccgtggcccgaccttgagctgttcaagaagctccctttcgactacattatccacgacccaaagtacgaagacgccagtctaatctgctcccattaccaggggattaagtccgaggacagggggatgtctaggaagccagaggatctttatgtgcgccggcagaccgctcgcatgaggctttctaagtatgccgcctacaatacctatcaccattgtgagcaatgtcatcagtatatgggcttccaccccagataccagctctatgaatccaccttgcatgctttcgccttctcttatagcatgctaggagaggagatccaattgcatttcataattcccaagagcaaagagcaccacttcgtcttcagccagcccggaggccaacttgagtcgatgagactgcctttggtcaccgacaagagtcatgagtacattaaatcacctactttcacaccaactactggccgccacgagcacggtctgtttaacctgtaccacgctatggacggtgcgtcccacttacatgtcctggtagtgaaagagtacgaaatggctatctataagaagtactggccaaaccatataatgctggtgctcccgtccatcttcaatagtgcaggagtaggggcagcacactttttaattaaggaactttcgtatcataacctcgaacttgagcgcaacagacaagaagaattgggcatcaagcctcaggatatctggcctttcatagtgataagtgatgatagctgcgttatgtggaatgtagttgacgtgaattcagccggcgaacggagccgagagttcagttggtcagagaggaatgtgtccctgaaacatattatgcagcacattgaggccgcccccgatataatgcactatgcccttctgggtctgcgtaaatggtcctcaaaaaccagggccagcgaggtgcaagaacccttctccagatgccacgtgcacaatttcattattttgaacgtggacctgacacagaatgtgcagtacaaccagaacaggtttctatgcgacgacgtcgatttcaacttgcgggtgcactctgccggcctgttgctttgcagattcaatcggtttagcgtgatgaagaagcaaattgttgttgggggccaccggtcttttcacataacgtccaaagttagcgacaattctgccgcggtcgtgcccgcccagtatatctgcgcccccgactcaaaacacacattcctggccgctccagctcagctgctcctggagaaatttctgcaacaccactctcacttgttttttccgctcagcctcaaaaaccacgatcatccagtgctgtccgtcgattgttacctgaacctaggcagtcaaattagcgtgtgctatgtgtcatccaggccccactcactgaatattagctgctccgatctgctgttcagcggactcttactttatctctgtgactcttttgtgggcgcctcattccttaaaaagttccactttctgaaaggagccacgctgtgtgtaatctgccaggatcgcagttccctgagacagacagttgttagactcgaactggaggacgaatggcaattccgcctgagggatgagttccagaccgccaacgctcgcgaggatcggccactcttcttcctgaccggtcggcacatctag

SEQ ID NO: 42613 - DNA, 1395 bp, Artificial Sequence
  Description of Artificial Sequence: Synthetic coding sequence
atgcgggagggcagcagcaccctgagcgagatccggaagctgaagccagggataatggtttgtacatgcaacccatcctacagcaaccaagagacggaagtacaggaaaattcacccggccacagagcaggtctggaaccattctttgactttatcgtgtctataaacggctctagactgaacaaagacaatgatactcttaaggatttattaaaagccaacgtggaaaagcccgttaaaatgctgatttactccagcaagaccctcgaactgagagaaaccagtgtaaccccctcaaacctctggggcggccagggcttactaggggtcagtatccgtttctgcagctttgacggagctaacgagaatgtttggcacgtgttggaagtcgaatctaatagccccgctgccctggctgggctacggccacacagtgattatataattggagcagacaccgtaatgaacgaaagtgaagacctcttttccttgatcgagacccatgaggcaaagccgctgaagctctacgtctataacactgacacagataactgcagagaggtgattattaccccaaatagcgcctggggcggagaagggtctcttggatgtggtatcggatatggttacctgcataggatccccactagaccctttgaagaagggaagaaaattagcttgccagggcagatggccggcacgcccatcacccctttgaaagatgggtttaccgaggtccaactgagcagcgtgaacccgcccagtctgtccccccctgggaccacaggaattgagcaatccctcactggtcttagtatctccagcaccccgcctgcggtgagttccgtcctttccacgggggttcccaccgttcccctgctgccacctcaggtgaatcagtccttgacatcagtccccccgatgaatcccgcaactacgctcccaggcctaatgcccttgccggcggggctgcccaatctgcccaacctcaacctgaacctccccgctcctcacattatgcctggtgttggactcccggaattagttaaccccggactcccgccactcccctcaatgcccccaaggaatttaccgggcatcgctccattacccttgccatcagaatttctgcccagcttccctcttgtgcctgaatcctccagcgcagcatcctccggcgaactcctgtcgtcattgccccctacatcaaatgctccgtccgatccagctacaactacagcaaaagccgacgcagcctccagtctgacggtcgatgtaacaccaccaaccgccaaagcccctaccaccgtggaggaccgagtgggggatagcacccctgtgtccgagaagccggtctcagcggccgtggacgcaaatgcgtctgagtcaccttag

SEQ ID NO: 42614 - DNA, 399 bp, Artificial Sequence
  Description of Artificial Sequence: Synthetic coding sequence
atgatcagcatcaccgagtggcagaagatcggcgtgggcatcaccggctttggcatttttttcatccttttcggaacactcctgtattttgactctgttcttctcgcatttggcaaccttttatttctgacaggcctgtccttaattatcggactgcggaagactttttggttttttttccaacgacataagcttaaagggacatcctttctgctcggcggagtcgtgattgtcctgctccggtggcctttgttgggcatgtttctcgagacatatggctttttttccctctttaaagggttttttccggtcgctttcggcttcctggggaacgtctgtaacatcccatttctgggcgcactgttcagaaggctccagggcacaagctccatggtgtag

SEQ ID NO: 42615 - DNA, 918 bp, Artificial Sequence
  Description of Artificial Sequence: Synthetic coding sequence
atgagcgtggaccccgcctgcccccagagcctgccctgcttcgaggcctctgattgtaaggagagtagccctatgcctgttatctgcggacctgaagaaaactacccttccttacagatgagcagtgctgaaatgccacataccgaaacagtgtcccctctcccaagctctatggatctcctgattcaagattcacctgattcctcaacctccccaaaagggaagcaaccaacttcagcagagaaaagcgtggccaagaaggaggacaaagttccagtgaagaaacagaagacaagaacggtgttctcaagcactcagctttgtgtcctcaacgataggttccagagacagaagtacctctccctgcagcagatgcaggaactgagcaatatcctcaacttgagctataaacaggttaagacgtggttccaaaatcagcggatgaagtccaaaagatggcagaaaaacaattggcccaagaactccaacggcgttacccaaaaagccagcgcaccaacgtatccctccctgtattcctcttatcatcagggctgcctggtcaaccctaccgggaacctcccgatgtggtccaatcagacttggaataatagtacctggtcaaaccagacccagaacatccagtcatggtcaaaccactcctggaatacccagacctggtgtacccaaagctggaataatcaggcgtggaacagcccattttacaactgtggtgaggaatcattgcagtcctgtatgcaatttcagcctaattctccggcttctgatctcgaagctgctctggaggcagctggggaaggactcaatgtgatccagcagactactagatacttttctacaccacagaccatggacctttttctgaactatagcatgaacatgcaacccgaggatgtctag

SEQ ID NO: 42616 - DNA, 1842 bp, Artificial Sequence
  Description of Artificial Sequence: Synthetic coding sequence
atggccgccaccgccgtggccgccgccgtggccggcaccgagagcgctcaggggcccccaggaccagccgcctcattagaactgtggttaaataaagctaccgatccctctatgagcgagcaggactggtccgctattcagaacttttgtgaacaggtgaatacagaccccaatggacctacccacgccccatggcttctggctcataagatccaatcccctcaggagaaggaggctctgtatgcattgaccgtcttggagatgtgtatgaatcattgcggcgaaaaattccattctgaggtggccaagttcaggttcctcaatgagttgatcaaggtgttatctcctaaatacctgggctcctgggcgacgggtaaagttaagggtcgtgttatcgagattttatttagctggacagtatggtttccagaggacattaagatccgcgatgcctaccaaatgctcaaaaaacagggcattatcaagcaggaccccaaactgcctgtcgataaaatcctgccaccaccctccccctggcccaaatcttccatcttcgatgccgacgaggagaagagcaagttgctcacacgactgcttaagtcaaatcatcctgaagacctgcaggcagccaacagacttatcaagaacctggtcaaggaggagcaggaaaaatctgagaaagtatctaagcgagtgagtgctgttgaggaggtgcggagtcatgtcaaagtgctccaagaaatgctgtccatgtacagacgcccgggacaggcacccccagaccaggaagcactgcaagtcgtctacgaacggtgcgaaaagttacgacccacattgtttaggctcgcttctgataccaccgatgacgatgacgctctggcagagatcctacaggccaacgaccttctaacccagggagtgctcctctataaacaggtcatggagggccgggtcaccttcggcaacagggttacttcaagtctcggcgacatccccgtgagtagggtctttcagaacccagccggatgtatgaaaacctgccccctgatcgatctggaagtagacaacggacccgctcagatgggcactgttgtgccttccctgttgcatcaagacttagccgctttgggtatttccgatgccccagtgactggaatggtttctgggcagaactgttgcgaagaaaaaagaaatccaagcagttctacactgcctggggggggggtgcagaatcctagtgccgaccgtaaccttctggacctcctgtccgcccagccagcgccctgtcccctaaactatgtttcccaaaaatccgtgcctaaagaggtgcccccaggtactaagtcatcaccaggttggagctgggaagccggtcccttggcccctagcccgtcttcacagaacactccgttggctcaggtctttgtcccactggaaagcgtgaaacccagctcactccctccactcattgtctatgatcggaacgggttcagaatcttgctgcacttctcccagaccggggcccccggacaccccgaggtccaagtgctcttgctgactatgatgagcactgccccccaaccggtctgggacattatgttccaggtggcagtgcctaagtctatgagggtgaaactgcaacccgcttcgtccagcaagcttcctgccttttctcctctcatgcctcccgcagtgatatcgcagatgcttctgttggacaacccacataaagagccaatacggttaaggtataagcttactttcaatcagggagggcagcctttctctgaagttggcgaagtcaaagactttccagatctggctgtcttgggcgccgcatag

SEQ ID NO: 42617 - DNA, 522 bp, Artificial Sequence
  Description of Artificial Sequence: Synthetic coding sequence
atgaccttcagcaagctgctgatctgcctggacttcctggacgtgctggagcgcatgggtgtcgctcttctctttatttggaagcaggtggaattactgctgggtatcagcctctactcctttctgacgggaatttcagacgcccccgttacagggatggtcagaatgcccttccccggccctggcgagagaatgggtgggtctcagacatgcccttgtgaagccgcactccctggggagcagcgaggtgcacctgccctctcacggtgggatcacgggttggggggccctaagcccctcccccacccctactgtctggccgacacatgggggcggcaggttgctcctggctcatgtttccttgaggtttgtcccggggccgcctgcgacctggccctctcctttccaagctgtcctaagagatgccaccagagcggcccccagcagctgggatgggctcaagaaagctgcgctttggtgctcttatggctcatggtgatccacacgctggtcctgttctag

SEQ ID NO: 42618 - DNA, 861 bp, Artificial Sequence
  Description of Artificial Sequence: Synthetic coding sequence
atggccgtgccccagcccatgcccagcatccccgaggacctggagagccgggaagctatggtggctttctttaacagcgcagtggcatcggctgaagaggaacaggctcgtctgagaggtcaactgaaggaacagcgtgtgagatgcagacgtttggcccacttactggccagtgcccagaaagaacctgaggctgctgccccagctccgggtacaggaggggattctgtctgcggcgaaactcatcgagctctacagggcgctatggagaagcttcagagccgcttcatggagctgatgcaagaaaaggctgaccttaaagagagagtcgaagagctggaacacagatgtatccaactgagcggggaaacagatactatcggcgaatatatcgccctctatcagtctcagcgcgccgttctgaaagaaagacaccgggagaaggaggagtatatcagtcggctggctcaggataaagaagagatgaaagttaagcttctggaattacaggaactcgttcttagattggtaggcgaccgcaacgagtggcacgggcggttcctggccgctgcccaaaaccctgcagatgaacccaccagcggggctcctgcccctcaggagttgggagccgcaaatcaacagggtgatctctgcgaggttagtctagctggctccgtggagccagctcagggcgaggcccgggaggggagcccccgagacaaccctaccgcccagcagatcatgcagctccttcgagaaatgcaaaacccccgagagcgacccgggctgggctctaatccttgtatccctttcttttatcgagccgatgaaaacgacgaggtcaagatcacggtcatctag

SEQ ID NO: 42619 - DNA, 3009 bp, Artificial Sequence
  Description of Artificial Sequence: Synthetic coding sequence
atgtggccccagccccggctgcccccccggcccgccatgagcgaggagacacggcagtccaagctggccgcagcgaagaaaaagctgcgggagtaccaacagcgcaatagccccggagttcccacaggtgctaagaagaaaaagaaaatcaagaacgggtccaacccagaaaccaccacgagtggaggttgccacagtcctgaagacacgcctaaggataacgctgctacactgcagcccagcgacgacactgttctgcctgggggtgtaccctcacccggcgcctccctgactagcatggccgcaagtcaaaaccatgacgccgacaacgttcccaacctaatggacgaaacgaaaacctttagcagcacagagtcgctgcgacaactgagtcagcagctgaacgggcttgtgtgcgaatcagcaacatgtgtgaacggggaggggcccgcctcttccgcgaatctgaaggacctggaatcccgttaccaacaacttgccgttgccctggatagctcatacgtgaccaataaacaactaaatattactatcgagaaactgaaacaacaaaatcaggagatcacagaccagcttgaagaggagaagaaggaatgtcatcagaagcagggtgctttacgggagcagctgcaggtccacatccagaccataggcatcttagtgtctgagaaagccgaactgcagacagccctggcacatacacagcatgctgcgaggcaaaaggaaggcgagagcgaagatttggcatcccgccttcagtatagccgccggagagtcggcgaactggagagagccctctcagcagtcagtacacaacagaagaaggcagacagatacaacaaagagctcactaaagagcgtgacgcactgagattggagttgtataaaaatacccagagtaacgaggatctaaagcaggagaagagcgaactggaggaaaagctgagggtgctagtgacagaaaaggcgggcatgcaactgaacctcgaggaattgcagaagaaactcgagatgaccgaactgcttctgcaacagttctccagccggtgtgaagctcctgatgccaaccaacagttgcagcaagctatggaggagcgcgctcagctcgaggcccatctggggcaggtgatggaatccgtgaggcaactacagatggagcgggataaatacgctgagaatctgaaaggagaatcagctatgtggcggcagcggatgcagcaaatgtccgagcaagtgcatactctccgcgaagagaaggaatgctctatgagcagagtccaggaactagagaccagccttgccgagttgcggaaccagatggccgaaccgccgccacccgagccccccgcagggccaagcgaggtcgagcagcagctgcaggccgaggctgaacatttgagaaaggagctagaaggcttggcagggcaacttcaggcccaggtgcaggataacgaagggctttcacggcttaatagagagcaggaagagcgcctccttgaactggagcgggctgccgaactatggggcgagcaagctgaagcccggcgacagatcttggaaacaatgcagaacgatcgtaccacaatctctcgcgcgctatctcagaatcgagagctcaaagagcaactggcagagctgcagtcaggctttgtgaagctgaccaatgagaatatggaaataacctcagccttacaatccgaacagcatgtgaagcgagagctaggtaagaaactgggggagttacaggaaaaactgagcgagctgaaggaaacagtggaactgaagtcgcaggaggctcagagcctacagcagcaacgggaccagtaccttggacatctgcaacagtatgtagctgcctatcagcagctgacctccgaaaaggaggttttacataaccaattgctgctgcagacacagttggtagatcagctgcaacagcaagaagcccagggaaaagcagtggccgaaatggccaggcaggagcttcaggagacacaggaacggctcgaggccgctactcaacagaatcagcagctgagagctcaactgtcactgatggcccatccaggagagggcgatggcctcgaccgcgaggaggaggaggacgaagaggaagaagaagaagaagctgtggcagttccgcaaccaatgccttcgatcccggaagatcttgagtctagagaagccatggtggccttcttcaattcggccgtggcatcagctgaggaggaacaggcaagactgcggggccagttaaaagagcaacgggttcgctgtcgcagactggcccacttgctggcttccgcacagaaagaacctgaagccgctgcccccgctcctggaacagggggtgattctgtgtgtggcgagactcacagggccttgcagggggcgatggaaaaactccagagtcgttttatggagcttatgcaggagaaggccgacctgaaagagcgggtggaagaactagagcacagatgcattcagctctcaggagagaccgacaccataggagaatacatcgctttgtaccagagtcaaagagcagtcttgaaggagagacaccgggagaaagaggagtacattagtagactggcacaggataaggaggagatgaaggtcaaactgctggagcttcaagaactggtgcttcgtctagtgggcgatcggaacgaatggcacggacggttcctggcagccgctcagaatccagcagatgaacctacctctggcgctccggccccgcaggaacttggagcggccaaccagcagggcgacctgtgcgaagtttccttggccgggtcagtcgaacccgcccaaggagaggcccgtgaagggtctcccagggacaatcctaccgcacagcagattatgcagctcctaagagagatgcagaacccacgcgagcggcccggactcggcagtaatccatgtatcccttttttttaccgggctgatgagaatgatgaagtaaagataacagttatctag

SEQ ID NO: 42620 - DNA, 1422 bp, Artificial Sequence
  Description of Artificial Sequence: Synthetic coding sequence
atgtggccccagccccggctgcccccccggcccgccatgagcgaggagacaagacaaagcaaactcgcagctgctaagaagaaactgcgcgaataccagcagcggaactccccaggcgtgccaactggagccaaaaaaaagaagaagataaagaacggtagcaacccagagacaacaacatcaggggggtgccattcaccagaggatattcaagacatcctgaaggtgctcgtgtccgatctgaacagatccaatggcgtggcgttacccccccttgacaaatggaagacgcctaaggacaacgccgcgacgttgcagccttcagacgatactgtgttgcccgggggagtgccaagccctggcgcctccctgactagtatggcagccagtcagaaccatgatgccgacaacgtaccgaacctgatggatgaaactaagacctttagttccaccgaatctcttcgccagctgtctcaacagcttaatggactggtgtgcgaatctgcgacttgtgtcaatggtgagggtccagcctcttctgccaacttgaaagatctggaatcacgataccagcagttagccgtcgctctggattcttcatacgttaccaataaacagttaaacattactattgagaaactgaagcagcagaaccaggaaataacagaccagctggaagaagaaaagaaggaatgtcatcagaaacaaggagccctgcgtgaacagttgcaagtacacatacagaccattggaatactagtgagcgaaaaagccgagctgcagacagcgctggcccatactcaacatgccgcgaggcagaaggagggcgagtctgaggaccttgcttcaagattgcaatacagtagacggagagtaggcgagctagaaagagccctgtccgccgtttcaacccagcaaaagaaggccgaccgttataacaaagaattaacgaaggagagagacgctctgagacttgagctgtataagaacacccagagcaacgaggatttgaagcaggaaaagtccgagttagaagaaaaattgcgggttctagtgactgaaaaggctggaatgcagctaaatctggaggaactccagaagaagctagaaatgaccgagttactactgcagcaattctcttccaggtgtgaggccccagacgcaaaccagcagctgcagcaagcgatggaagagcgtgctcagttggaagcccacctgggccaggtgatggagagtgtaagacagctacagatggaacgagacaagtacgccgaaaatttaaaaggtgagtcggctatgtggcggcaaaggatgcagcaaatgagtgaacaggttcacacactgcgggaagagaaggagtgctctatgagtagggtgcaggagctggaaacatcactggccgagcttaggaaccagatgtag

SEQ ID NO: 42621 - DNA, 414 bp, Artificial Sequence
  Description of Artificial Sequence: Synthetic coding sequence
atgcggccccagcaggcccccgtgagcggcaaggtgttcatccagcgggattactccagtggcacaagatgccagtttcagactaaattccctgcagaattagaaaacaggatcgacaggcagcagtttgaagagactgttcgcacattaaataatctgtatgcggaggcagaaaagctgggggggcaatcttacctggagggttgtctggcctgcctgacagcctacacaatttttctgtgcatggagactcattacgagaaagttttaaaaaaagtcagcaaatatattcaggagcagaatgagaagatctacgcaccacagggcctcctgctgactgatccgatagagcggggactccgcgttattgagatcacgatctacgaggatcggggaatgtccagcggccggtag

SEQ ID NO: 42622 - DNA, 405 bp, Artificial Sequence
  Description of Artificial Sequence: Synthetic coding sequence
atgcggccccagcaggcccccgtgagcggcaaggtgttcatccagagggattacagctctggaacacggtgtcagtttcaaactaagttccccgcagaactggaaaaccgcatcgacagacagcagtttgaagagaccgttcggacattaaataatctgtatgcggaggccgaaaagctgggcggacagagctatctggaagggtgcttagcttgtctaacggcttatactatcttcttgtgtatggagacccactatgaaaaggtgttgaaaaaggtcagtaagtacatccaggaacagaatgagaaaatttatgctcctcaaggtctcttgctgactgacccgattgagcgtggcctaagggtctttcggctgaagctgccattcatgaaaaccgaagcgtag

SEQ ID NO: 42623 - DNA, 414 bp, Artificial Sequence
  Description of Artificial Sequence: Synthetic coding sequence
atgcggccccagcaggcccccgtgagcggcaaggtgttcatccagcgggactacagtagcgggacgagatgccaatttcaaactaagttcccagcagaactggagaacaggatcgatagacaacagtttgaggagactgtgcggacgctgaacaatctgtacgccgaggccgaaaagctgggtgggcagagctacctggaggggtgtttggcgtgcctgactgcctacacaatctttctatgcatggaaactcactacgaaaaagtgctgaaaaaagtatccaagtacattcaggagcaaaacgaaaaaatttacgcgccccagggactgctgctgacagaccccatcgagagagggcttagggtcattgagattacaatttacgaggatagaggaatgagctctggccgctag

SEQ ID NO: 42624 - DNA, 414 bp, Artificial Sequence
  Description of Artificial Sequence: Synthetic coding sequence
atgcggccccagcaggcccccgtgagcggcaaggtgttcatccagagagactacagcagcggaacacgttgtcagtttcaaaccaagtttccagctgaactggagaatcggatagatagacagcagttcgaggagacggtaagaacactcaacaatttatacgcagaagccgagaaacttggtggccaatcgtatctggagggctgtctcgcgtgcctgactgcttacactatctttctgtgtatggagacacactatgagaaggtgctcaagaaagtgagtaaatatattcaggaacaaaatgaaaaaatctacgccccccagggtctgttgctgaccgaccccatcgaaagagggctgcgggtgatcgaaataacgatctatgaagatcgggggatgtctagcgggagatag

SEQ ID NO: 42625 - DNA, 501 bp, Artificial Sequence
  Description of Artificial Sequence: Synthetic coding sequence
atggacgaccagcggtgccccctggacgacggccaggccggcgccgccgaggccacagccgctcccacgcttgaagacaggatcgcacagccatcaatgacagcctcacctcagaccgaggaattttttgacctaattgccagctctcagagtaggagactggatgatcagcgagcttctgtcggtagcttgcccggcttacgcattactcacagcaatgcaggccatctacggggccacggggagcctcaagaacccggagacgatttcttcaatatgttgatcaagtatcagagctcaagaatcgatgatcagcgatgccccccgcccgacgtcctgccacggggcccaactatgccagatgaggattttttcagtctaattcagcgggtccaggccaagcgtatggatgaacaacgcgtcgacctcgccggcgggccggagcagggcgctggcgggcctcccgagccgcagcaacagtgccaacccggcgctagctag

SEQ ID NO: 42626 - DNA, 1959 bp, Artificial Sequence
  Description of Artificial Sequence: Synthetic coding sequence
atggaggccagctgcctggagctggccctggagggcgagcggctgtgcaaagctggagactttaagactggcgtggccttcttcgaggctgctgttcaggttgggacggaagacttgaagaccttgtccgctatttactcacaacttggcaacgcttatttttatctgaaggagcatggtagggccctggaataccacaaacatgacctgctcctagcacggacaattggagataggatgggcgaggcaaaagcctctggaaacctgggtaacacactcaaggttctcggacgattcgatgaggcagctgtctgctgtcaaagacacctctcgatcgcccaggagcagggcgacaaggtcggagaggccagagccctgtataacattggcaacgtctatcatgccaagggaaaacagctaagctggaatgccgctaacgctacacaagatcctggccacttgcccccagatgttcgggagactctctgcaaggcctctgagttctacgagcgcaacctgagcctggtcaaagagctgggtgatagagccgcgcagggacgcgcttatggaaatctagggaacacgcactatctgctggggaacttcaccgaggccaccacctttcacaaggagcggttagctatcgccaaagagttcggtgataaggcggctgaacggagggcatatagtaatctaggcaatgcgcatgtattcctgggtaggtttgatgtcgcagcggaatactacaagaaaacgttgcagttatcgaggcagttgagggatcaggccgtggaggcccaagcgtgttatagtcttggcaacacctatactctgctgcaggattacgagcgggctgccgaataccatctgcgccacctgttgatcgcccaggaattggctgatcgggtcggcgagggtagagcgtgctggtcccttgggaacgcctatgtgagcatgggtcgcccagcccaggcgctaacttttgctaagaaacatctgcagatcagccaggagataggagaccggcacggagagcttaccgccagaatgaatgtggcccagttacagctggtgttggggaggcttactagccctgccgcatctgagaagcctgatctcgccggctatgaggctcagggagccagaccgaaacggacccaacgattgtcggctgaaacctgggatctgctcagattaccccttgagcgagagcaaaatggcgattcacaccactcaggagactggcgcgggcccagtcgcgattcactgccactcccggtccgatccaggaagtaccaagagggaccggatgccgagcgccggccgagggaggggtcccatagccctctcgattccgcggacgtaagggtccatgtccccaggacctccattccccgcgccccttctagcgacgaggagtgcttttttgatctgctgaccaagtttcagtcaagtcgtatggacgatcaacgttgtcccctcgatgacgggcaggccggggcagccgaagccacggccgcacccactttggaggataggatagcccagccatcaatgaccgcttctcctcaaacagaagagttttttgacttgatcgcctctagtcagagccggcgtctggatgaccagagggcatctgtcggatcactgcccggattgcggataactcactcaaatgctggacatctgcgcggacacggtgagcctcaggagccaggagatgattttttcaatatgcttattaaataccagtcctctcggatcgacgaccagcgctgtccacccccagatgtgctcccgaggggtcctaccatgcctgatgaggatttcttctcattgattcagagggtccaggccaagagaatggacgagcagagggtagatctcgccggtggccctgaacagggcgccggcggcccccccgagccacagcagcaatgtcaacccggagcaagctag

SEQ ID NO: 42627 - DNA, 501 bp, Artificial Sequence
  Description of Artificial Sequence: Synthetic coding sequence
atggacgaccagcggtgccccctggacgacggccaggccggcgccgccgaggcgactgctgcacctacgctcgaggatcgtatcgcccagccttcaatgacagcaagcccccagaccgaggaatttttcgatctgattgcttctagtcaatcccgaaggcttgacgatcagagggctagcgtgggatccctgcctggactgaggataacccactctaacgcagggcacctacgcggacacggcgaaccccaggaacctggcgacgatttcttcaatatgctgataaagtaccagtcaagtagaatcgacgaccaacgctgtccgccacctgacgtgctgcccagggggcccactatgcccgatgaggactttttttctctgattcagcgggtccaggccaagcgcatggatgagcagcgggtggacctggctgggggtcctgaacagggggctggaggccctcctgagccacagcagcagtgtcagccgggagctagctag

SEQ ID NO: 42628 - DNA, 1374 bp, Artificial Sequence
  Description of Artificial Sequence: Synthetic coding sequence
atggccggccccgccccccccgtggccgacgagctgcccggccccgccgctcgaaggctatactcacgcatggaggcttcgtgtctcgagctggcccttgagggcgagcgtttatgcaaagccggcgactttaagactggagtcgccttcttcgaagctgcggtacaggtgggcaccgaggatctcaaaaccctatccgctatttattcccagctggggaacgcatatttctatctgaaggagcatggccgggcccttgagtatcacaaacacgacctgctgctggcccgaacaatcggggatcggatgggagaggctaaagcatccggcaacctgggaaacaccttgaaagttctcggccggttcgacgaggcggcagtgtgttgccagcgccatcttagcatcgcccaggaacaaggtgacaaagtaggagaggcgcgggccttatataacatcggcaatgtgtatcatgccaagggtaaacagctttcttggaacgcagcaaatgcaacacaggaccctggacatctgccacctgacgtcagggaaaccctgtgcaaggcttccgaattttacgaaagaaatctgagcctggttaaagagctgggagatagggctgctcagggccgcgcgtatgggaatttgggcaatactcattatctgctcggaaactttaccgaagcaactacctttcacaaggagcgcctggcgattgctaaggaatttggagataaggccgctgagcgtcgagcctatagcaatctcggcaacgcacacgtctttttagggcgattcgacgtggcggcagagtactacaagaaaacactacagctgtccaggcaacttcgcgatcaagccgtcgaggcacaggcatgctattctctgggtaacacgtatactttgctgcaagactacgagagggcagctgaataccatttaagacacctgctgattgcccaggaactggccgacagggtgggggagggtcgggcgtgttggtccctggggaatgcctatgtctcaatgggccggccggctcaggctctgaccttcgctaagaaacacctccagatcagccaggagattggtgatagacatggggaacttactgctcgaatgaacgtggcacagcttcagcttgtgctaggccgcctgacctctcccgccgcctctgagaagcctgatctagcaggctacgaagcgcaaggagagttccaaggctgcggcggtgtgctcctaccaaccggaacagataggatccgctcctgcggaggtgtgggctcgcgacctggccagcatgggggtggggggtcacgtcagaagatggcacctacctcacaattctttctggcctcaggaacagcacaggcttag

SEQ ID NO: 42629 - DNA, 501 bp, Artificial Sequence
  Description of Artificial Sequence: Synthetic coding sequence
atggacgaccagcggtgccccctggacgacggccaggccggcgccgcagaggccacggcagctcccaccctggaagaccgaatagctcaaccctcaatgacagcctcacctcagaccgaggagttttttgacttaatcgcatccagtcaatcacgtaggctggacgaccagagagcatccgtcggcagcctgccgggtctgaggatcactcatagcaatgcgggacacctcagaggacatggcgaaccacaagagccgggtgacgacttttttaacatgctgattaagtatcaaagcagtcgcatagatgaccagcgatgtcctcccccagacgtccttcctcgcggcccaactatgccggacgaggacttcttctctttaattcagcgggtgcaggccaaacgtatggatgaacagcgcgtcgacttagccggcgggccggagcaaggcgcaggaggcccacccgagccccagcagcaatgtcagcccggcgcgagttag

SEQ ID NO: 42630 - DNA, 2028 bp, Artificial Sequence
  Description of Artificial Sequence: Synthetic coding sequence
atggccggccccgccccccccgtggccgacgagctgcccggccccgcagccaggagactttacagtcgcatggaagcgtcctgcctggaattagctcttgaaggcgaaagactgtgcaaagcaggcgattttaagacaggggtggcatttttcgaggctgctgtgcaggtggggacggaggatctcaaaacacttagtgcaatatactctcaactgggtaacgcctatttctacttgaaagaacatggacgtgcactggaatatcacaagcatgaccttctcctcgcaaggaccattggcgaccgtatgggggaagcgaaagcaagcggtaacctcggcaataccttaaaggtcttgggccggtttgacgaggccgccgtgtgttgccagagacacctcagcattgcccaagagcaaggcgacaaagtgggggaggcccgcgcgctctataacatcgggaatgtgtaccacgccaaggggaaacagctctcctggaatgcggcgaatgcaacccaagacccaggacatctgccccccgatgtgcgggagacactgtgtaaggccagtgaattctacgaacggaacctgagtctggtaaaagagctgggagaccgcgccgctcaaggccgggcctacggaaatctgggaaatactcactacctgctgggcaactttactgaggcgactactttccacaaggaacgcttggccattgccaaggagttcggggataaagctgccgagagacgcgcctactctaacttgggaaacgcacacgtgtttctggggcgatttgatgtggccgcagagtattacaagaaaaccctgcagctctctcggcagctgcgtgaccaggccgtggaggcccaagcctgctactctctgggaaacacatataccctcctccaggactatgaacgggcggctgaataccatttgcgccacctgctcattgctcaggagttggcagatcgagtgggagaaggccgcgcatgctggagtttggggaatgcctatgtcagcatgggcagaccagctcaggctcttacttttgctaagaagcatttacagatttcacaagaaataggcgatcggcatggggagttaactgcaaggatgaacgtcgcacagctgcaactcgttctgggacgtcttacatcgcccgccgcgagcgagaagcctgatttagcgggatatgaggctcagggtgcgcgaccaaaacgcacccagcggctgtcagcggagacatgggacctgcttaggctccccctggagcgagagcagaatggagacagtcaccattcaggggactggagggggccaagcagggactctctgcccctgcctgtgaggtcacgtaagtatcaggaagggcctgatgcggagagaagacccagagagggatctcactctccgcttgacagcgctgacgtccgcgtgcatgtgccacgcacctccattccccgggcaccgtcctccgatgaggagtgcttctttgacctgctgacaaagtttcagtcctccagaatggatgatcagagatgtccactcgatgacggacaggctggagctgccgaggcaactgccgcgccaactctggaggacagaatcgcacagccctcaatgaccgcctcccctcagacagaggaattttttgacttgatagcctcttctcagtctaggagactcgatgatcaacgggcctccgtgggtagtctcccaggactcaggatcacgcacagcaatgcgggtcatctgcgggggcacggagagcctcaagagcctggtgacgacttctttaacatgcttatcaaataccaaagctcacgcattgacgatcagcggtgcccaccgcccgacgtccttccgaggggacccaccatgccagacgaggattttttctccctaatccagcgggttcaggccaaaagaatggacgaacaaagggttgatctggctggaggccctgagcagggtgctggcggcccacctgaaccacagcagcagtgccagcctggggcctcttag

SEQ ID NO: 42631 - DNA, 2175 bp, Artificial Sequence
  Description of Artificial Sequence: Synthetic coding sequence
atgttcgacaccaccccccacagcggccggagcacccccagcagctcaccatccctgcggaagcggctgcagctcctgccaccctcaagaccccctccagagcctgagccaggtaccatggtggaaaaagggtcggactctagctcggaaaagggcggcgtaccgggcacaccgtccacccaaagcctgggctctcggaacttcatacgaaactcaaagaagatgcaatcatggtacagtatgttatcaccaacttacaagcagcggaacgaggatttccggaagcttttcagtaagctacccgaggctgaaagattgattgttgactatagctgcgccctccagagagaaattctactacagggaagactttatctgtccgagaattggatctgtttctactcaaatatcttcagatgggaaactacaatctcaatccaactaaaagaggtaacatgtctcaaaaaggaaaagaccgcgaaactcatccctaatgccatccagatctgtactgaaagtgagaaacacttttttacatcatttggtgcaagggataggtgttttctgctcatcttccgcttgtggcaaaacgcgctcctggaaaaaaccctcagccctcgggagctctggcacctggtgcaccaatgctacggatcggagttgggtttgaccagcgaggatgaagactatgtcagcccactccagttgaatgggctcgggactccaaaagaggttggagacgtgatcgcactcagtgatattaccagtagcggcgccgctgacagaagtcaggaaccatctcctgttggatcacggagaggacatgtcacacccaacttgagtcgagccagttccgacgctgatcacggggccgaagaagacaaggaagagcaagtcgattcccagcccgacgcatcctcttcacaaacagtcacccctgtcgcggaaccaccatccaccgagccgacacagccagatggacccaccaccctgggacccctcgaccttctcccttctgaagagctgctcacagatacatctaactcaagctcaagtacaggagaagaggctgatttggctgccctgcttccagacttgtccgggagacttctgataaactcagtcttccacgtgggcgctgagcggttacagcagatgttgttcagcgactctccctttctccaggggtttctacagcagtgcaagttcacagacgtgaccctatccccctggtcaggtgatagcaagtgtcatcagcgccgagtgctgacatacaccataccaatctctaacccactcggccctaaatcagcctcagtggttgagacccagaccttattccggcgagggccacaagctggaggatgtgtagtagattcagaagtcctcacgcaaggcattccctaccaggattacttctacacagcccatagatattgtatattgggcttagcccggaacaaagccagacttagagtttcttccgagatcaggtacaggaagcaaccctggtccctggtcaagtcattgattgaaaagaactcctggtctgggatcgaggattactttcatcacttagagagagagttagctaaggccgaaaagctgagcttagaggagggtggcaaggatgccagaggactgcttagtgggcttagacgaagaaaacgaccgttgagttggcgcgcacatggggatggcccacagcatccagacccggacccttgtgcaagagccgggatccatacgagtgggagtctttcatcgcgtttttctgagccatccgtggaccagggacccggggctgggatcccaagtgccctggtgttgataagtattgtcatttgtgtatcactgataatactgatcgccctcaacgtactgctgttttaccgactttggagtttagagaggacagcccacactttcgaatcttggcacagcctggccctggcaaagggcaagtttccacagacagccacagagtgggcggaaatcctcgccctacaaaagcaatttcactctgtggaggtccataagtggcgccagatactgagggcctcagtggagctgctggacgagatgaaattttcattagagaagcttcatcagggtattaccgtttcagacccccctttcgatacacagcccagaccagatgacagcttttcctag

SEQ ID NO: 42632 - DNA, 2142 bp, Artificial Sequence
  Description of Artificial Sequence: Synthetic coding sequence
atgttcgacaccaccccccacagcggccggagcacccccagcagcagtccttctctgcggaaacgactgcaactgctgccacctagccgtcccccccccgaaccggagccagggactatggttgaaaagggaagcgatagctcctccgaaaaggggggcgtcccagggactccgtccactcaatccctaggctcacggaacttcatcaggaacagtaaaatgctgagccctacttataagcagagaaacgaggacttcaggaaactgttcagcaagctgccggaggcagaaaggctaatcgtggactattcctgcgctttacaacgcgagatccttttacaaggacgcctctatctgtccgaaaattggatatgtttctatagcaatatttttaggtgggaaactaccattagcattcagttgaaagaggtgacatgcctcaaaaaggaaaaaacagctaaactgattcctaatgcaattcagatttgtacagaaagtgagaaacattttttcacttcttttggtgctagagatcgctgctttctgctgatctttcggctgtggcagaacgctcttctcgaaaaaactctcagtccccgggaattgtggcacctggtgcatcaatgttacggcagtgaacttgggcttacgtctgaagatgaagattacgtgtctcccctccagttgaacggcctcgggactcccaaagaggtcggcgacgttatcgcgctgagtgatatcactagtagtggcgccgctgaccggagtcaagagccttccccagtgggatcaaggcgggggcatgtcacaccaaatctgtcacgggcctcatcggacgcagatcatggagccgaggaggacaaggaagaacaggttgactcacagcctgatgcctcttcatcccaaaccgtgaccccagtggcggagcccccttctaccgagccgactcagcccgacgggcccaccactctcggacctctggatctcctcccatccgaagagctcctgacggacaccagtaattcctccagctcaacaggtgaagaggcggacctggctgcactcctcccagacttgagtggcaggctgttgatcaattccgtcttccacgtgggcgcggagagactgcaacagatgctcttcagtgactcacctttcctgcaggggttcctccaacaatgtaagttcactgatgtcactttaagcccgtggagtggagattctaagtgtcaccagcgcagagtgctgacatatacaattccaattagcaatccattggggcccaagtctgcctcagtagtcgaaactcagacactattccggcgcgggccacaggctggaggctgtgtggtggactccgaagtattgacacagggtattccctaccaggattacttctatacagcacaccggtattgcatattaggtctggctcgtaataaggcacgccttagagtgtccagcgaaataagataccggaagcagccctggtcccttgttaagagtttaatcgagaaaaactcctggtctggaatcgaagactactttcatcatctggaaagagagctcgctaaggcagagaaactgtccctcgaggagggtggtaaagacgcccggggtctgctgtctggactgaggcgcaggaagcgacctctgtcctggagagcccacggcgacgggccccaacatcccgacccggacccatgtgccagggccggaatccacaccagcgggtctctctcatcgcggtttagcgagccgtccgtcgatcagggccctggggccggcataccttccgccctagtgcttatatcaatcgttttgattatcttgattgccttgaatgtcctccttttttaccgtctctggagtttagagagaaccgcacatactttcgaatcatggcatagtctagcgctggcgaaggggaagttcccacagaccgctactgaatgggctgaaatattagcgctccaaaagcagttccattcggtcgaggtccataagtggcgccagattctgagagcctctgtagaattactcgacgaaatgaagttctcacttgagaagctgcatcagggtattactgtcagtgacccacccttcgatacacagcctagacctgatgattccttctcctag

SEQ ID NO: 42633 - DNA, 2421 bp, Artificial Sequence
  Description of Artificial Sequence: Synthetic coding sequence
atggacgacgtgctgcccctgatgccctgggagaccctgctggcccaaggttctccacaggggagcccggaccttcccgctgggcagagaaaacagcagccccaaggtgaccgagcccagggccttgcatcagagagctggaagctgcttgaagtgcctatcatacacattaccccgtcatcggatggcgagtctccagcttgcacgcccacacctagaaggcggcagcagcagcgtatgcctgatccgcaatcgctgtcccaggattcgaccacacctcactccgggaggagcactcctagcagttcaccctcactgcgaaaacggttgcaattgttacccccatccaggcctccgcctgagcccgagccggggacaatggtggaaaaaggcagcgactcttcctcagagaagggcggagtgcccggcaccccgtccactcagagcctgggatccagaaattttatacgtaatagcaaaaagatgcagtcttggtactctatgcttagccccacttacaaacagaggaacgaagactttcgtaagctgttcagtaaactgccagaggctgaacggctgatcgtggactactcgtgtgccctccaaagagagatcctcctccaagggcggctctatttgtcggaaaattggatctgcttttattccaacattttccggtgggaaaccaccatctcaattcagttgaaagaagtaacctgcttgaaaaaagagaagacagccaagttgatcccgaacgcgatccagatctgcaccgaatctgagaaacatttctttaccagcttcggagctcgagaccgatgttttctgctcattttccgtctttggcagaatgcgcttcttgaaaagaccttgtctcctagggagctgtggcatctggtccaccagtgctatggttctgagcttggccttacaagtgaagacgaagattacgttagccccctacagttaaatggcctgggcacccccaaggaggtgggtgatgttattgcgttgtcagatatcacttcttcgggcgcggctgatcgctctcaggaaccatcacccgtgggatccaggaggggccacgtcaccccaaatctcagcagagcctcttctgatgcagatcatggagcggaggaggacaaagaggagcaggtggattcccaaccagacgccagtagttcccaaacagtgaccccagtggccgaacctcctagcacagagcccacccagcctgacgggccgactacactcggccccttggacctgctcccatccgaagaactcctgacagacaccagcaatagctcctcctctaccggcgaagaagacctggccgcacttctaccggatctatcaggccgattgctgatcaacagcgtctttcatgtgggcgccgagcggctccagcagatgctgtttagcgattcaccattcctgcagggcttcctgcagcagtgcaagttcactgacgtgaccctgtctccttggtccggcgacagcaaatgtcaccagcgcagagtactgacgtacaccatccctatttccaaccccttaggaccaaagagtgcatccgttgtggaaacacagacactgtttaggaggggcccccaagccgggggctgcgtcgtggactcagaagtgcttactcagggtattccatatcaagactacttttacaccgcccaccgatactgcattctaggacttgcgagaaataaggccaggctgcgggtgtcaagtgaaattcggtaccgaaagcagccatggtcccttgtcaagagcttgatcgaaaagaactcgtggagcggcattgaggactatttccaccatctcgagagagagttggctaaggcagaaaagttatccctcgaggaaggtggaaaggacgcccgagggctgctgtcgggcctacgccggcgcaagcgaccgctgagctggcgggcacacggcgacggccctcagcaccctgacccagatccctgcgccagagccggaatccatacttcaggcagtctgtccagtcggttttcagaaccgagcgtggaccaggggcctggagccgggataccgtctgcacttgtattgatctcaatcgtgttgataatacttatagctttaaacgtgctgttattctaccgcctttggagcttggagcgcacagcccataccttcgagagctggcactcccttgcccttgcgaaggggaagttcccccagactgcgaccgaatgggccgagatcctggcgttacagaagcagttccactccgtggaagtgcacaaatggcggcagatcctccgcgctagcgtggaactgctcgacgagatgaagtttagcctggaaaagctgcaccagggaatcacggtttccgaccccccattcgacacgcagccccgccccgatgacagctttagttag

SEQ ID NO: 42634 - DNA, 1461 bp, Artificial Sequence
  Description of Artificial Sequence: Synthetic coding sequence
atgcactgcctgaagcggacccccaaggaggtgggcgacgtgatcgcactgtccgacattactagctctggcgcagcggatcggtcacaagagccaagccccgtcggctcaagaaggggtcatgtcacccccaatctttctcgggctagtagcgacgcagatcacggagccgaggaagataaagaagagcaggtggactcccagccggacgcatcgtctagtcagaccgtgacccccgtagccgagcccccatctaccgaacccacccaaccagatggcccaactactctgggccccctggatttacttcccagtgaagagctgttgacggacacctccaatagttcttctagcactggtgaagaagctgacctcgccgcactcctgccagatctttctgggcggctgctgattaacagtgttttccacgttggcgctgagcgcttgcaacagatgctcttctccgattctcctttcttgcaggggttcctccagcagtgcaaattcactgacgtcacgttatcaccttggtctggcgattcaaaatgtcaccagagacgggtcctgacctacactatccctatatccaacccactggggccaaagtccgcgtctgtggtggagacgcagacattgtttaggagaggcccccaggcgggcgggtgcgtggttgatagcgaggtgctgacgcaaggcatcccataccaggactatttctatacggcccataggtattgtatcctggggctggcccggaataaagcacggcttcgcgtttcttccgagatccgctaccgtaagcagccatggagccttgtcaagagcctcatcgaaaaaaactcttggagcggtatcgaggattattttcaccacctggaaagggagctggccaaggccgagaagctttcattggaggaaggtgggaaggatgcaagggggctactaagtggtctgcggaggcgcaaaaggcccctgtcctggagggcccacggagatgggccacagcacccggacccagacccctgcgcccgggccggcatacacacctccggtagtctgtcatcaaggttttcagaaccaagcgtggatcaggggccaggtgctggtatcccttccgctctcgtcctgattagcattgtactgatcatactgattgccctcaatgtgctgctcttttacaggttgtggtccctggagcgaaccgcacacaccttcgagagttggcattcccttgcattagcgaagggaaaatttccccagactgcaaccgagtgggcagagattttggctcttcagaaacagttccactccgtggaagtgcataaatggcgtcaaattctccgcgcatcagtggagttgcttgacgaaatgaagttcagcctggagaaactccatcagggaattaccgtgtccgaccctcctttcgacacacaacccagacctgatgactcattctcatag

SEQ ID NO: 42635 - DNA, 2217 bp, Artificial Sequence
  Description of Artificial Sequence: Synthetic coding sequence
atgaagggcttcaagctgagctgcaccgccagcaacagcaaccggtctacccctgcgtgtagcccaatcctccggaagcgctctcggtcccctacgcctcaaaatcaggacggcgacactatggtcgagaagggttctgaccattcatcggacaagtctccctcaacacccgagcagggggtgcagcggtcgtgcagttcacaatctggtaggtccgggggcaaaaattctaaaaagagccaaagctggtataatgtcctttcgcccacctataaacagaggaatgaggattttaggaagttgtttaaacagcttcctgacaccgagaggttgatcgtggactactcttgtgccttacagagagatatcctcctacagggacgtctgtatctctccgaaaactggatctgtttctactccaacatctttcgctgggagaccctgctgaccgtgcggctgaaggatatctgcagtatgaccaaggagaagactgcccggctgatccctaatgcaatccaggtatgcactgattcagagaagcattttttcacgtctttcggtgcccgagacaggacatacatgatgatgttccgcctgtggcagaacgcactgctggaaaaacccctgtgtcctaaagaactgtggcattttgtgcatcaatgctacgggaatgagctgggcctgaccagcgatgatgaggactatgtccctcccgacgatgatttcaacaccatgggctactgcgaggaaatccctgtcgaggaaaacgaagttaatgatagctccagcaaatcttcgatagagactaagccagatgcctccccacagctccccaagaagtcaattaccaactcgacactcacttccaccgggtcctccgaagcccctgtgagtttcgatgggctacctctggaagaagaggcactggaaggagacggatctttggagaaggagttggctatagataatataatgggcgagaaaattgaaatgatagcccctgtgaattccccgtccctggacttcaatgataatgaagatatcccgacggaattgagcgactcttcggatacgcacgacgaaggggaggtgcaggccttttacgaggacctgtccggacgccagtacgtgaacgaggtctttaatttttccgttgacaagctgtacgacctgctcttcaccaactctcctttccaacgggacttcatggagcaacggcgcttttcagatataatctttcatccctggaagaaggaagagaacgggaaccagagtagagtgattctgtacacaattactcttaccaatccgctggcgcctaagacagccaccgttagggagacccagaccatgtacaaagcttcacaggagtctgagtgttacgtcatcgacgcggaggtgcttacacacgacgtgccatatcatgattatttctataccatcaaccgatacacccttacacgggtcgctcgaaacaaatcccggcttcgggtttcgacagagttacgctatcggaagcagccgtggggcctcgtaaagacttttattgagaagaacttttggagtggtttagaagattacttccgtcatcttgagagtgagttggctaaaacagaaagtacatacctcgccgagatgcacagacagtcacccaaagaaaaggcttctaagactacgactgtaaggaggcgcaagcgccctcacgcccacctaagagtgccacatcttgaggaggtaatgagtcccgtaacgacgcccactgacgaggatgtgggacacaggattaagcatgtcgctggaagtacccaaacccgccacattcccgaggacacacctaacggatttcacctgcagagtgtgagcaaactcttactggtcatctcgtgcgtcgtgagctttagcctcgtgctgcttgtgatcctgaatatgatgctattctacaaactctggatgttggagtatacaacccagaccctgacagcttggcaaggattacggcttcaggaacggctgccccagtcacagaccgaatgggcccaactccttgaatctcagcagaagtatcacgacacagagcttcaaaagtggcgggagattatcaagagttccgtgatgctcttggatcagatgaaagactctctcataaacctgcaaaatggcattcgtagtagggattatactagtgaatcggaagagaagcgaaaccgctaccactag

SEQ ID NO: 42636 - DNA, 2217 bp, Artificial Sequence
  Description of Artificial Sequence: Synthetic coding sequence
atgaagggcttcaagctgagctgcaccgccagcaacagcaaccggtcaacacccgcttgttcacctatactgcgtaaaaggagtcgaagtccgacccctcagaaccaggacggcgatacgatggttgagaaagggagtgaccactcgagtgataaatctcccagtactcccgaacagggtgtgcagcggtcctgttcttcccagtccggccgatcagggggcaaaaacagtaaaaagagtcagtcgtggtataacgtgttgtcccctacttacaagcagaggaatgaagacttcaggaaacttttcaagcagctgcccgacaccgaaaggcttatcgtggactattcgtgcgccctgcaaagggacattcttctgcagggcagactatatctgtccgaaaattggatctgcttttacagtaacatcttcagatgggaaacgctcctaacagtgaggctcaaagatatctgcagcatgacaaaggaaaaaaccgcgagactgattcctaacgcgatccaggtgtgcacagatagtgaaaagcacttttttacaagcttcggggcacgcgacagaacctatatgatgatgttcaggctatggcagaatgctctgctcgaaaagcccctgtgtccaaaagaattgtggcactttgtgcaccagtgctacggcaacgagttgggcctcacatccgacgatgaagactatgtgcctccggacgacgattttaacaccatgggctattgcgaggagatcccagtcgaggagaatgaagtgaatgattcttccagtaagtcctcaatagaaacaaagccggatgcaagcccccagttgcccaagaaaagcatcaccaattccacactaacatctactggaagctcggaagcccctgtgagcttcgatgggctgccattggaagaggaggcacttgagggcgatgggagtttagagaaggaactggccatcgataacattatgggggagaaaattgaaatgattgcaccggttaacagtccatctctggattttaacgacaacgaggatatcccgacagagctctcagacagctccgatactcatgatgagggtgaagtccaagctttctatgaggacctcagtggccgtcagtatgtaaacgaggtatttaatttctccgtcgacaagctttacgatctgctctttacaaactccccatttcagagagattttatggagcagcggcgcttttccgatatcatattccatccttggaagaaagaggaaaacgggaaccagtccagagtaatactctacaccataacactgacgaatccattggcgccaaagactgctactgtgcgggagactcagacaatgtacaaggctagccaggaatctgagtgctatgtgattgacgccgaggtgctgacacacgatgttccctaccatgattacttttacaccataaaccgttatactttaacccgcgtggctcgtaacaagtccaggttgagggtgtcgacggaactgcgctacaggaagcagccatggggcttagtaaagacattcatagaaaaaaatttctggtcaggtttagaggactactttcggcacctggagtcagagctagcaaagaccgaatctacttatctggccgagatgcataggcagtcaccgaaggaaaaggccagtaagacgactaccgtgagacgccgtaaaagaccgcatgcccaccttagggtgccccacctagaagaggtcatgagcccagtcaccactcctaccgatgaggacgtaggccataggatcaagcacgtcgcggggtccacacaaaccagacacatacctgaggatacgcccaatggctttcacctgcagtccgtatcaaagctcctgctagtcatctcctgcgtgatctgcttttcacttgtcttactcgtcattctaaatatgatgcttttttacaaactatggatgttagagtacactacccagacccttaccgcctggcagggccttaggcttcaggaacgcctgccacagagccaaactgaatgggcgcagctcctggagtctcagcagaaataccacgatactgaactgcagaagtggagggaaattattaagtctagcgtcatgctgctggatcagatgaaggactccctgatcaatctgcagaatgggattcgatcccgcgactacaccagcgagagcgaagagaaaagaaaccgttaccactag

SEQ ID NO: 42637 - DNA, 2238 bp, Artificial Sequence
  Description of Artificial Sequence: Synthetic coding sequence
atgaagggcttcaagctgagctgcaccgccagcaacagcaaccggagcacacccgcctgctctccaatcctgaggaaacggtcccggagtcccactccccagaaccaggatggcgacacaatggtcgagaaaggcagcgatcactcatcagataagagcccttccactccagaacagggggtgcagaggagctgcagcagccagtcaggtcgctcgggtggtaagaacagcaagagtcacaagaggttaagcaagaaatcacagtcgtggtataacgtgctgagccctacatacaagcagagaaacgaggatttccggaagctgtttaaacagcttccggataccgaaaggctgattgtggactatagttgtgctctgcaaagggatattctactgcagggtcggctgtatttaagcgaaaactggatctgcttttactctaacatctttcgatgggagaccctattgacagtgcggctcaaggatatctgttcaatgacgaaagagaaaacggcccggctgatccctaacgcaatccaggtgtgcaccgacagcgagaagcatttctttacctctttcggagcgagggacaggacctacatgatgatgttccggctgtggcaaaacgcgctgctagaaaaacctctttgccctaaggagctgtggcatttcgtacatcagtgttacgggaacgagctgggcctcaccagtgacgacgaggattatgtgcctcccgatgatgattttaataccatggggtactgtgaagagattccagtggaggaaaacgaagtgaatgactcgtcatcaaagagttccatagagacaaagcctgatgcatctccccagctcccaaaaaaatccattaccaactctaccctcaccagtacaggctcatccgaggctcccgttagcttcgacggccttccactggaggaagaagccctcgagggcgatggcagcctggaaaaggaactggcgatcgataacataatgggcgagaagatcgaaatgattgcgcctgtgaactccccttccctagactttaacgacaatgaggatatccctactgagctgtcggattctagcgacacgcatgacgagggtgaggtgcaggccttttatgaagacctaagcggacgtcagtacgtcaacgaagtctttaacttctctgtggacaagctttatgacctgctgtttacaaactcaccattccagcgagatttcatggagcaaagacggttctctgatattatttttcacccatggaaaaaagaggaaaatggcaatcagagcagagtgatcctatataccatcacccttactaaccccctggcacccaagaccgccacagtcagggagacccagaccatgtacaaagcttcacaggagtccgagtgctacgtgattgatgccgaagtgctgacccatgatgtcccatatcacgactacttttataccattaatcgctacaccctgacacgagttgcccgcaacaagtcccggttacgggtcagcactgagctgcggtaccggaagcagccctggggactggtgaagactttcatcgagaaaaacttctggagcggcctggaagactattttaggcatctggaatccgaactggcgaagacagagagcacctatttggccgagatgcatcgccagagccccaaggagaaagccagcaaaacgaccactgtgaggcgaaggaaaaggccccatgctcatctcagagttcctcacctggaagaagtgatgagtcccgtgacaactccaaccgatgaagatgtgggacacagaataaagcacgtagcagggtccacccaaacacggcacatacccgaagacacgcccaacggtttccacctccagagtgtgagtaagctgctgctcgtcataagttgtgtggttagtttctcactcgtcctattggtgatcctgaacatgatgctgttctacaagctctggatgctagagtacactactcagacgctgaccgcgtggcaaggcttgcggctgcaggaacgcctccctcagtctcagacggagtgggcccagctgttggaaagtcaacaaaagtatcatgacacagaactgcaaaaatggcgagaaattatcaagagttctgtgatgctgctcgatcaaatgaaagattctctaatcaatctgcagaatgggattagaagcagagactacacttcagagagcgaagaaaagcgcaataggtaccattag

SEQ ID NO: 42638 - DNA, 1989 bp, Artificial Sequence
  Description of Artificial Sequence: Synthetic coding sequence
atggagggcgcccccaccgtgcggcaggtgatgaacgagggcgactcctcactcgctacggatctgcaggaagatgtcgaagagaacccatcccccaccgttgaggagaacaacgtggtagtcaagaagcagggtccgaatctgcacaactggtcaggcgattggtctttctggatctcatcaagtacgtataaggacaggaatgaggagtaccgccgccagtttacacatctacctgatacagaacggcttatagccgattacgcctgcgccctgcagcgggacatcctgttgcagggacggctgtacctgagtgaaaactggctgtgtttctactctaatatctttcgatgggagaccactatctctattgccctcaagaacattacatttatgactaaggaaaagactgccaggctgatccccaatgcgatccagatcgtaaccgagtctgagaaattctttttcacttccttcggagccagagatcgatcctacctgtcaattttccgactctggcagaacgtattactggataagtcactaacccgccaggagttctggcaactcctccaacagaattatggaaccgagctgggattaaacgcggaagaaatggagaatctgtcgctgtctattgaagacgtgcagccgcgctcccccggtagatcgagcctggatgatagcggcgagagggacgaaaaactctccaagagcatttcgttcaccagcgagagcataagccgcgtcagcgagaccgaatccttcgacggtaacagtagcaagggtggactcggcaaagaggagtcccagaatgaaaaacagactaaaaaatccttgctcccgactctggagaaaaagctgactagggtgccctcaaagtctctggatttaaataagaacgagtacttgtctttagacaagtcatccacctccgattcagtagatgaggagaatgtgcccgagaaagatctccacggacggctgttcattaaccggatatttcacatctcggcggatcgaatgtttgagcttctgtttacatctagtaggttcatgcagaagttcgcgtcatcccggaacataatagatgtagtgtcaaccccctggaccgctgaactcgggggagatcaattaagaaccatgacttatacaattgtgctgaatagcccgttgaccggcaagtgtacagcagctaccgagaaacagacgctctataaagaatccagggaggcccggttttatttagtggattccgaagttttgacccatgatgtaccatatcatgactatttctataccgtgaacagatactgtattatacgttcaagtaaacagaaatgcaggctgcgcgtgtccaccgatttaaagtatcgcaaacagccatggggcctagtaaagtcactgatcgagaagaatagttggtcctctctggaagattattttaagcagttagaatctgacctgttaattgaagaaagcgtcctgaaccaggcaattgaggaccctggcaagctcaccgggctgagacggagacgtcgtacattcaacagaaccgccgaaacagtgccaaagctgtcttcccaacatagcagtggcgacgtgggactgggggccaaaggggatatcacaggcaagaagaaggagatggagaactacaacgtcaccttgatcgtggtcatgtccatctttgttttactgctcgtgttgcttaacgtcacgctgttcctgaagctgagtaagatcgagcacgcagcccagtccttctatcggctgagacttcaggaggaaaagagtctgaatctggcttcggatatggttagcagagcagagacgattcaaaagaataaggaccaagctcacagattgaagggtgttcttagggattctatcgtcatgctagagcagttaaaaagcagcttgatcatgctccagaaaactttcgacctgcttaataaaaataagacaggaatggcggttgagtcatag

SEQ ID NO: 42639 - DNA, 1374 bp, Artificial Sequence
  Description of Artificial Sequence: Synthetic coding sequence
atggagaacctgagcctgagcatcgaggacgtgcagccccggagccccggacggtccagtctcgacgactccggtgagagggacgaaaagctgtccaagagcatttcattcacaagtgagtccatctccagggtctccgagacagaatcctttgatggaaacagcagcaaaggtggcctaggcaaagaggagagtcaaaatgaaaaacagactaagaaatctttgctgcctaccctggagaagaagcttactagagtgcccagtaaatcccttgatctgaataagaacgagtatttgtccctggataaaagctccacatccgactccgtcgatgaagagaacgtacctgagaaagacctgcacggtcggctgtttataaatcgtattttccatatttccgccgatagaatgttcgaactcttattcactagcagcagattcatgcagaagttcgccagttcccgaaatatcatcgacgtagtgagcaccccttggacagctgagctcggcggcgatcagctgaggacgatgacatacaccatagttctcaactctcccctcaccggcaagtgtacagctgcgacagagaaacaaaccttgtacaaagaatcgcgggaggcccgcttttatttggttgattctgaggtactgactcatgatgttccttaccacgattacttctatactgtgaaccggtattgtatcatcaggagttctaagcagaagtgccgcttacgtgtgtctacagatttgaaataccgcaaacagccctgggggttagtaaagtctctgattgaaaaaaatagctggagttctctggaagattactttaaacagttagaatccgacttactcatcgaggagtccgtgttgaaccaggcaatcgaggacccaggtaaattgactggtctgagaagacgcaggcgaaccttcaaccgcaccgctgagacagtccctaaactgtcctcacagcactccagtggcgacgtggggctgggggccaagggagatatcactggaaagaagaaagaaatggagaactataatgtgactttgattgtggttatgtccattttcgtgcttcttcttgtgctgctgaacgtcaccttgtttcttaaactgtctaaaatcgagcatgccgcacaatccttctatcggctcaggctgcaggaggaaaagtccttgaatctggcctcggatatggttagtagagccgagacgatccagaagaacaaggaccaggcccaccgactcaaaggcgttctaagagattccatcgtgatgcttgagcagcttaaatcatctctcatcatgctgcaaaaaactttcgacctactgaacaagaataagaccggcatggccgtggagtcatag

SEQ ID NO: 42640 - DNA, 1176 bp, Artificial Sequence
  Description of Artificial Sequence: Synthetic coding sequence
atgaacatcttcctgtggaccaaggccgccctgcagatcctgctgatgaaatacgccgctggccacggactcgtcatcaggtgccttcctgagttccgaaccctgggcaggtccacactggccccatctggacagatagagaacgttcctgaaaaggatcttcacgggcgcctgttcatcaacagaattttccacatctctgccgaccgcatgtttgaactgctgttcacgagctccagatttatgcaaaaatttgcgtcttccagaaacattatcgatgttgtgagcacaccttggacagcggagttgggtggtgaccagctacgcacgatgacatatacaattgtgctgaattcccccctcactggaaaatgtaccgcagctacagagaagcagaccttgtacaaagagtcacgcgaggcccgcttctatttagtggactcagaggtgctcacccacgacgtcccctatcatgactatttttacaccgtcaataggtactgcatcatccgttcaagtaagcagaaatgccgcttgcgggtgtctaccgatctgaagtacagaaaacagccctggggactggttaaatcactgatagagaagaactcttggtcctctctggaggactattttaagcagttggagtcagacctactgattgaagagtcagttttgaatcaagcaatcgaagatcctggcaagcttaccggactccggagacgacggcggacctttaacaggacggccgaaacagtgccaaagctatcctcacagcattccagtggtgacgtgggattgggcgcaaaaggagacattaccgggaagaaaaaagagatggaaaactataatgtgaccctgattgtcgtgatgagcatcttcgtcctactgctggtgctcctaaatgtgacactgttcttgaagttaagcaaaatcgagcacgcagctcagtctttttatcgactccgtctgcaggaggaaaagtccctgaacttagcgtctgacatggtgagccgagctgagactattcaaaaaaacaaggatcaggcgcacagacttaaaggggttctccgtgactctatcgtcatgttggaacagctgaagtcatcactgataatgctgcagaagacctttgacctgcttaataagaacaagactggaatggcagtcgaatcatag

SEQ ID NO: 42641 - DNA, 1143 bp, Artificial Sequence
  Description of Artificial Sequence: Synthetic coding sequence
atggagaacctgagcctgagcatcgaggacgtgcagccccggagccccgggaggtcaagccttgatgactcaggcgagcgggacgagaagctatccaaatcgattagttttaccagtgaaagtatctctagagtctcagagacagagtcatttgacgggaatagctccaaaggcgggctcggaaaagaggaatctcagaacgaaaaacagaccaagaagagcctgttgcctacactcgagaaaaagctcacaagagtaccctctaaaagcttggacctcaacaaaaatgaatacttatccttagataagtccagcacctctgacagcgtcgacgaggagaatgtccccgaaaaggacctgcacgggaggctgttcattaatagaatctttcacatctctgcagatcgcatgtttgaacttctgttcacgagtagcagatttatgcagaagtttgcttcatcaaggaacattatcgatgtcgtgtccactccatggacagctgagctcggcggggaccagttaaggactatgacttataccattgtgctgaacagtcccctgacaggcaagtgtactgccgctaccgaaaagcagactctatataaggaatccagagaagcaaggttttacctggtggacagtgaggtgctgactcatgatgttccctaccatgactacttctacactgtcaaccggtattgcataatcagatcatctaagcagaagtgtaggctgcgcgtctctaccgacctgaaatacaggaagcagccctggggattagttaagagcctgatagaaaaaaactcttggtcctccttggaggattactttaagcaattggaaagtgatcttctgatagaggaatccgtgctgaaccaggcaatcgaggacccaggcaagctgaccggtttaagaaggcggcgccgcaccttcaatcggactgccgagacggttcccaagctgtcatcacagcacagtagcggggatgtcgggctgggtgctaagggcgacatcacagggaagaaaaaggagatggaaaattacaacgtgactctgattgtggtgatgtcaattttcgttctgctccttgtccttttgaacgttaccctgttcttgaagctttctaagattgagcacgcttag

SEQ ID NO: 42642 - DNA, 1065 bp, Artificial Sequence
  Description of Artificial Sequence: Synthetic coding sequence
atgaccgccctgagccggagcgaggccaccgaggagggcggcaaccagcagatgcaccgtaaaaccgcatctctaaacagtccagtgagttgtaaggagaaacccgatagggtggaagaacctcccgattacagtcttcattggcccgaaggcttgaagggcgaagagatcaaaaagtgtggcagagaggggatcaccctgaacaaatacaaccaacagtatcataagctgttcaaagacgtccctttggaggaagttgtcctgaaagtgtgctcttgtgcgttacagcgagacttcttactgcaggggaggctgtatatttcccctaactggctttgcttccacgccagcctgttcggcaaggacattaaggtcgttatccctgtcgtgtccgtgcagatgattaaaaagcataaaatggcgaggctcctccccaacggcctggccatcaccactaatacgtctcaaaagtacatcttcgtgtcattactaagccgggattccgtgtacgacctgttgaggcgggtgtgtactcatctgcaaccaagctctaagaaatctctgagcgtaagggaattcagtggggaaccagagtctctggaggttctaattccggagatgaaatggagaaaggtgtgcccctccagtcgtagcctttcactgccagacaacattccatgtattccaccaagctcagtcgacagtaccgactcattttttccaagccggaaacccccaatgagcgagaagagcagggctcaggtggcatccgagaacggaggacgctgggcttggccaatgcccggctgggggccagcgtgccccaagaagatgcccaactgctctccaacagcaaaaaatgctgtgtacgaggaagatgaactggaggaagaaccccgttctacaggggaactaagactgtgggactaccgactgctgaaggtgtttttcgtactgatttgctttctcgttatgtcctcatcctatctagcctttcggatctcgaggctagagcagcagctgtgttcactgtcttgggatgatcctgtgccagggcaccgttag

SEQ ID NO: 42643 - DNA, 474 bp, Artificial Sequence
  Description of Artificial Sequence: Synthetic coding sequence
atgagcaagagctgcggcaacaacctggccgccatcagcgtgggcattagcctgctcctactcctggtagtttgcggcataggctgcgtctggcattggaagcatagggtcgcaacgcggtttaccctccctcggtttttgcagaggcgcagctccaggcggaaggtgtgtacaaaaacttttctcggccctaggatcattggactgaggcacgagatctccgttgaaactcaggaccataaaagcgcagtgcgaggcaataacactcacgataattacgagaatgtggaggcgggaccccccaaagccaagggtaaaaccgataaagaactgtacgaaaacaccgggcagtccaacttcgaagaacatatatacgggaacgagacaagttccgattattataattttcagaaacctcggcccagcgaggtcccccaggacgaggacatttacattttacccgactcttattag

SEQ ID NO: 42644 - DNA, 474 bp, Artificial Sequence
  Description of Artificial Sequence: Synthetic coding sequence
atgagcaagagctgcggcaacaacctggccgccatcagcgtgggcatctcacttctgctgttgcttgtggtgtgtggaattggatgtgtgtggcattggaaacaccgagttgctacacgcttcaccttgccccgctttttgcaacgtcgcagttcaagacggaaggtctgcaccaagaccttcctggggcctcgaatcatcggcctgagacacgaaatcagcgtagagacccaggatcataagagtgccgtgaggggcaataatacccacgacaactatgagaatgtggaagctggacctccaaaagcgaagggcaagaccgacaaggaactgtatgaaaacaccgggcagtcaaatttcgaagagcacatctatgggaacgagacctctagcgactactataattttcagaaacccagaccttccgaagtgccccaggacgaagacatctacatactgcccgactcgtactag

SEQ ID NO: 42645 - DNA, 207 bp, Artificial Sequence
  Description of Artificial Sequence: Synthetic coding sequence
atgagcaagagctgcggcaacaacctggccgccatcagcgtgggcatctccctcctgctgttgctggtggtctgtggtatcggatgtgtttggcattggaagcatcgagttgctacccggtttacactcccccgttttctgcagcgccgcagtagccgtcgaaaagtatgcactaagacatttcttgggcccaggattatagggtag

SEQ ID NO: 42646 - DNA, 210 bp, Artificial Sequence
  Description of Artificial Sequence: Synthetic coding sequence
atgagcaagagctgcggcaacaacctggccgccatcagcgtgggcatatctttactgttattactggttgtgtgtggtattgggtgcgtatggcactggaaacacagggttgctacccggtttactctccctaggttcctgcagcgaagaagcagccggcggaaggtatgtaccaaaactttcctgggtcccagaatcatcggactctag

SEQ ID NO: 42647 - DNA, 753 bp, Artificial Sequence
  Description of Artificial Sequence: Synthetic coding sequence
atgatccagagcagccagcccatgagcctgaagctgacctgcagcgcatttcgcctgcagagagctcttcgctttctcttgggaagactgccttggcgggttgcatcaggtgcccgcagattccggagatggctgaatcgatactcctacactgttctaagctcttggcctgagcgtgcacttatcagcctgaaaaacagatcccgcttcttggtacgtccaaacactcggaacagggcgtttagctggacatgtcgggccgccagatctaagcctaggccacggcggtctacagctctccctaggagtcaagcttcaagcagtagacactcctgggccgagtttctgaagttcagaaaatcctttcagatgagtaatacaagtcaaccagacccgtcacgccctggcactgagcgtacaagcagtaaagaagccggctgtagaccgcttgggcagttggattccttctcctgggccgcacgcccgccacccggggccgccggattagccgtgagtgaaggctttttcaggaagataaggtcttctgcaccctccagcccctccttctcccgtgccttgatgagcaacacttatctgtgctttcttaccaccggacctcgcagttcgcgggagaacacacagaagtcttttcccgccacgtctccccgcgaacctgtaaccagccgcctgaggggcaaggctcccgcgctctccccctctagggaactatccttcacaagcgccccattctag

SEQ ID NO: 42648 - DNA, 978 bp, Artificial Sequence
  Description of Artificial Sequence: Synthetic coding sequence
atgctggccgcccggctggtgtgcctgcggaccctgcccagccgggtgtttcaccctgctttcacgaaagccagcccagttgtaaagaacagtatcacaaaaaaccagtggctacttactcctagccgcgaatacgcaactaaaacaagaatcggaatccgacgggggcggacagggcaggaactgaaggaggcagctctggagccctccatggaaaagatattcaaaatcgaccagatggggcgctggttcgtggcaggtggtgccatagaaaaggctgtgatctggccacagtatgtcaaagaccgcattcactccacttatatgtacctggccggaagcattggattaactgcactttctgccattgcaatcagccggacacccgttttgatgaatttcatgatgagaggatcatgggtgactattggtgtgacgttcgccgccatggtgggagccggcatgctagtgcggtctatcccgtatgaccaatccccaggcccaaaacaccttgcttggttactgcacagcggcgttatgggcgctgtagtcgcccctctcacaatccttggcggacccttgcttatcagggctgcgtggtacacagctggtatcgtcggcggcctgtccacagtggccatgtgcgctccaagtgaaaagtttctcaatatgggagctcccctgggagtggggctggggctggtttttgtgtcaagcctggggtccatgttcctcccccctaccacagtggcaggggcaaccctgtacagcgtagctatgtacggcggcctggtactctttagtatgttcttgctgtacgacacccagaaggtcatcaaacgtgctgaggtgtcacccatgtatggggtgcagaaatatgacccaatcaattctatgctctccatttatatggacacattaaacatctttatgcgcgtggccacaatgcttgctaccggcgggaatcggaagaaatag

SEQ ID NO: 42649 - DNA, 1038 bp, Artificial Sequence
  Description of Artificial Sequence: Synthetic coding sequence
atgctggccgcccggctggtgtgcctgcggaccctgcccagccgggtctttcaccccgccttcaccaaggctagccctgttgtgaagaactccatcaccaagaatcagtggctgttgactccatctcgtgaatatgctaccaaaacccgtattgggattcggcggggccgtactgggcaagagttgaaggaggcggctctggagccttccatggagaaaatatttaaaatcgaccaaatgggccgctggtttgtggccggaggagccgctgtgggcctgggcgcgctctgctattatgggctgggtctgagtaacgaaatcggcgccatagagaaagccgtcatctggccgcaatacgtgaaggaccggatccacagtacttacatgtacctggccggaagtatcgggctgaccgctctgtcagctatcgctattagccgaacacccgtcctgatgaatttcatgatgagagggtcctgggtcaccatcggtgtgacttttgcggctatggtgggcgccggtatgttagttcgctctattccgtacgatcagagtcccgggcctaaacatctcgcatggctcctgcattccggggtcatgggcgctgtggtggctcctctgactattctgggtggacctctgctcatccgggctgcgtggtacaccgcaggaattgtaggcgggctgtcaaccgtggccatgtgtgctccttctgaaaagttcctgaatatgggcgctccccttggagtaggccttgggctcgtctttgtgagctctttaggctctatgtttctgccgccgactaccgtggcaggagctacactgtatagcgtggccatgtacggaggattagtgcttttcagcatgtttctcttgtatgacactcagaaggtgattaagagggccgaagtgtcgcctatgtacggagtgcagaagtacgaccccattaatagcatgctgagcatttatatggacaccctgaatatttttatgagggtcgcgactatgctggccactggtggaaatagaaaaaagtag

SEQ ID NO: 42650 - DNA, 960 bp, Artificial Sequence
  Description of Artificial Sequence: Synthetic coding sequence
atgctggccgcccggctggtgtgcctgcggaccctgcccagccgggtgttccacccagcttttaccaaggcctctccagtggttaagaattccataaccaagaaccagtggctgctgacaccatccagagaatatgcaactaagactaggataggcattagaaggggaaggacgggacaggaattgaaggaagccgccctggaaccgagtatggagaaaatcttcaaaattgatcagatgggtcgctggtttgttgcaggcggagccgccgtgggcctcggggccttgtgctattatggccttggcctgagtaatgagattggagccatagagaaggccgtcatttggcctcagtacgtgaaggaccggatacactctacctacatgtacctggcaggaagtatcggtctgaccgccctgtctgcaatcgccatctctaggacacctgttctgatgaattttatgatgaggggcagttgggtaacaatcggcgtaacttttgccgcgatggtaggtgccggtatgttagtcagatccataccttatgatcaatctcctgggcctaagcacctcgcgtggcttttacattctggagtcatgggtgctgtggtggcacctctgaccatcctgggcgggccgttgctgattcgggcggcctggtatacggcggggatcgtaggggggctctccactgtggccatgtgtgctcctagcgaaaagtttctgaatatgggagccccactaggagtgggactcggattggtttttgttagctccctcggcagcatgttcctgccacctacaaccgttgcgggagcaacgctatactctgtagcaatgtacggagggcttgtgcttttttctatgtttttgctttacgacacacaaaaagtgagctccgtgcagaagtaccaccagtgtatggaatttaagaatatgattcctctcacacggtgctag

SEQ ID NO: 42651 - DNA, 999 bp, Artificial Sequence
  Description of Artificial Sequence: Synthetic coding sequence
atgctggccgcccggctggtgtgcctgcggaccctgcccttcgtgaagaactctattacgaaaaatcagtggctgcttactccgtcacgagaatatgcaaccaaaacccgcattggaattaggcgggggcggactggacaggaactgaaggaagctgccctggagcctagtatggaaaagatctttaagatagaccagatgggcagatggttcgtcgctggaggtgcagcggtgggacttggagccctatgctactacggactggggttgtcaaatgaaataggggccatcgaaaaggctgtgatctggccccagtatgtcaaggatagaatccattctacctatatgtatctggctggtagcattggtctgactgcattgtctgcaatcgctatctcccgcacccccgtgctgatgaatttcatgatgagaggctcttgggtcaccataggtgtaacattcgctgccatggtaggcgctgggatgctggttaggtcgattccatatgaccagagccccgggccaaagcatctggcgtggctgctgcatagcggtgtgatgggggcggtggtggcaccacttactatcttaggaggtcctctcctgattagagcagcttggtatacagcaggtattgttggagggttgtcaacggtggctatgtgcgcacccagcgagaagtttcttaatatgggcgcccctttgggcgtggggctcggtctcgtcttcgtatcatcactggggtccatgtttctcccccctactaccgtcgcaggagccacattatattccgtggctatgtacgggggattagtgctattcagcatgttcctactgtatgacacccaaaaggtgataaagcgcgccgaggtgagtccaatgtacggcgtgcaaaagtatgaccccataaacagcatgctctccatttatatggatacactgaacatttttatgagggtggcgacaatgctcgccactggtggaaaccgaaagaagtag

SEQ ID NO: 42652 - DNA, 5445 bp, Artificial Sequence
  Description of Artificial Sequence: Synthetic coding sequence
atgggcaacagctacgccggccagctgaagagcgcccggttcgaggaggcactgcataatagtatcgaggcctctctccgatgcagcagcgtagtgccccgaccaattttctcccagctatatttggaccctgaccaacatcccttctcttcagcagacgtgaagcctaaggtggaggacctggataaggacctggtcaatcgctacacccaaaatggaagcctagacttttccaataacctaacagtgaatgaaatggaggatgacgaggacgacgaggaaatgtctgacagcaactcaccccctattccctactcacaaaaacctgctcctgagggctcgtgcaccaccgacggcttctgccaagccgggaaggacctcaggcttgtcagcctgtgtatggaacagatcgatatccctgctggcttcctacttgttggtgccaagtcacctaacctgcccgaacatatcttggtgtgtgctgtagataagagattcctcccggatgaccatgggaagaatgccctgctggggttcagtggaaattgcattggttgcggagagaggggattccggtatttcaccgagttcagcaaccatattaatctgaaactaaccactcagcccaagaaacaaaaacacctgaagtattacctggttcgcagctcacagggagtactgagcaaaggtccccttatctgttggaaggagtgcaggagccggcaatctagcgctagttgccacagtattaagccctctagcagcgtgagttctactgttacacccgaaaacggtactaccaatggctacaaatctggctttacacagacagacgccgccaatgggaatagctcccatggaggaaaggggtccgcctcctcttccaccccagcacacacgggaaattactccttgtcccctaggccctcttacgcatccggcgatcaggccaccatgttcatatccggtccaccgaaaaagcgtcataggggttggtaccctggctcacccttgccccaaccaggcctcgtggtgcctgtgccaaccgtgcgccccctgagtcgcactgagcctcttctgtctgctcccgttcctcagacaccactaaccggtattcttcaacctcggcccatccctgcaggggagactgtgatcgtgcctgagaaccttctgagcaactcgggcgtgcggcccgttatcctgatcggttatggtaccctgccctatttttatggtaacgtcggcgatattgtggtctccccgctcctggtgaactgctacaaaattccgcaattggaaaacaaggatctcgaaaagctgggactgactggcagccagtttctaagcgtagaaaacatgattttgctaaccattcagtacctcgttagactaggacagcaccagtccagggcactggctgaaagtatgctcacaacttctgagttcctcaaagaaatcagctacgaattgatcacgggcaaagtatcttttctggcgtcccactttaagacaacaagtcttggggatgatctcgataaattgctcgagaaaatgcagcaacggagaggcgattctgttgtgaccccatttgacggggatttgaatgaatgtgttagtccacaagaggcagccgctatgattccaacacagaatctggatcttgataatgagacgttccatatctaccagccacagctgacagtggcccgtaagctacttagccaagtctgcgcgattgcagatagcggatcacagagcctggatctgggccacttttccaaggtcgacttcattataatcgttccgaggtctgaggtcctcgtgcaacagactcttcagcgtatacgccagagcggcgtgctagttgatctcggcctcgaggagaacggcacagcccaccagagggctgaaaaatacgttgttagactggataacgagatccaaacgaaatttgaagtcttcatgcgaagagttaagcagaacccttacacactgtttgtgctggtgcacgataactcccatgtggaactcaccagcgtgattagtgggtccctctctcactccgagccctcacatggtctcgctgacagggtcatcaattgtcgggaggtgttggaagcctttaacttgcttgtcctacaggtctcctccttcccttatactctgcaaacgcagcagtcaagaatttcttcttccaacgaagtgcactggatccagctcgacactggtgaggacgttggttgcgaagaaaagttatatttcggccttagcgagtactcaaaatccctccagtggggaatcactagtccgctactgaggtgcgacgagacctttgaaaagatggttaacaccctcttggagcgctaccctagactccattctatggtggttcgttgttaccttttgatccagcagtactcagaagcccttatggcccttaccacaatggcgtcacttcgtgatcacagtacgcctgagacactgtccatcatggatgaccttatctctagtccagggaagaataaatccggcaggggccatatgctgatcatccgggtgccctccgtgcagctggccatgctggccaaggagaggctgcaggaagttcgggataaactcggcctccaatatcggttcgaaatcattctcggtaaccccgcgactgagctttctgtggccacacacttcgtcgccaggctcaagtcgtggagggggaacgagcctgaagagtggatcccccgtacctaccaggaccttgatggactgccgtgcattgtgattctgacaggaaaggaccctctcggtgaaacgttcccccgctccctgaagtactgcgatttgcggctcatagatagctcatacctgacgcgcaccgctctggagcaggaagtcggccttgcttgctgctatgtgtccaaggaggtgatccgagggccaactgtggctctagatcttagtggcaaagaacaggaacgcgccgccgtgtctgagaatgactcagatgagctcctgattgatctcgaaaggccccagtcaaacagcagcgcagtgacggggaccagcggatccatcatggagaatggcgtgagctcatcaagcactgccgacaagtctcagaagcagtcgttgactccatcatttcaaagccctgccacttccctgggccttgacgaaggggtcagcgcttcttcggccggggcgggcgccggcgagactctgaagcaggagtgcgacagcttgggccctcagatggcatcctcaacgacaagtaaacctagtagcagctcatcaggcccacgtactctcccctggcccggccaacctatacggggttgcagggggccccaggctgctctaccaccagttgtgatcctgagtaaggctgcttattcactgctgggatcacagaagtccgggaagctgccttcctcttcctctctgcttccccacgccgacgtggcatgggtatcctctctcagaccactgttaaacaaggacatgtcctccgaggaacagagtctgtactatcgacagtggacattggcccgccagcatcatgccgattacagtaatcagttagaccccgcttccggaaccaggaatttccacccccggcgactgctcctgaccggacctccacaggttggaaaaaccggttcttatctgcagtttctgcgcattctctttaggatgttgattagactactggaagttgatgtttatgatgaggaggagattaatacagatcataacgagagctccgaagtctcacaaagcgagggcgagccatggcccgacattgagtctttcagcaagatgcccttcgatgtgtctgttcacgatccaaagtattcattgatgtcactggtgtacactgagaagctggctggcgtgaaacaagaagtgatcaaagaatcgaaggtagaggaaccacggaaaagagagacggtctccataatgctaactaagtatgccgcttataacactttccaccactgtgaacagtgtcggcagtacatggatttcaccagcgcaagccaaatgtcagattcaacactacacgcttttacatttagcagcagtatgctaggagaggaagtacagctgtactttattatacccaagagcaaagaaagccattttgtcttttcgaaacagggaaagcacctcgagtcaatgagactgcctctggtgagcgacaagaacctcaacgcagtcaaatctcccatatttacacctagcagcggaagacatgaacacggactgctcaacctctttcatgcgatggagggcattagtcacttacatcttctggtcgtgaaggagtacgagatgccactatatcggaagtactggccaaatcacattatgctggtgctgccgggtatgtttaacaacgccggcgtcggtgccgctagatttctgattaaggagctttcctaccacaacctggagctggagaggaaccgcttggaagagctggggatcaaacgccagtgcgtctggcccttcatcgtgatgatggacgattcctgcgtgctgtggaacatacactccgtgcaagagccctcatcccagcctatggaggttggcgtaagctcaaagaacgtgagcctcaaaaccgtgcttcaacacatcgaagccacccccaagattgtccattatgcaatcctgggtattcagaaatggtcatccaagctcacatcacagtctttgaaagccccctttagtcgctgccatgtccatgacttcatacttttaaacactgacctaacacaaaatgtacaatatgattttaaccggtatttctgtgaggatgccgatttcaacctgcggacaaattccagtggcttactcatctgtcgcttcaacaacttttcacttatgaagaaacacgtgcaggtgggaggacagagagatttcattatcaaaccaaagataatggtgagcgaatccttggcgcccatcttgccgctgcaatacatctgtgccccggactccgagcacaccctgcttgctgcacctgcgcagttcctgcttgagaagttcctgcaacatgccagttacaagctgttccctaaggcgattcacaacttccgatccccagtgctagccatcgattgctatctgaatatcggaccggaagtggccatctgttacatctcctcgcgcccgcacagcagcaacgtgaattgtgaaggggtgttcttcagcggactcctgctttatctgtgcgattcattcgtgggcgctgacctgaaaaaattcaaatttctgaagggcgctaccctctgcgtcatctgccaggatcgcagcagcctgaggcagacaatcgtcaggttggaactggaagacgaatggcagtttaggttaagggatgaattccaaaccgctaatagctctgacgacaagccactgtacttcctcaccggccggcacgtctag

SEQ ID NO: 42653 - DNA, 2229 bp, Artificial Sequence
  Description of Artificial Sequence: Synthetic coding sequence
atgggcaacagctacgccggccagctgaagagcgcccggttcgaggaggctctgcacaattccattgaggctagcctccggtgctcctctgtggttccccggcctatcttcagtcagctgtacctcgatcccgatcagcaccctttctcctcagctgacgttaagccaaaggtggaagacttagacaaagatctggtgaacagatatacacaaaacggaagtttggacttctccaacaatctgactgttaacgaaatggaggatgacgaggatgacgaagaaatgtcagactctaattctcccccgatcccgtacagccagaagcctgctcctgagggaagctgcacgactgatggcttttgtcaggccggtaaagatctgaggttggtctccctgtgcatggaacagattgatatccccgccggattcctgctcgtgggggccaaatctcctaatctgcctgagcatatcttggtttgtgctgtggataagcgttttctgcctgatgaccacggcaaaaacgcattgctggggttcagcggaaactgtatagggtgcggagagaggggcttcaggtacttcacggagttctctaaccacatcaatttgaaactcaccacacagcccaagaagcaaaagcatctgaagtattacctcgtgagaagctcacaaggcgtcctttctaaagggccgttaatttgttggaaagagtgtcggtcccggcaatcctctgctagctgtcatagtatcaaaccaagttcatctgtctccagcaccgtgactcccgaaaatggcactaccaatggttataagtcaggcttcacccagacagacgccgcgaacggaaatagttcccatggcggtaaggggtctgcttcctccagtacaccagcccacactggcaattactcacttagccctagaccttcatacgcatctggagaccaggccaccatgttcatctccggacctcccaagaagaggcatcgggggtggtatccgggctcacctctaccgcagccaggactggttgttccagtacccactgtacgccccttgagccggactgaaccactgcttagcgctcctgtgccccagaccccactgaccggcatcctgcagccaagacccatccccgccggcgagaccgtgatcgtccccgaaaatttgctctccaattctggagtgcgcccagttattctcatcggatatggaactctgccttacttttatggcaacgtgggcgatatagtggtgtcccccctccttgtcaattgttataagatccctcaactagagaacaaagacctcgagaaactcgggttaacgggttcacagtttctgagcgtggagaacatgattcttctgaccattcagtacctagtcaggctgggaccagaccaggtacccctacgcgaggagttcgagcaaatcatgcttaaagctatgcaggaattcacactgcgtgaacgtgcgctccagatcggggctcagtgtgttcctgtgagccctgggcagttgccatggctcgcaaggttaatcgcaagcgtgtcgcaggacctcgtccatgtggtggtgacccagaactccctggctgagggcatatctgaaaccctgagaacactgagcgagatgcgacattaccagcgcttgccggattatgtggttgttatctgtgcctctaagattcggggcaatgaattctgtgttgttgtactggggcagcaccagagtcgcgccttagctgagtccatgctcactacaagtgagtttctgaaggaaatttcctacgagctcatcacagggaaggtgtcttttttagcatcgcatttcaagactacctctctaggggacgacttagacaagcttttagagaaaatgcaacagaggaggggagacagcgtggtgaccccgtttgacggcgaccttaacgagtgcgtttcgccacaggaagccgctgccatgatcccaacccagaatctcgacctggataatgagacattccatatttaccagccacagctgacagtggcccggaagctgctctctcaagtttgtgcgattgctgactcaggctcccagtcactggatcttggccatttctcaaaagtagattttataatcattgtgccacggtctgaagtgctagtgcagcaaacactccaaaggatcagacaaagtgtctcatttcaggcgctgtgtcatatcgccaaccccgtcatgggttag

SEQ ID NO: 42654 - DNA, 5772 bp, Artificial Sequence
  Description of Artificial Sequence: Synthetic coding sequence
atgggcaacagctacgccggccagctgaagagcgcccggttcgaggaggctctacacaactcaatcgaggccagtcttagatgctcatcagttgttcctcgcccgattttttctcagctctatctggaccctgatcaacaccccttttcttcagctgatgtgaagcccaaggtggaggacctggataaggatcttgtaaatcggtacacccagaacggtagccttgacttttccaacaacttaaccgttaatgaaatggaagacgatgaagatgacgaggagatgtcagattccaattctccaccaattccctacagccagaaaccggcccccgaggggagttgtacaaccgatgggttctgtcaggccgggaaggacttgagactcgtgtccctgtgcatggagcaaattgacatccctgctggattcctgctggttggtgcaaaaagcccgaatctgccagaacacatccttgtttgcgctgtggataaacgattccttcctgacgaccacggcaagaacgcgttgctgggcttctcaggcaactgtatagggtgcggagagagaggattccggtactttactgaattttctaaccatataaatctaaaattaaccacacagccgaagaagcagaagcatctgaaatactatctggtgagaagctcacagggtgttctctctaaaggcccgttgatctgttggaaagagtgtaggtcaagacaaagttcggcaagctgtcacagtatcaagccgagttcctcagtttcatcgaccgtgacccctgaaaatgggactactaacggctataagtccgggttcacgcagaccgacgctgcaaatggaaactccagccatgggggcaaagggtctgcctccagctccacaccagcacacactgggaactactccctctcccccaggccttcatacgcgagtggagaccaggcgacaatgtttattagtgggcctcctaaaaaacgtcataggggctggtaccctgggagccctttgccccaacctgggctggtagtgccggtgcccaccgtccgtcccctgagtagaactgagccactgttatcagctcccgttcctcagacgcctctgacaggtatcctccagccaaggcccattcccgcaggggagacagtgattgtccccgagaacctcttatccaattcgggtgtgcgacctgttattctgattgggtatggcactttgccttacttctatggcaacgttggtgatatagtcgttagcccgctgctggtcaactgctacaagataccccagctggagaacaaggacttagagaaactcgggctcaccgggtctcaatttctctcggtggaaaacatgatccttctgaccatacagtatttggttcgattgggccctgatcaggtaccgctgagggaggaattcgagcagattatgttgaaggccatgcaggaatttactctgagagagcgtgcgctacaaattggagcccagtgtgtgcctgtcagccccgggcagctgccttggctcgcccgactcatcgcttcagtttcacaggacttggttcatgtcgtggtgactcaaaacagcttagccgaaggcatcagcgaaactttaaggactctgagcgagatgagacattaccagcggttaccagattatgttgtggtaatatgcgcatccaaaattcgcggaaacgaattctgtgtggtggtgcttggacagcaccaatcaagggctctagccgagagtatgctaactacttccgagttcctgaaggaaatctcctatgagctgattacaggaaaggtgagtttcctggcatcacatttcaagacgaccagcctgggagacgacctggacaaacttttggagaagatgcagcagagaagaggagattcggtcgtaacaccttttgatggggacctcaacgagtgtgtgtctccacaggaggccgcagcaatgatcccgactcaaaatctggacttagataatgaaacatttcacatctaccagccccagcttaccgttgcacggaaacttctatcccaagtctgcgccatcgctgattccgggagccaatccttggacctgggccacttctccaaggtcgatttcatcatcatagtgcctcggagcgaagtccttgtccagcagacgcttcagagaattcggcagtctggcgtgttggtggaccttgggctggaagagaatggcacagctcatcagcgggctgagaagtacgttgtacgccttgataacgaaatacaaacaaaattcgaagtgtttatgcgccgggtgaagcagaacccatatacactgtttgtgctggttcatgacaatagccacgtggagctaacaagcgtgatatccgggtctctgagccacagtgaaccctctcacggactggccgatcgggtcatcaattgccgggaggttctggaggccttcaacctgcttgtgctgcaggtgagctcttttccctataccctgcagacccagcaatcccgcatttcgtctagcaacgaagtgcattggatacagctcgataccggagaggatgtcggctgtgaggaaaagctgtattttggtctgagcgaatattccaaatccttgcagtggggcattacatctccgctgcttaggtgcgatgaaacattcgaaaagatggtgaataccttgcttgagcgttacccccggttgcactcaatggtcgtgcgctgttacctgctaatacaacagtactccgaggctcttatggctttaactaccatggccagccttcgggaccatagcacacctgagaccttgtccatcatggatgacctgatcagcagtcctgggaaaaacaagagtggccgtggccacatgctcattatccgcgtgccgtcagtacagctcgcaatgctggccaaggagagactccaggaagtgcgggacaagctcggcctacagtacagattcgagataatcctcgggaacccggcaacagaactgagtgtcgctacccactttgtcgcaaggttaaaaagctggaggggcaacgagccggaggagtggataccaagaacataccaggatctggacggactcccctgcatcgttatccttaccggtaaggatccactaggcgagacgtttccacggtccttgaaatattgcgatcttcgcctgattgactcttcatacctgacccggacagcactcgaacaggaggtgggacttgcatgttgttacgtctccaaagaggtgatccgcggacctacagtggcgttggacctctcagggaaagagcaggaaagggctgccgtaagcgagaacgatagtgacgaactgttgatcgatctagagagaccccagagtaacagctcggctgttaccggcacaagcggaagtattatggagaatggggtctcctcttcttccactgcagacaagagtcagaagcaatccctgactcccagcttccaatccccagctactagccttggccttgacgaaggagtctctgcgagtagcgcgggcgcaggtgccggagaaaccctaaagcaggagtgcgattcccttgggcctcagatggcaagttcaactacatccaaacctagctcgagttcatccggaccccgtaccctgccctggccaggacagcccatcagaggatgccggggcccgcaggcagccctacctccagtcgtaatcttatccaaagcggcatattcccttctgggatctcaaaagagcggcaaacttccctcttctagtagtctgttgccacacgcagatgtcgcctgggtgtccagcttgcgaccgctgctaaacaaagatatgtcctctgaggagcagtcactgtactatcgccagtggactctcgctcgacagcaccacgcggactactcaaaccaactggacccagcctccgggacacgaaacttccacccgcgccgcttgcttctcaccggacctcctcaagttggtaaaacaggctcctatttgcagttcctgcgcattctttttaggatgctgatcaggttgcttgaagttgacgtgtacgacgaggaggaaatcaacaccgatcataatgagtcaagtgaagtatcgcagagcgaaggcgaaccctggccagatatcgagtcgttcagcaaaatgcctttcgacgtttcagtccatgatcctaagtattctcttatgtcactcgtttacacggaaaaacttgctggagtcaagcaggaggtgatcaaggaatcgaaggtcgaagagccgcgtaaacgggaaaccgtctccattatgctgaccaagtacgctgcctacaacacttttcaccactgcgaacagtgccgacaatacatggacttcacatccgcaagccagatgtcagactctacgctgcatgcctttacatttagcagcagcatgctgggagaagaggtgcagttgtactttattattcctaaaagcaaagaatcccactttgtcttcagtaagcaaggaaagcacctagagtccatgaggctgccactggtgtctgataagaatctgaatgctgtgaaaagcccaatttttacaccgagtagcgggcggcatgagcacggcctgctaaacctgtttcacgcgatggaaggcatttctcatttgcacttacttgttgtcaaagaatacgaaatgcccttgtatcgcaagtactggccaaatcatatcatgttagtgctcccaggcatgttcaacaacgcaggggtcggagccgccagatttctgattaaagagctctcttatcacaatctcgaactggagcggaatcgtctcgaggagctgggaataaaacggcagtgtgtctggcccttcatagtgatgatggatgactcttgcgttttgtggaatatccacagtgtccaggaaccttccagccagcctatggaggtgggcgtctcctccaaaaacgtttcacttaaaactgtgctgcagcatatcgaggctacacctaagatcgtgcattacgcgatcctgggaatacagaagtggagtagtaaattgacaagtcaatctctcaaggcgccctttagccgttgtcatgtgcatgattttatcctccttaataccgatctcacacagaatgtacagtacgacttcaacagatatttctgtgaagacgctgatttcaaccttagaaccaattcaagcggactgttaatctgtcgctttaataacttctctcttatgaagaagcatgtccaggtgggcggacagagagattttattataaagcctaagattatggtcagtgagagtctcgccccaatccttcctcttcagtacatctgtgcaccagactcagagcacacattgctcgccgcaccggcgcagtttctgttagagaaattcctgcagcacgccagctacaagctgtttcctaaggctatccataatttcaggtctccagttctggcgatcgattgctacttgaatatcggtccggaggtagcaatttgttatataagcagtcggccccactctagtaacgttaactgtgaaggagtattttttagcgggttgctcctctatctgtgtgactcattcgtgggagccgaccttaaaaagttcaagttcctgaaaggggcaacactgtgcgttatttgccaggatagaagtagccttaggcaaactattgttaggctggaactcgaggacgaatggcagtttaggctgcgggacgagttccagactgcaaatagttctgacgacaagcctctgtatttcctgaccggaaggcatgtgtag

SEQ ID NO: 42655 - DNA, 2244 bp, Artificial Sequence
  Description of Artificial Sequence: Synthetic coding sequence
atgggcaacagctacgccggccagctgaagagcgcccggttcgaggaagctctgcacaattctattgaggcttccctgcggtgctcttcagttgtccctagaccaattttctcccaactgtacctggatcctgatcaacacccattttcatctgcggacgtgaagccgaaagtcgaagacctggataaggacttggtcaacagatacacacaaaatggctctctggactttagcaacaacttgacagttaatgagatggaagacgacgaagacgatgaggagatgtctgactcaaactcaccccccataccatatagtcaaaagcctgcaccggaaggctcgtgtaccacggacggattttgtcaggcaggcaaagacctgcgcctggtcagtctgtgcatggaacagatagacattccagctggctttctgctggtaggcgcaaaatctcccaatctgcccgagcacattctcgtgtgtgctgtggataaacgcttcttaccagacgaccacggcaagaacgccctgttgggcttctcgggaaactgtatcggctgcggggagagaggatttcggtattttactgagttctcaaaccacattaatctgaaactcacaacacagcccaaaaagcagaaacatctcaagtattacctcgtaagaagttctcagggtgtgctgtcgaaaggccctctcatctgttggaaagagtgcaggagccgtcagtccagtgcttcttgtcactccatcaagccaagcagctccgttagctctactgtgacacctgagaacggtaccaccaatgggtacaagagtgggtttactcagacagatgctgccaacgggaactcgagccacggaggcaaaggtagtgcttccagttcaacaccggcacacacgggtaactattccttgtccccacgcccctcctacgcctccggtgaccaggcaacaatgtttatatcaggaccacccaagaaacgacataggggctggtaccctggcagtccattaccacagcccgggttagtggtgccggtgcccaccgtccgacccctgagcaggaccgagcctctactgtctgctccggtgccccaaactccgttgactggcatccttcagccccgacctatccccgcaggcgagacagtgattgttccagagaatctgctctccaatagtggtgtcagaccagtgatcctgatcggctatggaactctgccgtacttttatgggaatgtgggagacatcgtggttagtccactactggtgaattgttacaagatcccgcaactggagaataaggatttagaaaagttgggactcaccggaagccagttcctgagcgtcgagaatatgatcctgcttacaattcagtacttagtccgcctgggtcctgatcaggtccctctacgtgaagagttcgagcagatcatgctaaaagcaatgcaggaatttactctgcgtgagcgcgctctgcagattggggcgcagtgcgtacccgttagccccggtcaattgccctggctggctaggctgatagctagcgtgagccaggacttggttcatgtcgtggtcacccaaaacagcttggccgagggcattagcgagacactgcgaacccttagcgagatgagacactatcagcgacttcccgattatgttgtcgttatctgtgccagcaaaattcgtggtaatgagttctgcgtcgttgtcctaggccagcatcagtctcgagcgttagccgaatcgatgctcactacttccgagttcttgaaggagatttcctacgagttgattacaggaaaggtttccttcttagcctctcatttcaaaacaaccagccttggcgatgatctagacaagctgcttgagaagatgcaacagcgacgtggagattctgtggtgacaccctttgatggggaccttaatgaatgtgtctctccccaggaagccgctgctatgataccaacccagaaccttgacctcgacaacgaaacgttccatatataccagcctcagctgaccgtcgccagaaaactcctcagccaggtctgcgcaatcgctgatagtggatctcaaagcttagacttggggcatttttcgaaggttgattttatcatcatcgtccctaggtcggaggtgctagtccagcaaaccctgcaaagaatccggcagtcaggctcctccccaggatctcacattgcgttctcgtacgtcttgtttatttcgtgcaatctgtag

SEQ ID NO: 42656 - DNA, 531 bp, Artificial Sequence
  Description of Artificial Sequence: Synthetic coding sequence
atgtgcctggagctgttccacagcagcaacgtgatcgacggcctgaagttgaacgcttttgccgccgtgttcactgtattgagcggcctgctgggcatggtggcccacatgatgtacactcaggtctttcaagtgaccgtgagtctgggtcctgaagattggcgacctcatagctgggattacggatggagtttttgtttggcttggggttccttcacgtgctgcatggcagcatctgtgaccactctgaactcttataccaagaccgtgatcgagtttagacacaagcgtaaagtctttgaacaaggttatagagaggagcccaccttcatcgaccccgaggcaattaagtatttccgcgaacgtatggagaaaagagatggttctgaagaggattttcatttagattgtagacacgagcgctaccctgccaggcatcagccccacatggcagactcttggccgcgatcgagcgcgcaggaggccccagagttaaataggcagtgctgggtccttggccattgggtgtag

SEQ ID NO: 42657 - DNA, 585 bp, Artificial Sequence
  Description of Artificial Sequence: Synthetic coding sequence
atgtgcctggagctgttccacagcagcaacgtgatcgacggcctgaagttaaacgcttttgctgcggtgtttactgttctgtccggactgttgggcatggttgctcatatgatgtatacacaggtgtttcaagtgaccgtatctctcggcccagaagactggaggccgcatagctgggattacggctggtctttttgtctggcttggggatcttttacttgctgcatggcggcttctgtgaccacactgaacagctacaccaaaacagtgattgagtttcgacataaaaggaaagttttcgaacaaggatatagggaagaacctacgtttatagatcctgaggccataaaatactttagagagaggtggcaaattgaagcccagcggggcagagccacttgccccaggtcgcatagttggatggaaaagcgggacggttccgaagaagatttccatcttgattgtcgccacgagcgttaccctgcgcggcaccaaccccacatggctgacagctggcctcgctcttcagctcaagaagcacccgagctaaaccgacaatgctgggtactgggccactgggtctag

SEQ ID NO: 42658 - DNA, 843 bp, Artificial Sequence
  Description of Artificial Sequence: Synthetic coding sequence
atgaagaccagccggcggggccgggccctgctggccgtggccctgaatctgctcgctctgctgttcgcgactaccgcctttctaactacccattggtgccaaggcacccaaagagtgccaaaacctggctgcgggcaagggggacgtgccaattgtcctaatagcggcgctaatgctacggctaatgggaccgcggcacccgctgcagccgccgccgctgccaccgccagcggtaatggaccacccggcggcgcgctctactcttgggagactggtgacgaccgttttttattccgaaattttcataccggtatctggtacagttgtgaggaagagctgtctggcctcggtgaaaagtgtcgcagtttcatcgacctcgcacctgcttccgagaaaggcctcctggggatggttgcacatatgatgtatacgcaggtctttcaagtgactgtgagtttgggtcccgaggactggcgcccacacagttgggattacgggtggagcttctgtctggcttggggatctttcacttgttgtatggccgcctcagtcactactcttaactcctacactaaaactgtgattgagtttcgacataagcgcaaagtgtttgaacagggatatcgtgaggagcccaccttcatagaccctgaggctatcaagtatttccgagagaggatggagaaaagggacggctctgaggaggatttccatcttgactgccgccatgagcggtatcccgccaggcaccaaccgcatatggctgacagttggccccggtcctctgcgcaagaggcgccggagcttaatcggcagtgttgggtgctgggccattgggtctag

SEQ ID NO: 42659 - DNA, 996 bp, Artificial Sequence
  Description of Artificial Sequence: Synthetic coding sequence
atgaagaccagccggcggggccgggccctgctggccgtggccctgaatctgcttgccctacttttcgctaccacagctttcctgactacacattggtgccagggaacccagcgcgttccaaaaccgggttgcgggcagggcggccgcgctaactgccctaattcgggtgccaatgccaccgcaaatggtacagccgccccggccgctgccgctgcggccgctacagcctctgggaacggaccgcctggaggagccctctattcttgggaaactggtgatgatcgcttcctgtttcggaacttccacaccggcatttggtatagttgtgaggaagaactaagcggcctgggggaaaagtgtagaagcttcatcgatctggctccagcctctgagaaaggagtgctttggttgtctgtggtgagcgaggtactgtacatcctcctgctggtcgtcggcttcagtctgatgtgcctggagttgttccacagctccaacgtgatcgacggcttgaaactgaatgcttttgccgcggttttcactgtcctgtcaggactgctgggcatggtcgcacatatgatgtacacacaagtgttccaggttacagtgtccctggggccagaagactggcggccccattcgtgggattacggatggagcttctgcttagcatggggttcattcacgtgctgtatggctgcaagtgttaccacgctgaatagctacactaagaccgttatagagttccggcacaagcgaaaggtgtttgagcagggatatcgggaggagcccaccttcatcgatcctgaggcaattaagtactttagagagcggatggaaaagcgggatggctccgaagaggacttccatcttgattgcagacacgagcggtatcctgcccgccatcaaccgcacatggctgatagttggccaagaagttccgctcaggaggcacccgagctgaatcggcagtgctgggtcctaggtcactgggtgtag

SEQ ID NO: 42660 - DNA, 1479 bp, Artificial Sequence
  Description of Artificial Sequence: Synthetic coding sequence
atgtggcggggcctgtggaccctggccgcccaggccgcccggggccctcggaggctctgcactagacgcagtagtggtgcacctgccccaggtagtggagctacaatcttcgccctgagcagcgggcaaggtcggtgtggaatcgccgtgatacggacatccggccccgcgagtggccatgcactgagaatcctaaccgctccccgtgatcttcctctggcccggcacgcttctctccggttgctgagcgatccacgtagtggcgagccattagaccgcgctctggtgctttggtttccgggtccacagtcattcacgggagaagactgcgtagaatttcacgtccatggcggtcccgcagtggtgagcggagtgctgcaggccttaggaagtgtacccggactgcgccccgccgaggcaggcgagttcacgagacgtgctttcgccaacggtaagttgaatttaactgaagtcgagggtctggctgacctaattcacgctgaaacagaagcccagcgacgacaggccctcaggcagttggacggcgagctggggcatttgtgtcgtgggtgggctgaaactcttactaaagcactcgctcacgtggaggcctatatcgacttcggtgaagatgataatcttgaggaaggcgttctggagcaagcagacatcgaagttagggcactccaggtagccctcggggcccatctgcgcgatgcccggcgtgggcagagactgcgtagcggtgtgcacgtggtggtgaccggccccccaaacgccgggaagtctagtctggtgaacttgctctcccgtaaaccagttagcatagtgagccccgaacccggcacaacacgagatgtgctggagacacccgtagacctggcaggttttcccgtcctgctcagcgatacagcaggactgagggaaggcgtgggcccggtggagcaggagggcgtgcgtagggccagggagcgcctggagcaggccgatctcattctggccatgctggacgcgtctgacttggcttctccctctagctgtaacttcttggccacagtggtggcctcagttggcgcacagtccccttctgattcctctcagaggttactgctcgtcctgaataagtcggaccttctgagtcccgagggacccggtcccggccctgatctccctccccacttgttactgtcgtgtctaaccggtgagggccttgatgggcttctggaagctctgagaaaagaacttgccgcggtatgcggggaccccagcaccgatccaccacttctgacaagggcccgccaccagcaccacctgcaggggtgccttgatgccctcggccattacaaacagtctaaggatctggccctggccgccgaggcgctgcgagtggcaagggggcatttgacccgcttaaccggcggcggcggtacagaagaaatactggacatcatatttcaggacttctgtgtgggcaaatag

SEQ ID NO: 42661 - DNA, 1575 bp, Artificial Sequence
  Description of Artificial Sequence: Synthetic coding sequence
atgtggcggggcctgtggaccctggccgcccaggccgcccggggcccacggaggctctgtacacgcagaagcagcggcgcaccagctccaggttccggggccaccatctttgcgttgagcagtggccagggtcggtgcggcattgcggtcattcggacatccggtccagcatcgggccacgcccttaggattctgaccgctccccgtgatcttcccctcgcccgacacgcatctctccgtctgctcagcgatcccaggagtggcgagccactggatagagctctcgtgctgtggtttcctggtccacagtcttttaccggcgaggattgcgttgagtttcacgtgcacggcggcccggcggtggtctccggagtgcttcaagccctggggtccgtcccgggactaaggcctgcagaggctggcgagttcacacgacgagcctttgccaatggcaagctgaatctgaccgaagttgagggtctggccgatctgatacacgccgaaacggaagcgcaacggcgtcaagccctcagacagctggatggagaactcggccacctgtgcaggggctgggcagaaacattgacaaaggctttggctcacgttgaggcttacatcgacttcggggaggacgacaacctggaagagggcgtgctcgagcagggggggagtacatggtggtggggaagaaagacgccccatattagcccacaacggctgccatctctgtctttatcagcctgcctactgtcccccaccgccgatattgaggtgcgcgccctgcaagtggcactgggggcccatctccgagatgccagacgagggcagagactgcggtctggggtccatgtggtcgtgacgggcccgccaaatgcaggaaaaagctcactggtgaatttactatccagaaagcctgtcagcattgtttcgcccgaaccgggcaccactagggacgtcctggagaccccagttgacctggcaggctttccagtgctgctttccgacacagccggattaagagagggcgttggtccggtggagcaggagggtgtgcggagggcaagagaacgtctcgaacaggctgacttgatcctggccatgctagacgcctcagacttggcctcaccatcttcctgtaacttcttagctactgttgttgccagtgtcggggcacagagcccatctgactccagccagcgtcttctcttagtgctgaacaaaagtgatctcctttcccctgagggacccggacccggtcccgatttgcctccgcacctgttgctttcttgtttaaccggggaagggcttgacggtctgctcgaagccctgcggaaagagctggccgctgtatgtggcgacccttcgactgatccccctttgctaacgagggcgcggcatcagcaccatcttcaggggtgcttggatgcactcgggcactacaagcagagtaaggacctcgcactggccgcagaagcccttcgagtggcacggggccatcttactaggctcactggaggtggcggtacagaggagatcctggatattatttttcaggacttttgtgtggggaaatag

SEQ ID NO: 42662 - DNA, 1545 bp, Artificial Sequence
  Description of Artificial Sequence: Synthetic coding sequence
atggtgcacagccccacctgcccccacccctgcttcctgctggtgcccgcaagcgagccgcagttcccccacctccagaccccagaccccggcgatgccgtctggaatgtccggtgggctctttgcacccggagatctagtggggccccggccccaggttccggggcaaccattttcgcactgtcttctggccaggggagatgcgggattgccgttatcaggacgtccgggcctgcatctggccatgcccttagaatcttgaccgcaccgcgggacctccctctggccagacacgctagcttgcggctactgtcagaccctagatccggcgaaccccttgatcgcgctctcgtattgtggttcccgggaccacagtctttcactggcgaagactgcgtggagtttcacgtgcacggaggccccgccgttgtctctggcgttcttcaggccctgggatcggtcccaggactccgcccagctgaagccggagagtttacaagacgggccttcgccaatggaaagttgaatctgaccgaggttgagggtctggccgacctcatccacgcggaaacagaggctcagcgccgtcaggcattaaggcagctggatggggagctaggccacctgtgtagaggctgggcggaaacattgacaaaagctctggctcatgtggaggcttatatcgactttggagaggatgataacctagaggaaggtgtcctcgagcaagccgacatcgaagttagggcactgcaggtggctctaggtgcacaccttcgcgatgcaagacgaggccaacgcctgcggagcggtgtccatgttgtcgtgaccgggccacccaacgcgggaaagtcttcactcgtcaatctactctccaggaaacccgtcagtatcgtgagcccggagccaggcaccacaagggatgtgctggaaactcccgttgatttggcaggcttccctgtgctgctcagtgatacagccggtctgcgggagggggtgggccctgtggagcaggaaggagttagacgcgctcgagagcgtctggagcaggccgaccttattctcgccatgttagatgcttcagatcttgcatctccaagcagctgcaatttcctcgctaccgtggtcgccagcgtaggcgctcagtctcctagtgattcctcacagcggctgctgctggtgctgaacaaaagtgatcttctatctccagaaggacccgggcctggcccagacctccctccacatctgctgttaagttgcctcacgggggaaggtttggacggactgctcgaagcgctaagaaaggaattggccgctgtctgtggcgacccctcaaccgatcccccactcttaacacgggcccgacaccagcatcatctgcaaggctgcctcgatgcgttgggtcattataaacagagcaaagacctcgctttggccgccgaagctctgcgtgttgctagagggcatttaacgcggttgacgggaggaggcggcactgaggagatcttagacatcatcttccaagacttttgcgtgggcaaatag

SEQ ID NO: 42663 - DNA, 456 bp, Artificial Sequence
  Description of Artificial Sequence: Synthetic coding sequence
atgtggcggggcctgtggaccctggccgcccaggccgcccggggccccaggaggctctgtaccaggagaagttctggtgcacccgctccgggaagtggggccacaattttcgcgctttcttcagggcagggacgctgcggaatcgctgtgatcaggaccagtgggccagcttctgggcacgctctgcgtatcctgactgcaccaagggatctacccctggctaggcacgcatcactgagactgctgtcggaccccagatccggggagcctctggacagggccctcgtgctgtggttcccaggccctcagagcttcaccggcgaagattgcgtggaattccatgtgcatggggggccggctgtggtgtctggtgtgctgcaggctctgggatccgtgcctggtcttcgacccgccgaacctggcgccgggagaggatcagctcagggttgcacctag

SEQ ID NO: 42664 - DNA, 1416 bp, Artificial Sequence
  Description of Artificial Sequence: Synthetic coding sequence
atgtggcggggcctgtggaccctggccgcccaggccgcccggggcccacggcgtctctgtacaaggcgcagttctggtgcgcccgcccctggaagtggggccacgatctttgccctcagcagtggccaagggcggtgtggcattgccgtgatccgcaccagtgggcccgcttcgggtcacgctcttcggatccttactgcccctcgtgatctgcccctggctcgccacgcgagccttagattactgagcgacccacgctctggggaaccgctggatcgcgccctggtgttatggttccctggtcctcagtcgttcaccggcgaggattgtgtggagttccacgtccacggcggccccgccgtcgtttctggagtgcttcaggctctgggctcagttcccgggttacgcccagccgaagcaggcgaatttaccagaagggcttttgccaatggcaaactgaatttgaccgaggtggaaggcctggcggatctcattcatgctgagacggaggcccaaaggcgacaggccttgcgtcagctagacggagagctagggcatctctgccggggctgggccgaaacgctcacgaaagcccttgctcatgtcgaggcttatatcgactttggggaggatgacaacttggaagagggggtcctggaacaggcagacatcgaagtccgagctctgcaggtggccctgggggcccatctgagagacgctcgcaggggccagcgattgagaagtggagtccacgtcgtcgtgacgggcccccctaatgccgggaagtcaagtctggtcaatctactgtcccgaaagcccgttagcatcgtctccccagagcctggtactactagagatgtgctcgaaacaccagtcgatctggcaggattcccagttctgcttagcgatacagctggcctgcgcgagggggtgggccctgtcgagcaagagggtgtccgcagggcccgagagtcttgtaattttctggccacagtagtggcctcagtaggagctcagagcccttctgactcaagccagcgcctactcttagtcctgaataagtccgatctgctgtcccccgaagggccagggcccggaccagacttgccaccccatttactcctgtcctgcttgaccggggaagggctggacgggctgctcgaagctctgaggaaggagctggcagccgtgtgtggagacccctccacagaccccccattgctgacacgcgctcggcaccagcaccacctgcaggggtgtctggacgcccttggccactacaaacagtctaaggacctcgcactagctgctgaggccctgcgcgtagcccgaggtcatctgacgcgcctgactggaggcgggggtactgaggaaatcctggatatcattttccaagacttttgcgtgggcaagtag

SEQ ID NO: 42665 - DNA, 423 bp, Artificial Sequence
  Description of Artificial Sequence: Synthetic coding sequence
atgcggaaggtgaagttcacccagcagaactaccacgaccggctgagccagatactgaccgattttcccaagttggacgacattcaccccttctatgccgatctgatgaacatcctttacgacaaagatcattataagcttgctttgggccagatcaatattgctaagaatctggtggacaatgtggccaaagactatgtccggctaatgaagtacggcgacagtctgtacagatgtaaacagctcaagagggccgccctcggcagaatgtgcactgtaattaaaagacagaagcagagcttggagtatctggaacaagtccgccagcatctgagtcggcttcctacaatcgaccctaacactcgaaccttgctcctatgcgggtacccaaatgtggggaagagtagcttcattaacaagtag

SEQ ID NO: 42666 - DNA, 1905 bp, Artificial Sequence
  Description of Artificial Sequence: Synthetic coding sequence
atggcccactacaacttcaagaagatcaccgtggtgcccagcgccaaggactttattgatctgacactgtcaaagactcagaggaaaacaccaacagtgattcataaacattaccagatccaccgaattagacatttttacatgaggaaggtcaagttcactcagcaaaattaccatgataggctttctcagatccttaccgattttccaaagctagacgatatacacccgttttatgctgatctgatgaacatcctttacgacaaggaccactacaagctcgccttagggcagattaacattgccaaaaatctggtggataatgtggccaaagattatgtgagactgatgaagtacggggattctctttatcggtgtaagcagttgaagcgagcagctctggggagaatgtgcacagtcatcaagagacaaaagcagtctctcgaatacctggagcaagtgcgccagcacttgagccggctgccaaccattgatccaaacacccgcacgctgttattatgtggttaccctaacgttggcaaatcatcattcattaacaaagtgacacgggccgatgttgatgtgcagccctacgcattcaccaccaaatctcttttcgtgggccacatggactacaaatatctgagatggcaggtggtcgacacaccggggatactagatcaccccttagaggatagaaacacaattgaaatgcaggccataacggctctcgcgcacctgcgggccgcagtgctttatgtgatggatctgagcgagcaatgtggacacggcctgcgcgaacagctggagctgttccagaatatcaggcctctcttcattaacaaacctttgatcgttgttgcaaataagtgcgacgtaaaacggatagccgagctctccgaagacgatcagaagatcttcaccgatttgcagagcgaaggatttcccgttatcgagacgtccaccctaacagaggagggagttattaaggttaaaaccgaggcgtgcgatcgtctcctggctcacagagtcgaaacaaagatgaaaggaaacaaagtcaatgaagtgctcaaccgcttgcacctagctattcccactcgacgggatgataaggagagacccccatttatccctgagggcgtggtggcgaggaggaaaaggatggaaaccgaggagtctcggaaaaagcgggagcgtgatcttgagctggagatgggcgatgactacatcctggacttgcagaaatattgggatttgatgaaccttagcgagaagcacgataaaatccctgaaatttgggaagggcacaacatagcagattacatcgaccctgcgatcatgaaaaagttagaagagctggagaaggaagaggagttacgcactgccgccggagaatatgattctgtctccgagagtgaagacgaggaaatgcttgaaattcggcagttggcaaagcagatccgggagaagaagaaactaaagatcctcgagtcaaaagagaagaacacccaaggaccacggatgcctaggaccgcaaaaaaggtgcagcgcacagtgctcgaaaaagagatgaggtccctgggagttgatatggacgacaaggacgacgcccattacgcagtgcaagcgcggcggagccgaagcatcaccagaaaaagaaaacgggaggactccgctcccccctcttctgttgcccgcagtggttcctgtagtcgtacacctcgagatgtgagtgggctgcgcgatgtaaaaatggtgaagaaagcgaaaacaatgatgaagaacgcacaaaagaagatgaaccgactcgggaagaagggcgaagcagatcggcatgtgttcgatatgaagcctaaacacctgctgtctggcaaacgaaaggctggcaagaaggaccggagatag

SEQ ID NO: 42667 - DNA, 1557 bp, Artificial Sequence
  Description of Artificial Sequence: Synthetic coding sequence
atgaagtacggcgacagcctgtaccggtgcaagcagctgaagcgggccgcactgggacgaatgtgtaccgtcatcaagaggcagaagcaatcgctcgagtacttagagcaagtgagacagcatctgtctaggctgccgaccatcgatcccaacactagaaccctgctcctttgcgggtacccgaacgtgggcaagagttccttcattaataaggtgacaagagccgacgttgatgtacagccatatgcctttaccaccaagagcctttttgttgggcacatggactacaaatatctacggtggcaggttgtggatacacctggtatactggatcatcctttagaagacagaaatactatcgaaatgcaggccattaccgcccttgcgcacttacgagcagctgtgctgtatgttatggatctgtctgagcagtgtggccatggcctccgggagcagctggagctgttccaaaatatcaggcctctgttcatcaataagccgcttatcgtggtggcaaataagtgcgacgttaagaggattgctgaactgagcgaggacgaccaaaaaatttttaccgatcttcagtcagaaggtttccccgtgatcgagaccagtaccctaactgaggaaggagttatcaaggtgaagactgaggcctgcgacaggctcctggcgcacagggtcgaaactaagatgaaggggaacaaagttaacgaggtgctcaaccgcctacatctcgccatacccacgagacgcgatgacaaggagcgccctccattcatcccagaaggtgttgtagcccggaggaagagaatggaaactgaggagtcaaggaaaaagcgagagcgcgacctcgagcttgagatgggcgacgattacattcttgatcttcagaagtattgggatcttatgaatctgtccgagaagcacgacaagatccccgagatctgggagggtcacaatatcgctgattacattgatccggcaataatgaagaagctggaagaactggaaaaagaggaagagctgagaaccgcggcaggagaatatgacagcgtcagtgaaagcgaagacgaagagatgctggaaattcgacagctagcgaaacagattcgtgagaagaagaaactgaagatcctggagagcaaggaaaagaatactcaggggcctagaatgcctaggacagcaaaaaaggtacaacggacagttttggagaaggagatgcgatcccttggggtggacatggacgataaagatgatgcacattatgcggtgcaggcccgccgctctaggagcataaccagaaagaggaaaagagaggactccgcaccaccttcctctgtggccaggtccggcagctgttcacgtactcccagagacgtctctggacttagagacgtgaaaatggtcaagaaagcaaagaccatgatgaaaaacgcacagaagaaaatgaaccgccttggaaagaagggtgaggcagacaggcacgtattcgacatgaagccaaaacacctgctttccggaaagagaaaggccgggaaaaaggatcgccggtag

SEQ ID NO: 42668 - DNA, 1764 bp, Artificial Sequence
  Description of Artificial Sequence: Synthetic coding sequence
atgcggaaggtgaagttcacccagcagaactaccacgaccggctgagtcagatcttaactgatttccctaaactggatgatattcatcctttttatgccgacctgatgaatatcttatatgataaggaccactataaacttgcactggggcagatcaacatcgcaaagaacttagtcgataatgtggctaaggattatgtcagactcatgaagtatggcgatagtttgtaccgctgcaaacaactcaaacgggcagctcttggccggatgtgcaccgtaattaagagacagaaacaaagtctggaataccttgagcaggtccgccagcacctctccagactgcccacaatcgacccaaacacccggactcttctactctgcggataccccaatgtcggtaagagcagcttcatcaacaaagtgacaagagccgacgtcgacgtacagccgtatgcatttaccacaaagtcactatttgtgggtcatatggactacaaatatctcaggtggcaagtagtcgacactcctggaatcttggaccatccgctggaggacaggaataccatcgagatgcaagccatcaccgcgctcgcccacttgcgagccgctgtgctgtatgtgatggatttatcggaacaatgcggccacggactacgtgagcagctcgagctcttccagaacattaggccactgttcatcaacaagccgctcatcgttgttgcaaacaaatgtgatgtaaaaaggatcgctgagttgagcgaggacgatcaaaagatctttacagatttgcagagtgaaggttttcctgtgatcgaaacctccacccttacagaggagggagtcattaaagtcaagacagaagcctgtgaccggctgctggcacatagagtggagactaagatgaaaggtaacaaagtgaacgaagtcttaaatcgcctccatttagctatcccaacaaggcgagacgataaagagcggccccccttcatacctgaaggcgtcgtggccagacgaaaaaggatggagacagaggagtcccgtaagaagagggaaagagacctggagcttgagatgggcgacgattatattctcgatctgcaaaagtactgggatcttatgaatttgtctgaaaagcacgacaaaattccagagatctgggagggccacaatattgcagactatatcgatcccgcaatcatgaaaaaattggaagagttggaaaaggaagaggaattgcggactgcagccggtgagtacgacagcgtatcagagtccgaggacgaggagatgcttgaaatccgccagcttgccaagcaaatccgtgagaagaagaaattaaagatcttagagtctaaggaaaaaaatacacaggggcctcgcatgcctcggacggcaaagaaggtgcagagaacagtcctggagaaggaaatgcgtagcctgggtgttgacatggatgataaggacgatgcacattatgctgttcaggcaagacgctctcgatctattactcgaaagaggaaaagggaagatagtgcaccgccttcttccgtggctagatctggctcatgtagtcgcacacctagggacgtgagtggacttcgtgatgttaaaatggtcaagaaggccaagactatgatgaagaatgcgcagaagaagatgaatcgattgggtaagaaaggggaagccgacaggcacgtgtttgatatgaagcctaagcatctcctaagtgggaaaagaaaggccggaaagaaggaccggcggtag

SEQ ID NO: 42669 - DNA, 1998 bp, Artificial Sequence
  Description of Artificial Sequence: Synthetic coding sequence
atgagcgagcagagctgccagatgagcgagctgcggctgctgctgcttgggaagtgcaggagtggaaagtccgccacagggaatgcaatattaggaaaacatgtgtttaagagtaaattttccgaccaaaccgtcatcaaaatgtgtcaaagagaatcttgggtgctgcgggaacgcaaagtggtggtgatcgacacaccagaccttttctcctcaattgcttgcgccgaggataagcagcgaaacatccagcactgcctggagctgagtgctccatcactccacgcgttgctgctggttatagccattggtcattttactcgtgaagatgaggaaactgcaaaggggatccagcaggtgttcggggcagaagctcgacgccatatcatcatcgtgttcacgaggaaagacgacctcggggatgacttacttcaggattttattgagaagaacaaacccttaaagcagcttgtgcaggactacgagggccgttattgcattttcaacaataaaaccaatagtaaggatgagcagatcactcaggtccttgagttgctgagaaaagtggagtctctggttaatacaaatgggggcccctaccacgtgaacttcaagaccgaagggagtcgcttccaggattgtgtaaatgaagctgccagtcaagagggagacaaaccgcagggaccacgcgagcggcagttgcaatcaaccgggccagagcagaatcctgggacttctgagttgacagtgttgctggtgggcaagcgcggcgcagggaaatccgcagctgggaatagcatcctggggcgacaggcctttcagaccggcttcagcgaacagagtgtcacacagtccttcctcagcgaatcacggagctggcgaaagaaaaaagtgtctattatcgatgcacccgacatctcatctttaaaaaacatcgatagcgaggtccgcaagcacatctgcacaggccctcacgcttttctgctagtaacaccactggggttctacaccaagaatgacgaggctgtcctgtctacaatccaaaacaatttcggcgagaagttttttgaatacatgattattctactgaccaggaaggaggacttgggcgaccaggatctggacaccttcctgcgtaattcaaataaggccctgtacgggttaattcagaagtgcaagaaccgttactcagctttcaactatagagcaactggagaagaggagcaaagacaggcggatgagctcctggagaaaatcgagagcatggttcaccagaatgggaacaaacactgcgttttccgcgagaaggagacgctgaacattgtgttagtggggagatccgggacaggtaagtccgctacagggaacagtatcctcggatccctcgtgtttacatcccgcctgagggcccagcccgtcactaagaccagtcagtctggccgccgaacttgggatgggcaggaagtggtggtcgtcgacactcctagctttaatcaaatgctcgacgtcgaaaaggacccatcccgactcgaagaggaagtaaagcgctgtctctcctgttgcgagaagggcgatactttctttgtcctcgtttttcagctggggcggttcaccgaagaagacaagactgccgttgccaaactagaggctattttcggggccgacttcacgaaatatgctataatgctgttcacccgaaaggaggacctgggtgccggaaacctagaagattttatgaagaactcagacaataaggcccttaggaggatcttcaaaaagtgtgggagaagagtgtgcgcctttaacaataaggagacaggccaggctcaggagacccaggttaaagccctgctaactaaggtgaacgatctgaggaaggagagtggttggtcaggctatcctcatacccaggaaaatgtcagcaaactgataaagaatgttcaagagatgtcgcaagctgaaaagctgttgaagaacctgatcggcattctccagtag

SEQ ID NO: 42670 - DNA, 924 bp, Artificial Sequence
  Description of Artificial Sequence: Synthetic coding sequence
atggccgcccccggcctgcggctgggcgccggccggctgttcgagatgccagcagtcttagagaggttgtccaggtacaattcgaccagccaggctttcgccgaagtgctgcgactgccaaaacagcagctccgaaagcttctgtaccctttgcaggaggtggagcgcttcctggcgccatacggccggcaggatctgcatctacggatcttcgatccttcccccgaggatatcgcgagagcggacaacatcttcaccgcaacagagagaaatagaattgactacgtgtccagcgcggtgcgaattgatcacgcaccagatctgccccgcccggaagtgcgaggagactctacagtgcatctccgcgccggcgtgacggccctgcctttacctggacggcccgcacgaggagtgttctaccgtcagtcaaatgtcggcaagtcctccctgattaaactgtactttcattggcctctgagactcaaatccgaaagccccaagaatcaggatacgcaggaaaacgaatttttcaaagtaggcaagcactttacagtcgtcgacatgccaggttatgggttccgggctcccgaagatttcgttgatatggtggagacttacttgaaggaacgaagaaatctaaagagaacgtttttgctcgtggactccgtggtgggaattcagaagaccgataatatcgccatcgagatgtgtgaggaattcgctctgccctatgtcattgtgctgacgaagatcgacaagagctccaaggggcatcttctgaaacaagtactccagatccaaaaatttgtcaacatgaaaacccaggggtgctttccacagttattccctgtctctgctgtgacattttcaggtatccaccttcttaggtgcttcatcgcttccgtgaccggatctctggattag

SEQ ID NO: 42671 - DNA, 756 bp, Artificial Sequence
  Description of Artificial Sequence: Synthetic coding sequence
atggccgcccccggcctgcggctgggcgccggccggctgttcgagatgccggccgtgctcgaaagactaagcagatacaatagcactagccaggctttcgccgaagttttgagactacctaagcagcagctacgcaagttgctctaccctcttcaggaggtcgagcgtttcctggcgccttatgggagacaagacctgcaccttagaattttcgatcccagccctgaggatattgctcgagccgataatatctttacagcaactgaaaggaatcgtattgattatgtgagttcggctgtgcggatcgatcatgcacccgacctgcccaggcctgagggccacaccaagaagatgaattttttcaaggtgggcaaacattttacagtggtggacatgcctggttacgggttcagggcacccgaagattttgtggatatggttgaaacctacttgaaagagcgccgcaacctcaagagaacattcctccttgtggattccgtggtggggattcagaagaccgataacatcgccatcgaaatgtgtgaagagttcgctcttccatatgtcatcgtactaaccaagattgacaaaagtagcaagggtcatctgctcaaacaggtgttgcagatacagaaattcgtgaatatgaaaacccaggggtgctttcctcagctgttcccagtgagtgccgttacgttctctggaattcatcttctccgttgcttcatcgcatcggtaacaggaagcctggattag

SEQ ID NO: 42672 - DNA, 855 bp, Artificial Sequence
  Description of Artificial Sequence: Synthetic coding sequence
atggccgcccccggcctgcggctgggcgccggccggctgttcgagatgcccgcagttctcgagcgcctgtctaggtacaactctacaagccaggcattcgctgaggtgctgcgtctaccaaagcagcagctcaggaagttgttgtaccccctgcaggaggtcgagagattcctggcaccttatggtcgacaggatttacacttgagaatttttgacccgtcccctgaggacattgctcgggctgacaacattttcaccgccacagaaagaaaccggatagactacgtgtcctctgccgtgcgcatcgaccacgcccctgatcttccaagacctgaggtatgcttcatcgggaggagcaatgttggaaaatctagcctcataaaggccctattctcacttgccccggaggtggaggtgcgcgtctcaaaaaagcccggccacaccaagaagatgaattttttcaaagtcggaaaacatttcaccgtggttgacatgccaggttatgggttcagggcccccgaggacttcgtagatatggtggagacctaccttaaagagaggcgtaacctgaaacgaacatttctgctggttgacagcgtggtggggattcaaaaaacggacaacatcgccattgagatgtgcgaagagttcgccctcccttacgtgatcgtgctgaccaagatcgacaaatcatcaaagggccatctccttaagcaagttttgcagattcagaaatttgtgaatatgaaaacacagggatgcttcccacaactgttccctgtgagcgcggttactttttctggcattcacctgttgcggtgctttatcgcctctgttacgggctccctcgactag

SEQ ID NO: 42673 - DNA, 522 bp, Artificial Sequence
  Description of Artificial Sequence: Synthetic coding sequence
atggtgtgcttcatcggccggagcaacgtgggcaagagcagcctgatcaaagctctgttttcacttgccccagaggtggaggtgagagtgtccaagaaacctggtcatacaaaaaagatgaacttctttaaagtcgggaaacacttcaccgtcgtcgatatgcctggctatggcttcagggccccagaggacttcgtggacatggtggagacatacttaaaggaacggcggaaccttaagaggacctttttgttggttgactccgtcgtgggtatccaaaaaaccgacaacattgctatagaaatgtgtgaggagtttgccctcccttacgtgattgttcttaccaaaatcgacaagtctagcaaaggacatctgctaaaacaggtgctgcagatccaaaaattcgttaatatgaagacgcaaggctgcttcccccaactcttccccgttagcgcagttacgtttagtggtattcatttattaaggtgtttcatcgcgtcggtgacgggcagtctggattag

SEQ ID NO: 42674 - DNA, 405 bp, Artificial Sequence
  Description of Artificial Sequence: Synthetic coding sequence
atgaacttcttcaaggtgggcaagcacttcaccgtggtggacatgccaggctacggctttcgagcccccgaggactttgtggacatggttgaaacgtacttgaaagaacggcggaatttgaagcgaacattcctcctcgtggatagtgtggtggggatccaaaaaaccgataatatcgctatcgagatgtgtgaggaatttgctctgccgtacgttattgtcctgactaaaatcgacaagtcaagcaagggccacctgctgaagcaggtcctgcagatccagaagtttgtgaacatgaaaacacaggggtgctttcctcagctcttccccgtctccgccgtgactttttctggaatccacctgctgagatgcttcattgcctccgtaaccggcagtctggattag

SEQ ID NO: 42675 - DNA, 756 bp, Artificial Sequence
  Description of Artificial Sequence: Synthetic coding sequence
atggccgcccccggcctgcggctgggcgccggccggctgttcgagatgccagccgtgttggagcgactctcacggtataacagcacttctcaggcgtttgccgaggtgctcaggctgccaaaacaacagctgcgcaaactgttatatccattgcaggaggtcgaaaggtttcttgctccttacgggagacaggacctccaccttcgcatattcgacccgtccccagaggacattgctagagccgataatatttttacggccacggagcgtaacagaatcgactacgtgagcagcgccgtgagaattgatcacgcgcccgatttaccccggccggagggacacacgaaaaaaatgaacttcttcaaagtgggcaagcatttcacagtggtcgatatgccaggttatggctttagagcccctgaggatttcgtcgatatggttgaaacgtacctgaaagagaggcgcaacttaaagcggacttttctactagtcgatagtgtcgttgggatccagaagaccgacaacatcgccatcgaaatgtgcgaagagtttgcactgccctatgtcatcgtgctgaccaaaatagataaaagctctaagggtcacctgttgaagcaagttctccaaattcagaagtttgttaatatgaagacccagggctgctttccacaactctttcccgtctccgctgtaaccttcagtggtattcatctcttacgttgctttatcgcgagcgtcacgggttccctcgactag

SEQ ID NO: 42676 - DNA, 462 bp, Artificial Sequence
  Description of Artificial Sequence: Synthetic coding sequence
atgaccgagcagatgaccctgcggggcaccctgaagggccacaacgggtgggtgacacaaatcgccacaaccccacagtttccagatatgatattgagcgcgagtagagataagacaatcatcatgtggaaattgacccgtgacgaaacaaattatggcatcccccagagagccttacgcgggcacagtcatttcgtgagcgacgtagtgatcagcagtgacggacagtttgcactatccgggagctgggacggaacgctgcggctttgggaccttaccacagggacgactaccaggaggtttgtaggccacacaaaggacgtcctgtccgttgctttctcatctgacaaccgacagatagtcagcggcagccgcgataaaacgattaaactgtggaacactctgggtgtatgcaagtacacagtgcagtcccattccgttgcccaggccggagtacagtag

SEQ ID NO: 42677 - DNA, 954 bp, Artificial Sequence
  Description of Artificial Sequence: Synthetic coding sequence
atgaccgagcagatgaccctgcggggcaccctgaagggccacaacggttgggtgacccagatcgccacaactcctcaatttcccgacatgattctcagtgcctcccgggacaaaacaatcatcatgtggaaactgacaagggacgagacaaactacggtattccccaaagggcgttaagaggacatagccactttgtgagcgacgttgtgatctcatctgatggtcagtttgccctgtcagggtcctgggacggcacgttaagactttgggatttgacaaccggtacaactacccgcagatttgtcgggcacactaaagatgttctcagcgtggcgtttagcagtgacaacaggcagatcgtgtccggcagtcgagacaagaccataaaattatggaatactttaggcgtgtgcaaatatactgtgcaggacgagtcccacagtgagtgggtcagttgcgttaggtttagtcctaattcttccaatcctatcatcgtgtcctgcggctgggataaactggtgaaggtttggaatctggccaactgcaagctgaaaactaatcatattggccacaccggatacctcaacaccgtgaccgtgagccctgacggctcattgtgtgccagtgggggaaaggatggccaggctatgttgtgggacctgaatgaggggaagcacctctacacactggatggcggtgatataatcaacgctctctgctttagccccaaccggtattggctctgcgctgctacgggaccatctatcaaaatctgggacctggaggggaagatcatcgtcgacgaactgaaacaggaggtcatctccacttcctccaaagccgagcctccacaatgcacgtcgctggcatggtccgctgatggacaaaccctgtttgcaggctacacagacaacctagtcagggtgtggcaagtgaccattggcactagatag

SEQ ID NO: 42678 - DNA, 207 bp, Artificial Sequence
  Description of Artificial Sequence: Synthetic coding sequence
atgagcagcggcgccagcgccagcgccctgcagcggctggtggagcagttaaagctggaggcgggagtggagagaattaaagtgagtcaagccgccgcagagctgcagcagtattgcatgcagaacgcatgcaaagatgctttgctagtgggcgtgcctgctggttcaaacccctttcgagagccgaggtcgtgtgctctgctgtag

SEQ ID NO: 42679 - DNA, 219 bp, Artificial Sequence
  Description of Artificial Sequence: Synthetic coding sequence
atgagcagcaagaccgccagcaccaacaacatcgcccaggcccggaggaccgtgcagcagctgagactcgaagccagcattgagcgcatcaaggtgtccaaagcctccgctgacctcatgagttattgcgaggaacacgccagatccgatccgcttctgatcggaattcccacgtcagagaacccctttaaggataaaaagacttgtatcatactgtag

SEQ ID NO: 42680 - DNA, 228 bp, Artificial Sequence
  Description of Artificial Sequence: Synthetic coding sequence
atgaagggcgagacccccgtgaacagcaccatgagcatcggccaggctcggaagatggtggaacagttgaagatagaagctagtctgtgtcggattaaggtcagtaaggccgctgctgacctgatgacctactgtgacgcccatgcttgcgaagacccattaatcactcctgtgcctacaagcgagaatcccttcagggagaaaaagttcttctgcgccttgctgtag

SEQ ID NO: 42681 - DNA, 228 bp, Artificial Sequence
  Description of Artificial Sequence: Synthetic coding sequence
atgaaggagggcatgagcaacaacagcaccaccagcatcagccaggctaggaaagctgtagagcagttgaaaatggaggcctgcatggatcgtgttaaagtctcgcaagccgctgccgatctcctggcttactgcgaagctcacgtgcgagaagatccactgattatcccggtgcctgcaagtgagaacccgttccgggaaaagaagttcttttgtaccattctctag

SEQ ID NO: 42682 - DNA, 228 bp, Artificial Sequence
  Description of Artificial Sequence: Synthetic coding sequence
atgaaggagggcatgagcaacaacagcaccaccagcatcagccaggcccgaaaagctgtggaacaactgaaaatggaggcctgcatggaccgggtgaaagtgagccaggctgccgcggacctgctcgcttattgcgaggcgcacgtgcgagaagacccgctaattatacctgtcccagcctctgagaacccgttcagagagaaaaaatttttctgtacaatcctttag

SEQ ID NO: 42683 - DNA, 228 bp, Artificial Sequence
  Description of Artificial Sequence: Synthetic coding sequence
atgaaggagggcatgagcaacaacagcaccaccagcatcagccaggccagaaaggccgtcgagcagctcaagatggaggcctgtatggaccgggtgaaagtttctcaggccgctgctgaccttttagcgtattgcgaggcccacgttcgtgaggacccactgatcatccccgtccctgcatcagaaaacccttttagggaaaagaagttcttttgcaccatcttgtag

SEQ ID NO: 42684 - DNA, 228 bp, Artificial Sequence
  Description of Artificial Sequence: Synthetic coding sequence
atgaaggagggcatgagcaacaacagcaccaccagcatcagccaggcccggaaggctgttgaacaactgaagatggaggcctgtatggatcgggtgaaagtgagccaggccgccgccgacctgctggcttactgcgaagcacacgtaagagaggacccactgataatcccagtgcccgccagcgagaatccttttcgcgagaagaaattcttttgtaccatcttgtag

SEQ ID NO: 42685 - DNA, 207 bp, Artificial Sequence
  Description of Artificial Sequence: Synthetic coding sequence
atgagcgccaccaacaacatcgcccaggcccggaagctggtggagcagttacgcatcgaagcgggaattgaacgtatcaaagtctcaaaggcagcctcagacctcatgagttactgtgagcagcatgcccggaatgatcccctgctggtcggggtacccgcttctgaaaaccctttcaaagacaagaagccttgtataattctgtag

SEQ ID NO: 42686 - DNA, 141 bp, Artificial Sequence
  Description of Artificial Sequence: Synthetic coding sequence
atgcccgtgatcaacatcgaggacctgaccgagaaggacaagctgaagatggaggtggaccagttaaagaaagaggtgacgctcgaacgaatgctgattccagctagacatttgcaaaaccagtctcttatggactattag

SEQ ID NO: 42687 - DNA, 141 bp, Artificial Sequence
  Description of Artificial Sequence: Synthetic coding sequence
atgcccgtgatcaacatcgaggacctgaccgagaaggacaagctgaagatggaagtggaccagcttaagaaggaggtgactctcgaacgtatgctgatcccagcaaggcacctgcagaaccagtcccttatggactactag

SEQ ID NO: 42688 - DNA, 141 bp, Artificial Sequence
  Description of Artificial Sequence: Synthetic coding sequence
atgcccgtgatcaacatcgaggacctgaccgagaaggacaagctgaaaatggaggtcgaccagttgaaaaaagaggtgacgcttgagcgtatgctaatcccagcccggcatctccagaaccagtctctaatggactactag

SEQ ID NO: 42689 - DNA, 1065 bp, Artificial Sequence
  Description of Artificial Sequence: Synthetic coding sequence
atgggcagcggcatcagcagcgagagcaaggagagcgccaagcggtctaaggagctagaaaaaaagctgcaagaggacgcggagagggatgcacgcaccgtcaaactactgttacttggggctggggaatctggcaaaagcacaattgtaaagcagatgaagattatccacaaaaacggatacagcgagcaggaatgcatggagtttaaagccgttatctacagtaatacactgcaatctatcttggctatcgtaaaagcaatgaccaccttgggaattgattacgttaacccccgcagcgccgaggatcagagacagttgtatgccatggctaacacactggaggacggcggaatgacccctcagctggcagaggtgattaagcggttgtggcgagatcccggcatccaggcctgcttcgagcgggccagcgagtatcagttaaacgacagcgccgcctattacctcaacgatctggaccgaatcacagcaagcgggtacgtgccgaacgaacaggacgtacttcattcacgggtaaagaccaccggtatcatcgagacgcagtttagctttaaagacctccatttcaggatgttcgacgtggggggacagcgcagcgagcgaaagaagtggattcactgttttgaaggtgtcacgtgtatcatcttttgtgcggcgctttctgcctacgatatggtgcttgtggaggacgaagaagtgaatcggatgcatgaatcccttcatttatttaatagcatctgtaaccacaaatacttctccactacttcaatcgtactgttcttgaacaagaaagacatctttcaagaaaaggttaccaaggtgcatctcagtatctgctttcctgagtatacaggtcctaatacctttgaggatgccggaaactacattaagaaccaatttctcgatttaaacctgaaaaaagaagacaaagaaatctattctcacatgacttgcgccacagacacccagaacgtgaagtttgtcttcgacgctgtcacggacataattatcaaggagaatctgaaggattgcggcctgttctag

SEQ ID NO: 42690 - DNA, 1749 bp, Artificial Sequence
  Description of Artificial Sequence: Synthetic coding sequence
atgatgaagctgcggcacaagaacaagaagcccggcgagggcagcaagggtcacaaaaagatttcctggccgtatcctcagccagcaaaacagaatggcaaaaaggcaacctctaaggttccgagtgcaccccacttcgtccaccccaatgaccacgctaatcgggaggctgaactgaagaagaagtgggtcgaagaaatgagagagaagcaacaggctgcgcgggagcaggagagacagaaacgcaggacaatcgagtcatattgtcaagacgtcttgagacgccaggaagagttcgaacacaaagaagaggtgctccaggaattgaacatgttcccacaactggacgacgaagcaactcggaaagcatactataaagaattcaggaaagttgtggagtactccgacgtgattttggaagtgcttgatgccagagatcccctaggttgtcgctgttttcagatggaagaagctgtcctgcgggcccagggcaacaaaaagctagtgttggtgctgaacaagatcgacctggtcccaaaggaagtcgttgagaaatggttagactacttgcggaacgaactccccacagttgcgtttaaagcttccactcaacatcaggtgaagaatctgaatagatgtagcgtccctgtggatcaggccagtgagtcattactgaaatcgaaggcctgtttcggagccgagaatctaatgagggtactagggaattactgccgcctgggagaagtccgcacacacattagagttggggtggtggggcttcctaatgttggaaagtcaagtctgatcaattcactcaagagaagccgggcttgtagcgtgggcgccgtgcccggaatcaccaagtttatgcaagaagtctatttggataagtttattcgtctactagacgcacccggcatcgtacccgggccgaattcagaggtgggcaccatcctccggaactgcgttcatgttcagaagctagcagaccccgtcactcctgtagaaaccatattgcagcgatgcaacctggaagaaatcagtaattattatggtgtgtctggatttcagacaactgaacactttcttacagcagtggcccatcggttgggaaaaaaaaagaaagggggcctctactctcaagagcaagcggccaaagccgtgctggccgactgggtgtcggggaaaatctccttttacatcccaccgccagcaacccacaccctgcctacccacctctccgccgaaatagtcaaggaaatgactgaggtcttcgacatcgaagacacggaacaggccaacgaggacaccatggagtgtctggcgaccggcgagagcgatgaactcctgggagacacggaccctcttgagatggagatcaaactactgcacagtcctatgactaagatagccgacgctatagaaaacaagacgacagtttataaaataggggacctgaccgggtattgcacaaacccaaaccgccaccagatgggttgggctaaaaggaatgtcgaccacaggccaaagtcgaactccatggtcgatgtgtgcagcgtggatcgccgcagtgtacttcaacggataatggagacagacccacttcagcagggacaggccctggcaagcgctctgaagaataagaaaaaaatgcaaaagagggcagacaaaattgcatctaaactctccgattctatgatgtcagctcttgacctgagcggaaatgccgatgatggagtcggggactag

SEQ ID NO: 42691 - DNA, 1749 bp, Artificial Sequence
  Description of Artificial Sequence: Synthetic coding sequence
atgatgaagctgcggcacaagaacaagaagcccggcgagggcagcaaaggacacaagaaaatctcctggccctatccacagccagccaagcagaatggaaaaaaagcgacaagcaaggtgccttccgcacctcactttgtccacccaaatgatcatgcaaacagagaggccgaacttaagaagaagtgggttgaggagatgagagaaaaacagcaggccgccagagaacaggaacgccagaagaggcggaccattgaatcctactgccaggacgttctgcgccggcaggaggagttcgagcacaaagaggaagttctgcaagagctgaatatgttcccacaactcgacgacgaagccactagaaaggcctattacaaggaattccgaaaggtagtggaatacagcgacgtgatcctcgaggtgctggacgccagggaccctctgggatgcagatgttttcaaatggaggaggccgtcctcagagcacagggaaataagaagctggtcctggtcctgaacaaaattgatcttgttcctaaagaggtcgtagagaaatggctcgactacctacgcaacgagctgcccaccgtcgcgttcaaggcctcaacacagcatcaagttaaaaaccttaatcgctgctcggttcccgtagatcaggcatccgagtcactcttaaagtctaaggcctgcttcggcgctgagaacttgatgagggttctgggcaactactgtagactaggggaagtgcggacacacataagagtcggggtggtggggctcccaaacgtgggcaagagctctctgattaactcactcaaacggagccgggcctgttcagtgggagccgtgcccggcattacaaaatttatgcaggaagtgtacctagataaatttatccggctcctggacgctcctggcatcgtacctggccctaactcagaggtgggaactatccttcgcaactgtgtgcacgtgcaaaaattggctgatccggtgacccctgtggaaacaattctgcaaagatgtaatctcgaagagatcagcaactactatggagtgagcgggtttcagaccaccgagcactttcttaccgccgtggctcacagactgggaaagaagaaaaagggaggcttgtactcccaggaacaagctgcaaaggccgtcttagcggactgggtcagcggaaaaatctcattttacattcccccaccagctacacacaccctcccaacccacctcagcgccgagattgtgaaagaaatgacagaggtcttcgatatcgaggatactgagcaggctaacgaggacactatggaatgcctcgccaccggagagagtgatgagcttctcggggacacggacccgctcgagatggagatcaaactgttacacagccctatgactaaaattgcagacgccatcgagaataagaccaccgtttataagatcggagatcttactggatattgcactaaccccaatcgtcatcaaatgggatgggccaaacgcaatgttgaccatagacccaagagcaacagcatggtggacgtgtgctcagtcgacaggcgaagcgtgcttcaacgaatcatggagactgatccactacagcagggtcaagccctggctagtgctctgaagaacaagaaaaaaatgcaaaagcgcgctgataaaatcgcatcaaagttatctgactcgatgatgtctgctttagacctgagcggaaacgccgatgatggcgtgggggactag

SEQ ID NO: 42692 - DNA, 2010 bp, Artificial Sequence
  Description of Artificial Sequence: Synthetic coding sequence
atgtggaccctggtgggccggggctggggctgcgcccgggccctggctccacgtgcaacgggcgctgccttgctcgtggcccctggacctcgcagtgcaccgacgctgggagccgcgccggaaagctgggccaccgatagattatatagctcggctgaattcaaagagaagttggacatgtcacgatttcccgtggagaacatccgcaatttctctatagtcgcccatgtggatcacgggaagagcacactggccgatagactcttggagctgacaggaactatagataagaccaagaacaacaaacaagtactggataagcttcaggtagagcgagagagaggcatcacagtaaaagcacagacagccagtctgttttacaattgcgaagggaagcagtatctgctaaatttgatcgacactcccggccacgtcgacttctcctatgaggtttcgcgttcactctcggcctgccagggagtgctgctggtggtcgatgcaaatgagggaatccaagctcagacagtggcaaatttctttttggccttcgaggcccagctttcagtgatacccgtcatcaacaagatcgatctgaagaacgctgacccggagagagtagagaatcagattgaaaaggtctttgacatcccaagcgatgaatgcattaagatctcggccaagttggggacaaatgttgaatcagtcttgcaggctataatagaaaggatccccccccccaaggtccatcgtaaaaacccgcttcgggctctcgttttcgactcgacattcgaccagtatcgcggcgttatcgccaacgtcgcgctctttgacggcgtggtctccaaaggagacaaaatcgtaagcgcacacacgcagaaaacctacgaggtcaatgaggtgggagtgttaaatccgaacgagcagcccacacacaagttgtacgctggtcaggtcgggtatttgattgccggcatgaaggatgtgacggaagcccagatcggcgataccttgtgtctgcataagcaacctgtggagccactgccgggattcaaaagcgcaaagccgatggttttcgccggcatgtatcccctcgatcaaagtgaatacaacaatctgaagtccgcgatcgaaaagctgaccttgaatgacagcagtgtgacggtacatcgggactcctcactggccttaggggctggatggagactgggctttctcggtctgctccatatggaggtcttcaaccagcgcctagagcaggagtacaatgcctctgtcatactgactacgccaacggtgccttataaggctgtgctgtcttcgtcaaaactgataaaagagcatagggaaaaggagattactatcatcaatcccgcccagtttccggataagtcgaaggtcacagaataccttgaaccggttgtacttggtacaattataacaccggacgagtacactggaaaaatcatgatgctctgcgaggccagaagagccgtgcagaagaatatgattttcatcgatcagaacagggtgatgttgaagtacttgtttcctctgaatgagatcgtggtggacttttacgattccctgaaaagcctctccagcggatacgcctcgtttgactatgaagacgctggctatcagaccgcagagctggtcaagatggacatcttactcaacggcaataccgtggaggagctggtcaccgtagtgcataaggacaaagctcattctatagggaaggccatctgtgaacgcctgaaggatagcctcccgaggcagctgttcgaaattgcaatccaggcagctattgggtccaagatcatagcgcgcgaaactgtcaaagcttacagaaagaacgtgctagccaagtgttatggaggtgatatcaccagaaaaatgaagctgcttaagcgccaagccgaaggcaaaaagaaactgcgaaagataggaaacgtggaagtccctaaagacgcctttattaaggtcctgaagacacagagtagcaagtag

SEQ ID NO: 42693 - DNA, 756 bp, Artificial Sequence
  Description of Artificial Sequence: Synthetic coding sequence
atggcccaccggctgcagatccggctgctgacctgggacgtgaaggacactctgcttagactgcggcacccgctgggcgaggcctatgcaactaaggccagggcacacggtctggaggtggagccctctgccttggaacaaggcttccggcaagcttatcgtgcccagtcccatagctttccaaactacgggctgtcacacgggcttacaagccggcagtggtggctggatgtcgtgctacagacatttcacctagccggagtccaagacgcccaggccgtcgccccaatcgcagagcagttatacaaggatttcagccatccctgcacatggcaagtgctggacggtgctgaggacacactgagagaatgcagaacgagaggattgcgcctcgccgtgatctccaattttgaccgtaggctggaaggcatcctgggaggtctggggcttagggagcatttcgactttgtactgacatccgaagcagctggatggcccaagcctgacccccgcattttccaggaagccctgcgactcgcccacatggagcccgtcgtggccgcccatgtcggggacaattacctctgcgattaccaaggccctcgcgctgtaggcatgcattccttccttgtagtagggccccaggcactcgaccccgtggtacgtgattcagtaccaaaggaacacattctcccgtccctggcacacctgctgcccgccctcgactgcctggaaggcagcacccctggcttgtag

SEQ ID NO: 42694 - DNA, 756 bp, Artificial Sequence
  Description of Artificial Sequence: Synthetic coding sequence
atggcccaccggctgcagatccggctgctgacctgggacgtgaaggacactctgctgagactcagacaccctctgggtgaagcgtatgcaaccaaggcccgggcacatggactggaggtggaacctagtgcactggagcagggcttcaggcaggcataccgcgctcagtcccattctttcccaaactacgggctctctcatggactcacctctaggcagtggtggctggacgtcgtcctgcaaacatttcaccttgcgggggtgcaggatgcccaggccgtggcgcccatcgccgagcaactctataaagattttagccacccatgtacctggcaggtgcttgatggggccgaggatactctcagggaatgcaggacacggggcctgaggctggctgtgattagtaacttcgaccgaaggttggagggaatactcggcgggctgggcctacgagagcatttcgactttgtcttgaccagtgaagcagccggttggcccaaaccagaccccaggatattccaggaggctctccggcttgcacacatggaaccagtggttgccgctcacgtgggtgataactacttgtgcgattatcagggtccacgggcggtgggcatgcacagcttcctcgtcgtcggtccccaggcactggatccggtggtgagggatagtgtgcctaaggagcacatcctcccctccctggcacatctcttgccagccttagactgtttagagggctccactcccggcctctag

SEQ ID NO: 42695 - DNA, 867 bp, Artificial Sequence
  Description of Artificial Sequence: Synthetic coding sequence
atggacatcggcctgagcatcgccaacagcagcggcttccagctgtccgagttcatcctgatcggattccctggaatccatgagtggcaacactggctaagtttgcctctcgctctcggcgcaaatctgttgattattattacgatccagcatgaaacaatgttgcacgagccaatgtatcacctcctgggcatcctcgcagtcgtggacattggattagccaccactatcatgccaaagattctcgccatattttggtttgacgctaaagccatttctctgccggagtgttttgcccagatatatgctattcattcatttatgtgcatggagtcaggaatcttcctctgcatggccgtggatagatatatggctatctgctaccctctgcagtacacgtctatcgtgactgaagcctttgttataaaggcaaccctgtccgtggtcctccggaatggactgttaacaatacccgttcccgtgctggcggcccaacgccattattgcagtaggaacgagatcgatcaatgtctgtgttcaaatctgggggtgacatcattggcctgcgacgacaccacgatcaacaggttctaccagctcgccctggtgtgggttgtggttggctctgatatggggctggtgttcgcaagctattcgctgatcatccacagtgtgctgaaactcaactccgccaaagcaacctctaaagcattgaatacatgctccagccacctcatccttattctcttcttctataccgccatcatcgtggtctcagtgacgacctggcaggaggaggggcttcccgcatccttatttagcagtatgtgctgcatccttagtagcccacagcctctcactccatag

SEQ ID NO: 42696 - DNA, 513 bp, Artificial Sequence
  Description of Artificial Sequence: Synthetic coding sequence
atggccagcgtgagcagcgccaccttcagcggccacggcgcccggtcactgctccagtttctgagactggtgggccaactgaagcgagttccacggacagggtgggtataccgcaacgtacagagacctgagtctgtctccgaccatatgtatcgaatggcagttatggcgatggtgattaaggacgatcgactcaacaaggatcgggaagctatgaaacagatcacccagcttttacccgaagatctgcgcaaggaactgtatgagctgtgggaggagtacgagactcagtcctccgctgaagccaagttcgtgaaacaattagatcagtgcgagatgatcctgcaagcctcggaatatgaggacctggagcacaagcccggaagactccaggacttttatgactctactgctggcaagttcaaccatcccgagatagtccagcttgtttccgagctggaagccgagcgaagcacgaatattgccgctgctgcatctgaacctcacagttag

SEQ ID NO: 42697 - DNA, 615 bp, Artificial Sequence
  Description of Artificial Sequence: Synthetic coding sequence
atggccagcgtgagcagcgccaccttcagcggccacggcgcccggagcctgctgcagtttctgagactggtgggacagctcaaaagggtccccagaaccggttgggtgtataggaacgtacagagacccgaaagcgtctctgatcatatgtataggatggcagtgatggcaatggtcataaaagacgaccgcctcaacaaggatcgttgcgtcagactagccttggtgcatgacatggctgagtgtattgtgggcgacattgcacccgccgataatatacccaaagaggaaaagcatagacgagaggaggaggccatgaaacagatcacgcagctcctgccagaagaccttagaaaggagctgtatgaactgtgggaggaatacgagacacaaagcagcgctgaggctaagttcgtgaaacagctggatcagtgtgagatgatccttcaggcatccgaatatgaggatttggagcacaagcccggcaggctccaggatttttacgacagtacagccggcaaatttaaccacccggagattgtccagctggtctccgaactggaggccgaacggtctactaatatcgcagctgcagcctctgagccccattcctag

SEQ ID NO: 42698 - DNA, 3135 bp, Artificial Sequence
  Description of Artificial Sequence: Synthetic coding sequence
atggccctgagccccggcgccaacctggtgttccacgaggaccccaagatgacacccagtccgccatcttgcggtgcccccggcttgggaagcggcaccataccccagccacatcccgacatggctcaggtgccaatgcttaacctgctgccaagtcccggactggccttggttccggatttaaatgattctctgagtccggtgagcggagaagctagtggcctggtgtcagaaaacactccccgaccagacgacagccgcgccattgctcctgcatctctgcagattactagcagctgtagcggcgaggcactggatctggattctaaagatgttagcagaccggattctcagggcagattatgtcccgcttccaacccaattctgagcccaagttcgacggaggcaccacgactgagcagcggaaatcatcctcagtcaaatagcgaagatgctttcaagtgtctcagctccaagatcttcaagctaggacaacgcaattctaatccaagcagacacgagctaaacccattcatccggcaccatagcagggagggtcttgtgctagggcattgtatttcaaggccttcctcgaaagctctcctgattccgacgtcgaactcatctctggacctcgacagcaatccactcctaaatatgggcagtcggaatacctccaagctgaacctaaatgtcgcacccgatagccatggtactctgatccccgacaccaacgaaactatcactctggcctcccacaatatatcagaatccgtatctaagggagcatttagcaccacctggagcaccagtagtaaagagactatgaatgtggcgagctctgggcattccaggtccgatttaagtgtcacgattacccaggcttcctacgtgaccctgattccgggttccagttacgggatttctctacacagttccacacacgagcccaacagcacgattagtccgccaagttgcatgacattgatcctgggttctaatgagactctgtcactggacagcagcctgctgttttcggatacgtctacactgaccttgagctcccagcaggatgacgccaaagacaattccatccatacagtgccattggaggaaaacctggagagttggtcggagatggcttccatcaaggtgggccaatttcccctgggctttccaattagcaaccccgcaggtaaggatgccgtgactcttcaggggataccggagggggccttcgacgaggtgacaagctgtctagtaaaagtccctgagaagacagaaggggggaacaacatggcgctcgtggaaaatgttacaaccctgcagaagagccaggatctccttgaagcggaaggtgagaagaagactatgatcaaaaaaatcatgcggcagatccaagaggaaccgttagactcacttagctcaagcgtccgcaagcaagccatggagattttgactcagctttcacacacccagcccacactaggtatgcgcgaacggtccgaattggtgaacgtgtgcgtgcattctgttttctcactgcctagcgttcaggccatgcaagagaaagatgaggctaaagccgagactatccaggccctgtatcaccagacgttggaggccctccagacactcttaaaagcattgtttattgaggatcccacccccgcaggcctgaagtccattctcgaggctttgggcccatggatgaattctggcaaggcccacgaaagagccagggctgtaaacaccaatgtgagcgttttgaatcatatgcttttaaccctgccattctttatgcctctcggattccctgccttaggactgttactaggacggctcattctccatataggcgatccggacgaagagataggatgtgaggcattggacggtataatcattctatacactatactggaactacagaagcgtgctcgggacaaggaagaaactaataaaaaggagctgtatgagagcaataaacactttcttgggccatataatccagtcagtccatgccagaacatactgcgagtaatcgaggagtttggtgactttctgggacctcaacaaatcaaagatctcctgctggcggccctcgaaggactgaaaggcagcagtgaagctccaggcaaggactctcgcgaaatgatgcagctggcctcagaagttatgttatcatccgtcctcgagtggtatcgacaccgcgctttagaggtgatccctgaaatcatgcaaggtatctacatgcagctgagccatattcaggaacctagagcgagacaagtcgccctgttgccggtgtccttactcgcctcgtccttcatgaccgaagtggtggttgccttgctaatgtgtccactgccacttaactctaatggggcggagatgtggaggcagctgattctgtgtaagccatcctgcgatgtgagagatctgctcgacctgctgctcggctctctaaaggaaaaacccgtgaccaaagagggacgggcctcgatcgttccactggccgccgcttctggcttgtgcgagctgttatccgtaaactcctgtatggggagggtgagaaggatatatccacaactcctgttagctttgctcattcaggttcactaccacattggactcaacttgccagggtgcgtcgctccgcctaaggatacaaaaaagggggcgcaacctagtccctttgtgcccgtgagatgggtcgtgaaagtagtcaaaacattactgctccggatggggtgctcatatgagaccacttttcttgaagaccaaggaggttgggaacttatggaacaggtcgagtcccatcacagaggggtggccctcctcgcacgagctatggtgcaatactcctgccaggaactgtgtagaatactgtatctgctgattcctcttctagaacggggggacgaaaaacatagaattacagcgaccgccttttttgtggagcagccctgcgaggaaggaatcgtcattctgatgttgagaatctcttgggaacgtcaacagcaggccgtgacaggcgctcggtcttggagagtgacacactctgccctgccacacggagcggatggccaccagacggagacttcatcgaacttgctcgtgctccaggtgtag

SEQ ID NO: 42699 - DNA, 1179 bp, Artificial Sequence
  Description of Artificial Sequence: Synthetic coding sequence
atggtgctgatggacatccggcggcggctgcccgccatctgctggttttgtaaatctgaggccccagggagagccgaaccaggtatccagtgcgcaatccccgtgcatggtcgcccgggaggatgccccgctcctctgtctctgggatccaatgatccgttgctgccccagctgctgcagatggagcaggtgcggagaatccccgaggaatactcacttgggcgcatggcagaaggactgtctcatcacgatcctataatgaaagtgttgagcatcaggggactcgtcatactggcacgccgcagtgagaaaaccgcaaaggtcaaggcactgctcccttctatggtcaagggccttaagaatatggacggtatgctcgtggtcgaggctgttcacaacctcaaggcagtgttcaagggtagggatcaaaaattgatggacagtgcagtgtatgtggagatgctccagattctccttccacatttctcggacgctcgagaagttgtccgcagctcatgcatcaacctatacggtaaagtggtccagaagcttagggcaccaagaacccaagcaatggaggagcagttggtgtccactctcgtccctttgctgttgaccatgcaggagggaaacagcaaggtgagtcaaaagtgcgtcaagaccctgctgagatgcagctacttcatggcctgggagctgcctaaacgtgcttatagccggaagccctgggacaatcagcagcagactgtggctaaaatctgcaaatgtctcgtgaacacccaccgggacagcgcctttatattcctttcccaatccctggaatacgcaaagaattctcgagcctccctaagaaagtgtagcgtcatgtttataggctctctcgtgccttgcatggagagcatcatgacagaggatcgccttaacgaggttaaggcagctcttgacaacttaaggcacgaccctgaggcttcagtctgcatctacgcggcacaggtccaggatcacattctggcctcctgttggcagaattcttggctgccccatggaaacagctgggtctgttacagcgctacgacacaccgctggagtccttcttgcgaaaacctgcccacttctcaccagcgacgctcatggataatgcaggccctggggtcctggaagatgagcctgaaaaaatag

SEQ ID NO: 42700 - DNA, 3093 bp, Artificial Sequence
  Description of Artificial Sequence: Synthetic coding sequence
atggccctgagccccggcgccaacctggtgttccacgaggaccccaagatgacccctagcccaccttcttgtggcgccccaggattggggtccggtacaatcccccagcctcatccagatatggctcaggtccctatgttaaatcttctgccctcccccggactggccctcgtgccagacttaaatgactccctgagtcctgtgagtggcgaagccagtggactcgtctcagagaatacccccaggcccgatgatagcagagctatagctcccgcctcactacagataaccagcagctgttccggcgaggccctggacctggacagcaaggacgtttccagacccgatagtcagggaagactgtgccccgcgagtaacccaatcctcagcccctcttccacggaagcccccagactgtcaagtgggaatcacccacagagcaattctgaggacgcctttaaatgcttgtctagcaagatctttaagcttggccagcgcaacagtaaccctagcagacatgaactgaacccatttatccggcaccactcacgagaaggactggtactcggacattgtattagccgcccctcttccaaagctttactgatccccaccagtaactccagcttagaccttgattctaatcccctgcttaacatggggtccaggaacacatccaaactgaatctcaacgttgctcctgacagtcacgggaccctcattcctgacacaaatgagactatcactcttgcttcacataacattagtgagtccgttagcaaaggtgccttcagtacaacctggagcactagttcaaaagaaaccatgaacgtcgcttccagcggccactcaagatcagaccttagcgtgaccatcacccaagctagctatgtgaccctgatccccgggagttcctacggcatcagcctgcatagtagtacacacgagcctaactcgactatctcccctccaagctgcatgaccctgatattggggtctaacgagactctttcacttgactcctccttgctgttttctgacactagtaccttgactctctcctcccagcaggacgatgctaaagacaactccattcacacagtgcccctagaggagaatctggaatcttggtcagaaatggcttctatcaaggttggacagttccccctgggatttcccatctccaatccggccggcaaggacgcagttactttgcaaggcatccccgagggcgcatttgacgaggtgacttcctgtctcgttaaggtcccagagaagacagaagggggaaataatatggctctcgtagagaatgtaaccactctccagaaatctcaagacctactggaggccgagggcgaaaagaagacaatgattaagaagattatgcgccagattcaagaagagcctcttgatagtctctcaagcagcgtcaggaagcaggctatggaaatcttgacccagctgtcacacacgcagccaacactcggcatgcgcgagaggtcggagcttgtgaacgtgtgtgttcattctgtgttttccctcccgtccgtgcaggccatgcaagaaaaagacgaagccaaggcagaaaccattcaggctctgtaccatcagaccctcgaggcacttcagaccctcctgaaggcgctgtttatagaagatcccacacccgccgggctaaagagcattttggaggccctgggtccctggatgaatagtgggaaagcacacgaaagggcccgtgcggtgaacaccaatgttagcgtgctcaatcacatgctgttaacattaccttttttcatgccgctcggatttcccgctctgggtctcctcctcggccggctcatcctacacatcggcgaccccgacgaggagattggctgcgaagctctcgatggaatcataatcctatatacgatcttggaactgcaaaagcgtgccagagacaaagaagagaccaataaaaaagagctgtatgagtcgaataaacactttcttggcccatacaacccagtgtcaccatgccaaaatatactaagggtgatcgaagagtttggagactttctgggaccacagcagattaaggaccttttgctggcagccctagaggggctgaaggggagctccgaagctcctggcaaagattcaagagaaatgatgcagctcgcctccgaagttatgctgagcagtgttctagaatggtataggcacagggcccttgaggtaatcccagagattatgcagggaatctacatgcagctgtcgcacattcaggaacctcgcgccaggcaggtggccttgctgccagtttcactgctggcttctagcttcatgactgaagtggtggtggcgcttcttatgtgccccctgcctctgaactccaatggggccgagatgtggcgacagctaatcctgtgtaaaccttcttgcgatgtcagggacctactggatctgcttcttggctctttgaaggaaaagcctgtgaccaaggagggccgcgcctccatagtgccattagctgcagccagcgggctgtgcgagctgctgtccgtgaacagctgtatgggacgggtccgaaggatctacccgcaactccttctagcccttcttatccaggtgcactatcatattggcctaaaccttcctggctgcgtggctcctccaaaggatacaaagaagggagcccagccatcgccattcgtgccggtgcgctgggtggtcaaggtcgtgaagacgctgctgctgagaatgggctgtagctatgagacaacctttctggaggatcaaggaggctgggagcttatggagcaggtggaaagtcatcatcgcggggtggcacttctggccagggctatggtccagtactcttgtcaagagttgtgcaggattctctatctgttgatacctctgctggaaagaggtgacgaaaaacaccgaattaccgccaccgccttcttcgtcgagcagccctgcgaagagggcattgtgattcttatgctgcgcccgcaggatctcatgggaaaagccaccaccagctcacatcgggggtcagaactggagtcggacaccttgagttttgcaacctggtgttag

SEQ ID NO: 42701 - DNA, 3870 bp, Artificial Sequence
  Description of Artificial Sequence: Synthetic coding sequence
atggccctgagccccggcgccaacctggtgttccacgaggaccccaaaatgactccatccccgccctcttgcggtgcaccgggactggggtcagggaccattccgcaaccccatcccgatatggctcaggtacctatgctgaatttactaccaagccccgggctggcactagtgcctgatcttaacgacagcctatcgcccgtgagcggagaggcctccgggttagtctctgaaaacacccccaggcctgacgactcgagggccattgccccagcttccctgcagatcacatctagttgttccggtgaggccttagacctggactcgaaagacgtaagccggcccgatagccaaggaaggctttgccctgcctcaaatcctattctgtctcccagttccacggaggccccacgactgagctctgggaatcatccacagagcaatagtgaggacgcttttaagtgtctgtcgtccaagatattcaaactgggccaacggaactcaaatccctcaagacatgaattgaatccattcattcgacaccattcccgggaggggctcgttttgggtcactgcattagcaggcctagtagcaaggcgcttttaattccgacttctaacagttcccttgacctggactcaaaccccctcctgaacatgggttctcgcaacacgtccaaattgaatctgaatgttgcgccagactcacacggcacactaattcccgacactaacgagacaatcacactcgcatcccacaacatcagcgaaagcgtgagcaagggggctttctctactacttggtctaccagctctaaagagactatgaatgtcgcttcttccgggcactcccgaagtgacttgagtgtgaccatcactcaagcaagttatgttacccttattccaggaagctcatacgggattagtttgcacagtagtacccatgagcccaattcgaccatctctcccccatcgtgcatgaccttaatcctcgggtcaaacgagaccctctcactcgacagtagccttcttttctctgacacatccacactcactctgagctcgcagcaggacgacgcaaaagataacagtattcacacggtcccgttggaggagaacctcgagtcatggagcgagatggctagcattaaagtaggccaattcccactgggctttccaataagcaacccggccggtaaggacgctgtcacgcttcaggggatccccgaagatggggtcagtctcctgctcccgcgcctggagtgtaatggggccatcagtgcacactgtaatctttgcctgcccggcgcgttcgacgaggtgacctcatgtttagtgaaagtccctgagaaaacagaaggaggcaataacatggcacttgtagagaacgtgaccacactccagaaaagccaggatcttctcgaagcggaaggtgagaaaaaaactatgataaaaaagatcatgcgccagattcaggaggaaccattagactcactgagcagtagcgttcggaaacaggctatggagatcctcacccagctgagtcacacccagccaaccctgggcatgagggaacggtctgagttggtaaatgtgtgtgtccactctgtcttctctctgccatctgttcaggccatgcaggaaaaggatgaggccaaagcagagaccattcaggccctctatcaccagacactcgaggccctccagaccctgctcaaagcattgttcattgaagaccccactccagcaggtctgaaatccatcttagaggcactcgggccttggatgaactcagggaaggcccacgagcgtgcccgcgcagtgaatacaaatgtgtccgtgctgaaccatatgctccttacactgcctttttttatcgccatccagatgccccttgggtttcccgcactgggactccttttgggccgtctgatcctgcacatcggcgaccctgacgaggaaatcggatgtgaggcattagacggaataattatcctgtacactatcctcgagctccagaagcgggctagagacaaggaggagacaaacaagaaagagctctatgagagtaataagcattttctgggaccttacaatccagtcagcccttgtcagaacattctgagagttatcgaagagtttggagattttttgggccctcagcaaatcaaggacctgttgctggccgctctggagggcctgaagggctcgtccgaggctcccggtaaggactcccgtgagatgatgcaattagccagtgaggtgatgctgagtagcgtgctggaatggtacagacaccgagctctggaggtgattcctgaaatcatgcagggcatctacatgcagctgtcccacatccaggagccccgcgcccgacaagttgctctgctgcctgtcagtctgttagcgagtagtttcatgactgaggtcgttgtcgcgttgctcatgtgtccgctgcctctcaacagcaatggtgccgagatgtggcggcaattgattctgtgtaagccttcgtgtgacgtgcgggacctgttggatctattgctaggcagcctgaaggaaaagcctgtcaccaaagaggggcgcgcctctatcgtgccactggcagccgccagcgggctgtgcgagctcctgtctgtcaattcctgcatgggccgtgtaagacgcatctatccacagctcctgctagccctgctcatccaggttcactaccatattggcctgaacttacctggatgtgtggcccccccaaaagacaccaaaaaaggtgctcaaccttcgcctttcgtgcctgtgagatgggtggtgaaagtagtgaagaccctgctgttgagaatgggctgtagttatgaaacaacctttttggaagatcagggcggctgggagctaatggagcaggttgagtcccaccatcgaggggtcgctctcttagcaagagcaatggtgcaatattcatgtcaggagctctgtcggattctgtacttgctgattcctctgctggagcgcggcgatgagaagcatagaatcacagcaactgccttctttgtggaactgcttcagatggagcaggtccgaagaataccggaagagtactccctcggccgcatggcagaggggctttcccatcacgaccccatcatgaaggttctgtccattcgcggccttgtgatcctggcccgccgctccgagaagactgcaaaagtgaaagcactcctaccttctatggtaaaaggactaaagaatatggatggcatgttagttgtggaagccgtgcacaatttgaaggccgtgtttaagggtagggatcaaaaacttatggattccgcagtgtatgtagaaatgctgcagatcctgctgcctcacttctccgatgctcgcgaggtagtgaggtcttcttgtattaacctgtacgggaaggtggtgcaaaaattgcgagcccccagaacacaggccatggaggaacaactcgtcagtactttagtgcccctgctgctcacgatgcaggagggtaattctaaagtgtctcaaaagtgtgtcaagaccctcttaagatgcagttattttatggcttgggagctgccaaagcgagcgtactcacgtaagccatgggataatcaacaacagactgtggccaaaatatgtaagtgccttgtgaatacacatagagattcagcttttatcttcctaagccagtccctggagtacgctaagaactcccgcgccagcctcagaaagtgctcagtgatgtttattgcgaccccacggggccagcgatttcacctgttgtgccctccactgtactcacagcccttggagcaagctgggtcagcagagagagcaaagaatctcaagaggtcgccttatctctag

SEQ ID NO: 42702 - DNA, 3972 bp, Artificial Sequence
  Description of Artificial Sequence: Synthetic coding sequence
atggccctgagccccggcgccaacctggtgttccacgaggaccccaaaatgacaccgtccccgccgtcttgtggcgcccctggccttgggtcagggaccattccccagccacaccctgatatggctcaggtgccgatgcttaaccttctaccgagtcccggtctggccctcgtccccgatctgaacgactctttgtcccccgtcagcggagaggcctccggactcgtgtccgaaaatactccacgtccagatgattcacgggccattgctccagcatcgttgcagattacgtcaagttgctcaggcgaggcattggatctagactccaaggatgtgtcccggcccgacagccagggcaggctgtgccctgcctctaaccccatcctgtcccctagttccacagaggctcctaggctcagcagcggcaatcatccccaatctaacagtgaagacgcattcaagtgtctgtcttctaaaatctttaagcttgggcaacgcaatagtaacccaagccgccatgagctgaacccttttattaggcaccattccagggagggcttggtgctcggacactgtattagccgcccttcatccaaagcgctcttgatccctacctcaaacagttccctagatctggacagcaaccccctgctgaatatgggaagccggaatacctctaagcttaatctcaacgtagcaccggattcccatggcaccctgattcctgatacaaacgagaccataactctcgctagccataacatttccgagtcagtgagcaagggtgcattcagcacaacatggtctacgtcttccaaggagactatgaatgtcgcttcctcgggacacagccgcagcgatttatcagtaacaatcacccaggcctcctatgtgactctaatcccgggctcaagctatggtatatctctgcattcttctacgcacgagcccaattctactataagtccaccatcatgcatgaccctcattttaggatctaatgagacactgagccttgacagttctttgctcttttctgatacatctactctgacactctcaagccagcaagatgatgctaaagacaattcgatacacacggtgcctctcgaagaaaatttggagtcttggagtgaaatggcttcaatcaaggtggggcagtttcctttgggatttcccatctctaatcctgctggtaaggacgccgtaacacttcaggggattccggagggcgcgtttgacgaagttacatcctgtctggtgaaggtgccagagaagaccgaagggggcaataatatggcattagtcgagaatgttactactctgcagaagtcccaggaccttctggaggccgaaggcgaaaaaaagaccatgatcaagaagatcatgcgccagattcaggaggaacctctggatagcctgagcagcagtgttcgtaagcaggctatggaaattctgacgcaacttagccacacccagccgaccctcggaatgagagagagatcagaactggtcaatgtctgcgttcactcagtgttttccctccccagcgtccaagccatgcaagagaaggatgaggccaaggccgaaacaatacaggccctctaccaccagactctggaggcgctccagacgttactgaaggcactgtttatcgaggatccgacaccagccggattgaagtcaatacttgaagccctcggtccatggatgaacagcggcaaggctcatgaacgtgctagagccgttaacaccaatgtgagcgtcctgaaccatatgctgctcaccttgcctttctttatgcccctgggattcccagctctgggcctgctcctaggtcggctcatattgcacataggagatcccgacgaagagattgggtgtgaagcactagatggaatcattattctctataccatcttggagttgcagaagcgcgcccgcgacaaggaagaaacaaataaaaaagaactttatgagtcaaacaagcactttctggggccctacaatcccgtgtccccttgccagaacattctgcgcgtgatcgaagagtttggggacttcctgggcccccagcagatcaaggatcttctccttgcggccctcgaaggactgaaggggagctccgaggcacccggcaaggactctcgcgagatgatgcagcttgcaagcgaagtcatgctgtcaagtgtactggagtggtatcgccaccgtgccctggaggttataccagaaataatgcaggggatttacatgcagctctctcatatccaggagcctagggcgcgccaggtggccttgttaccggtttcactgctagcaagctcctttatgacagaggtagtggtggctttactgatgtgccctttacccctaaactctaacggggccgaaatgtggagacaattgatcctgtgcaagccttcctgcgacgtaagggacctgctggatctgttactgggctccctgaaagagaagcctgtgacaaaggaggggagggccagtatcgtcccactggccgccgcatccggtctctgtgagcttctgtccgtgaactcgtgtatgggtagggtgaggcggatctacccacagctactccttgctctgctcattcaagttcattatcacatcggcctgaatcttcccggctgcgttgccccacctaaagacaccaagaagggcgcgcagccttcgccttttgttcccgtgcgttgggtagtaaaggtagtcaagaccttgttgcttcgcatgggttgctcctacgaaaccacttttctagaggatcagggcggatgggagttaatggaacaggtagagagccatcaccgcggcgtagccttgctagctcgcgccatggtgcagtattcttgccaggaattgtgtcggatcctgtacttgctcatccccttgctcgagagaggggacgaaaaacatcgcattactgccacagccttcttcgttgaactgttacagatggagcaggtgagacgaatcccagaagagtattcattgggacggatggccgaggggctgagtcaccacgaccctattatgaaagttctcagcattcgggggctggttatactcgccagacggtccgaaaagaccgccaaggtcaaagccctcttaccctccatggtgaaaggtttgaaaaatatggacggcatgctcgtggtagaagctgttcacaatctcaaggctgtctttaagggacgggaccagaaattaatggacagcgccgtctacgttgagatgctccagatcttgttgccccatttcagcgatgctcgcgaggtggtccgatcttcatgtataaacctgtacggaaaagtagtccagaaactgcgggccccacggactcaggctatggaggagcagctggtgtccaccttagtgcctcttctactgactatgcaggaaggaaattcaaaggtgtcccaaaaatgcgttaagaccttgttacgctgtagctatttcatggcctgggagctcccaaagagggcatactctaggaagccctgggacaatcagcagcagaccgtggctaagatctgcaaatgtttagtcaacacacaccgagactccgccttcatcttcctgtctcagagcctagaatacgctaaaaactcacgggcgtccttgcgcaaatgcagcgtcatgttcattggatcacttgttccttgcatggagtccattatgacagaggataggttaaacgaggtcaaggcagccctggataatctgcgccacgatccagaggcctctgtatgtatttacgctgctcaagtgcaggaccacatcctggcttcctgctggcagaattcgtggttgccccacggcaactcctgggtgtgttacagcgcaacaacacaccgctggtctcctagctgtgagaatctgcctacaagtcaccaacgtaggtcctggattatgcaggccttgggtagctggaagatgagcctgaagaaatag

SEQ ID NO: 42703 - DNA, 2526 bp, Artificial Sequence
  Description of Artificial Sequence: Synthetic coding sequence
atggagatcctgacccagctgagccacacccagcccaccctgggcatgcgggaacggtctgaactggtgaatgtctgtgtacatagcgttttcagcctcccctcagttcaggcgatgcaggagaaggatgaggccaaagccgagacaatccaggcgctgtaccatcagaccctggaagcattgcaaacactgttaaaggccctgtttatagaggacccgactcccgcaggcctaaagtccattctggaggcactcgggccatggatgaacagcgggaaagctcatgagcgagctcgcgccgtgaatacaaatgtcagcgtgctgaaccacatgcttttgacgcttccttttttcatgccactggggttccccgcgctcggcttgcttctggggcgcctcatactccatatcggggatcctgatgaagaaatcgggtgcgaggccttggacgggatcattatcctgtatacgattctcgagcttcagaaacgcgcccgagacaaggaggaaaccaacaaaaaggaactttacgagtcaaataagcactttctgggaccatacaatcctgtgagcccctgccaaaacatcctgcgcgtcattgaggaatttggtgatttcctgggcccgcagcaaattaaggacctcttgctagccgctctagagggtctgaaagggagctctgaggccccagggaaagatagccgcgagatgatgcagctggcctcagaggtgatgctgtcttccgtgcttgaatggtacagacacagagccttagaggttatcccagagatcatgcaaggcatatacatgcagctctcacacattcaggagcctagggcgcgtcaagtcgccctactccccgtctcgctgttggccagttccttcatgactgaagtggttgtggccctgctgatgtgtcccctccctctgaatagcaacggtgcagagatgtggcgccagctgattctttgtaagccttcatgcgatgttcgggatcttttggatttgctgctcgggagcctcaaggaaaagccagtgacaaaggagggcagagcctccatcgtcccactagctgccgccagtggactgtgcgagctactctcagtcaactcttgcatgggtcgtgtgcggcgcatctatccccagcttctcctggctcttctaatccaggtccattatcacatcggactcaatttgcccggatgcgttgctcccccaaaggatacaaaaaagggggcacaaccgagccccttcgtccccgtgcgatgggtcgtgaaggttgttaaaaccctgctgctccgcatggggtgcagctatgaaacaacctttctggaggaccaaggggggtgggaactgatggaacaggtcgaatcccaccatcgtggcgtggccctgctggctcgcgccatggtccagtactcgtgccaggaattgtgcaggatactgtatctccttataccccttctggagcggggagatgagaagcatcggataactgccacggctttcttcgtggaattactgcagatggaacaagtgagacgcattcctgaggagtattctcttgggaggatggccgagggcctctcccatcacgatcctatcatgaaggtgttaagtatacgcggtcttgtgattttagcccgccgttcagaaaaaaccgccaaggtgaaggcgcttctacctagcatggtcaaaggactgaagaacatggatggcatgctggtggtagaagctgtgcacaatctgaaggcagttttcaaggggcgggatcagaagctgatggatagcgctgtatatgtggagatgctacaaatattattgccgcatttttctgacgccagggaagtggtgcggtcctcatgcatcaatctttatgggaaagtggtccagaaactgcgtgcccctaggacccaggcgatggaagagcagcttgtctccacattggtgcctctgctgttgaccatgcaggaaggaaatagcaaagtctctcagaaatgtgttaagacactgctgaggtgcagctacttcatggcttgggagctgccaaagagggcctacagtcgtaagccctgggataaccagcagcaaaccgtcgccaagatctgtaaatgtctggtgaacacccaccgcgattctgccttcattttcctgagtcagtccctagagtacgctaaaaactctagagcaagccttcgcaagtgtagtgttatgttcatcggatcactggtcccttgtatggaaagcattatgactgaagacagactgaacgaagtgaaggccgccctggataacctgcgacacgaccccgaagccagcgtgtgcatctacgcagctcaggtacaagatcacattcttgcatcttgttggcagaactcttggttaccgcatgggaatagttgggtgtgctatagtgctacaacccaccgttggtctccatcttgcgagaaccttcctacgtcgcaccagaggagatcttggattatgcaggctcttgggtcttggaagatgagcctcaagaagtag

SEQ ID NO: 42704 - DNA, 1623 bp, Artificial Sequence
  Description of Artificial Sequence: Synthetic coding sequence
atggccctggtggagaacgtgaccaccctgcagaagagccaggacctcttagaggccgaaggggaaaaaaagacaatgattaagaaaattatgcgacagattcaggaagagcccctggattctctctcttctagtgtcagaaagcaggcgatggagatcctcacccagctgtctcacactcagcccacactagggatgagggaaagatccgagctagtaaacgtgtgcgtgcactcagtgttttccctacccagcgtgcaggccatgcaagagaaagacgaagcgaaagctgaaaccatccaggcactctatcaccagacgctggaggccctacaaacactcctcaaggccctttttatcgaggatcctactcccgccggtctgaagtcaattctcgaggcattggggccatggatgaattctggtaaagcccacgagcgtgcccgggcggttaatactaacgtttccgtacttaatcatatgctgcttactctgccattttttatgccactcggttttcccgctctcgggctgctgctgggccgactgattctacatattggggaccctgatgaagaaattggctgcgaggcgctcgatggaattatcattctctatacaatactggaattgcagaagcgcgccagagataaagaagagacaaataagaaggaactgtacgagtctaataaacattttctcgggccatacaaccccgtctccccttgtcagaacattctgagagtgattgaagaatttggcgatttcctcggaccgcagcagattaaagaccttctgctagccgccctagagggactgaaagggtcatcggaggcacctggcaaagacagtcgcgagatgatgcaacttgcctcagaagtcatgctgagttcagtcctcgaatggtatcgacatcgggcgctggaagtgattcctgagattatgcagggcatctatatgcagttgagccatattcaggaaccaagagcgaggcaggtggctctcctgccagtgagcttgctcgcctcaagcttcatgactgaggtggttgttgcacttctgatgtgcccacttcccctgaactccaacggcgccgaaatgtggagacagctaatcttgtgcaagccctcttgtgatgtgagagacctgctcgacctgcttctcgggtccctgaaagaaaagcctgtgactaaagaaggccgcgcctccatcgtccccctggcagctgcatcgggactctgtgaactgctgagcgtcaactcctgtatgggcagggtgcgacggatctacccccagttgctacttgcactgctcatccaagtacattaccacatcggcctcaaccttcctggctgcgtagcaccgcctaaagacactaaaaagggggcccagccctcccctttcgttccagtcagatgggtggtgaaggtggtgaagacccttctgttacggatgggttgttcctacgagacaacattcctcgaagaccaaggcgggtgggaactgatggagcaggttgagtcacatcatcgcggcgttgctttgcttgcttcaagtagccgctggagccgctgcgctggcagtccccgcaataccttgtggggagggtggcagaaggcttag

SEQ ID NO: 42705 - DNA, 1416 bp, Artificial Sequence
  Description of Artificial Sequence: Synthetic coding sequence
atggcccgggagatgaccatcctgggcagcgccgtgctgaccctgttactggctggctacctggcccagcaatacttgccattacccactccaaaggtgatcggcatcgatctgggcaccacgtactgcagcgttggggtgttctttcctggtaccggcaaggtcaaggtgattcctgacgagaacggtcacatatcgattcccagtatggtgagttttaccgacaatgacgtgtatgttgggtacgagtcagtggaactcgctgattcgaaccctcagaataccatttacgacgccaaacgtttcattgggaaaattttcacagctgaggagctggaagcggaaatcggacgttatccctttaaggtcctgaataaaaatggaatggtcgaatttagtgtgaccagcaatgaaacaataaccgtgtcacctgaatatgttggctcgcggctccttcttaagctcaaggagatggccgaggcctacctagggatgcctgtggctaacgccgtgatcagtgtgccggcggagttcgatctgaaacagagaaactccacaatcgaagccgcaaatctggctggcctgaaaattctgagagtcattaatgagccaaccgctgccgccatggcatacggtttgcacaaggccgacgttttccacgtgctcgttattgatttggggggaggcaccttggacgtaagcctgctcaacaagcagggggggatgttcttaacaagggccatgtccggcaacaataagctggggggtcaggacttcaaccaaaggctcctgcagtatctttataagcagatctatcagacttacggatttgttccctctcgcaaggaggagatccaccgtctgagacaggctgtggagatggttaagctcaatctgaccctacaccagagtgctcagttgtcagtgctgctcaccgtagaggagcaagatagaaaggagccgcactcctccgatacggagcttcctaaggacaaactgagcagtgccgacgatcatagagtgaactcagggttcgggcgagggctgtctgacaagaagtccggagaatcccaggtcctattcgaaacagaaatctctcgcaagctatttgacaccttgaatgaggacctgtttcagaaaattttggtccccatacaacaagtactgaaggaggggcatcttgagaagactgagatcgatgaggtagttctcgttggagggagcacccgcataccgaggatacggcaggttatccaagagtttttcggcaaggaccccaacacatctgtggaccccgatctagccgtggtaactggcgtagcaatccaggcgggtatcgacggcggctcctggcccctccaggtgtcggctttggagatccccaacaaacacttacaaaagacaaatttcaactag

SEQ ID NO: 42706 - DNA, 792 bp, Artificial Sequence
  Description of Artificial Sequence: Synthetic coding sequence
atggcctacggcctgcacaaggccgacgtgttccacgtgctggtgattgacctaggggggggcaccctagatgtgagcctgctgaacaagcagggcggaatgtttctgacaagggctatgagcggaaataataagctaggtggacaggactttaatcagagactgttgcaatacctctataagcagatttatcagacctatgggtttgtgccctctcgcaaagaagagatccatcggctaagacaagcagtcgagatggttaagttaaacctgactctgcaccagtcagctcagctctctgtgctactaaccgtggaagagcaagaccggaaagaaccacattcctctgatactgagctgcccaaagacaaactaagctccgcggatgaccacagagtgaactctggattcgggcgtgggctttccgataagaaaagcggcgaaagtcaggtgctctttgaaacagagataagccgcaagctctttgataccctaaatgaggatctgttccagaagattttggtcccgatccagcaggtgctgaaagagggccacctggagaaaaccgagatagatgaagtggtcctggtcggggggtccacccggataccgaggattaggcaggtcatccaggaattctttgggaaggatcctaatacctcggtggatcctgatctcgctgtcgttactggcgtggccatccaagctggaattgatggcggctcctggcccctccaagtgtccgccttagagataccaaataagcatctgcagaagaccaacttcaattag

SEQ ID NO: 42707 - DNA, 1515 bp, Artificial Sequence
  Description of Artificial Sequence: Synthetic coding sequence
atgggcatcaagaccgccctgcccgccgccgagctgggcctgtacagcttagtgctttccggcgcattagcatacgcggggcggggactgctcgaagcatcacaggacggtgcacatcgcaaggccttcagggagtccgttaggcccggatgggaatatattggcaggaagatggatgtggctgactttgaatgggtcatgtggttcacttcttttcgcaacgtgatcatatttgctttgagtggacatgttctcttcgccaagctttgcaccatggtggccccaaaactccggtcttggatgtacgcggtctatggtgcattagccgtgatgggcacaatggggccttggtatctcctgctcctgctcgggcattgcgttggactctacgtggctagcctgctgggtcagccctggctatgtttaggtctcggcctggccagcttggccagcttcaaaatggatcctcttatttcttggcagagcggttttgttacgggaacattcgatctgcaggaagtcctcttccacggcggttcaagcttcactgtcctcagatgtacgtcttttgccttggaatcatgcgcccatcctgaccggcattacagtttagccgacctgctgaagtataacttttacctgcccttcttctttttcggacccatcatgactttcgaccggtttcacgcgcaggtgtcgcaggtagaacctgttagacgggaaggagagttgtggcacatccgggcccaggcaggcttgagcgtggtcgcaataatggccgtagacatttttttccactttttctacattctgaccatcccctctgacctcaaatttgctaaccggctccccgactccgccctggctggactggcctactcaaaccttgtgtacgattgggtcaaggccgcggtgctattcggtgtcgtgaatacagtggcctgccttgatcaccttgaccccccccaacctcctaaatgcatcaccgctctctatgttttcgccgagacccattttgatcggggcattaatgactggctgtgcaaatacgtctataaccatattggaggcgaacatagtgccgtgattcccgagttggctgctacagtggctacctttgctatcaccacattgtggttaggcccctgcgatatcgtgtatctctggagtttcctgaactgtttcggtcttaactttgagttatggatgcagaaacttgcagaatgggggccactggcccgcatcgaggcttctttgagtgtacaaatgtcgcgaagagtccgcgccttgtttggggctatgaacttttgggccatcatcatgtataaccttgtgagcctgaattcactgaaatttaccgaacttgtcgccagaaggctgttgctgacaggatttccccaaacaacattaagcattctcttcgtgacttactgcggggtccagttggtgaaggagcgtgaacggactctcgcactagaggaggagcagaagcaggataaggagaaaccggaatag

SEQ ID NO: 42708 - DNA, 738 bp, Artificial Sequence
  Description of Artificial Sequence: Synthetic coding sequence
atggtggcccccaagctgcggagctggatgtacgccgtgtacggcgccttagccgtaatgggaaccatgggcccgtggtacctcttgctactgctcggccattgcgtcggcctgtatgtcgcaagtctactgggccagccttggctgtgcctgggtcttggcctggcgtcactggcatcctttaagatggatcccctcatttcctggcagtccgggtttgtgaccggaacattcgatttacaggaggtcctcttccacggcggtagcagctttaccgtactcaggtgtacgtcatttgctctggaaagctgtgcccaccccgatagacattattctttggccgatctgttgaagtataatttctatctgcctttcttcttttttgggcctatcatgacatttgatagatttcacgcacaggtgtctcaggtagaacccgtcaggagggaaggagagctgtggcacatccgggctcaggctggcctgtctgtggttgcgattatggcggtcgatattttttttcatttcttctatatcctgagtcctgccactagcagttcaccaactgcgtcccagactgtgccatccgccgggctggcttacagcaatctagtgtacgactgggtaaaaggaaggcccttgtggtgctgtcagcactggcacgcctcaacgacgtggacccatcctccaccaaaatgcatcacagccctgtacgtctttgctgaaactcacttctag

SEQ ID NO: 42709 - DNA, 696 bp, Artificial Sequence
  Description of Artificial Sequence: Synthetic coding sequence
atgggcatcaagaccgccctgcccgccgccgagctgggcctgtacagccttgtgctcagcggtgctctggcttatgccggacggggccttctagaggcttcgcaagatggcgctcacagaaaggcttttagggagagcgtcaggcctggttgggagtacataggaaggaagatggatgttgccgatttcgagtgggtgatgtggttcaccagcttcaggaatgtaatcatctttgccctgagtggccacgtccttttcgcgaaactgtgcaccatggtggcaccaaaactgcggagttggatgtacgcagtgtacggagcccttgctgtgatgggcaccatggggccctggtacctgctgcttctgctcgggcattgtgtgggtctctacgtggcaagtcttctgggccaaccttggttgtgtctggggctgggcttggcttctctcgctagcttcaaaatggatcctcttatttcttggcagtccggctttgtcaccggaaccttcgaccttcaagaggtcctttttcacggaggatcgtctttcaccgtgttaaggtgcacctccttcgccctggagagctgcgctcatccagaccgacattatagtttggcagacctcctgaagtataacttttatctgccgttcttttttttcggaccaataatgacgttcgaccggttccacgcccagtag

SEQ ID NO: 42710 - DNA, 1515 bp, Artificial Sequence
  Description of Artificial Sequence: Synthetic coding sequence
atgggcatcaagaccgccctgcccgccgccgagctgggcctgtactctctggtcctgagtggtgccctggcctacgcagggcgggggctgctggaagcaagtcaggacggtgcccacagaaaagcatttcgggagtcagttcggccaggctgggagtatattggacgcaaaatggacgtggcagatttcgagtgggtaatgtggttcaccagctttagaaatgtgattatttttgctttatcgggccacgtgctgtttgctaagttatgcaccatggtagctccgaaactccggagctggatgtacgccgtatacggagcccttgctgttatgggtacaatgggaccatggtacctattgcttctgttggggcactgcgtcggtttatacgtcgcatctctgttagggcagccttggctttgcctggggctaggcctcgcctccctagcttcattcaagatggaccccctgattagctggcaaagcggtttcgtcacaggcaccttcgacctgcaagaagtcttgtttcacggagggagtagctttactgtgttgcgctgcacaagctttgcattggagagctgtgcccatcctgacaggcattactctctcgctgaccttttgaaatacaatttttatctgcctttcttcttctttgggcccatcatgactttcgaccggtttcacgcccaggtcagccaggtggagcccgttcgtcgggagggcgagctgtggcatattcgtgcccaggcgggcctgtccgtggtggcaatcatggcagttgacatcttctttcactttttctacatccttacaatccccagtgatctcaagttcgcgaacaggctgccagattcagccctcgctggactcgcttatagtaatcttgtttatgactgggtaaaggcagctgtgctgtttggagttgtcaacacagtcgcctgtctcgatcatttagatcccccacagcctcccaaatgtattacggccctgtatgtctttgccgaaacccatttcgatcgtggcatcaatgactggctgtgcaaatacgtgtacaatcacataggaggcgaacactccgctgtcattcctgagcttgcagctaccgtggccacttttgctatcactaccctttggctggggccatgcgacatcgtgtacctctggagcttcttaaactgtttcggactgaactttgagttatggatgcagaagctcgcagaatggggcccactggctaggatcgaggcatcgctgtccgtccagatgtcaaggcgcgttcgggcgctgtttggcgccatgaatttttgggccataattatgtacaacctagtctcgcttaactctttgaagttcaccgagttggtagcccgacggctcctcctgaccggcttccctcaaacaaccctgtctattctgttcgtcacgtactgcggcgttcagctcgttaaggagcgggagagaactctcgcattagaagaggagcaaaagcaggacaaagaaaaacctgagtag

SEQ ID NO: 42711 - DNA, 282 bp, Artificial Sequence
  Description of Artificial Sequence: Synthetic coding sequence
atgatccacctgggccacatcctgttcctgctgctgctgcccgtggccgcagcccaaactactcctggggaacgatcttccctgccagccttctatccaggtacatctggatcatgctcaggatgtggctctctgagtctgcctctgttagcagggctcgtcgcagcagacgctgtcgctagtcttttgatcgtgggtgcggtcttcttgtgcgcgcgccctagacgtagtccagctcaggaggatggaaaggtgtacattaacatgccaggccgaggctag

SEQ ID NO: 42712 - DNA, 279 bp, Artificial Sequence
  Description of Artificial Sequence: Synthetic coding sequence
atgatccacctgggccacatcctgttcctgctgctgctgcccgtggctgctgcccagaccactcccggggagaggtcatcgctgccagcattctaccctggaacctcagggtcttgctctggttgcggcagcctgagcctgcccctgctggccggcctggtcgccgctgatgcggtcgcctcgctgctgatagtcggcgctgtatttctgtgcgcgaggcctaggcggtcccccgctcaggacggcaaggtttatatcaacatgcctgggaggggatag

SEQ ID NO: 42713 - DNA, 924 bp, Artificial Sequence
  Description of Artificial Sequence: Synthetic coding sequence
atggccgccctgctgctgggcgccgtgctgctggtggcccagccccagctggtacctagtaggccagcggaactgggtcagcaggaacttctacgcaaagccggtacattacaggatgacgtcagggacggggtggcacccaacggcagtgcccaacagctgcctcagaccatcatcatcggagtccgcaagggcggcacccgcgctctgctggagatgctgtctctgcatcccgacgtggccgctgccgaaaacgaggtgcacttcttcgactgggaagagcactattcccacgggctgggctggtacctgagccagatgccattctcttggccacaccagctaaccgtcgaaaagactccagcttactttacctccccaaaagtgccagagcgtgtgtattctatgaaccccagcataaggttactgctgatacttcgcgatccttctgaaagagtgctctcagactatacacaagtgttctataaccatatgcagaaacacaaaccttatcccagcattgaggaatttctcgttcgcgatgggcgtttaaacgtcgattacaaggctctgaaccgtagcctttaccacgtacatatgcaaaactggctgagattctttcccctccgacacattcacatagtggatggggatcgcctgatacgggacccttttcctgagattcaaaaagtggaaagattcctcaaactctcaccacagattaatgcatctaatttttacttcaacaagactaaaggcttctactgtctacgggattcaggccgtgaccggtgcctccatgaatcaaaggggcgggctcatcctcaggtggatccgaagcttctcaataagctgcatgaatattttcacgaacctaacaaaaaattttttgaactagtgggccgcacatttgattggcactag

SEQ ID NO: 42714 - DNA, 252 bp, Artificial Sequence
  Description of Artificial Sequence: Synthetic coding sequence
atggccgccctgctgctgggcgccgtgctgctggtggcccagccccagctggtgccgtctcgccccgcggagctggggcaacaggagcttctccggaaagccggtactcttcaggacgatgtgcgcgatggtgtagctccaaatgggagcgctcagcagttgccacagacgatcattatcggcgtgaggaagggcggaactagggccctgctggagatgctctctctgcatccagacgtcgctgctgcatag

SEQ ID NO: 42715 - DNA, 252 bp, Artificial Sequence
  Description of Artificial Sequence: Synthetic coding sequence
atggccgccctgctgctgggcgccgtgctgctggtggcccagccccagctggtgccctcccggcctgccgagctgggccagcaggaactgctgcgcaaggcagggacgctccaggacgatgtgcgggatggcgtggctcccaatggctccgcacaacagctacctcagacgatcattatcggagtgagaaaggggggaactagagctttgttggaaatgctgtctttacacccagatgtggcagctgcctag

SEQ ID NO: 42716 - DNA, 1029 bp, Artificial Sequence
  Description of Artificial Sequence: Synthetic coding sequence
atggccggcagcggcggcctgggcggcggcgccggcggcggccagggggctggcgcaggccagggcgcagctctgcgcgcatccagggcccctatgctgctggtcgctctggttctgggcgcttactgcttgtgcgcgctgcctgggcggtgtccacctgctgcccgggcacctgcccccgccccggcgccttcagagccaagctcctctgtacacagacccggcgcccctggacttcccttggcttcagggcctgggaggcgacggtttccccaggctttgatagttggggttaagaaagggggtacccgtgctcttctggagtttctgcgactccacccagatgtgcgagccctcggaagtgagccccacttttttgaccgctgctatgaacggggactggcttggtacagatccctgatgcctcgcacacttgatggccagataaccatggagaagacaccaagctactttgtgaccagagaggctccacggcgcatacatgccatgtctccagataccaagctgatcgtggttgtaagaaatcctgttaccagggcaatctctgactatgctcagactctgtctaaaacacctggactgccctcatttagggcgttagccttcagacatgggttggggcctgtggatactgcctggagtgcagtgcggatcggcctttacgcgcaacacttagaccattggctgaggtactttccgctgtcacatttcctgttcgtctcaggagaacgcctggtgagcgatcccgccggcgaggtcgggcgcgtgcaggactttctgggcctgaaacgcgtggtgaccgacaaacatttctacttcaacgccacgaaaggcttcccctgcttaaaaaaggcacaggggggcagcagacccaggtgtcttgggaagagcaaagggcggcctcacccccgagtgccgcaggctttagtgaggaggttgcaggaattctaccggccattcaaccgccgcttctaccagatgacaggtcaggattttggatgggggtag

SEQ ID NO: 42717 - DNA, 936 bp, Artificial Sequence
  Description of Artificial Sequence: Synthetic coding sequence
atgctgctggtggccctggtgctgggcgcctactgcctgtgcgccctccctggacgttgccctccagccgcccgggctcccgcacccgcaccagccccgtcagagccatcaagttcagtgcatcggcctggcgcccccgggctgcctctagcctctggcccagggaggcgcagatttccccaggcgctgatcgtgggcgttaagaagggcgggacaagagctctcttagagtttttaaggcttcacccagacgtcagggccctaggatcagaaccccattttttcgacagatgttatgagcggggactggcttggtatagaagcctaatgccacggacattggatggacaaataacgatggagaagacccccagctacttcgttaccagagaggcaccaaggagaatccacgcaatgtcaccagatacaaaactgatagttgtggtccgtaacccagtaacaagggccatctctgactatgcacagactctgtcaaagacacccgggctccccagtttccgcgcccttgccttccggcacggactgggcccagtggatacagcgtggtcagccgtcagaattggtctctacgcccagcatctcgaccactggctacgctacttcccattgtcacacttcttattcgtgtccggagagagactcgtgtcagaccccgccggggaagttggtcgggtccaggacttcctcgggttaaagcgagtcgtgactgacaagcatttctacttcaacgctaccaaaggttttccgtgtctaaaaaaagcacagggaggatcgcgcccaagatgcctcggcaagtccaagggtcgaccccacccgcgggtgcctcaggctctggtcaggcgtctgcaggagttttacagaccgtttaacaggaggttttatcaaatgacaggccaggattttggttggggctag

SEQ ID NO: 42718 - DNA, 1146 bp, Artificial Sequence
  Description of Artificial Sequence: Synthetic coding sequence
gccgccggcccccccggcgccgagcacaagcccggcacccacggcctgtcgggagctagggctgagatgcgggctaggctgttgcccccccttcctggcctggagcggcgggacccaatggcggggtctggaggattgggaggaggagccgggggcggccaaggcgccggcgccgggcagggggctgcgctacgtgctagccgagcgcccatgttgttagttgctctcgtcttaggcgcatattgcttgtgtgcccttcccgggcggtgtccccctgccgcacgggctccagcacccgcgcccgccccatccgagccttcctcatccgtacaccgaccaggtgccccagggctgcctctcgcgtcaggacccggccggaggaggttcccacaagcgctgatagtgggggtcaagaaaggcggtacgcgggccctgcttgaatttctgcgcctgcatcccgacgttcgcgcgctcgggtcagaacctcattttttcgaccgctgctacgaaagaggcctggcctggtatcgtagtcttatgcccaggacgctggacggccagatcactatggaaaagaccccctcttacttcgtgactagggaggccccaagaagaatccacgccatgagtcctgataccaagctaatcgtggtggtgcgaaaccccgtgacgcgtgcaatctccgactacgcacagactctctccaaaactcccgggttgccttccttccgcgccctagccttcaggcatggcctgggaccggtggatactgcctggagcgctgtgagaatcgggttgtatgcccagcacctcgaccattggctgaggtactttccattgagccacttcctttttgtctcaggcgagcgcctagttagtgatcctgccggcgaggttgggcgagtacaagactttctggggctcaaacgcgtggttaccgacaagcacttttatttcaatgctaccaaggggtttccatgcttgaaaaaagctcagggtggctcgaggcctaggtgcttaggtaagtccaaaggaaggccacatcccagagtgccccaggcgcttgtgcgccgacttcaagaattctacaggcctttcaatcgccggttctatcagatgactggtcaggattttggctggggatag

SEQ ID NO: 42719 - DNA, 906 bp, Artificial Sequence
  Description of Artificial Sequence: Synthetic coding sequence
atgttcagccacctgcccttcgactgcgtgctgctgctgctgctgctgcttctcaccagatcttccgaggttgagtatcgggcagaagtgggacagaacgcgtacctgccttgcttctacacccctgctgccccaggcaacttggttccagtctgttggggcaagggagcttgtcctgtgtttgaatgtggaaacgtggtgttgcgcaccgatgagcgcgatgtcaactattggacaagtcgatactggttgaacggagacttccggaagggcgatgtatctcttacaatcgagaacgttaccctggcggattcagggatctactgttgtagaattcagattcccggaattatgaatgatgaaaagttcaaccttaagttggtgatcaagccggcaaaggtgacacctgctcctacgcgccagcgggatttcacagcagccttccctaggatgctcacgaccagaggccacggacctgctgaaacccagacccttggctccctgccagacatcaacctgacccagatttcaactcttgctaatgaattgagggactctcggctggccaatgatttgagagactctggggcaacaataagaatcgggatttacatcggggccggcatatgtgcaggattagcacttgccttgatcttcggtgccctcatatttaaatggtacagtcacagcaaggaaaaaatccagaacctcagccttatctctttagccaacctgccgccaagcggccttgccaacgctgtcgccgaaggcatccggtcagaagagaacatatatacaattgaagagaatgtctacgaagtggaggagcctaacgaatattactgttacgtgagtagtagacagcagccaagccaaccgctcggctgtcgctttgcaatgccttag

SEQ ID NO: 42720 - DNA, 3480 bp, Artificial Sequence
  Description of Artificial Sequence: Synthetic coding sequence
atgccccggaagcagcccgccggctgcatcttcctgctgaccttcttgggactatccggtcttgtgggcaccgttacccgcacatattatattggtatagtggaggagtattggaattacgtgccccaagggaaaaacgtgataaccggcaagagtttcacagaggacaaattggctacactatttctcgagagaggtccaaatagaatcggatcaatttacaagaaggccgtgtatagaagatttacagacgggacttatagtatcgaaattcctaaaccgccatggctggggtttctgggacctatcctaagagctgaggtcggcgacgtgatagtgatacacctaaagaattttgcttctcgcccctactctctgcacccccacggtgtcttttataacaaagatagcgaaggcgccctgtaccccgatggaacctctggcaggaataagaatgatgacatggtgccccctggcaaaaattatacatacgtgtggcccgtgcgcgaagagtacgctcccactccggcagacgcaaattgcctgacatgggtgtaccatagccacattgatgctccaaaagacatttgttccggacttattgggccacttcttgtgtgtaaggagggcattctaaatcgctactctggtacgcgtaatgatgtcgatcgtgagtttgtcatcatgtttacccttgtggacgagaaccaaagttggtacttgaatgagaacatcaagcacttctgcacaaacccagactcagtggacaagaaagacgcagtgtttcagagatccaataagatgcacgccctgaacggctacctcttcggtaactttccggagccagacatgtgcgtgggtgaatcagtgtcatggcacctcttcggcatgggaaacgagatcgacattcattctatttacttctacggaaacaccttcatatctcgaggtcaccgaaccgacgtagtgaacctttttccagccacctttctcaccacagaaatgatcgccgagaatcccggaaaatggatgatcacttgccaggtgtctgatcatctgcaggcagggatgctcggccagtataacgttgacaactgcaaatctgatatcttttatccgaagatgaaaggacagcagcggcgctattttatcgctgcagaaaagatcctgtgggactacgctccacaaggttacaataaattcagcggacttcccctgaatgccagcggttcggatagcgacttatatttcacacagggggataaccggatcgggggcaaatattggaaggtgcgctatacggagttcgttgatgccacctttaccaagagaaagaggctgagcgcagaggaggcgcaccttggaatacttggacccgtgatcaaggccgaggtcggggatacactattagtgactttcgccaataaggccgacaaggtctactccatacttccacacggagtgatatacgataaggcctctgatgcggcgcccaacctggatggtttcgtgaagcccggagctcacgtgaagccaggagaaacatttacatataaatggactgtccccgagtctgtaagccccacagctggagaccctccttgtctgacgtacttgtactttagtgcagtcgacccaatcaaggatacctcgagcggtttggtgggtcctcttctcgtctgcaaaaaaggggtgctgaacgctgatggaactcaaaaaggaatcgacaaagagttttaccttctcttcaccgtcttcgacgagaacttgagtaggtatttcgatgagaatattcaaaagttcatatggcacccgttctcaatcgacaaggaggacaaagaatttgtgaaatctaatcggatgcatgcggttaatggctacatgtatggaaatcagcctggcctgaatatgtgcaagagagaccgagtatcatggcatctgatcgggctgggtacagacaccgatatgcacggaatcgtgttccaaggaaatacaattcacctgagaggcacacacagggattccctcgcactgtttccccacatggcgaccaccgcctttatgcaacccgaccacgcaggaatcttcagagtcttctgtgccaccatgcctcatctatcccgcggaatgggccagatttacgaggtgtcttcatgtgacaatcgggacccctctgaacagcgctacggcatgatcaggactttctatatcgccgcagaagaagtggaatgggattacgctcccaataagaactgggagtttgagaagcagcatgtcgacgcgcgcggagagcgtcacggcgacatctttatgaaccgaacagagaactggatcggttcccagtacaaaaaagttgtgtatagggagtataccgatggcgagttcgtagagattaaggctaggcccccccgtgaagagcacctagagctactcggtcccatgattcatgccgaagtgggcaacacagtgttaatcatctttaagaataaggccagcaggccatacagtatcagtgcccagggggtggaggaaatggatagcggaaagcaatttcaggtgccaatgacaaaacccggggaggtgaagacctaccgatggaacatccccaagcgcagcggaccgggtccgtcagacccgaactgcatcccctgggtttactactctactgtaaatttcgtgaaagatacatattcgggtctgatgggacccctcatcacatgtcgaaaaggcgtcctgaatgagaaaggtcggcggagtgacgttgattatgaattcgcgctcctctttttagtatttaacgaaaacgagtcatggtacttagacgacaatataaagaaataccttaacaaggatccacgtgatttcaaacgcacggacgacttcgaagaaagcaaccggatgcatgccattaatggaaagatttttggtaacctgcatgggctaataatgaatgaagacaccatgacaaactggtacttacttggcattggctcagaagtggacattcataccatccattaccatgccgagtcgttcctgttcaaaatagacaagtcctaccgggaggatgtgtatgatcttttccctggaactttccagaccattgagctgtttgccgatcaccctggcacctggttgctgcactgccacgtcagcgatcacatacacgccggcatggaaaccacatataccgtcctccgcaacattgacaaccggattccctacagtacgacaagccccggagtcgcctcacacccagcgactgtgccaagtaacgaacggccgggcaaagaacagctatacttctttggaaagaacttaggccccaccggcgccaaagcagcactcgtaatcctcttcattatcggcctgctgttgttgataaccaccgtgattctgagcctgaggctgtgctcagccatgaagcagaccgactaccaacaggtgcagagttgcgctttacctacagacgctctttag

SEQ ID NO: 42721 - DNA, 1221 bp, Artificial Sequence
  Description of Artificial Sequence: Synthetic coding sequence
atggaccagagcggcatggagatccccgtgaccctgatcatcaaggcccctaatcagaagtatagtgatcagaccatctcttgctttctgaactggaccgtgggtaagctgaagacccacctcagcaacgtgtaccccagtaaacccctgactaaagatcagagactggtgtacagcggcaggctgctgcccgatcacttgcagctaaaggacatcctgagaaagcaggacgagtatcacatggtccatctggtgtgtactagtcgcactccacctagctcgcccaagtcttccacaaacagggagtcccacgaggctctcgccagctcttcgaattcgtccagcgaccacagtggctcaacaacccctagcagtggacaggagactctttcactagctgtgggatcttcatcagaaggcctgaggcagcggactctcccacaggctcaaaccgatcaagcgcagagtcaccaattcccatatgtaatgcaggggaacgtggataaccagttccctggtcaggctgccccacctggctttcccgtctatcccgcattctcccccctacagatgctgtggtggcaacagatgtatgcacaccagtactatatgcagtatcaagcggcggtcagcgcccaggcaacctccaatgtcaaccctacccaacccactacatcccaacccttgaatctcgcgcatgtgccaggggaggaaccaccaccagcccccaacctggtggcccaagagaatagaccgatgaacgaaaacgttcaaatgaacgcgcagggagggccagtcctgaacgaagaggatttcaatcgtgactggctggattggatgtacaccttttcacgagccgctattctgctaagtattgtctatttttattctagcttcagcagattcatcatggttatgggagcgatgcttctcgtctatctccatcaggccggatggttcccttttcgtcaggaaggaggacatcagcaagcacccaataataacgccgaagtaaacaacgacggtcaaaatgccaataatctcgagctggaggaaatggagaggctcatggacgacggactcgaggatgaatctggggaagatggaggagaggacgcctcagccatccagcggccgggcctgatggcatctgcatggagtttcatcacgacattcttcacttctttaataccagaaggcccccctcaggtcgctaattag

SEQ ID NO: 42722 - DNA, 1221 bp, Artificial Sequence
  Description of Artificial Sequence: Synthetic coding sequence
atggaccagagcggcatggagatccccgtgaccctgatcatcaaggcacccaatcagaagtacagtgatcaaaccatatcctgcttcctgaattggaccgtcggcaagttgaagacccatctttctaatgtgtacccctccaaaccacttacaaaagatcagagactggtctacagcgggagactcctgcccgaccatcttcagcttaaggacatccttcggaagcaggacgagtaccacatggtgcatctggtatgcaccagccggactcctccatccagccctaaaagctccacgaatagagagtcccacgaggccctggcctcttcgtcaaattcatcatcagatcactccggctcaaccactccgagttctgggcaagagaccctgagtctagccgtgggatcatcttccgaaggcctcagacaacgaacgctaccccaggctcagactgaccaggctcagtcccaccaatttccgtatgtgatgcaaggcaatgtggacaaccagttcccggggcaagcagccccacctgggtttccagtgtaccccgccttctctcctcttcagatgctttggtggcagcagatgtacgcccaccagtattatatgcagtatcaggccgccgtgagtgcgcaggcaacctcgaacgtcaatcccacccagccgactacaagtcagccattgaatcttgcccacgtgccgggagaggagcctcctccagcaccaaatttggtggcacaggagaaccggccgatgaacgagaatgtccagatgaatgctcagggcggcccagtgttaaacgaggaggactttaaccgcgactggctggattggatgtatactttttcacgtgccgccatccttttatctattgtctatttttatagcagcttctccagatttataatggtcatgggggcgatgctgcttgtgtacctgcatcaggctggatggtttcccttcagacaggagggcggtcatcagcaggctcccaacaacaatgccgaagtgaacaatgacggccagaatgccaacaacttagagctggaggaaatggaaagactgatggatgacgggttggaagacgaaagcggagaggatggcggagaagatgcctcagctattcagcgcccaggattgatggccagtgcatggtctttcattacgaccttcttcacatccctcatccctgaggggccccctcaggttgctaactag

SEQ ID NO: 42723 - DNA, 1245 bp, Artificial Sequence
  Description of Artificial Sequence: Synthetic coding sequence
atgaaggcccagaccgccctgagcttcttcctgatcctgatcacctccctaagtggctcccagggaatctttcctctggcattcttcatatatgtccctatgaatgagcaaatcgttatagggcgcctagacgaggatataatcctccccagctcatttgaaaggggatccgaagtggtcattcactggaagtatcaggattcttacaaggtgcattcatactacaagggttccgatcatctggagtcacaagatccacggtacgctaaccgcacatcactgttttacaacgagatccagaacggaaatgcaagcctgtttttccgcagggtttccctactcgacgaaggtatatatacttgctacgtaggcacagctatacaggtgattactaacaaagtggtgctgaaggtgggtgtgtttcttacccccgtaatgaaatacgaaaaaaggaataccaactctttcctgatttgttcggtgctgtcagtttaccctaggccgattatcacttggaagatggacaatacccctatctctgagaataatatggaagagaccggctccctagatagcttcagcattaatagtcccctgaatatcaccggttctaacagcagctacgagtgcacaatagaaaactctctgctgaagcagacttggactggaagatggaccatgaaggatggtctacacaagatgcagtccgagcacgtgagcctgtcatgtcaaccagtgaacgactatttctccccaaatcaggacttcaaagtgacttggtcccggatgaagagtggcactttctcagttctggcttattatctgagttcatctcagaatacaatcatcaacgagagcaggttttcctggaacaaagagttaattaaccaatcagatttctcaatgaatctgatggacctaaacctcagcgactctggggagtatctgtgcaacatttcatccgacgagtataccctgctgaccatacacaccgtgcacgtcgagccttcccaggagactgcatcgcacaacaaggggctttggattcttgtgccgagcgccatactcgccgccttcctcttaatctggtctgtgaaatgttgtcgagcccagttagaggcccgtcggtcccgacacccagcggacggtgcccaacaggagagatgctgcgttccaccaggcgaaaggtgtccatctgctcccgacaatggagaggagaatgtcccattaagtggaaaggtttag

SEQ ID NO: 42724 - DNA, 294 bp, Artificial Sequence
  Description of Artificial Sequence: Synthetic coding sequence
atgaaggcccagaccgccctgagcttcttcctgatcctgatcacctccctgtcggggtcccaggggatctttccactggctttctttatatacgttccgatgaatgaacaaattgtgatcggaagacttgacgaggatatcatcctgcccagcagtttcgagcggggatcagaagtggtcattcactggaagtaccaggacagctacaaagtccactcctactacaagggctctgatcacctggaatcacaggacccccggtatgccaacaggacatccctcttttacaattag

SEQ ID NO: 42725 - DNA, 438 bp, Artificial Sequence
  Description of Artificial Sequence: Synthetic coding sequence
atgaaggcccagaccgccctgagcttcttcctgatcctgatcaccagtctgagcggctcccaagggatatttcccctcgccttttttatttacgtccccatgaacgaacagattgttatagggagacttgacgaagacattatactaccatcttcttttgagagaggttcagaagtggtgattcactggaaatatcaggactcgtataaagttcactcctattataaggggtcagaccacctcgagagccaggatccacgctatgcaaatcgaacctccctgttctacaatgagattcaaaacggcaacgcgagcttattttttagaagagtgtccctgctcgacgaagggatttatacctgctatgtgggtaccgccattcaagtcatcaccaacaaagtagtgctgaaggtaggggtgttcttaacccctgtatag

SEQ ID NO: 42726 - DNA, 1245 bp, Artificial Sequence
  Description of Artificial Sequence: Synthetic coding sequence
atgaaggcccagaccgccctgagcttcttcctgatcctgatcacctccctaagcggatctcagggaatcttccctttagctttttttatctatgtacctatgaacgagcagattgtaattggccgcctcgatgaagacataatactccctagctcatttgaaaggggaagtgaggttgtgatccactggaaataccaggactcgtacaaggtgcactcctactataaagggtcagaccacttagagagccaggatcctcgctacgccaatcggacctcacttttctacaacgaaattcaaaatggcaacgccagtctatttttccggcgcgtatctctcctggatgagggtatctatacctgttatgttggcactgctatccaggtaattaccaacaaagtggtgcttaaagtgggcgtgtttctgaccccagttatgaagtatgagaaacggaataccaactcctttcttatctgctcagtgctcagtgtataccctcgcccaatcattacctggaaaatggataacactccaatctccgagaataatatggaagagactggcagcctagatagcttctctataaatagccccctcaacataacgggaagcaacagctcctacgagtgtactatcgagaactccctactcaagcagacctggacgggtcggtggactatgaaagacggactgcacaagatgcagtcggaacatgtgagcctttcttgccagccagtgaacgattacttttccccaaatcaggattttaaagtgacttggtcacgtatgaagagcggcaccttctcagtactggcctattatttgtccagcagtcagaacacaatcatcaacgaaagccgcttcagctggaacaaagagctgatcaatcagtctgacttcagcatgaatctgatggacttgaatctatcagatagcggggaatatctttgcaatatatcatctgacgaatatactctgctgacgattcacacagtccatgtcgagccatcccaagaaacggcatcacacaataaaggactctggattttggtcccctccgccattctggctgctttcctgttgatctggtcagtgaaatgttgccgcgcgcagctggaagcaaggcgcagccgccaccctgccgacggcgcgcagcaggaacggtgttgtgtgccacccggcgagaggtgtccatccgcccccgacaacggagaggaaaacgtgccgctcagtgggaaggtgtag

SEQ ID NO: 42727 - DNA, 411 bp, Artificial Sequence
  Description of Artificial Sequence: Synthetic coding sequence
atgaaggcccagaccgccctgagcttcttcctgatcctgatcacctctctctctgggtcacagggaatatttcccctggctttcttcatttatgtccctatgaatgagcagattgtgattggtagactggacgaggacatcattctgcctagcagcttcgagcgcggtagtgaggtggttatccattggaaataccaggattcatataaggttcactcatattataaagggtctgatcacctcgaatcccaggacccccggtatgctaaccgcacatcactgttctacaacgaaatccagaacggcaacgctagtctgtttttccgaagggtcagcctactggacgaagggatatacacttgttacgtgggcactgctattcaggtgatcacaaacaaggttgtcctttag

SEQ ID NO: 42728 - DNA, 1245 bp, Artificial Sequence
  Description of Artificial Sequence: Synthetic coding sequence
atgaaggcccagaccgccctgagcttcttcctgatcctgatcaccagcctcagcggaagtcagggaatcttcccactggccttcttcatctatgtgccaatgaatgagcagattgtcattgggcgtctggatgaggacatcatcctgccttctagcttcgagcgcggctctgaagtggttatccattggaaataccaggactcttacaaagtgcacagctattataaggggtctgaccatctggagagccaggatcccagatacgcaaatcgtacgtcactgttttataacgaaatccaaaacggaaacgcaagtttgttttttaggcgtgtgtctcttctagacgagggtatatacacctgttacgtgggtaccgctattcaggttatcaccaacaaagtggtgctgaaggtgggcgtattcctaacccccgtcatgaaatatgagaagaggaatacgaatagcttcttgatctgttctgttctgagcgtatacccacgcccaatcatcacatggaaaatggataatactcccatctcagagaataatatggaggaaacgggctctttggactctttctcgatcaactcccctctgaatatcaccggcagcaattcatcatatgagtgcaccatcgagaacagcctattaaaacagacttggacggggcgctggactatgaaggacggtctccacaaaatgcagtccgaacacgtgtctctctcatgccagcccgtgaatgattacttctccccaaaccaggactttaaggtcacttggtcacggatgaagtcaggaacatttagtgttctcgcatattacttaagcagctctcagaatacaatcatcaatgaatctcggttctcctggaacaaagagctgatcaatcagtccgatttttccatgaatttgatggatttgaacctctctgacagtggagaatacttgtgcaacattagcagtgacgagtatacactgcttacaattcacaccgtgcacgttgaaccctcccaagagaccgcctcgcacaacaagggattgtggatcctggttccctcagccatcctggcagccttcttgctgatctggtctgtgaaatgctgccgagcccagctggaggctcgccgttcccgccaccccgctgacggggcacagcaggagcgatgttgtgtgcctcctggcgaaaggtgtccttcggcaccagataatggggaagagaatgtccctcttagcggcaaggtctag

SEQ ID NO: 42729 - DNA, 2193 bp, Artificial Sequence
  Description of Artificial Sequence: Synthetic coding sequence
atggccgccggcgtggaggccgccgccgaggtggccgccaccgagatcaaaatggaggaggaaagtggcgcaccgggagttccctcaggcaatggcgcacccggcccaaagggagagggcgaaagacccgctcaaaacgaaaagcggaaggagaagaatattaaacggggtgggaatagattcgaaccttacgccaatccaaccaaacgataccgcgcatttattactaatatccccttcgatgtgaagtggcagtctctgaaggacctcgttaaagagaaggtaggcgaagttacctatgtggagctgctgatggatgcagaagggaagtctcgggggtgtgcagtggtggaattcaagatggaggagtcaatgaaaaaggcagcagaagtcttaaacaaacactcactgtcaggacggcccctgaaggtaaaggaggatccggatggggagcatgcgcggagggcaatgcagaaggttatggctacaactggcggaatggggatgggaccaggcggccctgggatgatcaccatcccacccagcatccttaataatcccaatattcctaacgagataatccacgctctacaggcagggaggttaggcagtaccgtgttcgtcgccaatttggactacaaggtcggatggaaaaaactgaaagaagttttcagtatggctggtgtcgtggtccgcgcggatatcctggaagacaaagatggcaagtcacgaggaattggcacagtgacattcgaacaatctatcgaggcggtgcaagcaatctcaatgttcaacggccagcttcttttcgaccgaccaatgcatgtgaaaatggacgaaagggctttaccaaagggcgatttctttcccccagagaggccgcaacagctgccccacggcttgggcggaattggtatgggcctgggtcctggaggtcagccaattgatgccaatcacctcaataagggaatagggatgggtaatatcgggcctgctggtatggggatggagggtattgggttcggcattaacaagatggggggcatggagggacccttcgggggaggaatggaaaacatgggacgcttcggcagcggaatgaatatggggagaattaacgagattctgtcgaacgcgttgaagcggggagaaattattgcaaagcagggggggggtgggggaggagggagcgttccaggtattgagaggatggggcccggcattgacaggctcggcggagcaggcatggaaagaatgggagctggactaggccatgggatggatcgggtaggctccgagatcgaacgtatgggcctggtaatggataggatggggagcgtggagcgaatgggcagtgggattgaaaggatgggcccactgggtctggatcatatggcttctagcatcgagcgcatgggccagactatggagcgtattgggagcggtgtcgaacgcatgggagcgggtatggggttcggactggaacgaatggcagccccgattgacagagtaggtcagaccatcgagaggatgggtagtggagttgaacggatgggccctgccatcgaacgcatgggactgtctatggaacggatggtgccggcggggatgggggcaggactcgaacggatgggcccggtcatggataggatggcgacaggcttggaaaggatgggcgctaataacctggagcggatgggcctggaacggatgggggcaaactctttagagagaatggggctggagcgaatgggagcgaactctcttgaaaggatgggaccagctatgggacctgcactgggcgcaggcatcgagaggatgggccttgcaatgggggggggcggcggcgcatcctttgaccgagctattgaaatggagagagggaactttgggggctcattcgccggtagctttgggggagctggggggcacgctcctggtgtggcccggaaggcatgccagattttcgttagaaatctgccttttgatttcacgtggaagatgctgaaggataagttcaatgagtgcgggcatgtgctgtacgccgacattaaaatggagaatggaaagtcaaagggatgcggtgtggtgaagtttgaaagtccggaggtggcagagagggcctgtcgaatgatgaatggaatgaagctgtcagggagagaaattgacgtacgcattgaccgcaacgcctag

SEQ ID NO: 42730 - DNA, 2076 bp, Artificial Sequence
  Description of Artificial Sequence: Synthetic coding sequence
atggccgccggcgtggaggccgccgccgaggtggccgccaccgagatcaagatggaagaggaaagtggagcccctggagttccctccggaaacggcgcaccaggaccaaaaggagaaggtgagcgccccgcccagaacgagaaaaggaaagaaaaaaatattaaaaggggaggaaaccggtttgaaccatacgccaatcccacaaagcgatacagggctttcataacaaacattcctttcgacgtcaagtggcagtcactcaaagatctagtgaaggaaaaggtgggagaggtcacatatgtggagctcttaatggacgccgaggggaagtccagaggatgtgccgtggtcgagtttaagatggaggagtccatgaaaaaggcagccgaagtcttgaacaagcatagcctgagtggaaggcctcttaaggttaaggaagatcctgacggtgaacacgcccggagggccatgcaaaaggccggccgtctaggttcaaccgtgttcgtcgccaacctggactataaagtcggatggaaaaaactcaaagaggtgttttccatggccggcgttgtcgtgcgtgccgacatattggaggacaaagatggaaagtcccgcgggataggaactgtcaccttcgaacagtccatagaagcagtccaggctatttcaatgtttaacggacagctgctttttgaccgacctatgcacgttaagatggatgaacgtgcgcttcccaagggggacttcttcccgcctgagaggcctcaacagctacctcacggtctcggtggcatcggaatgggcttgggcccaggtggccagcccatcgacgcaaaccatctgaataagggtatcggcatgggtaatataggccccgccggcatgggcatggaaggcatcggcttcggcataaataagatgggtgggatggagggccctttcggcggcgggatggagaatatgggcaggttcggaagcggcatgaacatgggacgaataaatgagattctttctaatgcactgaagcgcggagagatcatcgccaagcaaggtggcggagggggaggaggatcagtacccggaatcgagcggatgggaccaggaatcgatagacttggcggcgcaggaatggaaagaatgggggctggcctgggccatgggatggacagggtgggatccgagatcgaaaggatgggcttggtcatggatcgaatgggctcagtggaaaggatgggctccgggatcgaacggatggggcctctcggcttggatcatatggccagcagcatcgagaggatgggccaaacaatggaacgcatcggctccggagtagagcgtatgggagccggaatgggattcgggttagaaaggatggctgcccctatcgaccgggttggccagactatcgagcgcatgggcagcggggtggagcggatgggccctgctatcgagcgtatgggactgtcgatggagaggatggtaccggcagggatgggtgccggtcttgaacgcatgggccccgtcatggaccgtatggcaacaggcctggagcgaatgggtgccaacaacctggagcgcatggggttggagcgaatgggggcaaactcactggagcgcatggggcttgagcggatgggggccaacagtctggagagaatgggtcccgctatgggtccagcacttggcgcaggtatcgaacgcatgggactggcaatgggcgggggaggcggcgcatcgtttgatagggcaatcgagatggaacggggaaactttggcgggagctttgccggtagtttcggtggagctggcggtcacgcgcccggggtggccagaaaagcttgccaaatcttcgtgagaaatctgccttttgatttcacctggaagatgttaaaggataagttcaacgaatgcggtcacgtgctgtacgccgatattaagatggagaacgggaagagcaaaggatgcggagtggtcaaattcgagagtcctgaggtggccgaaagagcttgccgtatgatgaatggtatgaagttaagtgggagagaaatcgacgtccgcatcgatcggaatgcctag

SEQ ID NO: 42731 - DNA, 864 bp, Artificial Sequence
  Description of Artificial Sequence: Synthetic coding sequence
atgggcagcgtggagcggatgggcagcggcatcgagcggatgggcccactgggactggaccatatggctagctccattgagcgcatgggacagacaatggaaaggatcggatctggagtggaacgaatgggcgctggtatgggctttggcttagagcgaatggcggcacccatagatcgggtggggcagactatagaacgaatgggcagtggcgtggaaaggatggggcctgccattgaaaggatgggactgagcatggagaggatggtgcctgcaggaatgggcgccggcctcgagaggatgggccccgtcatggaccggatggcaacaggcctggagcgtatgggggcgaataacctagaacggatgggccttgagaggatgggtgctaatagtcttgagcggatggggttggagcgtatgggcgcaaacagcttggaaagaatgggacccgccatggggcctgctcttggcgctggcatcgagcgtatgggcctcgctatgggcgggggtggcggtgcttcttttgacagagcaatcgaaatggagcgcggtaactttggcggatccttcgcgggctctttcgggggcgctggagggcacgcacctggcgtggcacggaaggcctgtcagatcttcgtgcgcaaccttcctttcgatttcacatggaaaatgcttaaggacaagttcaatgagtgtggtcatgtgctctacgctgatattaagatggagaatggcaagtcaaaaggctgcggtgtggtaaagtttgaaagcccagaagtcgcagagagagcttgtcggatgatgaacggcatgaaattgtccggtagagaaattgatgtccgaatagaccgaaatgcgtag

SEQ ID NO: 42732 - DNA, 1848 bp, Artificial Sequence
  Description of Artificial Sequence: Synthetic coding sequence
aacggcagccacctgaagacctggctgaagaagaagggctgcgccgttgtggaattcaaaatggaagaaagtatgaagaaggccgccgaagtgctgaataagcacagcctgtccggaaggccacttaaggtgaaagaggacccagatggggagcatgctcgccgcgccatgcaaaaggttatggccacaactggaggcatgggaatgggacctggcggacccgggatgattactatccccccttctattctgaacaatccaaatatacctaacgagattatccacgcacttcaggcaggccggctgggctccaccgtgtttgtcgccaatcttgattataaggtgggctggaaaaagttgaaggaggtgttcagcatggcaggagtggtagttagagctgatattctggaggataaagacgggaagagtaggggcattggcacagtgacctttgagcagagcatcgaggctgtccaggcaataagcatgttcaacggtcagctgctatttgaccggcccatgcatgttaaaatggacgaacgagctcttcctaaaggggattttttccctcccgagcgcccacaacagctcccccacggattgggtggcattggaatgggactagggccaggaggccagcctatagacgctaaccatcttaataaggggattgggatgggcaatatcggtccggctggcatggagggaccttttgggggaggcatggaaaacatgggccggttcggaagtggcatgaatatgggcagaatcaatgagatcctttcgaatgcattaaaacgtggcgaaatcattgcaaagcagggcggaggagggggcggcggcagtgtgcctggcatcgagcggatggggcccggaatcgaccgactggggggggccggcatggagcggatgggtgcgggattggggcacggaatggatcgggtgggttcagagatcgaacggatgggattggtcatggatcgcatgggaagcgtcgaacgcatgggttcaggaattgagcgaatgggcccactgggcctggaccacatggcatcgagcatagaaaggatgggacagaccatggaacgcatcggttccggggttgagcgaatgggcgctgggatggggttcggtctggaaagaatggcggcccctatagaccgcgttgggcagaccatagagagaatgggctccggtgtagagaggatgggccctgcgattgaacggatggggctttcgatggagaggatggtccccgcggggatgggagccggactggaaaggatgggtccagtgatggatcgcatggccactggtctcgaaaggatgggcgcgaataaccttgaaaggatggggttggagaggatgggagctaacagcttggagcgaatgggtcttgagcgaatgggagcaaacagcctggagcgtatgggacctgcgatgggcccagctctgggcgccggcattgagcgcatggggctagccatgggcggcggaggcggcgcgtcctttgacagggcgatcgagatggaaagaggtaatttcggcggctcttttgccggatcgttcggcggcgcaggcggccatgcgccgggagtagctcgaaaggcttgccaaattttcgtgcgcaatcttccatttgattttacatggaagatgttgaaagataaatttaatgagtgtggccacgtgctgtacgcagacatcaagatggaaaacggcaaatccaaaggttgtggcgtggttaagtttgagtcacctgaggtggccgaaagggcatgccgcatgatgaacggcatgaagctcagcggaagagaaatagacgtgcgaatcgaccggaatgcctag

SEQ ID NO: 42733 - DNA, 2754 bp, Artificial Sequence
  Description of Artificial Sequence: Synthetic coding sequence
atgttcgccgtgcacctgatggccttctacttcagcaagctgaaggaagatcaaatcaaaaaagttgatcgattcctttaccatatgcggctgtccgatgatacactcttggatatcatgcggcgctttagagctgaaatggaaaaggggttggccaaagatacaaacccgacggcggccgtgaagatgctgccaacatttgtccgcgccatcccagacggaagcgaaaatggggaatttctttccctggacctgggaggaagtaaatttcgagtgctgaaagtacaggtcgcggaggaaggaaagcggcacgtgcagatggagtctcagttctacccaacaccaaacgaaattattaggggcaacggtacggaacttttcgagtatgtagcggattgtttggccgactttatgaaaacaaaggatctgaagcataaaaagcttcccctgggtcttacattcagcttcccctgtcggcagacaaagctcgaagaaggtgtactgctaagttggacgaaaaaatttaaggcaagaggtgttcaggataccgatgtagtctctcgattgactaaagcaatgcggaggcacaaggatatggatgtcgacatcctggcgctggtgaacgacaccgtgggcacaatgatgacatgtgcttatgacgacccgtactgcgaagtgggcgtgatcatcgggaccggtactaacgcctgttacatggaggatatgtcaaatatcgatctcgtcgaaggggatgaagggcgaatgtgcattaatactgaatggggtgcattcggtgacgacggcgcgctggaggatatcagaacagagttcgaccgggaactggatttgggatctttaaaccctgggaagcagctctttgaaaagatgatctccgggttgtatcttggtgaattggtgcgcctgattctcctgaaaatggctaaggccggccttctttttggcggagagaaatccagcgcactacacacgaagggaaagatagaaacccggcacgttgcggcgatggaaaagtataaggaggggctggcaaatacaagggaaattctggtcgacctaggattggagcccagtgaagccgactgcatcgccgtccaacatgtctgcaccatcgtgtcgttcaggtctgccaatctgtgcgccgcggctctggcagcaattttgacgcggctgagagagaacaagaaggtggagaggctccggacgactgtgggcatggacggcaccctctacaagatacatccccagtacccaaagcggctgcataaggttgttagaaaattggtaccaagctgcgatgtgcggtttctgctcagcgagtcagggagtaccaagggcgcagctatggtgaccgcagttgcctctagggtgcaagctcagcgcaaacagattgacagagtccttgccctcttccagttaactcgcgagcaactggtcgacgttcaagctaagatgcgggccgaattggagtatggactgaagaagaagtcacacggacttgccacagtgaggatgcttcccacctacgtgtgcggcctgcccgacgggactgaaaaggggaagttcctcgcattggatctgggcggaacaaatttcagggttttactggtaaagattcgctccgggaggcggagtgtgcggatgtataataagatcttcgcaatcccattggagataatgcagggcaccggggaggagctgtttgaccatatagtgcaatgcatcgctgacttcctggactacatgggattaaaaggcgcctctttacctttgggcttcacattctcgtttccatgtcgccaaatgagtatagataagggaacgctgattggctggacaaaaggatttaaggcaactgactgcgagggagaggatgttgtggacatgctgagggaagcgatcaaaaggcgcaatgagtttgacctcgatatagtggctgttgttaatgacaccgtggggaccatgatgacttgtgggtacgaggatcccaactgtgagatcggcctgatcgccgggacaggtagtaacatgtgctatatggaggatatgcggaatatagagatggtcgagggtggtgagggtaaaatgtgtatcaacactgagtgggggggctttggagataatggctgtatcgacgacatctggacccgctacgatacagaggtggatgaaggatcgctgaatccagggaaacagcggtatgaaaagatgacatccggcatgtatctaggagaaattgtcagacagatactcattgacctaacaaaacagggccttctctttcgcgggcaaatcagcgagagacttcgcacccgcggtatctttgagaccaaatttttgtcccagatagaaagtgatcggctggctctgctgcaggtcagaaggatccttcagcagcttggtctcgattccacttgtgaggactccatagttgtcaaagaagtgtgtggagccgtgtcccgtagagccgcacagctttgcggggctggcctcgcagccatcgtggagaagcgcagagaggatcagggtttggagcaccttcgtattaccgttggcgtggacggaactctctacaagctgcatccccatttctctcggatactgcaggaaaccgtcaaggaattagcgccacgctgtgatgtgactttcatgcttagcgaagacggaagcggtaaaggtgccgccctgatcaccgccgtggcgaagagactgcagcaagcgcagaaggagaactag

SEQ ID NO: 42734 - DNA, 2421 bp, Artificial Sequence
  Description of Artificial Sequence: Synthetic coding sequence
atgttcgccgtgcacctgatggccttctacttcagcaagctgaaggaggatcagataaagaaagtagataggtttctttaccatatgcgattgtctgatgatacactgctcgatatcatgcggcgcttccgggccgaaatggaaaaggggctggccaaagacactaatccaacagctgcagtcaagatgctgcccacctttgtcagagccatccccgatgggagtgagaatggggagtttctgtctctggatctaggggggtcaaagtttcgagtgttaaaagtccaggtggccgaggaaggcaagagacacgtgcagatggagagccagttttacccaacccccaacgagatcatccgtggcaatggaacagaactctttgagtacgtcgcagattgtctcgctgactttatgaagactaaggacttaaaacataagaaacttccgctgggtctgacgttttcttttccctgtaggcagacaaaacttgaagagggggtgcttctgagctggaccaagaagtttaaagcccgtggggtgcaggatacagatgtggtgtcaagattgactaaggccatgagaaggcacaaagacatggatgtggacatacttgccctggtgaacgacactgtgggaaccatgatgacgtgcgcctatgacgatccttactgtgaggtcggggtgatcatcggtactggcactaatgcctgttacatggaagacatgtccaatattgacttggtggagggcgatgaagggaggatgtgtattaacacggaatggggcgcctttggagacgacggtgctctggaggatataaggactgagtttgaccgggaacttgatctgggaagcctgaatcctggtaaacaactgtttgagaaaatgatatccgggctttatctgggagagctggtgcggttaatactgttgaagatggcgaaagctgggttactgttcggtggggagaaaagtagcgccctgcacaccaaaggtaagatagagacacgacacgttgcggccatggaaaagtacaaagagggcctggccaatacccgtgagatcctcgtcgatctcggacttgaacctagtgaagctgactgtatcgccgtgcagcatgtctgcactattgtgtcctttaggtcggccaacttgtgcgcagccgctcttgctgctatattgacacgcctgcgcgagaacaagaaggtggaacggctgcgcactaccgttggaatggatggcaccttgtataaaattcatccacagtacccgaagcggctgcataaagtcgttaggaaactcgtccctagctgtgacgtaaggttcttgctgtccgagagcgggtctaccaagggggctgcgatggtgaccgcggtggccagcagagtccaggctcagaggaagcagattgatcgcgtactcgcactgttccagcttactagggaacagctcgtggacgttcaagccaagatgagggcggaactggaatacggccttaagaagaaaagccatggtttggcgaccgttcgaatgctgcctacgtatgtgtgcggcctcccagacggcaccgaaaaggggaagttcctggcactggacctgggcggcaccaacttcagggttctgctcgtgaagatacgatctggacgaaggtccgtaaggatgtataacaaaatctttgccatccccctcgaaataatgcagggcacaggcgaagaattatttgatcacattgttcagtgtatcgcagactttctcgactacatgggtctcaagggtgcatctctcccacttggattcactttctccttcccatgccggcaaatgagtatcgacaagggcacattgattggctggactaagggttttaaagccaccgattgcgagggcgaagatgtggtggacatgctaagagaggccatcaaacgtcgcaatgaatttgacctggacattgtcgccgtagtcaatgataccgtgggtacaatgatgacctgtgggtatgaagaccccaactgtgaaatcggcttgatcgctggaaccggctcaaacatgtgctacatggaggacatgagaaatatagaaatggtcgaagggggcgaaggtaaaatgtgcattaacactgagtggggtggctttggggataacggttgtattgatgacatctggacaaggtacgataccgaagtggacgaaggttccctgaatccaggaaagcagagatacgagaaaatgacctctggaatgtacctgggggagattgtgcgacagatacttattgacctgactaagcaaggactcctatttcgcggacagataagtgagcgactccggaccagaggcatcttcgaaacgaagtttttaagccagatcgagcgtatgctctccgtgatcgatgcatactgcttggatttgctgtttcactag

SEQ ID NO: 42735 - DNA, 2211 bp, Artificial Sequence
  Description of Artificial Sequence: Synthetic coding sequence
atgttcgccgtgcacctgatggccttctacttcagcaagctgaaggaggatcagatcaaaaaggtggatagattcttataccatatgcgcttgtcagacgatacactgctggacatcatgcgcagattccgagcagaaatggagaaggggctcgctaaggatacaaatcctaccgccgccgtcaaaatgctaccgaccttcgtgagagcaattcccgatggttctgaaaatggtgagtttttaagccttgacctaggcggatcaaagtttagagtgctgaaggtccaggtggcagaagagggcaaacgccacgtacagatggagtcacaattttatccaactcctaacgaaataatccgtggtaacggcaccgagttgtttgaatacgtggctgattgtctcgccgattttatgaagacaaaggatctcaagcacaagaaactgcccttgggattaacattctcattcccgtgtcggcagaccaagttggaggaaggggtgctactgtcctggactaaaaaatttaaggctagaggagttcaggataccgacgtagtgtctcggttgactaaagctatgcggaggcataaggacatggacgttgacattctcgctcttgtaaacgacaccgtagggaccatgatgacgtgtgcatacgacgatccttactgtgaggtgggggtgatcataggtaccggaactaacgcctgctacatggaagacatgagtaacatcgacctggtggagggcgatgagggcaggatgtgcatcaataccgaatggggagcgtttggcgatgacggcgctctggaagatattagaactgaattcgaccgagaactggatctaggttctcttaacccgggaaagcagctttttgagaagatgatctctggtctgtatcttggagagctggttcgtctcatccttctgaagatggccaaggcaggcctgttgtttgggggggaaaaaagtagcgcactccacaccaaagggaaaatcgagacacgccatgttgccgccatggaaaagtacaaggaaggattggccaatacgcgagaaattctggtcgacctcggcttggagccatccgaggctgattgcatcgcagtccagcacgtgtgcaccattgttagcttccgttcagccaacttatgtgccgccgccctagctgccatattgaccaggctacgggagaacaaaaaggtcgagaggctgagaacaacagtgggtatggatggcaccctgtacaagatccatccccagtacccaaagcgcctccataaggtggttagaaagcttgttccctcatgcgacgtccggttcctgttaagcgagtccggatcgactaaaggcgctgccatggtaacggcggtcgcgtccagggttcaagctcaacggaagcagatcgaccgagttctggcactgtttcagttgacccgggaacagctggtggatgtgcaagccaagatgagagccgagctggaatatggactgaagaaaaaatcccacggtttggcaaccgtgagaatgttaccgacttatgtgtgtggactgccagacggcacagagaaaggaaaattcctggcactggacttaggcggcaccaatttccgggtactgctagtgaagattaggagcgggcgtcggagcgtacggatgtacaacaaaatctttgcaattcccctggagatcatgcaaggaacaggcgaagagctgttcgaccacatcgtccagtgtatcgccgattttttagactatatgggtctgaaaggagcatccctacccctaggcttcactttttcttttccttgtcgtcagatgagcatagataaggggacactcatcggttggacaaaaggtttcaaagccacggattgcgagggagaggacgtagtcgatatgttacgcgaagctattaaaaggaggaacgagtttgacctcgatatcgtggcggtagtcaacgataccgtcgggactatgatgacttgtggatatgaagaccccaactgtgaaatcgggttgatcgcgggcaccgggtcaaacatgtgctacatggaggatatgaggaacattgaaatggttgaggggggggaaggaaaaatgtgtatatgttttagtttttgtctctggttcgttctgcaagtgctcatcgtcgtattgcggatcgtaaggtaccgcaagtcctctaagttgattaagaagttctag

SEQ ID NO: 42736 - DNA, 282 bp, Artificial Sequence
  Description of Artificial Sequence: Synthetic coding sequence
atgagcaccgacaccggcgtgagcctgcccagctacgaggaggaccaggggagtaaactaatcagaaaagccaaagaggccccatttgtgcccgttggtatcgctgggtttgcagctattgtcgcttacggactttacaaactgaaatcacgcggtaatactaagatgagcattcacctcatccacatgagggtagctgcacaggggttcgtggtcggcgctatgaccgtcggcatgggatattctatgtatcgcgagttctgggcaaagccaaaaccatag

SEQ ID NO: 42737 - DNA, 282 bp, Artificial Sequence
  Description of Artificial Sequence: Synthetic coding sequence
atgagcaccgacaccggcgtgagcctgcccagctacgaggaggaccaaggcagcaagcttatacgcaaggctaaagaagccccttttgtgcctgtggggatagccggtttcgcagccatcgtagcatacggactgtataagctgaagtctcgcgggaatacaaaaatgagtatccacctcattcatatgagggttgccgcccagggattcgtcgttggcgcgatgaccgttggtatggggtacagtatgtaccgcgaattctgggccaaacccaaaccatag

SEQ ID NO: 42738 - DNA, 324 bp, Artificial Sequence
  Description of Artificial Sequence: Synthetic coding sequence
atggagcagaagctggtggaggagatcctgcaggccatcaccatgtctacagacaccggcgtgtctctcccttcttacgaggaggatcagggaagtaaacttatcagaaaggccaaggaagccccctttgttcctgtcggtattgccgggttcgccgccattgtggcctacggactctacaaactgaaatctagaggaaatactaagatgagtattcatttgatccatatgagagtggccgctcaaggcttcgtagtaggcgccatgacagtgggaatgggatattcaatgtaccgagagttttgggcgaagccgaagccttag

SEQ ID NO: 42739 - DNA, 300 bp, Artificial Sequence
  Description of Artificial Sequence: Synthetic coding sequence
atgagcgccaaccggcggtggtgggtgccccccgacgacgaggactgcgtaagcgagaagctcctccgaaagaccagggaaagcccactcgtgcccatcgggctggggggttgcttagtcgtggctgcttaccggatttaccggctgaggagtcgggggagcacaaaaatgtctatccatcttatacatacccgcgtagccgcccaagcttgtgccgtcggcgctatcatgctgggcgccgtctataccatgtactcagattacgttaagagaatggcccaggacgcgggcgagaaatag

SEQ ID NO: 42740 - DNA, 321 bp, Artificial Sequence
  Description of Artificial Sequence: Synthetic coding sequence
atggccacccccggccccgtgatccccgaggtgcccttcgagcccagtaaaccgccagtcattgaaggactgtcgccaaccgtttataggaacccagaatcattcaaagaaaaattcgtaaggaagacccgcgaaaatcccgtggtgccgatcggctgtctggccactgccgccgcgctgacctatggactttactctttccaccggggaaactctcagcggtcccagttaatgatgcgaacccgaatcgctgcacaaggttttacagtggctgctatcctgctaggacttgccgttacagccatgaaaagtcgcccttag

SEQ ID NO: 42741 - DNA, 321 bp, Artificial Sequence
  Description of Artificial Sequence: Synthetic coding sequence
atggccaccctgggcttcgtgacccccgaggcccccttcgagagctccaagcctcccatctttgagggtctgtccccaaccgtgtattccaaccctgagggtttcaaagaaaaattcctgagaaaaaccagagaaaacccagtggttcccatagggttcctgtgcactgctgctgtgctgaccaacggcttgtattgcttccaccagggtaattcacagtgctctcgcctgatgatgcatactcagattgccgcacagggctttaccatagctgccatcctcctaggattggcagctacagctatgaagtctcccccttag

SEQ ID NO: 42742 - DNA, 1473 bp, Artificial Sequence
  Description of Artificial Sequence: Synthetic coding sequence
atgacccagggcaagaagaagaagcgggccgccaaccggagcatcatgctggccaagaaaattattatcaaggacggtggaaccccacagggaataggtagtccatcagtgtatcatgcagtgatagtaatcttcctggagttcttcgcatggggactgctgaccgcacccacccttgtggtccttcacgagacattccctaaacacacgtttctgatgaacgggcttatccaaggggtcaagggccttttgtcttttttgagcgcgccgctcataggtgcgctgagcgatgtgtggggaagaaagagctttctgctgctgaccgtatttttcacctgcgcccctattccgctgatgaagattagtccttggtggtacttcgcggtgatttctgtctcgggggtcttcgcagttactttttcagtggtgttcgcttatgtagctgacatcactcaggaacatgagcgctctatggcatacgggttggtttctgctaccttcgcggcatcgcttgttaccagccccgccatcggcgcttatttgggccgggtttacggtgatagccttgttgtggtgctcgctactgcaattgctctgttggatatttgtttcattctcgtcgccgttcccgaaagcctccctgagaagatgcgcccggcgtcctggggggccccgataagctgggaacaagccgatccctttgcatccctaaagaaagtgggccaggacagcattgtcctcctcatctgtatcacggttttcctctcttacctgccagaggctggacaatactcatcttttttcctgtatttacgtcagattatgaagttctcacctgagtctgttgccgcattcatcgccgtcttgggaatcttgtccatcatcgctcagaccattgtcctctccctcctgatgagatccattggcaacaagaatacgattttgttaggactgggatttcagattctgcaactcgcttggtacggattcggatccgaaccttggatgatgtgggcagccggagctgtcgccgccatgagttctataacttttcctgccgtctctgcactggtgtccagaacagccgatgcggatcaacagggtgtggtgcaaggcatgatcacaggtataagagggctttgcaatggacttggcccagccttatatggttttattttctacattttccatgtcgaactgaaggagttaccaatcacaggtactgatctggggaccaatacctctccccagcaccatttcgaacaaaatagtatcatccctggaccccctttcctttttggagcctgcagtgtgctcttggccttgctggtggcgctattcatccctgagcataccaacttgtctctacgatccagcagttggcgaaagcattgtggatcccattctcatccccacaacactcaggctcctggagaggccaaggagccactactgcaggatacaaatgtgtag

SEQ ID NO: 42743 - DNA, 363 bp, Artificial Sequence
  Description of Artificial Sequence: Synthetic coding sequence
tgacacgagaccttccccaagcacaccttcctgatgaacggcctgattcagggcgttaaaggactcttgagcttcctaagcgcccccctaatcggggcacttagcgacgtgtgggggaggaagtcttttctgctcttgacagtgtttttcacatgtgcacccatcccgctcatgaagatctccccttggtggtacttcgctgttatctccgtgtctggggtgtttgcagtcacgttctccgtagtgttcgcctatgttgctgatatcactcaagagcatgaacgcagtatggcctacgggctggtttgtatgtttatactctatctgctgtacctgctgcgcaacgccctgtttctaagatag

SEQ ID NO: 42744 - DNA, 462 bp, Artificial Sequence
  Description of Artificial Sequence: Synthetic coding sequence
atggtgggcatcctgagcatcgtggcccagaccgccttcctgagcattctcatgcgctctttaggcaacaaaaacaccgtcctgctgggcctggggttccagatgctacaacttgcatggtatggcttcggatctcaggcttggatgatgtgggctgctggcaccgtggcggccatgtcttctatcacctttccggccatcagcgccttagtctctagaaacgccgagagcgaccagcagggtgtcgctcaagaccacaattggaacaagagaaccatgcagtggccgggggccctatacggttttattttctacatgtttcacgtggaactcaccgagttggggccgaagctgaactctaacaacgttcctctccaaggctcttgccatccccgccctgctgtgtttatttggggtatgtactccccctatgtattctctggttgcttaatccatagttag

SEQ ID NO: 42745 - DNA, 1521 bp, Artificial Sequence
  Description of Artificial Sequence: Synthetic coding sequence
atgagcgtggagcccccccccgagctggaggagaaggccgccagcgagccagaggctggggcaatgccagagaaacgagccggggctcaggcagccggtagtacttggttgcagggatttggacggccatctgtttatcacgccgctatcgttattttcctcgaattttttgcatggggcctcctgaccaccccaatgctgacagtgcttcacgagacattcagccagcacacctttctaatgaatgggttaatccaaggcgtgaagggactgctgagtttcctgtccgcccccctgattggcgccttgtccgacgtgtggggaagaaagccatttctgttgggtaccgttttcttcacttgtttcccaattcccctgatgagaattagcccatggtggtattttgctatgatctccgttagtggcgtcttttctgtgactttttccgtgattttcgcctatgttgctgatgtaacccaagagcacgaaagaagcaccgcctatggttgggtaagcgctacctttgccgcgtcactggtctctagtccagccataggtgcttatcttagcgcttcctacggcgactccttggttgtcctcgtggctacagtagtggccctcctggatatctgctttatccttgtcgccgtgcccgagagcctgcccgagaagatgaggcccgtttcttggggcgcccagatctcctggaagcaggccgatccatttgcctccttgaaaaaagtaggcaaggactctactgtgttgctaatttgtatcactgttttcctaagttacctgccagaagcaggacaatatagttccttcttcctgtatctacgtcaggtgatagggttcggtagtgtcaaaattgctgcattcatagcaatggtggggatcctgagcatcgtagcccaaaccgcctttctttcgattctcatgagaagtcttgggaataagaatacagtcctcctgggcttggggtttcagatgctgcaattggcctggtacgggttcgggagtcaggcctggatgatgtgggcggctggaactgtggcggccatgagcagcattacattccccgctatctccgccttggtcagtaggaacgcagaatcggatcagcaaggcgtggcccagggcatcattacgggcatccggggactctgtaacgggcttggcccagcactatacggctttattttttacatgttccacgtcgagttgacagagcttggtcccaagttgaattcgaataatgtaccactccagggcgcagttataccaggcccccccttcctctttggtgcatgtattgttctcatgtcctttctcgtcgccctgttcatccctgaatattccaaggccagcggtgtacagaagcactcgaattccagcagcggaagtctaaccaatactccggaacgtggctctgatgaggacatcgagcctctgctgcaggactccagcatatgggagctctctagctttgaagagcctgggaaccaatgcacagagctgtag

SEQ ID NO: 42746 - DNA, 936 bp, Artificial Sequence
  Description of Artificial Sequence: Synthetic coding sequence
atgctgaccgtgctgcacgagaccttcagccagcacaccttcctgatgaatggcctgattcagggggtgaagggactgctaagcttcctgtcagctcccctgatcggagcactcagcgacgtctgggggagaaagcctttcctcctgggaacagtgttttttacctgcttcccaattccattaatgcgcatttccccgtggtggtactttgctatgatctcagtctcaggggtcttttctgtcaccttctctgttattttcgcctacgtcgccgacgtgacacaggagcacgagaggagtactgcctacggctgggtgtcagctactttcgctgcgtcactggtgagctcacccgcgatcggcgcctacctaagcgcgtcttacggtgactctctggtcgtgctcgtggccaccgtggtagccctgctggacatatgtttcattctcgtcgccgtcccagaatccttgcctgaaaaaatgcgacctgttagctggggtgcccagataagctggaaacaggctgacccttttgctagtttgaaaaaggttgggaaggactccacagtgctgctcatttgcattacagtcttcctctcctaccttcccgaggcagggcagtacagctctttctttctgtacctacgccaggttatcggttttggttctgtgaaaattgccgcttttatagctatggtgggaattctgtccatcgtagctcagaccgcgttcctgagtatattgatgaggtctcttggtaataagaacacggtgttactagggttgggattccaaatgctgcagctggcatggtacggcttcggttctcaggcgtggtcatgtcccggagaccacaactggaacaaacgcaccatgcaatggccaggtgcaagcacggtgtggctgcacattctccacgtgccatgtggcaccgactag

SEQ ID NO: 42747 - DNA, 405 bp, Artificial Sequence
  Description of Artificial Sequence: Synthetic coding sequence
atgagcgtggagcccccccccgagctggaggagaaggccgccagcgaacccgaagcaggggccatgcctgaaaagagggctggggcccaggccgctggatccacctggctccaaggctttggccctccctctgtgtaccacgcagccattgtgatctttctggaatttttcgcctggggcctgttgacaacaccaatgctcacggtgctccacgaaactttctctcagcacactttcctaatgaacggtctgattcaaggtgtaaagggcttactatcctttctgagcgcccctcttattggtgccctgagtgacgtgtggggaaggaagccatttctcctagggactgtcttcttcacatgcttcccgatccccctgatgagaatatcaccttgtcaggcgtag

SEQ ID NO: 42748 - DNA, 348 bp, Artificial Sequence
  Description of Artificial Sequence: Synthetic coding sequence
atgctgggcctgctgggcagcaccgccctggtgggctggatcaccggggccgccgttgctgtgcttctccttttgctgctgctcgccacgtgtctattccacggaagacaagactgtgatgtggaaagaaacaggaccgccgccggcggcaatagagttaggagggcacagccatggccattccgcaggcggggccacttgggcattttccatcatcataggcatcctgggcatgtgtctcacgtacccaatgttgggctgcaccatcatcatcacccccggcatacaccacaccatctacatcaccatcaccacccacaccggcaccatccccggcatgctagatag

SEQ ID NO: 42749 - DNA, 1041 bp, Artificial Sequence
  Description of Artificial Sequence: Synthetic coding sequence
atgtacaacggcagctgctgccggatcgagggcgacaccatcagccaagttatgcctccgcttctgattgtggctttcgtgctgggtgctttgggtaatggggttgctctttgtggcttttgcttccatatgaaaacttggaaacccagcaccgtctatctgttcaacttagctgtggcagattttttgctcatgatttgtctgccatttcgtactgactactatctgagaagacgtcactgggcctttggagacatcccatgccgggtaggtctctttaccctcgccatgaatcgggcgggaagtatcgtattcttgacagtggttgcagccgacagatacttcaaagtggtgcatccgcaccatgccgtgaacactataagcactagagtggcagctgggatcgtgtgtaccctttgggcgctcgtgatactcgggacagtctatcttttgctagagaaccacctgtgtgtccaagagacagctgtgtcctgcgagtcctttattatggaatcagcgaacggctggcatgacataatgtttcagcttgagtttttcatgccgctggggataatcctattctgttccttcaaaatcgtctggtccttacgtaggcggcaacagctcgcgcgtcaggcaaggatgaaaaaggccacccgcttcatcatggttgtggcaatagtctttataacctgttacttgcccagtgtctctgctcggttgtacttcctgtggaccgtaccaagcagcgcatgcgacccctctgttcatggtgccctccatataactctgtcatttacatacatgaatagcatgttggatcccttagtctattatttctcaagccctagctttccaaaattttacaacaaacttaagatttgttctttgaagcctaagcagcccggccactccaagacccagcggcccgaagaaatgccaatctccaacctgggacggcgctcctgcatctccgttgcaaactctttccagagtcagagtgacggccaatgggatccacacatcgtggaatggcactag

SEQ ID NO: 42750 - DNA, 1041 bp, Artificial Sequence
  Description of Artificial Sequence: Synthetic coding sequence
atgtacaacggcagctgctgccggatcgagggcgacaccatcagccaggtgatgccaccactgctcatcgtggctttcgtgcttggtgcactgggcaacggtgtcgctctgtgcggcttttgcttccacatgaaaacatggaagccaagcaccgtataccttttcaacctcgcggtcgctgatttcctgctaatgatctgtttgcccttcaggaccgattactatttgagaaggaggcattgggccttcggcgacatcccatgtagggtggggctgttcacactcgcaatgaatcgcgcaggtagcatcgttttcctgacggtggtagctgcagatagatatttcaaggtcgtacatccgcaccatgctgtgaatacaatttcaacacgggttgccgccggtattgtgtgtacactctgggctctcgtgattctgggcaccgtctatttattactggaaaatcacctgtgcgtgcaggaaactgccgttagttgtgagtcatttattatggaatcagcaaatgggtggcacgacatcatgtttcaacttgagttttttatgccgctgggcattatcctgttctgcagttttaaaattgtctggagcttgcggaggcgccagcagcttgcccggcaggcaagaatgaagaaggccacacgctttataatggttgtggcgattgtgttcatcacctgctatctgccatctgtctccgcccggctgtacttcctgtggaccgtgcctagctccgcatgtgacccctctgtgcacggagctctccatataactctgagctttacatacatgaattcgatgttggacccactggtctactacttcagcagtcccagtttccctaagttttacaacaagctcaaaatctgtagcctgaagccaaagcagcccgggcatagtaaaactcagaggccagaagaaatgcccatatcaaatctcgggagaagatcgtgcatcagtgtggcaaactcatttcagtctcaatcagacggccagtgggaccctcacattgtcgaatggcactag

SEQ ID NO: 42751 - DNA, 1041 bp, Artificial Sequence
  Description of Artificial Sequence: Synthetic coding sequence
atgtacaacggcagctgctgccggatcgagggcgacaccatcagccaggtgatgccgcctttattgattgtggcctttgtgctgggagccctgggcaatggggtggccctctgcgggttttgttttcacatgaaaacctggaaaccttctaccgtatacttatttaacttggcagtggctgatttcctgctgatgatatgtctcccctttcgtaccgattactatctgcgcagacggcattgggcctttggagacatcccttgtcgagtgggcctgttcaccttggctatgaatagagccggttccatcgtgtttctgactgtagtggctgccgaccgctacttcaaagtggtgcacccacatcatgctgttaataccatcagcaccagggtcgcagcaggaatcgtatgcactttgtgggcactagttatattgggcactgtgtatctgctcttagagaaccacctctgtgtgcaggagaccgctgtgagttgcgaaagcttcatcatggagagtgccaacggctggcacgacatcatgtttcagctagaatttttcatgccactaggcattattcttttttgcagcttcaagattgtctggagtctcagacggagacagcagctggccaggcaggcccgcatgaaaaaggccactcgattcatcatggttgtcgcaatagtgtttatcacttgttacttgccaagcgtttcagccagactttactttctttggactgtgccttcttctgcatgcgacccctccgtccatggagctttgcacatcacactttccttcacctacatgaatagcatgctcgatcccctggtctattacttcagcagcccttcttttccaaaattttataataagctgaaaatttgttccctcaagcctaaacaaccgggtcattcgaagactcagagaccagaggagatgccgatctcaaatttaggaaggcgctcctgcatctcggtcgctaactcttttcagtcccagtccgacggtcagtgggacccccatatagtcgagtggcactag

SEQ ID NO: 42752 - DNA, 1092 bp, Artificial Sequence
  Description of Artificial Sequence: Synthetic coding sequence
atgaaccggcaccacctgcaggaccacttcctggagatcgacaagaagaattgctgcgtgtttagagatgactttatcgtgaaggtcctgccacctgtgttgggcctcgaatttatcttcggccttctgggtaatggtctcgccctgtggatcttttgtttccatctgaaaagttggaagagctccagaatttttctatttaatctggctgtggccgacttcctattgattatctgcctgccttttctcatggacaactacgttcggagatgggattggaaatttggcgatattccatgtcggctgatgctgtttatgctcgctatgaatcgccaaggtagcataatctttttaaccgtggtggcagtcgacagatatttccgagtggtgcatccccatcacgcactgaataagataagtaataggaccgccgccattatttcatgcttgctgtggggcataacaatcggtttgacagtccacctcctgaagaagaagatgcctattcagaacggaggggctaatttatgcagttcgttcagcatctgccacactttccagtggcatgaggccatgtttctgctagagttctttctgcccttgggcattatcttgttctgctctgcccgcatcatctggtcactgaggcaacggcagatggatagacatgcaaaaattaagcgggctattacctttattatggtggtagcaatcgttttcgttatctgttttttaccttcggtggttgttaggatacggatcttttggctgcttcacacgagcggtacccagaattgcgaggtgtataggagcgtggatttagcatttttcataaccctcagtttcacatatatgaatagtatgctcgacccagttgtctattatttctcaagcccaagctttcccaactttttttcgactctgatcaatcgatgcctgcagcggaagatgactggggagcccgataacaatcgcagtacctctgtggagctaacgggggatcctaacaagaccaggggggcaccggaagcccttatggcgaacagtggtgaaccctggtcaccatcctatctaggacctaccagcccctag

SEQ ID NO: 42753 - DNA, 1164 bp, Artificial Sequence
  Description of Artificial Sequence: Synthetic coding sequence
atgaaccggcaccacctgcaggaccacttcctggagatcgacaagaagaactgctgtgttttcagagatgatttcatcgtgaaggtgctgcccccggtcctgggactggaattcatctttggtctgctgggaaatggactcgctttgtggattttttgttttcaccttaaatcttggaaaagctcccgtatttttctgttcaacctggccgtggccgatttccttctaatcatttgccttccttttctgatggataactatgtgagacgctgggactggaaattcggggatatcccatgcaggctcatgttgtttatgctggctatgaatcgacaaggcagcataatatttttaacggtagtggcggtggaccggtattttcgagtagtgcatccacaccatgcccttaataagattagcaaccggacagcagccataatctcatgcctcctgtggggtatcactattgggctcactgtccacctactgaagaaaaagatgcccatacaaaacggcggagctaatctttgctcttccttctcaatttgtcatacgttccagtggcatgaagccatgtttttgctcgaatttttcctgcccttgggtatcatacttttttgtagcgcccggatcatctggtctctgcggcagcggcagatggaccggcacgccaaaatcaagagagctattaccttcattatggttgtcgctatcgtgtttgtcatctgcttcctgccctctgtggtagtccgcatccggatcttttggcttctgcacacgtcgggcacccagaactgtgaggtgtacagatcagtagatctagcgtttttcattaccctgtcttttacttatatgaattctatgctcgaccccgtggtgtactacttttcgagtccaagcttccctaattttttcagtactctaattaaccggtgtctacagcggaaaatgacaggagagcctgacaacaacagatccacgtctgttgaacttacaggtgaccctaacaagacaaggggcgcccctgaagccctgatggccaatagtggggagccctggtcccctagttacctggggcctacatcaaacaatcatgccaagaaaggccattgccatcaggaacccggttcgttagaaaagcaactgggttgctgcattgagtag

SEQ ID NO: 42754 - DNA, 954 bp, Artificial Sequence
  Description of Artificial Sequence: Synthetic coding sequence
atgtggctgtacctggccgccttcgtgggcctgtactacctgctgcattggtaccgagagaggcaagtggtgagccatctgcaggacaagtacgttttcattacaggctgcgactctggctttgggaacctgctcgcgagacaacttgatgcccggggactcagagtgctcgccgcttgcctcacggagaagggggctgaacagttgcgaggacagacctcagataggctggaaaccgttacgctggatgtcacaaagatggagagtatcgcagcagctactcagtgggttaaagagcacgtgggcgatagggggctttggggtctggttaacaacgctggaatcctgaccccaattaccctgtgtgaatggctcaacacagaggattcaatgaatatgctaaaggtcaacttgatcggagtgatacaagtaacgttgtccatgctcccactagttagacgtgcccgggggaggatcgtcaatgtgtccagcattctggggcgcgttgccttctttgtcgggggttactgcgtctctaagtacggagtggaggctttttctgatattttaaggcgagaaattcagcatttcggagttaagatcagtatcgttgagccgggttacttcagaactggcatgacaaatatgacccaatctctggagcggatgaaacaaagctggaaagaagcccctaagcatattaaagaaacatacggacaacagtattttgatgctctgtataacatcatgaaggaaggcttgttgaattgtagtactaacctgaacttggtaacagactgcatggaacacgccctcacctccgtgcatcctagaacaagatactccgcagggtgggacgccaagttcttcttcatacctttgtcttatttgccaacctctttggcagactacatcttgacaagatcatggcccaaaccagcccaagcggtttag

SEQ ID NO: 42755 - DNA, 954 bp, Artificial Sequence
  Description of Artificial Sequence: Synthetic coding sequence
atgtggctgtacctggccgccttcgtgggcctgtactacctgctgcactggtatagagaacgacaggttgtctcccatctacaagataaatacgtgttcattactggctgtgactctggcttcggaaatctattggcccgacagctggacgccaggggacttcgcgtcttggcagcttgcctcaccgagaaaggcgcggaacaactgaggggtcagacatccgaccgcctggagactgttaccctggatgtgaccaaaatggaaagcattgcggctgcaacccagtgggttaaggaacacgtcggtgacaggggcctatggggactcgtaaacaacgccggaatcctgactcctatcacactatgcgagtggctgaacaccgaggattcaatgaatatgctcaaggtgaatcttatcggtgtgatccaagtcaccttgagcatgctgcccttggttagaagggctaggggtaggatcgttaacgtgagcagtatcctgggtcgcgtagccttcttcgtgggcggatattgtgtgagcaagtacggggtggaggccttttctgacatcctgaggagggaaattcagcattttggagttaagatcagtattgtcgaacccggttatttcagaaccggtatgaccaacatgactcagtctcttgaaagaatgaagcagagctggaaggaagctcctaagcacataaaagagacctatggccagcaatactttgatgctctgtacaacatcatgaaagagggactgctgaattgttcgactaatttaaacctggtgaccgactgtatggaacatgctctaacctcggtgcaccctcgaacccgctactctgcaggctgggacgctaagttttttttcatccccctttcatacctcccaacctctctcgcagattatatccttacaaggtcttggcccaagccagctcaggcggtgtag

SEQ ID NO: 42756 - DNA, 267 bp, Artificial Sequence
  Description of Artificial Sequence: Synthetic coding sequence
atgtggctgtacctggccgccttcgtgggcctgtactacctgctgcactggtatcgagaaaggcaagtggtatctcatctgcaggacaagtatgtattcataacaggctgcgactccggttttggcaatctgttggcgaggcagctcgatgctaggggcttacgcgtgctggccgcctgcctgacagagaagggtgcagagcagctccgtggacagacaagcgatagattggaaacagtcacattggatgtgactaaaatggagtag

SEQ ID NO: 42757 - DNA, 954 bp, Artificial Sequence
  Description of Artificial Sequence: Synthetic coding sequence
atgtggctgtacctggccgccttcgtgggcctgtactacctgctgcactggtatcgtgaacgtcaagtcgtgtctcatctgcaagacaagtacgtgttcataaccggctgcgactcggggtttggtaatctcctggccaggcaacttgacgcccggggtctaagggtgctggccgcgtgtcttactgagaagggtgccgaacaactgagaggtcagacgtccgaccgcttggagactgtgaccctcgacgtgactaaaatggaatccattgctgcagctactcaatgggtcaaggagcacgtgggagatagaggcctttggggcttggtgaacaatgctggaatccttacccccattacattgtgtgagtggctcaacaccgaggatagtatgaacatgctcaaggttaacctgataggcgtgatccaagtcaccttaagcatgctgcctttagtcaggcgggccagaggtagaatcgtgaacgtttcttctatactggggagggtggcctttttcgtgggcgggtattgtgtcagtaaatacggagtcgaggctttctcagacattcttaggagagaaattcagcacttcggagtgaagatctccattgtggagcctggatattttagaactggcatgactaatatgactcagagcctggagagaatgaagcaatcctggaaagaggctccaaaacacatcaaagagacctacggtcaacaatactttgatgctctatataacatcatgaaagaagggctcctcaattgttcgacgaacctcaacttggtcaccgattgcatggagcacgctctgacttccgtgcatccacgaaccagatattctgctggttgggacgcaaaattcttcttcattcccctgagttaccttcctacaagtctagctgactacatcctaactcggtcatggccgaagccagctcaggccgtctag

SEQ ID NO: 42758 - DNA, 954 bp, Artificial Sequence
  Description of Artificial Sequence: Synthetic coding sequence
atgtggctgtacctggccgccttcgtgggcctgtactacctgctgcattggtatcgagagagacaggtcgtgtctcatctgcaggacaaatatgtctttatcacaggctgcgattccgggtttggtaatctcttagcacggcagttggatgcaagaggcttacgggttctagccgcctgcctaaccgagaagggggcagagcagcttcgaggtcagaccagcgaccgcctcgaaacggtcacacttgatgtgaccaagatggaatcaatcgctgccgctacacagtgggtaaaggagcatgtgggagaccgcggcttatgggggctcgtaaacaatgccggtattctcacccccatcaccttatgcgagtggctgaatactgaagactcgatgaatatgcttaaggtgaatctaattggggtgatccaagtcactctgtctatgttgccattggtccgccgggcaaggggacgaatcgttaatgtctccagtatcttgggtagagtcgccttctttgtcggagggtactgtgtgtccaagtatggcgtcgaggcattttcggatatcctcaggcgggaaatccagcactttggtgtgaagatttctatcgttgaacccggatatttccgaacaggcatgaccaacatgacccagagcctcgaaagaatgaaacagtcatggaaggaagctcctaagcacattaaggagacatacggtcagcagtattttgacgctctttacaatatcatgaaggagggactgcttaattgctcaaccaacctgaacctagtcaccgattgcatggaacacgcccttacgtccgtccatcccagaacccgctactcggcagggtgggatgcaaaattctttttcattcccctgtcttacctgcctacaagtcttgcagattatatactaacgcgctcgtggccaaagccagcacaggcagtttag

SEQ ID NO: 42759 - DNA, 954 bp, Artificial Sequence
  Description of Artificial Sequence: Synthetic coding sequence
atgtggctgtacctggccgccttcgtgggcctgtactacctgctgcattggtatcgagagcggcaggtggtcagtcacctccaagataagtacgtattcatcacaggctgtgatagtggatttggcaatctgctggcaaggcagttggatgctcgcggactgagggtcctggcggcctgcctgaccgaaaagggggctgagcagctccggggccagacctcagaccgtctcgagactgttacgcttgacgtcaccaaaatggagtccatagcggcggctacccaatgggtgaaggagcacgtaggggaccgagggctgtggggattggtcaacaacgccgggatcctcactcctataacactctgcgaatggcttaataccgaagactcaatgaatatgctgaaggtgaacctcatcggcgtgatccaagtgaccctgtctatgctgcccctggtccggcgggcgagaggcagaatagtgaatgttagtagcattctgggtagggttgcctttttcgtcgggggatactgtgtcagcaagtacggcgttgaggccttcagcgacatcctaagaagagaaatccagcactttggggtgaaaatttccattgtggagcccgggtacttcaggactggcatgaccaatatgacacagtcacttgagcgaatgaaacagtcctggaaggaggctcctaagcacatcaaggagacctacggtcaacagtacttcgacgctctatacaacattatgaaggaaggcctcctcaattgctccacgaatctgaatttggtcaccgattgcatggagcacgctctcacctccgtgcaccctaggactcggtactccgccgggtgggatgccaagtttttctttatcccattatcctacttgcctacaagtctcgcagattatattttgactcgctcctggcccaagcctgctcaggccgtgtag

SEQ ID NO: 42760 - DNA, 228 bp, Artificial Sequence
  Description of Artificial Sequence: Synthetic coding sequence
atgtggctgtacctggccgccttcgtgggcctgtactacctgctgcactggtatcgtgagaggcaggtcgtcagccacctgcaggataagtacgtattcatcacaggctgtgactccggtttcggcaacctgctagcccgccagctcgacgcaagagggttgcgggtactcgcagcctgcctgactgagaagggcgccgagcaacttagaggtcagacttctgactag

SEQ ID NO: 42761 - DNA, 897 bp, Artificial Sequence
  Description of Artificial Sequence: Synthetic coding sequence
atggtgacccccgccctgcagatgaagaagcccaagcagttctgccggcggatgggtcagaagaaacaacgccctgcacgcgcaggccagcctcacagctcctcagacgcagcccaggcacccgccgaacagcctcattccagctccgatgccgcacaggccccctgcccgcgggagagatgtttaggtccaccaaccactcctggcccctatcgaagcatctatttttcttctcctaaggggcatttgacgaggttgggcctggaattctttgaccaacccgctgtgcccctggcccgtgcattcctgggacaggtcctggtgaggcgcctgcccaacgggacagagcttaggggtagaatcgtggaaacagaagcttatctaggccctgaggacgaggccgctcattccagaggaggccgccagactcctcggaacagaggcatgtttatgaaaccgggcactctctatgtatacataatctacgggatgtatttctgcatgaatatcagtagtcagggggacggagcctgcgtcctcctgcgtgccctggaaccgcttgagggactggaaaccatgaggcagctacgctccacattgcggaaagggacagcttcccgcgtgttaaaagatcgcgagctttgctcaggcccatctaagctgtgccaggccttggctatcaacaaatccttcgatcagcgtgatctagctcaggacgaggccgtatggttggaaaggggaccacttgaacccagcgaaccagcagtcgtggccgccgcccgagttggagtggggcacgctggagagtgggctcggaaaccgctccggttttatgtccgtggttcgccctgggttagcgtggtcgacagggttgcagaacaagatacgcaggcttag

SEQ ID NO: 42762 - DNA, 828 bp, Artificial Sequence
  Description of Artificial Sequence: Synthetic coding sequence
atggccgccgtggacagcttctacctgctgtaccgggagatcgccaggagttgtaactgttatatggaggccctcgccctggtgggagcttggtacacggcaagaaagtccatcactgttatatgcgatttttatagtctgattcggctccattttatacctcggctcggcagccgggctgatcttatcaaacagtatggcaggtgggccgtagtgtcaggcgctacggacggaataggaaaagcatatgcggaggagctcgcttcccgaggactcaacatcatcctcatcagcagaaatgaggaaaagttacagtatttcacgcagctgtccgaagacaagctctgggatatcattaatgtaaacatcgccgccgcctctttgatggtccatgttgtcctaccgggaatggtagagagaaaaaagggcgccatagtgacaatctcatctggaagctgttgcaagcccacccctcagctggctgcattctcagctagtaaggcctacctcgaccacttcagccgagcacttcaatatgaatacgcttcaaaaggtatcttcgtgcagagcctgatcccgttttacgtcgccacctctatgaccgccccatctaacttcctgcaccgctgcagctggcttgtcccttcccccaaagtgtatgcacaccacgcagtgtctacgctcggcatatccaaaaggaccaccggctattggtcccatagcatccaatttttattcgcccagtatatgccagagtggttgtgggtctggggagcgaacatcctaaacaggtccttgcggaaagaagcactctcttgcacagcctag

SEQ ID NO: 42763 - DNA, 2673 bp, Artificial Sequence
  Description of Artificial Sequence: Synthetic coding sequence
atggagggcggcggcaagcccaacagcagcagcaacagccgggacgatggaaattctgtgtttccagctaaagccagtgccaccggcgctgggcctgctgccgccgaaaaacgactgggcacaccaccgggaggcggcggagctggagctaaagaacatggaaattccgtttgctttaaggtcgacggcggcggaggcggaggcgggggaggagggggtggtgaggaacctgctggcggtttcgaagacgccgagggtcctagaaggcagtatgggtttatgcagcgccagtttaccagcatgctgcagcctggggtgaacaaattcagtctgaggatgtttgggtcacagaaggccgtcgaaaaagagcaggagagagtgaaaacagcaggcttctggattattcacccatattcggacttcagattctactgggacttgattatgttgattatgatggtgggcaacctggttatcatccccgtggggataacgttttttactgaacagaccacaaccccctggatcatctttaacgtggcatcagacaccgtcttcttgctggatctaattatgaattttagaacaggtacagtgaacgaggactcatcagaaatcatcctcgaccctaaagtgattaagatgaactatctgaaatcttggttcgtggtggattttattagcagcattcccgtagattacattttcctcattgttgagaaaggtatggatagcgaagtgtataagactgcaagagccctgcggatagttagatttacaaaaattctgtccctgctgcggctgttgaggttgtctcgactgatccgttatattcaccagtgggaggagatcttccacatgacgtacgacctcgcaagcgctgtggtccgcatcttcaatttgatcgggatgatgctcctgctatgccactgggacggctgtctgcagttcttggtgcctctcttgcaggatttcccccccgattgttgggtgagcctgaatgaaatggtgaacgattcttggggcaagcagtactcctacgctttgtttaaagctatgtcgcacatgctctgtatcggttacggggcccaagccccagtgtccatgtcggatctttggataacaatgttgtccatgattgtaggcgccacatgctacgccatgttcgtagggcatgctacggccctgatccaaagtctggattcgtcacgacgccaataccaagaaaagtacaaacaagttgaacagtatatgtcattccataagcttccggcagacatgaggcaaaagatccatgactattacgagcacaggtatcagggcaagatattcgacgaggagaacatcctcaacgagctgaacgatcccttgcgagaggaaatcgtgaactttaactgtcgaaaactcgttgccaccatgccactctttgccaatgcagatcctaactttgtgaccgctatgttgtctaagctcagattcgaggtgtttcagcccggcgattatatcattcgggagggggccgtggggaagaaaatgtattttatacagcacggagttgccggggtgattactaaatccagtaaggaaatgaagcttactgacggcagctactttggcgaaatctgcctgctcacgaagggtcgtcggactgcttccgtccgcgcagacacgtattgtagattatacagcctgtctgtggataactttaacgaggtgctggaagagtatcctatgatgagacgcgctttcgagacagtggccatcgaccggctggatcggataggcaaaaaaaacagcattttgcttcagaagtttcagaaggaccttaatactggtgtgttcaacaaccaggagaatgagatactaaagcaaatagtgaaacacgacagagagatggtgcaagcaatcgcccctatcaactatcctcagatgacgacgctgaacagcacatcctcaacgaccactccgacaagtaggatgcgaacccaatcaccccctgtgtatactgccacctctttaagtcattccaatttacacagcccatccccctccacgcagacaccccaaccctccgcgattctttctccatgcagttacactaccgctgtatgttcaccaccagtgcagagcccacttgccgcccgcaccttccactacgcctcccctacagcatcccagttgtctctcatgcagcaacagccccagcagcaggtccagcaatcacagcctccccagacgcagccccagcagccttccccgcagccccaaaccccaggcagctccacgcctaaaaacgaagtgcacaaatccactcaagcactccataacactaaccttacacgcgaagtgagacccctatccgcatcacagcccagcctcccacatgaggtgtctactctcatatcgcgtccccacccaactgtgggcgaaagtctggcctctattcctcagccagtgacagcagttccaggaacaggattgcaggcgggcggcaggtcgaccgtgccccaacgggtcaccctctttagacagatgtctagtggggctatcccacccaaccgcggggtgccccccgcccctccaccaccggccgccgccctcccccgcgaatccagcagtgttttgaatactgaccccgacgcggagaagccacgtttcgcctctaacctatag

SEQ ID NO: 42764 - DNA, 1170 bp, Artificial Sequence
  Description of Artificial Sequence: Synthetic coding sequence
atggagcccagcgccacccccggcgcccagatgggcgtgccccccggctcacgggagccatccccggtcccaccggactatgaagacgagttcctgcgctatttgtggcgagattatctctaccccaagcagtacgaatgggtgctcattgctgcctatgtcgctgtgtttgtcgtcgcattggtgggcaacactttagtctgcctggcagtctggcgcaaccaccatatgcgcactgtgaccaattactttattgtgaacctgagcctggctgacgtcttggttactgcaatctgtctccccgcaagcctcctagtggatatcacggaatcatggctgttcggtcacgctctgtgtaaagtgatcccatatttacaagcggtttccgtgtccgtggcggtgctgacactaagcttcatcgctctggaccgttggtacgccatttgccacccactgctgttcaaatccacagcaaggagggccagagggagcattctcggcatttgggcggtgtctctagctattatggtccctcaagcagccgttatggagtgtagttctgtgctcccagagttagccaaccgcacccgcctgttttccgtgtgcgatgagaggtgggctgatgacttgtatcccaagatttaccacagctgctttttcatagttacctacctcgcgcccctcggacttatggctatggcgtatttccagattttcagaaagctgtgggggagacagatacctggcaccacctctgctctcgtgaggaattggaaaagaccctctgaccaattgggcgacctagaacaggggctttccggggagccacaaccccgtgccagagccttcctcgctgaggtgaaacaaatgcgtgcacgaagaaagactgccaaaatgctgatggttgtactcttggtgttcgccctctgttacctgccgatcagcgtacttaatgtgctgaagagggtgttcgggatgttccgccaagccagtgatagggaagccgtgtatgcctgtttcactttcagtcactggctggtctatgctaactcagccgccaatcccatcatttataatttcctatcagggtgcaaagagaagagtctggcactgtcctgtccctcctgtcccgggcatgatccacatctggcagctgccctttgcagctag

SEQ ID NO: 42765 - DNA, 1278 bp, Artificial Sequence
  Description of Artificial Sequence: Synthetic coding sequence
atggagcccagcgccacccccggcgcccagatgggcgtgccccccgggtctcgggaaccctcccccgtgccgccagattatgaggatgagttcttgaggtatttgtggcgagattacctgtatcctaagcagtacgaatgggtgctcatcgccgcatatgttgccgttttcgtagttgccctcgtggggaataccctagtctgcttggccgtctggagaaatcaccacatgcggactgtgacgaattatttcatcgtgaacctgtctctggcagatgtgctagtcaccgctatctgtctcccggcttccctgcttgtggatatcaccgagagctggttattcggtcacgccctatgcaaggtcatcccctaccttcaggctgtatccgtcagcgttgccgtcttgactttgagtttcatcgctctagaccgctggtatgcaatctgccaccccttgctgttcaagagtaccgcccgccgcgctcgcggcagcattttgggtatttgggctgtgagcctggcaatcatggtgccacaggcggctgttatggagtgcagctcagttcttcctgaactcgccaatagaacacgcttattttcagtgtgtgacgaacgttgggccgatgatctgtatccaaagatatatcatagctgctttttcattgttacttacttggcgcctttaggcctgatggccatggcttattttcagattttcagaaaactgtgggggaggcagatcccaggcactacaagcgccctcgtacggaattggaagcggcccagcgatcaattgggggacctggaacagggactctctggcgagccacaaccgagggcccgcgcctttctggccgaggtgaagcagatgcgcgctcgtaggaaaacggccaaaatgctgatggtggttctcctggtctttgctctgtgttacctgcctatcagtgttctgaacgtcctcaaacgggtcttcggaatgttccgacaggcatcagaccgtgaggcggtatatgcatgcttcacgttttcacattggctggtatacgcaaatagtgccgctaatcctatcatctataacttcctttctggcaaattccgcgagcagtttaaggctgcctttagttgctgcctgcccggccttgggccctgtgggtccctcaaggccccgagccctagaagtagcgcctcccataagtcgttatcacttcagagccggtgttctatttccaagataagcgagcacgtcgtgcttacctccgtgacgaccgttcttccatag

SEQ ID NO: 42766 - DNA, 1278 bp, Artificial Sequence
  Description of Artificial Sequence: Synthetic coding sequence
atggagcccagcgccacccccggcgcccagatgggcgtgccccccggaagcagagagccatctccggtaccacctgattacgaagacgagtttctgagatacctttggagggattatttgtatcctaagcagtatgagtgggtattgattgctgcctacgtggcagtttttgtagtggcactggtgggaaacacactggtttgtctcgctgtgtggcgcaatcaccacatgcgaactgttacaaactactttattgtcaatctgagtctcgctgacgtgctcgtcaccgccatctgcctgcccgctagtctgctcgtagacatcactgaaagctggctctttggtcatgcactctgtaaggtcatcccttacttacaggctgtctctgtaagtgtcgcagtcttgacactctccttcatcgctctggaccgctggtacgcaatctgtcatccacttctcttcaagagcaccgccaggcgcgccagaggcagtatcctggggatttgggcggtgagcctggccatcatggtcccacaagctgctgtcatggagtgcagcagcgtgctgccagagcttgctaaccggacacgattatttagcgtgtgtgacgaaagatgggccgacgatctgtatcctaaaatttaccattcttgctttttcatagtcacctacttagcaccccttgggctaatggccatggcctatttccagattttccggaaactgtggggacggcagatcccgggtacgaccagtgctcttgttcggaactggaaacggccctcagatcaactgggcgatttagaacagggcctttctggtgagccccaaccgcgagccagggcatttttagccgaggtgaagcaaatgcgggctcggagaaagacggctaaaatgctgatggtggtactcctggtgtttgccctgtgctaccttcctattagcgtgctcaatgttctgaagagggtcttcgggatgttccgccaagcaagcgacagggaagcagtgtatgcctgtttcactttcagccactggctcgtctatgcgaactcagcagccaacccgattatatacaacttcctaagcggtaaattccgcgaacagttcaaggccgcgttctcctgttgcctcccaggccttggcccatgcggctcccttaaggcaccatctcctagaagctccgcttctcacaagtccctctctctgcagagtcggtgcagcatctcaaagatctccgaacacgttgtcttaacatctgtaaccaccgtgttgccctag

SEQ ID NO: 42767 - DNA, 1335 bp, Artificial Sequence
  Description of Artificial Sequence: Synthetic coding sequence
atgagcggcaccaagctggaggacagccccccctgccggaactggtctagtgctagcgaacttaacgaaacgcaggagccatttttaaaccctaccgattacgatgacgaggagtttctcaggtacctgtggagagagtacttacaccctaaggagtatgaatgggtgctcatcgccggttacatcatcgtgtttgttgtagcattgatcgggaatgtccttgtttgcgtggcagtgtggaagaatcaccacatgcgcaccgtgacaaattatttcatcgtgaatctcagccttgcggacgttcttgtcacgataacctgcctgcctgccactctagtcgtcgatattacggagacctggttcttcgggcagtctctctgtaaagtgattccttacctccagacagtgagtgtttccgtgtctgtgctgactctgtcctgtattgctctggatcgatggtacgcaatctgccatcctctgatgtttaagtcaacagccaagagggcccgaaattctatcgtaataatctggattgtaagctgtatcatcatgatcccacaggccattgtcatggaatgtagcaccgtattccccggattagccaataagactaccctgtttactgtttgtgacgaacggtggggaggggagatctatccaaaaatgtaccatatctgtttttttcttgtgacttatatggcacctttgtgcttgatggtccttgcttatctgcagattttccgcaaactttggtgccggcaaatcccaggcacgtcatctgtcgtacaacgcaagtggaaaccactgcaacctgtgtcacaaccccgtggtcccggccaacctacaaagagcagaatgagcgcagtggcggctgagataaaacagatcagggctcgcaggaagaccgctcgcatgctgatgatcgttttgctcgtattcgctatatgctatctgccgatcagcattctcaacgtcctcaaacgcgtgttcggaatgttcgctcataccgaggatcgcgaaacagtttacgcctggttcacctttagtcattggctggtgtacgcgaatagcgctgcaaatcctattatttataactttctctccggcaagtttcgggaggagtttaaggctgctttctcttgctgttgtctgggtgtgcatcataggcaggaagatagactgaccaggggccgaaccagtacagaaagccgaaagagcttaactacgcaaatttctaacttcgacaatatatctaagctgagcgagcaagtagttctgacctccattagtacgttgcccgcagctaatggagcagggcccctgcagaactggtag

SEQ ID NO: 42768 - DNA, 1134 bp, Artificial Sequence
  Description of Artificial Sequence: Synthetic coding sequence
atgagcgaggtgaagagccggaagaagagcggccccaagggcgcccccgccgcagaacctggtaagagatccgagggtgggaagacacccgtggcacgaagttccggtggcggtggatgggcagatccaaggacttgcctatccctactgtcactcggaacttgcctgggtctcgcatggttcgttttccagcagtcagagaaattcgcaaaggtcgagaaccagtaccagcttctcaaattggaaacaaacgaattccagcagcttcaaagcaaaattagtctcattagcgaaaaactcgaatcaactgagtccattctacaggaggctacatctagtatgagtctgatgacccagttcgagcaggaagtgtcaaatcttcaggacatcatgcatgatatccaaaataatgaggaggtcctgacccaacgtatgcagtcgctgaacgaaaaatttcagaacatcaccgacttttggaagcgatctctcgaggaaatgaacataaacacagatatcttcaagtccgaagcgaaacacattcactcacaggtgaccgttcaaatcaacagcgcagaacaggagatcaaactgctgactgagcggcttaaagacctggaagattctaccctgcggaacatcagaaccgttaaacgccaggaagaagaggacttgctgagggtggaggaacaactcgggtccgacacgaaggccatcgagaaacttgaggaagagcaacacgctctgttcgcgcgtgacgaagacttaactaataagttgagcgactacgaaccaaaagtggaggaatgtaaaacacacctccctaccatcgagtctgccattcatagtgtgctgagggtgtcccaagatctcatcgagacagagaaaaagatggaggacctcacgatgcagatgtttaacatggaagatgatatgctgaaggctgtgtccgaaatcatggagatgcagaagaccctcgaagggatccagtacgataattcgatcctgaaaatgcagaacgaattagacatcctgaaagagaaagtccatgactttatcgcatactcctctaccggcgaaaaaggcacgctgaaggagtataatattgaaaacaagggcatcggaggagatttttag

SEQ ID NO: 42769 - DNA, 1053 bp, Artificial Sequence
  Description of Artificial Sequence: Synthetic coding sequence
atgagcgaggtgaagagccggaagaagagcggccccaagggcgccccggccgctgagcctggcaagcgcagcgagggtggcaagacccctgtcgcaagaagctccgggggtggtgggtgggcagatcccaggacatgtttgtcactcttaagtctgggcacctgcctggggctggcctggttcgttttccagcagagtgaaaaattcgccaaagttgagaaccaatatcagttgctgaaacttgagactaacgaattccagcaactgcagagcaagatcagcttaataagtgaaaagtggcagaagtcagaggctatcatggagcagctgaaatcgtttcagattatcgcccacctgaaaagactccaggaggaaattaacgaagtcaagacctggtctaaccgaataactgaaaagcaggacatcttgaacaatagcctgacaaccctgtcgcaagacattacaaaggtggaccagtcgacaacctccatggctaaggatgtcgggctcaaaatcacctcggtcaagaccgacattagaaggattagtggcctggtgacagacgtcatctccctgaccgactctgtgcaagaactggagaataagatcgagaaagttgagaagaatactgtcaaaaatatcggcgatctgctctcctccagcatcgacagaaccgccaccttaagaaagaccgccagcgagaactctcagcgtattaacagcgtcaagaagaccctcaccgagctaaagtccgactttgataagcacaccgatagattcttgtccctggagggagaccgcgcaaaggtgctcaagaccgtaacttttgctaacgatttaaagccaaaagtttataacctgaagaaagacttctcccggctcgaacctcttgtgaatgacctgactctcagaattggaaggcttgtcaccgatttgctgcagagagagaaggaaatcgcctttttaagtgaaaagatctcaaatctgacgatcgttcaggctgagataaaggatatcaaggatgaaattgcacatatcagtgatatgaactag

SEQ ID NO: 42770 - DNA, 213 bp, Artificial Sequence
  Description of Artificial Sequence: Synthetic coding sequence
atgagcgaggtgaagagccggaagaagagcggccccaagggcgccccagctgccgagcctggtaagcggtccgaggggggaaagacaccagtggctaggtcaagtgggggagggggctgggccgacccgcggacatgtctgtcactactcagcctgggtacctgcttgggcttagcctgcggccgcaacctcaagctgtcctggaacaattag

SEQ ID NO: 42771 - DNA, 735 bp, Artificial Sequence
  Description of Artificial Sequence: Synthetic coding sequence
atggagcagctgaagagcttccagatcatcgcccacctgaagcggctccaggaggagatcaatgaggtgaagacgtggtcgaatagaattactgagaagcaggacatcctcaataattcactgactaccctcagtcaagatataacaaaagtcgaccagagcacaacaagcatggcaaaggatgtgggcttgaaaattactagcgttaaaactgatatcagacgcatcagtggcctggtgaccgatgttatctctctgactgattctgtgcaagagttggagaataaaatagagaaggtggagaagaataccgtcaagaacattggggatttactgagtagcagcatcgaccggactgcgacattacggaaaaccgcgagtgaaaactctcagaggatcaactctgtcaaaaagacactcactgaactcaaaagcgactttgataagcatacagacaggtttttgtcacttgagggcgacagggctaaggtcttaaagactgtgacatttgccaacgatctaaagcctaaggtctataatctgaaaaaggacttcagccgccttgaacccctggtgaatgatttgaccctgcgcatcggcaggctcgtgaccgatctcctccaaagggagaaggagatagcgttcctgtccgaaaaaattagcaatctgaccattgtacaggcagaaattaaggatatcaaggacgagatcgcccacatctcagacatgaactag

SEQ ID NO: 42772 - DNA, 2445 bp, Artificial Sequence
  Description of Artificial Sequence: Synthetic coding sequence
atggccgtgcagcgggccgccagcccccggcggccccccgcccccctgtggccccgcctgctgttgcccttgttacttctactgctccctgcccctagcgaagggctgggtcatagcgccgaacttgcgtttgccgtggaacctagcgacgatgtggccgtgcctggccagccaatcgtgcttgattgtagagtagagggcacaccaccagtcagaataacttggcgcaaaaacggcgtggaactgccggaatctactcattcaacattgttagccaacggatcactgatgattagacactttcgcttagagcctggcggaagtcctagcgatgaaggcgactatgagtgtgttgctcagaaccgatttggcctggtggttagtaggaaagctaggatccaggcagctacaatgagtgacttccatgttcatcctcaggcaaccgtaggtgaagagggaggggtggcacgcttccagtgtcaaattcatggcctgccaaagccactaattacatgggagaaaaaccgcgtgccgatcgacacggataacgagcgctataccctgctgcccaagggggtgctgcagattacaggattaagggccgaggatgggggaatattccactgcgtagcctccaacattgcttctattcgcatctcccatggggccaggctaacggtgtccggatctggttcaggcgcgtacaaggagcctgccattttggtcggccctgagaacctaacacttaccgtgcatcaaacagccgtactcgaatgtgtggccacaggcaatcccaggcctattgtgagctggtcaagactggacggcaggcctatcggggtggagggtattcaagtgctcggtaccggcaacctcattatctctgacgtaacagtgcagcacagcggggtgtatgtgtgtgcagcaaatcggccaggaacccgtgtgcgaaggacggcacaggggagactcgttgtacaggccccggcggagttcgtgcaacacccacaaagcatttcccgtcctgccggcaccacagcgatgttcacatgtcaggcacagggagagcctccaccacatgtgacatggctgaagaacggccaggtcttaggtccaggaggtcatgtcaggctgaaaaacaacaactccaccttgaccatctccgggattggcccagaggatgaagccatttaccagtgtgtggcagaaaatagtgcagggagcagccaagcaagcgctaggctaacagtactgtgggctgagggattacccggccctccccgaaatgttagagcagtgagtgtgtccagcactgaagttcgcgtgtcctggtccgagcccttagctaacactaaggagatcattgggtatgtcttgcacattaggaaagcagccgacccccccgaactggagtatcaggaagctgtcagcaaaagcactttccaacacctggtgtccgacctggagccatctacggcgtactcattctacattaaggcctatacccctagaggcgcgtcctctgcctcggtaccaactcttgcctcgacccttggcgaggctcccgctccacccccactgtctgtgcgtgtgttaggctcgtcatctttgcagctgctgtgggaaccatggccacgcctggcacagcatgaaggtggctttaagctgttctacagacctgctagtaagacatcgtttacagggcccatactgttaccggggaccgtttctagctataacttaagtcagctggacccgactgctgtgtacgaggtgaagctgctcgcctataatcagcacggtgatggcaacgcgaccgtgcgttttgtatcacttaggggggcctcagaaaggaccgctctctctcctccctgcgactgtcgcaaagaagaggccgctaaccagacgtcgaccaccgggattgttatcgggatacacataggagtcacatgtatcatcttttgtgtgctgtttctgcttttcggccagaggggccgcgtgctgctctgtaaagatgtcgagaatcaactgtcaccaccacaggggcctaggtcgcagcgtgacccgggaatccttgctctgaacggcgcacggcgtggacagagggggcagctgggcagagatgagaagcgagtagatatgaaggaactggaacagctgttcccacctgccagcgcagccggacagccggatccccgacctacccaggaccccgccgccccagccccatgtgaagagacccagctgagtgttctacccctccaggggtgcggtctcatggagggaaaaactaccgaggcgaagactacagaggcgacagcgccatgtgctggtcttgctgctgcgcctcccccaccggatggcggtccaggtctacttagcgagggacaggccagtagacccgctgctgcccgcgtgacccagccagcacatagtgagcaatag

SEQ ID NO: 42773 - DNA, 1914 bp, Artificial Sequence
  Description of Artificial Sequence: Synthetic coding sequence
atgagcgacttccacgtgcacccccaggccaccgtgggcgaggaggggggagtcgcccgctttcaatgccagattcacggtctgcctaaacccctgattacgtgggagaaaaatagagtacccatcgacaccgataatgagaggtataccttactacccaagggcgttctccagataacaggactgcgcgccgaagacggggggattttccattgtgttgcatccaacatcgcctcaattcgcatctcacatggagccagattgactgtgagcgggagcgggtctggagcttataaggagcctgccatcctggtgggccctgagaatcttacactaactgtacaccagacggctgtgctcgaatgtgtggccactgggaatcctcgccctattgtcagttggtctagactagatgggcgccctataggcgtggagggcatccaggtcctggggaccggtaacttaatcatctctgatgtcactgtacagcacagtggcgtttatgtgtgcgccgcaaatcggcccgggacgcgagtgagaagaacggcccagggtcggctcgtggtgcaggccccagctgagttcgtccagcatccccagtctatctcaagaccagctggcaccactgctatgtttacctgccaagctcagggggagcctcctccccacgtaacctggctgaaaaacggccaggtgttgggacctggaggtcacgttcgccttaaaaacaataacagtactctcacaatctccggcattggccccgaggacgaggcaatctatcaatgtgttgcggagaattctgccggcagttctcaggcctcagcccgactcactgtgctctgggctgagggcctgccagggcctcctcgtaacgtgcgcgcggtctcagtgtcaagtaccgaggtccgggtgtcctggtccgaacctcttgcaaacaccaaagagatcatcggatacgtccttcatatacggaaggccgccgaccctcctgaactggagtaccaggaggcggtgtctaagtctacattccagcacctagtatcggatcttgagcctagtacagcgtacagcttctacatcaaggcctacactcctcgcggggcatcctcagcatccgtccccacactagcgagtaccctgggcgaggcacctgccccaccacctctctcagttcgcgttctgggatcttcttctctgcaacttctgtgggagccgtggccacggctggcacagcacgagggcggttttaagttattctatcgcccagctagcaagacctcattcactgggccaattctgcttcctggaacggtgagcagttacaatttgagccagcttgaccctactgctgtttatgaagtgaagctgttagcctataatcaacatggtgacggcaacgctactgtgcgttttgtgtccctccgcggcgcaagtgagagaacagcactctcccccccgtgcgactgcaggaaagaggaggccgctaaccagacctcaacgacaggcatcgtgattggcatccacataggggtgacttgtatcatattctgtgttctcttcctgttatttggacagcgggggagggttctcctgtgtaaggatgtggacatgaaagaactcgagcagctcttccctcctgctagtgcagcaggtcagcccgacccccgcccaactgacccagccgccccagccccctgcgaagagactcagctgagcgtgctacctcttcagggctgcggactcatggaaggaaagacgactgaggctaagacaactgaagctacagcaccctgcgctgggcttgccgcagccccaccccctccggatggggggccgggcttgctgagtgaaggacaagcaagtagacccgccgctgccagggttacacagccagctcactcggagcaatag

SEQ ID NO: 42774 - DNA, 3753 bp, Artificial Sequence
  Description of Artificial Sequence: Synthetic coding sequence
atggcccggggcgacgccggccggggccggggcctgctggccctgactttctgtctcttggctgcccgcggagaattactgctgccacaagagactacagtcgaactgagctgtggagttgggccactgcaagtgattctggggcccgagcaggcggcggtgttgaactgcagtctcggcgccgctgcggccggtccaccgacccgcgtgacttggagcaaagacggtgacaccttactggagcacgaccacttacatttactgccaaatggtagcctgtggttaagccagccactcgcccccaatggatccgacgaaagcgtgccagaagctgttggcgtaattgagggaaactactcgtgcctcgcacacggtcccttaggcgttctggctagccagaccgcagtcgttaagctcgctaccctcgccgacttctctctgcatcctgagagccagacagtggaggagaacggaacagcgcgcttcgagtgccacatcgagggtttacccgctcctattataacttgggaaaaagatcaagtgactttgccagaagagccgcgactgatagtgttgcctaacggcgtgctccagatcctggacgttcaggagtctgatgctgggccttacaggtgcgttgccactaattctgctcgccagcacttcagccaagaagctttgctgagtgttgcacacagagggtcgcttgcctccacaagggggcaggacgtcgtgatcgttgcggcccctgagaatactacggtggtcagcggccagagtgtggtaatggaatgtgtggcctctgctgaccccactccttttgtcagctgggtccgtcaggatgggaaaccgatctctacagacgtcattgtcctcggtcgaacaaacctgttaatcgcaaacgcacagccttggcattctggggtgtacgtgtgccgggcaaacaaacctcgaactcgggatttcgcgacagccgctgctgaattgcgagtcctggcagcacccgccattacacaggcgccggaggccctttctagaacacgagccagcaccgccaggtttgtgtgtagggcatccggggagccccgccccgccttacgctggctccacaatggcgcaccactgcgtccaaatggtcgagtgaaagtacaggggggcggagggagcctggtgatcacacagattggactgcaagatgcgggatactaccagtgcgtcgctgaaaactccgcaggaatggcatgtgctgcagctagtcttgcagtggtggtcagggagggcctgccaagtgctcctactcgagtcactgcaacacccttaagcagcagcgctgttctggtggcttgggagcgcccggagatgcacagcgagcagatcatcggattctccttgcattatcagaaggctcgaggtatggataacgttgaataccagttcgcagtcaataacgatacaactgaattacaagtccgggacttggaaccaaacacagattatgaattctatgtcgtcgcttactcacagttaggggccagtaggacttccacacctgcattggtgcacacactggacgatgtaccaagcgccgcacctcagttgtctcttagtagcccgaatccctctgatatacgggttgcctggctaccactaccaccaagtctatcaaatgggcaggtcgtaaagtataagattgaatatggcttggggaaagaggaccagattttctccactgaggtgaggggcaacgagacccagctgatgctcaactccttgcagcccaataaggtgtacagagtgcggatatccgctggaacggctgcggggtttggggccccttctcagtggatgcaccacagaactccgtccatgcacaaccagagccatgttccatttgctcctgcggaactgaaggtgcaggcaaagatggaaagcctggtagtttcctggcagccacctccgcatccgactcagataagcggctacaaattgtactggcgagaggtgggcgccgaggaagaggctaacggagatagactgccgggcggccgtggcgatcaggcgtgggacgttgggcccgtaagattgaagaagaaggtgaaacaatatgaactcacacagctggttcccggccgcctgtacgaggtgaaactggtggccttcaacaaacatgaagacggatacgccgccgtttggaaaggcaaaacagagaaggcaccggcacccgatatgcccatccaacgtgggcccccactgcccccggctcatgtccatgctgagtccaattcctccacatcaatttggcttagatggaagaagccagacttcactactgtgaagatcgtgaactatactgtgcgcttctcaccttggggcctgcggaatgcttccctcgtgacatactacacttcttccggtgaggatatcctcattgggggcctgaagccgttcaccaagtatgagtttgcagtacagagccacggagtcgacatggatggaccctttggctctgtcgtagagcgctctacgttacccgaccgtccttcaacccccccctccgatttacgtctgtcccctctgacaccctccacggttaggctgcactggtgtcctcctactgaaccaaacggtgaaatcgtcgagtacctgattctgtactcgagcaatcacacccagccagaacaccagtggacactgctcacaacccagggtaatatcttttctgccgaggtgcatgggttggagagcgacacacgctacttttttaagatgggcgctcggaccgaagttggccctggtcctttttcaagactccaggacgttataaccctgcaggaaaagctgagtgactccttagacatgcattctgtgacgggtattatagtgggagtgtgtctaggactgctatgcttgcttgcgtgcatgtgcgcagggctcagacggtcacctcatagagagagtttgcctgggctatcttccacagccacaccagggaaccctgcactgtactcaagagcaaggttgggacctccttctccaccagccgcccacgagctcgagagtttagtgcatccccatcctcaagactggagcccacctccgtcggacgtggaggatcgagccgaggtccacagtttgatgggtggaggggtgagtgagggtagaagtcattccaaacgaaagatcagctgggcccagccaagtggcctgagctgggctggcagctgggccggctgcgagctgcctcaggctggtcctcgaccagctttaactcgagcgctactaccccccgcgggcacaggccaaacgctcctcctccaggcccttgtctatgacgccatcaaaggcaatggcagaaagaagtcacccccagcctgccgcaaccaggtggaagctgaggttatcgtgcactccgacttctctgcaagcaacggcaacccggacctccatcttcaggacctggaaccagaagacccactcccccctgaagcccctgatttgatttctggggtgggtgacccagggcaaggtgccgcctggttagacagagagctgggcggctgtgagctggcagccccgggtcctgacagacttacttgcctgcccgaggcagcaagtgccagttgctcctaccccgatctccaaccgggggaagttttggaagaaacaccgggggattcttgccagctgaagtccccttgccccctgggggcctccccgggtctccctcgcagcccagttagcagcagtgcctag

SEQ ID NO: 42775 - DNA, 2940 bp, Artificial Sequence
  Description of Artificial Sequence: Synthetic coding sequence
atgggccggcggaagggccggagcgccctgagccggagcagcctggaaagagtgaaccagggagaggtgaaggtcatcggccggggagctagagagggcggaggcgggcaggcttggggcactgggggcgggcgcgacctgtcttgcggcatcccacggagcgctagcccccttgcacctttagcagcccccgccataacacaagcacctgaggctctgagtcggactagagcctcaacagcaagatttgtgtgccgggctagcggtgagccgcgccctgccctccgttggctccataacggagctcccttgagacctaatggacgcgtcaaggtgcagggcggggggggaagcctggtgattactcaaatcgggctccaggatgcaggttattatcagtgcgtggccgagaactcggcaggcatggcctgcgccgccgccagtctggccgtcgtggttagggaaggcctgccatcggcccctactagagtcaccgctaccccattgagctcaagtgctgttctcgtggcatgggaaagacctgaaatgcatagcgagcagataatcggcttctcactgcattaccagaaggctagaggaatggacaatgtggaataccagttcgcagtgaataatgatactacggaactgcaggtgagagacctggagccgaataccgactatgaattttacgtggttgcttattcccaactgggagcctctcggacaagtacaccagccctcgtacatacactggatgatgtgccttcagccgctccccagttgtcactgtcctcgcccaacccctccgatattcgcgttgcttggttgccactgcccccaagcttgtccaatgggcaggtggttaagtacaaaatcgaatatgggcttggtaaggaggaccagatctttagcaccgaagtgcggggcaatgagacccagctcatgctgaatagcttgcagcccaataaggtatatagggtgagaatatctgcgggcacagccgccgggtttggagccccgagccagtggatgcaccataggactccctcaatgcataatcagtcccatgttccttttgctcctgctgagctgaaggttcaggccaagatggaaagtctcgtggtttcttggcagcccccaccgcatcccacccagattagcggatataaactctattggcgtgaggttggcgctgaggaagaggctaacggtgaccgcttacccggcgggcgaggcgatcaggcttgggacgtgggcccagtgagactgaaaaaaaaagtgaagcagtatgagctgacccagcttgtaccagggcggctttacgaggtaaaactggtagcctttaacaagcatgaagatggctacgccgcggtgtggaagggaaagactgagaaggcgcctgctccggacatgccaattcaacgcggccccccactaccacctgcacatgtccacgccgagagtaactcaagcaccagcatctggttacggtggaaaaaaccagatttcaccacggttaaaattgtcaattacaccgttcgattcagcccctgggggctccgcaatgcctccctagtcacttattacaccagttccggtgaggacatacttatcggcggtttgaagccctttacgaaatatgaatttgcggtgcagtcccatggggtggatatggacggccctttcggctctgtagtagagaggtctaccctgcctgacaggccgtcaacacctccatcagatcttcgcttgagccctctgacaccgtcaacagtcaggctacattggtgcccccctacagagcccaacggcgagattgtagaatatctcatcctgtacagtagtaaccacacacaacccgagcatcagtggacccttctcactacccagggcaatatcttctctgccgaggtgcacgggctggaaagcgatactcgatatttttttaagatgggggctcgcaccgaagtggggcctggccccttctcccggctccaggatgtaattacactccaggagaaactgtcagatagcctcgacatgcattcggtaaccggcatcatagtcggggtctgcctcggtctgctgtgtctcttagcctgcatgtgcgccgggctacgcaggtcacctcaccgagagagtctgccagggctgtcatccaccgccacaccgggaaaccctgcgctttatagcagggctcgcctagggcccccctctcctccagctgcccatgaactggagtctctggtgcaccctcacccacaggactggtccccgccaccatcagatgtcgaagaccgggctgaagttcacagcctgatgggcggaggggtttccgagggaaggagccactccaaacggaaaatctcttgggcccagccaagtggattatcctgggccggatcatgggccggatgcgaactgcctcaggctggacccagacccgccttgacgcgtgctctcttgcccccagccggtactggccagactctgctgctgcaggctttagtctacgacgccataaagggcaacggccggaagaagagcccacccgcttgtcggaaccaggtggaagcagaggtgatcgttcactccgactttagcgcctccaacggcaaccctgatctacatcttcaagacctcgagcctgaggatcccctgccacccgaggctccagacctgattagtggagtgggagaccctggccagggagcagcgtggctggatcgtgagctgggaggatgtgaactcgccgcccctggtcccgaccggctgacctgtcttccagaggcagcaagcgcttcatgcagctaccccgacctccaacctggagaggtcctggaggagacgcctggtgactcttgtcagctgaaaagtccttgtcccctgggggctagccccggtctacccagatcacccgtgagtagttcggcttag

SEQ ID NO: 42776 - DNA, 1293 bp, Artificial Sequence
  Description of Artificial Sequence: Synthetic coding sequence
atgagcctggtggagctgctgctgtggtggaactgcttcagccggaccggcgtggccgcctcgctggaggtctctgagtctcctggctcaatccaggtggcaaggggccagcctgccgtcctcccctgtaccttcaccacatctgccgctctgatcaaccttaatgtgatttggatggtaacgcccttgtcgaatgctaaccagccagagcaagtgatcctgtaccagggcgggcaaatgttcgatggcgcacctcgttttcatggccgcgtcggcttcaccgggacaatgccagccacaaacgtatcgatttttattaacaacacccagctgtccgacactggaacctaccaatgcctggtgaacaatcttcctgatattggcggcagaaatatcggtgtcaccggtctaacagtgcttgtgccgccatcagccccacattgccagatacagggaagtcaagatatcggctccgacgtgattctgctctgtagcagtgaagagggcatccctagacctacttacctctgggagaagctggataatacacttaagctaccccctacagcgacccaggaccaggtgcaagggaccgttactatccgcaatatttcagctttatcctccggcctttaccagtgtgtagccagtaacgcaatcggcactagtacatgccttctggaccttcaggtgatcagtccacaaccgcgaaacatcggtctcattgccggcgctattggcaccggcgctgtgattataatcttttgtatcgccttgatactgggcgcgttcttttattggaggtctaagaataaagaggaggaagaggaggagatccctaatgagatccgtgaggacgatctgcctcccaagtgtagctctgcaaaagcatttcacactgagatttcctcttcagacaataataccctgacctcatcaaatgcatacaattctcgttactggtccaacaatcctaaggtccacaggaacactgagtctgtgtcccatttttccgacctgggccaatcatttagcttccactctgggaacgccaatatcccatcgatctacgcaaatggaacacacctcgtgcccggacagcataaaacactagtggtgacagcaaacagggggtcttccccacaggtgatgtcaagatctaacggttctgtgtcacgaaagccacgccccccccacactcacagttatacaatctcccacgctacccttgagcgaatcggggccgttcccgtcatggtgcccgcgcagtcgagggcaggatctcttgtgtag

SEQ ID NO: 42777 - DNA, 1296 bp, Artificial Sequence
  Description of Artificial Sequence: Synthetic coding sequence
atgaccagccagcggagccccctggcccccctgctgctgctgagcctgcatggggtggctgccagcctggaagtttcagaatccccagggtccatccaggtggccagaggccaaccagcagtcctaccttgcactttcactacttccgccgccctcatcaacctcaatgtaatttggatggtgacacctctgtctaacgctaaccagccggagcaggtcatcctctaccaaggagggcagatgtttgatggagcaccgagatttcacgggagagtgggattcactggaaccatgcctgcaacaaacgtctccatctttataaacaatacccagctgtctgacacaggtacctaccaatgcctggtaaataaccttcccgacattggtgggcggaacattggggttaccggcctgacagtgcttgtcccaccctcagccccccactgccagatccagggttcgcaggacatcggcagtgatgtcatactcctgtgctcttccgaggagggtatcccccgcccaacgtacctctgggagaagctggacaacacattgaaactgccacccaccgcaacacaggaccaggtgcagggtaccgtaacgattcgtaatatctctgcactttcttctggactctatcaatgcgtcgcctcaaacgccatcggaaccagcacctgcttactagacctccaggtcatctccccccagccgaggaacattggacttattgctggcgctattggaactggtgctgtcattatcattttctgtatagcgctaattctgggcgctttcttttactggcgctcaaagaataaagaggaagaagaggaggaaatccccaatgaaatacgcgaggacgacttgcctccaaagtgtagcagcgccaaggcgttccatacagagatctctagctccgacaataataccctcacttcctccaacgcatataacagccgctattggtcgaacaacccaaaggttcatcgcaataccgaaagcgtctcccatttctcagatctcgggcaatcgttcagcttccatagtgggaatgctaatatcccctcgatctacgccaacggaacccatctggtgccgggccagcacaagaccctcgtggtgaccgccaaccgtggttccagcccacaggtaatgagccgctctaatggttctgtgagtcggaagccccgtccgcctcacacccattcatacacaatcagtcatgctacactcgagcgcatcggggctgtgcctgttatggtacccgcccagtcacgtgccggcagcctggtgtag

SEQ ID NO: 42778 - DNA, 1293 bp, Artificial Sequence
  Description of Artificial Sequence: Synthetic coding sequence
atgagcctggtggagctgctgctgtggtggaactgcttcagccggactggggtggccgccagtttggaggtcagcgaatccccaggctccatccaggtggcccgaggccagcccgctgtcttgccctgtacattcacaacttctgcggccctgatcaatctaaatgtgatttggatggtgactccgttatccaacgccaatcagccggaacaggtgattctataccagggcggccaaatgttcgacggagccccacgcttccacgggcgggttggtttcacaggcacaatgcctgctacaaatgtttcaatcttcattaataacactcagctcagcgacacagggacataccagtgcctggttaacaatctcccggatataggcgggcgtaatattggtgtgaccggtttaacagtgctggtgcctccctccgctcctcattgccaaatccagggttcacaagatattgggagtgatgtcatcctgctgtgttcgagcgaggagggaatcccccgcccgacgtatttgtgggagaagctagacaataccctgaagctccccccaactgccacacaggaccaggtccaggggacagtcacgatcagaaacataagcgcactatcatctggactgtaccaatgtgtcgcatcaaatgctattgggacttcgacttgtttgctggatctacaagtaatatcccctcaacctagaaatattggccttatcgccggggcgataggaaccggcgccgtaatcataattttctgcatcgctctgattctgggcgcattcttctactggagatccaagaacaaagaagaggaagaagaagagattccaaacgaaattcgcgaagatgacttgccccccaaatgctcgtcagcaaaagcctttcacaccgagatttcatcctctgacaacaacacattgacgtcgtcgaacgcttacaatagccgatattggagtaacaatcccaaggtacacaggaatacagaatctgtcagccacttcagtgatctgggacagagcttctcgttccactccggtaacgccaacatcccatcaatctatgcaaatggcacccaccttgtgcctggtcagcacaaaacattagtagtgacagctaaccgaggatccagcccacaagtgatgagtcgctccaacgggtccgtctcccgtaagccccggcctccgcatacacactcttacactatctctcacgctacattagaacgcattggtgccgtaccggtgatggtgccggcgcagagccgcgcaggtagtctcgtgtag

SEQ ID NO: 42779 - DNA, 579 bp, Artificial Sequence
  Description of Artificial Sequence: Synthetic coding sequence
atgcgggccaagccccagagccccctgccccggaaccccgtgcccgcctggtcgcctcccacaaccacaactgaccctatgctagaaaaagatgctgccggaggagattttccggctaatcttgtcctgcaactcatgccactgaaaacatttcccgctgcaatcaggggggtgattcagtcagagctgaactactcagttatactgcagtgggtcgtcaccatggaccctgagccagtgcttagctggaccttttccggggtgccttgtggcatgggtgaaaaattgtttataaggaggctcagctgtgagcagctgggcacctatatgtgtatcgcaaccaatagcaagaaacagctcgtaagcgaaccagtcaccatatctctccccaagcctatcatgcagcccaccgaagcggagcccatggagcccgacccaacactcagtctctccggcggaagcgctatcggtctgttagccgcaggaatcctcggcgcaggcgccttgatcgctggaatgtgtttcatcataatccagtctcttcgtacagatcgtcaacgaataggaatatgcagttag

SEQ ID NO: 42780 - DNA, 1224 bp, Artificial Sequence
  Description of Artificial Sequence: Synthetic coding sequence
atgggccagaaggagcggagcaccgccgacaccctgcccgacctggaagagtggaagagcgccgctggtttgaggtggtggcagacagccgtggtggacggaagtggaagtggaaacgaggtcatcgagggcccccagaacgctagggtgctgaaaggcagtcaggcaaggttcaactgtacagtgtcccaggggtggaagctgattatgtgggctctgtcagatatggtggtcctgagtgtcaggccgatggaacccatcattaccaatgaccgctttacctcacagcgctacgatcaggggggcaactttacaagtgaaatgatcattcataatgtggaaccgagcgacagcgggaatattaggtgctccttacaaaactcccggttgcatggttctgcttatctgactgtccaggtgatgggcgagctgttcatcccctctgttaacctggtggttgcggagaacgagccgtgtgaggtcacatgcctaccatcccactggacaaggttgccagatattagttgggagctcggtctgctggtgagccattcctcatattattttgttcccgagcccagtgatcttcagtccgctgttagcatcttggctctgaccccgcagtccaacggcactctaacctgcgtggcaacatggaagtccttgaaagcaaggaagagtgctacagtgaacttaaccgtgattcgatgcccacaggatacagggggcggaataaatatccccggagtcctctcctccctgcctagcctgggcttctcattgcccacttgggggaaagtaggcctggggctcgcaggtaccatgctactgacccccacgtgtacattaaccatacggtgctgctgttgtagacgccgctgttgcgggtgtaactgctgttgtcgatgctgtttttgctgtcggagaaagagaggatttcggatacagttccagaaaaaatcagaaaaagagaagaccaataaagaaactgaaacagagtcagggaatgaaaattctgggtacaactccgatgaacagaaaacaaccgacacggccagcctgccgcccaagagttgcgaatcaagtgatccagagcagaggaatagctcttgtggccccccacaccagagggcggaccagagaccaccgcgacctgcttctcacccccaggccagcttcaacctcgctagccccgaaaaagtctccaacacaaccgtggtctag

SEQ ID NO: 42781 - DNA, 1920 bp, Artificial Sequence
  Description of Artificial Sequence: Synthetic coding sequence
atggaccgggtgctgctgcggtggatcagcctgttctggctgaccgccatggtcgagggcctgcaggtgacggtcccggacaagaagaaagtggccatgttgtttcagccaacagtccttcgatgtcacttctcgacaagttcccatcagccagcggtagtacaatggaagttcaaatcgtactgccaggaccgaatgggggagagcctcggcatgagcagcacccgtgctcagagcctgagcaagagaaacttggaatgggacccctaccttgactgcctggattcccggagaaccgtaagagtcgtcgcttccaaacaggggtccactgtgaccctcggagacttttacaggggtcgagaaatcacaatagtccacgacgcagatcttcagatcggaaaactaatgtggggcgatagcggtctctattactgcatcatcacaacccccgatgacctggaaggaaaaaatgaggatagcgttgagctgctagttctcggaaggacggggcttctggccgatttactgccttcattcgccgtggagatcatgccagagtgggtgttcgtgggactagtgctgctgggggtgttcctcttcttcgttctcgttgggatatgttggtgtcagtgttgcccccacagctgctgctgctacgtgcggtgtccatgctgcccggatagttgctgttgtcctcaggcactctatgaggctggcaaggccgcaaaagccggataccctccgagtgtatcaggtgtacctgggccgtactccattccgtccgttccccttgggggagctccctctagcggcatgttgatggacaagccccatccccccccgctggcccccagcgatagtacaggagggtcccactctgtgcggaagggatatcgaatacaggccgacaaggaaagggatagcatgaaggttctatactacgtggaaaaagaactggctcagtttgatccagcccggagaatgagaggacgctacaacaatacgatttccgagctgtcaagtctgcacgaggaggattctaatttccggcaaagcttccatcagatgcgcagcaagcaattccctgtgtcgggcgacctagaaagcaatcccgactactggtccggagttatgggcggatcttctggtgctagccgagggccgagtgctatggagtacaataaggaggatagagagagcttccggcatagccaaccgaggtctaaaagtgagatgctttcccgaaagaacttcgcaacaggcgtccccgcagtcagcatggacgagctggctgcttttgctgactcctacggacagaggcccaggcgggctgacgggaacagtcacgaagcacgcggtgggtcccggtttgaacgaagcgaatctcgagcccattccgggttctaccaggatgactctctggaggaatactatgggcaaagaagtagaagccgcgagccccttacggacgcagaccgaggctgggcattctctccggctcggagacggcctgcagaagatgctcacctgcctcgtctcgtatctcgaacaccaggaactgctccgaaatatgatcactcttacctgggatccgcccgcgagcgccaggcacggcccgaaggggcttcaaggggtgggtcactggagactccaagtaagaggagcgcgcagctcggtccccggagcgcttcatactacgcttggagccctcccgggacgtataaagctggctctagccaggacgaccaggaagatgcatctgacgacgcactcccgccctactcagagctcgaactaaccaggggcccatcctatcgcggtagagatcttccctaccattccaatagtgaaaagaaacggaaaaaagaaccagccaaaaaaacaaacgatttccccacccgaatgagcctagtggtttag

SEQ ID NO: 42782 - DNA, 1644 bp, Artificial Sequence
  Description of Artificial Sequence: Synthetic coding sequence
atggccatgggcctgttccgggtgtgcctggtggtggtgaccgccattattaaccatccgcttttattcccgcgggagaatgccactgttcctgaaaacgaagaggaaattatacggaaaatgcaggcacatcaagaaaagctgcagttggagcaattgcggctcgaggaggaggtggcacggttagccgccgagaaggaagcactggagcaggtggcggaggaaggccggcagcagaacgagactcgggtggcctgggacctgtggtcaacactgtgcatgatactttttttgatgatcgaggtctggcgccaagaccatcaagaaggaccgtctccagagtgtctgggaggagaagaggacgagctgcccggcctcgggggagcacctctgcagggcctgacgctgccaaataaggcaacattagggcacttttacgaaaggtgtatacggggggcaactgctgacgcagcccgcacacgcgagtttttagagggcttcgtcgacgacctattggaagctctcagatcgttatgtaatcgcgatacggacatggaagtggaagatttcattggggtggattccatgtatgagaattggcaagtggaccgtccactcctctgccacctgttcgtcccatttactccgcctgagccatacaggtttcatccagagctctggtgctctggccgctccgtcccactggaccgtcagggctacgggcagatcaaggtggtacgcgccgatggggacacactctcttgtatctgtggcaagaccaagctgggcgaggatatgctctgcttattgcatggccgaaattcaatggcaccaccttgtggcgacatggaaaacctactgtgcgcaacagatagcctgtatctcgatacgatgcaggtgatgaagtggtttcaaactgcgctgaccagagcctggaaggggattgctcataagtatgagtttgacctggccttcggtcagttggattcacccggaagcctgaagataaaatttagatctggcaaatttatgcccttcaatctgatacctgtcatacagtgtgatgatagtgatctatatttcgtgtctcatctgcctcgcgagccatcggagggaactccagccagtagcacagattggcttctgagctttgccgtgtatgagcggcatttccttagaactacgcttaaggctctccccgaaggcgcctgccatctcagctgtttgcaaattgcctcgttcctcctcagcaaacagtcgcggttgactgggccttcgggactcagttcctaccatctaaaaactgccctacttcatttgttacttctccgtcaagctgccgattggaaggctgggcaattggatgccaggctgcatgagcttctgtgctttctcgaaaagtcactattgcagaaaaaacttcaccatttctttataggcaaccgcaaggtcccggaagccatgggactgccggaagctgtgctgcgggctgaacctttgaacctttttagacccttcgtgctgcagcggagcctgtaccgcaaaaccctggactccttctacgagatgctgaagaacgcacctgcgctcatttctgagtatagtctgcacgtgcccagcgaccaacctacacctaagtcttag

SEQ ID NO: 42783 - DNA, 1644 bp, Artificial Sequence
  Description of Artificial Sequence: Synthetic coding sequence
atggccatgggcctgttccgggtgtgcctggtggtggtgaccgccattatcaaccaccccctgctcttccctcgggagaacgccaccgtgcccgagaatgaggaagaaatcattagaaaaatgcaagcacatcaggagaaactgcagcttgagcagctgcgtcttgaggaagaggtagcacggctcgctgccgagaaagaagcgctcgaacaggtagccgaggaagggaggcaacagaatgaaacccgcgtcgcctgggacttgtggagcactctttgtatgatcctgttcttgatgattgaagtgtggcgccaggatcatcaggagggaccctctcctgagtgtctaggtggggaagaagacgagcttcctgggctagggggagctcctctgcagggcctgaccttgccgaacaaagccaccctgggccacttctacgaacgatgcattcgaggcgcaaccgccgatgctgctagaacaagggaattcttagagggcttcgtcgatgatctgctcgaagcgctcagaagcctgtgcaaccgggatacagatatggaagtagaagatttcattggggtggacagtatgtacgaaaactggcaggtggacagaccactcctctgccatctgtttgttccattcacacctcctgagccttacaggtttcatcccgagctctggtgtagtggccgcagcgtgccactggatcgccagggctacggacagatcaaggttgtaagggccgatggggacactcttagttgcatttgtgggaagaccaaactgggagaggacatgctttgtctgctgcatggcaggaacagcatggcacccccatgcggcgacatggaaaatttgctgtgcgctaccgacagtctgtatctggacaccatgcaggtgatgaaatggtttcagactgccctcacccgggcttggaaaggcattgcccacaagtacgaattcgatctagcatttggccagctcgactcccccggttcattaaaaattaaatttaggtcgggcaaatttatgcccttcaatctgatccccgttatccagtgtgatgactccgacttatactttgtgtcccatctcccccgggaaccttccgaaggaactcctgccagctccaccgattggcttctctcgttcgccgtgtacgagagacatttcttgcggacaacactcaaggcgctgcctgagggagcttgccatttgtcgtgcttgcagatagcctcgttcctgctgtctaaacagagccgcctcactggcccctctgggcttagttcctatcacttgaaaacagccctcctgcacctgttgctgctgcgccaggctgcagactggaaggcaggccagctggacgcacgcctgcacgaattgctgtgcttcctcgaaaagagccttctgcagaagaagctgcaccattttttcatcggaaatcgcaaggtcccagaggccatgggactgccagaggccgtgctgcgtgctgagcccctgaatctgttcagaccttttgttctgcagaggagcttgtatcgtaaaacgctcgactcattctacgaaatgcttaaaaatgctccggcactgatcagcgaatatagtctccacgtgccttccgaccagccaacacctaagagttag

SEQ ID NO: 42784 - DNA, 1644 bp, Artificial Sequence
  Description of Artificial Sequence: Synthetic coding sequence
atggccatgggcctgttccgggtgtgcctggtggtggtgaccgccataatcaatcacccgctgctcttccctcgcgaaaacgccacagtacctgagaatgaggaggagatcatccgaaaaatgcaggctcaccaggaaaagctgcaactcgagcaacttagactcgaggaggaagtggcccgactggcggccgaaaaggaggccctagagcaggtcgccgaggaaggccgtcaacaaaacgaaactcgggttgcttgggacttgtggagcaccctttgcatgatccttttcttaatgattgaggtttggaggcaagatcatcaggagggaccatcccccgagtgtctcgggggtgaggaggatgagctccctggccttggtggcgcgcctctgcaggggctcaccctgccaaacaaggctactttaggtcacttttatgaacgctgtatacgcggtgccacggcggatgcggctcggaccagggaattcttagaggggttcgtcgatgaccttttggaggcgctgcgtagcctctgtaacagggacactgacatggaggtagaagatttcattggggttgatagcatgtacgagaactggcaagtggaccgtccattattgtgccacctgtttgttcccttcacacctcctgaaccatataggttccacccggagctgtggtgcagcgggcgttccgtacccctggaccgccaaggatatggacaaatcaaggttgtgagagcagatggcgatacattgtcttgcatctgcggcaaaaccaaactgggagaggacatgctgtgtttgttgcatggacgcaactcaatggctccaccttgcggggatatggagaatttgctgtgtgccacggattctttgtacttggacaccatgcaagtcatgaaatggtttcaaaccgccctgacccgggcctggaaaggcattgcccacaagtacgagttcgatctggcctttggacagctagattccccgggatctctgaagattaaattcaggtccgggaaattcatgccctttaacctgattcccgtcatacaatgtgatgattcggacctatacttcgtgtcccatctgccacgggaacctagcgaaggaactccggcgtcatctaccgattggttattgagtttcgccgtttacgaacggcacttccttcgcaccacactgaaggcattgcctgaaggcgcctgccatctgagttgtctccaaattgcatcctttctcctctctaagcagtccagacttacagggcctagcgggctcagctcttaccaccttaaaacggcattgctgcacctactcctgcttagacaggctgccgattggaaagccggacaactggatgctaggcttcatgaactgctctgctttttggagaaatctctcctgcaaaagaaattacatcatttcttcatcggcaaccgaaaagttcccgaagccatggggctgccagaagcggtgttgcgcgctgaacccttgaatctgttccgtccctttgtgctccagagaagtctgtaccggaaaactctggattctttctacgaaatgctgaagaatgccccagccttaatctccgagtattccctccatgtgccaagcgaccaaccgacgccgaaatcctag

SEQ ID NO: 42785 - DNA, 345 bp, Artificial Sequence
  Description of Artificial Sequence: Synthetic coding sequence
atggccatgggcctgttccgggtgtgcctggtggtggtgaccgccatcattaatcatcctcttctttttccgcgagagaatgcaacggtgcccgagaacgaagaggagatcatcaggaaaatgcaggcccaccaggaaaaacttcagttggaacagctgaggctcgaggaggaggttgcccgcctggcagctgaaaaggaggccctggaacaggtggctgaagaggggagacaacagaacgaaacccgcgtggcttgggacctctggtccacactttgcatgatcctatttcttatgattgaggtctggagacaggaccaccaggaaggtcctagtcctgagtag

SEQ ID NO: 42786 - DNA, 1692 bp, Artificial Sequence
  Description of Artificial Sequence: Synthetic coding sequence
atgaccaccgacagctacagccccaccagccccgacgccgaggcctccatggctgtgatctctctgctttttttggcagttatgtatgtggtgcaccaccccctcatggtgtctgaccgtatggacctggatacgcttgcccgcagtagacagctcgagaaacgcatgagcgaggagatgagactgctcgagatggagttcgaggagcggaaaagagctgccgagcagcgtcagaaggcggagaacttttggacaggagatacttcctctgatcaacttgttctggggaagaaggatatgggttggccttttcaggctgatgggcaggaaggtccgctcgggtggatgcttggaaacttgtggaatacagggctgttttgcctttttctcgtgttcgaactgcttcggcaaaatatgcaacatgagcccgctttcgatagctctagcgaggaggaggaagaggaggttagggtcgtacctgtgacatcctataattggctgacagatttcccttcccaggaggctctagattccttctacaagcactacgtgcaaaacgccattagagatctcccatgcacctgtgaattcgtggaaagtttcgtggacgacttgattgaggcttgcagagttctttcccgccaggaggcacacccccaactcgaggactgcttaggaatcggcgcagcattcgagaaatggggcacccttcatgagactcaaaagtttgatattctggtgcccatcgtcccaccacaggggaccatgtttgtgctggagatgcgtgaccccgcattgggacgacggtgtggatgcgtgcttgtagagtcagagtgcgtgtgtaagcgcgagaagctgcttggggacgtgctttgccttgtgcatcaccacagggatccctccgccgtgcttggcaagtgctccagctcgataaaagcggccctgtgtaccggtttccacctcgacgtctgtaagactgtgcagtggttccgtaatatgatgggcaatgcctgggcattggtggcacacaaatatgattttaagctgagcctgccaccgtctactacctcatgtaaactgcggttggactaccggagcggcagatttctcagtattcacctggtccttggagtccaaagagaagacacactggtctacttagtttctcaggccccggaccaggagcagctaacatcagtggattggcctgagtcttttgtagcttgtgagcacctcttcttgaagctggtgggccggttcgctccagagaacacctgccaccttaagtgtctgcagatcattttgagtctgagacagcaccagtccctgccccacggggccagccgcccgatattaacctcctaccattttaaaacagctctgatgcacctgctcctgcgactcccattgactgattgggcccacaacatgctatcacagaggctacaagatatcctctggtttctaggtcggggtttgcaacagcggtctttacaccacttcttaatcggcaacaactttctacctcttacgattcccattccaaaaaccttccggaatgccgagcccgtgaatcttttccagcacctggtgttaaatccaaaggcgcacagccaggctgtggaagagttccaaaatcttttgacgcaggtgaagactctcccacacgctcctttagctgcagctccctag

SEQ ID NO: 42787 - DNA, 1668 bp, Artificial Sequence
  Description of Artificial Sequence: Synthetic coding sequence
atgaacgtggacgccgaggccagcatggccgtgatcagcctgctgttcttggccgttatgtatgtggttcatcacccactcatggtgtccgatcgcatggatctagacactctcgcccggagcaggcagcttgagaaacgaatgtcagaggaaatgagattattagaaatggaattcgaagaaagaaaaagagccgccgaacagaggcagaaagcagagaatttttggaccggggatacctcttcagaccagttggtgctggggaagaaagacatgggctggccctttcaggccgacggtcaagaaggccccctcgggtggatgttaggtaacctgtggaatactggcttgttctgtctatttctcgtattcgaattactgcgccagaatatgcagcatgaacccgccttcgacagctcatcggaagaagaagaggaggaggtccgagttgtccctgtaacttcgtataactggttgaccgactttcccagtcaggaggccctggatagcttctataagcactacgtacagaacgcgattcgcgatttaccatgtacttgcgagtttgtggagtctttcgtagacgacctcattgaggcctgtcgagtgctttcgcgccaggaggcccatccacagctggaagactgtctgggcataggcgctgccttcgaaaaatggggaactctgcacgagacccagaagtttgatattcttgttccaatagtccctccgcaggggaccatgttcgtactcgaaatgcgggatcctgcgctcgggcgacggtgcggttgtgtgcttgtagagagcgaatgtgtgtgcaaacgggagaagctgctcggggacgtgttatgcttagtccatcaccaccgcgatccatccgccgtcctcggaaagtgcagctcctcaataaaggccgccctgtgtaccggctttcacttagatgtgtgcaaaaccgttcagtggtttcggaacatgatgggaaacgcatgggccctggtggcacataaatatgactttaagctctcccttccgccctcaaccacaagttgtaaattacgtcttgactatcgctctggcagattcttgagcattcatctggtcctgggcgtgcaaagagaggacactctggtgtacctggtttctcaggcacctgatcaggagcaacttacatctgtggactggccagagagtttcgttgcttgcgagcacctgtttctgaagctagtcggaaggtttgcacccgagaatacctgtcacctcaagtgcctccagattatcttatcactacggcagcaccagtcactgccccacggggcctcacgcccaattctcactagttatcacttcaagacagctttgatgcacctgctgctgcgcctgcccttgaccgattgggctcacaacatgctaagtcagaggttacaggacatcttgtggttcctgggcaggggactccagcagcgatccctgcaccattttcttatcggaaataatttcctgcctttaaccatcccaatcccaaagacattcaggaacgctgaacccgtgaaccttttccaacacttggtgctcaaccccaaagcacattcccaggctgtggaggaatttcagaatttattgacccaggtgaagactttgcctcacgctcccctggccgccgcaccgtag

SEQ ID NO: 42788 - DNA, 1644 bp, Artificial Sequence
  Description of Artificial Sequence: Synthetic coding sequence
atggccgtgatcagcctgctgttcctggccgtgatgtacgtggtgcaccatcctttaatggtttcggacagaatggatctagacacactcgcccggtccaggcagctcgaaaaaaggatgtccgaggagatgcggctgcttgagatggagtttgaggagagaaaaagagctgcggagcagagacagaaagcggagaacttctggacgggcgatacaagcagcgatcagctagtattgggcaagaaagatatgggatggccttttcaggctgatggccaggagggccctctgggctggatgctggggaacctctggaacaccggattgttctgtctttttctggttttcgaactactgcggcagaatatgcaacatgagcctgcctttgatagtagctccgaagaggaggaggaagaggtgcgggtagtgcccgttacttcgtacaattggctgactgacttcccgtctcaagaggccctggattcgttttacaagcactacgtccagaacgccattcgagacctgccttgtacctgtgagttcgtcgagtcctttgtggatgacttgatcgaagcctgcagggtgctttcccggcaggaggcgcatcctcagctcgaggattgcctgggaattggcgctgccttcgaaaaatggggaaccctccacgagacacaaaagttcgacattttagtgccaatagttccaccccaggggacaatgtttgtgttggaaatgagggaccccgctttaggcagacggtgcggctgtgtgttggttgaatctgagtgcgtgtgcaaacgtgaaaagctactaggagacgtgctttgcttggtgcaccatcaccgcgacccgtccgcggtccttggaaaatgctcatcgtcaatcaaagctgctctgtgtacaggattccaccttgacgtgtgcaagaccgtccagtggtttcggaacatgatgggcaacgcttgggccctggtggcgcataagtatgatttcaaactttcgctcccaccatcaaccacctcttgcaagttgcgtcttgactaccggagcggacgttttcttagtatccatttggttctcggcgtgcagcgggaagacacactggtctacttagtctctcaggcgccagaccaggagcaactgacatctgtcgactggccggagagtttcgttgcctgtgaacatctcttcctgaagcttgtggggaggtttgcacctgagaatacttgtcacttaaaatgtttacaaattatactaagcctgcggcagcatcagtctctgccgcacggcgccagccgccccattctcacaagttatcactttaaaactgctttgatgcatcttcttttaagattacccctcacagattgggctcacaatatgctatcccaacggcttcaggacattctgtggttcctcggcagaggcctgcagcaaaggtctctgcatcactttctcatcggcaacaacttccttcctctgacaattcccattcccaaaacttttaggaatgctgagccggtgaatttgtttcagcatctggtcttgaatccaaaggctcacagccaggctgtggaggaattccagaatctcctgacgcaagtaaagactctgccacacgcccccctggccgctgcaccctag

SEQ ID NO: 42789 - DNA, 1644 bp, Artificial Sequence
  Description of Artificial Sequence: Synthetic coding sequence
atggccgtgatcagcctgctgttcctggccgtgatgtacgtggtgcatcatccgctcatggtctccgatcgaatggacctggatactttggcccgctccaggcagttggagaaaagaatgagtgaggagatgcggctactggaaatggagtttgaggaaagaaaacgggcggccgaacaaagacagaaggctgaaaacttttggactggggacactagttctgatcagttggtactgggaaagaaagatatggggtggccttttcaggcagatgggcaggagggccctttgggttggatgctgggcaatctgtggaataccggcctattttgtctgttcttggtattcgagttgctgagacagaatatgcaacacgagcctgccttcgattccagctccgaggaagaggaagaagaagtccgcgttgtaccggttaccagctataactggctcacagactttccaagccaggaggctctggacagtttctataagcactacgtccagaatgctatcagagatctgccatgcacatgcgagttcgtggaaagtttcgttgacgatctcatcgaagcttgcagggtactcagcagacaagaagcgcatccccagctggaggattgtctgggtatcggcgcggccttcgagaaatggggcaccttgcatgaaacccaaaagtttgatattttagtcccaattgtgccccctcaggggaccatgttcgttctcgagatgagggaccccgccctcggtagacgctgcgggtgcgtacttgtggaaagcgaatgtgtgtgtaaaagagaaaaactgcttggagacgttttatgcctggtacaccatcaccgggatccttctgctgtgttgggcaaatgtagttctagcatcaaggccgccctttgcactggcttccatctggatgtgtgcaagaccgtccagtggttcaggaatatgatgggcaacgcctgggctttagttgctcacaaatatgacttcaaactgagtcttccgccttccaccacctcatgtaagctcagattagattaccggagcggccggtttctgtccatacatctggttcttggggtccagagggaagacactttagtctacctggtgagccaggctcccgatcaagagcaattgacctctgttgattggccagaatcattcgtcgcctgtgagcacctgttcctcaagcttgtggggagatttgcccccgaaaacacatgtcatctgaagtgtctgcagataatcctgtctctgcgccaacatcagtcattgccccatggggcgtccagacccattttgacctcttaccatttcaaaacagcactcatgcacctccttctccgcctgccccttacagattgggctcacaacatgctgagtcagcgactgcaggacatcctgtggttcctcggacgcggacttcagcagagatcccttcatcactttctgatcggtaacaattttctcccactgacaatacccatcccaaagaccttcaggaacgcggagcctgtgaatttgttccagcacctcgtgctcaatccaaaagcccattctcaggcagtcgaggagtttcaaaacttgctaactcaggtgaaaacccttccccacgcgccattggcagctgccccctag

SEQ ID NO: 42790 - DNA, 1608 bp, Artificial Sequence
  Description of Artificial Sequence: Synthetic coding sequence
atgagcgtgcactacaccctgaacctgcgggtgttctggcccctggtgacggggctgtgcactgccctggtgtgcctgtaccatgtgttaagaggatcgggcggagcaagagctgagcccgccgatggggttgacggcgggtttcccctccttaaggtagcagtgctgctgctgctaagctacgtgctgttgcggtgccgtcacgcggttaggcaaaggttcttgccggggagcccacggctggaaggccacgcagccttctcaagtcgccatttcagagaacctggtctctccatacttctcgagtcttactatgagcatgaagtccgcttgtctccccacgtcttgggacactcgaaggcccatgtaagcagaattgtcggagagctggtaagggcaggccgagcccgcggcagtccggggctcattccaggcggcgcactggccctagcattcagaggcgattttatccaggtgggctcagcgtacgagcaacacaaaataaggcggcccgacagtttcgacgtgctggtgcccctcagactcccccccttagtcgcactagagccaaggagcttgggcgaagaacctgccctcgcaccagccttccgtggatgtttcctctgtgcattgaaggctcccccttcgccttcaggcgcatctggcggccattggctgcgggactgcaaacccttcgcggacgcattctgcgtcgacgttaggggcaggaggcatctttccgcgactctcgttctgaggtggttccagagccatctgcagcgaagtttagccacggtgcggtatagccttgaagggcgttgtagggtgacccttacccctggaggactcgagcaaccccctacactgcatatactcccatgcagaacggactatgggtgctgccggctctctatggctgttcgcttgattcctgctgttcaccttggtgacggagtgttcctggtcgcacctccacccccacctctcccgtccgcccccctgctggagctgccagaggggctgcgcgccgaagccctttggggcgtcaatacagctaggcaggaacagaagctcctcagctggcttcaggaacgtgcagccccaggtgcatgttatctcaagtgtttgcagctattgaaggctctgcgggacctcggtgctcgcggacttgactctgctgccgccacccagtggggcagaatactttcaagttacgtgttgaaaaccgtactgcttgccgttcttctccggaaaggagccccaggccagggttgggatgaggaacacttgggcagatgcctggaggagcttgtgcagtttcttcgggattgcctccttcggcggcacactttgttccattgcgtgctgggccctgggggggcagctgctgaagtaggcccgctgcctaaggccctgagggaggccgcccccgtggacctgctggctgccttcgacggtcatgcccgggagttggcagccgctcgattgttgagcacatggcagaggcttcctcagctactccgtgcatacggaggcccgaggtatctagccaggtgccccccccccagatctcagcgtacccaggggttcctagaaggagagccttag

SEQ ID NO: 42791 - DNA, 3774 bp, Artificial Sequence
  Description of Artificial Sequence: Synthetic coding sequence
atggccagctgcagcttcacccgggaccaggccacccggcggctgagaggggcagcagcggcggcagccgcagccctggctgccgtcgttaccacacctctgttatcctcaggtactcccaccgcactgattggcacgggaagttcctgtccaggcgcaatgtggctctctacagcaactggttctcggtctgacagcgaaagtgaggaggaagaccttccagtgggggaagaggtgtgtaaaagagggtacctccgaaagcagaaacatggtcacagaagatatttcgtcctcaaattggaaaccgctgatgccccagcaagattagagtactatgagaatgccaggaaattccgccatagtgttcgcgcagccgcagcagctgccgccgccgccgcgagtggggccgcaatccctccccttatcccccctagacgtgttattaccctctaccagtgcttttctgtctctcagagagccgatgctcgatatagacacctcatcgcccttttcacacaggacgagtattttgccatggtggcggagaacgagagcgagcaggagtcttggtatttgctgctgtctcgcctgatactggagagcaaacgaaggcgatgtggcaccctgggcgcccagcccgacggcgaaccagccgctctggctgcagccgctgccgccgagcccccattctataaagacgtgtggcaagtaatcgtcaaaccccggggtctggggcatcgcaaggagctttccggagtcttccggctctgtctgacggatgaggaggttgtgttcgtccggctgaacacagaagttgcatccgtggtggtccaactgctatccataagaaggtgcggtcactccgaacagtacttttttcttgaggtcggccggtccactgtgatcgggcccggcgaactctggatgcaagtggatgactgcgtcgtagctcaaaacatgcacgagctgttcctggaaaagatgagggccctgtgcgctgacgagtaccgcgcccgctgcagatcctattccatcagcataggggcccatctgctaaccctgctgagcgctcgacgccatctgggtctcgttcccctggaaccaggaggttggcttcgccgatccaggtttgaacagttttgccatctgcgagccatcggcgacggcgaagatgaaatgctgttcacacgccggtttgtgaccccctccgaacccgttgcccatagccggaggggcagactgcacctgccccgcgggcgccgctcccgccgcgcagtttcggtgcccgcgtcattcttcagaaggctggctccaagtcctgctaggccacgtcaccccgccgaggccccgaacaacggcgcaaggctgagttccgaggtctcaggctcaggtagcgggaatttcggcgaagagggcaacccacagggaaaggaagaccaggaaggctccggcggggactatatgcctatgaataattggggttccgggaacggccgcgggtctggtggaggacagggatccaatgggcaggggtccagtagccatagcagcggaggaaatcagtgttcaggagagggacaggggagccggggaggacaaggctccaacggccagggcagcggcgggaatcaatgtagtagagatgggcagggtactgcgggcggccacggctctggtggcggacagaggcccggaggtgggcatggtagtgggggcggtcagggacctggcgacggccacggttcaggcggtggcaagaattccggcggcggcaagggcagcgggagtgggaaggggtccgacggcgatggcgagcgaggaaaatccctgaaaaaaagaagctactttgggaagctaacccaatctaaacagcagcaaatgccacccccaccccccccacccccaccacctccaccggctggcggaaccggggggaagggcaagagcggcgggcggttccggttatatttttgcgtagaccggggggctaccaaggaatgcaaagaggcaaaggaagtcaaagacgcagaaatacccgaaggtgctgcccgaggacctcacagagcccgggcattcgatgaagacgaggatgacccgtatgtgcctatgcggcccggggttgccacccccctggtgtcctcaagcgattatatgcccatggcccctcaaaatgtgtcggcatcaaagaagaggcactccagatctccctttgaggatagcagaggctacatgatgatgttcccgcgcgtgagccctcccccagccccctctccaccaaaagctcctgacaccaacaaggaagacgattctaaagataatgacagtgaaagcgattacatgttcatggcgccaggcgccggcgcgatcccaaaaaacccacgcaatccacaaggagggtccagcagcaaaagttggtccagttacttctcactgcctaatcctttccggagcagtccgctcggacaaaatgacaattcagagtatgttcccatgttgcctggcaaattcctcggcaggggtctagacaaggaggtgagctataactgggacccgaaggacgccgcttccaagcccagcggagaggggtcttttagcaagccaggcgacgggggtagccctagcaagccctccgaccatgaacccccaaaaaataaggccaaacggcccaatcgactcagcttcattaccaaaggctacaagatcaagccaaagccccagaaaccgacacatgagcagcgtgaagccgattcatcatcggattacgtgaatatggacttcaccaaaagagagagcaatacaccagctcctagcacacaaggactccctgacagctgggggatcattgctgagcctcgacagtccgcattcagcaactacgttaacgtggagttcggcgtcccctttccaaacccggctaacgatctgtcagacctgctccgggctatcccaagggccaaccccttgtccctggattctgcccggtggccccttccccctttgcccctcagcgccactggctccaacgcgattgaggaagagggggactatatcgaggttatattcaacagcgctatgaccccggctatggccctggccgatagcgccattcgttacgacgcagaaacaggccgcatttatgttgtcgatcctttcagcgagtgctgtatggacatcagtttatctccatctagatgctcagagcctccccccgtcgcaaggctgctccaggaagaggagcaagagcgccgacgacctcaaagccgaagtcaaagctttttcgccgcagctcgcgcagctgtaagtgcgttcccaaccgattcactggaaagagatctgagtccttcgtctgctcctgctgtggcgtccgctgctgagccaaccctggccctctctcaagtcgtagctgccgcatcagctctcgctgccgctccaggcatcggtgccgcagctgcagccgctggattcgatagcgcttccgcccggtggtttcagccggtagcaaacgccgccgacgccgaggcagttcggggagcccaagacgtcgccggcggctctaacccgggggcgcataacccatctgctaatctggcacgcggcgacaatcaagcggggggggccgccgcagcagcggcagcgcccgagcctcctcctcgtagtcgccgggttcccagaccaccagagcgggaggactctgacaacgacgatgatacacacgtaaggatggacttcgcccgccgcgacaaccaatttgattctcctaaaaggggaaggtag

SEQ ID NO: 42792 - DNA, 7185 bp, Artificial Sequence
  Description of Artificial Sequence: Synthetic coding sequence
atgtggctgagcggcaagagccaggtgcagaagcggggcgccgtgcgctatctgcaagcccccccagtgaatggggaagcctccgcttgcccggcccctcccactcaccttgatcgcacaacgtgtgcccgccggaggcccgcccgtctgcctccaccatggggggctgcaggaattagaccagcacctcgggcttcccgcgccagtttctgggcacgttttccgccacattgcttcccatctgggtgttctggatctagggtgctggaggggggcgagattggattccgctttagagggggccgggtggccgctgccgctctcagatcccgttgggcccggggcgatgccgcagccgccgggagtcgcgagggaagagggcggatgaaccgagctaagcccacaactgtccgccgaccttcagccgcggccaagccaagtggccacccaccaccaggtgattttatcgcgctaggcagtaaaggccaggcaaacgaatccaagactgcctcgaccctcctgaaacccgcccctagcggcctgccatcagaaaggaagcgggacgccgctgcggccctgtcttctgccagtgctctcactgggctgactaaaagacccaaactctcgtcgacaccaccactttccgccctgggccggctcgcagaagctgcagtcgcagaaaaaagagctatatcgccaagtatcaaagaaccatcagtggtgcccatcgaagttttgcctacagttcttctggatgagatcgaagcagctgaactggagggcaacgacgatcggatcgaaggtgtgctctgtggggccgttaaacagctgaaagtgaccagagccaagcctgattccacactatacctcagccttatgtatctggccaagatcaagccaaacatttttgcaactgaaggggtgatcgaagccctttgcagcctgcttcgccgggacgcttccataaactttaaggcaaaaggtaatagtttagtgtccgtgttagcctgcaaccttttgatggccgcttatgaagaggatgagaattggcctgagatcttcgttaaggtgtacatcgaagactcgctgggcgaacggatttgggttgatagcccccactgtaaaacttttgtggacaacattcaaacggcttttaacacgaggatgcctccaaggagcgtgttgctgcaaggggaagctggacgcgtcgctggcgacctgggggccgggagcagtcctcatccctccctgactgaagaggaagactcgcagaccgaactgctgatagcagaggagaaacttagccccgagcaggagggccagcttatgccgcgctatgaggaattagctgagagcgtcgaggagtacgtcttagatatgctgagagatcagttgaaccgtcgccaaccgatcgacaatgtgtctagaaatctgctgcgactgctcacatcgacctgcggctacaaggaggtgcgcctactggctgtacagaaactggaaatgtggcttcaaaatcccaaactgacccgtccagctcaggaccttctgatgagcgtgtgtatgaactgcaatacacacggaagcgaagacatggacgttatttctcacctgatcaaaatcagattgaagccaaaggtattgctcaaccacttcatgttatgtattagagaattgctgagtgctcataaagacaacctgggcactaccattaagctcgtgatttttaatgagctctctagtgcccgcaatccaaataacatgcaggtcctgtacaccgcactgcagcatagctccgaactggccccaaagttcctcgccatggtgttccaagatttgctcaccaacaaagacgactacctccgtgcctctcgcgctttgctgcgggaaatcattaaacagactaagcacgagatcaattttcaagctttctgtctgggtctgatgcaagagaggaaagaaccacagtatctcgagatggaattcaaggagagattcgtagtccatatcacagatgtgttagcagtatccatgatgctgggtatcacagcccaggtcaaagaggccggtatcgcatgggacaaaggagaaaaacgaaaccttgaggtgcttaggtcgtttcagaaccaaatcgctgccattcagagggacgccgtttggtggttacacaccgtggtcccatctatctcaaaactagcccctaaggattacgtgcactgtctgcataaggtgttgtttacggagcagccggagacatattataagtgggacaactggcctcccgaatctgatcgaaactttttcttgcgcctctgttctgaggtgccaatcttggaagatacattaatgcgaatcctggtgatcgggctttccagggagttgcccctcggcccggctgatgctatggagctggcagaccatctggtaaagagggccgccgcggtccaggcggacgacgtggaagttctcaaggtggggaggacacagcttatcgacgctgtgctgaatctatgcacgtatcatcatccagagaacatccagctacctcctggctaccagccccccaatctagccatcagcactctgtactggaaagcctggcccctgctgctcgtggtggccgcatttaatcccgagaacataggtttggccgcctgggaggagtatcccactctgaagatgctgatggagatggttatgaccaacaattattcctatccaccctgtaccctgaccgatgaagagacaagaacagaaatgctgaacagggaactgcagacagctcagagagaaaaacaggagattcttgcgtttgagggccaccttgctgccgctagcaccaaacagacgatcaccgagtcttcgagtctgttgctgagtcagctgacgtctctggaccctcagtacgcagcccatacagcgcccccatgtgcttgtcgacgtgatctgggacctcctcgacggcccccaccccacattctggatcaggttaagtccctgaatcagagcttgcgcctcggacacctcctctgccggagcaggaaccctgatttcttgctgcacatcattcaaaggcaggcctccagccaatctatgccatggttagcagacctcgtgcagtcctccgaaggatctctcgatgtcctcccagtgcagtgcctgtgtgaatttctgctgcacgatgctgtagacgatgccgccagtggggaagaggacgatgaaggggagtcaaaggaacagaaagccaagaaacgccaacggcagcagaagcagcggcagcttctagggcggttgcaggaccttctcctcggaccgaaggccgatgaacagactacatgcgaagtactggactacttccttagaaggcttggatcaagtcaggtggcttcacgggtgctcgctatgaaaggtgagactctgcctgctctgcctaaagcaggcccagcacacgaatgcttgccccagggtctgagcctggttctgtccgagggctctctaagagatggcgaggagaaagagccccccatggaggaggatgtgggcgacactgacgtgttgcagggctatcagtggttgctgcgagacctacccaggcttccactgttcgattccgtgcgctcaactacagccctggcactacagcaggccatacatatggaaacggatcctcagacaatctcagcctatctgatatacctgagccagcatacgccggtggaggagcaggctcagcattccgatttggcacttgatgtcgcacgcctcgtagttgagcggtccaccatcatgtcccatctcttctcaaagctctcaccatctgccgcctccgatgcagtgttaagcgcactgctgagcatcttttctaggtacgtacggaggatgagacaatcgaaagagggtgaggaagtgtactcttggagtgaatctcaggaccaagtttttttgcgctggtcttcaggggagaccgcaacgatgcacattttagtggttcacgcgatggtaatattactcacgctcggtcctcctcgtgccgatgactcagagtttcaagccctgctcgatatctggttcccagaggagaaaccgctgccaaccgctttccttgtcgacaccagtgaggaagccctgctcctgccagattggctgaagctgcgcatgattcggtccgaggtgctgcgtctggtcgatgccgctttgcaagatctcgagccacaacagttactcctgttcgtacagagttttggcattcctgttagcagtatgagtaagttgctgcagttcctggatcaggccgtggcccacgatccacagacattagagcagaacattatggataagagcaagatgcccggcacgtgtggagttggctctcatactttgactgagcctcagcctgggcaggcctttggagcctgggtccgcgccggagtgaccctcctccgcttcgccgattacatggctcatctcgtggaagtccagcacgaaagaggcgctagtggcggtcagaccttccacagcttgttgacagcttcgctcccaccacgcagagactcaaccgaagccccaaagccaaagtcaagtccagaacaaccgatcggacaaggacgaatccgggtagggacacaacttagggtattgggccccgaagacgacctcgcaggaatgtttctccagatctttccgctctctcccgatccacgttggcaatcctcatctccacgtcctgtggcactggcactgcagcaggcgcttggccaagaactggccagagtggtccagggttcaccagaggtgcctggaataacagtcagagtcctgcaggcccttgccacactgcttagctctccccacggcggggcattagttatgagcatgcacagaagtcactttctggcatgccccctgctccggcagctctgccaatatcagcgctgcgtcccccaggataccgggttcagctccctcttccttaaggtactgctccagatgttacagtggctcgactcgccaggggtcgagggcggccctctgcgcgcccagcttcgcatgctggctagccaggcttctgccggacgaaggttgtctgacgttcgcggaggcctcctccgcctggctgaagcattagcgttccgccaagacctggaagttgtgtcgtcaaccgtgagagctgttatagcaaccctgaggtccggggagcagtgctccgtggaaccggacctgattagcaaggttcttcagggtttaatcgaagtcagatctccccacctggaagagctactgactgcctttttctccgcgactgcggacgctgcgtccccgttccctgcctgcaaaccagtggtggttgtgtctagcttactcctgcaggaagaggaacctctggccggcgggaaacctggcgctgatggcggaagtttggaggcagttaggttgggacctagcagtgggcttttagtggattggctcgaaatgcttgatcctgaggtcgtttcctcctgtcctgacctccagctgaggcttctgttctcccgacgtaagggcaagggacaggctcaagttccatctttcaggccttatctgttgaccctgttcacacatcagtctagttggcccaccctgcatcagtgcataagagtgcttctgggaaagtcccgggaacagaggttcgatccatctgcatcgctagacttcttatgggcatgtattcatgtccctcgtatttggcaagggagagaccagaggactcctcaggcgggtttgggccggaagcgccgcgaggagcttgtattaagagtgcaaggtcccgaattgattagcctcgttgaactcatcttggcggaggctgaaacaagaagccaggacggtgacactgctgcctgttccctcatccaggcaaggctgccgttgctgctctcgtgttgctgcggggatgacgagtctgtaagaaaagttactgagcatctgtcgggctgcatccaacagtggggggattccgtcctcggacgccgttgtcgcgacctgctcctgcaactttaccttcagcgacctgagctgcgagttcccgtccctgaggtcttgttgcactccgagggcgcggcatcctcctcggtctgcaaattagatgggttgatccacagattcataactttactggccgacaccagcgattcaagagccctcgaaaacagaggggcagacgcgtctatggcctgtaggaaactggctgttgcccatcccctgttactcttgaggcacttgcccatgatcgctgcattgctccacgggaggacgcacctgaatttccaggaatttcgtcagcagaaccacttaagctgcttcctacacgtcctcggtctgttggagttactgcaacctcacgtgtttcgtagtgagcatcagggggcgctgtgggattgcctcctgagttttattagactgctcctgaactaccgcaagagttccagacatcttgctgctttcatcaataagttcgtgcagtttattcacaaatacattacctataacgcgccagctgcaattagtttcttgcagaaacacgcagatcctcttcatgacttgtcattcgacaactcagatctcgtgatgctgaaatcgctcttggctgggttaagcctgccgagccgtgatgatcgcacagaccggggactcgacgaagagggcgaggaagagagctccgctggaagtcttcctctcgtgagtgtgtctctgttcacccccttaaccgcggccgagatggctccctatatgaagcgcctctcacgcggtcaaaccgtggaggacctcttagaggttttgagtgacattgatgaaatgtcacgccggaggcctgagatactgagcttctttagcactaacctgcagcggctaatgagcagtgccgaggaatgctgtcgcaacttagcttttagcttggctttaagaagcatgcagaattccccttccatcgccgctgcttttcttcctactttcatgtattgcctggggtctcaggacttcgaggtggttcaaacagcactcaggaacttgccagagtatgcccttctttgccaggaacatgcagccgttctgctgcaccgagcattcctggtaggcatgtatggccagatggatccatcggctcaaatcagcgaggcactgagaattcttcatatggaagcagtgatgtag

SEQ ID NO: 42793 - DNA, 6573 bp, Artificial Sequence
  Description of Artificial Sequence: Synthetic coding sequence
atgaaccgggccaagcccaccaccgtgcggcggcccagcgccgccgctaaaccatctggccaccctcctcccggcgattttatcgcgttagggtccaaagggcaagcaaatgaaagcaaaacagcttcaactctgctgaaaccagctccgtctggcctcccatccgagcgtaaacgggacgctgcagcggcgctatcaagtgccagcgctctgaccggactgacaaagagacctaaactgtcttctacccctcctctgtccgctttgggacggctggccgaggctgccgttgccgaaaagcgtgcaatcagtcctagcattaaggagccctcagtggtacccattgaggtcctgcctactgtgttgttagacgaaattgaggcagctgaactggaaggaaacgatgaccggattgagggagtgctgtgcggggccgtaaagcagctgaaagtgacacgagctaagcctgattcaaccctgtacctctctctaatgtacctggctaaaatcaaaccgaatattttcgccacggagggggtgatcgaggctctctgctctcttctccgaagagacgcctctatcaactttaaggcgaaaggcaacagccttgtctctgtgctggcatgcaatctgctcatggccgcctatgaggaggacgagaactggccggagatcttcgtaaaagtgtacatagaggatagtctgggcgaacggatttgggtggattctccccactgcaaaacattcgtggacaacatccagactgcatttaatacccggatgccccctagatcagtgctgctgcagggggaggcgggacgcgtggctggggatctcggcgccggctcatccccccacccgtcgctgactgaggaggaagactctcagactgagttgctcattgccgaagaaaaactctctcctgaacaggagggacagctgatgccacgctatgaggagctggctgagtccgtcgaggaatacgtgttggacatgttgcgtgatcagctgaatcggcggcagccgattgacaatgtgtctcggaacttgctgcggttgttgacctctacgtgcggctataaagaggtccgcctgctggcggttcaaaaactagaaatgtggctgcaaaatccgaagctgaccaggcccgctcaggacctgcttatgagcgtgtgcatgaattgcaatacacacgggtccgaggatatggacgtgataagtcacttgatcaaaatccgcctgaaacctaaggtacttcttaatcactttatgctgtgcatccgcgagctgctgtccgcccacaaagacaatttgggcaccactatcaaactggttatcttcaatgaacttagctccgccagaaacccaaataacatgcaggtcttgtacaccgcactacaacattctagcgaactggcccccaagttccttgctatggtcttccaggacctcctgactaacaaagacgattatctgcgagccagcagggcccttctgagggagataattaagcagactaagcacgaaattaactttcaggccttttgtctgggacttatgcaggaacggaaagaaccccagtacctggagatggagtttaaagagcgatttgtcgtgcacatcacagatgtgctcgcagtgtcaatgatgttggggatcacagcacaggttaaggaagcgggcattgcatgggacaaaggtgagaagaggaatctggaagttctgcgaagttttcagaatcagatcgccgctatccagcgagacgccgtgtggtggctgcatactgtggtccccagcattagtaagctggctcctaaagactatgtgcattgtcttcacaaggtgcttttcaccgagcagcctgaaacatactacaaatgggacaattggccacctgagagcgatcggaacttcttcctgagactgtgcagcgaggtgccgatcctggaggatacgctgatgagaatcctggttatcggcctttcgagagaactgccactcggcccagcagatgccatggagcttgcagatcatctggttaagcgcgccgctgccgtgcaggcggacgatgtagaggtgctcaaggtgggaagaacccagttgattgacgctgttctcaacctgtgcacttatcaccaccctgagaacatccagttaccaccaggataccagcccccaaacttagccatttcaaccctgtactggaaagcgtggcccctgctgctggtggtggccgcttttaatcctgagaatatagggctcgccgcgtgggaagaataccctacccttaagatgctgatggagatggttatgacaaataattatagttaccccccctgtacattgaccgacgaggagaccaggaccgaaatgcttaaccgggaactgcagacagcacagagggagaagcaggaaatactcgcctttgaaggacacctagccgcagcatccactaagcagacaataaccgagagcagctccctcctcctgtcccagttgactagtctggacccacaagggcctcctagacgcccccctcctcacattttagatcaggtgaaaagtcttaaccagtcactcaggttgggccacctactatgtcggagcaggaatcccgattttctgctccacattattcagcgccaggcaagtagtcagtccatgccctggttggccgacctggttcaaagctccgagggcagcctagacgttctgcctgtgcagtgcctgtgcgagtttttgcttcatgatgccgtagacgacgctgcttctggggaggaagacgacgaaggtgagagcaaggaacagaaagccaaaaaacggcagaggcagcagaaacagaggcagttgcttggccgcctgcaagacctactgctggggccaaaggccgatgaacagactacctgcgaggtgctggactactttttacgtaggctgggtagctcgcaggtagccagccgtgtgctggccatgaaagggctgtcattagtgttgtctgaaggatcacttcgcgatggtgaggaaaaggagccaccaatggaggaggacgtcggcgacactgatgtcctgcagggctaccagtggttgctcagggacctgccacgcctccccctgttcgattccgtcaggtctaccaccgctctggccctgcaacaggcaatacacatggaaactgacccccaaacgatctccgcttacttgatttacctttcacaacatacacccgttgaggaacaagcccaacacagcgacctggctttggacgtggccagactggtagtcgagcgttctacaattatgtcacatctgttcagtaaactctcaccctcagccgcctctgatgctgtcctttccgcactcctgagcatattcagccgttacgtgcgtaggatgaggcagtcaaaggagggggaggaggtgtattcttggtcagagtcccaggatcaggttttcctccgttggtcatcaggcgaaaccgccactatgcacattttggtggttcacgcaatggtcattctcttgacactggggccccctcgcgctgacgattctgaatttcaggccctgctggatatttggtttcccgaagaaaagccccttccaaccgcctttttggttgacacttctgaggaggcactgctgttgcctgactggttaaaattacgcatgatccgctccgaagtgctcagattggttgatgctgccttacaggacctggagccccaacaacttctgctgtttgtgcagtcttttggcatccctgtgagtagtatgagcaagctgcttcagttcttagatcaggcagttgcccatgacccccagacactagaacagaatataatggataagaactacatggcccacctagtggaggtacaacacgagcgcggagccagtggcggccagacctttcactccctactgaccgctagtctccctcctcgccgtgacagtacagaagctcctaagcccaaaagctctcctgaacaacctattggccagggacgtatccgcgtcggaacccagcttcgggtgctgggtcctgaagatgacttagcaggcatgttcctgcagattttccccctgtctcccgatccgagatggcagtcaagctcacccaggcccgttgcactggccttacagcaggccctaggacaggagctcgcgagagtggtccaggggtctccggaagttcctgggatcacagtgagagtgctccaggctttggcaacactcctgagcagcccacacggcggcgcactggtgatgagcatgcacaggtcccatttccttgcatgtcctttgctacgccaactatgtcagtaccagcggtgtgtgccacaggacactggcttctccagcctgttcctaaaagttttgctgcagatgctacagtggctggatagccccggggtggagggtggaccactgagggcccaattacgaatgctggcatcacaggcctctgcgggcagacgcttaagcgacgtgagaggtggactactccgcctggcagaagccttagcgttcagacaggaccttgaagtggtctcatcaactgtaagggccgtcatcgcgacgttaaggtcgggagaacagtgtagcgttgagccagatctgatttccaaagtcctgcagggtctcatcgaagttaggagcccccacttagaggagcttctcacagcattcttctccgccacagcagatgccgcgagcccgtttcccgcttgtaagccagtcgtggtagtgtcttcattattgctacaggaggaggaacctctggccggcggaaaaccaggcgccgatgggggcagcctcgaagccgttcggttgggaccctctagcggtctcctggtggattggttggaaatgctggacccagaggtggtgtcttcttgccccgacttgcagcttcgacttttattttccaggcgcaaggggaagggccaagcccaggtgccatccttcaggccctatcttctgacgctgttcacgcatcagtcgtcctggccaactctccaccagtgtattcgagttctactaggcaaatccagagagcagaggttcgacccttctgccagtttggacttcctctgggcctgcatccatgtgccaagaatatggcagggcagagaccaaaggacaccccagaaaagacgcgaggaactcgttcttcgagtgcagggcccggagcttatttctctggtcgagctaatactggctgaagctgagacccgtagtcaggatggagacaccgctgcgtgcagcctcatccaggcacgcctgcctttgctgttgtcttgctgctgcggggacgacgagtccgttaggaaagttacggagcatctcagcgggtgcatccagcagtggggtgattctgtgctcggtcgcaggtgccgggacttgttgttgcagctgtaccttcagagacccgaactgcgtgtcccggtgccggaggtgctgctgcactctgagggtgccgcgagctcaagcgtgtgtaagctcgatggacttatacatagatttattactctattggccgatacttcggatagccgcgcactggagaaccgtggggccgacgctagcatggcatgcaggaagctggccgtggcccatccactgctgttactgcggcatctccctatgatcgcagctttactgcatggacgcacacacctcaattttcaggagtttcgccagcagaaccacctctcttgttttttacacgtcctgggcctgctcgagctactacaaccacacgtcttccgatctgaacaccagggagccctgtgggactgcctgctgtcatttatccgtctgcttttgaattatcggaagtctagtagacatctggctgcattcatcaacaaatttgtgcagttcatacataaatacattacctataatgcccctgccgccatcagttttctgcaaaagcacgctgatcctctgcacgacctgtcatttgacaattccgacctcgtcatgctgaaatccctcctggccggactaagcctccctagcagggatgaccgtaccgaccgaggacttgatgaggaaggagaggaagagtccagcgccggctcactaccgctggtaagcgtctccctgttcaccccgctcacagccgcggaaatggctccctacatgaagagactgagccgtggtcagaccgtggaggatctcctcgaggtgctatctgatatcgatgaaatgtccaggaggaggccagagatcctgtcctttttctccacaaacttacagcgcctgatgtcttcggctgaagaatgctgccgcaacttagcattttccctcgcgctaaggagcatgcaaaacagtcctagcatcgccgctgcattcttgcccaccttcatgtattgcctgggcagccaggacttcgaagtagtgcagacagctttacgcaacctgccagaatacgcactactttgtcaggaacacgccgcggtgctattgcacagagccttcctggtcgggatgtatgggcagatggaccctagcgcccaaatctcggaggcccttcggatcctgcacatggaggcagtgatgtag

SEQ ID NO: 42794 - DNA, 3612 bp, Artificial Sequence
  Description of Artificial Sequence: Synthetic coding sequence
aaggaccagcagaccgtgatcatgaccgagtgcaccagcctgcagttcgtttcccccttcgccttcgaagcaatgcagaaggtggacgtcgtttgcttggctagtcttagtgaccctgagttgaggctcctgctgccatgcctggtgagaatggctctgtgcgcaccagctgatcagtcccagagttgggctcaggacaagaaattaattttgcggctgttatctggcgtcgaagctgtgaacagcatcgtcgctcttttgagcgtggacttccatgccctagagcaagacgcttccaaggagcagcaactgagacataagctgggaggcgggtcaggagagagcatactggtcagtcagttacaacatggtttaaccctcgaatttgaacactcagactctcctcggcgactacggctggtactgtcggaactgttggctattatgaacaaggtgagtgagagtaacggggaattcttctttaaatcctccgaactgttcgagtcgccagtgtacctcgaggaggcagcagatgtgctgtgcattttgcaagctgaactgccaagtctactgccaattgtggacgtggcagaggcactcctacacgttcggaatggggcttggttcctgtgcttgctggttgctaacgtaccagacagctttaacgaggtgtgtcgcggcttgattaaaaacggagagcgtcaggacgaggaaagtctcgggggacggcggcgcacagatgctcttcggtttttgtgcaagatgaatccttctcaggccctgaaggttcgcgggatggtggtggaggagtgccatctgcccgggctcggcgtggcacttacgcttgaccacactaaaaacgaagcatgcgaagacggagtgtcagacttggtttgcttcgtatctgggttactactcggaactaacgcaaaggtccggacatggttcgggactttcatcagaaacggtcaacaacggaaacgggagacctcgtctagcgtgctctggcagatgcgacggcagctcctgctcgagctaatgggcatactgcctactgtccgatccacccgaatcgtcgaagaggccgacgtggacatggagcctaacgtctctgtttattctggattgaaggaggagcacgtggtgaaagcaagcgccctcctgcgtttgtactgcgctctgatgggcatagccggcctgaaaccaaccgaggaagaggcggagcagctgttgcagttaatgactagccggccccctgccacccccgccggggtgcgatttgtgtccctgagcttttgtatgctccttgccttttctacactggtaagcactcccgagcaagagcagctgatggtggtctggctgtcatggatgataaaagaagaagcatatttcgagtcaaccagtggtgtgtctgcctccttcggggaaatgctactgttggtagccatgtactttcacagcaaccaacttagtgctatcatcgacctggtgtgttccacactggggatgaagatcgtgattaagcccagttctttatccaggatgaagaccattttcacccaggaaatttttactgaacaggtagtgaccgcacacgccgtgcgcgtacctgtcactagcaacctgagcgcgaacattaccggatttctgccaatccactgcatctaccagctgctgagatcaaggtcctttacaaaacacaaagtctccattaaggattggatttaccgtcaactctgcgagacaagcacccctctgcacccacagctcctccctcttatcgatgtatatatcaacagcatcttgactcccgcctcgaaaagtaatcccgaagcgaccaatcagccagtgacggagcaggaaatccttaacatttttcagggcgtaattggcggcgacaatatcaggcttaatcaaagattctcaatcactgcccaactgctggtgctgtattatattctgtcatacgaggaggcactcctggctaacacaaaaaccctggcggcaatgcaacgcaagcccaagagctactcaagtagtttaatggatcaaatcccgattaaattcttgatcaggcaagcccagggcttacagcaggagctaggggggctccattctgccttgcttcgactgttagctaccaattatcctcatctgtgtatagtcgacgactggatctgcgaagaggagattaccgggaccgacgccttgctccggagaatgttgttgaccaacaatgcgaagaatcattctcctaagcaactccaggaggcattttccgctgttcctgtcaataacactcaggttatgcagattatcgagcatctgaccctcttgtccgccagtgagctgataccgtatgccgaggtgctgacaagcaatatgtctcaactgctgaatagtggagtgccccgcaggatcttgcagacagtgaataaactttggatggtgttgaatacggttatgccccgccgcctgtgggttatgactgttaatgcccttcagccttctatcaaattcgtgcggcagcaaaagtatactcagaacgacctgatgattgatcccctcattgtgcttcgctgtgatcagcgcgtacaccgatgccccccactgatggatataacccttcacatgttgaatggctatttgctggccagcaaggcttacctctctgcccacctaaaagagactgaacaggatcggccctctcagaataacacaatagggcttgtgggccagactgacgctcccgaagtgacaagagaagaactgaagaatgccctcctggccgcccaggattcagcagcagttcagatcttgttggaaatctgccttccgacagaggaagagaaggctaacggtgttaatcctgattcgctgctgagaaacgtgcaatcggtgatcactacctccgctccaaacaaaggcatggaggaaggcgaggacaatctgttatgcaacctgcgcgaggtgcagtgtttgatttgctgtctcttacaccaaatgtacattgccgaccccaatatagcgaaactggtgcacttccagggttatccctgtgaattactgcccctcacggtggccggcatcccaagcatgcacatttgtttggatttcattccggaattgatcgcacagcctgagctggaaaagcagatcttcgccatacagctactgagccatctgtgtattcaatatgcgctgccgaagagtctgtccgtggctcgcctggccgtgaacgtcatggggaccctactcaccgtactgacccaggctaagaggtacgcttttttcatgcctaccctcccttccctggtctcgttctgccgcgcctttcccccactgtatgaggatatcatgagtctcctgatccagatcggccaggtgtgcgccagtgatgttgccacccagactagggacatagaccctattatcaccagactgcagcagattaaagagaaaccgtccggttggtcccagatttgcaaggactcctcctataagaacgggtctcgcgacaccggtagtatggatcctgacgtgcagctgtgtcactgtatcgaacggacggtgattgaaatcataaatatgtccgtctccggcatttag

SEQ ID NO: 42795 - DNA, 3615 bp, Artificial Sequence
  Description of Artificial Sequence: Synthetic coding sequence
atgaaggaccagcagaccgtgatcatgaccgagtgcaccagcctgcagttcgttagcccctttgctttcgaggcgatgcagaaagtggatgtggtgtgcctggcctccctctcagatcctgagctgcgactacttctgccttgcttagtacgcatggccctctgtgctcccgccgatcagtcccagagctgggcccaggacaaaaagctcattctgcggctacttagtggggttgaggccgtgaacagtatagtggcgctcttatccgtggattttcatgcactcgagcaagacgcatcgaaagaacagcagctgcggcataaattggggggaggtagcggagaaagcatccttgtgagccagttacagcacggtttaacacttgaatttgagcattctgattccccccgacggctaaggctggtcctgtccgaactactggccatcatgaacaaagtttctgaatctaacggcgagttcttctttaagagtagtgagctcttcgagagcccggtgtatctggaggaagccgcagacgtcctgtgcatactacaggccgagctgccaagtctgttgccgatcgtggatgtcgccgaggccctgctccacgtacggaacggcgcctggtttctctgcctcctggttgccaatgtccctgatagcttcaacgaagtgtgtcgcggactgattaagaatggggagcgccaggacgaggaaagtctagggggaaggcgacgaactgatgccttaagatttctgtgtaagatgaatccatcccaggccttaaaggtccgggggatggtcgttgaagagtgccatctgcccggacttggcgtggcattgactctggatcacactaagaatgaagcttgtgaggacggtgtctctgacctggtatgtttcgtgtctgggctgctgctcgggaccaatgctaaggtcagaacctggtttggaacatttattaggaatggccagcaaagaaagagggagacttcctcctcggtgctctggcaaatgcgcaggcagctactgcttgaactgatgggcattttaccaacggtcagaagcacaaggattgtggaagaggctgacgtggatatggagccgaatgtgtcagtttactccggactgaaggaagagcacgtagtgaaggcctcagcccttttgcggctatactgcgccctaatgggcattgcaggtctcaagcccacagaggaggaggccgaacagctgttgcagttgatgacatctcgtcctcctgccacaccggctggcgtacgattcgtttctctatctttctgtatgctgctcgcctttagcacactggtaagtacccccgaacaggaacagctaatggtggtttggctgagttggatgattaaagaagaggcatatttcgagtcaacaagcggagtgtcagcgtcctttggggagatgctgctcctggtggcgatgtactttcactccaatcagctgtccgcaataatagacttagtttgcagcactctcggcatgaagatcgttattaagccatccagcctgtcccgcatgaaaacgatctttactcaggaaattttcacagagcaggtggttactgcccatgctgttcgggttccagtcacctccaacctcagtgctaatattacaggcttcctccccattcattgcatttatcagttgctccggagtaggtcctttaccaaacataaggtgagtattaaagactggatctatcgacagctttgcgagacctccacccccctgcatccacagctgctcccactgattgatgtgtatattaatagcatcctcactcccgcgagtaaatccaatcctgaggctacaaaccagcctgtgacagaacaggagattctgaatattttccagggggtcatcggtggcgacaacatacggcttaatcagagatttagcatcacggctcaactgcttgtgctctactatattttgtcctacgaggaggccctgctggcaaacactaaaacactggccgcgatgcagcggaagccgaaaagctatagtagttccctgatggatcagatccccatcaagtttcttattcggcaggcccaggggcttcagcaggagctgggaggtctgcactctgctttgctgcgcctacttgcaaccaattacccgcatctatgtatagtcgacgactggatttgtgaggaggagatcacaggcactgacgctctgcttcgtcgcatgctgctgacgaacaacgcgaaaaaccacagcccgaagcagcttcaagaggcgttttcagccgttccagtgaacaatacacaggtgatgcagattattgaacaccttaccttactttcggccagtgaactgataccttatgccgaggttctcacgtccaatatgtcccaactgttgaactctggagtgcctagacggatcttgcagacggtaaacaaattgtggatggtgctgaacaccgttatgccccgacgcctgtgggtgatgactgtcaacgccctgcagccgtccatcaagttcgtaagacagcagaaatatactcaaaatgatctcatgatcgaccccttgatcgtactgagatgcgaccagagagtacatagatgtccacctttaatggacatcacattacacatgctcaacgggtacttactggcctccaaagcctatctctcagctcacctgaaagagacagagcaggatcggccaagtcaaaacaacactattggcctggtgggccaaacagatgctcctgaagtgacccgggaggagttgaaaaatgctttactggctgcccaggattccgctgctgtccagattctgttggaaatctgcttaccaaccgaagaggaaaaagctaatggggtgaatcccgactccctgcttcggaacgttcagagcgtgattacgactagcgcccctaacaagggcatggaggagggggaagataatttattgtgtaacctgcgagaagttcaatgcctgatttgctgtctgttacatcagatgtatattgccgatccaaatatcgcaaagctcgtgcactttcaagggtacccttgtgagcttttgcccttaaccgtggcaggaattccatctatgcatatctgcctggacttcatacccgagttgattgcccagcccgaattggaaaagcaaatattcgccattcagctcttgagtcacctgtgcattcaatacgccctgcctaagtcattgagcgtggcacggctcgcggtcaacgtgatgggtactctgctgactgtactaactcaggccaagcggtatgcattttttatgccaaccttaccatctctggttagtttctgccgagcatttccccccctctacgaagacataatgagcctgttgatacagatcggacaggtatgcgcctcggacgtggcaacgcagacaagagacatcgacccaatcatcacacggctgcaacagatcaaggaaaagccaagcgggtggagccagatctgtaaagatagctcctataagaacggcagccgcgataccggcagtatggatccagacgtgcagctgtgccattgcattgaacgcaccgtgatagagattatcaatatgtcagtttcagggatctag

SEQ ID NO: 42796 - DNA, 3060 bp, Artificial Sequence
  Description of Artificial Sequence: Synthetic coding sequence
atgagcgccctgtgcgacccccccggcgcccccggcccccccggcccagcaccagctacccatggcccagccccgctttcggctcaggagctgagccaggagatcaaagcattcttgactggcgtcgaccctatcctcgggcatcagttatccgctagggaacacgctaggtgcgggctgctgctgctccggagccttccccccgcccgggcggccgttctggaccatctccggggcgtgttcgatgagtctgtgcgcgctcatctcgccgctctggacgagacaccagtcgccggccctcctcatctgaggccgccacccccttctcatgtccccgctggcggtcctggcctggaagacgttgtccaagaagtccagcaagttctctctgagtttatccgcgccaatccaaaagcctgggccccggtaatctctgcctggagcattgatctcatggggcagctcagctcaacctactcaggccagcaccagagagtgcctcacgccactggcgctctcaatgagctcctgcaactatggatgggttgccgagccacgaggaccctgatggacatttacgtacagtgtctatcggcactgataggttcatgcccagacgcatgtgttgacgctctgctggacacctctgtgcagcattccccccattttgactgggtcgtggcccacatcggatcaagcttcccgggaacaatcattagcagggtgctgtcctgcggccttaaagacttctgtgtgcacggcggagcagggggcggggctggcagttcgggagggtcttcctcacagacaccctctaccgacccttttccgggaagcccggccattcccgctgagaaaagggtgcctaaaatagcttccgtggttggaatcctgggtcacctggcctcgcgccatggggattccattcggcgcgagctgcttagaatgttccacgattccctggccggaggaagcggcgggagatcgggcgatccctcgttacaggccacagtgccctttttgctgcagctggcggtgatgtctcctgctctcctcgggacagtgagtggtgagctggtagattgtctcaagccccctgctgtcttgtctcagctgcaacagcatttacagggtttccctagagaggaactcgacaacatgcttaaccttgccgtgcatctcgtgagtcaggcctccggggcaggagcatataggttactgcagttcctagtggatacggcaatgcctgccagcgtaatcaccacacagggcctggctgtcccagacacagtacgtgaggcttgcgatcggctcatccagcttctgctgctccatctgcagaagctggtgcatcatcggggtggtagtcccggggaaggtgtcctcgggcccccccccccgccccgcctggttccatttctggacgcactgaaaaaccacgtcggagaactgtgcggtgagactctcaggctggaacgcaagcgcttcctgtggcagcaccagctgctcgggctcttatcggtgtacacacgcccatcctgcggccccgaggcgctggggcaccttctatcccgcgctcggtcccctgaagagttgtctctggctacccagctgtacgccggccttgtggttagcctgtccggcctgttgcctttagccttcagaagctgcttagcccgcgtacacgcaggcaccttgcagcctccttttactgccaggtttttacgcaaccttgccctgctggtcggctgggaacagcaaggtggagagggcccagctgctctgggagcacactttggggagagcgcaagtgcccatctctcagacctcgcacccctcttgctgcaccctgaggaagaagtagccgaagcagctgcatctttacttgcaatctgtccgttcccttctgaagcgttatcacctagccagctgctgggtcttgtgagggctggtgtccaccgcttttttgcgtccctacgactgcacggccctccaggcgtggccagcgcttgccagctgctcacccggctctctcagactagtcccgccggattgaaagccgtcctgcagctgctagtggaaggggcgttgcacagaggaaacaccgagctgtttggaggccaggtagatggggacaatgagactctctccgtcgtgtccgcctctcttgcctcagcatcactgcttgacacaaatagaaggcacacagccgcggtccccggacctgggggcatttggtccgtatttcacgctggggtgatcggacgcggtctgaagcctcctaagttcgttcagagtcgtaaccaacaggaagtcatctacaacacccaatccctgctgtccctccttgtgcattgctgctccgcgcctggcggcactgagtgcggcgagtgctggggtgctcctatccttagcccagaggccgctaaagcggtggcagtgaccttagtggagtctgtgtgcccggacgcggcaggcgcagagctggcctggccgcccgaagagcacgcacgcgccacagtagaaagagacctccgtatcggcaggaggtttcgagagcaaccactgctgttcgagctgttgaagttggtggcagcagcacccccggcactgtgttactgctcagttttactccgaggtctgttagccgctctccttggccactgggaagcttctcggcatccagacactacacatagcccctggcacctagaggcaagttgcacgctggttgccgtaatggccgaaggctctcttttgccgcccgcgctcggcaacatgcacgaggtgttctctcagcttgctccatttgaggtaagactgctcctgctctctgtatggggtttcctcagggagcacgggccgcttccccagaagtttatattccagagtgagcgtggcaggttcatacgggatttttcgcgagaaggaggtggcgagggaggtccgcacctcgctgtactccactctgttttgcaccgcaacattgatcgtttaggtctgttctccggcagatttcaggccccctctcctagcacccttctgcgccagggtacttag

SEQ ID NO: 42797 - DNA, 1659 bp, Artificial Sequence
  Description of Artificial Sequence: Synthetic coding sequence
atgctggaccacaaggacctggaggccgagatccaccccctgaagaatgaggagagaaaaagccaggaaaatctgggcaaccccagtaagaacgaagacaacgtgaagtccgccccgccgcagagtcgcctctccagatgtcgcgctgccgccttttttctgagcttattcctgtgcctttttgtggttttcgtggtttcctttgtcatcccctgtcctgataggccagcctcgcaacgtatgtggaggattgattactccgccgctgtgatctatgactttctcgctgtggatgatatcaatggcgatagaatccaggatgtgctgtttctgtacaaaaacacaaattcctcaaacaacttcagccgaagctgcgtcgacgagggcttttcaagcccttgcacattcgccgccgccgtgtctggggcaaacgggagcaccttgtgggagcgaccagtggcacaggacgttgccctggtggaatgtgccgtaccgcagcctcgcgggagcgaagccccttccgcctgtattctcgtcggcaggccctccagttttatcgcagtgaacctatttaccggggagaccctatggaatcattcctcctcattcagcggaaacgcaagtattctttcacctctcctccaagttcctgatgtggacggcgatggggccccggacctgttagtcctgacccaggaaagggaggaagtcagcggacatctgtactctggatccacaggccaccagataggtttacggggctccctgggagtggacggagaatctggtttcctgctccatgtgacccgaacaggggcacactacattctttttccctgtgctagcagcttatgcggttgtagtgtaaagggtctgtacgagaaggtaacaggcagcggaggaccatttaaatctgatccacattgggagtctatgctgaacgctaccactagacgcatgctgtcacatagcagtggcgcagtacgatatctcatgcacgtgcccggtaacgcaggtgccgacgttctcctggtaggcagcgaggctttcgtgctgttggatggtcaagagctgactccacgctggaccccaaaagccgcccacgtgctcaggaagccgatcttcgggagatacaagccagacacattagcagttgccgtcgaaaatgggaccggcaccgaccgccagatactattcctggaccttggcaccggggccgtgctttgctcattggcactgccgtcccttcccggagggcctctcagtgcctcactccctacagccgaccacagatcagctttttttttttgggggctccatgagcttggttctacatcggaaaccgagaccggtgaggccagacactccctgtatatgttccaccccacgctgccccgagtactgctggagttagcaaacgtcagcacccatatcgtggcttttgatgccgtcctctttgaaccatcccggcacgctgcttatatcctgttgacggggccggccgactccgaggcaccagggttggtgtcagtcatcaagcacaaggtgcgcgatttagttccatcgtccagagtggtgcggttaggggaggggggaccagactcggaccaggccattcgcgatagattctcgcgcctgcgctatcaatccgaggcctag

SEQ ID NO: 42798 - DNA, 1659 bp, Artificial Sequence
  Description of Artificial Sequence: Synthetic coding sequence
atgctggaccacaaggacctggaggccgagatccaccccctgaagaatgaagagcgcaaatcccaggaaaatctagggaatccttccaaaaacgaggacaacgttaagagcgccccaccgcagtcccggctgtcccgttgccgggccgctgcgttttttctcagtctgtttctgtgtctgttcgtggtgttcgtcgtcagcttcgtcatcccctgccccgatagacccgcctcccaacgcatgtggaggattgactactctgccgccgtaatttatgatttcctggccgtggacgacattaatggcgatcgcattcaagacgtgctgtttctttataaaaatactaattccagtaacaatttctccagaagctgcgtggatgagggattctcttcaccatgcaccttcgcagccgctgtaagcggggctaatgggtccaccttgtgggaacgtcctgtcgctcaggatgtggctttggttgaatgtgcagtgccccagccccgcggctcagaagctccttccgcctgcattctcgttgggcgccccagcagctttatcgcagtcaacttgtttacaggtgagaccctatggaaccatagctcttctttctctggaaacgcatccatcctatcccctctgttgcaggtgccagatgttgacggcgatggcgctcccgacctgctggtgctgacgcaggagcgtgaggaagtctccggtcacctgtactccgggtcaaccgggcaccagataggactgcgcgggagcttaggggtggatggcgagtctgggtttcttctgcacgtgacacgcacaggcgcccactatatactcttcccgtgcgctagtagtttgtgtgggtgcagcgttaagggcctgtacgaaaaggtgacaggatcaggcgggccttttaagtctgatcctcactgggaaagcatgcttaatgcgaccacgagaagaatgctgagtcattcatccggcgccgtccgatatcttatgcacgtcccaggtaatgcaggcgctgatgtgttattggtgggaagcgaggcctttgtgctcctggacggtcaggaattgacccctaggtggacacctaaggctgctcacgttctgcgcaagccaatatttggaagatataagccagatactcttgccgtggccgttgagaacgggactgggactgatagacagatccttttcctcgatctggggactggggcagtgttgtgctctctcgcactgccatctttgccaggaggaccactgagtgcctcactccctacagctgatcatcgttctgcgttctttttctgggggttgcacgagctgggtagtacctccgaaacagaaactggagaggcacggcatagtctgtatatgtttcatcccactcttcctcgcgtgctactcgaactggccaatgtgagtactcatatcgtggcgtttgatgccgtcttattcgagccctcccgtcacgccgcttacattctgttaacaggccctgctgactctgaggcacccggactggtgtcggtgatcaagcacaaagtgagggatttggtgccaagctctcgcgttgtgcgactcggcgaggggggccctgatagcgaccaggccatccgcgaccgattttcaagactgagataccaaagcgaggcctag

SEQ ID NO: 42799 - DNA, 210 bp, Artificial Sequence
  Description of Artificial Sequence: Synthetic coding sequence
atgctggaccacaaggacctggaggccgagatccaccccctgaagaacgaagaaaggaaatcgcaggagaatctcgggaacccctcaaagaatgaggataacgtgaagtccgcgcctccacagtccagactcagtaggtgtcgggctgcggccttttttttgagtctatttttgtgtctttttgtcgtgttcgtcgtaagtttcgtatag

SEQ ID NO: 42800 - DNA, 309 bp, Artificial Sequence
  Description of Artificial Sequence: Synthetic coding sequence
atgctggaccacaaggacctggaggccgagatccaccccctgaagaacgaggagaggaaaagccaggaaaacttgggcaacccatccaagaacgaggataatgtgaagtcagcaccccctcaatccagactgtcccggtgccgggcggccgcattttttctgtctctgtttctgtgcttgtttgtcgtctttgtggtgagtttcgtgattccttgtccagatcgccccgcgtctcagaggatgtggcgcatcgactactcagcggccgtgatttacgatttcctcgctgtcgatgatattaatggctag

SEQ ID NO: 42801 - DNA, 702 bp, Artificial Sequence
  Description of Artificial Sequence: Synthetic coding sequence
atgctggaccacaaggacctggaggccgagatccaccccctgaagaacgaggaacgtaaatctcaggaaaacctgggaaatccatccaagaatgaggataacgtgaagtcagctcccccacagtcaagactgagccgctgccgcgcagccgccttttttctgtcgctgttcctttgtttatttgttgtgttcgtcgtctcattcgtgataccttgtcccgaccgcccggcttcacagagaatgtggcggatcgattatagcgccgctgtgatatacgatttcctggcagtggatgacatcaatggagatcgaatccaggacgtgctgttcctgtataagaatacaaactccagtaacaacttcagtaggtcttgcgttgatgaaggcttctcgagcccctgtacctttgctgcagctgtgagcggggcgaatggttccactctgtgggagaggcctgtcgcccaagatgtggctttagtggaatgtgccgtgccccagccaagagggagtgaggctcctagtgcctgtattttagtgggcagacccagttcctttatcgccgtcaacttgttcacaggggagacactatggaatcactcttcttcattctcaggcaacgcctccattttgtcacccctgctgcaagttccggacgttgatggcgatggggcccccgatctgctggtgcttactcaggagtag

SEQ ID NO: 42802 - DNA, 156 bp, Artificial Sequence
  Description of Artificial Sequence: Synthetic coding sequence
atgctggaccacaaggacctggaggccgagatccaccccctgaagaatgaggaacgaaagtcccaggagaacctcggtaatccctctaaaaatgaggataacgtgaagtcagctcccccacagagccggttatcacgatgcagagctgcggcctag

SEQ ID NO: 42803 - DNA, 1596 bp, Artificial Sequence
  Description of Artificial Sequence: Synthetic coding sequence
atgctggaccacaaggacctggaggccgagatccaccccctgaagaacgaggaacgaaagtctcaggagaatctgggtaatccttctaaaaatgaggacaatgtgaaatctgctcctccacagtctaggctgtctcgctgccgagccgccgcattttttctcagcctgtttctgtgtctatttgtggttttcgtggtgagtttcgtcattccctgtcccgatcgaccggccagccagcggatgtggagaatcgattacagtgctgctgttatttatgactttctggccgtggacgatatcaacggcgatcgcatccaggatgtgctctttttgtacaagaacaccaacagctctaacaacttcagtcgctcttgtgtggacgaagggttcagcagcccatgtactttcgccgccgcggtgagtggcgccaacggatcaacactgtgggaacggccggtcgcccaggatgtcgctctggtagagtgcgccgttccccagcctcgggggagtgaggcccccagcgcatgtatcctggttggtaggccctcaagttttattgccgtcaacctttttactggagagaccctatggaatcactcgagcagttttagcggcaatgcatctattctgagccctctgctgcaggttccagacgtggacggggatggggccccagacctgctggtactcacccaagaacgggaggaagtgtctggtcacttatatagcgggagcacaggacatcagatcggtctgagggggtctctgggtgtagacggtgagtccgggtttctcctccatgtgactagaaccggagcccactacattctgtttccctgcgctagcagtctttgcggctgttccgttaagggcctgtatgaaaaagttacaggctctggaggccccttcaagagcgatccacactgggaaagtatgcttaacgccaccacaagaagaatgctctcccactcaagtggagccgttagatacctgatgcatgtgccagggaatgccggggccgacgtcctgttagtcggtagcgaggcattcgtgctgctagacggccaagagctgactcccaggtggacacctaaggcggctcacgtgctgcgcaagcccatctttggacggtataagcccgatacactcgcagtagccgtggaaaatgggacaggaacagataggcagattctttttctagaccttgggactggggcagtgctgtgctctttggcccttcctagcctgcctggggggccactgtccgcatccctacccaccgctgatcatcgttccgccttctttttttggggactgcatgaattgggatctacgtccgagacagagacaggagaagcccgccacagcctgtacatgttccaccccacactgccacgggttctgctggagttagcaaatgtgagcactcacatcgtcgcctttgatggatcacactgggcgacagctgagcggttgctggatggcgcagagctggcccctcggcccgcgtgccccagacttgtaacaggcgtgtgggaggccgctaggttgtgtatacttctgcccggtattaggtggctgatttactggttctag

SEQ ID NO: 42804 - DNA, 264 bp, Artificial Sequence
  Description of Artificial Sequence: Synthetic coding sequence
atgctggaccacaaggacctggaggccgagatccaccccctgaagaacgaggagaggaagagccaggaaaatctcggaaatcccagtaaaaatgaggataacgtgaaatccgcaccaccccagagcagattgagccgttgccgcgctgccgctttcttcctctctcttttcctgtgcctgttcgtggtcttcgtggtgtccttcgttattccttgtcctgatagacctgccagccagcgtatgtggaggattgactactcctag

SEQ ID NO: 42805 - DNA, 1623 bp, Artificial Sequence
  Description of Artificial Sequence: Synthetic coding sequence
atgctggaccacaaggacctggaggccgagatccaccccctgaagaatgaggaaaggaaatcccaggagaatctcggtaatccaagtaagaatgaggacaatgtcaagtccgcccccccacagtctagactcagtcgttgccgagccgccgccttctttttaagcctattcctctgcctcttcgtagtatttgtggtgtctttcgtgatcccatgccccgacaggccggcttcacagagaatgtggcgcatagattatagtgcggctgtgatctacgacttcctggccgtcgatgatatcaacggggacagaatacaagacgtcctcttcttatataagaataccaacagcagcaataatttctctcgttcttgcgtggacgaaggatttagctcgccatgcactttcgctgctgctgtaagcggggctaacggcagtaccctttgggagcggccagtggcccaagacgttgcattagtggagtgtgcggttccccagccccggggctcagaagccccgtctgcttgcattcttgtggggcggccgtccagttttatcgccgtgaacctgtttacgggcgagactttgtggaatcactcttcttccttttctgggaacgccagcattctctctccactgctgcaggtccccgacgtcgatggtgatggagcccccgacctgttagtgcttacacaggagcgcgaagaggtgagcggacacctctactctggctccactggtcaccagattgggctgagaggatctctgggagttgatggagagagtgggttccttctgcacgtgacaagaaccggcgcccattacattctatttccatgcgcttcatctctgtgcggctgttcagtgaagggcttgtatgagaaggttaccggtagcggaggtccatttaagagcgacccgcattgggaatccatgctaaatgccaccaccaggagaatgcttagtcactcatccggtgcagttcggtatctcatgcacgtgcccgggaatgcaggcgccgacgtacttttggtgggatcagaagccttcgttctcctggatggccaggaactgacccctaggtggacacctaaagcagctcacgtactgcggaagcctattttcgggcggtataagcctgatacgctagcagtcgccgtagaaaatggcaccggaaccgaccgacagattctcttcctggatctggggacaggggccgtgctctgcagcctggcattgcctagcctgccaggtggccctctgtctgcttcactcccaaccgctgatcatcggtctgctttctttttttgggggctccacgagctgggaagcaccagtgagactgagactggagaggcaagacacagcctctatatgttccatcccaccctccccagagtcctgctcgagcttgctaatgtttcgacccacatcgttgcctttgacgccgtgctgtttgagcccagccggcatgctgcctacatcctgttaactggacctgcagactctgaggccccaggcctggtgagtgtgattaagcataaggcccatacgggccgccagcgccgcggctcatggacgggccagagttcgaggcgcgacttgcacgtgagggttttgtag

SEQ ID NO: 42806 - DNA, 711 bp, Artificial Sequence
  Description of Artificial Sequence: Synthetic coding sequence
atgctggaccacaaggacctggaggccgagatccaccccctgaagaatgaagagaggaaatcacaggagaatcttggaaacccatctaagaacgaagacaatgtgaagtctgcccctccacagagcaggttgtcaaggtgtagggccgccgcctttttccttagcttgttcttatgcctgtttgtagtctttgtggtctcttttgtcattccatgtccagataggcctgcctcacagcgtatgtggaggatcgactatagtgccgccgtgatctatgactttttagccgtagacgacattaacggagacaggatccaggatgttttattcctgtacaaaaacactaactcatccaacaacttttctaggtcctgcgtggatgaggggttttcatcgccctgtacctttgccgctgctgtgtccggcgctaacgggtcgactctttgggagaggcctgtcgcccaagatgtggccctcgtggagtgcgcagtccctcagcctcgaggctctgaggctccctctgcttgtatcctcgtgggacgaccatcctcttttatcgcggttaacctgttcacaggagagaccctgtggaaccacagcagttcatttagtgggaacgcaagcatactgtctcccctgctacaggttccagatgttgatggtgacggcgctcctgacttacttgtactcactcaggagagagaggaatag

SEQ ID NO: 42807 - DNA, 3504 bp, Artificial Sequence
  Description of Artificial Sequence: Synthetic coding sequence
atggagctgcccttcgtgacccacctgttcctgcccctggtgttccttaccggtctgtgcagcccattcaacttggacgagcatcacccaagattatttccggggccccccgaggctgaattcggatactcagtgcttcagcacgttgggggaggacagcgttggatgctcgtgggtgctccatgggacggcccctcaggcgacaggaggggggatgtgtacaggtgccccgttggtggagcgcataatgccccctgcgcgaagggtcacctgggagattaccaactgggcaatagcagccatccagcagtcaatatgcatctggggatgtcactgttggagaccgacggagatgggggattcatggcctgtgcgccactctggtctcgggcttgtggtagtagcgtatttagctccggcatttgcgctagagttgacgcaagctttcaaccgcagggctccctggccccgacggcccagcgctgtcctacgtacatggacgtagtgattgtgctggatggctcaaattccatctacccctggtcggaggtgcaaacgtttcttcgccgccttgtcggcaaactgtttattgaccctgaacagatccaggtgggccttgtgcagtacggtgaatcacctgtacacgaatggagcctgggggattttagaactaaagaggaagtggtgagggccgcgaaaaacctgagccgtagagaaggacgagaaaccaaaactgcacaggcgattatggtggcatgtacagagggcttctcccagtcgcacgggggacgccccgaggccgctagattgctggtagtggttaccgacggcgagtcccatgatggtgaagagctccccgcggccctaaaagcctgcgaagccggacgtgtcactaggtacggaatagccgttttgggccactaccttagacgtcagcgggatcccagtagtttccttagggaaatccgaactatcgcttctgaccctgatgaacggttcttcttcaatgtcaccgacgaggccgcactgaccgacatagtggatgccctgggagacagaattttcggcctggaaggcagccatgctgaaaacgagagctcttttggcttagagatgtcgcagattggattcagcacacatagactgaaggatggcatcctgttcgggatggtcggcgcttacgattggggcggctctgtgctgtggcttgaaggagggcacagattatttccgccgagaatggctctcgaggacgaattcccccccgcactgcagaaccatgcagcctacctgggatattccgtctcgtcaatgctgctccgcggaggccggcgactgtttttgagcggtgctccccggttccgtcatcgcggaaaagttattgccttccagctgaagaaggacggcgcagtgcgcgtggcccaaagtctacaaggggaacaaatcggaagctactttggctctgagctttgcccactcgataccgatagggacggcactaccgacgtgctacttgtagctgccccaatgttcctaggcccccaaaataaagagaccggtagagtttacgtgtacttggtagggcagcagagcttactgacccttcagggcacacttcagccggagccgccacaagacgctcggtttggctttgcaatgggggccctcccggatctgaaccaggatggctttgcggatgtggcagtcggagcacctcttgaagatggtcatcaaggcgccctgtatttgtaccacgggacgcagagtggggtcaggcctcacccagcccagcggattgcagcagccagcatgccccatgcactatcctacttcggaaggagcgtggacggacggctggacctggacggtgacgacctggttgatgtggccgtcggtgcacagggtgccgctatccttcttagctccaggcctatcgtgcacctgacaccgtcccttgaagtgacaccacaggctatatctgtggtgcaaagagactgccgcaggcgcggacaggaagccgtgtgtctgaccgctgctttatgtttccaggtgacaagtagaacaccagggcgttgggaccaccaattctacatgcggttcactgccagcttggacgaatggaccgcaggcgcacgcgctgcatttgatggttccggacagagactcagcccacgtaggctgcgcctgagtgtgggaaatgtcacttgtgaacaattgcatttccacgtgctagacacttctgactacttgagacccgtagcgctgacagtcaccttcgctctggataatacaacaaaaccaggaccagtgttaaacgagggatcgcccacaagcatccagaagctcgtgcccttctccaaagactgcggcccagacaacgagtgcgtaactgaccttgtgttacaggtcaacatggacattagaggctcgaggaaggctccattcgtggtgcgaggtgggcgccggaaagtgcttgtgtccacaacactagaaaacagaaaagagaatgcctacaacacatcgctttcactgatcttttcaaggaatttgcacctagcctctctgacaccacagcgagaatctccgattaaggtcgagtgcgctgcacccagtgctcacgcccgactctgctcagtgggccaccctgttttccagaccggggcaaaagtaaccttcctgctcgaattcgagttctcctgctcatcgctcctatctcaggtgttcgtgaagctcacagctagctcagactccctggaaaggaacggaacgcttcaggacaacaccgcccaaaccagtgcttacatacaatatgagccacacctgctctttagtagcgagtctaccttgcacagatatgaggtccatccatacggaaccctgcccgttggcccgggtccagaattcaaaacaacattgcgtgtgcaaaacctggggtgttatgtggttagcggtctgatcatcagcgcgttattgcccgcagtggcccacggcggcaattattttttgagcttgtcgcaggtgatcacgaacaacgccagctgcatcgtgcagaatctcactgagcctcctgggccccctgtgcaccctgaggaactccagcatacgaatcggctaaacggctctaacacacagtgccaggtggttcggtgtcatctcggtcaattggccaaaggtacggaagtgagtgttgggctcctgaggctggttcataatgagttcttccgaagagctaagttcaagtcactgacagtggtgtcaacctttgaattgggcacagaggaaggtagcgtcctgcagctgacagaagcgagccggtggtccgagtctctcctggaggtagtgcagactaggcctattctgattagtctgtggatcctgatcggcagtgtccttggtggcctcttgctcctcgcactgctagtgttttgtctgtggaagttagggttcttcgcccataagaagattccagaggaggagaaaagagaagagaagctggagcagtag

SEQ ID NO: 42808 - DNA, 3111 bp, Artificial Sequence
  Description of Artificial Sequence: Synthetic coding sequence
atgaacatcacccacgcctacagccagggccaccagaagctgaacctggacacagttagctacaatatgctcggagtggattctgacggctgccctacctacatggacgtggtgatcgttctggatggttctaacagcatctatccttggtccgaggtccagacttttttgaggaggctagttgggaaactcttcattgaccccgaacagatccaagtgggcctggtgcaatacggcgagtcgcccgtgcacgaatggtctctgggcgattttcgaacgaaggaggaagtcgttagggccgccaagaacctgtctcgcagagaagggagggagacgaaaactgctcaggcgataatggttgcctgtactgaggggttctcccagagccacggcggtcgacccgaggccgctcgcttattggtggtcgtgaccgatggggaatcacatgatggcgaggagctgcctgcggcattgaaggcttgcgaagccgggagagtcacccgatatggcatcgctgtattaggacactatcttcgccgccaacgcgatccctcttctttcttgcgcgagatccggacaatcgctagcgatcccgatgagcggttcttttttaatgtgaccgatgaagctgctctcactgatatcgtagacgctttaggggaccgaatctttggccttgaaggcagccacgcagaaaacgaaagtagcttcggactggaaatgagccagattggcttctctactcatcgcctgaaggacggaatactttttggcatggtcggggcctacgattggggtggatccgtcttatggctggaaggtgggcatcgccttttccctccacggatggccctggaggacgaattccctcccgccttacaaaatcacgcagcgtacctagggtatagcgtgtcgtctatgctgctccgcggcggtagacgactgtttctgagcggagcacccagatttcgccacaggggaaaagtgatcgctttccaactgaagaaggacggggctgttagagtggcccaaagcctccagggcgaacagattggctcatacttcggatcagagctctgtccactggacacggatcgtgacgggacgacagatgtcctcttggtggccgcccccatgttccttggcccacaaaacaaggagacaggcagagtttatgtctacctagtgggacaacagtcgctgttgacactgcagggaacactccagcccgagccaccccaggatgccagattcggcttcgcaatgggcgccttacccgacctgaatcaggatgggtttgctgacgtagcagttggagctcctctcgaggacggccatcagggagctctgtatctctatcatggcacacagtcaggagttagaccacacccggcgcaacggattgccgccgccagtatgccccacgctctctcttacttcggtcgctccgtggacggacgccttgatctcgacggcgatgatctcgtggacgttgctgtgggggcccagggcgcagcaatcctactctcctcgcgacccattgtacacttgacaccctccttggaggtcactccccaggccataagtgtggttcagcgggattgcaggaggaggggacaggaagcagtatgtctgacagccgccctctgttttcaggttacttcccgtacccctgggagatgggaccaccagttctatatgaggttcactgccagtcttgatgagtggacagcaggtgctcgcgccgcttttgatggcagcgggcagagactgtccccccggcgtctgcggttgtcagtcggtaacgtaacttgtgagcagctgcactttcacgtgttggatacatcagattatctccggccagtggccctgacagttaccttcgctctggataatactacaaaaccgggacctgtccttaatgaaggttcccctacatcaattcagaagctagtgcccttcagcaaggattgtggccctgacaacgaatgtgtcacggatctggttctgcaggtgaacatggacatacgcggctctcgcaaggctccattcgtcgtgcgcggtgggaggaggaaggttctcgtgtcaacaaccttagagaatcgcaaggaaaacgcctacaacacgtctctgtcacttatcttcagcaggaacctgcatctggcctcactgactccacagcgcgaatcccccattaaagtggagtgtgcggctccttccgctcacgctaggctttgctccgtgggccatcccgtgtttcagacaggcgccaaagtcacattcctactggagttcgagttcagctgcagttctctcctgagtcaggtctttgtgaaattgactgcatctagcgactcactggagaggaacggaactctgcaggacaataccgctcagactagcgcctacatccagtatgaaccccacttgctcttcagctccgagtccacacttcacaggtacgaagtccatccatatgggacactccccgtaggtccgggcccagagtttaagacaaccctccgcgtgcagaacctgggatgctacgtggtgtcaggcctgattatttcggctcttttgcctgcagttgctcacggcggcaactattttctgtctctatctcaggttattactaataatgcaagctgcatcgtgcagaatctgaccgaacctcctggaccacccgttcatccagaggagctgcagcatacaaatcgcctcaatgggtctaacactcagtgccaggttgtgcggtgccacctaggccagctggccaagggtactgaagtctctgtagggctattacggctcgtccacaacgaattttttcgacgggccaagtttaagtcccttacggtggtgtcaacgttcgagctggggacggaggaagggtccgtcttacaactgaccgaggctagccggtggtctgaaagcctgctcgaggtggtgcagacacgccccatactcatctccctctggatcctgatcggctctgtgctgggggggttgctcctgctcgctcttctcgtcttctgcttatggaagctgggtttttttgcccataagaaaatcccagaggaggagaagcgtgaggagaaactggagcagtag

SEQ ID NO: 42809 - DNA, 3075 bp, Artificial Sequence
  Description of Artificial Sequence: Synthetic coding sequence
atggagctgcccttcgtgacccacctgttcctgcccctggtgttcttaactggctgccctacttacatggatgttgtcattgtcctggacggttccaattcaatttatccgtggtcggaagtccagacgttccttcgcagactggtgggaaagctttttattgacccagagcagatacaggtcggcctcgttcagtacggagagagtcccgttcatgagtggtctctgggagacttcagaacaaaagaagaggtggtccgggcagcaaagaatctttctagaagggagggtcgggagactaagactgctcaggcgataatggtcgcctgtaccgaaggtttctcacagtcgcacggaggccgacctgaagctgcccggctcctggtggtcgtgacagacggtgagtcacacgatggtgaggagcttcctgctgctctgaaggcttgcgaagccggcagagtgacgcgctacgggatcgccgtgctgggacactacctccgaaggcagagggaccctagctcttttctgagggagataaggactatagccagtgacccagatgaacggttttttttcaacgttactgatgaagcagctctcactgacattgtggatgctctgggcgacagaatttttgggttagagggcagtcacgcagagaacgagtccagctttggattagaaatgagtcagattggattctctactcatagattgaaggacgggattttgtttggcatggtgggagcttatgactggggagggtcagtcctgtggctcgaaggggggcaccgcttgtttccccctcgcatggcgcttgaggatgagttcccgcctgcactacagaaccatgctgcgtacctcggatattccgtgtctagtatgcttttacgcggaggccgccggttgtttctctccggagcaccacggttccgacatcgaggcaaggtgatcgcctttcagctaaagaaagatggcgccgtccgggtggcacaaagcctgcagggtgaacagatcggctcttactttggctccgaactttgccccctggacactgaccgtgacgggaccacagacgtcctgctggtggcagcccccatgtttctcggacctcagaacaaggagaccggacgggtctatgtgtacctagtggggcagcagtcactgctgactctccagggcactctacagcccgagcccccgcaggatgcaaggtttgggttcgcgatgggcgcgcttccagacttgaatcaagacggctttgctgatgtcgcagtaggcgcccccttagaggacgggcatcaaggggccctctatttgtaccatggcactcagtcaggagttcggccccacccagcgcagcggatcgctgcagcatctatgccccatgcgctctcatactttgggcgttctgtcgatggacggctggatttggatggggatgatttggtcgatgtggctgtcggggctcagggcgctgcgatcctgctgtcttcccgtcctattgtgcatctgacgccatctctggaagtgactccgcaggccatcagtgtggtgcaaagagattgtagacgacggggacaggaagccgtctgcctgaccgcagctctgtgtttccaagtaacttcacggactccaggccgctgggatcatcaattttacatgagatttactgcatctctggacgaatggacagccggcgcccgagctgcttttgacggtagtgggcagcgcctcagcccccgacgcctgcggctgagcgtcggcaatgtaacatgtgaacagttgcattttcatgtgttagacactagcgactacctaaggccagttgctctcacagtcaccttcgcgctggacaacacaaccaaaccaggaccagtcctgaatgaggggtcgccgaccagcattcagaagctcgtgcctttttcgaaggattgtggacctgataatgagtgcgttaccgatctggttctgcaagtgaacatggatatacgaggcagcagaaaagcccctttcgtggtcagaggaggaagaaggaaggtcctggttagcaccaccctggagaacagaaaagaaaacgcatataacacaagtctcagcttgattttcagtaggaacctacatctggctagtttaacaccacaaagagagtcaccaatcaaagtggaatgtgccgcaccaagtgcacacgccaggctgtgttcggtgggccatcctgtgttccagacaggcgccaaggtgacgttcctgctggaattcgaattcagttgcagctcactgctgtcccaggtgttcgtcaagctaactgcatcttccgattcactcgagcgcaatggaacactgcaagataatactgcacagacaagcgcctacattcaatacgagccccatctgctgttttcaagtgagtctacccttcaccgctacgaggtgcacccatatgggacactgccggttggtcccgggccagagtttaagacgacactgagggtccagaatctgggctgttacgtcgtatctgggttgatcatcagtgccttactacctgcggtcgcgcacggcggcaactactttctgtcactgtcccaggtcattacaaacaatgccagttgcattgtgcagaaccttacggaacctcccggccccccagtgcacccggaggagctccagcatacaaatcggctgaatgggtcaaatacccaatgccaggtggtgagatgccatctggggcagcttgcaaaagggactgaggtgtcggttggtctgttgcgtcttgtgcataacgaattctttcggcgggctaagtttaaaagtctgactgtggtgagcaccttcgagctggggacggaagagggttcggtgctacaattgacagaggcctcccgctggtccgagagcttgctcgaggtagtgcaaacccggcctattctgattagtctttggattctcatcgggtctgtactggggggtctcctgctgctagccctcctcgtgttctgtctctggaagctgggtttcttcgcccacaagaagatccccgaagaagaaaagagagaggagaaattggaacagtag

SEQ ID NO: 42810 - DNA, 3288 bp, Artificial Sequence
  Description of Artificial Sequence: Synthetic coding sequence
atgaacatcacccacgcctacagccagggccaccagaagctgaacctggacactgtgagctacaacatgctgggtgtggattcggatggatgctggtgggctccccctggcatgggcctgcaggccacgggtgggggggcacacaacgccccttgtgccaagggtcatttaggtgattatcagctaggcaactcctcccaccccgccgtgaatatgcatctcggcatgagtctgttggaaaccgacggagacggagggtttatggcgtgcgctcccctctggagccgcgcctgtggatcctctgtcttttcctccggcatctgtgctagggtggacgctagctttcaacctcaagggtccctcgcacctacagctcagcgctgccccacgtatatggacgtagttatagtcttggatggatccaatagtatctatccttggtcagaagtgcagacattccttcggaggctggtgggaaagctttttattgatccagaacaaatccaggtgggtctggtacaatacggagaatcaccggtgcacgagtggtctcttggcgacttccggacaaaagaggaggtcgtccgcgccgccaagaacctctcgagacgcgagggcagggagactaaaaccgcccaggcaattatggtggcttgcaccgagggcttcagccaatctcacggaggaaggcctgaggccgctcggctccttgtagtcgtgactgacggcgagtcccatgacggtgaagaactacctgccgctcttaaggcttgtgaagccggtcgagttacccggtacggcattgcggtattaggccactacctccggaggcagcgggatccttcatctttcttgagggagatccggacgattgcatcggatcccgatgagaggtttttcttcaacgtgactgacgaggctgccctaactgacatcgtagatgccctgggcgatcggatattcgggctggaaggcagtcacgctgaaaatgaatcgagctttggcctcgaaatgtctcagataggctttagtacgcatcgtcttaaagacggtattctgttcggcatggtgggggcttatgattggggtgggagcgtcttgtggcttgaaggaggtcataggctctttccgcctcgtatggccctggaggacgagtttcctccagccctccagaatcatgctgcttatctgggatactcagtctcctcaatgctgctacgcggcggaaggcgcctcttccttagtggcgcacctcgtttcaggcatcgcgggaaagtgattgcctttcagctgaaaaaagacggtgccgtgcgcgttgctcagagcctacagggagagcagataggatcctactttggtagtgagctgtgccctttggacactgatcgtgatggcacaactgatgtgttgttggttgcggcaccaatgtttttgggcccccagaataaagaaacaggtagggtgtatgtttatcttgtggggcagcagtctttgctcacgttgcaaggaaccctgcagcctgagccgccccaggatgctcgctttggctttgcaatgggggcgctaccggacctgaaccaggatgggtttgccgacgttgctgtcggcgctccactggaggatggccaccagggtgcactatatttgtatcatggaacacagagcggcgtgaggccacatcctgctcaacgtatcgctgccgccagtatgcctcatgccctctcgtatttcggccgatctgttgacggtcgcctggatctggacggcgacgaccttgttgatgtggctgtcggagcccaaggagccgccattctcctgagctcccgccctatcgtccatcttaccccatcccttgaggttacaccgcaggccatctccgtggtccagagggactgccggagaagaggacaggaagcggtgtgcctcacagccgccttgtgctttcaggtcacctcccggactccaggaaggtgggaccatcagttctatatgagattcacggcctccctcgatgagtggacagcaggcgcacgagcggccttcgacggctcagggcagaggctgagccctagacggctgaggctgagcgttggcaacgtgacatgcgaacagctccatttccatgtactcgacacaagcgactatttgaggcctgtggcacttacagtcacatttgccctagataacacaaccaagccgggccccgtgctcaacgagggctcaccaacctccatccagaagctggtgccattctccaaagactgtgggccagataacgaatgtgtgactgacctggtgctgcaagtgaacatggacatcagaggctctaggaaagccccgttcgtggtcagagggggcagaaggaaagttttggtgtctacaactttagagaacagaaaggagaacgcttataacacatcactgtctttgatcttcagccgcaatcttcacctggccagcctgaccccccagcgcgagagtcccattaaggtcgaatgcgctgcacctagcgcccatgcccgactgtgttctgttggccatccggtgttccagacaggcgctaaagtgactttcctgctcgaattcgagttcagttgctcatcactcctgagtcaggtgttcgtcaaactgactgcatcttccgattcactggagcggaacggaactctgcaggataacaccgcccagacatccgcatacatccagtacgagccacacttactgttttcatccgaatctacactgcaccgctatgaagtgcacccatacggcactctgcctgttggaccggggcctgaattcaagacgacactgagggtccaaaatctggggtgttacgtggtgagtggcttgatcatttcagcactactgcccgcagtggcacatggcggcaactattttttatcactctctcaagttataactaacaacgcctcctgtatcgtgcagaatctcaccgaacctccagggccccccgtacacccagaagaactccagcacacaaacagactggctaagttcaagtctctgacagttgtgtctacatttgagcttggaactgaggaggggtcagtgctccagttgacggaggccagtaggtggagcgaaagtttactcgaggttgtgcaaacacggcctatactgatctcactctggattctgataggcagtgtgctcggagggctccttttgttggccttattggtcttctgtctctggaaactcggatttttcgcacacaaaaaaattcctgaagaggagaagcgcgaagagaagctggagcagtag

SEQ ID NO: 42811 - DNA, 3192 bp, Artificial Sequence
  Description of Artificial Sequence: Synthetic coding sequence
atgagccccggcgccagccggggcccccggggcagccaggcccccctcatcgcccctctctgctgcgccgccgctgccctgggcatgctgctgtggagtccggcatgccaggccttcaacctggacgtcgagaagttgacggtgtatagtggtccaaaagggtcgtactttggttacgcggtagatttccatatccccgacgcaaggacagccagtgtgcttgtgggggcacccaaggccaacacttctcaacccgacattgtagaagggggagccgtctattattgcccatggcctgcagaaggttccgcccagtgtcgacagattcctttcgacaccacaaataaccgaaagatcagggtgaacggcaccaaagagcctatcgaatttaagagcaatcagtggtttggtgctactgtcaaagctcacaaagggaaggtggtggcttgtgctccgctctatcactggcggaccttgaaacctactccggaaaaagaccccgttggtacatgttacgtggccatccagaactttagcgcctacgcagaattttccccctgtcgcaatagcaatgcagacccagaggggcaaggctattgtcaggcagggttcagtctggatttctacaagaatggcgacttgatagtggggggccccggcagtttctactggcagggccaggtgataaccgcatccgttgctgacatcattgctaactattcatttaaagatatccttcgaaagttagccggggagaagcagactgaagtcgcacctgcctcttatgacgactcctacctaggctattcagtcgctgcgggcgagtttacaggcgacagccagcaagagctggtggccggaatacctagaggagctcaaaatttcggttacgtaagcatcatcaacagtacagacatgacattcatccagaactttacaggagagcaaatggcgtcttacttcggctacactgttgtcgtcagtgatgttaacagcgacgggctcgacgacgttctggtgggggccccgctgttcatggaacgggagtttgagtcaaatccacgagaggtcggtcaaatttatctctacctccaggtgagctcactactattccgggacccacagatcctgacaggtactgaaacatttggaagattcggttctgccatggcacatctcggcgatctcaatcaggacggttacaatgacatagcaatcggtgtgcccttcgccgggaaggaccagcgaggtaaagtgctcatttataatggcaataaagacggtttgaacacgaaaccttctcaggtgctgcaaggtgtgtgggcctctcatgctgttccctccggctttggattcacactgcgcggagactcagatatagataaaaacgactaccccgacctaattgtgggcgcattcggcactggcaaggtggctgtgtaccgggcccggccagtcgtgactgtcgatgcccagcttctcctgcacccaatgatcattaatttggagaataaaacttgccaagtacctgatagcatgacgagcgccgcatgtttctcattgcgcgtgtgcgcatctgtgaccggccagagcatcgctaatacaatcgttctaatggctgaggtgcagctagacagcctgaaacagaagggggcaatcaagcgtactctgtttctggacaaccaccaagcccatcgggtgttccccctggtgatcaagagacagaagagccaccaatgtcaggattttatcgtctacttgcgggacgaaaccgagttccgggataagctgtcacccattaacatctcgctaaactattcgctggacgaatccacattcaaggagggcctggaagttaaacccatcctgaactactatagagagaatatcgttagtgaacaggcgcatattttagtggattgcggcgaagataacctttgcgtgccagatctgaaattgagtgccagacccgataaacaccaggtgatcattggtgacgagaatcacttgatgcttataataaatgccaggaatgagggcgagggggcctacgaagcagagttatttgttatgattcccgaagaagcagattacgtgggaatcgagcgcaacaacaagggcttcaggcccttgtcatgtgaatataaaatggaaaacgttacaagaatggtcgtgtgcgatctgggcaaccctatggttagcggtaccaattactctctgggacttagattcgctgttccacggctggagaagaccaacatgtctataaacttcgacctgcagatccggagctctaataaagataaccctgacagtaactttgtgtcactgcagattaacattactgctgtggcacaggtggaaattaggggagtatcacatccaccacagattgtgctgcccatccataactgggaaccagaagaggagcctcataaagaggaggaggtcgggccactggttgagcatatctacgagctgcacaacatcgggccatctaccatctctgatactattcttgaagtcggctggcctttcagcgctcgagacgagtttctgttgtatatcttccacattcagaccctgggacctcttcagtgtcagcccaatcctaatattaatcctcaagatataaaacccgcggcttctcccgaggatactccagagctctcagcttttctgcggaattccacaatcccgcacctcgtccggaaaagggatgtgcatgtagtagagtttcacagacaatctcctgccaaaatcttgaactgtactaatattgaatgtctgcagatcagttgtgctgtggggcgattggagggaggtgagtcagccgtgctgaaggtacgctcaaggctgtgggcccacaccttcttacagagaaagaatgacccctacgcacttgccagccttgtttcattcgaggtgaagaaaatgccttataccgatcagcccgccaagctccccgaaggctcaatcgtcatcaaaacatctgtgatctgggctacccccaatgtgagcttctctattcccctctgggtcatcattcttgctatcctactgggcctactggtcctggctatattgaccctcgccctgtggaagtgcggcttttttgaccgggctcggccgccccaggaggatatgaccgacagagagcaacttaccaacgataagactcccgaggcctag

SEQ ID NO: 42812 - DNA, 3147 bp, Artificial Sequence
  Description of Artificial Sequence: Synthetic coding sequence
atgagccccggcgccagccggggcccccggggcagccaggcccccctgatcgcccccctgtgctgtgccgctgctgcccttgggatgctgctatggtcacccgcctgccaggcctttaacctggacgtggagaagctcacggtgtactcaggtcccaaggggtcctacttcgggtatgccgttgatttccatattcctgacgccaggactgcctcggtgcttgtaggcgctccaaaagccaataccagtcagccagacatagtcgaagggggtgctgtctactactgcccgtggcctgcggaagggagtgctcaatgccgtcaaatccctttcgacaccactaacaataggaaaatccgagtaaacggcaccaaagagcctatcgagtttaagtcgaaccagtggttcggggctaccgttaaagctcacaaaggtaaagtggtagcttgtgccccactatatcactggaggactctcaagccaacacctgagaaggaccccgttgggacatgctatgtagctattcagaacttctccgcgtacgctgaatttagcccttgtagaaactcaaatgcagatccggagggtcagggctactgccaggccgggttttctctcgacttctacaagaacggcgatctgattgtggggggtccggggtccttctattggcaaggacaggtaatcaccgctagcgtagcagacataatcgccaactatagctttaaggatatacttcgcaaactggccggggagaaacagacagaggttgcacctgcctcttatgacgactcctatctcgaactggtcgcagggattccccggggagcgcagaatttcggctatgtaagtattatcaattctactgacatgacgtttatccagaatttcacaggcgagcaaatggcctcatactttggctataccgtagtggtcagcgacgtaaactcggatgggctcgacgacgtgctggtcggcgcccccttgttcatggaaagagaatttgaaagcaaccctcgcgaagtgggccagatttacctctatctacaggtgtcatccctcttgtttcgggacccgcagatcctcactggaacggagactttcggacggttcgggagtgccatggctcacctgggagacttgaatcaggacggctacaacgatattgctataggggtgccgtttgccggtaaggaccaacgaggtaaggttctcatctataacggcaataaagatggcctcaacactaaaccatcacaagtcctgcagggagtttgggctagtcatgctgtacctagtgggttcgggttcactctgaggggcgactctgatatcgataagaatgactaccctgacctgattgtaggggcctttggcacaggaaaagtggccgtgtaccgggctagaccagtggtgactgttgacgctcagcttctgcttcatcctatgataatcaacctagaaaacaagacatgtcaggtccctgatagtatgacgtccgcagcgtgcttctcactgcgcgtgtgcgcaagcgtcacaggtcagtcaatcgccaatactatagtcttgatggccgaggtccaactggattctttgaagcagaagggcgccatcaagcgtacactctttctggataaccatcaagcgcatcgcgtcttccctttggtcatcaaacggcagaagtcccatcaatgtcaggacttcatcgtttatttgcgtgatgaaacagaatttagggacaagctctcacccataaacatctctctgaattacagtctggacgaatcaacattcaaagagggattagaggtgaagccaatcctcaattactaccgagagaatattgtgagcgaacaggcccacattctggtggactgtggggaggataatctgtgtgtgcccgacttgaagttaagcgcgaggcctgataaacatcaggtgatcattggggatgaaaaccacctgatgctcatcatcaacgccaggaacgagggggagggagcctacgaggccgagctgttcgtgatgattcctgaagaggcagactacgtggggatcgaaaggaacaataagggattcaggccactgagctgcgaatataagatggagaatgtgactaggatggtggtctgcgacctcggaaatccaatggtctccggaaccaactactccttaggattgagatttgccgtcccccgactagaaaaaacaaatatgagtataaacttcgacctgcagattcgaagttctaataaggataaccctgactctaacttcgtttccctccaaattaacataactgccgtggcccaggtcgagatccggggagtcagccaccctccccagatagtcctccccatccacaattgggagcctgaggaggaaccacataaggaggaggaggtcgggcccctcgttgaacatatatatgagctacacaatatcggaccttcgaccatttccgacactatactcgaagtaggttggcctttttcagcaagagatgagttcctcctgtacattttccacattcagaccctgggaccattgcaatgccagccaaaccccaatatcaatcctcaagacataaaacctgccgcatccccagaggacacccccgaactgtcagccttcctcaggaactcaaccataccgcatttagttaggaaaagagatgtccacgtggtcgaatttcacagacaaagcccagcgaagattctcaactgtaccaacattgagtgcctccagatcagttgcgctgtcggccgcctggaaggtggcgagtctgctgttctgaaagtacggtcccgactctgggctcacacgtttctccagcggaagaacgacccttatgccctggcctctttggtatcctttgaggtgaagaagatgccttacaccgatcagcctgcaaaacttcccgagggatcaatagtaattaaaaccagcgtaatatgggccactcccaacgtgtccttctcgatacccctgtgggtaattatcctggccatactgctgggcctgctcgttctcgcaatcctcaccctggccctttggaaatgtgggttttttgatagggctcgaccaccccaggaggatatgacggacagggaacaactgacaaacgacaagacccccgaagcttag

SEQ ID NO: 42813 - DNA, 3540 bp, Artificial Sequence
  Description of Artificial Sequence: Synthetic coding sequence
atgtggctgttccacaccctgctgtgcatcgccagcctggccctgttagccgcatttaacgttgatgtagcacgcccctggctcacaccaaaggggggagcccccttcgtactttcttctctcctccaccaagatccatctactaatcagacatggctgctagtgacttcaccacgaaccaaaaggactcctggacccctgcataggtgctctttggttcaagacgagatcttatgccatcccgtcgagcatgtgcctataccaaaaggccgacaccgaggtgtcacggtcgtccggtcccaccatggagttctgatctgcatacaggtgctggtacgccgacctcattctctgtcttccgaattgacaggcacttgtagtctgctagggcctgaccttcgtcctcaggcacaagctaactttttcgatttagaaaacttacttgacccagacgcaagagtagacacaggggactgctatagcaacaaagaaggtggaggcgaagatgacgtgaataccgcccggcaaagacgggcgcttgaaaaagaggaggaagaagacaaagaggaagaggaggatgaggaggaggaggaggccggaacagagattgccattatccttgatggatcgggtagcatcgatcccccagacttccagcgcgctaaagattttatttctaacatgatgcgtaatttctatgaaaaatgtttcgagtgtaattttgccttagtccagtacggaggtgtaatccagactgaatttgacttgcgggacagccaggacgttatggctagtctggcccgggtacaaaatattacacaggttggcagtgtgaccaagactgcttcagcaatgcagcatgtgctcgacagtatatttacaagctctcacgggagcaggcggaaggccagcaaggtgatggtggtacttactgatggaggcattttcgaagatccactcaatttgactacagtcataaattcgcctaagatgcagggtgtggaaagatttgccatcggtgtaggtgaggagtttaagtccgcccgaactgctcgggagctaaatctcattgccagcgatcccgatgagacgcatgcttttaaggtgaccaattatatggccctggatggcttactctctaaactgagatacaatataatctcaatggaaggcaccgtcggggacgccctccactatcaactggcgcaaatcggcttctccgcacagatcctggatgagcgtcaggtgctgctgggtgccgtaggggcattcgactggtctggtggagcgctgctctacgataccaggagtcgccggggtcgctttctgaatcagacggccgctgccgcggccgacgctgaggcagcccagtactcctacctcggctatgcagtagctgtgcttcacaaaacctgttctttgtcctacatagccggggcccctcgctacaagcaccatggcgcagtgttcgaactccagaaggagggcagggaggcatcgttcctgcccgtgctcgaaggcgagcagatgggctcttatttcggatctgagttgtgtcccgtggatattgacatggacggctccaccgattttctcctggtcgctgccccattttaccacgtgcatggcgaggagggacgcgtgtatgtttaccggttgagtgaacaagacggctcattcagcctcgcccggattttatccggtcacccaggcttcactaatgcgcgtttcgggttcgccatggccgctatgggcgacctttcacaggataagttgacagatgtggcaattggggcacccctggaggggtttggcgcggacgatggcgcctcattcggttccgtttacatctataacggccactgggatgggcttagtgcttcaccatcccaacggatccgagctagcacagtcgccccgggcctgcaatattttggaatgtccatggccggaggcttcgacatcagcggcgacgggctcgccgacataaccgtgggcaccctaggacaggcagtcgtcttcagatcacgtcctgtcgtacgccttaaagtgtcaatggcttttactccaagtgctctccccataggatttaatggcgtcgtcaacgtgaggctgtgttttgagatatcctctgttacaactgccagtgagtcgggactgcgggaggctttactgaacttcaccctcgacgttgacgttggcaagcaacgcaggagattgcaatgctccgatgtgcggtcttgtctgggttgtttacgtgaatggagtagcggaagccagctttgtgaagacctgttgctcatgccaaccgagggcgagttgtgcgaggaagactgcttttccaacgctagcgtcaaggtctcttaccagctccaaaccccggaaggacagactgaccacccccagcccatcttagatcggtacacggaaccattcgccatcttccagctcccatatgagaaggcttgcaaaaacaagttgttttgcgtggctgagcttcaattagccacaactgtctcacagcaggagctcgtggtcgggctgaccaaagagttgacgctgaacattaacctgacaaactccggagaggatagctatatgacatcgatggccctaaattatcctcggaatttgcagctaaaaaggatgcagaagcctcctagtccaaacatccagtgtgacgatcctcaaccagtggcgtctgtactgataatgaattgccggatcggccaccctgtgttaaaaagatctagtgcccacgtgagtgtagtctggcagctagaagagaatgctttccccaaccgaacagccgacatcaccgttacagtaactaactccaatgagcggaggtctctggccaatgagacccatactctccagttcagacacggcttcgtggcggtgctgtccaaaccctcaatcatgtacgtcaacactggtcagggattgtcccaccacaaagagtttctattccacgtccatggcgagaacttgtttggcgcagagtatcagcttcagatctgtgtgccgaccaagctcaggggattacaggtcgtggccgttaagaaactcactcggacgcaggcttcaacagtgtgcacttggtcccaagagagagcttgtgcctacagctcagtccagcacgtagaggaatggcattctgtgtcttgtgtgatagcttctgataaagaaaacgtgaccgtcgcggcagagatttcctgggaccacagtgaggaattactgaaggacgtcaccgaattacagatcctgggcgaaatctcattcaacaagagtctgtacgaaggcctcaatgcagagaaccaccgcactaagattactgtggtttttttaaaggacgaaaagtaccattcactaccaataatcatcaaggggtccgtgggtggacttctcgtgctgatcgtgatccttgtgattctcttcaaatgtggttttttcaagcgtaagtaccaacagctcaatttagagtcgattcgcaaggcccaactcaagagcgagaatctcctggaagaggaaaactag

SEQ ID NO: 42814 - DNA, 2400 bp, Artificial Sequence
  Description of Artificial Sequence: Synthetic coding sequence
atgccccgggcccccgcccccctgtacgcctgcctgctgggcctgtgtgccctgcttccgagacttgccggcttgaacatctgtaccagcgggagcgccacatcttgcgaggaatgtcttctaatccaccctaagtgtgcatggtgctccaaggaggatttcggtagcccaagaagcatcaccagtagatgtgatctaagagccaatttggtgaagaatggttgcggtggagaaattgagagccccgcatcaagcttccatgtattgcgctccttgcctctgtccagcaagggatccggcagtgctggctgggacgtgatccagatgacaccgcaggagattgccgtcaatctacggccaggggacaagactactttccaattgcaagttcgacaggtggaggactaccctgtggacttgtactacctcatggatttgtcactctctatgaaagatgatcttgacaacatcaggtcactcgggacaaagctggctgaagaaatgagaaaactgacttccaactttaggctcggcttcgggtctttcgttgacaaagatatatctccattcagctacacggcgccacggtaccagacgaacccttgcatcgggtacaagctgtttccaaactgtgtaccctcttttggtttccgccatctgcttcccctgaccgatcgggtcgattccttcaacgaggaggtgcgaaagcaacgggtttcaagaaacagggatgcgcctgaaggcggttttgacgccgtactgcaggccgccgtgtgtaaggaaaagataggctggagaaaagacgccttacacctgctcgtgttcacaacagacgatgtgccccatatcgcgcttgatgggaagttaggcggcctggtgcagcctcacgacggtcaatgtcatctcaacgaggcaaatgaatatacagccagcaaccagatggattatccaagcctcgccctgttgggcgaaaaactcgccgagaataacataaacctgatctttgctgtgacaaagaaccactatatgctttataagaattttactgcactcatcccaggtacgaccgtggagattctggacggtgacagtaagaatattatccagctgatcatcaatgcatacaatagcatacgatcaaaggtggagctttcagtctgggaccaacctgaggatctcaacctgtttttcaccgccacatgccaggacggagtatcatatcccggccagaggaaatgtgagggtctgaagataggcgacaccgcttcatttgaagtttcactggaggctcggagctgcccctccaggcacactgaacacgtgtttgcattgagacctgtggggttcagggattccttggaagtgggcgtgacctacaattgcacatgtgggtgctccgtgggcctggagcccaatagcgcccgctgcaatggctccggaacttatgtgtgcggactgtgtgaatgcagtcctggttatctgggcacgaggtgcgagtgtcaggacggagagaatcagagcgtgtatcagaacctatgccgtgaagccgagggtaaaccattgtgttctggacgtggagattgttcatgtaaccagtgtagctgtttcgagagtgagtttggcaagatctatggaccattctgtgagtgtgataatttctcttgcgcgaggaacaagggagtgctatgttccgggcacggcgagtgtcattgcggggaatgtaagtgccacgcgggctacattggagacaattgtaattgttctaccgacataagcacttgtagaggacgtgatgggcagatttgctccgaacgggggcattgtctgtgcggccaatgccagtgtacagaaccaggagcctttggcgagatgtgtgagaagtgtccaacatgccccgacgcatgtagtactaagcgggactgtgttgagtgcctccttttgcactcagggaaacccgacaaccagacctgccactcgctctgtcgtgacgaggttataacctgggtggacactatcgtgaaagacgaccaggaggcagtgttatgcttttacaaaactgcgaaggactgtgtgatgatgttcacatatgtagaactgccgtctgggaagtcaaacctgaccgttcttagggagcccgaatgtgggaatacacctaatgctatgacgattctcctagcagtggtcggcagtattctcctcgtcggtctcgcattgctggcaatctggaagctcctggtcacaatccacgatagacgggagtttgccaaattccagtctgagcgcagtcgggcccgctatgaaatggcctcaaatccattatacaggaaacctatttctacacacacagtcgattttacgtttaacaagttcaataagtcttacaacggcacagttgattag

SEQ ID NO: 42815 - DNA, 1065 bp, Artificial Sequence
  Description of Artificial Sequence: Synthetic coding sequence
atgggccggctggtggccgtgggcctgctgggcatcgccctggccctgcttggggaaagactgctcgccttacggaacaggcttaaggcatccagagaggttgagtcggtggatctcccgcattgccatttaattaaggggatcgaagctggaagcgaagatattgatatcctgccgaacggactcgcatttttcagcgtagggttaaagttcccgggtctgcacagcttcgcccccgataaacccgggggaatactgatgatggacttgaaggaggaaaagcctcgagcacgggagctacgaatctccagaggatttgacctcgcctcatttaaccctcacggcatcagtactttcatcgataacgacgatacggtgtatctgttcgtcgtaaatcacccagaatttaagaatacagtcgagatttttaaatttgaggaggccgagaacagcctactacaccttaagaccgttaagcatgaactgctgcccagcgtgaacgacattactgcagtaggcccagctcatttttatgccacaaacgaccactacttttctgatcctttcctgaagtatctggagacgtatctgaacttgcactgggctaacgtggtatattacagcccaaatgaggtaaaagttgttgcagaggggttcgatagcgcaaatggtatcaatattagcccggatgacaagtatatatatgtggcagacatcttggctcacgagatccacgtgctcgagaagcataccaacatgaacttgactcagctgaaagtgctggagctggatacccttgtggataatcttagcattgacccgagtagcggcgatatttgggtgggatgccaccccaacggccaaaagctgtttgtctatgacccaaacaaccccccaagctcagaagtcctgcggatccagaacatcctaagcgaaaagcctaccgtaactaccgtatacgcgaataatggctcagtgctacaggggtcatctgtggccagtgtgtacgacggcaagctgctgatagggacactctatcatagagccctgtattgcgagctgtag

SEQ ID NO: 42816 - DNA, 1905 bp, Artificial Sequence
  Description of Artificial Sequence: Synthetic coding sequence
atgctgaaggtgcaccccctgaagaagtaccccgtggacctgtactacctggtcgatgtctccgcgtcaatgcacaataacatcgaaaaactgaactctgtgggaaacgacctgtccagaaaaatggcattcttctctagggacttcaggctgggtttcggaagttatgtggacaagacagtgagcccctatatcagcatacacccagagcggattcacaaccaatgttccgattataacttggattgtatgcctccccacggctacatccacgtcttgtcattaactgagaacatcacggagttcgagaaggctgtacataggcagaagatctccggcaatatagacacacctgaaggcgggtttgacgcaatgctccaggccgcagtgtgcgagagccatatcggctggaggaaagaggccaagcgcctcctgttggttatgaccgatcagacttcccacctagcattggatagcaagcttgctgggatcgtcgtgcccaatgatggtaactgccatctaaaaaataacgtgtacgtgaagtccacaactatggagcatcctagcctgggtcaactgtcggaaaaacttatcgacaacaatatcaatgttatcttcgctgttcaggggaagcagtttcattggtataaggacctcctgcccctgctccctgggactatcgctggagaaattgaatctaaagctgctaacttgaataatttagttgtggaggcttaccagaagcttatctccgaagtgaaggttcaggtcgaaaaccaggtgcaaggaatttattttaatatcaccgcaatctgccctgacggatctcgtaagccagggatggagggatgtcgaaatgtgacatcaaacgacgaggtactgttcaatgtcactgtcacgatgaagaagtgcgatgttacaggcgggaaaaactatgctattatcaaacctattggattcaacgagacagcgaagatccacatccacagaaattgttcctgccagtgcgaagataatagggggcctaagggaaagtgcgtagacgagactttccttgacagcaagtgcttccaatgcgatgaaaataagtgtcattttgacgaggatcagtttagctccgagtcttgcaagtcgcataaagaccagccagtctgctcaggacggggcgtatgcgtctgcgggaagtgctcatgccataaaataaagcttgggaaggtgtacggaaaatattgcgaaaaggatgatttttcttgcccctaccaccatggcaatctttgcgcgggtcatggcgaatgcgaggcaggacgatgccaatgctttagcgggtgggaaggggatcgctgccagtgtccaagtgcagcggctcagcactgcgtcaatagcaagggccaagtgtgctccggccgcggaacctgtgtgtgcggtaggtgcgaatgtaccgatccccggtcaatcggtagattttgtgaacattgccctacgtgctacaccgcatgcaaggagaactggaactgcatgcaatgtctgcacccgcacaacctgtctcaggcaattttggatcagtgcaagacatcctgtgctctcatggaacagcaacactacgtggaccagacatctgagtgtttttccagtccttcttacctccgaatcttctttatcatctttattgtaaccttcctgatcggtctgctaaaagtactcattatacggcaggtcattttacagtggaattcgaataaaatcaaaagctcctctgactatcgcgtgagcgcgagcaagaaagacaaacttattctgcaatccgtgtgtacccgtgccgtgacctacaggagagagaagccagaagagattaaaatggatatttccaagctaaatgcacacgagactttccgctgtaacttctag

SEQ ID NO: 42817 - DNA, 1314 bp, Artificial Sequence
  Description of Artificial Sequence: Synthetic coding sequence
atgaccagctacatggccatcgacggcagcgccctggtgcccctgagacagaagccccggaggaagacacagggatttctcaccatgtcacgcaggagaatctcgtgtaaggatctgggacacgcggattgtcagggctggctctacaagaagaaggagaagggaagttttctgagcaacaaatggaaaaagttctgggtgatactgaaaggtagcagcctgtactggtacagtaatcagatggctgaaaaggccgatggtttcgttaatctccctgatttcaccgtcgagcgagcaagtgaatgtaagaaaaagcacgcattcaagatcagccaccctcagattaagaccttttactttgcagcagagaacgtccaggagatgaacgtgtggctgaacaaactgggctccgctgtcattcaccaggagagtacaacgaaagatgaggagtgctacagcgaatcagaacaggaggatccggagatagcagctgagacgcccccccccccccacgccagtcagactcagagtctgaccgcgcagcaggcctcatccagttctccatccctgtcagggacatcttactctttcagcagccttgagaatactgtgaaaactcccagttctttcccctcaagtctaagcaaggagcggcaatctctgcccgacaccgtaaacagtctgagcgccgcagaggacgaggggcagccaattacctttgccgtgcaagttcactcacccgtcccgagtgaagcaggcattcacaaggcgcttgagaacagctttgtaacctctgagtcgggatttcttaacagcctctccagcgacgacacctctagcctctcctccaatcacgatcatctgacagttcccgacaagccagctgggagcaagattatggataaagaagagactaaggtgagcgaggatgacgaaatggaaaaattgtataagtccctggagcaggccagcctgtccccccttggagatcgacggccctcaacaaagaaggaactcagaaagtcttttgtaaagagatgcaaaaaccctagcatcaatgagaagttacataagatccggacattgaacagcactctcaaatgtaaggagcacgatcttgcgatgatcaaccaattgcttgacgatcctaaactcacggcgcggaaatatcgggaatggaaggtgatgaatactttattaatccaagacatctaccagcagcagagggctagccctgcccctgacgacacggacgacactcctcaggagctgaagaaatctccaagcagccccagcgtagagaattcgatttag

SEQ ID NO: 42818 - DNA, 1317 bp, Artificial Sequence
  Description of Artificial Sequence: Synthetic coding sequence
atgaccagctacatggccatcgacggcagcgccctgcaggtgcccctgagacagaaacccaggcggaagacccagggattcttaacgatgtctcggaggcgaatctcatgcaaagacttgggccatgctgactgtcagggctggctatacaagaaaaaggagaaaggcagctttctctccaacaaatggaagaaattttgggtgatccttaaggggtcctccttgtactggtattccaatcagatggcagagaaggccgatggcttcgttaatttgcctgattttaccgtcgaacgggcatctgaatgtaagaagaagcatgcctttaagatcagccacccccagatcaaaacgttttactttgctgccgagaacgtgcaggaaatgaatgtttggctgaacaagctgggctccgctgtgatccatcaggagagtacaaccaaggatgaggaatgttactccgagagcgagcaggaagaccccgaaatcgcggccgagaccccacctccaccacacgccagccagactcaatcccttactgcgcagcaggcctccagcagtagcccttctttatcgggcactagttattccttcagttctctggaaaacacagtgaagactccttcctcattccccagcagtctttcaaaagaaaggcagtcactgcctgacacagtgaactcactctcggctgcagaagacgagggacagcccattaccttcgccgtgcaagtgcattcccccgtcccaagtgaggccggaatccataaggccctggaaaatagcttcgttaccagtgagtccggcttcctgaattcgctcagtagcgatgacacatcttcgctgtccagcaatcatgaccaccttacggtaccagacaagcccgccggtagcaaaattatggacaaggaagagacaaaagtctctgaagatgacgagatggagaagctttacaaaagtctggagcaggcatccctgtcccccttgggcgatagacgcccaagcaccaagaaggagctgcgcaagagcttcgtgaaacgatgtaaaaatccttcgataaacgaaaagctacacaagatacgcacgttaaactccaccctgaaatgtaaggagcatgacttggctatgataaaccaactgctcgacgacccaaagcttactgccaggaaatacagagagtggaaggtcatgaacaccctgctgatacaggacatttatcagcagcaacgagcctccccagcacccgacgacacggatgatacaccacaggaactcaagaagagtccctcgagtccgtctgttgaaaactccatctag

SEQ ID NO: 42819 - DNA, 1317 bp, Artificial Sequence
  Description of Artificial Sequence: Synthetic coding sequence
atgaccagctacatggccatcgacggcagcgccctgcaggtgcccctccgacaaaagccaagacgcaagacccagggcttcctgactatgtcacgccggcggatcagctgcaaagatctcggccacgcagattgccagggttggctgtacaaaaagaaggaaaaagggtcttttttgtcgaacaagtggaagaagttctgggttatcttgaaaggctcgtccttgtattggtactccaaccagatggccgagaaggctgacggatttgtgaatctgccagactttacagtggagagagcttcagagtgtaagaaaaagcatgcatttaaaatttcccatcctcagatcaaaaccttctatttcgctgcagagaacgtccaggaaatgaatgtctggcttaataaactgggcagcgccgtgatccaccaggagtccaccaccaaagatgaagagtgttattctgagtccgagcaggaagatccggagattgccgcagaaaccccccctccaccgcacgcatctcaaacccaatcactgaccgcacagcaagcttccagctcctccccaagcttgtctgggacgagttactccttctcttccctggagaacacggtcaagacaccaagctccttcccttcatccctcagcaaagaacggcagagtctgcctgacacagtgaacagcctcagtgctgctgaggacgagggccagccaatcactttcgccgtccaggtgcattcacctgtgcccagcgaagcaggaatccacaaagccttagaaaattccttcgtaacctccgagtcagggttcctgaattctttaagcagtgatgacacatccagcctctcctctaatcatgaccatctgaccgttccggacaagccagcaggaagcaagatcatggataaggaagaaacaaaagtcagcgaggacgatgaaatggagaaactgtataagtctctggagcaggcctcactgagtcctctgggtgacaggagaccctccaccaaaaaggagttaaggaagtcttttgtcaagcgatgcaagaatccgagtatcaatgaaaagctgcacaagatcaggaccttaaacagtaccctgaagtgtaaggagcatgatttggctatgatcaaccaactgctggacgacccgaagttgaccgctaggaagtatagagaatggaaagtgatgaacacattactcatccaggatatctatcagcagcagagagccagtcctgcacccgacgacacagacgacacgccacaggaactgaaaaagtcacctagcagcccaagcgtcgagaacagcatttag

SEQ ID NO: 42820 - DNA, 237 bp, Artificial Sequence
  Description of Artificial Sequence: Synthetic coding sequence
atgaccagctacatggccatcgacggcagcgccctggtgcccctgaggcagaaacccaggaggaaaacacagggctttctaaccatgagccgccggagaatcagttgcaaagacctggggcatgctgattgccaggggtggctctataaaaagaaggagaaggggagcttcctgagcaataaatggaagaagttttgggtgattctgaaaggaagttccttatattggtatagctag

SEQ ID NO: 42821 - DNA, 396 bp, Artificial Sequence
  Description of Artificial Sequence: Synthetic coding sequence
atgttcagcgacaacagccactgccccgactgcggccagcagtggttcccgtctctggagttgggtcactggctgtaccagacagaactagtagagaacgagtgttaccaagtgtttctcgataggataaaccgggctgattactgtcctgaatgttaccctgataaccccgcgaaccgttcactagtgttaccatggagttttccattggagtgggccccccagaatctaacccggtggacatttgagaaggcctgtcacccgttcttattgggtcctcctctcgtgcgcaagcggattcatgacagtcgcgtagcaggctttaaccctgctttgcaattgattttgacccgtaccgataagacgctgaataagaagctgggtcagaacaagtag

SEQ ID NO: 42822 - DNA, 687 bp, Artificial Sequence
  Description of Artificial Sequence: Synthetic coding sequence
atgcgggagggcaagcggggccccccctgcatcctgagcttccggggaactctggagagagtggaggctcagtgggaactcgaggcccagggccctggccagtgcccagcccctctcggagaccccgcatcaacaaccgacggggcccaggaagccagggtccctctggatggggcattttggattccccgtccccccgccggttctccaaagggatgtttcgcctgcgtctccaagcccccagccttacaggcacctgccgcacccgcgcctgaaccttcggcgagtcccccaatggcgccaacattgtttccaatggaaagtaagagctctaagactgactctgtgcgagcagccggggctccaccggcttgcaagcacctcgcggaaaagaaaaccatgacaaatcccaccaccgtgatcgaggtgtatcctgacaccaccgaggtaaacgactactacctgtggtcaatctttaactttgtgtacctgaacttttgctgcctggggtttattgccttagcctacagccttaaggtgagggataaaaaattattgaacgatctgaatggcgccgtggaagacgctaaaacggcacgactgtttaatattacgagcagcgcactcgccgcatcctgtattatcctggtgtttatctttctgaggtatccacttacggattactag

SEQ ID NO: 42823 - DNA, 399 bp, Artificial Sequence
  Description of Artificial Sequence: Synthetic coding sequence
atggacaccgcctacccccgggaggacacccgggcccccacccccagcaaagcaggcgcccacacagcgctcacgctgggagccccccatcccccacccagagaccatctcatatggagtgtgttctccacgctctatctgaatctgtgctgtctgggttttctggccctcgcttattccattaaggcccgcgaccagaaagtagttggcgacctcgaagcggcacgaaggttcggaagcaaggccaaatgctataacatcttagcagccatgtggaccttggtgcctcccctgttgctgttgggcctcgtggtgactggcgcattgcatctggctcgcctggctaaggattctgctgctttcttctcaacgaagtttgatgatgccgattatgattag

SEQ ID NO: 42824 - DNA, 1551 bp, Artificial Sequence
  Description of Artificial Sequence: Synthetic coding sequence
atgcccgtgcccgagcggcccgccgccggccccgacagcccccggcccggaacaaggagggccgctccccgagtgttgtttggagaatggctgttgggtgagatcagcagcggatgttatgaaggattgcaatggctggatgaggccagaacgtgctttagagtcccttggaagcattttgcgcgtaaagatctgtctgaggccgatgcccggatctttaaagcctgggcagtggctcggggtcgttggccaccaagttcaaggggaggcggacctcctccggaggccgagacagccgagcgcgctggctggaaaaccaactttcggtgcgcgctacgctccaccaggaggtttgtgatgctgagagataattctggggacccagccgaccctcataaggtatacgccctctctcgggagctgtgttggcgggagggaccaggcaccgaccaaaccgaagctgaagcccctgccgcagtgcccccccctcagggaggcccacccggcccgtttctggcgcacacccatgcaggattgcaggcccccggccccttacctgcgcctgctggcgacaaaggagatttactattgcaggccgtgcaacagagctgcttggccgaccatttactgactgcatcatggggtgctgatcccgtcccaacaaaggctcccggggaaggtcaggaaggactgcccctgactggggcctgcgctgggggcccgggtctgccagcaggagagctgtatggatgggcggtggaaactacaccaagccctggaccccaaccggctgctttgaccaccggtgaggccgccgccccagagtccccacaccaggctgagccctatctatccccctccccatctgcctgcacagccgtacaggaacccagcccgggagctctagatgtcaccatcatgtacaaaggacgaacagtgcttcagaaggtggtgggtcatccgagctgtacatttctctacggacccccggaccctgccgtaagagccacggatccacagcaggtcgctttcccctccccagccgagctccctgaccagaaacagctgagatatacagaggaactcctgcgacacgttgctcccggccttcacctcgaattgaggggtccacaattgtgggctagaaggatgggaaagtgtaaagtctactgggaggtaggaggccctccagggagtgcctctccttcaacgcccgcttgtttgctgccacgcaattgtgatacccccatattcgacttccgcgtcttcttccaggagctggtggaattccgcgctcggcaacgcaggggttcccccagatatactatctatctgggcttcggacaggatctctcggccggtaggcctaaagaaaagagcctcgtcctggtgaaactggagccctggctctgtagagtgcacctcgagggcacacagagagagggagtgagttctctggacagcagttcactgtcactgtgcctctcttcagcgaacagtttgtacgatgacatcgagtgcttcctgatggagctcgagcagccagcctag

SEQ ID NO: 42825 - DNA, 1425 bp, Artificial Sequence
  Description of Artificial Sequence: Synthetic coding sequence
atggccctggcccccgagcgggccgccccccgggtgctgttcggcgagtggttgttaggggagatcagtagtgggtgctatgagggcttacagtggctggacgaggcaagaacctgtttcagagtaccttggaaacacttcgcacgaaaggatctgtcagaggctgatgccaggatttttaaggcttgggctgtggcaagaggccgctggccgccgtcaagtcgaggaggcggaccgccacccgaagccgagactgcggagagggccggctggaaaaccaacttcaggtgtgcgctgcgaagcacccggcgattcgtcatgctgagggacaacagtggagaccccgcagacccccataaggtctacgccctctcgcgagaactgtgctggcgtgagggtcctgggacagatcagactgaggccgaggccccagcggctgtgcctccaccacaaggtggacctccggggccctttttggcacacacacacgccggtctccaggcaccagggccgcttcccgcgccagccggggataaaggcgatctgctattgcaagccgtccaacagagttgcctggcagatcacctgctgacagcctcctggggcgccgatcccgtaccaacaaaggcacctggcgaaggccaggagggtttacctttaactggagcgtgtgccgggggcgaggcagcagctccggaaagcccccatcaggctgagccgtacctgtccccctcacccagtgcttgtactgccgtgcaagaaccctctccaggagctctggacgtcaccattatgtacaaaggcaggaccgtcttacaaaaagtggtgggccatccatcctgtacctttctgtacggaccgccagaccccgcagttagagcaaccgaccctcaacaggttgctttcccttcacccgcggaattacccgatcaaaagcaactgcgctatacagaggagctcctccggcacgtggctccaggcctgcacctggaactgaggggtcctcagctttgggcgagacgcatgggaaagtgcaaggtgtactgggaagtgggcggaccccccggttccgcatctccgagtactccagcatgtttactgccacggaattgtgacactcccattttcgatttccgggtcttttttcaggagctggtcgagttcagggctcgacaaaggcgagggagcccccggtatacaatctatctcggtttcgggcaggatctgagcgctgggaggcctaaggagaaatctttagtgttggtgaaactggaaccttggctgtgccgcgtgcacctggaaggaacacagcgggagggggtgtccagtctggatagctcatccctgtctctgtgcttgtcgagcgcaaactccctgtatgacgacattgagtgctttttaatggaactcgaacaacccgcctag

SEQ ID NO: 42826 - DNA, 633 bp, Artificial Sequence
  Description of Artificial Sequence: Synthetic coding sequence
atgtacaagggccggaccgtgctgcagaaggtggtgggccaccccagttgcacatttctctacggaccacctgaccctgctgtgcgggccactgacccccagcaggttgcattcccctcacctgccgagctgccagaccagaagcagctgcgctacactgaagagctcctgcgccatgtcgcccccggcttacacttggagctccgggggcctcaattgtgggcgagacgtatgggcaagtgcaaagtgtactgggaggtcggcggacccccaggaagcgcatccccttctacgccggcatgcctgctccctagaaattgcgacacgcctatcttcgatttcagggtgttcttccaggagttagttgagtttcgcgcaagacagaggcgaggcagccctaggtatacaatctacctaggatttggccaggacctttcagctgggaggcccaaagagaaatccctggtgctggtgaagctcgagccatggctgtgtcgcgttcacctcgaagggacacagcgggaaggagtgagttcactggactcttccagcctatcactgtgtcttagctctgcaaattctctgtatgacgacatcgaatgtttcttgatggaactcgagcagcccgcctag

SEQ ID NO: 42827 - DNA, 1551 bp, Artificial Sequence
  Description of Artificial Sequence: Synthetic coding sequence
atgcccgtgcccgagcggcccgccgccggccccgacagcccccggcctggcactcgtagagcagctcctagagtgttgttcggcgagtggctgctgggagagattagctccggatgttatgagggcctgcagtggttagacgaggcaagaacctgcttccgtgtaccctggaaacacttcgctcggaaagatctgagcgaagccgacgcgcgaattttcaaggcatgggctgtcgcccgaggtaggtggccgcctagctctaggggcgggggaccaccacccgaggccgagacggcggagcgagccggatggaaaaccaacttccgctgtgccctgaggagtaccagaagatttgtcatgcttagggataactcaggggatcctgccgaccctcacaaagtgtacgcgctaagcagggagctctgctggcgagagggaccaggaacggaccagacggaagccgaggcccccgcagcagtgccacctccacaggggggacctccaggcccgttcctggcccatacccatgctggcctgcaagcgcctggtccacttcctgctccagcaggggataagggcgacctactcttacaggccgtgcagcagtcttgtctggccgaccacctgctgactgcgagctggggcgcggacccagtacctaccaaagccccaggcgagggacaggaggggctcccactcactggggcctgtgccggaggccctggtcttcctgcaggggaactgtacgggtgggccgttgaaaccacaccttcgcctggaccgcagccggccgcacttacaacaggagaggccgctgctcccgagtcccctcaccaggccgaaccttacttgtccccctccccatccgcttgtaccgctgtacaggagccttctccgggggctcttgacgtgaccataatgtacaagggtagaaccgtgctgcaaaaagtagtcggacatcccagctgcacattcttatacggcccccctgaccctgccgtgcgggcgactgaccctcaacaggtcgcgtttcccagcccagcagagctgccggaccagaaacagctcagatacactgaagagctcttgcgacatgttgctcctggcttgcacttggaattacggggcccccaactttgggcgagaagaatgggcaagtgcaaagtctactgggaggtagggggacccccggggtccgccagcccatccacgccggcatgcttactgccccggaattgcgatacacccatctttgatttccgagtgtttttccaagaactggtcgaattcagggcacgtcagaggaggggttcgccccggtacacaatttatttaggattcgggcaagatctctccgctggacggcctaaggagaagagtctcgtactggtgaagttagaaccatggttgtgcagggtgcacctcgagggcactcagcgagaaggggtcagctctctggatagcagctcactgagtctgtgcttaagctcagccaatagcctgtacgacgacatagagtgcttcttaatggagctggagcagccggcatag

SEQ ID NO: 42828 - DNA, 1425 bp, Artificial Sequence
  Description of Artificial Sequence: Synthetic coding sequence
atggccctggcccccgagcgggccgccccccgggtgctgttcggcgaatggttactgggtgagatttcctcaggatgctatgaagggctgcagtggctagacgaggcaagaacatgctttagagtgccttggaaacactttgcaagaaaagacctgtcagaggccgacgcaagaatcttcaaagcctgggcagtagctaggggtaggtggcctccttcttccagaggtggcggaccaccccccgaagctgagaccgcggaacgagctggctggaagaccaactttagatgcgcacttagatctacccgccggtttgttatgctgagagataactcaggcgatcccgccgatcctcataaagtttatgccttgagtcgagagttatgttggcgggagggaccgggaactgaccagacagaggcagaagcacctgcggctgttcctccccctcagggaggtcctccaggccctttcctcgcacacacccacgccggactgcaggcccctgggcctctacccgccccagcaggcgacaagggcgacctgctcctgcaggcggtgcagcagagctgtcttgcggaccacctgctgaccgccagttggggggcggaccccgtgccaacaaaggctcctggagaggggcaagaagggcttccgctaactggagcatgtgcaggaggggaagctgcagcccctgaaagtccacaccaggcagagccctatctcagcccctctccttccgcctgcaccgcagtgcaggagccaagcccgggtgccctggacgttacgatcatgtacaaagggcggacagttctgcagaaagtcgttggccatccttcttgtacattcctctacggaccaccagatcctgccgtgcgagccaccgacccccagcaggtggcctttccatctccagccgaactgcctgatcagaaacagctacggtatacagaagagcttcttcgtcacgtcgcccctgggcttcacttggagctgcgtgggcctcagctgtgggcccgccgaatgggcaaatgtaaggtgtattgggaagtgggaggaccacccgggtctgcaagtccttccacaccagcatgtcttctgcccagaaattgtgatactccgatttttgattttcgcgtgttctttcaagagcttgtcgagtttcgcgccaggcagaggcgggggagcccccgctatactatatacctgggattcggccaggatctgtccgccggaagacccaaagaaaaatctctagtgttagtcaagctggaaccttggctgtgtagagtgcacctggagggaacacagcgagagggggtttcttcactggacagtagttctcttagcctctgtctttcctctgccaactctttatacgacgacatagagtgctttctaatggagctggagcagcctgcctag

SEQ ID NO: 42829 - DNA, 1512 bp, Artificial Sequence
  Description of Artificial Sequence: Synthetic coding sequence
atggccctggcccccgagcgggccgccccccgggtgctgttcggcgaatggcttttgggcgaaataagcagcggatgctacgagggcctgcagtggctcgatgaagcccggacctgttttcgcgtgccgtggaagcatttcgccagaaaagacttaagtgaagccgacgccaggatcttcaaggcctgggctgttgcacgtgggcgctggccaccctctagccgcggtggcggacccccccctgaagctgagaccgctgagcgtgctggatggaagactaatttcaggtgtgctcttagatcgacacgtcgctttgtgatgctccgcgacaactccggagaccctgctgacccgcataaggtgtatgccctctcacgcgagctctgttggcgagaggggcccgggaccgaccaaacagaagcagaagctccggctgcagtcccaccaccccagggaggtccccccgggcccttcctcgcccatacgcacgcaggcctccaagcccctgggcctctccccgcccctgcaggtgacaagggcgatctgctgctccaggcagtgcagcagagctgccttgctgaccacctgctgaccgcctcttggggggctgaccctgttcccacgaaagcaccaggcgaggggcaggagggactgcccctaaccggcgcgtgtgctgggggccctggactcccagcaggagaactgtatggctgggcagtggagactacaccttctcccgggcctcagccagctgccctgacaaccggcgaagccgcagcacctgagtcacctcatcaggctgagccctatctcagtcctagccctagcgcctgtacagccgtccaagaaccttctcctggggcgctggatgtaactataatgtacaaggggagaactgtgctgcagaaggtggttggccaccccagctgcactttcctatacggcccacccgaccctgcagtgagagccactgacccccagcaagtggcttttccctccccggctgaactgccagaccagaagcaactgagatatactgaggaattgctgaggcatgtcgccccaggactccacttggagctgcgagggcctcaactctgggcccgtcggatggggaaatgcaaagtgtattgggaggtggggggtcctcccggatcagccagcccaagcacccccgcctgtctcctgcctcgcaattgtgatactccaattttcgatttccgggtcttcttccaggaacttgtggaatttcgggcccggcaaaggcgggggtcaccccggtacactatctatctcggcttcgggcaggacttaagcgcaggtagacccaaggagaaaagcctcgtcctggtaaagctcgagccctggctgtgtcgagtacacttagagggcacgcaaagagagggagttagttcactcgatagtagttccctttccctctgcctgtcttccgctaatagtttgtacgacgacatcgaatgcttcctcatggagttggaacagccagcatag

SEQ ID NO: 42830 - DNA, 315 bp, Artificial Sequence
  Description of Artificial Sequence: Synthetic coding sequence
atgggcaaggagagcggctgggacagcggccgggccgccgtggccgccgtggtcggtggagtggttgccgtgggtacagtgttagttgcactgtccgccatgggattcacctctgtgggcatagcagcaagctccatcgccgcaaagatgatgtccacagccgctatcgccaacggtggtggcgtggccgctggttctttagtggcgatacttcagagcgttggggccgctggtcttagcgtcacttccaaggtaattggcggatttgccggaactgcactgggcgcctggttgggatcacctccctcatcatag

SEQ ID NO: 42831 - DNA, 315 bp, Artificial Sequence
  Description of Artificial Sequence: Synthetic coding sequence
atgggcaaggagagcggctgggacagcggccgggccgccgtggccgccgtagtgggcggcgtggtagccgtgggcaccgtgctggtcgcgctcagtgctatggggttcacttctgtcggcatcgccgcatctagcatcgcagccaagatgatgtctaccgccgctatcgcgaacggcggcggggtggcagccggttcactggtcgccatcctacaatcagtcggggcggctggtctgtccgttacctccaaggtaattggcggcttcgcaggaactgctctgggcgcctggcttggtagcccaccctcatcgtag

SEQ ID NO: 42832 - DNA, 393 bp, Artificial Sequence
  Description of Artificial Sequence: Synthetic coding sequence
atgatgaagcgggccgccgccgccgccgtgggcggcgccctggccgtgggcgcagtcccagtcgtattgtcagcaatggggttcacaggagcaggtatcgctgcatcctccatcgcggcgaagatgatgagcgctgctgccatcgctaacggagggggcgtgagtgcaggctctttggtggccaccctgcaatccgtcggggctgcagggttgtccaccagttctaacatcttactggcatctgttggctcagtgctgggagcttgtctggggaactccccttcaagctccctccccgccgaaccagaggccaaagaagatgaggctcgggaaaacgtaccccagggcgaaccccctaaacctcctcttaaatccgagaagcatgaggaatag

SEQ ID NO: 42833 - DNA, 417 bp, Artificial Sequence
  Description of Artificial Sequence: Synthetic coding sequence
atgcggcagaaggccgtgagcctgttcctgtgctacctgctgctgtttacttgctctggtgtagaagctggtgaaaatgccggaaaggacgctggtaagaagaaatgctctgagtcttccgactcagggtctgggttctggaaggccctgacctttatggctgtcgggggaggactggccgtggctggcctgcctgcattaggcttcactggggcaggcatcgcagcgaactctgtggcagcttctctgatgtcgtggagtgccatcttgaacggcggcggtgtaccagctggcggcctcgtggcgaccctccaatctttgggcgcagggggaagttcagtcgtcatcggcaacattggggcattgatgggctacgccactcacaagtaccttgattccgaggaggacgaagaatag

SEQ ID NO: 42834 - DNA, 393 bp, Artificial Sequence
  Description of Artificial Sequence: Synthetic coding sequence
atgcggcagaaggccgtgagcctgttcctgtgctacctgctgctgtttacatgcagcggagtcgaagcgggcaaaaaaaaatgttcagagtcatccgacagtggttctgggttttggaaagccttgacgttcatggccgttggcggggggctagccgtggccgggcttcccgcccttggttttacaggggctggcatcgccgctaatagtgtagcagcttccttgatgtcttggtccgcaatcctcaacggcggcggggtccccgcaggtgggctcgtcgcgactctccaaagtctcggggcaggcggatcttcggtcgtgatcggcaatatcggcgcactcatgggctacgctactcacaagtatctggacagtgaggaggatgaagagtag

SEQ ID NO: 42835 - DNA, 405 bp, Artificial Sequence
  Description of Artificial Sequence: Synthetic coding sequence
atgcggcagaaggccgtgagcctgttcctgtgctacctgctgctgttcacatgcagcggcgtggaggctggagagaatgcaggcaaaaagaagtgttccgaaagctccgatagcggtagcgggttctggaaagctttgaccttcatggctgtcggtggaggtctagcggtggctggcttgcctgccctggggttcacgggcgccggcatcgccgccaactctgttgccgcctcacttatgtcctggagtgcgatcttgaacggaggaggtgtgccagccggcggattggttgcaacactgcagtcccttggcgccggggggagcagcgtcgttataggcaacatcggtgctttgatgggatatgccactcataaatatctggactccgaagaagatgaggagtag

SEQ ID NO: 42836 - DNA, 978 bp, Artificial Sequence
  Description of Artificial Sequence: Synthetic coding sequence
atggcctggagcctgggcagctggctgggcggctgcctgctggtgtccgcattagggatggtgccccccccagagaatgtgcggatgaattccgttaacttcaagaatatccttcagtgggaaagtcccgcctttgcaaaggggaacctcacctttaccgctcagtatctcagctatcgaatttttcaggataagtgcatgaatactaccttaaccgaatgtgatttcagcagcctgtccaaatatggagaccatactctgcgagtgagagcggagtttgctgacgagcacagcgactgggttaacatcaccttttgtccggtggacgataccattattgggccccccgggatgcaggtcgaagtcttggctgacagcctgcacatgcggttcctcgcacccaagatcgaaaacgagtatgagacctggacaatgaagaacgtatacaatagttggacctacaacgtacaatattggaagaatggaactgacgagaagtttcagatcaccccacagtacgacttcgaggtgcttcgaaaccttgagccatggacaacttactgtgtccaagtgagagggttcctccccgacaggaataaagcgggagagtggtcagaaccagtgtgcgagcagaccacccacgacgaaaccgtgccatcttggatggtggctgttatcctgatggcctccgtgttcatggtgtgccttgccttactgggttgctttgcattgctgtggtgtgtgtacaagaaaactaagtatgcattcagtcctagaaactcactacctcagcatctcaaggaattccttggtcacccacatcacaatacgctactgttttttagtttccccctctccgacgaaaatgatgtctttgacaaactgtccgttatcgccgaggactctgagtccggaaagcagaacccaggggacagctgcagtctggggacaccgcctggccaaggtccccagagctag

SEQ ID NO: 42837 - DNA, 969 bp, Artificial Sequence
  Description of Artificial Sequence: Synthetic coding sequence
atggcctggagcctgggcagctggctgggcggctgcctgctggtgtcagccctgggtatggtgccgccacctgagaatgtacgaatgaactcagttaactttaagaatatcttacagtgggaaagcccagccttcgcaaagggcaatttaacattcaccgcccagtaccttagttatcgaatttttcaggacaagtgcatgaacactactctaaccgagtgcgattttagttcgctctccaaatatggagatcacacactgagggtcagagctgaatttgctgacgagcactccgactgggttaatatcactttctgccccgtggacgatacaattatagggcctcctggtatgcaggtggaggtgctcgccgactccctccacatgagattcttagcccctaagatcgaaaacgaatacgaaacctggaccatgaaaaatgtatataattcttggacatataacgtgcagtactggaagaatggtacagacgagaagttccaaatcacgccgcagtatgactttgaggtgctaaggaacttagagccgtggaccacctattgtgttcaggtgcgcgggttcctgcccgaccggaacaaagctggtgaatggagtgaacccgtctgtgaacagacgacgcacgatgaaactgtcccgtcttggatggtggccgtgattctgatggcttcagtcttcatggtgtgtcttgccctgctcggctgttttgcgctattgtggtgtgtgtataaaaagacaaagtacgcgttcagccctcgaaactcattgcctcagcacctgaaagaattcctgggccacccgcatcacaacactctgctctttttctctttcccactatccgacgagaacgatgtattcgataagttaagtgtcatagcagaggacagcgagagcggcaaacagaacccaggcgattcacccacatcccggaccccacgtccctggacgtag

SEQ ID NO: 42838 - DNA, 444 bp, Artificial Sequence
  Description of Artificial Sequence: Synthetic coding sequence
atgaagcacctgctgatgtggagccccgtgatcgcccccggcgagacagtgtattactctgttgaataccagggcgagtatgaatcgctctacacttcccatatttggattccttcatcctggtgttccttgaccgaaggcccagagtgcgacgttaccgacgacataacagccactgtgccttacaacctgagggtgagagcaaccttgggaagccagaccagcgcatggagcattctgaagcacccttttaacagaaattctactatcttgacaaggcctggtatggagatcacgaaggacggctttcacctcgtcattgaactagaggacctggggccacagtttgagtttcttgtggcctactggagaagagagccaggagccgaggagcgacccttcccatggtactggccatgtctgccactcctggcttcttgctag

SEQ ID NO: 42839 - DNA, 936 bp, Artificial Sequence
  Description of Artificial Sequence: Synthetic coding sequence
atgcagaccttcaccatggtgctggaggagatctggaccagcctgttcatgtggttcttttacgcactcatcccatgcctgctgactgatgaggtggcaattctcccggccccgcaaaacctgtcggttttgtctacaaacatgaaacatctgctgatgtggagtccggtgatcgccccaggggagaccgtgtattacagcgtcgagtaccagggcgagtatgaaagcctctacaccagtcacatctggatcccttcaagttggtgtagcctgaccgaaggccccgagtgtgacgtcacagatgacatcactgcaacggtaccctataatctgcgggtgcgagctaccctgggaagccagacttctgcctggtctattttaaagcacccattcaatcggaacagcactatcctgacaagacccggaatggaaatcactaaggatggctttcacctggttattgagcttgaggacctcggacctcagtttgaatttctcgtcgcttactggaggagagagccaggggcggaagagcacgtgaaaatggtgaggtctggcgggatccctgtgcatttggagacaatggaaccaggagccgcctactgcgtcaaagcacaaacattcgtgaaagcaataggccgatactccgcctttagtcagacagagtgtgttgaggtccagggggaagctattcccctcgttctcgccctcttcgcctttgtggggtttatgctcattctggtggtggtccccctgtttgtctggaagatgggtagactcctacagtattcatgctgtcccgtggttgtcttaccggatacactgaagatcactaactcaccccaaaagctcatctcttgtcgcagggaggaagtggacgcctgtgctactgctgtgatgagtccggaagaattactccgtgcatggatttcttag

SEQ ID NO: 42840 - DNA, 1725 bp, Artificial Sequence
  Description of Artificial Sequence: Synthetic coding sequence
atgcggaccctgctgaccatcctgaccgtgggcagcctggccgcccatgcacccgaagatccttcagatctcctgcagcatgtaaaattccaaagcagcaattttgaaaacatcttaacttgggatagtggtcctgagggcacacctgatacagtctatagtattgaatacaaaacgtatggggagagagattgggtcgccaaaaaaggctgtcaacgaatcaccagaaaatcttgcaacttgaccgtggagacgggcaacttgacagagctttactacgcacgggtgaccgctgtgtctgcaggtggcaggtcggcaacaaagatgaccgacaggttttccagcctgcagcataccaccttaaagcccccggacgtcacatgcatttccaaagtaagatcgattcagatgatcgtgcacccaactccaactccgatccgagcaggcgacgggcaccgactgacgcttgaagacatttttcacgatctcttctatcacctggagctgcaggtgaaccgaacatatcaaatgcatctcggaggaaagcagcgcgaatacgaattctttggactgacgcccgatacggaatttcttgggactatcatgatttgcgtgccaacatgggcaaaagaatctgcgccctacatgtgccgggtgaaaacactgcctgaccgtacttggacctactcattctctggtgcttttttattttccatgggcttcctagtggcggtgctctgctatctgtcttaccggtatgtgacaaagcctccagcgccacccaatagtttgaatgttcagcgtgtcctgaccttccaaccactgcggttcatccaggagcacgtgcttatacctgtgttcgacctgagcggtccgtccagcttagcccagccagtccagtactctcagatcagagtgtccgggccacgagagcccgcaggggcccctcagagacattctctttcagaaatcacctacctgggccagccagacatcagtattctgcagcccagcaacgtacctccgcctcaaattctatctccactttcttatgccccaaacgccgcccccgaggtgggcccgccctcctacgccccacaagtgacccccgaagcacagttcccattctatgctccccaagccattagcaaggttcagcccagctcttacgccccacaggcgactcctgacagctggcctccaagctatggggtgtgtatggagggaagcggaaaagattctcctacgggcacattgagctctcctaagcacctcaggcccaagggccagctgcagaaggaaccccccgcaggctcctgtatgcttggtgggctgagcctacaggaagtgacttcccttgctatggaagaatcacaagaggctaagtccttacatcagcccctgggaatatgtacagacagaacttcagatcccaatgtgcttcactcaggggaggaagggaccccccagtacttaaaggggcagttgcccctgctgtccagcgtccagattgaggggcatcctatgtccctccccttgcagcccccaagcagaccctgctctccctcagaccaaggccctagtccctggggcctactagagagcctggtttgtcctaaggacgaggccaagtcacctgcccctgagactagtgatctggaacagcctaccgagctcgactccttgtttaggggtttagcactaaccgtccaatgggagagttag

SEQ ID NO: 42841 - DNA, 1911 bp, Artificial Sequence
  Description of Artificial Sequence: Synthetic coding sequence
atgcggggcggccggggcgcccccttctggctgtggcccctgcccaagttggctcttctgcctctgctctgggtactgttccaaaggacccggccgcaaggcagcgccggaccacttcagtgttacggagtggggcctctgggcgacttaaactgtagttgggaacccctgggagacctgggagctcccagtgagcttcaccttcagtcacagaagtaccgcagcaataagacgcagactgttgcggtagcagctggacgctcttgggtagctatccctcgagaacaactgactatgagcgataaacttttggtatggggcaccaaggcagggcaacccctgtggcctccagttttcgtgaaccttgagacccaaatgaagcctaatgcccctcgcctcgggccagatgttgacttttctgaagatgaccctctcgaagccacggtccattgggccccaccgacatggccaagccataaagtgctgatctgccagttccactacaggcgctgccaggaagccgcttggacattgctggaacccgagctgaagacaatcccattgacacccgtagagatacaggaccttgaattagctacgggttacaaggtatacggaagatgtcgcatggaaaaagaggaagacctatggggagaatggtcccctatattgtctttccagacgcctcccagcgcacccaaagatgtctgggtgtccgggaacctttgcggcacccctgggggcgaagagcctctactcctgtggaaggccccgggtccctgcgtgcaggtgtcttataaagtctggttctgggtgggagggagggagctgagccctgagggcattacatgttgctgttcattgattcccagtggagcggagtgggccagggtgtccgccgtcaatgccacctcatgggagcctctgactaacctttccctggtatgcctggactcagccagtgctcctcgctctgtggcagtgtctagcatcgcagggtccaccgagctccttgtcacatggcagccaggacccggcgaacctctggagcacgtagtggactgggcacgcgatggagaccctttggagaagcttaactgggtgcgtctccctccagggaatctgtccgcgttattgccagggaattttacagttggggttccctaccgcattactgtcactgccgtgagcgcgtccggattagcgagcgctagcagcgtgtgggggttcagagaagagttggcaccgctcgtgggcccaaccctttggcgcctgcaggacgctccacccggcacccctgcaatagcatggggtgaagttccacgccaccagctccgcggccatctgacgcactacaccctgtgcgcccagagtggcactagccccagcgtgtgtatgaatgtgtccgggaatacccagtccgtgacattgcctgatctaccctggggaccttgcgagctctgggtcaccgcgtccactatagctggccagggcccaccagggccgatcctgcgcctccacttgccagataatactctgagatggaaagtgctgccaggaatcctctttctctggggtctgttcctgctcggctgtggattgtccctggcgaccagcgggcgatgttaccatctgagacacaaggttctgccaagatgggtttgggagaaggtccctgatcctgccaattctagctcaggccagccacacatggagcaggtgccggaagcacagccactgggggatctccccatactggaggtggaggaaatggagccgccacctgtcatggagtcatcacagccagcccaagccaccgcaccgctcgacagcggatacgaaaagcacttcctgccaaccccggaggaactggggctgctgggtcctccacgaccgcaggtcctggcatag

SEQ ID NO: 42842 - DNA, 453 bp, Artificial Sequence
  Description of Artificial Sequence: Synthetic coding sequence
atgaccatcctgggcaccaccttcggcatggtgttcagcctgctgcaggtagtgtcaggggagtcaggatacgcccagaatggggatctggaggatgccgagctggacgattattcattctcctgctatagccaattggaggtgaacggctcacagcacagtctgacctgcgctttcgaagacccagatgttaacatcacaaacctggaattcgagatttgtggcgctctggtggaggtgaagtgccttaactttagaaaattacaggagatatatttcatagagaccaagaaattcctgcttataggtaagagcaatatttgcgtgaaagtgggagaaaagagcctgacctgtaagaagattgacctgacaacgattggaaaaaagctgtacatcaaagtatggcttagtttacttgggtatctgaagacgctgtgcctggacattctttag

SEQ ID NO: 42843 - DNA, 543 bp, Artificial Sequence
  Description of Artificial Sequence: Synthetic coding sequence
atgaccatcctgggcaccaccttcggcatggtgttcagcctgctgcaagttgtgagcggagaaagtggatatgcacagaacggcgatctggaggacgcagagctcgacgattattcattctcctgctatagtcagctggaggtgaatggctcccagcattccctgacctgtgccttcgaagatcctgatgtaaatatcaccaacctcgagtttgaaatttgtggggccttagtcgaggtcaagtgtttgaattttcgcaagctgcaagaaatctacttcatcgagactaagaagttcctccttattggaaaaagtaatatttgtgtgaaagtaggcgagaaatcccttacctgtaagaagattgacctgaccaccatagtcaagcccgaggctcctttcgacttaagcgtggtgtaccgagagggggctaacgacttcgtagtcaccttcaacacctctcacctacagaaaaaatatgttaaggtgctcatgcacgacgtagcataccggcaggaaaaggatgaaaacaaatggaccgattag

SEQ ID NO: 42844 - DNA, 1893 bp, Artificial Sequence
  Description of Artificial Sequence: Synthetic coding sequence
atgcccctgggcggccgggccagcctgaccccccagaagctgtggctgggcactgcaaaacctgggtcactcactcaggcactgaacagtccgttaacgtgggaacacgcatggacgggcgtccccggtggtacccccgactgtctgactgacacctttcgggtgaagcgaccccatcttaggaggagcgcatcaaatggacacgtccccggtactcctgtctatagggagaaagaggatatgtatgacgagattatcgaacttaagaaatccctacacgtgcagaagtcagatgtggacctgatgcggaccaaactaaggagactcgaggaggagaactcccggaaggaccgccagatagagcagctgctagaccctagtcggggaaccgactttgtccggactctagcagaaaaacgccccgacgccagctgggtgatcaacggattgaaacagagaatcctaaaactagagcagcagtgcaaggagaaagatgggactatcagcaagctgcagaccgatatgaagaccactaacctggaggaaatgcggattgctatggagacttattatgaggaggtgcatcggctgcagaccttgctggcctcaagtgagaccacgggtaagaagccgctgggcgagaagaagaccggcgcaaagaggcaaaaaaaaatgggatccgccctcctttcactaagcagaagcgtacaggagctgaccgaggaaaatcagtccctaaaggaggatcttgacagagtactatccacctcacctacgatttctaaaacccagggatacgttgagtggagtaaacccaggctcctaaggcgtattgttgagctggagaagaaattgtctgtgatggagtccagcaagtcacacgccgcagagccggtgcggagccatcctcctgcgtgcttggcaagttcgtccgcccttcaccggcagcccagaggggatagaaataaagatcacgagaggctgcgaggggcggtgagggatctgaaggaggagagaaccgcattacaggagcagctgcttcaacgggacctggaggtgaaacagttgctgcaggccaaagccgatctagaaaaagagctagagtgcgctcgtgagggagaggaggaaagaagagagagagaggaggtccttagggaagagatccagaccctgacgtctaagctgcaggagctgcaggaaatgaagaaagaagagaaggaggattgccccgaggttccacacaaagcacaagagttacctgcgcctactccatcctctagacattgcgaacaggattggccgccagattcatccgaggaaggcctaccaagaccccgctccccttgctcagatggacgtcgtgatgccgcagcccgtgtgttgcaagcacagtggaaggtctataaacataaaaaaaaaaaggccgtactggacgaggccgccgtggtgcttcaggcagcatttcggggtcacctgacgagaacaaagttgttagccagtaaggcccatgggtcagaacctccctccgtccctgggctgcccgaccagagttcccccgtgccgagggtgccgtccccgatagcacaggcaactggcagcccagttcaggaagaggctatcgttattatccaaagtgccctcagagctcatctagccagagccaggcactcagcgacgggaaagcggacaaccaccgccgcctcaacaaggcggaggtcagcgtctgcgacccatggggacgcctcgtcccctcctttcctggcagctctgccggatccctcgccgagtgggccacaggccctcgctcctctgcccggcgacgatgtcaacagtgatgactcggatgatatcgttatagctcctagtctccctactaaaaactttcccgtctag

SEQ ID NO: 42845 - DNA, 2088 bp, Artificial Sequence
  Description of Artificial Sequence: Synthetic coding sequence
atgttcctgggcaccggcgagcccgccctggacaccggcgacgactctttatcagcagttacgtttgacagtgacgtcgaaactaaggctaagcgtaaggcatttcataagccccctcctaccagtccaaagagcccctacttgtcaaaacctcggaaagtagcctcttggcgttctctccgaaccgccggctcaatgccgctgggaggccgtgcttccctgacccctcagaaactgtggttgggcaccgccaaaccaggttcacttacccaggccctaaactcccccttgacatgggaacacgcctggaccggagtgccaggaggcacacctgactgcttgaccgatacctttcgtgtcaagcgtcctcacttgagaagatcagcctccaatggccacgtgcccggtactcccgtgtatcgtgagaaagaggacatgtacgacgagataatcgaattaaagaagtccctccacgtccagaagagcgacgtggacctgatgaggacaaaactccgtaggctcgaggaggagaattccagaaaagatcgacagatcgaacagctcttggacccaagccgcgggacagacttcgttagaaccctggccgaaaagaggcctgatgcctcttgggtcattaacggacttaagcagagaatccttaaactggagcagcagtgcaaggaaaaggacggtaccatctccaaattgcaaaccgatatgaagacgaccaacttagaggagatgcggatcgctatggaaacttactacgaggaagtgcacagactgcagacactcctcgcatccagtgagaccactggtaagaaaccactgggcgaaaagaaaacgggtgccaagaggcaaaaaaaaatgggttcagccctgttgagcctgtcacgatcagtccaggagctgactgaagaaaatcagtccttgaaagaggaccttgacagggtgcttagcaccagccccactatctccaagacacagggttatgtagaatggagtaagcctcgactcctgcggcggattgtggagttggaaaaaaaactaagcgtaatggagtcctctaagtctcacgctgctgagccagtgcgatcccatccacccgcatgcctggcgtcgtcatccgccctgcatcgccaaccccggggagatcgcaataaagatcacgagagactcagaggcgccgtccgagacctaaaggaggagagaaccgctcttcaggaacagctgctccagcgggacctggaggtcaagcagctcctacaagcaaaggccgatctggaaaaggaactggagtgcgcccgcgagggggaagaagaaaggagagaaagagaggaggttctgcgcgaggagattcaaaccctcacaagcaaactgcaagagctgcaggaaatgaaaaaagaagagaaggaagactgccccgaggtcccccataaggctcaggagctgccagcgccgactcctagttctcgccattgtgagcaggattggccgccagactcttctgaggagggcctgccccgccccagaagcccctgcagtgatggtaggagagatgccgcagcaagagtcctgcaagcacagtggaaggtctataaacataaaaaaaaaaaggccgtgcttgatgaggcggccgtcgttttacaagccgcattcagaggccacctgacccggactaaactgctcgcatccaaggcccacggtagcgaaccccccagcgtacccggccttcctgaccaatcttcacccgtgccccgcgtgccaagtccaatagctcaggcaacaggatcacctgtccaagaagaagcaatcgtcatcatccagtctgcgctacgagcccacctggctcgggccaggcatagcgccaccggcaagcgcactacaaccgccgctagtacacgtaggaggagtgctagcgccactcacggggatgctagttcaccgccattcctcgcagcattgcccgatcctagtccatccggcccccaggccctcgctcctttgcccggagatgacgtgaactccgacgacagtgacgacatcgtgatcgccccctccctgcctaccaaaaactttcctgtctag

SEQ ID NO: 42846 - DNA, 1935 bp, Artificial Sequence
  Description of Artificial Sequence: Synthetic coding sequence
atgttcctgggcaccggcgagcccgccctggacaccagccacctgattagcctgtccagggccagcttaaccccccagaagttgtggctgggcactgccaagccagggagtctgactcaggctctcaacagccccctcacctgggaacacgcttggactggggtgcctggcgggaccccagattgtctgaccgacactttccgcgtcaagcggccacacctgcggaggtccgccagcaacggccacgtgcctgggacaccggtgtaccgggagaaggaggacatgtacgacgagataatcgagctcaagaaaagtcttcatgtccagaagtctgacgttgatttgatgcgaacaaagttgaggcgcctggaagaagagaattccagaaaagatagacagattgagcagctgcttgatcccagtagagggaccgacttcgttcgcacacttgccgaaaaaaggccggatgccagctgggtcattaatggcctgaaacaaaggattttaaagctggagcagcaatgcaaagagaaggacggcactataagcaagctgcaaactgatatgaagaccacaaatttagaggagatgaggattgccatggaaacctactacgaggaggtgcatcgcctgcagacactgcttgccagctctgagaccacaggcaagaaaccactcggtgagaagaaaacgggagcgaaaagacaaaagaagatgggcagtgccttgctctccctgagccgaagcgtgcaagaactcactgaagaaaatcaatctcttaaggaggatttagatagagtcctgtccacatcccctaccatctccaaaacacagggctacgttgagtggtccaaacctcgattgctgcggcgcatcgtcgaacttgagaagaaactctccgttatggagagctccaaatcacacgcagctgaacccgtgcggtcccacccacccgcgtgtctcgcctccagctcagcactacacaggcaaccaaggggcgataggaacaaagatcacgagcgattacgaggcgccgtgagggatttgaaagaggagaggacagcccttcaggaacagctgttgcagcgggacctggaagtgaaacaactgctgcaggcaaaggctgacctggagaaagagctggagtgcgcccgggaaggagaagaggagaggagagagcgggaagaggttttgcgtgaagaaattcagactctcacctccaaattgcaggagctacaggagatgaagaaggaggagaaggaagattgtcctgaagtcccccataaggctcaagaattaccagctccaaccccttcctctcggcactgcgagcaggactggcccccagactcctcagaggagggcctgcctaggcccaggtcgccttgctcagatggtagaagagatgcagctgccagagtgttacaagcccagtggaaggtctataagcataagaagaagaaggccgtcttggacgaggcagctgtggtgctccaggccgcgtttagaggccatctgactcgcacaaaactgttagccagtaaggcacacgggtctgagcccccttcagtccccggactcccagaccagagctcccccgtgccgcgcgtgccatccccaatcgcccaggccactgggtctccagtgcaagaggaagcaatcgtcattatccagagtgccctgcgtgctcatttagccagggcgaggcattcggcaacaggcaaacgcaccacaacagcagccagcaccaggcgtcgctcagctagcgctacccacggagatgcttcgtccccccctttcctggctgcactgcccgatccgagccctagtggcccccaagctctggcccctcttccaggagacgatgtgaatagcgatgatagcgatgatatcgtcatcgcacctagtttgcctaccaagaacttcccagtgtag

SEQ ID NO: 42847 - DNA, 387 bp, Artificial Sequence
  Description of Artificial Sequence: Synthetic coding sequence
atgcccctgggcggccgggccagcctgaccccccagaagctgtggctcggcaccgctaagcccgggtccctcacccaggctcttaactcccctctgacctgggagcatgcgtggacgggtgtgccaggggggacgcctgactgtctgacagacaccttccgcgtgaagagaccacaccttcgtcgcagcgccagtaacggacatgtgcccggcacgccggtctatcgcgaaaaagaagacatgtacgacgagatcattgagctgaagaagagcctgcatgttcagaagtcagatgtggatctgatgcgaactaagctgcgaaggttggaggaagagaattcgcggaaagaccgccagatcgaacagctattagacccctctaggtag

SEQ ID NO: 42848 - DNA, 387 bp, Artificial Sequence
  Description of Artificial Sequence: Synthetic coding sequence
atgcccctgggcggccgggccagcctgaccccccagaagctgtggctcggaaccgcaaaacctggctcacttacccaagcccttaacagccctctgacttgggaacacgcatggacgggagtgcctggcgggactcctgactgtctgacagacaccttccgcgtgaaaagacctcacttgagaaggtccgcttcaaatgggcatgtgcctgggaccccagtatacagggaaaaagaagatatgtacgatgagataatcgaattaaaaaaatcacttcatgtccagaagtcagatgtagaccttatgaggaccaagctgcgccggttggaggaggagaattccaggaaggatagacagattgagcagctgctggaccctagtaggtag

SEQ ID NO: 42849 - DNA, 2040 bp, Artificial Sequence
  Description of Artificial Sequence: Synthetic coding sequence
atgttcctgggcaccggcgagcccgccctggacaccaaggccaagcggaaagctttccacaaacctcccccaaccagccctaaatctccatatctgtccaagccccgcaaggttgcatcttggaggtcgctacgtacggccggtagcatgcccctcggaggcagggcgtctttaacccctcagaagctgtggctcggtacggcgaaacctgggagtcttacacaggcccttaactcgccactcacgtgggaacacgcttggaccggtgtgccaggtggaacacctgactgcctgactgatacattcagagtgaagaggccgcatctacgtaggagcgcttcaaacggccacgtcccaggtacgcctgtctacagggaaaaagaggacatgtacgacgagatcattgaactgaagaagagtctgcatgtgcaaaagtctgacgtggacctgatgcgcactaaactccgcaggctggaggaggagaacagtcggaaggacaggcagatcgaacagttgctggatccatccagaggtacagacttcgtgcgcaccctagccgaaaaaagacccgatgcatcttgggtgatcaacggtctaaaacagcgaatcctcaagctggaacagcagtgcaaggaaaaagatggaacaatatcaaagcttcagactgatatgaagactacaaacttagaagagatgcgcatcgcaatggaaacttattacgaagaagtgcacaggcttcagactctcctggcgagcagtgagaccaccgggaagaagccgttgggagagaagaagactggagctaagagacagaaaaagatgggtagcgctctcctgagcttatcccgcagtgtacaggaactcacggaagagaatcagagtttaaaggaagaccttgatcgtgtgctaagcacctccccgacgatctctaaaacccagggttatgtggaatggtcaaagccacggctgctgcgacggatagtggagctcgagaagaaactcagtgtgatggagtcttccaaaagtcatgccgcagaacccgtgaggtcccaccctcccgcttgcctggcctccagcagcgcattgcatcggcagccgcgcggagatcggaacaaggaccacgaacgcctgcgcggtgcggtccgagacctgaaagaggagcgaaccgcccttcaggaacaactcctacagcgggacctcgaggtcaaacagctgctgcaggcgaaggccgaccttgagaaagagctggagtgcgcacgagaaggagaggaggagaggcgagagagggaggaagtgcttcgggaggagatccagaccctgacgagcaaactccaggaattgcaggagatgaagaaggaggaaaaagaggactgccccgaggttccacacaaagctcaagaactcccggctccgactccatcaagccgccattgcgaacaagattggcctcctgacagtagtgaagaaggactccctcgcccccgatctccatgtagcgacggccggcgagatgccgcagctagggttctccaggcacagtggaaggtttacaaacacaaaaagaaaaaggcggttcttgatgaggccgctgtagtgctacaggcagctttcagagggcacctgaccagaacaaaacttttggcatccaaggctcatggaagcgagcctccatctgttcccggactgccggatcagagttctccagtccctagggtcccatcccccatcgcccaggccacaggatcgcccgtgcaggaagaagcgatcgtgataatccagtcagccctgcgggcacacttggccagagctcgccatagtgccacaggcaagagaacgaccactgccgcatccacaaggcgcaggtccgcctcggctactcacggagatgcttcatctcctccttttctggccgccttgcccgatcctagtccttccggcccacaggccctggctccgctacccggggatgatgtgaatagcgacgattcagatgatattgtcattgcccccagcctgcctacaaaaaattttccggtatag

SEQ ID NO: 42850 - DNA, 4896 bp, Artificial Sequence
  Description of Artificial Sequence: Synthetic coding sequence
atggagcggcgggccgccggccccggctgggccgcctacgagcggctgaccgctgaggaaatggatgagcagagaagacagaacgtggcatatcagtacctctgcaggttagaagaagccaagcggtggatggaggcttgtctgaaagaagagctgccctcaccagtggagttggaagagtccctgcgaaacggggtgcttctcgccaagctggggcactgctttgctccgtctgtcgtccccctgaaaaaaatttacgacgttgagcagttacggtatcaggctactggactccattttagacacaccgataacatcaatttttggcttagtgccatcgcgcatatcggtctaccatccaccttcttcccagaaacaactgatatctacgacaaaaagaacatgccccgggtcgtgtattgcatacatgcccttagcctgtttctcttccgtttgggcctggccccccaaatccacgacctgtacggcaaggttaaatttacagcagaggagctttccaacatggcttctgagctagcgaaatacggcttgcagctgccggccttcagtaagattggaggaatcctggctaatgaattgtctgtggacgaggccgcggtacatgctgcagtcctggctatcaacgaagccgtcgaaaggggcgtggtggaagatacactggcagctcttcagaaccctagcgctcttcttgagaacctgcgagagccactggccgctgtctaccaagaaatgttggcacaggccaaaatggagaaagccgccaatgcgcgcaatcatgatgatcgggaatcacaggatatttacgaccactatctgactcaggctgagatacagggcaatattaatcacgtgaacgttcatggagctctcgaggttgtagacgacgctttagagcgccagtctcccgaggccctcctgaaagcactccaagaccctgccctggccttgcgaggagtacgcagagactttgctgattggtacctggaacagctgaatagcgaccgcgaacagaaagcccaagaactcgggctggtggagctgttggagaaagaagaagttcaggccggagtggcagccgcaaacacaaagggagaccaggagcaggcaatgctgcacgccgtccagcggattaataaggctattcggcggagggttgcggccgacactgtcaaggaattgatgtgtcccgaagctcagttgccacctgtctatccagtggctagctcaatgtatcaactggaactggccgtgctgcaacagcagcaaggcgaattgggccaagaggagctttttgttgcggtcgagatgctgagtgcagtggttttgatcaatcgggcgttagaggctagagatgcgtcaggtttttggagctctctggttaatcccgcaaccggtctggctgaggtggagggcgaaaatgcccaaaggtacttcgacgcccttctcaagttgcggcaagaaagagggatgggcgaggacttccttagctggaatgacctgcaggctaccgtatcccaggtaaacgcccagacccaggaagaaactgacagagtcctggctgtgtcactcattaacgaggcattggataaaggctcacctgaaaagacattgtccgctctcctgttgcctgcagccgggctcgatgacgtgtccctccccgtcgcaccgcgttatcatctgttattggttgctgccaaaaggcaaaaggctcaggtgactggtgacccaggggcagtcctgtggctcgaagaaattaggcagggcgtagtcagagccaatcaggataccaacacggcccaacgcatggctctcggcgtagcggcaatcaaccaggccattaaggaaggaaaggccgcacaaacagaacgcgtgcttaggaacccggccgttgctctccggggagttgttcctgactgcgctaacgggtaccaacgagcgctggaatctgccatggccaaaaagcagagaccagccgacaccgcattctgggttcaacatgatatgaaggatgggaccgcctattatttccatttacagacattccagggcatctgggaacagcctccggggtgccccttgaatacaagtcacctgactagagaggaaatacagagtgcagtgacaaaggtgacagctgcctacgaccggcaacaactgtggaaggccaacgtaggatttgtgatccagttgcaagcacgactccgggggtttctggttagacagaaattcgccgagcattctcacttcttgcgcacatggctgcctgccgtaatcaagatccaggcccactggcgtgggtatagacaacgtaagatctatcttgagtggctccaatatttcaaagccaacctcgacgcgataatcaagattcaggcatgggcccgtatgtgggcagcccgtcgacagtaccttcggagactgcattacttccaaaagaacgtgaactctatcgtaaagatccaggccttttttagagctagaaaggcacaggatgactaccggattttagtccacgcccctcatcccccgctcagcgtggtgagacgattcgcccacctactgaaccagagtcagcaagattttttagctgaggccgagttgctgaaacttcaggaagaagtggtccgcaagataagatcaaaccagcagcttgaacaggatctcaacattatggatattaagataggtttactggttaagaatcgcattacattacaggaagtggtttcccattgcaaaaaactgactaagagaaataaggagcaactttctgatatgatggtattagataagcagaaaggccttaagagcctcagtaaggaaaagagacagaaattggaagcatatcagcatctgttttacctgctgcagacacagccaatttatctggccaaactgatctttcaaatgcctcaaaataagactacaaagttcatggaggctgttattttttctctgtacaactacgctagcagcaggcgcgaagcatatctgctcttgcaactctttaagactgccctacaggaagagattaaaagtaaagtagaacaaccgcaagacgtagtcactggaaaccctaccgtagtacgcctcgtagtcaggttctaccgcaatggcagaggccagtcagccctgcaggaaatcttgggaaaggtgattcaggatgtgctggaagataaagtgctgagtgtgcatacagaccccgttcacctttataaaaattggatcaatcaaacagaggctcagaccggtcagcgttctcatttaccttatgatgtaactccagagcaggctctgagccacccggaggtccagagaaggttggacattgcactgcgcaacctgcttgcaatgaccgataaatttctgctggcaatcaccagctctgtggaccaaatcccttacgggatgcgttacgtcgccaaggtgttgaaggcaactcttgccgaaaagttccccgacgcaactgattctgaagtttacaaggtggttggcaacttactgtactatcggttcctcaatcccgccgtcgtggcccccgacgcctttgacatcgtggcaatggccgcagggggggcattagccgcaccccaacgccacgctttgggcgccgtcgcgcagctgcttcaacacgcagccgccggcaaagctttcagcgggcagagccagcatctgcgcgtcttaaatgattatctagaagagactcacttgaaattccgtaaattcattcaccgcgcgtgtcaagtcccggagcccgaagaacgttttgccgttgatgaatattcagatatggtggccgtcgccaaaccaatggtgtatattactgtgggggaactcgttaacacgcacagactactgctcgagcaccaagactgcatagcccctgaccatcaggaccctctgcatgagttgctggaggacctgggggagcttccaactattccagacctcataggcgagagcatcgcagctgacggacacacagatctaagtaagctggaagtgtccctgactctgactaataaatttgaaggattggaagcagatgcagacgatagcaacacgagatctctgctcctttccaccaagcagcttctcgctgatattattcagttccatcctggtgatacactaaaagaaatactctcgttatctgccagccgcgagcaggaggccgcccacaagcaactgatgtcaagaagacaggcctgtaccgcacagaccccagagccactgagacgccatcgttcattaacggcacactctttgctccccctggccgaaaaacagcgacgagtgttgcgcaacctcaggcggttggaggccctgggtttggtttctgcaaggaatggctatcagggactagttgatgaactcgctaaggacattaggaaccagcaccgacaccggcacaggaggaaagctgaattggttaaactccaagcaaccctgcagggtttgtccaccaagacgaccttttatgaggagcagggagactactatagccagtatatcagagcttgtctcgaccatctagccccagatagcaaaagtagcggaaaaggcaagaaacagccttccctccactacactgctgctcaactgctggaaaaaggcgtgctcgtagaaattgaggaccttcctgcgtctcactttaggaatgtgatcttcgacataactcctggcgatgaggccggaaaattcgaggtcaatgctaagtttctgggagttgatatggagagattccagctgcattatcaggacctgctgcaactgcagtacgaaggcgtggcagtgatgaagctgttcaataaggccaaagttaacgttaatctcctgatttttttgctcaacaaaaaattcctgagaaagtag

SEQ ID NO: 42851 - DNA, 465 bp, Artificial Sequence
  Description of Artificial Sequence: Synthetic coding sequence
atggccgccgcctggggcagcagcctgaccgccgccacccagcgggccgtgactccgtggccccggggtcgcctgctcactgcctctctcggaccccaggcccggcgtgaagcatccagctccagtccagaagctggggaagggcaaatccggctcacagactcctgtgtgcagagactgcttgagattaccgagggaagcgaattcttgagactgcaggtggaaggagggggttgcagtggcttccagtacaaattcagtctggatactgtgattaaccccgatgatcgtgtgttcgagcagggaggagcacgtgtggttgtggatagtgattcactggcgtttgtcaagggcgcgcaggtggatttctcacaggagcttatcagatcctccttccaggtgctaaacaatccccaggcacaacagggatgtagttgtggttcctctttttccatcaaactctag

SEQ ID NO: 42852 - DNA, 666 bp, Artificial Sequence
  Description of Artificial Sequence: Synthetic coding sequence
atgcccctggccctgaccctgctgctgctgagcggcctgggcgcccccgggggttggggctgccttcagtgtgaccccctcgtgctcgaggctctcggacacctccgttcagcattgatcccatcaaggttccagctggagcagctccaggctcgtgcaggtgccgtcctaatggggatggagggcccatttttccgtgattacgcccttaatgtgttcgtgggcaaagttgaaacaaatcagttagatttggtagcatcttttgtgaagaaccagacccagcacctgatgggcaatagcctcaaagacgagcctctcctcgaggagcttgtgactctgagggccaacgtcattaaggaattcaagaaagttttgatctcatatgaactgaaagcctgtaatccgaaactgtgccggctgcttaaggaggaggttctggactgtctccactgccagagaataactcctaagtgcatacacaaaaagtactgcttcgtcgacaggcagccccgggtcgccctgcagtatcagatggatagcaagtatcccagaaatcaggccctgttgggaattttgatctccgtatccttagcagtatttgtgtttgtggtgattgtggtgtcagcctgcacctataggcaaaatagaaagctactgctgcagtag

SEQ ID NO: 42853 - DNA, 579 bp, Artificial Sequence
  Description of Artificial Sequence: Synthetic coding sequence
atgcccctggccctgaccctgctgctgctgagcggcctgggcgcccctggcggctggggatgtctccaatgcgacccattagtgctcgaagccctgggacatctcagaagcgcactcattccctcaaggtttcaattagagcagctccaagcaagggccggcgcagtgctgatgggaatggaggggcccttttttagggattatgctctgaacgttttcgtaggaaaggtggagacgaatcaattggatttggtggctagttttgtaaaaaaccagacacagcacctgatggggaattccctgaaagacgaacctctcctggaagagctcgtgacactgagggctaacgtgattaaggagtttaaaaaagttttaatcagttacgagcttaaggccgggaacccagcatggccctgcagcacaagatggactgccaatactcgcggaactcggcggtgttgggccagctcgtttctgtgcctgtggctctctttgagctcttggagcagttggagtagattggtgcataccgataagacggagaattcctgctgctctaggacggtggtatgggggtag

SEQ ID NO: 42854 - DNA, 720 bp, Artificial Sequence
  Description of Artificial Sequence: Synthetic coding sequence
atgggcgacctgtggctgttcctgctgctgcccctgagcgccttccatggagtgaaagggtgcttagagtgcgacccgaaatttatcgaggacgtcggctctctcctaggaaacctcatcccaagcgaggtaccgggccggactcagcttctggagaggcaaatcaaagaaatgatacacttatcatttaaggtttctcatagcgacaagagactgcgtgtgttggcggttcagcaggtggtgaagctcaggacctggttgaaaaacgagttctacaagctgggtaatgagacatggaagggagtgttcatttatcaaggtaaattgttggatgtgtgccaaaacctggaatctaaactgaaggagctgctgaagaatttttctgagatagcatgctccgaggactgtattgtggtggaggggcctattctggattgctggacgtgcctgcggatgacgaatcgctgttttaagggagagtattgtggagacgaggatcctagaaaggccgaaaaccgggaaattgctctttttctgatcctgctcgcgaccgctgtcatcttgggctcggcggtgctcttgttccatttctgcatatttcatagaaggaagatgaaagccatcaggcggagtctcaaggagtatgtggaaaagaaactagaggaactaatgggcaagatagacgagaaagaggaaaaggacttccgcttgcgcaaatag

SEQ ID NO: 42855 - DNA, 1053 bp, Artificial Sequence
  Description of Artificial Sequence: Synthetic coding sequence
atgggcccccacttcaccctgctgtgcgccgccctggccggctgccttctgcctgcggagggatgtgtaatctgtgatccttcagtagtcttggctttaaagtctttggaaaaagactatctgcccggtcatctggatgctaagcaccataaggcaatgatggagagggtcgagaatgccgtcaaagactttcaggaactgtctctgaatgaagacgcgtacatgggcgtggttgatgaagctaccctgcagaaggggtcttggagcctactgaaagatctaaaacggatcactgactccgatgtgaagggcgatcttttcgtaaaagagctgttttggatgctgcacttgcagaaggaaaccttcgctacatacgtcgcgcggttccagaaggaggcctactgtccaaacaagtgtggggtgatgctgcagaccctgatttggtgcaagaactgtaaaaaagaagtgcatgcgtgcagaaagtcctatgactgtggcgagcgcaacgtggaagtgccccagatggaagatatgattctcgactgtgagctcaactggcaccaggcctccgaaggtctcacagattactccttttaccgcgtatgggggaataacaccgaaacgctggttagcaaaggaaaggaagctaccctcaccaagccaatggtaggcccggaggacgcgggaagctacagatgcgagctcggatccgtgaatagttcacctgccaccattattaacttccatgtgaccgtgctgcctaaaatgatcaaggaggagaagccttccccaaacattgtgacccccggggaggcaaccaccgagtcaagcatctccctgcagccactccagcccgaaaagatgcttgcttccagactgctcgggctcctgatttgtgggtccctggcgctgattaccggcctgacttttgctatattccgcagacggaaagtgattgacttcatcaaatcgagtttgttcggacttggctccggggccgctgaacagacacaagttccaaaggagaaggccactgactctcggcagcagtag

SEQ ID NO: 42856 - DNA, 552 bp, Artificial Sequence
  Description of Artificial Sequence: Synthetic coding sequence
atggccagccgggccggcccccgggccgccggcaccgacggcagcgacttccagcaccgggagagggttgcaatgcattaccagatgtcagtcactctgaagtacgaaatcaagaaattgatttacgttcacctggtcatatggctgttgctggtggctaaaatgagtgtgggccatctgagattgttaagccacgatcaggtggctatgccatatcagtgggagtacccttacctcctgtcaatacttccaagtctattaggcttgttgagttttcccaggaacaatatctcatacctggtcctctctatgatcagcatggggttgtttagcatagcacctctcatttacgggtccatggagatgtttcccgcagctcagcaactgtatcgacacgggaaggcttatagatttcttttcggattttctgccgtgagcatcatgtacctcgtcctagtcctcgccgtgcaggtccacgcctggcagctctattactccaaaaaattgctggatagctggttcacaagcacccaggaaaaaaagcataagtag

SEQ ID NO: 42857 - DNA, 546 bp, Artificial Sequence
  Description of Artificial Sequence: Synthetic coding sequence
atggccagccgggccggcccccgggccgccggcaccgacggcagcgactttcagcaccgcgagagagtggctatgcactatcagatgagcgtcactctgaagtacgaaattaaaaagttaatttacgtgcatttggtcatttggctacttctggtcgcaaagatgagtgtgggacacctgagactcctgtctcatgaccaggtagccatgccgtaccagtgggagtacccctatctgctgtccatcctgccaagcctccttggcctgctgtcttttccacggaacaatatctcttacctggtcttaagcatgataagtatgggtctgttccacagatccacccacctgtggcagcatggagacgtaccctgttgcacagccgccaccgctatggctagaccaacagtgtcttccctggtgtttctccctttccctatgtaccttgtcctggtcctggcagttcaggtgcatgcttggcagttatactactcgaaaaaacttttggactcttggtttacatctacgcaggagaaaaagcacaagtag

SEQ ID NO: 42858 - DNA, 1881 bp, Artificial Sequence
  Description of Artificial Sequence: Synthetic coding sequence
atgagcaagaagggccggagcaagggcgagaagcccgagatggagacagacgcggtgcaaatggcaaacgaagaacttagagcaaagctcacttcaatccagattgagttccagcaggagaagtctaaagtagggaaactcagagagagactgcaagaggccaaacttgagagagaacaggagcagcgccgccataccgcgtacattagcgaattaaaagcgaaactgcacgaagagaagacaaaggagctgcaggccctccgggagggcctgatccgacaacacgaacaggaggccgctcggaccgcaaagatcaaagaaggcgaactccagaggctgcaagcaactctgaatgtgttgagagatggtgccgctgataaagttaaaacagctctgctgaccgaggctagggaggaagcaagacgcgccttcgatggggagcggctccggcttcaacaggaaattctggagttaaaggccgctcgcaagcaggctgaggaagccttgtctaattgtatgcaagcggataaaacgaaggctgcggacttacgtgcagcttaccaagctcaccaggacgaggtgcaccgaattaagagggagtgcgagagggacatccggaggctgatggatgagattaaaggcaaagacagagtgatactggccctggagaaagagcttggcgtccaggcagggcagacccagaaactgctcctccagaaggaggccttggacgagcaactagtgcaggtgaaagaggcggagaggcatcacagcagccccaagcgcgaactgcctcctgggatcggagatatggttgagcttatgggtgtgcaggatcagcatatggacgagcgcgatgtgcgaagatttcaacttaagatcgccgagctgaactctgtgataaggaaacttgaggacaggaataccctacttgccgacgaacggaacgagctgcttaaacgttccagagagacagaggtccagcttaagccacttgtggaaaagaataagcgcatgaacaagaagaatgaagatttgttacagagcattcaacgcatggaagaaaagattaaaaatctcacaagggagaacgtggaaatgaaggaaaaactgtcggctcaagcttccctcaaacgtcacaccagcttaaacgacctttccctgacacgtgacgaacaggaaatcgagttcttgcgcctccaggtcctggaacagcagcacgtgatagatgatctgtcccttgagcgagaacggttactgagaagcaaacgtcaccgggggaagagtctgaaacctcctaagaagcatgtcgtagagacctttttcgggtttgatgaggaatcagtggattccgagacactctctgagactagttacaacacagaccgaaccgataggacgcccgccacccctgaagaggacctggacgacgctacagctcgggaggaagccgacttgcggttctgccagttaacccgggagtatcaggccctgcagcgagcctacgccctgctgcaggaacaagtcggcggaactctggatgcagaacgcgaagctaggaccagggaacagctccaggcagaccttctgagatgtcaggcgaaaatcgaagatctggagaagcttctggtggagaaaggacaggactctaagtgggttgaggaaaaacagcttctgataaggaccaaccaggatttgttggaaaaaatttaccggctggaaatggaggaaaatcagctgaagaatgagatgcaggatgccaaggaccagaacgagctgctcgaattcagagtattggagctcgaagtaagggatagcatttgttgcaaactcagcaatggagccgacatcctgtttgagcccaagctgaaattcatgtag

SEQ ID NO: 42859 - DNA, 2496 bp, Artificial Sequence
  Description of Artificial Sequence: Synthetic coding sequence
atgagcaagaagggccggagcaagggcgagaagcccgagatggagaccgatgcagtgcagatggccaacgaagagttaagggctaagttgacaagcatacagattgagttccagcaggagaaatccaaagttggcaagttgcgtgagcgtctgcaggaggcaaaacttgagagagagcaagagcagcggcggcatacagcatacatctctgagctgaaggcgaagctgcacgaggaaaagaccaaagaattgcaagcgctaagagagggactcattcggcaacatgagcaggaggcagcaagaacagcaaaaatcaaggagggcgaactccaacgtctccaggccactcttaacgtgttgcgggatggggccgccgataaagtcaaaaccgcccttttaactgaagcacgagaagaagcccggagggcttttgatggtgagcgcttacggctgcagcaggaaatcctggaactcaaggctgccagaaagcaagcggaggaagcactgagcaactgtatgcaagccgataaaactaaggcggccgacctccgagcggcctatcaagcacatcaagatgaagtccaccgcattaaaagggagtgtgagagagatatcagacgcctcatggatgagataaaaggcaaggatcgcgtgatactcgctctggaaaaagaactcggcgtccaagcgggacagacccaaaaattgctccttcaaaaggaggccctcgatgaacagttggtccaggtcaaggaggcggaaagacaccattcttcgccaaaacgggagctgcctcccggaatcggtgacatggttgagctgatgggcgtacaggatcagcacatggacgagagggacgtgcggcgctttcaattaaaaatcgcagagctgaactccgtgattcgaaaactcgaggatcgtaacacgctgctagcggacgagcgtaacgaactcctcaaaagaagccgtgagactgaggtgcagctgaagccactggtggagaagaacaaaagaatgaataagaaaaatgaagacctcctgcagtccatccagagaatggaagaaaagattaaaaatctaacccgggagaacgttgaaatgaaagagaaactgtccgctcaagctagcctcaaacgacatacatcactgaatgacctgtccttgactagagatgaacaggaaatagagttcctacgtctgcaagtcttagagcagcagcacgtgatcgatgacctgtcactggaaagggagcggctgctgagatctaaacgccatcgggggaagtcactgaagcctccaaaaaagcatgtggttgagactttctttggatttgatgaggaatctgtagattcagagacactctcagaaacctcttacaacactgacagaactgatcgcacccccgccacccccgaagaagatcttgatgacgccaccgcaagagaggaagccgatctccgcttttgtcagctcactcgcgaatatcaggccctgcagcgggcttacgctctcttgcaagaacaggtgggcggaacactggatgccgagcgtgaggctcgcacacgggagcaactccaggctgatctcctccgttgccaagctaaaatcgaggacctggaaaagttgttggtagagaagggacaagactcgaagtgggtagaggagaagcagctcctgatcagaaccaatcaagacctgttggaaaagatttatagacttgagatggaggagaatcagttgaaaaacgagatgcaggatgctaaggaccagaatgaactgctggagttcagggtcctggagctggaagagcgcgagcgcaggtcccctgccttcaacttgcagatcaccaccttccctgaaaaccatagcagcgctctccaactgttttgccaccaggaaggtgttaaagatgttaacgtgtcagaacttatgaagaaactcgacatcctgggtgacaatgggaatctaagaaacgaagaacaggtggcgatcatacaagccggtacggtgctggccttgtgtgagaagtggctcaagcaaatagaggggaccgaggccgccctgacccagaagatgctcgatctggaaaaagagaaggatctgttttcacggcagaaggggtatttggaggaagaactggattaccggaagcaggctctcgaccaagcctacctgaaaatccaagacttggaagccaccttatacacggctctccagcaggagcccggtcggagagccggtgaagcgctctctgaggggcagagggaagacttgcaggccgccgtcgaaaaagtccggcgccaaattctgcggcagagtcgcgaattcgattcacaaattctcagagagcgcatggaactgctccagcaggcccagcaaagaattcgggagttggaagacaaactggagtttcagaaacgacacctgaaggagctggaggagaaattcctttttctgttcctattcttttcactggcctttatcctttggccttag

SEQ ID NO: 42860 - DNA, 1941 bp, Artificial Sequence
  Description of Artificial Sequence: Synthetic coding sequence
atgagcaagaagggccggagcaagggcgagaagcccgagatggagaccgatgctgtgcaaatggcgaatgaggaattgcgagctaaactaacctcgatccaaattgagttccaacaggagaagtctaagatggatgagattaagggtaaagaccgcgtgatcctggccttagagaaagaattgggcgtacaagccggacaaacccaaaagttgttactccagaaggaggcccttgatgagcagctggtgcaagttaaggaggccgagcggcatcattcaagcccaaagcgcgagctgcccccaggcatcggcgatatggtggagctgatgggagttcaggaccaacacatggatgagcgtgatgttaggagattccaacttaaaatagccgagctgaacagcgtcatacgtaagttggaagaccgcaataccctgctggctgatgaaagaaatgagttacttaagcgaagccgggaaactgaagtgcagttgaaacccctggtcgagaaaaataagagaatgaataagaagaatgaagatctacttcagtctattcagagaatggaggagaaaatcaaaaatctgaccagggagaacgtggaaatgaaagaaaagttatctgctcaggcctcactgaaacggcacactagtctaaacgatctctccctgaccagagacgagcaagagattgaatttcttagactgcaggtgcttgagcaacagcacgttattgacgacttgtccctcaagcacgtggtggagacattctttggctttgacgaggagtcagtggattcagagaccctcagcgaaacgtcctataacactgacaggactgacagaaccccagccacccctgaagaagacctcgacgatgcaaccgcccgagaggaagccgacctgcgattctgccagcttacgcgagaataccaggctctccagagagcctacgccctcctccaggaacaggtgggcggcaccctcgacgcggagcgagaggctcgcaccagagaacaactacaggcagatctgctccgctgccaggcaaaaatcgaagacctagagaagttgctcgtcgagaagggccaggattctaagtgggtggaggagaagcagctgctgattcggacaaaccaagacttgcttgagaagatttatagattagagatggaggagaaccagctgaagaatgagatgcaagatgctaaggatcagaacgagctccttgagtttagggtcttggaattagaagagcgggagcgccggtccccggcatttaacctgcagataacaacattcccagagaatcactcttccgctctgcaactgttctgtcaccaggaaggagtcaaggacgttaatgtgtccgagctgatgaagaagttggacatactaggtgacaacggtaatctgaggaatgaggaacaggttgccatcatccaagctgggactgttctggccctgtgtgagaagtggctgaaacagatcgagggtacggaggctgccctgactcagaaaatgcttgatttagagaaagagaaagatctcttttcccggcagaaaggctatctcgaagaagagcttgattaccgcaagcaggcactcgatcaggcctatctgaagatccaggacctggaagccactttgtacactgcccttcaacaggagccaggtcggcgggccggagaggctctaagtgaaggacaacgggaggatctgcaggccgcagtagagaaggtgagacgccagattctaagacagtctcgggaatttgacagccagattctgcgggaaaggatggaactgctgcagcaggcccaacagcgaatccgcgagctggaagataagcttgagtttcaaaagaggcacctgaaggagctagaggagaaattcctgttcttgtttctcttcttttcccttgcatttattctctggccctag

SEQ ID NO: 42861 - DNA, 1881 bp, Artificial Sequence
  Description of Artificial Sequence: Synthetic coding sequence
atgagcaagaagggccggagcaagggcgagaagcccgagatggagaccgacgccgtgcagatggcaaatgaggagctgcgggccaagctgacctctattcaaatcgagtttcaacaggagaagagtaaggtgggtaagctgcgcgaacgtctgcaggaggcaaaactagaacgcgaacaagaacaaagaaggcataccgcctacatatcagaactcaaagccaagctgcatgaggagaaaactaaggaattacaggctctccgagagggtctcattagacagcatgaacaggaggccgcccgcacagccaagattaaggaaggtgaacttcagaggcttcaggccactctcaacgtgctgcgcgacggcgccgccgataaggtgaaaacggcactgctgaccgaggctcgagaggaagcccggagagcatttgatggcgaaaggttgcggcttcagcaggaaatcctggaactgaaggccgcccgcaaacaggccgaggaggccttaagtaattgtatgcaggctgataagactaaggccgcggacctgagagcagcctatcaggcccaccaggacgaggtgcatcgaatcaagagggaatgtgagcgggatatccgaaggctcatggacgagataaaaggaaaggacagggttattctcgctctcgagaaagaactcggagtgcaggcaggacagacacaaaagctgctgctgcagaaggaagcgttggatgaacaattggtccaggtgaaagaggctgaacgtcaccacagttcgcccaagagagaactacctcctgggataggagacatggtcgaactgatgggagtccaggatcaacacatggacgaacgggacgtacgaagatttcagctcaaaatcgcagagttaaactctgtgattcggaagttggaagataggaacacacttctcgccgacgaaaggaatgaactcttaaagaggtctcgggaaacggaggttcagctgaagccactcgtagagaagaacaaaagaatgaacaagaagaatgaagacttgttacagagcatccagcgcatggaagagaagattaaaaaccttactcgggagaatgtggaaatgaaagagaagctgagcgcccaggcaagcttgaaacgccacacgagcctgaatgacctgagcctgaccagagatgagcaggagattgagttcctgagactacaggtgttggagcaacaacatgtgattgacgatctgagcctggaacgtgagcggctgctccggtccaagcgacacagggggaagtccctgaaacctccgaagaaacatgttgtggagacattcttcggttttgacgaagaatcggtcgattccgaaacactttctgagacttcctacaatactgatagaaccgataggacacctgccacaccagaagaggacctcgacgatgctaccgcacgggaggaggctgacctgagattctgtcagctcacccgcgaataccaggctcttcagcgcgcctatgcacttcttcaggaacaggtaggaggcactctggacgctgaaagagaggctcgtacccgggaacagctccaggcagatctcctccgctgccaggcaaaaatcgaggatttggagaagctcctagtcgaaaaaggtcaggattcaaagtgggtcgaggagaagcaactgctaattcggacaaaccaggatctcctggaaaagatctacaggctggaaatggaggagaaccagctgaagaacgaaatgcaggacgcgaaggaccagaatgaacttcttgagttccgcgtcttagaattagaggtaagagacagcatctgctgtaagctttccaacggtgctgacatcctgttcgagcctaagctgaaatttatgtag

SEQ ID NO: 42862 - DNA, 1296 bp, Artificial Sequence
  Description of Artificial Sequence: Synthetic coding sequence
atgagcaagaagggccggagcaagggcgagaagcccgagatggagaccgatgctgtacagatggccaacgaagaattacgtgccaaactgacctccatccagatagagtttcagcaggaaaagtccaaagtgggtaagctgcgcgaacggctgcaggaggcaaagcttgagagagaacaggagcagagaagacacactgcatacatatcggagcttaaagccaagctgcatgaagaaaaaaccaaagagctacaggctctcagagagggactcatacgacaacatgaacaagaggccgcgaggacagctaaaatcaaggagggggagctgcagcgcctgcaggccacacttaacgtgctaagggacggagcggccgacaaagtaaagaccgctctgttaacagaagctcgagaggaggcacggcgcgccttcgatggtgagagacttcgcctgcagcaggaaatactcgaacttaaagcggcgcgcaaacaggccgaagaggcgctgagcaactgtatgcaagccgacaaaacaaaagcagccgatctgcgggccgcataccaggcacaccaggacgaagtgcacagaattaagcgcgaatgcgaacgcgacatccggcggttgatggacgaaattaagggtaaggacagagtgattctcgcactggagaaagaactgggggttcaagccggccagactcagaaactgttactgcaaaaagaagctctggatgagcagcttgtacaggtgaaggaagcagaacgacatcatagtagtcccaagcgggagcttcctccaggaatcggtgacatggtggagctgatgggggtccaggaccagcacatggatgagcgtgatgtgagaaggttccaactgaagattgcagagcttaattcagtgatcaggaaactggaggatcgcaacacgctgctggctgacgagagaaacgagctgctaaagagaagccgagagacagaggtgcagttgaagccattggtggagaagaacaaaaggatgaataaaaagaatgaagaccttctccagagtattcagcgaatggaagagaaaattaaaaatctgacccgcgaaaacgtggagatgcccgatcctgccggtgcccatggggctgcggctgccggacctgccgaaaacccccgtaccggcggccaaactggagtgtctgaggctgcccctgagaggacaggcggcaaggtgtttgttccgttttttgtgtttctgacgtcaatacacagcgtggctctcatgaccagcgtcagccaagagctggggctgtag

SEQ ID NO: 42863 - DNA, 1710 bp, Artificial Sequence
  Description of Artificial Sequence: Synthetic coding sequence
atgagcaagaagggccggagcaagggcgagaagcccgagatggagaccgacgcagttcagatggctaacgaagagctgcgggcaaaactgacttccattcagatagaatttcaacaggaaaaatccaaggtcggcaagctcagagaacgccttcaggaagcgaaattggagagagaacaggaacagaggagacacactgcttatatatccgaactgaaggccaaattacacgaggaaaagaccaaggaattgcaggctctgcgagagggactcatcagacaacacgaacaagaggctgctcggacggccaagataaaagagggcgagctgcagcgactgcaagcaaccctgaacgtcctcagagatggcgctgctgataaagtaaagaccgctctgctcaccgaggcaagagaggaggctcgaagagcatttgacggagagcgtctacgtctgcagcaggagattctggagctgaaggcggccagaaagcaagctgaagaggctctgagtaattgcatgcaagctgataaaaccaaggcagcagacctgagagcagcgtatcaagctcaccaggatgaggtacatagaatcaagagagagtgtgagcgtgacatcaggaggctgatggatgaaattaaaggaaaagaccgcgtcatcctggcactggagaaggaactgggtgtccaggcaggacaaactcagaagcttctgctgcagaaggaggccctggacgaacagcttgtgcaggttaaggaggcagagcgccatcattcttctccaaaacgtgagctccccccaggaataggagatatggtcgaattgatgggtgttcaggaccagcacatggacgaaagggacgttcgccgctttcaacttaagatcgctgaattaaacagtgtcataaggaagttagaggatagaaatacactgctggcagatgagagaaacgagcttctgaagagatctcgggaaactgaggtgcaacttaagccactggttgaaaagaacaagaggatgaacaaaaagaacgaggaccttctccaatctatccagcgtatggaggaaaagataaagaatctaaccagagagaatgtggaaatgaaagagaagctgagtgcgcaggcgtcattgaagagacataccagccttaacgacttatcactcacccgggacgagcaggaaattgaattcctgaggctgcaggttctggagcaacagcacgtgattgacgatttgagcctcgagcgagagaggcttttgagatccaagcgccacagagggaaaagcctaaagccaccaaagaagcacgtggtagaaactttctttggctttgacgaagagagcgttgactctgagaccctgtcagagacctcatataatacggaccggacagaccgcacaccggctacaccagaggaggacctggacgatgcaacagcacgggaggaagctgatctaagattttgccagctcactcgggaggacctgcaagcagccgttgaaaaagtgcggcggcagatcctgcgacagtcccgcgaatttgactcgcagatactccgcgagcgaatggagctgctgcagcaggcacagcagcggattagagaattagaggataagctggagtttcagaagaggcacctcaaggaactcgaagagaaattcctcttcctgttcctgttcttctctctcgccttcatcctgtggccttag

SEQ ID NO: 42864 - DNA, 1557 bp, Artificial Sequence
  Description of Artificial Sequence: Synthetic coding sequence
atgagcaagaagggccggagcaagggcgagaagcccgagatggagacagacgctgttcagatggccaatgaggccctgcgggaaggtttgatccggcagcacgagcaggaggctgcccggacagcgaaaataaaggaaatactagaactcaaggctgcccgaaaacaggctgaagaggccttgtcgaactgcatgcaagcggataagactaaagccgccgatctacgggcggcttatcaggcccaccaggatgaggtgcaccggatcaaacgggaatgcgagcgcgacattagaaggctgatggacgagataaaaggcaaagacagagttatcctcgccctggagaaggagctgggggtgcaggccggccaaacccagaagcttcttttgcagaaggaagctctggacgaacagctggtccaggtaaaggaggcagagcgacatcactcgtcccctaagagggaattacctccaggaatcggggatatggtggaactgatgggggtgcaggaccagcatatggacgagcgcgatgtccgaagatttcagctcaagattgctgagctgaattccgtaatcagaaagttggaagaccgaaacaccctactcgcggatgaacggaacgagctgttgaaaagaagtagggagactgaagtgcagctcaaacctctggtcgagaagaataagcgtatgaataaaaagaacgaggacctactccagagcatccagaggatggaggagaaaattaagaacctgaccagggagaatgtggaaatgaaagagaaactctccgctcaggcctccctgaaacgccacacatcactcaacgatttatccctgacccgcgatgagcaggagattgagttccttcggctgcaggttctggaacagcaacacgtgattgacgacctgtcactcgagagggagaggctattgaggagcaaacgccatcgcggaaaaagcctgaagcccccaaaaaagcatgtggtggagaccttcttcggctttgacgaagaatcagtggacagcgagaccctttctgagacttcatataatacagacaggaccgacagaaccccagctacccctgaagaagacttggatgacgcgaccgccagggaggaagctgatctgcgtttttgtcagctgacaagggagtatcaagctctgcagagggcctacgctttactccaggagcaagtggggggaacactagacgcagagcgagaagctagaacaagagaacaactccaggctgatctgcttagatgccaagccaaaatcgaagacctggaaaagctactcgttgagaaggggcaggatagtaagtgggtggaagaaaagcagctgctcatccggacgaaccaggacctattagaaaagatctacaggctcgagatggaagagaatcaactgaagaacgagatgcaagacgctaaggaccagaacgaattgcttgagtttagggttcttgagcttgaggtacgagatagcatctgctgcaaactctccaacggtgcggatatcctattcgagcccaagctcaaattcatgtag

SEQ ID NO: 42865 - DNA, 2433 bp, Artificial Sequence
  Description of Artificial Sequence: Synthetic coding sequence
atgagcaagaagggccggaacaagggcgagaagcccgaggccctgattgtcgcactacaggccgcgaatgaggaccttagaaccaagttgactgatatacagatagaacttcaccaggagaagtccaaggtgagtaagctggaaagagaaaagactcaggaggccaagcgcattcgcgagctcgagcagagaaaacataccgttttagtgaccgagctgaaggccaaattacacgaggagaaaatgaaagagctccaggccgtgcgagagaacctcatcaagcagcacgagcaagaaatgtctcgcaccgtgaaggttcgggacggtgaaattcagcggcttaaatctgcgctgtgtgctctccgtgatggaagctccgataaggtgcgaactgccctgaccatagaggccagagaggaggccaggaagttgttcgatactgagagattgaagctgctgcaggagatagccgacttaaaaactgccaagaaacaggtggacgaagccttgtcaaatatgatccaggccgacaaaattaaagccggtgatctccgctctgagcaccagtcacaccaggaggccatctctaaaattaagtgggagtccgaacgagacatccgtaggctgatggacgagattaaggccaaggaccgcattatctttagcctcgaaaaagagcttgaaacacagacaggatacgtgcagaaattgcagcttcagaaagaggctcttgacgagcagctgttcctggtgaaggaggccgaatgtaatatgtccagccccaaaagagagatccccggcagagccggggacggatctgagcactgctcaagtccggatctaagacgaaatcaaaagcgcatcgcggaactcaatgccactatacgaaagctagaagatcgaaacaccctgttgggcgatgaacgaaacgaactcctgaaaagagttcgagagaccgagaagcagtgcaaaccgctgcttgaaagaaacaaatgccttgctaagcgaaacgatgaattgatggtgtctctccagaggatggaagaaaaattgaaggcagtgaccaaagaaaacagcgaaatgcgcgaaaagattacctctcatcccccactgaagaaactgaagtctctgaatgacctagatcaagctaatgaggagcaagagacagagttcctgaagctgcaggtcattgagcaacagaatattatcgacgaattaaccagggacagagagaagctgattcggagaagaaagcatagacgcagctccaagcctatcaaaaggccggtgctcgatcccttcatcggatacgacgaagactctatggacagtgaaacaagctcaatggctagctttcgcaccgacaggactcccgcaacgcctgatgatgacctggatgagagcctggcggcagaggagtcagaattgagattccgccagctgacaaaagagtatcaggcactgcagagggcctacgccttgcttcaggaacagacgggaggcattatcgacgcagaaagggaggctaaagcacaggagcaactgcaagcggaggtactcaggtataaagccaaaattgaggacctagaggcaacacttgctcaaaagggtcaggactcccattgggtagaagacaaacagctcttcattaagagaaaccaggaactgttggagaaaatcgagaaacaggaagctgagaatcatcggctgcaacaggagttacaggacgcccgggaccagaatgagctcctagaatttaggaacttggagctcgaagagcgggaacgacgatctccacccttcaacctgcagatacatccattcagcgacggagtgtctgctctgcagatctactgcatgaaagagggtgtaaaggacgtgaatattcccgatctgataaagcagctagacatactcggggataatggtaatctaaggaatgaggaacaggtggcaattatccaggcatccaccgtactaagcctcgctgagaagtggatccaacagattgagggggccgaggccgctttacatcaaaaaatgatggagctggagtctgacatggagcaattttgcaagatcaaaggatacctggaggaagagctcgactaccgcaagcaggcactggatcaggcctacatgcggatccaggagctggaggccaccttatataacgctctgcagcaggaaacggtcattaaattcggcgagttacttagtgagaagcagcaggaggagctgagaaccgccgtggaaaagttgagacgccagatgcttagaaagtccagggaatacgattgccaaatacttcaggaacggatggaacttctgcagcaggcccatcagcgcatcagggacctggaagacaaaacggatattcagaagagacagataaaagacctggaagagaagtcgaacaggaagcacggctag

SEQ ID NO: 42866 - DNA, 2337 bp, Artificial Sequence
  Description of Artificial Sequence: Synthetic coding sequence
atggtgagcaagctggagcgggagaagacccaggaggccaagcggataagggaactggaacagagaaaacatactgtgctggtgactgagctcaaagcaaaacttcacgaggagaaaatgaaggaactgcaggctgtccgggagaacctgattaaacaacacgaacaggagatgtcacggaccgtcaaggttcgggatggggagatccagaggctgaaatccgcactgtgcgccctgcgggacgggtctagcgataaggtcaggacagccctgaccatcgaagcaagagaggaggccagaaaactttttgacaccgagagactaaagctcctacaggaaatcgcggatctcaaaactgccaagaagcaggtggatgaggccttgagtaacatgattcaggccgacaagataaaggctggagaccttcgaagcgaacatcaaagccatcaggaggccatctctaagattaaatgggaaagcgagagggacatcagacggctgatggacgagatcaaagcaaaagaccgcatcatattttcactggaaaaagagttggaaactcagaccggatatgtgcagaagctccagctgcagaaggaggctctagatgaacaactcttcttagtgaaagaggcagaatgcaatatgtcaagtcccaaacgcgaaataccaggcagagcaggcgacggctccgaacactgcagttctcccgacctccgaagaaaccaaaaacggatcgcggaactcaatgcaaccatcagaaaactagaggatcggaatactctgctcggagacgagcgcaatgaattgctcaaaagagtccgtgagaccgagaaacagtgcaaaccactcctggagcgtaacaaatgccttgccaagcgcaatgacgaactgatggtcagcctgcagagaatggaggagaagctgaaggccgtgacaaaggaaaattccgagatgcgggagaaaatcaccagtcacccgcccctgaagaaattgaaatccctgaatgatctggatcaggcaaacgaggagcaggaaaccgagttcttgaaactgcaggtaattgagcagcagaatattatcgatgaactgacaagggatagagagaagctgattcggcgcagaaagcacaggaggtcttccaagcccattaaacgaccagtcttggacccctttattggatatgacgaagattcaatggattccgagacatctagtatggcaagctttcgaactgatcgaacccccgccactcccgacgacgatcttgatgagagcctggctgcggaggaatctgagctaaggtttcgtcagctaacaaaagagtaccaggccttacagagagcctacgcgttgttacaggagcagacaggaggtattatagatgctgaacgtgaggccaaggcccaagagcaacttcaggctgaagttctgaggtacaaagccaagattgaagatttggaagccaccctggcccaaaaagggcaggactcccattgggttgaggacaaacaactatttattaaaagaaaccaagagttgcttgagaaaatcgagaagcaggaagccgaaaatcatagactccagcaggaactgcaagatgcccgcgatcagaatgaattgctcgagttcaggaatctcgagttagaggaaagagagcggcggtctcctccttttaacttgcagattcaccctttttctgatggagttagcgccctacagatctattgcatgaaggaaggagtcaaagacgtaaacattcctgacctcattaagcagctggacatcttaggtgacaatggaaacctgcgtaatgaggaacaggttgccataatccaggcaagtacggtgctgtcattggccgaaaaatggatccagcaaatcgaaggagccgaagcagctctccatcagaaaatgatggagctggagagtgacatggaacagttctgtaaaattaaggggtacctggaagaggagctggattatcggaagcaggctctggaccaggcatatatgagaatacaggagctcgaagctaccttgtacaatgccctgcagcaggaaactgtgatcaagtttggtgaattgctgtccgagaaacagcaagaggagctgaggactgccgtcgagaagctgcggcgtcaaatgctgaggaaatccagggagtatgactgtcaaatactgcaagagaggatggagctgctgcagcaggcccatcagagaatccgggatcttgaggacaaaacagatatacaaaaacgccaaatcaaagatttggaggaaaagtttcttttcctgtttctgttcttctcactggcttttatcctatggccgtag

SEQ ID NO: 42867 - DNA, 2400 bp, Artificial Sequence
  Description of Artificial Sequence: Synthetic coding sequence
atgagcaagaagggccggaacaagggcgagaagcccgaggccctgattgtggctttgcaggcggccaatgaggacctccggacaaagctcacggacatacagatcgaactgcaccaagaaaagtcgaaggtgtcaaaattggagagagagaagacccaggaggccaagcgaattagagagctcgagcagagaaagcataccgtgctcgtaacagagctgaaggcaaagctacacgaggagaaaatgaaggagctgcaggccgtgcgagaaaatctgatcaagcagcacgaacaggaaatgagtcgaaccgtgaaggttcgggacggcgaaatacagagactgaagagtgctctatgtgctctgagggacgggtcctcagacaaggtgaggactgcccttacgatcgaggcacgggaagaagcgcggaaacttttcgatactgagcggctcaaactcctgcaagagatcgcagacctgaagacagccaagaaacaagttgacgaagcattgtctaacatgatacaggctgataagattaaggcaggtgacttgcgatctgaacaccagtcacaccaagaggcaataagcaagattaagtgggagtccgagagagatattcggcgacttatggatgagatcaaagccaaggaccgaatcatcttctctctcgaaaaggaacttgaaactcagactggatatgtgcaaaaactgcagcttcaaaaagaggctctcgatgagcagctgtttttggtgaaggaggccgagtgcaatatgtctagccctaagcgcgagattccagggagggccggggatggcagcgaacattgctccagccccgacctgcggcgcaatcagaagagaattgccgaactgaatgccactattcggaagttagaggaccggaacaccctccttggagatgagcgtaatgagcttctgaaacgtgtgagagagactgaaaagcagtgcaaacccctgttggaacgtaataagtgcctggcaaagcgaaacgacgaattgatggtgagcctccagagaatggaggaaaaactgaaggcagtcactaaggaaaactccgagatgcgagaaaaaatcacaagtcacccaccgttgaagaagctgaagtcacttaatgacctggatcaggcaaatgaggaacaggagactgaattcctcaagcttcaggttattgaacagcagaatataatcgacgagctaacacgagatcgggagaaactgatccgccgcaggaaacacagaaggtcttccaagcccatcaagagacctgtcctggaccctttcataggctatgacgaagattccatggattctgagacgtccagcatggcttctttccgtactgatcggacccccgccacaccagatgatgaccttgacgaaagcctggccgcggaggagtcagagttaaggtttcgccagcttacaaaagaatatcaggcattgcaaagagcctatgcattgttgcaagaacaaaccggcggtattattgacgccgaaagagaggccaaggcccaggagcaactgcaggcggaagtgcttcgctacaaagctaagatcgaagatctagaggccacactcgcccagaaaggacagatcgagaaacaggaggctgaaaatcataggcttcagcaggagctccaggatgcccgagatcagaacgagctgttggagttccgtaacctggaacttgaagagagggaaaggcggtcaccaccctttaacttgcagattcaccctttctccgacggcgtaagtgctttgcagatctactgcatgaaggagggggtcaaggacgtcaatatacccgacttgattaagcaactggatatactcggcgataatgggaacctcagaaacgaagaacaggttgctattatccaggcttcgactgttctgtcccttgccgaaaaatggatccagcagattgaaggggctgaggctgcattacaccagaagatgatggagttggagagtgatatggagcagttttgtaaaattaagggctacctggaagaggaactggattatcgcaagcaggcgctggaccaggcttacatgagaattcaggagttagaggcaaccctctataacgctctgcagcaggagaccgtgatcaaattcggcgagctgctctctgaaaagcaacaggaagaactccggacggccgtcgagaagctgcgtaggcagatgctgcgaaaatcgcgcgagtatgattgtcagatattacaggagcgaatggaactcctccaacaggcgcaccaaagaatccgggacctcgaggacaagacagatattcaaaaacggcagataaaagaccttgaggaaaaattcctttttttgttcctcttcttctcgctggcgttcattctctggccttag

SEQ ID NO: 42868 - DNA, 2370 bp, Artificial Sequence
  Description of Artificial Sequence: Synthetic coding sequence
atgagcaagaagggccggaacaagggcgagaagcccgaggccctgattgtcgccctgcaggctgctaacgaggatttacgcacgaaactcactgacatacagatagaactccatcaagaaaaatctaaagttagtaaattggagagagagaagacgcaggaagccaagcggattagggagctagagcaacggaagcacactgtgttagtgaccgaactcaaagctaaactccacgaggaaaaaatgaaggagctgcaagcagtcagggaaaacctgattaaacaacacgaacaggagatgagtcgcactgtgaaggtgagagatggggaaattcagagactgaagtcggcactgtgtgccctccgtgacgggtccagcgacaaggtcagaacagccctgacgatcgaagcccgggaggaggcaagaaaactgttcgacaccgagcgcctcaagcttttacaggaaattgccgatctcaagacagctaagaagcaggtggacgaggccctgagtaatatgattcaagccgacaagataaaggctggcgacttgagatcagaacaccagagccaccaggaggccattagtaagattaagtgggaaagtgaaagagatatccgccgccttatggatgagattaaagccaaagacaggataattttctcactggaaaaagaactcgagacacagactggttatgtgcagaagctacagctgcagaaggaggctttagatgagcagttatttctcgtgaaagaggcagagtgtaacatgagcagtcctaagcgggagattcccgggcgcgccggcgacggctctgaacactgctcatccccagacttgagaagaaaccagaagcgcatcgcggagctaaacgccactattcgaaagttggaagacagaaatactctgctcggagatgagcgtaacgaactcctgaagcgcgtgcgggagactgaaaaacagtgtaaacccctactcgaaagaaacaaatgcttggctaagaggaacgacgaactcatggtttcgctccagcggatggaagaaaagctgaaggccgtgaccaaagagaattcagaaatgcgtgaaaagatcacatcccatccaccactaaagaaattaaagagtttaaatgatctggaccaggccaatgaggagcaggagactgaattcctcaagcttcaggtgattgaacagcagaatatcatcgacgagctcacgagggaccgtgagaaactgatcagacgccggaagcatcgccgttcctcaaagccaattaaacggcctgtcctggatccctttatcggctacgacgaggactccatggactctgagacctcatcaatggcgtcatttcggacagatcgcacaccagctacacctgacgacgatctcgacgagagcctggctgccgaagagtcggagctgcgattccggcagctcaccaaggaatatcaggcactgcagagggcgtatgcactgctgcaggagcagacaggcggtatcattgacgccgaacgggaggcaaaggcacaggagcagttacaggcagaggtgctcaggtacaaagcaaaaatcgaggacctggaagcgactttagcacagaagggccaaatagaaaaacaggaagccgagaaccacaggctgcaacaggagctacaggacgctcgagaccagaacgagctactggagttcagaaacctggaactcgaagagcgggagcgccggagcccaccgtttaacctgcagatccaccctttttcagatggggtatcggcactgcaaatctactgtatgaaagaaggtgtcaaggacgtgaacatccccgacttgatcaagcaacttgacatcctcggcgataatggcaacctgcgaaacgaagagcaagttgcaataatccaggccagtacggtgctctcgctcgccgagaagtggatccagcagatagagggcgccgaagccgctttgcaccagaaaatgatggagctggaatccgatatggagcagttttgtaagataaaaggctacctggaagaggagcttgattatagaaagcaggcactggaccaggcttatatgcgaattcaggagcttgaggccacactgtacaacgcactgcaacaagagactgtgatcaaattcggggagctgctgagtgaaaaacagcaggaggagctccggaccgcggtagaaaagctccggcgccaaatgttaagaaagagtagggagtacgactgccagatcctgcaggaaaggatggaacttctccagcaggcacaccagaggatccgcgacctggaagacaagacagatattcagaagcgacagataaaagatctggaggagaaatccaaccgcatgcccgcctag

SEQ ID NO: 42869 - DNA, 2535 bp, Artificial Sequence
  Description of Artificial Sequence: Synthetic coding sequence
atgagcaagcggggcatgagcagccgggccaagggcgacaaggccgaagctctcgcagctctgcaagctgcgaacgaggacttgagagctaaactaactgatatccaaattgagttgcagcaagaaaagtccaaggtgagcaaggtcgagcgtgaaaagaatcaggaactgcgccaggtgagagaacatgagcaacacaaaaccgccgtactactcacagagctgaaaaccaagctgcacgaagaaaaaatgaaggagcttcaggctgtgagagagactcttcttcgacagcacgaggcagagctcttgagggtgataaaaatcaaagataatgaaaatcagcgcctccaagctctgctgagcgcattgcgcgacggaggccctgagaaagtgaagaccgtcctgctgtcagaagccaaagaagaagcaaagaaagggtttgaggtggagaaagttaagatgcagcaagagattagtgagttgaagggggcaaaaaggcaggtcgaggaggcccttaccctcgtcattcaggccgacaaaattaaggcagcagaaatcaggtcagtgtaccatctgcatcaagaggaaatcacacgcatcaaaaaggaatgcgagagggagattcgaaggctaatggaggagatcaagttcaaagaccgagcagtcttcgtgctcgagagggagctgggagttcaggcgggccacgcacagagactgcaacttcagaaggaggccctagatgaacagctatcacaggtccgggaggctgatagacaccctggctcccccagacgggaactgccccacgccgccggggccggcgatgccagcgaccactcaggatcacccgagcagcagctcgacgaaaaggacgcccgacgctttcagcttaaaatagccgaactgagcgctattatccggaaactggaagaccgcaatgcactgttgagcgaggaaaggaacgagctgctcaagagagtaagagaggccgagtctcaatataaaccccttctggacaagaataaacggctgtcgcgcaaaaatgaggacctctcccacgccctccgccgcatggagaataaactgaagttcgtcacgcaggagaacattgagatgcgtcagagagctggcattattcgacgccctagcagtctgaacgatcttgatcaatctcaggatgagcgcgaggtggactttctgaaactgcagatcgtcgagcaacaaaatctcatcgacgaactgagcaaaacgcttgaaaccgcaggctatgtcaagtccgtacttgagagggataagctcctgaggttcagaaaacagcgtaagaaaatggcgaaactgccgaagcccgtggtcgtcgagaccttttttgggtacgacgaggaggcatctctcgaaagcgatggctcttccgtatcataccaaactgatcgcaccgatcagacaccctgcacccctgatgacgacctggaggagggcatggcgaaggaggagaccgagttacgctttcggcagttaacgatggagtaccaagcactgcaacgagcttatgcacttctccaggaacaggttggtgggacccttgacgcggaaagagaagtgaaaacccgagaacagctgcaagcagaggttcaacgcgcacaggcgagaatagaagacctagagaaagcactggctgaacagggccaggatatgaagtggattgaagaaaagcaggcattgtaccggcgcaatcaggagctcgtggagaaaatcaaacaaatggagacagaggaggcgagacttaggcatgaggtccaagatgcccgggaccaaaacgagctgctggagttccgaatcctggagctggaggagcgggaacgaaaaagcccggccatcagctttcaccatacacctttcgtggacggcaagtcacccctccaggtatattgtgaggccgaaggagttactgatattgtcgttgcggaattaatgaagaagctcgatatcctcggagataatgcaaacctcacaaatgaggagcaggttgtagtcattcaggctagaaccgtgctaaccctggcagaaaagtggctccagcagatcgaagagacagaagccgctcttcagagaaaaatggtggatttggagagtgaaaaagaacttttcagcaagcagaaagggtacctcgacgaggagctggactatagaaagcaagcgctggatcaggcaaacaaacacattctggaactggaagcgatgctatacgatgctctccagcaggaggctggggccaaagtcgccgagctgctgtccgaggaagaacgtgagaagctgaaggtggcagttgagcaatggaagcggcaggttatgtccgaactgagagagagggatgcccagattctgcgggaaaggatggagctcctccagctcgcgcaacagaggatcaaggaactggaggagcggatcgaagctcaaaaacgacagattaaggagctagaggagaagttcctgttcctgtttctctttttttctctcgcctttattctttggtcctag

SEQ ID NO: 42870 - DNA, 996 bp, Artificial Sequence
  Description of Artificial Sequence: Synthetic coding sequence
atgagcatgaccacccgggcctgggaggagctggacggcggcctgggaagctgccaagcgctagaagaccatagtgccctggccgagacacaagaggacagagcgagcgcaactccccgcctggcggactccgggtccgtgccacatgactctcaggtcgcagaaggtccgtctgtcgacactcgtcccaaaaagatggagaaggaacctgccgcccgcggaaccccagggaccggcaaagaacggttgaaagctggggcctccccccgtagcgtgccagcgcgcaagaaagcccagactgcaccaccgctacagccccctcctcccccaccggccttgtctgaggagttgccctggggagacctatctctgaacaaatgcctcgtactggcctccttggtggctctgctaggcagcgcatttcaactatgccgcgatgccgttcccggggaagcagcccttcaagctcgggtgccggagccttgggtcccgccgtcatcagcgcctagagagcctagctcacccttgcctaagttcgaggcccaagcaccacctagcgctcccccggcgccccgtgcggaagctgaggtccgcccaaagattcctggaagccgagaagctgccgagaatgacgaagaggagcccggggaagctaccggagaggctgtgcgagaagaccgcgttaccctcgctgataggggaccaaaagaacggcctagacgagaaggaaaaccccgtaaggaaaagcccagaaaggaggaacgaccaaagaaggagaggcccagaaaggaggaacggcccagggccgcacgtgaacccagagaagctttgccccagaggtgggagtcccgggaaggcgggcacaggccctgggccagagactctagggacgctgaacccagaaaaaaacaggcgtgggtatctccaaggaggcctgatgaagagcagaggcccgggtcacggcagaagcttagggccggcaaaggtagggattag

SEQ ID NO: 42871 - DNA, 1887 bp, Artificial Sequence
  Description of Artificial Sequence: Synthetic coding sequence
atgagccccggcggcaagttcgacttcgacgacggcggctgctacgtgggagggtgggaggccggtagggcccatgggtatggggtctgcacaggccctggtgcacaaggtgaatacagcggctgctgggcccatggcttcgaatctttgggcgtttttaccggcccgggcggacacagttaccagggccactggcagcagggaaaacgagaaggactgggcgttgaacggaagagccggtggacatacagaggagaatggctgggggggctgaaaggacgctccggggtctgggaatcagtgtctggcctgcggtatgcaggcctgtggaaagacggtttccaggacgggtacggaacggagacctattccgacggcggtacctaccagggccaatggcaggcaggtaagcgccacgggtacggcgtcagacagtctgtgccttaccatcaggcagctctgctgaggtctccacggcggacctctctggacagtggacattctgacccccccactcctccccctcctctcccactgcccggcgacgagggcggttctcccgcgtccggctccaggggcggattcgtgttggccgggccaggcgatgccgacggtgcgagtagtagaaagcgaactccagcagctggcggcttcttcaggcgatctctgctgctttcaggactgagagccggcggccggcgatcttctcttggttcaaaacgaggtagcctcagaagcgaggtgagctcggaggtcggtagcacgggtcctccgggctctgaggcaagtggccctcctgctgctgcccccccagcactgattgagggcagtgccacagaggtatatgccggggaatggcgggctgacaggcgcagcggctttggcgtgtctcagagatcaaatggcttgcgatatgaaggcgaatggctcggaaatagaagacacggctatgggcgtaccacgagaccggacggaagccgggaggaggggaagtacaagcggaatcgactcgtccatggcggccgcgtgagatccctgctgccactggccctgcgtaggggtaaagtgaaggaaaaggtcgatcgagccgtcgagggggcacggcgtgcagtgtctgctgccaggcaacgccaggaaattgccgccgcccgagcagccgatgcgttgctgaaagctgtggcagctagctcagtggctgagaaggccgtggaggctgcaagaatggcaaagctgatcgcccaggatctgcaacccatgctcgaagcccccggacgtcgcccccgccaagactccgaggggtccgatactgagcccctcgatgaagatagccctggcgtttacgagaatgggctgacacctagcgagggctcccctgaactcccaagctcccctgctagctcacgccaaccctggcgcccgcctgcctgccgctcacccctccctccaggaggcgaccagggacctttctccagtcctaaagcctggccagaagagtgggggggggccggagctcaagctgaggagctggccggatacgaggcggaggacgaggccggaatgcagggccccggaccacgggacgggtctccgctgttgggaggttgctcggacagctctggaagccttcgggaggaggagggagaggacgaggaaccacttccccccctcagggcaccggcgggtactgagccagagcccattgctatgctggtgttgcgaggatccagctctcggggacctgatgcaggatgtctcaccgaggagctgggagagcctgccgctaccgagagaccagcgcagcccggcgcagccaaccccctggtggtgggggccgtggctttgctcgacttgtctctggcgttccttttctctcaacttctgacctag

SEQ ID NO: 42872 - DNA, 1887 bp, Artificial Sequence
  Description of Artificial Sequence: Synthetic coding sequence
atgagccccggcggcaagttcgacttcgacgacggcggctgctacgttggtggatgggaggcaggtcgggctcatggatatggcgtgtgcacgggacccggtgcacagggtgagtactccgggtgctgggctcacggctttgagagccttggagttttcacgggcccaggcggtcatagctatcaaggacactggcaacagggaaaacgcgaaggcttgggcgtggagcgcaagagtagatggacgtaccgcggcgagtggctgggggggttgaaagggaggagcggtgtctgggaatccgtatcagggcttagatatgccggactgtggaaagacggattccaggatggatacggtacagagacctatagtgatgggggcacgtaccaaggacagtggcaggcagggaagcggcatgggtatggtgtgcggcaatctgtgccttaccatcaggccgctctgctcaggtccccaaggcgcaccagtctcgatagtgggcacagtgacccacctacacctccacctcctcttccactgcccggagatgagggaggatcaccagcaagcggcagccggggggggtttgtgctcgcaggccctggtgatgcggatggggcttccagtcggaaaaggacccctgccgcgggtgggttcttcagacgatctctgctactgtcaggcctccgagccggtggacggaggtcctctttgggatcaaagcgtggttctctcaggtctgaggtgtcatccgaagtgggatctacaggccccccaggttctgaggcttctggccctcctgccgcagccccaccagctctgatcgagggcagtgctactgaggtatacgcaggagagtggcgcgccgatagaaggtcaggattcggagtgtcacagagatccaatggcctccggtacgaaggggaatggttgggcaaccgccggcatggatacggccgaacgacgaggcctgacgggagcagagaggagggtaaatacaaacgcaacaggctggttcacggcgggcgcgtcagaagtctgctgcctttagcccttcgaagaggaaaggttaaggaaaaggtggaccgggccgtggaaggagcccgccgggcagtgtcagctgcaaggcagagacaggaaatagccgctgcacgtgccgccgacgccctcctgaaggctgttgccgcttcctcggtggccgaaaaagccgtagaggctgcccgcatggccaagcttattgcacaggacctgcaacccatgctagaagcacctgggagacgtccgaggcaagactcagagggcagcgataccgaacctttagatgaagatagcccaggtgtctacgaaaacggcctaacacccagtgaggggtcccccgagctgccttcctcccctgcatcttcacgccagccttggcggccacctgcctgtagatctccactccctccaggcggggaccaggggccatttagcagtcctaaggcttggcctgaagagtggggtggtgctggagctcaggcagaagagctggcaggctacgaggccgaggacgaagccggaatgcaggggcccggtcctcgcgatgggtcacccctgttgggaggctgtagcgattcctccgggtctcttcgcgaggaagagggagaggatgaggagcctctgccacctctgagagcccctgcaggcaccgaacctgagcccatcgctatgttggtcctgagaggcagtagcagccgcggccctgacgccggatgcctgacagaggagctcggcgaacccgctgcaactgagcgcccggcacagcctggcgccgcaaaccctctggtggtgggggccgtagcactcttggatctgagtttggctttcctattctctcagctccttacatag

SEQ ID NO: 42873 - DNA, 1887 bp, Artificial Sequence
  Description of Artificial Sequence: Synthetic coding sequence
atgagccccggcggcaagttcgacttcgacgacggcggctgctacgtcggtgggtgggaggctggaagagctcacggctatggtgtttgcactggacccggggctcagggagagtatagcggttgttgggctcacggtttcgaatctttgggagtcttcactgggcccgggggccactcctatcagggtcactggcagcaaggcaaacgggagggccttggtgtcgaaaggaaaagcagatggacttaccgcggtgagtggctcggcggccttaaagggagatctggagtgtgggagtctgtttctgggctgagatatgctggactgtggaaagacggcttccaagacggctatggtaccgagacctatagtgatgggggcacttaccagggtcaatggcaggccggcaaaagacatggatacggggtcaggcagtcagtgccatatcaccaggcagccctgttgcgttctcctagacggacttcactcgattccgggcactccgacccccccacacccccacctccattgcctttgccaggagacgagggcggcagccccgcctccgggtctaggggggggtttgttctcgcaggcccgggagacgcagatggagcatcttctaggaagagaacccctgctgccggcgggtttttcaggcgatccttactgctgtctggtcttcgcgccggtgggagacgttccagcctcggttccaagcgcggatccctaaggagtgaggtgtcttccgaagtgggttcaacaggtccaccaggttcagaggcatctggccccccggccgctgctccccccgctctcattgagggttcagccaccgaggtgtacgcaggggagtggcgggcagatcggagaagcggatttggggtgagtcagcgtagtaatggactcagatacgagggagaatggctcggcaatagacgccacgggtacgggcgaacaacgcgccctgatgggtcccgagaagaagggaagtacaaaaggaatcgcctggtacacggaggtcgggttcgatcactacttcccctcgctttgaggaggggcaaggtgaaagagaaggttgaccgggccgtggaaggcgcacggagagctgtgagcgctgcccggcagagacaggagattgctgctgcaagagctgcagacgcactgctcaaagctgtggcggctagctctgtggccgagaaggccgtggaggccgcacgtatggcaaaactcatcgcccaggacctccaaccgatgttggaggcgcccggccgcaggcctaggcaggattcagagggatccgatactgaacctcttgacgaggattctcccggcgtgtacgaaaacggcctgactccgtctgaggggagcccagaactgccaagctcccctgcatcctctcgccagccttggagacctcctgcgtgtcggagcccactgccgcctggcggggaccaggggcctttttcatcgcccaaagcgtggcctgaagagtgggggggcgccggagctcaggccgaggagctggccggttacgaggcggaagatgaggcggggatgcagggacccggaccgcgagacggttcccccttacttggcggatgctctgattcttcaggctcacttagagaagaggagggcgaagacgaagaacccctccctcccctgcgggcacccgccggaactgagccggagcctattgccatgctcgtcttgagaggaagcagctcaaggggtcctgatgcaggctgtctgacagaggagctcggggaacccgccgccaccgaacgccctgcccagcccggggctgccaacccgctcgtggtaggagcagtggcgttgcttgatctgagcttggcgtttctcttttctcagcttcttacatag

SEQ ID NO: 42874 - DNA, 1524 bp, Artificial Sequence
  Description of Artificial Sequence: Synthetic coding sequence
atgcggcggctgccccgggccctgctgctgcagctgcggctggccctgctcgtcgccgcaggggctcctgaggtacttgtttcagcacccagatcccttgtatggggaccaggtctccaggctgcggtggttttgcctgtgcggtacttttatcttcaggccgttaatagcgaaggacaaaatctgacaaggagccctgctggcgagacgccctttaaggttgtcgtcaagagcctcagccctaaagagctcgtccgcatccatgtgcccaagcccctggaccgcaacgacggcacatttctaatgaggtatcggatgtatgaaaccgtagacgaaggccttaaaattgaagtgctctacggggatgagcatgtggcccagagtccctatatattaaaggggccagtctatcatgagtattgcgaatgcccagaggaccctcaagcatggcaaaagacgctctcatgtccaaccaaagaaccccagatagccaaggacttcgcctctttcccgagtatcaacctacagcagatgctcaaagaagtgcctaaaagattcggtgatgagcgcggagccattgtccactacactatcctgaacaatcacgtttatagacgcagcctagggaaatacacagacttcaaaatgttttcagacgagatcttgctgtcattgactcggaaggtcctgttacctgacttagagttctatgttaacctcggtgattggcccctcgaacacaggaaagtcaacggaacaccctcacctattccaattatctcttggtgcggttccttggattcccgagacgttgtgctgcccacctatgatattacccactcaatgctggaggccatgcgcggagtaacgaacgacctgctctcgattcaggggaatactgggccatcctggatcaacaaaacagagcgtgcattcttcagaggccgagactcaagagaagaaagactgcagctggtgcagctctcaaaggaaaaccctcaactgcttgatgcgggcattacagggtatttcttctttcaggagaaggagaaggaattagggaaagccaagcttatgggattcttcgactttttcaaatacaaataccaggttaatgtggatggaacagtcgccgcttaccgatacccatatctcatgctcggggactcattggttcttaaacaggattcgccatactacgaacacttttatatggccctcgagccttggaagcattacgtaccgatcaagagaaatttgagcgacttgctggaaaaggtgaagtgggccaaggagaatgacgaagaggctaagaagattgctaaagaggggcagctcatggcccgcgatctgctacagccccaccgactgtactgctactactatcaggttcttcaaaagtacgctgagagacaatcctcaaagccggaagtgagggatgggatggagctggtacctcagcccgaggattcaactgctatttgtcagtgtcacaggaaaaagccatcaagagaggagttgtag

SEQ ID NO: 42875 - DNA, 1230 bp, Artificial Sequence
  Description of Artificial Sequence: Synthetic coding sequence
atggtggagctgttcatcttcctgttcctgctgggcgagaccccctttaaggtggtggtgaagagcctgagtccaaaggagctggtacgcattcacgtgccaaagcccctcgacagaaatgatgggacatttttgatgcgatatcgcatgtatgaaacagttgacgaaggcctgaagatagaggtactgtacggcgacgaacacgtggcccagtcgccgtacatactgaaaggacctgtgtaccacgagtattgcgagtgccctgaggacccccaggcttggcaaaagacactgagctgccccaccaaggagccgcagatcgccaaggatttcgccagctttccctccatcaatctacagcagatgctaaaggaagtgcccaagagatttggtgacgagcggggggccattgtacactacaccattctgaacaaccacgtgtatcgtcggtcgctgggcaaatacaccgattttaagatgttctccgacgagatactcttgagcctgacccggaaagtcctcttacccgacctggaattttatgttaacctcggggactggcccctggaacacagaaaggttaatggtaccccatcccctatccctattatcagctggtgcggcagtttagactccagagacgtggtgcttcccacatacgacatcacacattccatgcttgaagccatgcggggagtgactaacgatctcctttccatacagggaaatacaggtccttcctggatcaataaaaccgaaagagcgttctttaggggcagggacagccgtgaggagcgattacagttagtgcagctgagcaaagaaaaccctcaactgctggacgcaggcatcacaggttatttcttcttccaggagaaggaaaaggaacttggcaaggccaaactgatgggcttctttgactttttcaaatacaagtaccaggtcaatgtagacggcacggtagctgcctaccgatacccgtatctgatgctgggagattccttagtcctgaaacaagatagcccctattatgagcacttctacatggcccttgaaccgtggaagcattatgtcccgatcaagcgtaacctctccgatcttctggagaaggtgaaatgggccaagtccttcacgctgtcccctcgcctcgagtgctctggcactataagcacccactgcaacctctgcttgccgggaagcaggaatttcgtgccccagccacccgagtag

SEQ ID NO: 42876 - DNA, 1356 bp, Artificial Sequence
  Description of Artificial Sequence: Synthetic coding sequence
atggtggagctgttcatcttcctgttcctgctgggcgagacccccttcaaagtagtggtgaaatcattgagcccgaaagaactggtccgcatccacgtccccaaacccctggataggaacgatggcacgttccttatgcggtatcgcatgtatgagacagttgacgaggggctgaagatcgaagtgctttacggggatgagcacgtcgctcagtccccgtacatcttaaaggggcctgtatatcacgaatattgcgagtgtcctgaggatccacaagcatggcagaagaccttatcctgcccaacaaaagagccgcaaatagcaaaggatttcgccagttttcctagcattaatctgcagcagatgctgaaggaggttcccaaacgatttggagatgagaggggtgccattgtgcattacaccatcttgaacaatcatgtctacagacgctcacttggaaagtataccgactttaaaatgttctctgatgaaatcctcctctctctgacacgaaaggtcttactacctgacttagagttctacgttaacttgggggactggcctctggaacaccggaaagttaacggaacgccatccccaattcccattataagttggtgcggcagcctcgactcgcgagatgttgtactgcccacgtacgacataacacacagcatgctcgaggctatgcgtggcgtgaccaacgatcttctgtccatccagggtaacaccgggccctcttggattaacaagaccgaacgggcattctttcgtggccgggattcacgcgaagaaagactgcagctggttcagctgagcaaggaaaatccacagttactggacgcaggcattaccggatacttttttttccaggaaaaagagaaagaacttggcaaagctaagctgatggggttttttgattttttcaaatataaataccaggtaaatgtagacggcaccgtggcggcctaccggtacccatatttaatgctgggggactctctggttctgaaacaagattccccttattacgagcacttttatatggcactggaaccatggaagcattatgttcccatcaagagaaaccttagcgacctgcttgaaaaagtaaaatgggccaaggaaaatgacgaggaggctaagaagatcgcgaaggagggacagctgatggcacgcgacctgttgcagccccaccgcttgtactgctactactatcaggtcctgcagaaatacgctgaaagacagagcagcaagccagaagttcgagacggcatggaactggtaccccagcctgaagactcaaccgctatttgtcagtgccaccgaaagaagccctctagagaagagctgtag

SEQ ID NO: 42877 - DNA, 639 bp, Artificial Sequence
  Description of Artificial Sequence: Synthetic coding sequence
atgaacctgttccggttcctgggcgacctgagccacctgctggccatcattttgctgctcctcaagatttggaaatcccggagttgtgccggtatttctggcaagagccaagtcctgtttgcagtggtattcacggcccggtatcttgacctctttactaactacataagtttatataatacctgcatgaaagtcgtctacatagcatgcagcttcacaaccgtgtggttaatttatagtaagtttaaggccacctatgatgggaaccacgacactttccgggttgaattcctagtcgttcccaccgccatcctggccttcctggtgaatcatgattttacacctctggagatcctatggacttttagtatttacttagagtcagtggccattctgccacagctcttcatggtctctaagacgggggaagctgagactattacttcacactacctcttcgcgctaggggtttacagaaccttatacctgttcaactggatctggaggtaccattttgagggattcttcgatctgatcgccatagtggctggcctggttcagaccgtcctgtactgtgacttcttctatctgtacataacaaaagtgctcaaggggaaaaaactctcgctgccagcctag

SEQ ID NO: 42878 - DNA, 639 bp, Artificial Sequence
  Description of Artificial Sequence: Synthetic coding sequence
atgaacatcttccggctgaccggcgacctgagccacctggccgccattgtcatcttacttctgaagatatggaagacccggtcatgtgctgggatttcggggaaatcgcaattgctgttcgccctggtcttcaccacacgttatctcgacctatttacctctttcattagcctttataacacgtctatgaaggtaatataccttgcatgctcttacgccactgtgtatctgatatatttgaaattcaaggcgacttacgacgggaatcatgacacgttcagagttgagttcctcgtggttcctgttggaggactatcttttcttgtgaatcacgatttctcacccttggagatcctttggaccttttctatttatctggagtccgttgctattttgcctcaactgttcatgatatcaaagacaggggaggctgaaacaattactacgcattacctgttcttccttggactctatcgggcgctgtacctcgtcaattggatttggcgattttacttcgaaggcttttttgatctgatcgcagtcgtcgctggggtggtccagacaattctatactgtgacttcttttatctatacatcacaaaggtactgaaaggcaaaaagctctctctccctgcttag

SEQ ID NO: 42879 - DNA, 561 bp, Artificial Sequence
  Description of Artificial Sequence: Synthetic coding sequence
atgaacatcttccggctgaccggcgacctgagccacctggccgccattgttatactgctcctgaaaatctggaaaacacgttcatgcgccgggattagcggaaaatctcaactgctgtttgcactggtatttacaacaagatatctggatctttttacatcatttatcagtctctataatacttcgatgaaggtcatctacctcgcttgtagctatgcgacggtgtacctcatttatctgaaatttaaagcaacctacgacggtaaccatgacacattccgcgtggagttcctggtggtgccggtcggagggttgtctttcttagtgaaccacgatttcagccccttagaatactctcgcgagaggtcaagtgtctgccagcataagtgccagagacctagccccgctagcgtcctccaaggggcacgtacagagttcctcccccaacagcggcacaaaatgctcgacaccgagaaccaaaaactgaattcttttgttgcggattctcaccagtggctgtgcaagaacgcggaagagaaatcccagaaggtatccgtctag

SEQ ID NO: 42880 - DNA, 543 bp, Artificial Sequence
  Description of Artificial Sequence: Synthetic coding sequence
atgagcgtgctgcggcccctggacaagctgcccggcctgaacaccgctacaattctgctcgtgggaactgaagatgccttgctgcagcaactggccgatagcatgctgaaggaagactgtgcgagcgagctaaaagtgcacctggccaaatccctccccttgccatctagcgtcaataggccccggatcgacctgatcgtgttcgtggtgaatctccactccaaatactctctgcagaataccgaggagagtctcagacatgtggatgcgagctttttcctggggaaagtgtgtttcttggcaaccggcgccgggagagagtctcattgttccattcaccggcacaccgtcgtgaagctggcacacacctatcagtctcccttgctctactgtgatttggaggtcgagggtttcagggctacaatggctcagagactggttcgagtcctccagatctgtgccggacatgtgcccggcgtttctgccttgaatctgctgagcttgcttcggtcttccgaaggtccctcactagaggatctttag

SEQ ID NO: 42881 - DNA, 663 bp, Artificial Sequence
  Description of Artificial Sequence: Synthetic coding sequence
atgaacgtgttccggatcctgggcgacctgagccacctgctggccatgatcctactcttagggaaaatctggcgttctaaatgctgtaaaggcatctcggggaaatcacagatcctctttgcactggtttttaccacacggtacctggacctcttcactaatttcatctcaatttataacacagtgatgaaggttgtttttcttctttgcgcatatgtcaccgtatatatgatatatggaaagtttaggaagacttttgactctgaaaatgatacattcaggctcgagtttctgttagtgcctgtcattggtctctctttcctcgagaattacagttttacactcctggagatcctttggaccttctctatttatctagagtctgtggcgattctgccccagctcttcatgatttcaaagactggagaagctgagacaatcacaacgcactacctgttcttccttggactgtatcgagctttgtatcttgctaattggatcaggcgatatcagactgaaaatttttacgaccagattgcggtggtgtctggggtagtccagaccatattttactgtgattttttctacttatacgtcactaaaggcagatcctgggacgactctaacgccgacacagggcttaggagttattcatccatttag

SEQ ID NO: 42882 - DNA, 2334 bp, Artificial Sequence
  Description of Artificial Sequence: Synthetic coding sequence
atgttcccccggggcgccgaggcccaggactggcacctggacatgcagttaacagggaaggttgttttgtccgcagcagcactgctcctcgtcactgtggcttaccgattatataaaagcagacccgcccctgcccagagatggggtgggaatggacaggcagaagctaaggaagaggccgaagggtcaggtcagcccgccgtacaggaggcatctccaggcgtgctcctccggggaccccgacggcgcagaagcagcaagcgggcggaggcgccccagggttgctcttgtgagaatccccggggtccttatgtactcgtgactggcgctacttccaccgatagaaagcctcaacgaaaaggttctggagaggagcggggcggccagggaagtgactcagaacaggtgcctccctgctgcccctcccaggaaacacgtactgctgtggggtcaaaccccgatccccctcacttcccccgtctgggctcagaaccgaaaagctcccctgctgggctgatagccgcagctgacgggagttgcgccggcggggaacctagcccctggcaagactcaaagcctagggaacatcccgggctgggtcagcttgagccgcctcactgccactatgtggcacccttgcagggaagttccgatatgaatcagtcttgggtatttaccagagtaattggagtctctagggaggaagctggggctctcgaggccgccagcgatgttgacctcaccctgcaccagcaagaaggtgctcctaattctagctacactttctcatcgatagctagagtccgaatggaagagcattttatacagaaagcggaaggagtggaaccgaggctcaagggcaaggtgtatgactactatgtcgagagcacgtctcaggcaattttccaggggcgactggctccccgcacagcagccctaaccgaagttccatcccccagacccccacccggtagtctcggaacaggcgcagcttcaggaggccaggctggggatactaagggcgcggcggagagggcagcttctccccaaactggcccttggccatccacgaggggatttagtcgaaaagagtcccttctccaaatagctgagaatccagagctgcaactgcagccggatggattccggctgccggcccccccctgcccagatcccggtgcgcttccagggttgggcaggagttccagggaaccccacgtgcagccagttgcaggcacaaacttctttcatatcccacttactcctgcttccgctccccaagtgcggcttgacctggggaattgttatgaggtgctgacccttgctaaaaggcagaatcttgaagcactcaaagaagcagcctataaagttatgagcgagaactacttgcaggttttgcggagcccggatatatacggctgtctgtctggagccgaacgagagctgatcttgcagcgccgcctgagagggaggcagtacctggttgtagctgatgtttgccctaaggaggactccggcgggctgtgctgttatgacgacgagcaagacgtgtggcggccgcttgcaaggatgccccctgaggcggtcagtcgcggttgtgccatctgttcactgtttaactatctttttgtcgtgagcggttgccaagggccaggacatcaaccgtcgagtcgggtgttctgctataatcccttgaccgggatatggtcagaggtgtgtccactgaaccaggcaagaccacactgtcgattagtggcactggatggccacctctatgccattggaggggagtgcctaaacagtgtcgaaaggtacgatccaaggctggaccggtgggacttcgccccacctctgccatcagataccttcgcattggctcacaccgcgactgtccgagcaaaggagatcttcgttaccggggggtcgctgcggttcctgttgtttaggttctcagcccaggagcagcgctggtgggctgggcctacaggaggtagtaaggataggacggcagagatggtggccgtcaacggatttctttacaggttcgacttgaaccggtctttaggaatagcagtctaccgttgctcggccagcactcgcctatggtacgagtgcgctacttaccggacgccatatcccgacgcgttccagtgcgcagttgtggacaacctgatatactgcgtaggtcgccgatcaacgctgtgttttctcgcagattcagtgagcccgcgcttcgtgccaaaagaactacgctccttccctgctccacagggaactctgttgccgaccgtgctgaccctccctaccccggatctgccgcagacaagagtctag

SEQ ID NO: 42883 - DNA, 2088 bp, Artificial Sequence
  Description of Artificial Sequence: Synthetic coding sequence
ggccagcccgccgtgcaggaggccagccccggcgtgctgctgcggggaccacgccggcgacgttcttctaaacgtgctgaggcgcctcaggggtgcagttgcgaaaaccccagagggccctacgtgctcgtgacgggcgcaaccagcaccgatagaaagccacagcgtaagggaagcggtgaagagagaggaggtcagggatctgattccgagcaggtgcctccatgctgcccaagtcaggagacccggaccgcggtgggctccaaccctgatccgcctcatttcccacggttgggctcagagccgaaatcatcacccgctggacttatcgccgccgccgatggctcatgcgccggaggcgagccaagcccgtggcaggactcaaagcctagagaacacccaggcctggggcagctcgagcctccacactgtcactacgtggccccactgcaggggagctcagatatgaaccagagctgggtctttactagggttatcggagtttcacgggaggaggctggtgcactcgaggcggccagtgacgtcgacctcacactgcatcagcaagaaggagctcccaacagttcttacacattcagctctatcgctcgtgtccggatggaggagcattttatccagaaggccgagggtgtagagcctcgtctcaagggaaaagtttatgattattatgttgaatccacgtcgcaagccatctttcagggccggctggctccgcggactgctgcactcaccgaggtcccttctcccaggcccccacctgggtctctcggtacaggtgcagcttctggcgggcaggctggcgacacaaaaggcgccgccgaaagagccgcaagcccccagaccggcccctggccctccactcgagggtttagcagaaaggagagcttgctccagatcgccgagaatccggaactccagctgcagccggacggcttccgactgccagctcccccctgtcctgaccccggggccttgccaggactgggaaggagttctcgggaaccacatgtacagccagtggctggaaccaattttttccatatccccctgacaccagcttccgccccacaggtgcggctcgacttgggaaactgctacgaggtgctgacccttgcaaagagacagaatttagaggcgctgaaggaagcagcctacaaggttatgagcgaaaattacctgcaagtgcttaggagccccgacatttacggctgtttgtccggagcagagagagagctcattctgcaaaggagactcagaggcaggcaatacctcgtggtcgccgacgtctgtcctaaagaggacagtggagggctctgttgttacgatgatgagcaagatgtgtggcggccactggcgcgcatgccccctgaggccgtgtctcggggctgtgccatctgtagcctcttcaattacctgttcgttgtgtctggttgtcagggacccggccaccaaccaagttccagggtcttttgctacaatcccttaaccggcatttggtcggaggtctgccctctcaaccaagctagaccacactgtagacttgtggcacttgacggacacctgtacgctatcggtggagaatgtctcaattcagtggaacgttacgatccgaggctggatcgttgggactttgcccctcccctgccctctgatacctttgctctggctcatacagctaccgtgagagcaaaagaaattttcgtgaccggggggtctttgagatttctgctgtttcgattctcagctcaggagcaacgatggtgggccggaccaaccggaggaagtaaggacaggaccgccgagatggttgctgtaaatgggtttctctacagattcgatctcaatcggagcttgggtatcgcagtgtaccggtgctctgcctccactagactatggtacgagtgtgccacttatcgcaccccctaccctgatgccttccagtgcgccgtggtcgacaacctcatttattgtgtgggcagacggtctactctgtgcttcctggccgattccgtgtcccctcgtgaggcagccatagtgccatcctacctgctcgtggaggtatgttag

SEQ ID NO: 42884 - DNA, 1929 bp, Artificial Sequence
  Description of Artificial Sequence: Synthetic coding sequence
atgcagccccggagcgagcggcccgccggccggacccagagccccgaacacggatctcccggtcctggtcccgaggccccacctccccccccgccccagcccccagcccctgaagctgagcgaacccggcctcggcaggctcgccccgctgcaccgatggagggggccgtgcagctgctctcacgcgagggccacagcgtcgcacacaatagtaaaagacattatcacgatgcgttcgtggccatgtcacgaatgcggcagaggggattattgtgcgatattgttcttcacgtggccgccaaggagatcagggcacacaaagtcgtcttggcttcttgtagcccctacttccacgctatgttcacaaatgagatgagtgagtccaggcaaacgcacgtgaccttgcacgacattgacccacaagctctggatcagctcgtgcagtttgcttatacagctgagatagtagtcggggagggaaatgttcagacccttctgcctgcagccagcctgctgcagctaaacggtgtgagggacgcttgttgtaaatttctcttaagccagttagacccctctaattgcctcggaattcggggctttgccgacgcacattcatgttcagatctgctgaaggccgcccatcgctacgtgttgcaacactttgtcgacgtcgccaagaccgaggagtttatgctgctgcctttgaaacaggtgctcgagttggtatccagcgatagcttgaacgtccctagtgaggaggaggtataccgcgcggttctctcttgggttaagcatgatgtcgatgccaggcgccagcacgtgcccagattgatgaagtgcgtccggttgcctctgttgagtcgtgactttcttctgggacacgtagatgctgagtccctggttcgccatcatcccgattgcaaggacctcctcattgaagcacttaaatttcacctgctccccgagcagcgaggtgtactgggtacaagccggacccggccccgtcggtgcgagggagccggtcctgttctttttgcagtgggcgggggcagccttttcgccatccacggagattgcgaagcttacgatactagaaccgatcgttggcacgtggtcgcctcgatgtcaaccaggcgcgctagggtaggcgttgctgcggtgggcaacaggttgtatgctgtcgggggttacgatggaaccagcgatctggccaccgtagagtcatatgatcctgttaccaacacctggcagccagaagtaagtatgggtactaggagatcctgcctgggagtggccgctctgcacggactgctgtactccgccgggggatatgacggagcgagctgtcttaacagcgccgaaaggtacgatcccctcaccgggacatggacttctgtcgccgctatgagcacccgcagacggtatgttcgcgtggccacgctagacggcaacttatatgcggtaggcggatatgactccagctcccacctggctacggtcgagaaatacgaaccccaggttaacgtttggtcgccagttgcatcgatgctctcaagaaggagctccgctggagttgcggtgcttgagggtgctctctacgtagctggggggaacgatggcacttcttgcctaaattccgtcgaaagatactctccaaaggcaggcgcttgggaatctgttgcacctatgaatatcagaagatccacccatgatttagtggccatggacggctggctatacgccgtcgggggcaacgacgggtctagcagtctcaactccatcgaaaagtataatccccgcacaaataagtgggtggcagcctcttgcatgttcacccggcgctctagcgtgggtgtcgcagttctggagctgctgaactttccaccgccaagttccccaacgctgtccgttagctccacaagtctctag

SEQ ID NO: 42885 - DNA, 1557 bp, Artificial Sequence
  Description of Artificial Sequence: Synthetic coding sequence
atgagcgagagccggcagacccacgtgaccctgcacgacatcgacccacaagcacttgaccagttagtgcaattcgcctacacggctgagatcgtagtgggagagggcaacgtccagacactgctgcctgccgcctcgcttttgcagctcaatggtgttcgagatgcctgctgtaagtttctgttgtcacagctggacccatcaaactgcctggggatacgaggattcgctgatgcacatagctgtagtgatttactgaaagctgcacatcgctacgtactgcaacactttgtggatgtggcgaaaaccgaagagttcatgctactgcctcttaagcaagttctggagctggtcagtagcgattccttaaacgtaccttcagaggaggaggtctatagggccgtcttaagctgggtgaaacacgacgtcgatgcacggcgacagcatgtgccacgattaatgaaatgcgttcggctacctctgctgtcaagggatttcctccttggtcacgtggatgccgaatccctcgttaggcaccacccggactgcaaggatctcctcattgaggcccttaaattccacctcttgcctgagcagcgcggggtgctcggcacaagcaggacccggccaagaagatgcgaaggcgccggccctgtattatttgcagttgggggagggagccttttcgccattcacggcgactgcgaagcttatgatactagaactgatcgatggcatgttgtcgcaagtatgagcaccagaagggccagggtcggtgtcgctgccgttggaaatcggctttacgccgtaggcggatatgacggtacctccgatttagcaacagtcgaatcatacgaccccgtgacaaatacttggcagccagaagtcagcatggggaccagaaggtcctgtctgggggtggccgcgctacatggtctactgtattccgctggagggtatgacggcgcatcatgcttgaacagcgctgagagatacgacccactcaccgggacatggacttcagtagccgctatgtctacacgaaggagatatgtccgtgtagcaactctggacgggaatttgtacgccgtcggtggctacgattctagctctcatctggccaccgtcgaaaagtatgagccgcaggtgaatgtgtggagccccgtggcctccatgctctcccgtcggagttcagccggcgtcgccgtgctggaaggagctctgtatgtcgccggaggaaacgacggaacttcctgcttaaacagcgtcgaaaggtactctcctaaggcaggagcctgggaatccgtggcacctatgaatatccgtcgttccacgcatgacctggtggctatggacggctggctgtatgcagttgggggaaacgacggttcctccagcttaaactctattgagaagtataacccccgaactaataaatgggtggcagcctcatgcatgtttacaagacgctctagcgtgggcgtagccgtgctggaactattgaacttcccccctccatcttcccccaccctgagcgttagtagcaccagcttatag

SEQ ID NO: 42886 - DNA, 678 bp, Artificial Sequence
  Description of Artificial Sequence: Synthetic coding sequence
atgaagtgcgtgcggctgcccctgctgagccgggacttcctgctggggcatgtggacgccgagtccttggttcgccatcatcccgattgcaaagacctcttgatcgaagcgctgaaattccacctgttgcctgagcagagaggtgtcctcggaaccagtaggacccggccacgtcgctgtgaaggagcagggccagtccttttcgcagtgggtgggggttcactttttgcgatacatggcgactgcgaagcctacgatacccgtactgataggtggcacgtcgttgccagcatgtctacgagaagggcccgtgttggggtggccgctgtggggaacaggctctatgccgtgggcggatatgacggcacgtccgacctggcaaccgtggagtcatacgatccagtaacaaacacctggcagcctgaggtcagtatgggcacacgacgtagttgcctgggggtcgcggcccttcacggcctgctgtactcagccggcggttacgatggtgcctcttgtctgaacagcgctgagcggtatgatccattaaccgggacgtggactagcgtggcagccatgagcaccaggagacgttacgtgcgcgtggctaccctggacggcaacctctatgcggtaggtggttatgactcctctagccatctggcaaccgtagagaagtag

SEQ ID NO: 42887 - DNA, 489 bp, Artificial Sequence
  Description of Artificial Sequence: Synthetic coding sequence
atgcggatcgccaaccggacccggttcagcagccccttcctggcccgaggcgccggctggacccacgggagggggatgatggtggtgggcacgggtacatccctggccctgtcctccctgctctccctgctgctattcgcaggcatgcagatgtacagccgacagttagctagcaccgagtggttgactattcaaggtgggttgctgggctccgggctgttcgtgttctcattaaccgcttttaacaatcttgagaacctggtgtttggaaaaggtttccaagcaaaaattttccccgagattctgctgtgtctgctgctcgctttgttcgcttcaggacttattcaccgcgtgtgtgtgacaacctgttttattttctctatggtggggctgtattacatcaacaagattagctctaccctataccaagccgcagccccagtcttgacccctgctaaggtgactgggaagagtaagaaaaggaactag

SEQ ID NO: 42888 - DNA, 723 bp, Artificial Sequence
  Description of Artificial Sequence: Synthetic coding sequence
atgcggcggtgcagcctgtgcgccttcgacgccgcccggggcccccgtcggttgatgagagtggggctggccctgattctggtggggcatgtgaatctgcttctgggcgctgtgctgcatggcacagttcttcggcatgtggcgaacccaaggggagccgtaactcccgagtatacagtggcaaatgtaatcagcgtagggagcggactgttaagcgtgtccgtggggctggtcgcccttttggcttcaaggaatcttctgcggcccccactgcattgggtgctcctggctttggccctggtcaacttactgcttagtgtggcctgttcactcggcctgttacttgccgtgagcttgactgtggcaaatgggggccggcgcttgatcgcggattgtcaccccggcctgctcgaccctttggttcccctcgatgagggcccaggacacactgactgcccctttgaccccacgcgaatttatgacacagccctcgcattatggataccatctttactcatgagtgcgggggaggccgcactgtccggctactgctgtgtcgccgccctgaccttaagaggagtgggaccctgccggaaagatgggcttcagggccaactggaagagatgactgaactcgagtcccccaaatgtaagcggcaggagaacgagcagttactggaccaaaaccaggaaatccgagcaagccagcggtcgtgggtgtag

SEQ ID NO: 42889 - DNA, 669 bp, Artificial Sequence
  Description of Artificial Sequence: Synthetic coding sequence
atgcgggtgggcctggccctgatcctggtgggccacgtgaacctgctccttggcgctgtgttacacggcaccgtgctgaggcacgtcgcaaatcctcgcggggctgttacgccagaatataccgttgcaaacgttatttccgtcggctcgggcctactctctgtttcagtcgggctagtggctctccttgctagcagaaatttactgcggccgcccctgcactgggtacttctcgcgcttgctctcgtaaatctattgctttccgtggcctgtagtctggggcttctgctcgcagtatccctgaccgtggccaatggtggccgaaggcttatcgcagattgccatcctggcctactggatccgctggttcctctggacgaagggcctggccacactgattgccccttcgaccctacacgaatttacgatacagcccttgccctgtggatcccatctttactgatgagcgccggtgaagctgccctttcaggctattgttgtgtagctgcgctgacgctgaggggtgtgggcccttgtaggaaggacgggttgcagggccagctagaggaaatgactgaacttgaatcccctaagtgcaagcgccaggagaacgagcagttgctcgaccagaaccaggagatccgggcatcacagcgttcgtgggtgtag

SEQ ID NO: 42890 - DNA, 189 bp, Artificial Sequence
  Description of Artificial Sequence: Synthetic coding sequence
gccctgagcggctactgctgcgtggccgccctgaccctgcggggcgttggcccatgcaggaaagatggattgcaagggcagttggaggaaatgaccgagctggaaagcccaaagtgcaaacgacaagaaaatgaacaattattggaccagaaccaggaaatcagagcctcacagcgcagctgggtatag

SEQ ID NO: 42891 - DNA, 723 bp, Artificial Sequence
  Description of Artificial Sequence: Synthetic coding sequence
atgcggcggtgcagcctgtgcgccttcgacgccgcccggggcccccggcgtttaatgcgggtaggtctggcactaattttggtgggacatgtgaaccttttactcggtgctgtgttgcatggcactgtcctgcggcacgttgcaaacccgcgaggcgccgtgacacccgagtatacagtggccaacgttatcagcgttggatcaggattgttgagcgtcagcgttggtctggtggcactcctcgcctcccgcaacctgctgagaccacctctgcattgggtgctgctggctctcgccctcgttaacctcctactgtctgtggcatgttcgctgggattattactcgcggttagcctgactgtcgctaacgggggccggcggctgatcgcagactgtcatcctggtctgctggacccccttgtacccctcgatgagggacccggacacacagactgccccttcgaccccacccggatctacgacaccgctctcgcgctgtggatcccctcccttcttatgtctgccggggaggcggccttgagtggatattgctgtgtcgcggcattaaccctgcgcggcgtgggaccttgtcgaaaagacggtctgcagggacagctggaagaaatgactgagctggaaagtcccaagtgcaagaggcaggaaaatgagcaactgttggatcagaaccaggagattcgggcctctcagcggagctgggtgtag

SEQ ID NO: 42892 - DNA, 2982 bp, Artificial Sequence
  Description of Artificial Sequence: Synthetic coding sequence
atggccgccgagtgggccagccggttctggctgtgggccaccctgttaattccagccgccgcagtttatgaggaccaagtagggaagttcgattggcgccagcagtatgtgggcaaagtgaaatttgcgtccctcgaattttctcctggcagtaagaagctagtagttgcaacagaaaagaacgttatcgctgccctcaactctaggaccggggagatactgtggaggcacgtcgacaaaggaacagcggagggggctgtcgacgccatgctgctgcatggtcaggatgtcatcacagtgtctaatggtggccgcatcatgcgttcgtgggaaacgaacatcggaggattaaattgggaaattacactagactcgggcagttttcaggcgctcggactagtcggtctgcaggaatccgtccgttacatagccgtcttaaaaaagacaaccctcgcactgcaccacctaagtagtggacacctgaagtgggttgaacatctaccagagtcagatagcatccactaccaaatggtgtacagctatgggtccggcgtggtgtgggcgctgggagtcgtaccattcagtcacgtcaacatcgtaaagtttaacgtggaggacggggagatagttcagcaagttcgggtcagcacaccttggttacagcaccttagtggcgcatgtggtgtagtcgacgaggccgtccttgtatgtccagatccgagctctagaagccttcagacactggctctggaaaccgagtgggagttgagacagatccctctccagtccttggatttggaattcggatccgggttccagccacgcgtcctgccaacccagcccaatcccgtcgatgcgagccgagcccaattcttcttacacctgagcccaagtcattacgcgctgctccaataccattatggtacactctcgctcctgaagaatttcccgcagaccgctcttgtcagcttcgcaacaactggggagaagactgttgccgctgtgatggcctgcagaaatgaggtgcagaagtcctcaagcagtgaggacggcagcatggggtcctttagcgagaagtcctcttcgaaagatagcctggcatgtttcaatcagacttacaccatcaacctgtatcttgtcgagaccggccgacgccttctggacactacaatcactttttccctcgagcagtctggcaccagaccggaacggctgtacattcaggtgtttctgaagaaggacgattctgtaggctatagggccctcgtgcaaaccgaagaccacttactcctttttctccagcaactggccggaaaagttgtgctttggtcacgagaggagagtttagccgaggtggtttgtctggaaatggtggatttgccgctgaccggtgcccaagctgagctggagggtgagttcggcaagaaggccgacggcctgctcggcatgtttctgaagcgcctatcatcccagttgattctgctgcaagcctggacctcccacctttggaaaatgttttatgacgcaagaaagccgaggtctcagattaaaaacgaaatcaatatcgataccctcgcacgggatgaattcaatctccaaaagatgatggtgatggtaaccgcaagcgggaaactattcggcatagaaagctcctccgggactatcctatggaagcagtacctcccaaatgtaaagcccgatagcagcttcaagcttatggttcagcggaccaccgcccacttcccccaccctcctcaatgcacgcttcttgtaaaggataaggaatctggtatgagttctctgtacgtgttcaatcctatttttggaaagtggtctcaggtcgccccaccagttctgaagaggcccatacttcagagtctccttttgccagtgatggaccaggactacgctaaggttctcttgctcatcgatgacgaatataaggtgactgcgttccccgcgactagaaatgtgctaagacagctgcatgagctggcacctagcatttttttctacttagtcgatgccgagcagggtaggttatgcgggtatagactgcgaaaggacttgacaactgaattgtcatgggagctgactattccccctgaagtacagagaatcgtaaaggtgaaggggaaacggagttctgagcacgtccattctcaggggagagtcatgggggatcgctctgtgctctataagtcgctgaaccctaacctgctggccgtagttaccgaatcaaccgacgcccaccatgaaaggacgttcattggtatatttctcatagacggggtgacaggtcggattattcactcctcagttcagaaaaaagctaagggacccgtccacatcgtacatagcgagaactgggtggtctaccagtactggaataccaaggcgagaagaaacgagttcaccgtccttgaattatacgaggggaccgagcaatataatgctacggccttctcttcactggatagaccgcagcttcctcaagtgctgcagcagtcctatatttttccatcaagcatttcagctatggaggctacaataactgaacgcggaattacgtctcggcacctactcatagggctcccctctggggctatcctttcacttcccaaagcactacttgatccccgtagacccgagatcccaacagagcaatcacgtgaggaaaatttaattccttattcccccgatgtgcagatacacgccgaacggtttataaactataaccagactgtgagtagaatgaggggaatatacaccgcaccgtctggacttgagtctacatgtctcgtggttgcatatggactcgacatttatcagacacgtgtatacccatctaagcaatttgatgtgttaaaagatgattatgactacgtgctgatttccagtgtgctcttcgggctggtctttgctacaatgatcacaaagagactggcccaggtcaagctgcttaacagagcatggcgttag

SEQ ID NO: 42893 - DNA, 4071 bp, Artificial Sequence
  Description of Artificial Sequence: Synthetic coding sequence
atggacctgaaggagaagcacctgggcgagccccccagcgccctggggctatccaccaggaaggccctaagcgtattaaaagaacagttggaagctgtgctggaaggccatctgcgagaaaggaagaaatgtctgacctggaaagaggtgtggaggtcatcttttttgcaccattctaatcgatgttcatgcttccattggcccggggctagcctgatgttgctggccgtcctcctgctgctgggctgttgcggcggccagccagctggaagccggggcgttgggcttgtaaacgcctccgctctgtttctgctgttgttgctgaacctcgtgctcatcggcagacaggataggttgaaacgcagggaggtcgaaaggagactcaggggcattattgatcagatccaggatgctctgcgtgatggccgcgagattcagtggcccagcgccatgtatcccgacctccatatgccattcgcccccagttggagcttgcactgggcttatagggacggccatcttgtaaacctcccagtgtccctgctcgttgagggtgatataatcgctctgcgccccggccaggaatctttcgccagccttcgcggaattaaggatgacgagcacatagtgttagaacccggggacctctttcccccctttagcccgcctcctagcccgcgcggcgaagtcgaaagaggaccccagagcccgcagcaacaccgtttatttcgcgtgctagagactccagtaattgacaacatcaggtggtgcctggatatggcactgtcgcgccctgtgactgcattggacaacgagaggtttacagtccagagcgtaatgctccattatgccgtgcctgttgtgctggcaggatttctgattaccaacgcattgcggttcattttctccgcacctggagtgacgtcatggcagtacacactgctacagctacaggtgaacggggtgcttcctatcttgccattgctcttcccagtcctgtgggtcctggccacagcatgcggcgaggccagggtcctcgctcaaatgtctaaggcttctccatctagccttctcgcaaagttctccgaggatacactgtcgagctataccgaggcagtgagcagccaagagatgttacggtgcatctggggccactttctacgggtgcttggcggaactagtccaacgctgtcccactcatccagtttgcttcattctctgggttctgtgaccgtactttgttgtgtggataagcagggtattctatcctggcctaacccatcaccagaaaccgttttgtttttttccggaaaggttgaaccaccgcacagtagtcatgaggatctcaccgatggactgtctaccagatcgttttgccatcctgagcctcacgagagggacgccctcttagccggcagtctgaacaacactctccacttgtctaacgagcaggagcgcggtgactggccaggcgaggcacctaaacctccagaaccctattcccaccataaggctcacggcagatccaagcaccccagcggctcgaacgtctctttcagtagggatactgaaggcggggaagaggagcccagcaagacacagccagggatggaatctgatccttatgaagccgaggattttgtgtgcgactatcacttggagatgctctctctaagccaggaccagcagaacccgtcttgcatccagtttgatgattctaattggcaactccacctgacatcgctcaaaccgctgggattgaatgtgctgctgaacctgtgtgatgcttcagtgactgagaggctttgccgcttctcagatcacctctgtaacatcgccctccaagagtcccatagtgcagtcctgccagtgcacgtaccttggggtttgtgcgagcttgcacggctgatcggatttacacctggagccaaagagctctttaagcaggaaaaccaccttgcgctgtacaggctccctagtgcagaaactatgaaagaaacaagtctcgggcgcttgtcttgtgtgactaagagacgtcctcccttgagccatatgatttctctgttcatcaaggatactaccactagtactgagcagatgttaagtcatggaacagccgatgtcgtgctggaagcttgtactgatttttgggatggagccgatatctatccactctccggctctgatcggaagaaggttcttgatttttaccagcgagcgtgcctgtcggggtactgcagtgccttcgcctataaaccaatgaactgcgctctttcaagccagcttaatggcaaatgtatcgagctggttcaagtgccgggccaatcctctatcttcaccatgtgcgagctgccctccaccatcccgattaagcagaacgcgagaaggagtagttggtcctcagacgaggggatcggggaggtccttgagaaagaggactgcatgcaagcactgtccggtcaaatctttatgggcatggtgagctcccaatatcaagcccgcctggacattgtgcggcttatcgacggcctcgtaaatgcatgtatacgttttgtttacttcagtcttgaggacgagctcaagagcaaggtcttcgcagaaaaaatgggcttggaaactggttggaactgccatatcagtctgacaccaaacggtgatatgccaggcagcgagattccccctagctccccgagccacgctggatcacttcacgatgacttgaaccaggtttcacgggacgacgctgagggtctgctccttatggaagaggaggggcattctgatctgatctccttccagcccacagattccgacatcccatccttccttgaagattctaatcgcgccaagctgccccgcgggatccaccaggtccgaccccatctccagaacatcgacaatgttccactcctagtaccactgttcactgactgtacacctgaaactatgtgcgagatgatcaagatcatgcaggaatatggtgaggttacttgctgccttggaagcagcgccaatctccggaattcctgcctgttcctccaatcagatatcagtattgcccttgatccgctgtaccccagccggtgcagttgggaaacatttggctatgccacatcgatttccatggcgcaggctagcgatggccttagccccctgcagttatccgggcagttgaattccctgccgtgttctttaaccttcagacaggaagagaccatctctatcataagactgattgagcaggctagacacgcaacttatggcataagaaagtgttttctgttcctcctccagtgccagctgactctggtcgtgatacagtttctgagttgtctggtgcaattaccaccacttctttctaccaccgacattctctggctttcctgcttttgttatccgctgttgtccatttccttgttaggtaaaccacctcattcatccatcatgagcatggctactggcaaaaacctgcaatcaataccaaaaaaaacacagcattatttccttttgtgctttcttctcaaatttagcctgacaatctcttcctgtctcatctgctttgggttcacgctccaaagcttctgtgattcgtcccgggatcgcaatttgacgaattgttcctcagtcatgctccctagcaatgatgacagggcccctgcctggttcgaggattttgcgaacggtttgctcagcgcccagaaactcacagcagccctgatagtgttgcacacggtgtttatttctattacccacgtccaccgcacaaagcctctgtggcgaaagtctccactgacaaatctgtggtgggcggtgaccgtgcccgtggtacttctgggccaggtagtccagacagctgttgatcttcagctatggacacacagggatagccacgtccacttcggacttgaagacgtccccctgctgacgtggttacttgggtgcctcagcttggtgctggtggtcgttacaaatgaaatcgtaaagctccacgagatacgtgtgcgcgtgagataccagaaaaggcagaagctacagttcgagacaaagctggggatgaatagtcccttttag

SEQ ID NO: 42894 - DNA, 912 bp, Artificial Sequence
  Description of Artificial Sequence: Synthetic coding sequence
atgtgccacggccggatcgcccccaagagcaccagcgtgttcgccgtggccagcgtgggtcacggggtttttttgccactggttattctctgtacactactgggagatggcctcgccagcgtgtgtccacttcctccagaacctgagaacggtggctacatctgtcacccccggccttgtagggacccgttgacagcagggagtgtcatcgagtacctgtgtgctgagggatatatgcttaaaggggattacaaatacctgacctgtaagaacggggaatggaagcccgcgatggagatctcctgcaggttgaatgaagataaagacacccacacgtctctgggagtgccgactctgtccatcgtggcgagtacagctagctctgtagcgctgatcctcctcctcgtagttctgtttgtgttgttgcagcccaagctcaaatcctttcatcactcccggagggatcagggagtgagcggcgaccaggtgtctattatggttgatggcgtccaggtggctttgccctcttacgaggaggccgtgtatggatcgagtgggcactgtgtccccccagctgatccacgggttcaaattgtgctgtctgaagggagtggcccctcaggaagatccgttccgagggaacagcagctgccagaccagggtgcttgttctagcgcgggcggggaggacgaagctcccggacagagcgggctgtgcgaggcctgggggagtagagcctccgagaccgtgatggtgcatcaggccaccacttcaagctgggtcgctggaagcgggaaccggcagctggctcacaaggagacagctgacagtgagaactccgacatacaatccctcctgagtttgacatcagaggagtacaccgatgacatcccactgctcaaagaggcttag

SEQ ID NO: 42895 - DNA, 2472 bp, Artificial Sequence
  Description of Artificial Sequence: Synthetic coding sequence
atgttctacgtgatcggcggcatcaccgtgagcgtggtggccttctttttcactatcaagttcttgtttgagctggcagcgcgcgtggtcagctttctgcagaacgaggaccgcgagaggaggggcgaccgaaccatttatgattacgtgcgcggaaactatttggaccctcggtcgtgcaaggtatcgtgggactggaaggatccttacgaagtcggccattctatggcattcagagtacacctgttctataagaatggacagcccttccctgcacaccgccctgttggactgagagtccacatctcccacgtggagctggccgtggaaataccagtaactcaggaagtactgcaggaaccaaatagtaacgtggtcaaggttgcctttactgtaagaaaagcagggagatacgagattacagtcaaattgggagggctgaacgtggcctatagcccttattacaagatctttcagccggggatggtggtcccttccaagacaaagatcgtttgccattttagcaccctggtgctgacctgcggtcagccgcacactctccagatcgttccccgggacgaatatgacaaccccacaaacaacagcatgagtcttagagatgagcataactataccctgtctattcacgagctgggtcctcaggaggaggagtctacgggtgtcagttttgaaaagagtgtgacctcaaatcgccagacattccaggtctttctgcgtctgaccctccacagtagaggatgcttccatgcgtgcatttcataccagaaccaaccgattaacaacggggagtttgatatcatcgtccttagcgaggacgagaagaatatcgttgagaggaatgtgtcaaccagcggggtgagtatctactttgaggcttacctttataacgcgactaattgcagctctaccccgtggcaccttcctcctatgcacatgacgtcgagccagcgacggccttcaacagctgtggacgaggaagacgaggattctccttcagagtgccatacccccgaaaaggtcaagaaaccaaaaaaggtatactgctacgtctcacccaagcagttttccgttaaggaattttatctgaagatcataccctggcggctctatacctttcgagtctgccccggcaccaaattttcgtacctggggccggatcccgtgcataagcttctcaccctcgtggtagatgatggcatccaacctcctgtggagctcagctgcaaggagagaaacatcctggccgccacttttatccgctcactgcacaaaaatatcggtgggtcagagacttttcaggataaggttaacttcttccagcgggaattgcggcaggttcatatgaagcggccccactctaaggttacgctgaaggtgtcccgccacgctctcttagaatcaagcctgaaagccaccagaaacttcagtatctcagattggtccaagaacttcgaggtagtgttccaagatgaagaggcactggactgggggggtcctagacgtgagtggttcgagctcatctgtaaagccctctttgacactacgaaccaactctttacgaggtttagcgacaataatcaggctctcgttcatcccaatcccaatcgccctgcacacctccgcttgaagatgtacgagttcgctggacgcttggtgggcaaatgtctgtacgaatcttcccttgggggcgcttacaaacagctggttcgcgctaggttcactaggtcgtttctcgcccaaatcatcggccttcgcatgcactataagtactttgagaccgatgatcccgagttttacaagtcgaaggtctgtttcatactcaacaacgacatgagcgaaatggagctcgtgtttgccgaggagaagtacaacaagtccggtcagctagacaaggtagtagagctgatgaccggcggtgcccagactccggtcacaaatgcaaacaaaattttctacttgaacctgttggcacagtatcggctcgcgtcccaggtaaaagaagaggtggagcattttcttaagggtttgaacgaattggttccagaaaatcttcttgcaatcttcgacgaaaatgagctcgaactcctgatgtgtggtacaggggatatatctgtgtccgattttaaagctcatgcagtggttgtggggggaagctggcacttccgtgaaaaagtaatgcgatggttttggacagtcgtttctagtcttacacaagaggaactcgcccgcttgcttcagtttaccactgggtctagccagcttcctcctggcggcttcgctgctttgtgtccttcctttcagattatcgccgcccccacacattcaaccctaccaaccgcgcacacctgtttcaatcagctctgtttgcctacctatgacagctacgaggaagtacataggatgctgcagctggcaatttcagaggggtgcgagggtttcggcatgctctag

SEQ ID NO: 42896 - DNA, 3150 bp, Artificial Sequence
  Description of Artificial Sequence: Synthetic coding sequence
atggagaagcggctgggcgtgaagcccaaccccgccagctggatcttgtcaggctattattggcaaacgtcagccaaatggcttcggtcactgtacctcttttatacatgtttctgcttcagtgtgctgtggctgtctacagacgcctccgagagtaggtgtcagcaggggaagacccaatttggggttgggttacgcagcggtggggagaatcacctgtggctgcttgagggcaccccaagcctacagtcttgctgggcagcttgttgtcaggactccgcctgtcacgtattctggtggcttgaaggaatgtgcattcaggccgattgttctcgaccacagtcctgtcgagcgtttcggacgcactcgagcaactctatgttggtttttttgaaaaagtttcagacagctgacgatctgggctttctgcctgaggatgatgtgccccacttactcggtctaggttggaattgggcatcatggaggcagtcgcctcctagggctgccctgcgtcccgcagtctcatcgtctgaccaacaaagccttattcgcaagttacagaagcgcggaagccctagcgacgtcgtgacacccatcgtgacccaacatagtaaagttaacgatagtaatgagctgggaggtctcactacctcagggagtgccgaagtacacaaagctattacgataagcagtccactcacgaccgatctgactgccgaactgtcaggcggaccaaagaatgtgtcggtgcaacctgagatatcagagggtttagctactacaccaagcacacagcaggtgaaaagctcagaaaaaactcaaatcgccgtgccccagcccgtggcaccttcctacagctatgcgacccccactccccaggcgagcttccaatccaccagcgccccttacccggtgatcaaagaactagtggtaagcgcgggcgagagcgtccagattacacttccaaagaatgaggtccagctgaacgcctatgtgctgcaagaaccccctaaaggagaaacctacacctatgattggcagctgattactcacccaagggactattccggagagatggaaggaaagcattcacagatattgaaattatcaaaactgactccaggcctgtatgaatttaaggtgatagtcgaaggacagaacgctcatggggaagggtacgttaatgtcacagtgaagccagagcccagaaagaaccgccccccgatagctattgtgagtccacaattccaagagatctcgctacctactaccagcaccgtcattgatgggtctcagtcaacagacgacgataaaatcgtgcagtaccactgggaagagttaaaggggccactgcgagaggagaagatctctgaagatactgcaattctgaaattaagtaaacttgtaccaggcaattacaccttttcgctgactgtggtcgactcggatggggcgactaactcgacaacggccaatttgactgtcaataaagcagttgactatcctcctgtggcaaacgccggcccgaaccaggtgatcaccttaccgcaaaactctatcaccctgttcggaaaccagtctacagacgatcacggcatcacctcatatgaatggtcactctcccccagctctaagggaaaagtggtggaaatgcagggcgtacggactcctaccttgcaattgtcggccatgcaggaaggagactatacctatcagctgaccgttacggacacaatcgggcagcaggccactgcgcaggtgacagtgatagtgcagccagaaaataacaagccccctcaagccgatgcgggtcccgataaggaacttacgctgccagttgacagcaccacactggacggtagcaagtccagtgacgaccagaagataatcagttatctgtgggagaagacacagggccccgacggcgtccagctggagaacgccaatagctcagtggcaactgtcacgggactgcaggtgggaacttacgtgttcactctcacggtgaaagacgaacgtaacctgcagtcccagagctccgtgaatgtgatcgtcaaggaggagattaataagcctccgattgccaagattactgggaacgtggtgattaccctgccaacctccacagcggaactggacgggtccaaatcctctgatgacaaagggatcgtcagttacctgtggacccgcgatgaaggctctcccgccgccggtgaggttctgaatcactcagatcatcaccctatcctgttcctgagcaacctggtagagggtacctatacattccatttaaaggtcacagacgcaaaaggagagtcagacacagaccgcacgactgtggaagtgaagccagacccgcgcaagaacaacctcgtggagatcatcctcgatatcaacgtgtcccagttgacagaaaggctgaagggaatgttcatccgccagattggtgtgctccttggagttctggattcagatattatcgtgcagaagattcagccttataccgagcaaagcacaaaaatggttttcttcgtgcaaaacgagccaccgcaccagatcttcaagggccacgaagtggcagccatgctgaagagcgagttgaggaaacaaaaggccgacttcttgatctttagggctctggaggtgaatacagtgacgtgtcagctaaactgctctgatcacggccactgcgattccttcaccaaaagatgcatttgcgatcctttctggatggagaactttatcaaggtgcagcttagagacggggatagtaactgcgaatggtcggtcctttatgtcatcattgctacattcgttattgttgtggccctgggcattctcagttggaccgtgatctgttgttgcaaaagacagaaaggcaagcctaagcgtaaatccaaatacaagatcctggacgccaccgaccaggaaagtctcgagctgaagccaacatctcgagcagggatcaagcaaaagggattgcttttgtcaagtagcctgatgcactctgaatctgaactggacagcgatgatgccatctttacgtggccagaccgtgagaaaggaaagctgctgcacgggcagaatgggtcagttccaaacggtcaaacaccccttaaggcacgaagcccgagagaagagatactttag

SEQ ID NO: 42897 - DNA, 4830 bp, Artificial Sequence
  Description of Artificial Sequence: Synthetic coding sequence
atggccggcctgcggcggccccagcccggctgctactgccggaccgctgctgccgtaaacctgctcctgggggtgttccaggtactgcttccctgctgtcggcctgggggagcccaaggtcaagcaatcgaaccgctgccaaacgtagtcgagctttggcaggcagaggaaggggagctattgctgccaacacaaggcgacagtgaggagggcttagaagagccgagccaggagcagtctttttccgacaaattgttctccgggaaggggttacactttcaaccaagcgtcctggacttcgggatacagttcctggggcatcccgtggcaaaaatcctgcacgcgtacaatccttcccgagatagtgaagtagtggtgaattcagtgttcgctgctgccgggcacttccacgtacctcccgtgccttgcagggtgattcctgctatggggaaaactagcttccggattattttcttgccaactgaggagggcagcatcgagagcagtctgttcatcaacacgagctcatatggtgtgctctcttatcatgtgtcaggaattggcactcgtaggatcagcactgaggggagcgccaagcagcttcccaatgcctactttctgctgcccaaggtccaaagcattcaactgtcccagatgcaggcggagaccactaacacctcactcctccaggttcagctcgagtgtagcctgcataacaaggtgtgtcagcagcttaagggatgctacctggagtctgacgatgtgttaagattacaaatgtcaatcatggtgactatggagaatttttccaaggagtttgaagagaatacccagcatcttctcgatcatttatccattgtctacgtagcgacagatgagtctgaaaccagcgacgattcagcagttaacatgtacattcttcacagcggcaattctctaatttggatacaggacatccggcacttcagccagagggacgcattatctctgcagttcgagcccgtcctgcttccgacgtccactaccaatttcactaaaatcgctagctttacatgtaaagcaacatcctgcgactcgggtataatagaggatgtcaagaagaccacccacaccccaactttgaaagcctgcctattctcctccgttgcccagggctatttcaggatggattcatccgcgacccaattccacattgaaacccacgaaaacacgtccgggctctggtccatttggtatcgcaatcatttcgacagaagcgtagttttgaatgacgtgttcttatcaaaagagacgaagcacatgctgaaaatacttaatttcactggtcctcttttcctgccacctgggtgttggaacattttcagcctcaaactggctgtaaaagacatcgctataaaccttttcacaaacgtgttcctgacaacaaacattggcgcaattttcgcaatcccactccagatttattccgcacccaccaaggaaggctccctggggtttgaagtgatagcacattgtgggatgcactactttatgggaaaatctaaagcagggaacccaaactggaacggcagtctgtccctcgatcaatcaacctggaacgtcgattcggagttggccaacaagctctatgagcgttggaagaagtacaagaacggggacgtctgcaaaagaaacgtcctggggacaacaaggtttgcccacttaaaaaagtctaaagagagcgagagtttcgtgttcttcttgccgagacttatcgccgagcctggactgatgctcaatttttccgcaacagctttgaggagccgcatgattaagtattttgtggtgcaaaatccgtcatcctggcctgtgtccctccagctgctgcccctgtcactgtaccccaagcctgaagcattggtgcatctcttgcatcggtggttcggaaccgatatgcagatgatcaactttacaactggtgaattccagcttaccgaggcttgcccgtatttaggcacgcactccgaggaatccagattcggtatcctgcacctgcacctacagccgctggagatgaagagagtgggagtggtatttacacctgccgattacgggaaagtgacaagcttgatcctgattcggaataacctaacagttatcgacatgattggagttgaagggttcggtgctcgcgagctgctcaaagtgggcggcaggctgcccggagccggaggctccctcaggtttaaggtaccagagtccaccctgatggattgccggcggcaattgaaggattctaagcaaatcctgagtatcacaaagaatttcaaggttgaaaatattggacctcttcctatcaccgtgtcatcgctcaaaatcaacgggtacaactgtcagggatacggatttgaagttttggactgtcaccagttttctctagaccccaatacctcacgcgacatctcgattgtcttcactccagattttaccagtagctgggtcataagagatctgagcttggtgacagcagcggacctcgaattcaggttcacactaaatgtgactctgccacatcacctactccctctgtgtgctgatgtcgtaccgggcccaagctgggaggagtcgttttggagattgacagtattcttcgtgtctctcagtctcctgggagtcattctcatcgccttccagcaggctcagtatattctgatggaattcatgaagacccgccagcggcagaatgctagttcaagctcgcagcagaataatgggccaatggacgtcatctcccctcactcatataaatccaattgtaaaaattttctagacacatatgggccaagtgataaaggtaggggcaagaactgcctacccgttaataccccccagtcacggatccagaatgctgctaaaaggtccccagctacctatggacacagtcagaaaaaacacaaatgctctgtgtactactcgaagcacaaaaccagtaccgcagccgcctcttcgacgtccaccacaactgaagaaaagcagactagccctctcggatcttctttgcccgccgcgaaagaggacatatgtacagatgctatgagagagaattggatttccttacgatatgccagcggcataaacgtgaacctgcaaaaaaacctgaccctgcctaagaacttattgaacaaagaggaaaacacgctcaaaaacacgattgtgttctccaatccttcttctgaatgttcaatgaaagagggtattcagacttgtatgtttcctaaggagaccgacatcaagacgtcagaaaacacagccgagttcaaggagcgtgaactctgtccattaaagaccagcaagaaacttccggagaatcacctgcctcggaactctccgcagtatcatcagcctgacctacctgagatctctagaaagaataatgggaacaaccagcaggtgcccgttaagaatgaagtcgaccactgcgaaaatctgaaaaaggttgatactaagccatcaagtgaaaagaaaatccacaagacatcccgggaggacatgttttccgaaaaacaggatatcccttttgtggaacaagaggacccatatcgtaaaaagaagttgcaggaaaagcgggagggcaatcttcaaaatctcaattggtctaagagtcggacatgtcggaagaataagaagcgaggcgttgctcctgtgtctcgacctcctgagcaatccgatctcaagctcgtttgcagcgacttcgagcggtccgaacttagctcggatatcaatgtgcgcagttggtgcatccaagagtctacaagggaggtgtgcaaagcggacgcagagatcgcaagctctctcccagccgcacagcgagaggcggaaggctactaccagaaacccgagaagaaatgcgtggacaagttctgctccgactcttcaagcgactgcgggtcatctagcgggtccgtccgcgctagccgaggctcttggggatcatggagcagcactagctcaagcgacggtgacaagaaaccaatggtggacgctcagcacttcctgcctgctggggactccgtgagccagaatgattttccctctgaggcacctatctccctcaatctctcccataacatatgtaatccgatgacagtcaactcgctcccgcagtatgctgaaccgagctgcccatccctgcccgcaggtccaaccggggtggaggaggacaagggactctacagccccggcgatctgtggccgactccacccgtctgcgtcacttcaagcctgaactgcaccttggagaatggagtgccatgtgtcattcaggaatccgccccagttcataactctttcatcgactggtccgctacgtgtgagggccagttttcaagcgcttactgccctttggaactcaacgactataatgcgttccctgaggagaatatgaattacgctaacggctttccttgtcctgccgacgtgcagactgacttcatagatcacaactcccagtctacttggaatactccccccaacatgcctgcagcgtgggggcacgcgtcatttataagcagcccaccgtatctaacctcgaccagatctctctccccaatgagcggcctttttggttcaatctgggctccacagagcgacgtgtatgagaactgttgccctatcaatcctaccacagaacactctacgcacatggagaatcaggcggtggtttgcaaggagtactacccaggattcaaccctttcagggcctatatgaacttagacatatggactacaactgctaaccggaatgctaattttcctcttagccgggactcttcctactgtggaaacgtttag

SEQ ID NO: 42898 - DNA, 4212 bp, Artificial Sequence
  Description of Artificial Sequence: Synthetic coding sequence
atggccaactgcagccaggaggagctggacgaggagttcgagcagttcatgaaagagttatccgatgactccttcgagaacagcgataaaaccgcccgacagtcaaaaaaggaaatgaagaaaaaggacacagtcccttggtggatcacagaagacgattttaaagatgacgggctgttaggtaccaacgtgtcctaccttaagaccaagaaaaccagtcaaccagtcatggagatcgaggaagagagcgccgagaaaatccaatttctgaaaagcagcggcacgtcactgctgagtacagactctctggagaccaatgagctggtggtgtctgagctgaatcacagttcactgggtgtcgggttggatacactggaagagcaggaggaaaaggagcaattctttgcaagactggaaaaggggctgacttccagcatagactactctcgcctgaacaaggaattggacagcaacgattccacccatttcaaggcactccatagtaatcaggccaacgccgagctgactgacgacgagcacgaaaatgagtccaagcatgaagagctcgccgagaattattcagatgacttcgaggacgagtacgtgggggcacccttgaccacaaaggatgaagagatgccttcgaaggagaacagcaagagtgaaaaaatctcagtgccaaagcaggaagaagaaaaaacaggtatgctggctaacgtcgttttgctcgactcactagatagtgttgccgaggtgaatctcgatgaacaggataagattacgcctaaacccagatgcctacccgaaatgacggaaaatgaaatgacggggacaggagtatcttacggacaaagctcctctgacgtggaagccctgcatcaggcctactgtcacatcgcccattctctgggcgacgaagacaaacaaaagatcgaatccaacacggtggaggatatcaaatcgtcagtgaaaggacatccacaggaaaacgaagaaaattctaaaaacataagcactatggagtccgacctaccaacggtggaggagctcatgaaaccaatccgcatcgactccttcggaatctccgggtttgatctgcagcctgtcagtagcgaaaaggttgcagagcggaaagaaacagaatttttcagttctttgccccttaagatgaaccccaatattcttagtcaggattcacaacacgtcaatctgttttttgacaaaaacgacgagaacgtgatccttcaaaagacaacgaacgagtcaatggagaattcctgtccccaggtgacagaagttacggctaccgaggaacacgtggataagatgtatcttaatatcctgagaaagaaaatcactgtaaattctagcagtctgagccaggatgacaagataaacaagacatacaggagtcagctctcttccgaggaggaaggtgcagtgatgggcaagcaagtgccctacaagaaagcacgcagcgctcctccgctgctgaagaggaagccacagagcggactttatgcctccgtgaggagctctggatacggaaagccgagtagtccactgaaaatgttcagtacccttgaaaaaaagaccagcgaggatatcatcaagagcaaaaacctccggagcatctccacgagcaaccagccacgcaaaaaggaaatcctgtcaggcacaaagctgatcaaaccagctgccctcgataagcccgctcataagacagagtcttgtttaagcacccggaaaaagtctgagaatccaacagagacggactcctgcatccaatttcagaccgactctctgggctactgtggcgagaataaggaaaaaaagcttctgatgttcaaacgagtgcaagaggcagaagacaaatggaggggggcgcaggcactgatcgagcaaatcaaggctacgttcagcgagaaggagaaggagttggagaacaagctcgaagaactgaagaaacagcaggaaaaagagctgtttaagctaaatcaggacaattacatcctgcaggccaaactgtcatccttcgaggagacaaataagaaacagcggtggttgcactttggggaagctgcagatcccgtgacaggggaaaagctgaagcaaatacagaaagagatccaggagcaagagacacttctccagggataccagcaggaaaatgagcgcctttataatcaggtgaaagacctacaggagcaaaataagaagaacgaggagcgcatgttcaaagaaaatcaatccttattttccgaggttgccagtctaaaagaacagatgcacaagagtagattcttgtcccaggttgtggaggacagcgagcccacccgcaatcaaaacttcaccgacttgctggctgaactcaggatggctcagaaagagaaggacagtcttctggaagatataaagagacttaaacaggataagcaggcactagaagtggatttcgaaaagatgaagaaagagagagatcaggcaaaagaccagattgcctacgttacaggtgaaaaactgtacgagattaagattctcgaggagacgcacaagcaggaaatcagccggttacagaagcggctgcagtggtacgctgagaatcaggaattactggacaaagacgccctgcgattgagagaggccaatgaagagattgagaaactgaagctggagatagagaaactgaaggcggaatctggcaacccatccattcggcaaaagataaggttgaaggacaaggccgctgacgctaagaaaatccaggatctcgagcggcaggtgaaggagatggaagggatcttaaagcggagatatccgaactcactcccagctctgattttggccgcctcagcagccggggatactgttgataagaacactgtagaattcatggaaaagaggatcaaaaagctagaggctgatttggagggtaaggatgaggatgccaagaaaagtctgagaacaatggagcaacagttccaaaaaatgaaaatccagtacgaacagagactggagcagcaggagcagctgctggcttgcaagctaaaccagcatgattcacctagaattaaggcgctcgaaaaggaactcgacgatatcaaagaggctcaccaaatcaccgtgcgcaacctggaggcagaaatcgacgtactgaagcaccagaacgccgagctcgacgtgaaaaagaacgacaaggacgatgaggactttcagtctattgagtttcaggtcgagcaggcccacgccaaggcaaagcttgtgcggctgaacgaagagctggccgccaaaaaaagagaaatccaagatctgtcaaaaaccgtggaacgactacagaaggacaggcgcatgatgcttagtaaccaaaattcaaaaggacgagaggaaatgagcgcaaagagggccaagaaggatgtgctgcactcatctaaaggcaatgccaactccttccccgggacgctcgacagtaagttgtatcaacctcacacattcacagacagccatgtatctgaggttctacaggaaaattaccgcctcaaaaatgagcttgaaggccttatttcagagaaaaatgaacttaaaatgaagagcgaggccgttatgaatcagttcgagaattctatgcggcgagtgaaggaggacacagcggctcacattgcaagtctcaaggcatctcaccagcgcgagatcgaaaaactcctttgccagaatgctgtagaaaattcctctagtaaggtcgctgagctcaatcgcaagatagccacccaggaagtgctaattcgtcacttccagagccaagtcaacgaactgcaatccaagcaggagagtctcgtggtctctgaagtcagagaagagatccttcagaaggagattaccaagctgctggaagaactccgtgaagccaaagagaaccacacacccgagatgaagcatttcgtgggcctggaaaagaagattaagcagatggaaatgaggcacgcacagcgcgaacaagaactgcagcagatcatccaacagacacaccaggtggtggagaccgaacagaacaaggaagtggagaaatggaagcgactggcacaactcaagaaccgggagcttgaaaagttcaggaccgagttggatagcatactggatgtcctgcgcgaactacaccgccaaggggtggtggtaccagtggcatttgccgatgaaatgaacgcacctgaatattag

SEQ ID NO: 42899 - DNA, 2751 bp, Artificial Sequence
  Description of Artificial Sequence: Synthetic coding sequence
atggagaccagccaggagaccagcctgttcctggtgaagatcctggaagagttggactccaagcagaatacagtcagttaccaggacctatgcaagtccctgtgcgcccggttcgacctttcccagctggccaagcttcgttcagtcctcttttataccgcctgcctggacccaaatttccctgctaccctgttcaaagataaaatgaagtgtacggtcaataaccaacagtccaaaaaaatcatggtcgccgccgacatcgtgaccatctttaatcttatccaaatgaatggcggtgccgctaaggaaaagttgccgacaggacgccagaaagtacggaaaaaagaagcctcattcgaaagctgccggtccgataccgagatatgtaacgccgctgagtgtgaaccgctgaattgcgagctctccgagaggtcgttctctcgcggctatcccatcaggcagtctagcaaatgtaggaagatggactgcaaggactgtccccagtttgttccagcctccgagccgaatttcctcctgggcgtgagcaaggaagtgaaaaatagagcagcctcgctcgatcggctgcaagctctcgcaccctattccgtcacatcccctcagccatgcgaaatgcaacgcacatacttcccaatgaacatcgagaacgagagtatctctgatcaggacagcttgccaattaaccagtccatcaaagagacttttatatctaatgaggagcccttcgtcgtccagtcttgcgtgcaaaaaagaaacatctttaaagaggatttccataacctaatggcagtctccccgtccctggtgggccctatttccaaggcagagaacgagcacagagagccccagtcccggaaggaaccccacaagccccccttctttaatcacagcttcgagatgccatataactcccagtatttaaatcccgtgtactctccagtgccagacaaacgcagagctaaacatgagtcgctcgacgatctgcaagccagcacttattttggacccacgcccgtcatggggacgcaggaggctcgacgttgtctcggcaagccaaacaaacagacaccttggcccgcgaaaagctggagtttgaataccgaggaggtcccggatttcgaaaggagtttcttcaaccggaacccctccgaagagaaactgcactacccaaacgcaagctcccagacccccaactttccagccccagagagacggcccacctatctggtgcccaaggaccaacagccaatactgcccatcgcctacgccgctaagcagaatggcctgaaaagtaaggaaatttcttctccagtggatcttgaaaaacatgaacccgttaaaaagttcaaggataaatccattaattgcacgagtggacagctgagcagtgataccagcagcgttggaacccagactgaacatgtgcttgaacctaagaagtgtcgggacttatgtacctctggccaaggcaagtacagtgatcgacacactatgaagcactctgatgatgactctgagatagtaagcgacgacatctcagatattttccgatttttagacgatatgtcaattagtggatctactggggtgatccagagctcctgctataactcaacaggatctcttagccagctgcacaaaagtgactgcgacagttctcctgaacataacctcaccaagatcgccaacggggtcccaaattctaagggtgacaaagggaacagacccgagaacacccaccattctgaagaagagcttaagacgtccgtctgcaaactggtcctgcggattggtgaaatagagcgaaaactggagagtctctccggagtaagagacgagatctcccaagtgctggggaaattaaataagctggatcagaagatgcagcagccggaaaaagtcagcgtgcaaatcgacctgaacagtctcacgtctgagggccctagtgatgacagcgctagtccgagaatgttccacgcgcactctggcagtcacgggcccaagcttgagaataaccccgactggtgctgttctgacgcgtctggaagcaactctgagagcctgagggtgaaagccttaaagaaatctctgttcactcggcccagcagtcgatccttgacagaagaaaatagcgccaccgagtcaaagatcgcctcgatttccaattccccacgcgattggagaactatcacatatacaaatcgggtgggcctgaatgaagaggaaataaaggacactggaccaggtgataataaggactggcacagaaagtccaaagaagccgaccgccagtacgatattccccctcagcacagattacctaaacagcccaaggacgggtttctcgtcgaacaggttttcagccctcacccatacccagcctccctcaaagcacatatgaagtccaaccccttatataccgacatgaggctgactgagcttgccgaggttaagagaggacagccctcttggaccatcgaggagtacgcccgaaacgctggcgacaaaggaaagctgacagccctggatctgcagacacaggagtcgctgaacccaaataatttggagtactggatggaagatatttacacacctgggtacgactccctcctcaagaggaaggaggctgagttccgccgggctaaggtttgcaagattgcggctctgatcgccgctgcagcttgcacagtgattctggtgattgtggtgccgatttgtaccatgaaatcctag

SEQ ID NO: 42900 - DNA, 6534 bp, Artificial Sequence
  Description of Artificial Sequence: Synthetic coding sequence
atggaggagatcctgcggaagctgcagaaggaggccagcggcagcaaatataaggcgatcaaggaatcatgcacatgggctctggagacacttgggggactagatacaatcgtcaaaattccgccccatgtgctgagagagaaatgcctccttcctctgcagctcgcattggagtcaaagaatgtcaaactagcccagcacgcactggccgggatgcagaagcttttgtcagaggaaagattcgtaagtatggagacagattctgacgaaaagcaactccttaaccaaatattgaatgccgtgaaggtaactccttctctgaacgaggacctgcaggtcgaagttatgaaggtgctgctctgcatcacctacacccccacttttgatttgaacgggagcgctgtgctcaaaattgctgaggtatgtattgagacctatatctcgtcctgccaccagagaagcatcaacaccgccgttcgtgctacgctgtctcaaatgctttctgacttaacactgcaactccgccagcgacaggagaacacaattattgagaatccagacgtgcctcaggacttcggcaatcagggatctactgtcgagagcctgtgcgacgacgttgtgagcgtattgaccgttctgtgcgaaaaactgcaagcggctattaacgactcacagcagcttcagttgctgtatttggagtgtattctgagcgtcctgagttccagttcgagctctatgcacttgcaccggaggttcaccgacctgatctggaagaatctgtgtcctgcgcttatcgttattctgggcaacccgattcatgataaaactattacatccgcacatacatcgtccacctctaccagcctcgaatcagatagcgctagccctggcgtaagtgaccacggacggggatctggctgcagctgcacagcgcctgccttgagcggcccggtcgcaaggacgatatactatattgctgccgaactcgtacggctcgtgggaagtgtcgattcgatgaagcccgtgctccaaagtctgtaccacagagttcttctctaccctcctccgcagcaccgtgtggaggccataaaaatcatgaaggaaatcctggggagcccccagcgactatgtgatctggccggcccaagcagcactgagagcgagtccagaaagagatctatcagtaaaagaaagagccacctcgacctgttaaagttgatcatggatggcatgaccgaggcctgcatcaaaggcggaattgaagcctgttacgctgctgtatcttgtgtatgtacactgttgggagccctggacgagctgagccagggcaagggtttgagtgaagggcaggtccagctgctgctgcttcggctcgaggaactaaaggacggcgccgaatggagccgtgactcaatggagatcaatgaggccgattttcgatggcagcgcagggtgctgtcctcagaacacacgccttgggagtccgggaacgagcgctccctcgatatcagcatctccgtgaccacagacaccggccagaccacccttgaaggcgagctgggacaaacaacccctgaggatcactccggaaaccacaaaaatagtttaaagtcccctgctattccggaaggcaaggaaaccctgtctaaggttctggaaaccgaagccgtcgatcagccggacgtggtgcagagatcccacaccgtcccataccctgacattactaatttcttgagcgtggattgtcggacgaggagctatggaagtcgatactccgagagtaatttcagtgttgatgatcaggatctgagccgcaccgaattcgatagttgtgaccaatattctatggcagccgagaaagactctggcaggtctgacgtttcagatattgggagtgataactgtagtttggctgacgaggaacagactccaagggattgtctcggacaccgcagcctccggaccgcagccttgtctctgaagcttttaaagaaccaggaggccgaccagcactcagcaaggctgtttatacaaagtttagagggcctgcttccgagactgttgagcttatctaacgtggaggaagtggacactgctttgcagaattttgcttctaccttttgcagtgggatgatgcattccccaggatttgatgggaacagttccctctcctttcagatgctgatgaacgctgattcgctgtacacagccgctcattgtgctcttttgctgaacttgaagttgtctcatggagattactataggaagaggcctacgctcgcgcccggcgtcatgaaagattttatgaaacaggtgcagacgagcggggtcctgatggtgttttcccaggcctggatcgaggaactgtaccatcaggtgttggatcgtaacatgcttggcgaggctggctactgggggtctcctgaagacaactcgcttccattaataactatgctgaccgacatcgacggcctggaatcatcagccatagggggccagcttatggccagtgccgccaccgagagtcccttcgcacagtcacggaggatcgatgatagtacagtcgcaggagtggcttttgcccgctatatcctagttggctgctggaagaacctcatcgatacacttagtaccccactcacaggtcgcatggccgggtcaagcaagggcctggccttcatcctgggagccgaggggatcaaggaacaaaaccagaaggagcgtgacgccatttgcatgagtctcgatggactccggaaggctgccaggctgagttgtgccctgggagttgctgctaattgcgcttccgccctggcgcagatggccgctgcctcatgtgtgcaggaggagaaagaggaaagggaagcacaagagcccagtgacgcaatcacccaagtcaaactgaaggtggaacagaaactcgaacagatcggaaaagtgcagggcgtgtggttgcatacagcacacgttctgtgcatggaagcaatcctgtcagtcgggcttgagatggggtcccacaatccagattgttggccccatgtgtttcgtgtttgcgaatatgtaggtaccctggagcataatcacttctctgacggcgcgagccagcctccactgactattagccagccccagaaagccaccggatcagcagggttgttgggcgacccagagtgcgaaggcagcccgccagagcactcacctgaacaggggcgcagcctcagcacagccccagttgtgcagccacttagtattcaggacctggtgagagagggtagccggggccgcgcctctgacttcagaggcggcagcttgatgtccgggtcaagtgctgccaaggtggtgcttactctgtccacccaggccgatcgcctgtttgaggacgccacggacaagcttaaccttatggccctcgggggattcctgtatcagctcaaaaaagcatctcaaagccaattgtttcacagtgttacagataccgtggactacagtctggcaatgccaggagaggtgaagtccacccaggatagaaaatcggcacttcacctttttaggcttggaaatgcaatgctgagaatcgtgaggtccaaggcccgcccgctgctgcatgtgatgcgatgttggagtctcgttgcacctcatctggtagaggccgcctgtcataaagagagacacgtctcccagaaggcagtgagctttatccacgacatcttgacagaagtcctgaccgattggaacgagccaccccatttccatttcaacgaggccctttttcgcccattcgagagaatcatgcagctggaactgtgcgacgaagacgttcaagatcaagtagtgaccagcattggtgagcttgtggaagtctgctcgacccagattcagtccggatggcggccactcttttccgccctagaaacggtacatggggggaataagtccgagatgaaggagtacctcgtgggtgactacagtatggggaaaggacaagcccctgtattcgatgtgtttgaggccttcctgaatacagacaatatccaggtgttcgccaatgccgccacctcatatatcatgtgcttaatgaaattcgtgaagggactgggagaggtcgactgcaaagagatcggagactgcgcccctgctcccggcgccccttcaaccgatctttgtttgcccgcactggattaccttcggcgatgtagtcaacttctggccaagatttacaaaatgccgctcaaacctatcttcctgtccgggcgtctcgccgggctgccccgccggcttcaagagcagtctgcttcttccgaagacggaattgagtctgtcctgagcgacttcgacgatgacacaggactgatcgaagtgtggattattctgttggagcaactcacagccgctgtctccaattgtccaaggcaacatcagccaccaacactcgatctgctgttcgaactgctgcgcgacgtcactaagaccccagggcccggcttcggaatatacgccgtcgtccacttgctcctacccgtcatgtctgtgtggctgagaaggtctcacaaggaccactcttactgggacatggcctcggccaatttcaagcacgctatcggcttgagctgcgagcttgtggtggaacacatccagtccttcctccatagtgacatccgctatgagtccatgatcaatacgatgctgaaagatctatttgaacttctggtggcttgtgtcgcgaaacccaccgagactatttcacgagtgggctgcagctgtattcgatacgtcctggttacagccggcccagtgtttaccgaggagatgtggcgcttggcctgctgcgcccttcaggatgcgttctccgccacactgaagccagtcaaggacctgctggggtgctttcacagtggtacagagtcattttctggggaaggctgccaggtccgggtggcagcacctagtagtagcccaagcgccgaggccgaatactggcgtatcagagcaatggcccaacaggtttttatgctagatacccagtgcagccccaagacgcccaataattttgatcatgcacagtcttgtcagctgatcattgaactccctccagatgaaaagcccaacggtcatactaaaaaatccgtttcatttcgcgagatcgttgtctctttgctgagccatcaggtgctgctccagaatctgtacgacatcctgctggaggagtttgtgaaaggtccctccccgggcgaagagaagaccatccaagtccctgaagcaaaacttgcgggtttcctgcggtacatatccatgcagaatctggccgtgatctttgacctgctgctcgattcctatagaaccgctagggagtttgatacctcgcccgggttaaagtgcctactgaagaaggtgtcaggcatcgggggagctgctaatctttaccgacaaagcgccatgagctttaacatttactttcatgctctcgtgtgcgcagttctgactaaccaggagacgatcaccgctgaacaggtaaaaaaggtcctcttcgaggacgacgagcgttctactgactccagccagcagtgcagcagtgaggacgaggatatcttcgaagaaaccgcccaagtctcccctccccggggcaaagaaaagcggcagtggagagccagaatgccactgctctcggtgcagcctgtctcaaacgctgactgggtatggttggtgaaaaggctgcacaagctgtgcatggagctctgtaacaattacatccagatgcatctggatctcgaaaactgtatggaagagccccctattttcaaaggcgacccctttttcatcttaccctcctttcagtctgaaagctccactccttccacaggtgggttctccggaaaggaaacaccgagtgaagatgaccgaagccagtcacgggaacacatgggcgagtccctttccctcaaagccgggggcggtgatctcctgctgccaccaagcccgaaagtcgagaagaaagacccttctaggaaaaaggagtggtgggagaacgccgggaataagatctacacaatggccgccgataagaccatttccaagttgatgaccgaatacaagaagagaaaacaacagcacaatctcagcgcttttccaaaagaagtgaaggtggagaagaagggcgaaccccttgggcctcggggtcaagactctcctctgctgcagcgaccccagcatcttatggatcaaggacagatgaggcattccttttcagctggccctgaattgctgcggcaggataagagacctcgcagtggcagtaccggatcctccctcagtgtgtctgtaagagatgccgaggctcagatccaggcctggaccaacatggtactgacagtgttgaaccagatccaaatactccccgaccaaaccttcactgcactccagcccgcagtctttccctgtatctcccagctgacttgccacgtcaccgacatccgggtcaggcaagcagtccgcgagtggcttggtcgcgtgggcagagtgtacgatatcatcgtctag

SEQ ID NO: 42901 - DNA, 3042 bp, Artificial Sequence
  Description of Artificial Sequence: Synthetic coding sequence
atggccgagcccggccacagccaccacctgagcgcccgggtgcggggaagaaccgaacggcgcataccgagactgtggagattgctgttgtgggccggtaccgccttccaggttactcagggcacagggcccgagctgcacgcatgtaaagaatctgaatatcactacgaatacaccgcttgtgacagtacaggatccagatggcgcgtagccgtgccacacaccccaggtctgtgtacctcactgccagaccccattaaaggaactgaatgctcatttagctgtaacgcgggtgaattcctggacatgaaagatcagtcatgtaagccctgcgccgaagggcggtattctctgggaactggtatccgtttcgacgagtgggacgagttaccgcacggcttcgcatccttgagcgcgaacatggagctcgatgactccgcggctgagtcaacagggaattgtactagttctaagtgggtccctcgtggggactatatcgcatccaacacagacgagtgcaccgctaccctaatgtacgctgttaatttgaaacaaagcggaacagtgaactttgaatactactaccccgactcatccataatcttcgagttctttgtgcagaacgaccaatgtcagccaaacgctgacgactccagatggatgaagacaaccgaaaagggatgggaattccacagcgtagagctaaatagagggaacaacgtgctatattggcggacaacagcatttagtgtctggactaaggtgcccaagcccgtactcgtgcggaacattgccattactggagtagcatatacaagcgagtgttttccctgtaaacccggcacatatgccgataaacagggtagcagcttttgtaaactgtgcccggccaactcctactcgaataaaggtgagacctcctgccaccagtgtgatcccgacaagtactccgagaagggaagcagctcttgtaatgtgcgacccgcatgtacggataaagactacttttacacccatacagcctgtgatgctaacggtgagacccaattaatgtacaagtgggccaagcccaaaatctgtagcgaggacttagagggggcagtgaagctgccagcaagcggggtcaaaacacactgtcctccctgtaaccctggatttttcaagaccaataattccacctgtcaaccctgtccttatgggagttactctaatgggtctgactgtacccggtgtcccgcgggtacagagcctgcagtaggttttgaatataagtggtggaataccttacccaccaacatggagacaactgtcctgtccggcatcaactttgagtacaagggaatgacaggctgggaggttgcgggagaccatatatacaccgccgccggagcaagtgataatgacttcatgatcctgacgcttgtggtacctggcttccgccctccccagagtgttatggctgataccgagaataaagaagtggcaaggattacgtttgtctttgaaacgctctgcagcgtaaactgcgaactgtattttatggttggggtgaatagtcgcaccaataccccagttgaaacctggaagggatcaaaaggcaagcagagctatacctatatcatagaggaaaatactaccacctcctttacgtgggctttccaaaggacgacattccacgaagcatcaaggaaatacaccaacgacgtcgccaagatttactccattaacgtcaccaacgtcatgaatggtgtggcctcttactgccgcccttgtgcgttagaggcttctgatgtgggcagttcatgtactagctgccccgctggctactatatcgacagagactccggcacatgccatagttgtcccaccaacaccattctaaaggcgcatcagccatatggggtgcaagcgtgcgtgccctgtgggcctggaactaagaacaataagatccattcgctttgctacaacgattgtacctttagtcggaatacccccactcgaactttcaactataacttttccgccctggccaacacagtcacactagcgggaggacctagttttaccagcaaaggcctgaaatactttcaccatttcactctgagcctgtgcggtaatcaggggaggaagatgagcgtgtgtacggataatgtcactgacctgcgcatacccgaaggcgagtccggctttagcaaaagcatcactgcgtacgtatgccaggcagttattatcccgcccgaggtgacagggtataaagccggcgtcagctcacagccagtgtccctggccgaccggctgatcggcgttacaaccgatatgactctggacggcataaccagtcccgccgaactgtttcaccttgaatcactggggatccccgacgtgatttttttctatagaagtaatgacgtgacacaaagctgttctagcggacggagcactactatacgagtaagatgtagcccacagaagaccgtgccgggcagtctccttttgccggggacttgttccgatggcacctgtgacgggtgtaattttcactttctttgggaatctgccgccgcctgccccttatgctcagtggcagactatcacgccattgtcagcagctgtgtcgctggcatccaaaaaacaacatatgtctggagagagcccaaactttgttccggcggcattagtctacccgagcagagggtcaccatatgtaagacaatcgatttctggctcaaagttggaattagtgcaggaacttgtacagcgatcttgcttaccgttctgacctgctacttttggaaaaagaaccagaaactggagtacaaatattcaaaactggtcatgaacgctacccttaaagattgtgatctacctgcagcagattcatgtgccattatggagggagaagacgtggaggacgacctgatctttacgtcgaagaagagcttgtttggcaaaattaagtcctttacatcaaagaggacccccgacggcttcgacagcgtgcctcttaagaccagctccgggggtctggatatggatttgtag

SEQ ID NO: 42902 - DNA, 1869 bp, Artificial Sequence
  Description of Artificial Sequence: Synthetic coding sequence
atggccaccgtgctgagccgggccctgaagctgcccggcaagaagtctccggacctgggcgaatacgatcccctgacgcaggccgacagcgatgaaagcgaagacgatctggtcctgaaccttcagaaaaacgggggagtgaagaatggaaaatccccactgggcgaggccccggagccagattctgacgccgaagtggctgaagctgctaagcctcatctgtctgaggtaacaacagaagggtatccctccgaacccctgggagggctcgaacagaaggctgcttcatcgctggtcagctatgtgagaactagcgtgtttctgttaactttaggcatatctatgattctcgtcctgctctgtgcattcctgattccttgccccccgagggatctacactccacttggagtagacacttgggtagtcaaggaggaggagacctgagtccactagaactcgcagatgtgaacggcgacggtctgagagatgtgctgcttagcttcgtgatgtcccgcaacgggagcgcagtgggagtcagtcgccctgctgccaatctcgtgtgcctctcaggcatgaatggatcaaccctctggagctctcttctaccagaggaggcccgtgacattacatgccttgaactaatgcccgggtctctggcagagaccatttgtttggtgactggaacccataaaatgttgtcagccttcaacgctacctcagggaaagccatctggaccctgaacccaaattacctgagcaatgggaccctggccgctccggtggtggtcttgcctgacttagatgaagatggggtgcgagacttggtagtgctggctatcggcgaactccagccggacttgtgcttcctgttggtgtcagggagaacgggaaaccccgtaggtaggcctgtgaaatacaatattgtgggtgtgggaaatctaatcggcccacaggtgtatataaccaccaacggcgctgtttatattctcttcgggtttgggaatattcaggcagtcgccctgagggacatttttgtgcaggcacagaacagagattcgtcgcctcccagcttacagattgaagagccagaatgggaaaaaagacgaagcataaacctgtccgaactcatcgatgtgtacagcgacggagtggagctcctgcagatggtcaaggctcccgactcgaattgctctaatctgctgatcaccactcggcagtcccttgtcctactaaggggccagaacctcacaccctattgggccttgcgcctgcagggcctgagatcccagccaactccaggttacttcactgatgaccaaactctcgacttccttctgcagatccaggatggagttggcatgaagaaaatgatggtcgtggatggtgactccggcagtatcgtgtggagttatcgggctccctgtcacatgaaagaaacaccagctaccagtgcagtcacatccgaccagaaatccgtatttttgttttgggccgaaggactctccgctgctagcccaaacagtgacatcatcttaggcaccgagccgccttcccttcatcacctgtatttgttgcaccctgctttcccttcaattctcctggacctcgcaaacacaacagggacggtcacggcctcggaagttggaattaatgatctgtggaaagacgctttctatgtcaccagaactaccggtccctcctctgaaggccacccggccgcacttgtagtgtccaaactgtctctaagatgggctctgatggaagggcagatggcacagctccaagagagcacccctaaaataggtcggggggagctcagaaggttcctctcaagaattaagtttgtggaggcaccatacgagatttag

SEQ ID NO: 42903 - DNA, 1869 bp, Artificial Sequence
  Description of Artificial Sequence: Synthetic coding sequence
atggccaccgtgctgagccgggccctgaagctgcccggcaagaagagccccgatctgggcgagtacgaccctctgacacaggcagattcggacgaatcagaggatgacctcgtgttgaacctgcagaagaatggcggcgtgaagaacggcaaaagccctctgggggaggcacctgaacccgactctgatgccgaggtcgctgaggctgccaagccccacctttccgaggtgacaaccgagggatatccctccgagcccctgggcggacttgagcaaaaagcagcaagctccctggtgtcttacgtgcggacttctgtttttctcctgacactggggatttcgatgattctggtactcctatgtgcttttctgataccatgcccccctcgggacctgcatagcacgtggtctagacatctaggatcccagggggggggagacctttccccattggagctggctgacgtgaacggcgatggactgagagacgtcttgttgtctttcgtcatgagccggaatggttctgcagtgggtgtgagtcgcccagctgcaaacttggtctgcttatccggaatgaatggctccacactctggagctccctgcttcccgaagaggcacgcgatatcacgtgtctggaactaatgccagggagcctcgctgaaactatctgtctcgtcactgggactcataaaatgctcagcgctttcaatgcaacctctgggaaagctatctggaccctaaatccaaactacctgagcaatggaaccttggccgcaccagtggttgtgctgcctgacctggacgaagatggggtgcgggacttagtggtgttggctataggggaacttcagcccgatctgtgctttcttctcgtgagtggccggaccgggaacccggtgggacggcccgtgaagtataacattgttggagtcggtaacttaatcggaccccaggtgtacattactactaacggagctgtttacatcttgtttggattcggtaatatacaggccgttgccctcagagacatattcgtccaagcgcaaaacagagacagttcccctccctcactgcaaatagaagaacccgagtgggaaaaaagacgatctattaatctgagtgagctgatagacgtttattcagacggtgtagaattgcttcagatggtgaaggctcctgacagtaattgctctaacctactcatcaccacacggcagtcccttgttcttttgcggggtcagaatctaaccccgtactgggcccttcgtctccagggcctcaggtcacagcccactcctggatattttacggacgaccagacgctcgattttctgttgcaaatccaggatggggtgggaatgaagaagatgatggtggtggacggtgatagcggcagtattgtgtggtcatacagggctccatgtcacatgaaggaaacacctgcgacgagtgccgttacaagtgatcagaagtcggttttcttgttttgggccgagggcctctcagcggctagccccaattccgacatcatcctgggaaccgaacccccttctctccaccatttgtatttgctgcatccggcttttccgtccatcctgcttgacctggctaacactaccggcacggtgacagcgtcagaagtgggcatcaacgacctttggaaggatgcattctatgttactaggacaacaggtccatcctcagagggacaccccgccgccctcgttgtgagcaaattgtcccttcggtgggctctgatggaaggacaaatggcccaactccaagagagtacccctaaaattgggagaggagaacttcgccgcttcctgagcagaattaagtttgtcgaggccccctatgaaatttag

SEQ ID NO: 42904 - DNA, 600 bp, Artificial Sequence
  Description of Artificial Sequence: Synthetic coding sequence
atgaccagctgcggccagcagagcctgaacgtgctggccgtgctgttcagcctgcttttctcggctgtgctcagtgcacatttcagggtttgtgaaccatacacagatcataagggccggtatcactttggatttcactgcccacggctgtccgacaacaagacattcattctctgctgccatcataacaataccgtattcaagtattgctgcaatgagacagaatttcaagccgtgatgcaggcaaatctgacagccagcagtgaagggtatatgcataataactatacggccttactgggcgtctggatctatggctttttcgtgctcatgttgcttgtgctggacctgctgtactatagtgcaatgaactacgatatctgcaaggtgtacctggccagatggggtattcagggccgctggatgaaacaggatcctcggaggtgggggaatcccgcaagggctcccagaccaggacagagagcaccccagccccagccaccgccagggcccctgcctcaggccccacaggccgtgcataccctaaggggcgacgcccactcacctccacttatgacttttcagagctcgtcagcgtag

SEQ ID NO: 42905 - DNA, 3543 bp, Artificial Sequence
  Description of Artificial Sequence: Synthetic coding sequence
atgaccctgcagggccgggccgacctgagcggcaaccagggcaacgccgctggccgccttgctacagtccacgagcccgttgtaacacagtgggccgtgcatcccccggcacccgcccaccccagtctcctggacaagatggaaaaggcacccccccaaccgcagcacgaaggcttaaaaagcaaggagcacctgccgcagcagcctgccgagggtaaaactgccagccggcgtgtcccgcggctccgcgccgtggtcgagtctcaggcttttaagaatatcctcgtggacgagatggatatgatgcacgcccgtgccgccactctgatccaggcaaattggcggggctactggttgagacagaaattgatctcgcagatgatggcagccaaagctatccaggaggcttggcggagattcaacaaacggcacattctacactcatccaagtctctagtaaagaagactagggcagaggagggggacattccatatcatgctcctcagcaggtccggttccagcatccagaagagaacagactcctgtccccgcccattatggtgaataaagaaacccagttcccatcctgcgacaacctggtcctgtgcaggccacagagctcacccttactgcaaccacctgccgcccagggcactccagagccctgtgttcaggggcctcatgctgcccgggtgagagggctggcgttccttccacaccaaaccgtgactataagattcccctgcccagtcagcctagacgccaagtgccaaccctgtttactcacacggaccattcgatctacatgccttgtacacatagaaggcgactccgttaagaccaaaagagtcagcgcacggacaaataaggcccgggcaccggaaacacccctgtcacgtcgctatgaccaggccgtcactagaccatcacgcgctcagacccaagggcctgtcaaggctgagactcctaaggcaccctttcagatctgccccggcccaatgattaccaagaccttgctgcagacatatcctgtggtgagcgtcacgctcccccagacataccccgcctcaaccatgaccactacacctccaaaaacgtctccggtccccaaggtgactatcattaaaacacccgctcagatgtaccctgggcctaccgtaactaaaactgcgccacacacctgccccatgccgacaatgacaaagattcaagtacaccccactgctagtcggacaggtaccccacgtcaaacgtgtcccgcaacaatcacggctaagaatagaccacaagtctctctcctggctagcattatgaaatcccttccccaggtgtgtcccggaccagctatggctaagacccctccgcagatgcatcccgtgacaacgcccgctaaaaaccccttacaaacgtgcctcagtgctacgatgagtaaaacatcttctcagaggtcaccagtgggtgtaaccaagccatccccccagaccagactcccggcaatgattaccaagacaccagctcagctacggtctgtcgctacaattctaaagaccctgtgcctcgcatcgccaactgttgctaacgtgaaagcacccccccaggttgccgtggctgctggaactcccaacacttccgggagtattcacgagaatccacctaaggccaaagccaccgttaacgtgaagcaggcagcaaaggtcgtgaaagccagcagtccatcttaccttgccgagggtaagatccggtgcctcgctcaaccacacccagggaccggcgtgccccgcgctgcagctgagttgcctctggaagccgagaagattaagacagggactcagaaacaagccaagaccgatatggctttcaaaacgtctgtggcagtggagatggccggcgcaccctcctggacgaaagtggcagaagaaggcgacaagccacctcacgtgtatgttccggtggacatggcagtgacactgcctcgtgggcaattggctgctcctttgaccaacgcttcgtcacagcgacacccgccatgcttgtcacagaggcccctggccgcccctcttactaaggcctcatcccaggggcacctgccaacggagttaactaaaaccccctccctggcacacctagacacatgcctttcaaagatgcatagtcagacccacctggcgacgggtgccgtcaaagtccagagccaagcgcctctcgccacttgtctgacaaaaacacagagccgcgggcagcccataaccgacatcaccacctgtctcattcctgctcaccaagctgccgatctcagttctaacacccacagtcaggtcctactcactggaagtaaggtcagcaatcacgcttgccaacgactaggtggccttagcgctcctccgtgggctaagcctgaggatagacaaacgcagcctcagcctcatgggcacgtccccgggaagacaacacaaggcgggccttgcccagcagcctgtgaggtgcaaggcatgctggtgcctcccatggctcctaccggccacagtacttgcaatgtcgagtcatggggggacaatggggccacccgggcccagccaagtatgccagggcaggccgtgccctgccaagaagacactggcccagctgacgcgggggttgtcggtgggcagagctggaatcgtgcctgggagcctgcccggggggcggcttcctgggatacgtggcgcaacaaggccgtggtgcctccaaggagatccggagaacccatggtctctatgcaggccgcagaagagatccgcatcctggccgttattactatccaggctggcgtgcgaggttatcttgcccgcagacggatcaggctctggcacagaggcgcaatggttatacaagctacttggcggggctaccgggtgagacggaacctggcgcacctgtgccgggccacaacaaccatacaatccgcgtggcgaggatactctactcggcgagatcaggcgcgacattggcagatgttgcaccctgtgacttgggtagaacttggtagtcgtgccggagtcatgtctgatcgctcctggtttcaggatgggcgagcgagaactgtatccgaccatcgatgttttcagtcctgccaggcccacgcgtgcagtgtctgtcattcattatccagcagaatcggctcaccaccctcagttgtgatgctggtaggatcttcaccaagaacctgccatacctgcggccgcacccagcccacaagggttgtccagggcatgggacagggcacggaaggccctggcgctgtaagttgggccagcgcctatcagctagcagcactcagcccgcgccagccccatcgccaggacaaggccgcgacagccatacaatcagcatggcgcggattcaagattcggcagcagatgcggcagcagcagatggctgcaaagatcgtgcaagcaacatggagaggccatcacacgaggagttgtttgaagaatactgaagctttattgggtcctgctgatccgagtgcctcatctcggcatatgcattggccgggaatctag

SEQ ID NO: 42906 - DNA, 5406 bp, Artificial Sequence
  Description of Artificial Sequence: Synthetic coding sequence
atgagcgacgacatccggaagcggttcgagttccccaacagcctgatccagtcgcaggcggtgggccacttaattgcggccgtgttgaaggaaaacggattttctgagaagatccatcagtccacaaaccaaacacctgcgttaaacctgctctgggagaaatgctgtagcgacaacgtcgtggtccggacagcctgctgcgaagggctcgttgcactcgtagcccaggatcatgctgagttttcatatgtgctgaatggtatactgaatctaatcccaagtacacgtaacacccacgggctgattaaagcgattatgcacttgttacaaatgcaggcactgaaagaaggacagggaggcgagaaaaacatacagagtatatatactatcaggaaccaccctcatccacttataaccgtcctcgagcacaggccagactgttggcctgtgtttcttcagcagctgaccgcattttttcaacagtgtccagagaggctggaagtctcctgcatccagatcatggcgccatttctttggtacttgtactgtgaaccctcgcaactacaggagtatgccaaattaaggctcgccctactcaaagtgctcctacagccacaggttttatgcgataaggaccagccatctatcttggagcagcagatcctgcaattgtgctgcgacatagtgccttgtctccaagtgaaagatctgatccaaacaactgaagccatgatgtttatcgaagaggtgtgtctgtctctcctgcggcatccggtgttctggaaaatccagctgacccagatgtctctgcaactgctttgcgtgtctgaggtttcactgaagattaccggcgagtgctccagtagtatccaccttctcgagcatagcgttgagcttttgaaggaagatttccctgttgaacttgttatcataggaatagccctcctcctgctgcaaactccagcttctcagcagaagcccattcttaacctggcactcaaactgctaagcgtgaccgaggatcagaaaatacctaaaagtagccttctgctcgtcatgcctatcttgcagatcttgtcctccacagcattggaagattgcattagcgtggacgaagaaggtccctctcgccagcagttagcactcaatctgctggagatgatccagcaggaatgttaccgcgacgatcatcagaagctgtcatataagctggtctgtcccgtgacatcaatgtacggcaccatttttacggcctggcgtatcctggaagtgatgaccgacagttcggcagcttctgattggctagcctccgtcgagtccctcctgcccattaccgccgtgattcctgctcctgcatttttgctcctggcccacctgctggtcgaggataaagggcagaatctgcatcagatccttaaggtgaccacagaactcgctcaagccgattcctctcaggtccccaacctgatcccagtcctgatgttcaaactcggccggcctctggagcctatcctctacaacgacatcctgtacaccctaccgaagctgggcgtccacaaagtttgcatcggtcaaatcctaaggataattcagctcctggggaccactcctaggttgagggccgtgacactgcgcctgttgacctcattgtgggaaaagcaggatcgtgtgtaccctgagctacagagatttatggcagtttccgacgtgccaagccttagcgttggtaaggaggtgcaatgggagaagctgatcgcaaaagctgcgagcatcagggacatctgtaaacagcgcccctaccagcacggggcagatatgctcgctgcaatttcacaggtgctcaacgagtgtaccaaaccagatcaggccacccctgctgccctcgtcctgcaggggctacacgcactgtgtcaggcggaggtggtctgtatcaggagcacgtggaacgcactgtcccccaagctgtcttgcgacaccaggccccttattctgaagacactctcagaattgttttcattggtgccttccctgaccgttaataccactgagtacgagaattttaaggtccaagtgctgtccttcctctggacccatacgcaaaacaaggaccccattgtcgcgaatgctgcttaccgctcgttggcaaatttcaccgccggagaacatacaatcttacacttgccagagaagatcagacccgaaatcccgatcccagaggaacttgacgatgacgaagatgtggaggacgtggacctaagtgtccctggatcgtgttaccttaagctgctgagtcttacaccacctctggtacttcctgccctagaagagttctttacatcactggtgaaacaggagatggtgaacatgccacggggaatctaccacagcgccttaaagggtggggcaaggtccgaccaaggcaagacagtggccggcattcccaactttattctgaagatgtatgaaaccaataagcagccggggctgaagccaggactggccggaggcatgctgttttgctatgacgtcagcatgtatcagtcaaaggatggtaagccactgaacagactcatggcgtctagaggaaggtctttcaagcaaacgtccttagccctcgtgcatgaagtccatatccaattgtccgagtggcatagagccattttcttgccccaggcttggctggcctatatgaatagggcctaccacgcaatattgcaggggagactcggggaactggagctgcagctcaagcacggcaaggaagagcctgaagaggtacagtacaagaagtcaaccgcatggctgtgggtccgggatatgctgactgatgaaattaccaaagccgccgccaaggagtcgcccgttgtgaaagggaacgcactgctggcgctgtcctccctggctgtggtggttagccgccacgaagccagtctgtcctctgactcggacggattacttgaggtgcagccaaacttcctctctatgaaggaatgggtgagcatggtgttggacaccctgttagttattgttgattctcattaccagccccggggacagttactaagctggttctactataagtcctattccggcgagaatacggcttctgctatcgccagaagcgcagccgctactgcgttatctctgttggttcctgtgtttatcatctcctgtaaagaaaaagtggaagagatcctgaatatgctgacagcacgactgcccggcaaaccatcagcggacgagtcccaggctgtccaaatccatatgggactggctctgggtatgttcctgtctaggttatgtgaggagaagctgagcgacatttcaggtcaggaaatgaacctgctactgatgaagtccctggacgctctcgaaaactgttgcttcgatacatctctggagtacaacactggttgtattctcggtgtgggactggttctgtcgctgatgtctcacagctcacagatgcagagccgggtgcacgttgcggccctactgagaaagctgagtgcccacgtggacgactccggatcccagtcccgcaccttccaggaagtcctcgcttatactcttagttgcgtgtgtacatctgccttcagcgctggcatcatcgaagcaactgaagctgaggatgtgatgaataagttgagattactcgtcgagaattcacaacaaacatccggtttcgcgctcgccctgggcaatattgttcatggactgtccgtgtgtgggcacggaaaagccgaggacttgggcagtaagctcctgcctgcttggattcggatcgtgttgacagaggggacccctaccatgctgtgcctggcagcactgcacggcatggttgcgctcgtgggcagcgagggggatgtgatgcagctgaaaagtgaggctatacaaacgtctcacttccaggggagattgaatgaggtgattaggactctcactcaggtcataagcgtaagtggggtgatcggtttacaatcaaacgccgtatggctgctgggccacctgcatctcagcacgctaagctccagtcagtcacgagcctcggtgcccaccgattatagttatttaccagaaagtagcttcatcggtgcagctatcggtttctttattacgggcggcaaaaagggcccagaatctgtaccaccaagcttacttaaagtggtcatgaaaccaatagctactgtgggggagagctatcagtatccccccgtgaactgggcagccttgttgtccccactgatgaggctcaattttggggaggaaatccagcagctgtgcctggagattatggtcactcaggcccagtccagtcaaaacgctgccgctctgctgggactctgggtaacacctcccctgatacattccctgtccctgaacaccaagcgatatctcctgatatctgccccgctgtggattaaacacatcagtgatgagcaaattctcggctttgtagagaacctgatggttgcggttttcaaggccgcttcacctctcggctccccagagctgtgtccctccgctctccacggcctaagccaagctatgaagctcccctccccagcacatcatttgtggagcctactgtcagaggcaactggaaaaattttcgacctacttccaaataagatccgtcggaaggaccttgagttgtacatctccatagctaaatgcctgctcgaaatgactgatgacgacgcgaatagaatcgcccaggtcacgaaatccaacatcgagaaagccgcttttgtcaagttatacctggtttcacagggtaggtttcctcttgtgaatcttaccgacatgctttccgtcgcggtccaacaccgggaaaaagaggtgctcgcctggatgatcctgcatagtctgtatcaggcccgcattgtaagccacgccaacaccggggtgctgaagcgaatggagtggttactggaactgatggggtatatcaggaatgttgcataccagtccacttcattccacaacacggctctcgataaagctctggatttctttcttctcattttcgcaactgctgtcgtggcttgggctgatcacactgccccactgctcctgggtttgtcggctagctggctgccctggcaccaggagaacggtcctgcgggccctgtccctagttttttgggcaggtctcccatgcatcgtgttacacttcaggaggtactaactctgctgccaaactccatggccctgcttctacagaaggaaccatggaaggaacagacccagaagttcattgattggctgttctccattatggaatcccctaaagaggccctgagcgctcaaagtcgcgacctactgaaagcaacactgctgtccttgagagtgttgcctgagtttaagaaaaaggcagtgtggacgagagcctatgggtggtag

SEQ ID NO: 42907 - DNA, 5406 bp, Artificial Sequence
  Description of Artificial Sequence: Synthetic coding sequence
atgagcgacgacatccggaagcggttcgagttccccaacagcctgatccagtcacaggcagtggggcatttgatcgccgctgtgctgaaagagaacggttttagtgagaagatacaccagagtaccaatcaaactccagcccttaacctgctatgggagaagtgttgctctgacaatgtggtggtaagaacggcttgctgcgaggggttggtcgcgctggtggcccaggatcatgcagagtttagttacgtccttaacggaatcctcaatctcattccatcaactcgaaacactcatggacttataaaagctattatgcaccttcttcaaatgcaggccctcaaagaaggccaaggcggtgaaaagaatatccagtcgatctacaccattcgtaaccatcctcatcccttgatcactgtcttagagcataggcccgattgctggcccgtctttctacaacagctgacggcattttttcagcagtgtccagagaggctagaggtgtcctgtattcagatcatggctccctttctttggtacctgtattgcgaaccttcacagctgcaggagtacgctaaattgcgtctggccctgctgaaggtattgctgcagccccaggtcctatgcgataaggaccagccttcaatactggagcagcagatcctgcagctgtgctgtgatatcgtcccctgccttcaggttaaggaccttatacagacaacggaggccatgatgttcatagaagaagtgtgcctgagcctcttaagacacccagtcttttggaaaatccagttgactcagatgagcctgcaactcctctgtgtctcggaagtgtcactgaaaattacaggcgagtgctcttcatcaatccaccttctggagcactccgtggaactattaaaagaagacttccccgtcgaactcgtcatcatcgggatagccttgctgttgcttcagacacctgccagccagcagaagcccattctgaatcttgctctaaaacttctgagtgtgactgaggaccagaagatcccgaaaagcagccttctgttagtgatgcccattctgcagatactgtccagtaccgccctggaagactgtatctcagtcgatgaggaagggccatcacggcagcagctagccctgaatctgttggaaatgatccagcaggagtgctacagagatgaccaccagaagctgtcttacaaactggtctgcccagttactagcatgtacgggaccatcttcacagcatggcgcatactcgaggtgatgacagactcaagcgcagcctctgactggctggcctcagtcgaaagcttgctgccaataacggcagtgatccccgcccccgcgtttcttctgttagcccacctcctggtggaggacaagggccagaacctccaccagatccttaaagtgactacggaactggcacaggctgacagctctcaggtgcctaacttaatccccgtgctgatgtttaaactgggacggccacttgagccaatcctgtacaatgatatcttatatactctgcccaagctcggcgtgcataaggtctgcataggccagattctgcggatcatccagcttctggggactactccccgattgcgggctgtaactctccggcttttgacttccctgtgggaaaagcaggaccgcgtctacccagaactgcagcggttcatggccgtgagcgacgttccaagcctgtccgtcggcaaggaggtgcagtgggaaaaactgatagcaaaggctgccagcattcgggacatttgcaaacagcgaccctatcaacatggtgctgatatgcttgccgcgatcagtcaggtgcttaacgaatgtaccaaaccagatcaagccaccccagccgccctggtgctgcagggcttgcacgcgctgtgccaggctgaggtcgtgtgtattagatcaacctggaatgccctttctcccaagctgtcctgtgatacgaggcctctgatcttgaagaccctctctgaattgttctctctggtgccctccttaacggtgaacacaacagaatacgagaactttaaggtacaggttttaagttttttgtggactcacactcagaacaaggaccccatcgtcgccaacgccgcctaccgaagtttggccaactttactgcaggcgagcacaccatactacacttgcccgagaagattcgccctgagatccctataccagaagaattggacgacgatgaggatgtggaggacgtggacctatctgtcccaggatcctgttacctgaaattgctgtcactgacccctcctctcgtactgcccgcactggaggagttctttacctcacttgtcaaacaagaaatggtaaatatgcctagaggcatttatcactccgccctgaaaggtggtgccagatctgaccagggcaagaccgtggcaggaatccccaattttatcctgaagatgtacgagaccaataaacaacccgggctgaagccaggtctggccggaggcatgctgttttgttacgatgtctcaatgtatcagtccaaagatgggaaaccactcaaccgtctcatggccagccgtggaagatccttcaaacagacttcgctggccttagtccacgaagtgcacatccagctctcagagtggcatagagctatttttctgcctcaggcctggttagcttacatgaatagagcatatcacgcaattctgcagggacgtctgggagaactggagctccagctgaaacacggtaaagaggagccggaggaagttcagtataagaaaagcaccgcctggctctgggtgagagacatgctcacagatgagattacgaaggccgcagcaaaggaatctcccgtggtcaagggcaacgctcttctagctctatccagcctggcagtggtggtgtccaggcacgaggcttccctttcttcagactcagacgggctactggaggtacaaccaaactttttgtctatgaaagagtgggtatctatggtcctcgacacacttcttgtcattgtggatagccattaccagcccagggggcagttactgagctggttctattataagtcttacagcggcgaaaatactgcatccgcgatcgctaggtccgcagctgcaactgccttgagtctgctggtcccggtttttataatcagctgtaaggaaaaggtagaggagatccttaatatgcttacagcacgtttgccgggaaaaccctcagcggacgaatctcaagccgtacagattcacatggggctagctctgggaatgtttttgtctcgcttgtgtgaagagaagctatcagacatcagcgggcaagagatgaatctgttattgatgaaaagtttagatgctctggaaaactgctgttttgatacatcacttgagtacaacacgggatgcattctgggggtggggctggtgttgagtctgatgtcacacagtagccagatgcaaagccgagtgcacgtggccgccctcctgcggaagctttccgcccacgtcgacgactccggcagtcagagtaggacattccaggaagtgctagcttacaccctgtcttgcgtttgtacttcagccttcagcgcagggattatcgaagcaacggaggcagaggacgtgatgaacaagctgagactcttagttgaaaactctcaacaaacttccggattcgcattggccctgggaaatattgtccacgggctctccgtgtgcggacacggcaaggctgaggacttagggagtaagctactgcccgcttggatccgcatagttctcaccgaaggaacacccaccatgttatgcttagccgcgcttcacggcatggtcgccctggtcgggtcagaaggcgatgtcatgcaattgaaatcagaggcaatccaaacaagtcacttccagggccgcttgaacgaggtaatccgtacacttacccaggtaatctccgtatccggggtaataggtttacagagcaacgcagtgtggcttctgggccatctccatttatcaacccttagctcctctcagtcaagagcatctgtccctacagactactcctacttgccagagtcaagctttattggagctgccattggtttcttcattactggaggaaaaaagggtcctgagagtgtgcccccctccctcctgaaagtcgtgatgaaaccaatagcaacagtgggggaaagttaccagtacccccccgtgaattgggctgcactgctcagcccactgatgcgcctcaacttcggagaagagattcagcagctgtgtttagagattatggtaacccaggcacaatcctctcagaacgccgctgccttgttgggtctctgggttacccctcccttgattcatagtctgagtctcaacacaaaacgctatctgttaatatctgctcctttgtggattaagcatatctccgacgagcagatcctcggttttgttgagaacctgatggttgctgtgttcaaggccgctagccccctgggctctccggaattgtgcccatccgcgctgcacgggctcagccaggccatgaagcttccctcccctgcccaccatctgtggagtctcttgtcagaagctacaggcaagattttcgatctgcttccaaacaaaatccgtcgtaaagacctcgagctctacatttcaatcgctaaatgcttgctagagatgactgatgatgacgctaatcggatagctcaggtaacgaaatcaaacatagaaaaagccgcattcgtgaaactgtatctggtgtctcagggtaggtttcccttggtgaacttgactgatatgctttcagtagcagtccagcatcgagaaaaggaagtgctcgcatggatgatcctgcacagcctgtaccaagccagaatcgtcagccatgccaacacaggggtgttaaagaggatggagtggttgctggagctgatgggatacatccgcaatgtagcttaccagtccacaagctttcacaatacagccctggataaggcgcttgactttttccttctcatcttcgccaccgcagtcgttgcatgggcagaccacacggcaccccttctactgggtctgtctgcgtcctggctgccctggcaccaggagaatggtcccgctgggcctgtcccatcttttctgggccgaagccccatgcaccgcgtgacactccaggaggtactgaccctgctaccaaactccatggcgttactcctgcagaaggaaccttggaaggaacagacccaaaagtttattgactggctattctccataatggagagccctaaggaagctctctctgctcagagcagggacctacttaaggctactctgttgagcctgcgcgtcctcccggagttcaaaaagaaggccgtgtggacaagggcatatggttggtag

SEQ ID NO: 42908 - DNA, 1557 bp, Artificial Sequence
  Description of Artificial Sequence: Synthetic coding sequence
atgctgtgcgccagcttcctgggcctgggcctgagcgtggccatcgttgggccaacattccaggatctggcaacgaatgttaaccggaatatttccagcctatctttcatctttgttggcagagccctcgggtacctgtctggaagcgtgattggagggtttctggtcgatgttatgaattacttcctactgttagggatctccatgtccgccaccaccgtaggactctacttggttccattttgtaaaacagccatcttgcttacagtgatgatgtcaattttcggcgtttctatcggtatccttgacacaggtgggaacgtgctgatcctggctatttggggcgataagggagcgcctcatatgcaggctctccattttagcttcgctctgggtgccttcttggctcccctgttagcgaagttggcactgggccctaccgccagcgcagagaaccatacagaatccgatttccaccccgccctgaatcagtcctctgacgcagatagtgaagcgctgttcggcgtcccgaacgataagaacctgctctgggcttacgctgttattgggacctacatgttcttggtgtctgtgatctttttctgtctcttcctgaaaaattccagtaagcaggagaaagcacgggcatccgccgaaacctttcggagggctaaataccataacgcgctactgtgcctgctgtttttgtttttcttcttctatgtgggcgcagaagtgacctacggaagttatgtgttcagtttcgccaccacccatgctggaatgaaagagagtgaagcagccggtctgaactccatattctggggaacttttgcagcctgcagggggctcgccatcttcttcgccacatgcttgcaacccggcaccatgatcgtgctgtctaatattggatcacttacctcatctctatttctggtgttgttcgataaaaaccctatctgcctgtggattgctacgtcagtgtatggcgctagcatggctaccacattcccgtccggcgtctcgtggatcgagcagtacacaacaatccacggtaagagcgctgcgtttttcgtcataggcgcctctctgggggagatggccattccagctgtcattggaatcctacagggcaagtatcctgacttacccgtcgtcctatatacctcattaggggcctcaatagctacgggcattcttttcccggtgttatataagctcgccaccagcccccttgacaggcaaagaaaagaggacagaaagtcggaggaccaaaaggccctgttgtccagctcgggcctcaacgagtatgaggaggagaatgaggaggaggatgcggagaagtggaacgagatggactttgagatgatcgaaaccaacgacaccatgcgacactccatcattgaaacgtcacgatccagcctgactgaacctaccgcggaggtgtacaaccagtacccctctaacgccctggttttcgagagctcccccttcaatacaggttctgcccacgttaagcatctccccgagaccaggacaaaagggaccaatgtctag

SEQ ID NO: 42909 - DNA, 1905 bp, Artificial Sequence
  Description of Artificial Sequence: Synthetic coding sequence
atgtggctgcagcagcggctgaagggcctgcccggcctgctgagcagtagttgggcccggcggctgctgtgccttctgggcctgctgctgctcctgctgtggtttggcggctcgggggctcgccgggcagctggaggccttcacctgctgccctggtccaggggcgagccaggcgcagccgagccatctgcctgtcttgaagctgcaactagagcttggaggggcttaagggaacgcggcgaggtcgtccccctgggaccaggtgtccccgcccttgtggctaacggttttttggccctcgatgttgcagcaaatcggctgtgggtcactccaggcgagagggaacctgctgtcgcccccgatttcgttcctttcgtgcaattgcgaccgctttcggccctggccgaggccggagaggccgttctcttgttgagagagggcctcttacgacgcgtccggtgcctgcaattgggtagcccagggcccggccctgtggctgctggccccgggccagcttctgtctctgggctcgctgcgggctccggccgtgactgtgtgcttctccaggaggacttcctggcccaccggggccgtcctcacgtgtacctgcagcgtattcagctgaataacccaacagagcgcgtcgccgccctccaaactgtgggccccaccgccgggcctgctcctaaggccttcacctccaccctcgaaaaggtgggcgaccaccaattcctcttgtactctggtagaagccctcctacccccacagggctggtgcatctggttgtcgtggctgccaagaagctggtgaaccgccttcaggtggccccaaagacccagctggatgagacagttctgtgggtggttcacgttagcggcccgataaatccccaggtactgaagtctaaggccgctaaggaattaaaagctctgcaggaccttgcacgaaaggaaatgctggagttgctggacatgcccgctgccgaactcctgcaggatcaccagttgctgtgggcccagctatttagccctggcgtcgagatgaagaagatcactgacactcatacaccatccggccttaccgtgaacctcaccctgtactacatgttatcttgcagtcccgccccactccttagcccaagtctttcgcacagggaacgggatcaaatggagtcaactttgaattatgaggaccattgtttttccgggcatgcaacgatgcacgcagagaacctctggcctggcaggctgagcagtgtgcagcagattttacagctctcggatctgtggcggttaaccctacagaagagggggtgtaaagggctcgtgaaggtgggggcccctggcatactgcaaggcatggtgttgagtttcgggggcctccaattcactgagaatcacctgcagttccaggccgatcccgatgtcctccacaacagttatgcgttgcatggaatccgctacaaaaacgatcatatcaatctggcggtcttagccgatgctgaaggaaagccctacctacatgtctccgtcgagtcccgcggccaacctgtgaaaatttacgcctgcaaggcggggtgcctcgacgagcctgttgaactcacatcagctccgaccgggcataccttctcagtgatggtgactcagcctattactccgttgctgtatattagcaccgacctgacccacctccaggacttacggcatactcttcaccttaaggccattctggctcatgatgagcacatggcccagcaagatcctgggctgccattcctgttctggtttagcgtggcctccctgatcaccctgtttcatctctttttgttcaagctcatctataacgaatactgcggccctggggcaaagccactgtttaggtctaaagaagacccctccgtctag

SEQ ID NO: 42910 - DNA, 1233 bp, Artificial Sequence
  Description of Artificial Sequence: Synthetic coding sequence
atgagcctgatggtggtgagcatggcctgcgtgggcttcttcctgctggaaggcccctggccccacgttggcggacaagacaagccctttctgtcggcctggccaggcaccgtcgtgtcggagggccagcacgtgactctgcagtgtagatctagacttggattcaatgagttctcactctctaaggaggatggaatgccggtcccagaactttacaatagaatcttccgcaattcattcttgatgggcccagtaacacctgcacatgcaggaacttacaggtgttgttcatctcaccctcattctcccacagggtggtctgcaccttccaatcccgtggttatcatggttactggggtccaccggaaacccagcctactggcccacccaggacccttagtcaagagtggggagaccgtgatcctgcagtgttggtcagacgtgaggtttgagcgatttctgctccaccgcgagggcattaccgaggatcccctaagactcgtcggtcagttgcatgatgcaggctcacaggtcaattactctatgggacccatgacccctgccttggctggcacataccggtgtttcggttcggtaacgcacctaccctacgagttaagcgctccttcggatccactggacattgttgtggttgggttgtatggtaagcctagcctctccgcccagccaggcccaacagtacaggccggcgaaaatgtgacgttatcctgctcttctaggtcgctgtttgatatctaccacctgagccgcgaggccgaagctggcgagttgagattaaccgctgtgctgagggtaaacgggacatttcaggccaatttccccctgggccccgtcacacacggaggaaattataggtgtttcggttcattcagggcattaccgcacgcctggtccgatccctcagatcctctgccagtttctgttacgggcaactccaggcatttgcacgtgctcatcgggacctcagtcgttatcatcccattcgctatattactcttctttctgttgcaccgctggtgcgctaacaaaaagaacgccgtggttatggatcaggaaccggcaggaaatcgcacagtcaaccgcgaagacagcgatgagcaagacccccaggaagtgacctacgcccaacttaatcactgtgtgttcacacagagaaaaatcacacgaccatctcaaagacctaagacccctccaaccgatacatcagtgtag

SEQ ID NO: 42911 - DNA, 624 bp, Artificial Sequence
  Description of Artificial Sequence: Synthetic coding sequence
atggagaacgaggacggctacatgaccctgagcttcaagaaccggtgcaaaagtaagcaaaaaagtaaggacttctctctgtatccacagtattactgtttacttttaatctttggatgtatcgttatcctaatctttatcatgacaggcatcgatctcaaattctggcacaagaagatggacttcagtcagaatgtcaacgtatccagcctgagtgggcacaactacctctgcccgaatgattggttactgaacgaggggaaatgctattggtttagtacgagctttaaaacttggaaggaaagccaacgcgactgtacgcagctgcaggcacatttgttggtcattcaaaacttggatgagttggagttcattcagaatagtctcaaacctgggcacttcgggtggataggcctctacgtgaccttccagggaaatttatggatgtggatcgacgaacatttccttgtacctgagctgttttcagttattggccccactgatgacaggagctgtgccgtgattacagggaattgggtgtactctgaagactgcagttctactttcaaaggcatttgccagcgggatgctattctcacacacaatggcaccagcggggtgtag

SEQ ID NO: 42912 - DNA, 1230 bp, Artificial Sequence
  Description of Artificial Sequence: Synthetic coding sequence
atggaggagagctgggaggccgcccccggcggccaggccggcgccgaactgccaatggagccagtcgggtctctcgtccctacactggagcagccccaagtacctgctaaggtccggcaacccgaggggcctgaatccagccctagccccgcaggggctgtagaaaaagccgccggcgccggactagaaccatcctccaaaaagaagcctcctagtccaaggccaggctcccctcgagtgcccccgctttccctgggatacggagtgtgtcccgagcccccatctccaggtcccgctctagtcaagttgccccggaacggcgaggctcctggagcagagcccgccccatccgcttgggcaccgatggagctgcaggtcgacgtgagggttaaacccgtgggcgcagccggtggcagctccacaccatcgccaagaccctctacccgattcttgaaggtgcctgtcccggaaagccccgccttctctagacacgccgaccctgcccaccagttgcttttacgcgctccctcacagggcggcacctgggggagaagatccccactggcagcagctcggacggagagtggttgcgacgctgagggaagggcaagccccgccgagggatctgcaggatcgccagggtcccctacatgttgtcgatgcaaagaactggggcttgagaaggaagacgctgctctgctgcccagggcgggcctcgatggagacgaaaaattacctcgggcagtcaccctgacaggacttcccatgtacgtcaaatccctctactgggcccttgcttttatggctgtgctgctggccgtcagtggcgtggtcatcgtagtgcttgctagtagagccggggcaaggtgtcagcagtgtccaccggggtgggtgctctcggaggaacattgctactacttctccgccgaggcacaggcctgggaggcctctcaggctttttgtagcgcctaccacgccacactgcctctgctctcccatacgcaggattttcttggccggtatccagtttctaggcactcctgggtgggagcttggcggggccctcagggctggcattggattgatgaagccccacttccccctcaactgctgccagaagatggcgaggacaacttggacattaattgcggagccctcgaagagggtacactggtggctgcgaattgcagtacgcctaggccatgggtgtgtgcaaaaggcacacagtag

SEQ ID NO: 42913 - DNA, 945 bp, Artificial Sequence
  Description of Artificial Sequence: Synthetic coding sequence
atggaggagagctgggaggccgcccccggcggccaggccggcgccgaactccccatggaaccggtcgggagtttagttcctaccctcgagcagccacaggtgccagctaaagtccgccagcccgaagggccggagtccagcccttcgccagccggagctgtcgagaaagctgccggcgccgggttagagccgtcctcaaaaaagaaaccccctagcccaaggcctgggtctccaagggtcccaccactgtctctgggctacggggtttgtcctgagccaccttccccggggccggccttagtgaaactcccacgtaacggggaagcacccggggctgagccagctccatcagcatgggccccgatggagctccaagtggacgtgcgcgtaaaacccgttggggccgccggaggctcatcaactcctagcccaaggccttccactaggttccttaaagtgcccgtgcccgagtctcccgcattttctagacatgctgaccctgcacaccagctgcttctcagggcacccagccagggaggcacatggggaagaaggtcgcccctggccgcagcccgcacagagtccggttgtgatgccgaagggagagcaagccctgcagaaggcagcgccggatcccctggtagtcctacctgttgccgctgtaaggagctgggcctcgagaaggaggacgctgcgctgctccctagggccggattggacggtgatgaaaagctcccacgcgccgtcacgttaacagactccttgcgcaccgctcgcaccatctggatctcaaccgtgggtccatggcgcaaagctcgttggtggcttcagacagctgctttgcaggaccctgggagcgtgccacgcggaccaagcgacttgggctccgcctggagttccgcgtgtcaggccgatgccgccccaccaactggagaggcatcttag

SEQ ID NO: 42914 - DNA, 2274 bp, Artificial Sequence
  Description of Artificial Sequence: Synthetic coding sequence
atgctgagcctgctggtgtggatcctgaccctgagcgacaccttcagccagggaacacagacacggttctcccaggaaccagccgaccagaccgtggtcgctggccagcgggccgtgttgccgtgtgtcctgttaaactacagcggaattgtgcagtggactaaggacgggttggctctgggaatgggtcagggactgaaggcctggccacggtatagagttgtggggagtgctgatgcaggacaatacaatctcgagattacagacgcagagctgtctgatgatgcttcgtacgaatgccaagcaaccgaggctgctctgagatctcggagagcaaagttgactgttcttattcctcccgaggacacccgaatcgatggaggacccgtgattctgctgcaggcaggcacaccgcacaacttgacgtgccgtgctttcaatgcgaagcccgcagcaacaatcatctggttcagagacggcactcagcaggagggcgctgtcgcatcgacagaactgctcaaagatggcaaacgagaaaccacagtgagccagctcctcatcaaccctaccgacctggatatcggtcgcgtgttcacttgccgctcaatgaacgaagcaattccttccggtaaggagacgtccatagagctcgatgtgcatcatccacccactgtgacgctgtccatcgagccgcaaaccgtccaggaaggagagcgtgtcgttttcacctgccaagcgaccgccaaccccgaaattcttggatataggtgggctaaaggtggctttctgattgaggacgctcacgaatctcggtatgaaacaaatgtggactattcttttttcactgaacccgtgagttgtgaagtccataacaaggtgggttcaactaatgtgtcgactctcgttaacgtgcattttgcccctaggattgtagtggatccgaaaccaacaacgactgacatcgggagtgacgtcacactgacttgtgtgtgggtaggcaacccgcccctcacactaacttggactaagaaagattcaaacatggtgctgtcaaattccaaccagctgctgctcaagagtgttacacaggccgatgccggaacatatacttgtagggctatcgtaccccgcatcggcgtcgcagagcgggaagtccctctgtacgtcaatggtcctcccataataagtagtgaggccgtacagtatgcggttagaggcgatggaggcaaggtggagtgtttcatagggagcactcccccccctgacagaatcgcttgggcttggaaggagaatttccttgaggttggcactcttgagcgatataccgtggaaagaacgaactccggctcaggggtactctcgacgctcactataaataacgtcatggaggccgattttcaaactcactataactgcaccgcctggaactcattcggccccgggacagcaatcattcaattagaggaaagagaagttctccctgtgggcataattgccggtgctacgattggggcgtcaatccttctgatcttcttctttattgctctggtctttttcttatacaggcgtcggaaaggctctcgcaaagatgtgaccctgcgtaagctggatatcaaggtggaaactgtaaacagggagccccttacaatgcacagcgacagggaggacgacacagcgtccgtcagcactgccacccgggtcatgaaggccatttacagcagtttcaaggacgacgtcgatttgaagcaggacttgcggtgcgatacaattgatactcgagaagagtatgaaatgaaggatcctacaaacgggtattacaatgtgcgggcacacgaagaccgccctagcagccgagctgtgctgtacgcggactatagagcccctgggccggccaggttcgacggccgccccagcagccgtctaagccatagctccggctacgcccagctgaacacgtattcaagggggccagcatctgattacggccccgagcccacacctcctggacccgcggccccagcaggcaccgataccacctctcagctgtcttatgagaattacgaaaagttcaactcccacccatttcccggtgcagccggctacccgacataccggttgggctatccgcaggctcctcccagcggactcgaaagaacgccttacgaggcctacgaccccatcggaaaatacgctaccgcaacacggttctcctacacaagtcagcactctgattatggacagcggtttcagcaacggatgcagacccatgtctag

SEQ ID NO: 42915 - DNA, 1782 bp, Artificial Sequence
  Description of Artificial Sequence: Synthetic coding sequence
atgggccagggcctgaaggcctggccccggtaccgggtggtgggcagcgctgacgcaggacagtacaacctcgaaattacagacgcagagctctccgacgacgcctcatacgagtgtcaggccaccgaagctgctctgcgcagtcggcgagccaagctgaccgtgttgaatccaccaactgtcactctgagcattgagccacaaaccgtccaggaaggagagcgcgtggtctttacctgccaggctactgccaatcccgaaatcctgggctatcggtgggccaaaggagggttcctgatcgaggacgcccatgagagtcggtacgagactaatgtggactactctttttttactgagcccgtgtcatgtgaggttcataataaagtgggctccaccaatgtttccaccttggtcaacgtacattttgcgccacgaattgtcgtggatcctaaaccaacgaccacagacatcgggtcagacgtgaccttgacgtgcgtgtgggtggggaaccccccccttaccttgacctggaccaagaaggatagtaacatggtactatctaacagtaaccaactcctgctgaaatcggtcacgcaggccgatgcaggcacctatacctgtagagccattgtgccacgcattggtgtcgcagaacgggaagtgcctctgtatgtaaacgggcctccgatcataagctccgaggctgttcagtacgcagtaaggggggatggtggcaaggtggagtgtttcatcggcagtactcccccaccagaccgcatcgcgtgggcctggaaagagaacttcctggaagttggtactctggagcggtacactgttgagagaactaactctggcagtggcgttctatctacattgaccataaataatgttatggaggctgatttccagacccactataactgtactgcatggaactctttcggacctggcaccgcaataatacagcttgaggagcgggaagtactcccagtgggcattattgcaggggcgaccataggggcctcaatccttctcatatttttttttatagccttggtcttctttctgtatagaaggagaaagggatcccggaaagacgtgaccctgagaaagctcgatataaaagtcgaaacagtgaatagggaacccctcacaatgcactccgaccgggaagatgacacagcctcagtgtcaaccgccacgcgggtcatgaaagccatttacagcagtttcaaggacgacgtcgatctgaaacaggatctgaggtgcgacacgatcgacaccagagaagaatacgagatgaaggatcctacaaatggttactataatgtgcgagcccacgaggatcggccttcctcccgggcggtgctctacgctgactaccgagcgccgggtcccgcccgatttgacgggcgcccgagtagtaggctttcgcactcatctggctacgctcagttgaacacatattcacgaggacccgctagcgattacgggcctgaacccacacccccaggtcctgctgctcccgcagggactgacactacttcacagttgtcatatgagaattacgagaagttcaacagccaccctttccccggcgccgctggatatccaacataccggctcgggtatccccaggccccgccctccggactggagcggaccccctacgaggcatacgatcctattggaaaatatgctacagcaaccaggtttagctacaccagccagcatagtgactatggacagcgatttcagcagcggatgcagacacatgtgtag

SEQ ID NO: 42916 - DNA, 2322 bp, Artificial Sequence
  Description of Artificial Sequence: Synthetic coding sequence
atgctgagcctgctggtgtggatcctgaccctgagcgacaccttctcacaaggaacacagaccaggttctcacaggagcccgctgatcaaaccgttgttgcgggccagagagcagttctgccctgcgtgctcctcaattatagcggcatcgtgcagtggactaaggacggcctggcactcggcatgggacaaggactgaaagcctggcccaggtacagggtcgtgggaagtgctgatgccggccagtacaacttagagatcactgacgccgaactgtcagatgacgcttcctatgagtgccaggccacagaagcggcgttgcggtcccgaagggctaagctaactgtcctgatccctcccgaggacacccgcatcgacggaggtcctgttatcttactgcaggcgggcacaccacacaacctaacctgtagggctttcaacgctaagccagcggcgaccataatttggtttagggacggcacacagcaggaaggtgcagtagcatcgactgagctcttgaaagatggcaagagggagactactgtgtcccaactcctgatcaacccaaccgacctcgatatcggccgggtcttcacctgcaggtcaatgaacgaagccattccatctggtaaggagaccagcatcgaactggatgtccaccaccctccgactgtaactctgtccattgaaccccaaaccgtccaagaaggagagcgcgtggtatttacatgtcaggccactgcaaacccagaaatcttgggatacagatgggctaagggcgggttcctgattgaagacgcacacgagtcccggtacgaaacaaacgtggattactcttttttcacagagcctgtgagttgtgaagttcataataaggtggggtctaccaatgttagcactctggtgaatgtgcactttgcccccagaattgtggtggatcctaagcctaccactaccgatattggaagcgatgtgaccctgacctgcgtgtgggtggggaatcctccgttgactttaacttggacaaaaaaagatagcaacatgggaccacgcccacccggctcgccccccgaggccgctttgtcggctcaggtcctctctaattccaatcagttgctcttaaagagcgtcacacaggccgacgcgggcacctacacttgtagagcgattgttcccaggataggtgtggcagagagagaagttcccctgtatgtaaatgggcccccgatcatcagttctgaggccgtacagtatgctgtcagaggagatggaggcaaagtagaatgttttattggtagtacacctccccccgatagaattgcctgggcctggaaagagaattttcttgaagttggcaccctggaaaggtataccgtggaacgcaccaacagtggtagtggggtcctgtcaactttgaccattaacaatgtaatggaggcagattttcaaacccattataactgtacagcctggaacagcttcgggcctgggaccgcaatcatccaattagaggaaagagaagtcctacccgttggtatcattgcaggcgctactatcggggctagcatcctgcttatcttcttctttattgcccttgtcttcttcctctacagacgccgcaagggttcccgcaaagacgtgacactccgcaagttggacatcaaggtggaaactgtgaatagagagcctctcacgatgcacagtgacagggaggacgacaccgcctccgtttctactgcgacaagggtgatgaaggcgatatatagctccttcaaagacgacgttgatctgaaacaagacctgagatgcgacactattgacacaagggaggagtacgagatgaaagatcctaccaacggttattacaacgtgagggcccacgaggatcggccctcctcacgggccgtcctgtatgccgattatcgcgcgccagggcctgcacgattcgacgggcgcccatcttcaagactgtcccactccagcgggtatgctcagttaaacacgtatagccgtggtcccgcgagcgactacggcccggagcccaccccgcccggaccggctgccccagctggcacggataccacatcccagctgtcctatgaaaactacgaaaagtttaactctcacccattccctggagccgcgggttacccaacatatagactgggataccctcaggcacctccgtcaggcctggaaagaacaccatacgaagcgtatgaccccattggaaagtacgccactgctactcgtttcagttatacctctcaacattccgattacggtcagcgctttcagcagcggatgcagacccacgtgtag

SEQ ID NO: 42917 - DNA, 1965 bp, Artificial Sequence
  Description of Artificial Sequence: Synthetic coding sequence
atgctgagcctgctggtgtggatcctgaccctgagcgacaccttcagtcaaggtactcaaactagattctcacaggagcctgccgaccaaactgtagtcgcaggccagcgagctgtgctaccttgcgtactgcttaactacagcggaatcgttcagtggacaaaagatggcctagccctggggatgggccagggtctgaaggcctggccgcgatacagggtggtcggtagcgctgatgccggccagtacaatcttgaaatcacagatgctgagttatctgatgacgccagttacgaatgccaagccacagaggcagctctcagatcacgaagagcaaagcttacggtgctgaaccccccaacggtgacactgagcatcgagccccagactgtccaggagggagaaagggtggtgtttacatgtcaagcaaccgcaaacccagagatcctgggctatagatgggccaaaggcggattcctcatcgaggatgcacatgagtccaggtacgagactaatgtggattacagctttttcacagagcccgtaagctgcgaggttcacaacaaagttgggagtacaaacgtgagtactcttgtgaatgtgcatttcgccccgcggatcgtggtcgaccctaagcctacgacaacagacattgggtccgacgtaactctcacctgcgtgtgggtgggtaaccctcccctgacactgacctggaccaagaaagattccaacatggtgctgtcgaattctaaccaactgttgctaaagtctgtcacacaggcagatgccggtacttatacctgcagggcaatagtccccaggataggcgtggcggaacgagaggtgcctctttacgtgaatggacccccaatcatcagtagtgaggccgtgcagtatgccgtaaggggagatggggggaaggtggaatgctttataggaagcacaccgccgccagaccggatcgcctgggcttggaaagagaatttcctagaggtgggaaccctagaacggtatacagtcgagcgcaccaacagtggatccggcgtgctctctacgctgaccatcaacaatgtcatggaagccgattttcaaacccattacaactgtacagcatggaactctttcgggccagggaccgccatcatccagctcgaggagcgcgaagttctgccagtcggcatcatagccggcgccacgataggggcgagtatccttctcatattttttttcattgctctggtgttctttttgtataggagacggaaaggaagtaggaaagacgtgacactccgcaagttggacatcaaagtggagaccgtgaaccgcgaacccctaacgatgcactctgacagggaagacgatactgcctccgtctccactgcaacgcgggttatgaaggctatttatagttccttcaaggacgatgtggaccttaaacaggatttacgatgtgacactatagacactcgagaagagtacgaaatgaaggaccctactaacggttactataacgttcgggcgcacgaggacagaccatcaagtagagctgtgctctatgctgactatagagcccccggacccgcccgctttgatgggaggccttcgtcccggttaagtcattcttccggatatgctcagttgaatacctattctcggggacctgcttctgactacgggccagaacctaccccccccggccccgccgccccggcagggactgacacgacgtctcagctgagttacgaaaactacgaaaaattcaattcccacccattccctggtgccgctgggtacccaacttaccgattgggatatccccaggccccaccctccgggctggagcgcaccccctacgaagcttacgacccaattgggaagtacgcaacagccaccagattcagctatacctctcaacatagcgattatggccagagatttcagcagcgcatgcagacccacgtctag

SEQ ID NO: 42918 - DNA, 1974 bp, Artificial Sequence
  Description of Artificial Sequence: Synthetic coding sequence
atgctgagcctgctggtgtggatcctgaccctgagcgacaccttctcacaggtgccccccgaggacacgcgcattgatggcggaccagtgatcctgttgcaagctggaaccccccataacctcacctgcagggccttcaatgctaagcccgctgccaccatcatatggttccgagacggaactcagcaggaaggggccgttgcttccaccgagcttctgaaggacggcaagagggaaacgaccgtgtctcagctgctcataaatccaacagatctagacatcggacgcgtctttacttgtaggtctatgaatgaagctatcccttcaggtaaagagacttcaattgagttagacgttcaccaccctcctaccgtgactttgtccattgaacctcagaccgttcaggagggggagcgagtggtatttacttgtcaggcgactgcaaacccagaaattctaggatacagatgggctaaaggcggctttctgatcgaggatgctcacgagtcacgatacgagaccaatgtcgactattccttctttaccgaacccgtgtcatgcgaggtgcataacaaggtggggtccacaaatgtatcaacacttgtgaatgttcattttgcccccagaattgtggtggacccaaagcctactaccaccgacatcgggagcgatgtgactctgacatgtgtgtgggttggcaacccacctttgaccctgacatggactaagaaggacagtaatatggttctttctaattccaaccagttgttgctgaagtcggttactcaggccgacgcagggacgtacacctgccgtgccatcgtgcccaggatcggcgtagctgagagggaagtgcctctctacgttaacggtccgcccattatctcttccgaggcagttcagtacgctgtgcgaggtgacggcggtaaggttgagtgtttcatcgggtctacacccccaccggaccggatcgcctgggcatggaaagagaacttccttgaggtggggacattggagcgctataccgtcgagagaacaaactctggcagtggcgtcctgagcaccctcactatcaataatgtaatggaggccgacttccagacccattacaactgtacagcctggaacagcttcggtccaggtacagcaatcatacaactggaagagcgggaggtgctgcccgttggtattattgcaggagccacaatcggcgcgtctatactgcttatattctttttcatcgctttggtatttttcctgtataggcggcgcaaaggctctcgcaaggacgtcaccctaaggaagctggacattaaggttgagactgttaacagggagcctttaaccatgcacagcgatcgggaggatgacacggcaagtgtgtctaccgcaaccagagtcatgaaagcaatctactcgagtttcaaggacgacgtagatctgaagcaggatctgaggtgtgacacaatcgataccagggaggagtatgaaatgaaggatccaactaacggttactataatgttcgggctcatgaggatcgcccaagttcacgcgcagtgctgtacgcagattaccgcgcgccaggacccgcccggttcgacggtcggccttcctccagattgagtcatagctctggatacgcacagctgaacacttattctcgggggccagcctccgattatggcccggagccgactccaccaggccccgccgcgccggccgggactgacaccacaagccagttgagttatgagaattacgagaagttcaactctcacccttttcctggcgctgccggatatcccacctaccggcttggatacccgcaagccccccccagtggacttgaacgtaccccttatgaagcctatgatcctataggcaaatacgcaacagccactcgtttcagctacacttcccagcactccgattacgggcaacgttttcagcaaaggatgcaaacccacgtgtag

SEQ ID NO: 42919 - DNA, 5316 bp, Artificial Sequence
  Description of Artificial Sequence: Synthetic coding sequence
atgagcgtgctgatcagccagagcgtgatcaactacgtggaggaggagaatatccctgctctgaaagccctcctcgagaaatgcaaggacgttgatgagcgtaatgagtgcggccagactcccctgatgattgccgcggagcagggcaacttggaaattgtgaaggaacttatcaagaatggcgccaattgtaatctggaggacctcgacaactggactgctctgatatcagctagtaaagaaggccacgtgcacatcgtggaggagcttctcaagtgcggcgtaaatctcgaacacagagacatgggtggctggaccgccctcatgtgggcatgctacaaaggtagaacagatgtcgtggagttgctgctgagccacggtgcaaatccctcggttacaggtctatattcagtctacccaattatctgggcagcaggccggggccatgctgatatcgtgcatttactactccagaacggcgcgaaggttaactgctctgataagtacggcacaacgcccctggtgtgggctgcccgcaaggggcacctcgaatgcgtgaaacatttgctcgctatgggcgccgatgtcgatcaggagggcgccaacagtatgactgcactgattgtcgccgtgaagggggggtacactcagtctgtcaaggagattctgaagcgaaatccaaatgttaatttgaccgataaagacggcaataccgcgctgatgatcgctagcaaggagggacatacagagatcgtgcaggatctcctggacgcgggtacatatgtgaacatcccagatagatcaggggatacagtgctgatcggagcggttagaggaggccatgttgagatcgtccgcgctttgctgcaaaagtatgctgacatagacataaggggccaagacaataagaccgctctgtattgggccgtggagaagggtaatgcaactatggtgcgggatatcttacagtgcaaccccgacaccgagatctgcaccaaagatggtgaaactccgttgattaaagcgacaaagatgaggaacatcgaagtggtggaactgctgcttgataagggagcaaaagtgtcagccgttgacaaaaagggggacacccccctgcatatcgccattcgaggcaggtcccgcaagcttgccgagcttcttttacggaaccctaaggacggaaggttactctataggcctaacaaggctggcgaaaccccgtacaacattgactgttcacaccagaaatctattcttacacagatctttggcgcccgccaccttagtcctactgaaactgacggcgacatgctgggctacgatctctacagtagcgccctggccgacattctaagcgagcctaccatgcagccacctatctgtgtggggctgtacgcccagtggggctccgggaaatccttcttattaaagaagctggaggacgagatgaaaacctttgccggacagcagattgagccactcttccagttttcctggttgattgtcttcctgacactgctgttatgtggcggcctcgggctgttgttcgcttttacagtccatcccaatctgggaattgcagttagcctctctttcttggccctgctttacatattcttcatcgtgatatatttcggcggaaggcgagaaggtgagtcttggaactgggcctgggtgctgagcacaaggttggctcgccacatagggtacctcgagctgttgctcaagttgatgtttgtgaatcctcccgagctgcctgagcagaccactaaggccttgcccgtgcgcttcctctttactgattacaacagattgtcctctgtgggcggtgagacgagtctagccgaaatgatcgcaaccttatccgacgcatgcgagcgggaattcgggttcttggcgacccgtctcttcagggtttttaagaccgaggatacacaaggcaaaaaaaagtggaaaaagacatgttgcctgccttctttcgtcatttttctcttcatcatcggctgcatcatctccgggattactttactcgctatctttagggtcgatcccaagcacctgaccgtgaacgctgtcctgatttctatcgcttcagtggtcggtctggcctttgtgctaaactgcagaacttggtggcaagtgctggactccctcctgaatagtcagcgcaagagactgcacaacgctgcctctaagctacacaaactgaagtctgaagggtttatgaaagtgttgaagtgcgaggtcgaactcatggctcggatggccaagaccattgactcttttactcaaaatcaaacaagactcgtggttatcatcgatggcctggacgcgtgcgagcaggacaaggtgctccaaatgctcgacaccgtaagagtgctcttttcaaaaggacccttcattgctatctttgcaagtgacccccacatcattataaaagctattaatcagaacctgaattccgtcctgcgcgacagcaatattaacggacacgattacatgagaaacattgtacatctgcctgtcttcctgaattccagaggtctttccaatgcccgcaagttcttggtgactagcgccactaatggcgacgttccctgcagcgatactacggggatacaagaagatgccgatagaagagtctcccaaaattcactgggagagatgaccaaacttggtagcaagacggctctcaatcgaagagatacatataggcgccgtcagatgcagcggacgataactaggcaaatgagcttcgatctaacaaagctgctggtgacagaagactggttctctgatatctcaccccaaacaatgagacggcttttgaatatcgtatcagtgacaggtcgactccttagggccaaccaaatttcctttaattgggacagactggccagttggataaatctcaccgaacagtggccctacagaactagctggttgatactttacctggaagagacggagggaatcccggaccagatgaccctgaaaacaatctacgaaaggatcagcaaaaacatcccgacaaccaaggatgtggaacctctgctggagattgacggcgacattagaaattttgaggtctttctttcatctcggactcccgtgttagtggcacgggacgtgaaagtgttcttaccatgtacagtcaaccttgatcccaagctccgcgaaatcatcgccgacgtgcgcgccgcccgcgagcaaatctctatcggcggcctagcataccccccgctgccacttcacgaggggcccccacgagcgccttcaggatactctcagccccccagcgtgtgcagctcaaccagctttaatggcccttttgcaggcggagtggtctcaccacaaccccattctagttactacagcggtatgaccggccctcagcatcctttctacaatagaccttttttcgccccttacctatacactcctcgctactaccccgggggaagtcagcaccttatatccaggccaagtgttaaaacctctcttcccagagatcagaataacggactggaagttataaaggaagatgcagccgaggggttgtcctctccaaccgattcatcgcgcgggagtggccccgcacccggtcccgtcgtgctgctcaatagcctgaacgtggacgcagtgtgtgaaaagttgaaacaaatcgaaggactcgatcagtctatgttgccccaatattgtactactatcaagaaggcaaacattaacggtcgcgtcctggcgcagtgcaacattgatgaactcaagaaagagatgaatatgaacttcggtgattggcaccttttcaggtctaccgtgcttgaaatgagaaatgccgagtcccatgtggtgcccgaggacccgcggttcctctcggagagttcctcgggtccagcccctcatggggagccagccagacgagccagccacaacgagctaccccatactgaactcagcagtcaaacgccatacaccttgaatttctcttttgaggagttaaacactctgggcttagatgaaggcgctcctcgtcatagcaacctgagctggcagtcccagacccgacgtacaccctccctcagctctctgaatagtcaggattcctccattgagataagcaagctgaccgacaaggttcaggcagagtaccgcgacgcctatagggagtatattgcacaaatgtcccagctggaaggcggccccgggtctaccaccatctctgggagatcatcccctcactccacatattatatgggacagtcctcatcaggaggcagcatccactctaacctggaacaggagaaaggtaaggacagtgagcccaaacccgacgacgggcgcaaaagttttctcatgaagcgaggagatgttatcgactatagttctagcggcgtatctacgaatgacgcttcccctttggatcccatcacggaagaggacgagaagtccgaccagtctggctcaaagttgctcccaggaaagaagagcagcgagcgttcttcactctttcaaaccgatttgaagctaaaagggtccggtctgcgctatcagaagttgccaagtgatgaggatgaatctggaactgaggagtccgataatacacctttgttgaaggatgataaagatcggaaagctgaaggcaaagtcgagagggtgcccaagtctccggaacacagtgcagagcctatcagaacatttattaaggcaaaggagtacttgagtgacgccctgctggataagaaggacagttccgacagtggcgtgcgatcttctgagtcttccccgaaccactcccttcacaatgaagtggccgatgattcacaactggaaaaagctaatctgattgaactggaggacgacagccactctggcaagagaggaattcctcatagcctttctggactccaagacccgatcattgcccggatgagcatctgcagcgaggacaagaaaagcccctcagaatgctccctgatcgcgtcttctcccgaggaaaactggcccgcttgtcaaaaagcgtacaacttgaaccggaccccttccaccgtaaccctaaataataacagcgcccctgccaatagagccaaccagaatttcgacgagatggaaggaatccgcgagacctctcaggtgatccttcggcccagctcctccccgaaccctactactatccaaaacgaaaatctaaaaagtatgactcacaagcgctcgcagcggagctcttatactaggctcagtaaggatcccccagagttacacgctgccgcttctagcgagtccactgggttcggcgaggagagagagagcattctctag

SEQ ID NO: 42920 - DNA, 3096 bp, Artificial Sequence
  Description of Artificial Sequence: Synthetic coding sequence
atgagcgtgctgatcagccagagcgtgatcaactacgtggaggaggaaaatatcccagctcttaaagctttgctcgagaagtgcaaggacgtagacgaacggaacgagtgtggacagacgccgttgatgatcgccgctgaacagggaaacctagaaatcgtcaaagaactgataaaaaatggcgcaaactgtaatctcgaggacctagacaactggacagctctcatctccgcatcaaaggaaggccacgtccatatagtggaggagctgttaaaatgcggggtgaatctagaacacagagacatgggcggctggacggccctgatgtgggcatgttacaaaggacggaccgacgtggtggagctgctgctttcgcacggggcaaatcctagcgtcacggggctgcaatactccgtgtatcctatcatttgggcagctgggcgtgggcatgcggatattgtccacctcctcttacaaaacggcgccaaagtcaattgctccgataaatacggcactacccccttggtatgggcagcccgaaaaggacacctggagtgtgtgaagcacttgctggcaatgggggcagacgtagaccaagaaggcgccaattccatgacagctctgatagtggctgtcaaaggcgggtacacacagtccgtgaaggagatccttaaacgcaacccgaacgtaaacctgacagacaaagacggcaacacagcgttgatgatagctagcaaagagggccacacagagatagtgcaggacttgctagacgccgggacatatgtaaatatcccagacagaagcggcgataccgttcttatcggggcggtgcgtggtgggcacgtggagattgtccgtgccttgctgcagaaatacgctgacatagatatacggggacaagataataagaccgctttgtattgggctgtcgagaaggggaacgccacgatggtaagggacatcctgcagtgcaatcctgacaccgagatttgcactaaagatggcgagacgccacttataaaggcaacaaagatgcgcaacatcgaagtcgttgagctgttactggataagggagcaaaggtgtcagccgtagataaaaagggagatacccccctacacatagcgattcgcggtcgctcaaggaaactggccgaattgttgctcagaaaccctaaggatggtagacttctgtatcggcctaacaaggcaggcgagactccctataacattgattgctcccaccaaaagtctatactaacgcagatctttggggcccggcatctgagcccaactgaaactgacggtgatatgcttggctatgatctttattccagcgccctggctgacatcctgtcagagccaacaatgcagcccccaatatgcgtgggcttatacgctcagtgggggagcggtaagtcctttctgctcaagaagctggaggacgaaatgaaaacgttcgccggtcagcagattgaaccactctttcagttctcttggctgatcgtattcctgactttactcctctgcggtggtttaggactgcttttcgcctttaccgttcatcctaatctcggcatcgctgtgtcactcagttttctcgctttgttgtacatcttctttattgttatttacttcgggggccgacgcgaaggcgaaagctggaactgggcttgggtgctctctacccgcctcgctagacatatcggttacctggagctcctccttaaacttatgtttgtcaacccccccgagctccccgagcagacaactaaagctctgcccgttcggtttttatttaccgactacaatcggctatcaagcgtgggtggggagacgtccctcgccgagatgatcgccactctgtcagatgcatgcgagcgtgaatttggtttcctcgccacgcggctgtttcgggtatttaagacagaggacacgcagggtaaaaaaaagtggaaaaagacctgctgcttgccctcttttgttatctttttatttattatcggttgtataatcagtggtatcacccttctggctatctttcgggtcgatcctaaacacctgacagtgaatgctgtgctgattagcatcgccagcgtcgtgggtctggcctttgtgctgaactgtagaacttggtggcaggtgcttgattccctgttaaacagccagcggaagcggctgcacaacgctgcaagcaaattacataagctcaagtcagaagggtttatgaaagttctgaagtgcgaggttgagctcatggcccggatggctaaaaccatcgatagctttacgcaaaaccagacacggctagtggtcatcattgacggcctggacgcatgtgagcaggataaagttttacaaatgctggatacagtacgagttctttttagcaaaggcccttttatagccattttcgctagcgatccacatataataattaaggccatcaatcagaacctgaattccgttttgcgcgatagcaacattaatggccacgattatatgcggaacatcgtccatttacctgtgttccttaattcccggggcctcagtaacgcaaggaaatttctggtgacctctgcaacaaacggagatgtgccgtgctccgatacgaccggaatacaagaggacgcagacaggcgcgtttcgcagaattcgctgggcgagatgacaaaattgggaagcaaaacagctctcaatcgtcgtgacacctacaggcggaggcagatgcaacggacaattacccgccagatgtctttcgacctgaccaaattactggtgactgaagattggttctcggacatctcaccacagacgatgcggagacttttgaatattgtgtcggtcacgggacgtctgttacgagcaaatcagatatcctttaattgggatcgactggcgtcctggattaatctgaccgagcagtggccgtatcgaacatcctggcttatactctacctagaagagaccgaaggtatcccagaccaaatgacactcaagactatttacgaacgatgttgtggtgccgattcatgcgatcgagacagaattggaatctccaagtctgtactcgttgcaatgctgatggagtcctag

SEQ ID NO: 42921 - DNA, 5019 bp, Artificial Sequence
  Description of Artificial Sequence: Synthetic coding sequence
atgatcgccgccgagcagggcaacctggagatcgtgaaggagctgattaaaaacggcgccaattgtaatctggaggatctcgacaattggacagccttgatttccgcaagcaaagaaggacacgtgcatatcgttgaagagctattaaagtgtggcgtgaacctagaacaccgggacatgggtggctggacggcccttatgtgggcatgttacaagggaagaacagatgtagttgagctcctcttgtcccacggggccaatccatctgtgactggcctctacagtgtatatcctattatctgggccgctggacgcgggcatgctgatattgttcatctgctcctccaaaatggtgcaaaggtgaactgtagcgataagtatgggaccacccccctggtctgggcagcacgtaaaggccatttagagtgcgtgaaacacctgttggccatgggtgctgatgtcgatcaggagggggccaatagcatgaccgctctgatcgttgcggtgaagggcggctatacccagtcggtcaaagagattctgaagcgcaatcctaacgtgaatcttaccgacaaggacgggaacactgccttgatgatcgctagtaaagaaggccatactgagattgtgcaagatttgctcgacgcaggaacttatgtgaacatcccagaccgtagcggagacactgttcttataggagccgtgagaggaggccacgtagaaatcgtgcgagccttgctacaaaagtatgccgacattgacatccgagggcaggacaataagactgctttgtactgggccgttgaaaaggggaacgccacaatggtgagagacatactccagtgtaaccctgatacagagatctgcacaaaggacggagagacccccctgatcaaggctacaaaaatgcgcaatatcgaagttgtggagttgctgcttgacaagggggccaaggttagcgcagtcgataagaagggggacactcccctgcacatagcaattagaggtagatctcggaaattggccgaactactgctgagaaaccccaaagacgggagactcctctacaggcccaacaaagccggagagactccgtacaatatagattgtagtcatcagaagagtattctgacacaaattttcggtgccagacacttgtcaccgacggaaaccgacggggacatgctgggctacgacctgtactctagcgccctggctgatatcttgtcagaacctacaatgcagcctcccatctgcgtgggtctgtacgcccagtggggaagtggcaagtcgttcctcctgaagaagctcgaggacgagatgaagacttttgccggccagcagattgaacccctgttccagttctcctggttgattgttttcctgactttgctgctctgcggagggctcggtcttctgtttgctttcaccgtccacccaaatctaggtattgctgtgtcacttagctttcttgcactcctgtacatcttctttatcgtaatctattttggtgggcgtcgagaaggggaaagctggaattgggcctgggtcctgtctactcgactggcccgccacatagggtacttggagttactgttgaaacttatgttcgttaacccccctgaactacccgaacaaaccaccaaagctttacctgtgaggttcctatttacagactataatcggctaagttccgttggtggggaaacctcactcgctgagatgattgctacactgtctgatgcgtgtgaaagagaatttggttttctcgccacccgactgttccgcgtgtttaagaccgaagacacacagggaaaaaagaagtggaaaaagacctgttgtttacctagcttcgtcatcttcctgttcatcattggatgtattatatccggaataactctgttagccatctttcgcgttgatcctaaacacctgaccgtgaacgccgttctgattagcatcgcatctgttgtcggactggcctttgtcctcaactgcaggacatggtggcaggtcctggactccctgttgaactcacagcggaaacgcctccacaacgcggctagtaagttgcataaattgaagtccgaaggtttcatgaaggtattgaaatgcgaagtggagctgatggcccggatggctaaaacaatcgacagctttacacagaatcagactaggctggtcgtgatcatcgacggtctcgacgcctgtgagcaagacaaggtcctccagatgctggacacggttcgcgttctgttctctaaagggcctttcatagccatctttgcatctgacccccatataattataaaagccatcaatcaaaacctcaactccgttctgcgcgactctaacattaacgggcatgactatatgcgcaacatcgtgcacctgccagtgttcctcaactcacgtggactctccaacgcgcggaagttcctggttactagtgccacaaatggagatgtcccttgttctgatactaccggaatccaagaggatgcagacagaagggtttcacagaacagcctcggtgaaatgaccaaactgggatcaaaaacagcccttaatcgacgagacacctaccgcaggagacagatgcaacgaacaatcacgaggcagatgagctttgacctgaccaagttgttggtcaccgaggattggttctctgacatttctcctcagactatgagaagactcctgaatatcgttagtgtaacaggacgcctgctaagagctaaccaaatttcctttaattgggaccgtttggcatcctggataaatctgaccgagcaatggccttaccggacatcctggctgattctgtatttggaggagacagagggtatacccgaccagatgacacttaaaaccatctacgagagaatttctaaaaatattccaactaccaaggacgtggaacctttgctggagatagacggcgacatcaggaatttcgaagttttcctgagtagccgtactccagttttagtggctcgggatgtcaaggtttttttgccatgcacagtgaatctggatccgaaactcagagagattatcgcggacgttagggcagcacgcgagcaaatcagcattgggggcttggcctatccccccctgcctctccacgaaggcccacctcgggcaccctccggctattcccaacccccctccgtgtgtagttccacatcatttaacgggccatttgccggcggagtggtcagcccgcagccccatagctcgtattatagtggtatgaccggccctcagcatccgttctataatcgcggctcggggccagctcctggcccggttgtactactcaattcactgaatgtagacgcagtgtgcgaaaagctgaagcagattgagggactggaccagagcatgctgccccagtactgtactactattaagaaggccaatattaacggccgggtccttgcgcagtgtaacatcgacgagctcaagaaggagatgaacatgaattttggagattggcacctgtttcgatcaactgtgctggagatgcgcaacgcagaaagccatgtagtgccagaggacccccgcttcttatccgagagttcttcgggccctgcaccacatggcgagccagcacggcgggcttcacacaacgaactgccccacaccgagctttcatcccagaccccgtacactctgaatttcagtttcgaggaactgaacacgttgggactcgatgagggagcacctcgacactctaatctcagctggcaatcacagactcggcggactccaagcctgagttccctgaattctcaggactcatccattgagatctctaagctaaccgataaggttcaagcagagtatcgagatgcctaccgcgaatacattgcgcagatgagccaactggagggtggccccggctcaaccaccatttcagggcggagttctccccactccacttattacatgggccagtctagctcaggtgggagcattcactcaaatttagaacaggaaaagggcaaggattccgaacctaaaccggatgatggtcgcaagtctttcctcatgaagcggggagacgttattgactatagctcctcaggcgtgtccacaaacgatgcttcacctctggatccaataactgaagaggacgaaaaatctgatcagagcggaagcaagctgttaccgggaaagaaaagttcagaaagatcgagcctgtttcagaccgatctgaaactgaagggcagcggcctgaggtatcagaaactgccatcagatgaggacgaatccggtaccgaagaatccgataacacgcccctcctaaaagatgacaaggacagaaaggccgaagggaaggtcgaaagagtacccaagtctcccgaacacagcgctgaaccaatccggacctttatcaaggccaaggaatatctatctgatgcattgcttgataaaaaggatagcagcgatagtggcgtacggagctccgaatctagtccaaatcattcacttcacaacgaggtcgccgacgattcccaactcgaaaaggctaatttgatcgagctagaggatgactcgcattctggaaagcgtggcatcccacatagcttgtccgggttgcaggatcctattatcgctcgaatgagtatttgctctgaggataagaaaagtccctctgaatgctcactgatcgcgtcgagtcctgaggagaactggcccgcctgccagaaggcttacaacttaaatagaactccctccacagtgacacttaataataactccgcaccagcaaatcgggcgaatcaaaacttcgatgaaatggagggtatcagggagacctctcaggtgatcctgaggcctagctctagtcctaaccctacaacaatccaaaatgaaaatctcaaaagtatgacccataaacgaagccagagatccagttatactcgcctatcaaaggatccaccagagctccatgcagcagcatcctccgagtctaccggttttggagaggagcgagagtctatactttag

SEQ ID NO: 42922 - DNA, 5259 bp, Artificial Sequence
  Description of Artificial Sequence: Synthetic coding sequence
atgagcgtgctgatcagccagagcgtgatcaactacgtggaggaggagaatatccccgccctgaaggcgctcctggaaaagtgtaaggacgtcgatgaacgcaatgaatgcggacagacacccctgatgatcgcagcagagcaaggcaatctggagatcgtgaaggaattaatcaagaatggcgcaaattgcaatttagaggacctggacaattggacagcactcatcagtgccagcaaggagggacacgtgcacatcgtggaggaactgctgaagtgtggggtgaatctcgagcatcgtgacatgggcggatggacagctctgatgtgggcgtgttataagggccggaccgacgtcgtcgagctccttctgtcacatggcgccaatccttcagttacaggcctgtactctgtgtatcccatcatttgggccgcaggacgaggccatgccgatattgtacatctcctcctgcagaatggagccaaggtcaattgttcagacaagtatgggacaacccctcttgtgtgggctgctcgaaagggacatctggagtgcgtgaagcacctgcttgccatgggcgcggacgtcgatcaggagggagctaactccatgactgccctgatagtcgcggtcaaaggtggctatacccagagtgtgaaggagatcttgaaacggaatcccaacgtgaatctgaccgataaagacggcaataccgctttgatgattgcaagtaaagaaggccatacagagatcgtgcaagatctgctcgacgcgggaacatacgttaacattcctgaccggtcaggagacacagtactcattggagctgtcaggggaggacacgtcgaaattgttcgagcactgctgcaaaagtacgccgacatagatattaggggtcaagacaataagacagctttgtattgggccgtagaaaaaggaaatgcaacaatggtgcgggacatcctgcagtgcaatcctgacaccgagatctgcacaaaggacggagaaacccccctgatcaaagctaccaagatgaggaatatcgaggttgttgagctcctcctggataaaggcgccaaggtgtctgcagtcgacaaaaagggcgacactcccctgcatattgccattcggggccgatcccgcaagcttgcggagctgcttctgcgcaatcccaaagatggtcgcttactctaccgtccgaataaagccggggaaaccccgtataatattgattgttcccatcagaaaagcattttgacacagattttcggggccaggcatctcagccctactgagaccgatggggacatgctcggatacgacctttactccagcgctctcgccgacatactgagcgagccaacaatgcaacccccaatctgcgttggtctgtacgcgcaatgggggagtggaaagtcgtttcttctcaaaaagctggaagacgaaatgaagaccttcgcaggacaacagattgaaccacttttccagttttcctggctaatagtcttcttaacactactgctctgtggcggcctcggtctcctgttcgcatttacggttcaccctaaccttggcattgctgtgtctctgtcttttctcgccctgctgtatatattctttatcgttatctactttggaggacggcgtgagggcgaaagctggaattgggcatgggtcctgagtaccaggctggcccgccacatcggctacttagaattgttgctgaaactgatgtttgtgaaccccccagagcttccggaacagacgacaaaggctttgcccgtgagatttctttttactgactataaccggctcagtagcgttggcggagagacctctctggctgagatgatcgcgacactgtcagatgcttgcgagcgagaattcggctttctggccactagactttttcgcgtttttaaaacggaggatactcagggaaagaagaagtggaaaaagacctgctgcctgccctcatttgtgatttttctattcatcatcggctgcataatttcgggtattactctcttggcaatatttagagtcgacccgaaacacctgacagtgaacgccgtgttaatcagcattgcgtccgtcgtgggcctcgcctttgtgctgaactgtagaacgtggtggcaggtcctcgactctctgctcaacagccaaagaaagcgcctgcataatgctgctagcaaactccacaaactgaagagcgagggcttcatgaaggtactgaaatgtgaggtagagttgatggctaggatggccaaaaccatcgatagttttacacagaaccaaacgcggttggtggtaatcatcgatgggctggacgcctgtgagcaggacaaggtgctgcagatgttggacactgtcagagtgcttttttccaaagggcctttcatagccatcttcgcatctgatccccatatcattatcaaggctatcaaccagaatctgaactccgttctgagagactcaaacattaatggccatgattatatgcgaaacatagtgcacctgcccgtgttcctcaactcccggggacttagtaacgccagaaagttcttagttacatccgccacgaatggggatgtcccttgctccgacactacggggattcaggaagacgctgataggcgcgtgtcacagaactccctcggagaaatgaccaaactgggcagcaaaactgcacttaaccgccgcgacacctaccgtaggcgacagatgcagagaaccataactaggcagatgtccttcgatctcaccaaacttctcgtcactgaagactggtttagcgacatttcaccccagacaatgagacgactcctcaacatcgtgtctgtgaccggaaggctgctaagggccaaccagattagtttcaactgggatcggctggcctcatggattaatcttacggaacaatggccgtaccggacatcgtggctgattctgtatctcgaggagacggagggcatccctgatcaaatgaccctgaaaaccatttatgagcggattagcaagaatattccgactaccaaagatgttgagccactcctggagatcgacggcgatattcgcaatttcgaggttttcctttctagcagaacacccgtgttagtggctagagatgttaaggtcttcttaccatgcaccgtcaacctggaccccaaactgcgggagatcatcgctgacgtgcgggcagccagagaacagattagtattgggggcctcgcctacccacctctaccgctgcacgagggacccccaagagccccctctggttacagccagccaccatctgtctgtagcagtacctccttcaatggccctttcgctggaggcgtcgtctctccacaacctcacagctcttattattcaggtatgaccggaccccagcatccattctataatcgcccgtttttcgccccctacctgtatacaccaagatactaccctggcggctcccagcacctgatcagtagaccatcggtgaagacttctctcccccgagatcagaacaacggcttagggagcggccctgctcccgggcctgtagtgttgttaaattccctcaacgtggatgccgtgtgtgaaaaactgaagcagatagaaggattggatcagagtatgttgccacaatattgcacaaccattaagaaagctaatatcaatggacgggttctggcacagtgtaacatcgacgagcttaagaaggaaatgaatatgaacttcggcgactggcacctatttcggtctacagtgctggaaatgcggaatgccgaatcccacgtagttccagaggatccaagatttctctctgagagctcttcaggtcccgcccctcatggggaacccgctagacgcgcatcacataacgaactgcctcatactgagctttcttctcagacaccctacactcttaacttttcctttgaagagttgaacactctggggttggacgaaggggcccctcgacacagcaacctttcctggcaatctcagaccagacgaacgccgagcctgtctagtcttaactcacaggattcatcaatcgagattagtaaactgacagacaaagtacaagctgagtaccgtgacgcttacagagagtacattgctcaaatgagtcagttagaaggggggccggggagcacaaccatcagcggtagatcctccccgcactcaacctactacatgggccagtccagttcaggaggatcaattcattcaaatctcgagcaagagaaagggaaggattcggagccaaagccggatgatggacgcaagtcttttctgatgaaaagaggggacgtcatcgactactcaagttctggcgtgtctacaaacgacgcatctccactagaccctatcacagaggaagatgagaaaagtgatcaatctggctctaagttactcccagggaaaaagagctcagagcggagttcgctctttcagacagatctgaagctcaaaggctctgggctgcggtaccaaaagctgccgtcagacgaggatgagtctggaacagaggaatccgataatactcccctcctgaaggacgacaaagatagaaaggctgagggcaaagttgaacgtgtgcccaagtcacccgagcatagcgccgagccaatccggacattcataaaggctaaagaatacctgagcgacgcactcctcgataaaaaggattcatccgactcaggggtcaggtcttccgaaagtagcccgaatcactctctccacaacgaggtggccgacgactcacagttagaaaaggcaaacctgatcgagttagaagacgactcccactcaggaaaacggggcatcccacacagcctgtcgggtcttcaggaccccataattgcaagaatgtcaatctgcagtgaagacaagaaatccccaagcgagtgctcgcttatcgcatccagccccgaagagaattggcccgcctgccaaaaagcctataacttaaatagaacacctagcacagtcactctgaataacaattcagcgcctgccaacagagcaaaccaaaatttcgacgaaatggagggcattcgggaaacctctcaggttatcctgcggcctagctcctcccccaatccgactaccatacaaaatgagaacttaaagtccatgacccacaaaaggtcacagcgatcgagctatacccggttgtcaaaagacccgccagagcttcacgctgccgcttcctccgagtccaccggatttggggaggagcgggagagcatcctgtag

SEQ ID NO: 42923 - DNA, 5259 bp, Artificial Sequence
  Description of Artificial Sequence: Synthetic coding sequence
atgagcgtgctgatcagccagagcgtgatcaactacgtggaggaggagaatattcccgctttgaaagctctcctcgaaaagtgcaaggatgtggatgagcgtaatgaatgtgggcagacacccctgatgatcgcggccgagcaaggaaacttagaaattgttaaagagctcatcaaaaacggggccaattgtaacctggaggacttggataattggacagccttgatctccgcctccaaggagggacacgtgcatattgtagaagaactgctcaaatgcggtgtgaacctggaacacagggatatgggaggctggaccgccctgatgtgggcatgctataaaggcagaactgatgtggtggagctactgctctcccatggtgctaacccatctgtgaccggactgtatagtgtctatccgatcatatgggcagccgggaggggtcacgctgatattgtacaccttctgctgcagaacggtgcaaaagttaattgctctgacaagtatggcactacacccctggtttgggcggctagaaaaggtcatctcgagtgtgtgaaacatttgctggctatgggcgcagatgttgatcaggagggtgccaactctatgaccgcacttattgtcgccgtgaagggaggctacacacagagcgtgaaggaaattttaaaacgtaaccctaatgtaaatttgaccgataaagatggcaacaccgccctgatgatcgctagcaaagagggacacaccgagatcgtacaagacctattggatgcaggcacttatgtgaatatccctgacagatcaggagacacagtgctaatcggggcagtgcggggcggccatgtggagatcgtgcgagcattgcttcagaaatacgccgatatcgatatcagggggcaggataacaagaccgctttgtactgggcggttgagaagggcaacgctacaatggtgcgcgacatattgcagtgtaatcctgataccgaaatctgtactaaggatggagagacccctctgatcaaggctacgaagatgcggaacatcgaagtggtggaactgctgttggataaaggtgccaaggtctccgccgtggacaaaaagggtgatacccctctgcatatcgctatcagagggaggtcccgaaaactggccgagttacttctgaggaacccgaaggatggacggctcctgtaccgaccgaacaaggctggcgagacgccgtacaacatagactgctctcatcagaagtcaatactgactcagatctttggggctagacacttaagccctactgagactgacggtgatatgttgggatacgatctgtacagctccgcactcgcagacatactgagcgagccaactatgcagcccccgatttgtgtgggcctatacgcacaatggggctccggaaagagcttcctattaaaaaagctggaagacgagatgaagaccttcgcggggcagcaaattgagcctctgttccagtttagctggctgatcgtgtttctgacgctgcttctttgtgggggcctcggccttctgtttgcatttacagtgcaccccaatctggggatagccgtgagtctgagtttcctggcgctcctgtacatcttcttcattgtgatttatttcggtgggcggagggagggggagtcatggaattgggcttgggtgctcagcaccaggttagccagacacattggttatctggagctgttgctgaagctcatgttcgtgaatcccccggagttgccagagcaaacaaccaaagctctgcccgtacggtttctgtttaccgattacaatcgactgtcctctgtggggggagagacctctctggccgagatgatcgcgactctgtctgatgcctgcgagcgcgagttcggctttttggccacaaggcttttcagagtgtttaagactgaggatactcagggaaaaaagaaatggaaaaaaacgtgttgcttacccagtttcgtgattttccttttcataatcggctgtatcatcagcggtatcacactcctggccatctttcgggtggacccaaaacacctgacggtgaacgctgtgctgatcagcatcgcctccgtggtgggtctggccttcgttctaaactgtcgtacgtggtggcaggttctcgactctctcctgaattctcagaggaagcggctccacaacgccgcctcaaaattgcacaaactaaagagcgaaggtttcatgaaagtgttgaagtgcgaagtcgagctgatggcacggatggcaaaaacaatcgactcattcacgcagaatcagacccgcctcgttgtgattattgacgggctggatgcctgcgagcaagacaaggtattacagatgctggacaccgtgagggttctgttctctaagggccctttcatcgccatctttgccagtgatcctcacatcatcatcaaagccatcaatcagaatctaaactccgtactgagagactccaatattaacggccacgattatatgcgaaacattgttcaccttccagtctttctgaactcccgggggctttctaacgctcggaagttcttggtgacatcggctaccaacggggacgtgccctgtagtgacacgactggtatccaggaggatgccgaccgaagagtctctcaaaattctctcggcgagatgacaaagcttggtagcaagacggctctgaatagacgcgatacctatcgaaggcgccagatgcagagaactattaccagacagatgagcttcgacctgactaaattactcgtcactgaggattggttctccgacatttcgccacagactatgcggaggctcctgaacatcgtcagtgttactggcagactgctgagggcaaaccaaatctcctttaactgggatcgattagcctcctggatcaatttgaccgaacagtggccgtatcgtactagctggttgatcctctacttagaggaaaccgagggaatacccgaccagatgactctgaaaactatatatgaaagaatctccaagaacattcctactactaaagacgtagagcctctgctcgagatcgatggagacataagaaacttcgaggtctttctgtccagtcgaacacccgtgctggtggctagagacgtcaaagtctttcttccctgtacggtgaacctcgatccaaagctccgggagatcattgcggacgtgcgcgccgcgagggaacagattagcatcggggggctggcatacccgccactgcctcttcacgaaggaccaccacgggccccttccggatacagtcaaccaccgagcgtttgctcttcaacttcctttaatgggccattcgccggcggcgtggtgtcgccacagccccattcaagctactatagtggtatgacggggccccaacatccattctataatagacctttcttcgccccctacctgtacacccccaggtactatccaggggggtcccaacacttgatatctagaccctctgtgaaaacctccctccctcgcgaccagaataatggcttgggaagcggccccgctcctggcccagttgtgctgctgaactccctgaatgtggatgcagtctgtgaaaaactgaagcagattgagggtttggaccagagcatgttgccccaatattgtacaacaattaagaaggctaatatcaacgggcgtgtgttagctcagtgcaacatcgacgagctcaagaaagagatgaacatgaatttcggagattggcatctttttaggagcaccgtgctagagatgcggaatgccgagtcccacgtggtcccagaagaccccagatttctcagtgaatcctcctctggcccagctccacatggtgaacccgctcggcgcgcctctcacaacgagctgccccacaccgagctgtccagccagactccctacaccctgaactttagtttcgaagaactgaatactctggggttagacgagggggctccccggcattcaaacctctcgtggcaatctcaaactcgacgtaccccctccctgtcctcacttaactcccaagactcgagcattgaaatatctaagctcacggataaagttcaggccgaatacagagatgcatatagagaatatatagctcaaatgtctcaactcgaaggagggcccggtagcacgaccatttccggccgctcatcccctcacagcacctattacatgggccagtcgtcatccggcgggtctatccatagcaacctggaacaggaaaaaggcaaggacagcgaacctaaacctgatgacgggagaaagtctttcctcatgaagagaggtgatgtaattgattattcctcaagcggcgtaagcactaacgacgcttcccctcttgatcccattacagaagaagacgaaaaatcagatcagagcgggtctaagctacttccaggcaaaaaatcatccgaaaggagctctcttttccaaaccgatcttaaactcaagggcagtgggctgagataccaaaagctgccatccgatgaggacgaaagcggcacggaggagtcagataacacccccttactcaaagatgacaaggatagaaaggccgagggaaaagtggagcgcgtgcccaagagcccagaacacagtgccgagcccatccgtaccttcatcaaagcaaaagaatatttgtccgacgctctgctggacaagaaagattcatccgacagcggcgtgagatcctccgagtcctctccaaaccactcactccacaatgaggtcgcagacgactcccagctcgagaaagcgaacctgatcgagctggaggacgactcccacagcggaaagagaggaattccacattcgctgagcggactgcaagatcctataatagctcgcatgtctatttgcagcgaggataaaaaatcaccatctgagtgcagccttattgcctcttcaccagaggagaattggcccgcctgtcagaaagcgtataacctgaataggaccccctccactgttacattgaacaacaatagtgccccggcaaacagggccaaccagaactttgacgagatggagggcattagagaaacatcccaagttatcttgagaccctcatcctctcctaatcctacaacaattcagaacgagaacttgaagtctatgacccacaaaaggtcgcagcgaagcagttataccaggctgtcaaaggaccctcctgagcttcatgcggctgcttccagtgagtctaccgggtttggcgaagagcgcgagtctatcttgtag

SEQ ID NO: 42924 - DNA, 2985 bp, Artificial Sequence
  Description of Artificial Sequence: Synthetic coding sequence
atggtgcgggacatcctgcagtgcaaccccgacaccgagatctgcacaaaagacggcgagactccactgatcaaggctaccaaaatgagaaatatagaagtggttgaattactcctggataaaggggcaaaagtgtccgctgtcgataagaagggcgacacccctctacacatcgctatccggggcaggagtcgcaagctcgccgagctcctgcttcgcaacccgaaggacggtaggctgttgtatagaccaaataaggctggggaaactccctataatattgattgcagccaccagaagtctatactcactcaaatctttggagcaaggcacctcagcccaacagagacggatggagacatgcttggttacgacttgtactcatccgccctggcagatatactgtccgagccgaccatgcaacctcctatctgcgtagggttatatgcccaatggggttcgggaaagtcttttctactgaagaagctcgaggacgaaatgaaaacattcgccggtcagcagatcgaaccgcttttccagttttcctggctcattgtgttcctgaccctgttgctatgcggcggcctgggtctactctttgcattcacggtccatcctaatctgggaattgccgtctccttaagcttcctagctctcctttatattttttttatcgtcatctactttgggggccggcgggagggtgagagctggaattgggcatgggtcctttccacacgcctggcccgccacataggctatttagagcttctgctgaaactgatgttcgtcaatcccccagagctacccgagcagacgactaaggctttacccgtccgcttcctgttcactgattataataggctgagcagcgtgggaggcgagacatcccttgcagaaatgattgccaccttgagcgatgcctgtgaaagggagttcggtttcctcgccacacggttatttcgggtgtttaaaaccgaagacactcagggcaaaaagaagtggaaaaaaacctgttgtctcccttcattcgtcatcttcctgttcattattgggtgtatcatttctggcataactcttctagcaatttttcgggtggaccctaagcatctcacagtgaatgcagtcctgataagtatcgccagcgtagtgggccttgcgtttgtgctcaattgcaggacatggtggcaggtgctggactctctcctcaatagccagcggaagcgtctgcataatgctgcatctaagctccataagctcaagtccgagggctttatgaaagtgctgaagtgtgaagtagagctgatggctagaatggctaaaaccatcgacagttttactcaaaatcaaacacgcctggttgtcatcattgacggcctcgacgcctgcgagcaggacaaggtattacaaatgctggacactgttagggtcctcttcagcaaaggtccgttcattgccatctttgcatccgatccacacataatcattaaggccattaatcaaaacctgaattcagttcttcgagactccaacatcaacggacacgactatatgcgtaatattgtacatttgccagtttttctgaattctcgcggcctctccaatgcccggaagttcctcgtcacctctgccactaatggggacgtcccatgctccgacacaactgggattcaggaagacgcggatcgacgagtgtcccagaattcactcggcgaaatgactaaacttgggtccaaaacagcacttaaccggcgtgatacctatcggagacggcaaatgcagagaacaattacccgccagatgtccttcgacttgactaagctattggtgacggaagattggttcagtgacatcagtccccagacgatgcgtcgtcttctaaatatcgtgtctgttacaggccgcctgctcagggccaatcagatctcctttaactgggacaggcttgcctcgtggatcaacctgacggaacaatggccctacaggacctcctggctgatactgtatctcgaagaaacggagggaattcctgatcaaatgaccctaaagaccatctacgaaagaatctcaaaaaatattcccaccacgaaggacgtagaacctctgctcgagatcgatggggatatccggaattttgaggtgtttctctcgagtcgaacacctgtcttggtagcccgggatgtaaaggtgttcctgccatgtactgtgaatctggaccccaaacttagagaaattatcgccgacgtgagggctgctcgcgagcagatctctattggagggctcgcttacccccccctcccactgcatgagggacctcccagagccccatcaggctactctcagccacctagcgtctgtagctccacgtctttcaatggcccctttgccggaggcgttgtctcccctcagccgcatagttcgtattacagcgggatgaccgggcctcagcatcctttctacaacagagggtctggacctgcgcccggccccgttgttctactaaactctctgaacgtagacgccgtgtgcgagaagctcaagcagatcgaggggctagatcagtccatgctccctcagtactgcacaactatcaagaaagccaacattaatggaagagttctcgcgcaatgcaatattgacgagctgaagaaggagatgaatatgaacttcggcgactggcatctgttccgcagcaccgtgctcgaaatgcgcaatgccgagagccacgttgtgccagaggatccacgattcctctcagaaagcagttccggtcccgccccccatggcgagcctgcaaggcgcgccagtcacaacgaactcccccatactgaactgagttcacaaaccccgtacaccctgaacttttctttcgaggagctcaacacgttaggacttgacgaaggagcccccaggcattctaacctgagctggcaagaggagaacgcagggctggagattgacagttcgtccgaggatccagattag

SEQ ID NO: 42925 - DNA, 3954 bp, Artificial Sequence
  Description of Artificial Sequence: Synthetic coding sequence
atggccagcgtgaaggtggccgtgcgggtgcggcccatgaaccggcgcgaaaaggacctggaagccaaattcattatacagatggaaaagagcaagactacaatcacaaacctcaaaattcccgaaggcggcactggggactcagggcgggaacgcaccaagacatttacatatgattttagcttctatagcgcagatacaaagagccccgattacgtgtcccaggaaatggtctttaagaccctgggcactgacgtagtgaagtccgctttcgagggctataatgcctgtgtcttcgcctatggccagactggatcaggtaagtcatacacaatgatgggcaactcaggagactcaggcttaatcccgcgtatatgtgagggcttgttcagtaggatcaacgagactacaagatgggacgaagcttccttcaggactgaagtcagctatctggagatctataatgagcgtgttcgcgatctgctccgccggaaaagctctaaaacattcaacctccgcgtacgggaacacccaaaagagggcccttatgtcgaggacctctccaagcaccttgtgcaaaactacggggacgtcgaggaactcatggacgctgggaacataaacagaaccacagctgccacggggatgaatgatgtctcgtcacggagccacgccattttcacgatcaaattcacacaggcgaaatttgactctgagatgccatgcgagacagtgtctaaaattcaccttgttgaccttgccggttctgaaagagccgatgccacaggcgccactggtgtgagactgaaggaaggcggcaatatcaataaatcgctggtcaccctggggaacgtgatttctgccctggcagacctgtcacaggacgccgcaaacacgctggctaagaaaaaacaggtcttcgtgccttatcgggattctgtactcacatggcttctgaaggactcactagggggaaatagcaaaaccataatgatagcaacaatcagcccagccgatgttaactacggggaaaccttgagcaccttgcggtacgcaaatcgcgccaaaaacattatcaataaacccacaatcaacgaagacgccaacgtcaagcttattagggaattacgcgccgaaatcgccagactgaaaactcttctggcccagggcaaccagatagccctgcttgactcaccaacggctctgtccatggaagagaaattacagcagaatgaagcccgcgtgcaggaactcactaaggagtggactaataagtggaacgagacccagaatattctgaaggagcagacactcgcgttacggaaggagggcataggcgtggtactggactccgagcttcctcatcttataggaatagatgatgatctgctttcgacaggcatcatcctatatcacctgaaggagggacagacgtatgtgggtagagatgatgccagcaccgagcaggacatcgtgctgcacggcctggacttggaatctgagcactgcatctttgaaaacatcggtggaacagttaccctaattcccctgtccggcagccaatgctccgtcaatggggtgcagattgtggaggctacccaccttaatcagggggccgtgatattgcttggtcggaccaacatgttccgatttaatcaccccaaagaagccgctaaactgagagagaagagaaagtctggcctgctgagtagtttctccttatcgatgactgatctcagcaagtcacgagagaatctgagtgctgtgatgctgtataatcccggacttgaatttgaaagacagcagcgagaggagttggaaaaactggaatcaaaaaggaaacttatcgaggaaatggaagagaagcagaagagcgacaaggcagaattagaaagaatgcagcaggaggtggagacacaacgcaaagaaacagagatcgtacagttacagattaggaaacaagaggaatccttaaagcggagatcttttcacatcgagaacaaactcaaagacctcttggctgaaaaagagaaatttgaagaagagcggctcagagagcagcaggagatcgagctccagaaaaaacggcaggaagaggagactttccttcgagtgcaagaagagcttcaacgattaaaagaactcaacaacaatgagaaggccgaaaagttccagatttttcaggagctcgatcagcttcagaaggaaaaagacgagcagtacgccaaacttgagctcgagaagaaaaggctggaagagcaggagaaagagcaggtgatgctggtggcccacctcgaagagcagctgagagaaaagcaggaaatgatccagttgctgcgccgaggagaagtgcagtgggtcgaggaggagaagcgcgacttggaagggattcgcgaatctctcctgcgagtgaaagaggcccgcgctggaggagatgaggacggcgaagaattagaaaaggcgcagctcagattttttgagtttaagcgcaggcagctcgttaagcttgtgaacctggagaaagatcttgtgcagcagaaggacatcctgaagaaggaggtgcaggaggagcaggaaatcctcgaatgtttgaaatgtgaacatgataaagagtcacgcttgctagagaagcatgatgagtccgtaaccgacgtcaccgaggtcccgcaggatttcgagaaaataaagcccgtggagtatcgcctgcaatataaggagaggcagctgcagtacctgctccaaaatcaccttcctacgctcctggaggagaagcagcgagcctttgaaatcctcgatcgggggccattaagtcttgacaatacactgtaccaggtcgagaaggagatggaagagaaggaagaacagctcgctcagtaccaggccaatgcgaaccagcttcagaagctgcaggctaccttcgagtttaccgctaatatcgccagacaggaagagaaggtgaggaaaaaggaaaaggagattttggaatctagagaaaagcagcagcgcgaggccctggagcgagcattagctagattggagaggcggcattctgcccttcagcgccattcgaccctgggcatggagatagaggagcagagacagaagctggctagtcttaacagcggaagccgggagcagtctggcttacaggcaagcctcgaggccgaacaagaagccctagaaaaagatcaggaaagactggagtatgagatccaacagttgaagcagaagatctatgaagtggatggagtccagaaggaccaccatggaacactagaaggtaaggtggcgagctcatccctgccagtatctgccgaaaagagccatttggtgccactaatggacgcccgtataaatgcttatatcgaagaggaagtgcagagaaggttgcaggacctccatcgggtgatcagcgaagggtgctccacatctgccgacactatgaaagataacgaaaaattacacaatgggactatccagcgcaaactgaagtacgagaggatggtgtccagatccctcggggctaaccctgacgatctcaaggaccctatcaaaatcagtatcccccgttatgtattgtgtggtcagggcaaggatgcacattttgaatttgaggttaagattaccgtgcttgatgagacatggactgtgtttcgtaggtacagtaggttcagagagatgcacaagacactgaagctcaaatacgcagaattagccgccttggaattccctccgaaaaaactcttcgggaataaggacgaacgtgtaatcgccgaacgcaggtcccacttagagaaatacctgcgggacttttttagcgtgatgctgcagtccgctacctcacccctacacatcaacaaggtggggctcacactgagcaagcataccatttgtgaattttctcccttctttaagaagggtgtctttgactatagctcccacggcactggctag

SEQ ID NO: 42926 - DNA, 3864 bp, Artificial Sequence
  Description of Artificial Sequence: Synthetic coding sequence
atggccagcgtgaaggtggccgtgcgggtgcggcccatgaaccggagagaaaaggatcttgaagcaaagtttatcatccagatggaaaaatccaagaccacaattactaatctcaaaattccagaggggggtactggagacagtggacgcgaaagaaccaagacattcacttacgacttctccttctactcagctgacactaagagtccagactatgtgagccaggaaatggtgttcaagaccctgggtaccgatgttgttaagagcgctttcgaaggatataatgcgtgcgttttcgcttacgggcagacgggatctgggaagtcttacactatgatgggtaacagtggcgatagcggtctgattccacgaatttgtgagggcctctttagcagaataaatgagacaaccagatgggacgaggccagctttagaacagaagtttcttacttagaaatttataatgagcgcgtgagggatctactacgtcgcaagtcctcaaagacctttaatctcagagtgcgggaacatccaaaggaaggtccttatgtagaggacttgtcgaaacatctggttcaaaactatggcgacgtggaggagctgatggatgccgggaatatcaatcgtaccacggctgcaacaggtatgaacgacgttagctcccgcagccacgcgatattcaccataaaatttacccaggctaagttcgatagcgaaatgccctgcgagacagtgtctaagatccacttagtggatctcgccggctcagagagggctgatgctactggggcaacaggtgtgcggctgaaggagggtgggaatatcaataagtccctcgtgactcttgggaacgtgataagcgctcttgctgacctgagtcaggacgcagccaacacgctggccaaaaagaaacaggtgttcgtgccatatagggactcggtgctgacttggttgctcaaagactctctcggaggaaattctaagactatcatgatcgctacaatatccccagccgacgtaaattatggcgagaccctctcgacgcttcgctatgccaatcgcgcaaagaacattattaacaagccaaccattaatgaggacgcgaacgttaagcttatcagggaactcagagcggagatagctaggctgaagacactgctagcgcaggggaaccaaatcgcgctcctcgacagcccaacagccctctctatggaagagaagctacagcaaaacgaagccagggttcaggagctaacaaaagagtggaccaataagtggaacgagacccagaatattttgaaggagcagacccttgctctccgcaaagaagggatcggtgtcgtgctggactcagagctgcctcacctgatcggaatagacgatgacctgttatccaccggaataattctgtaccacctcaaggaaggacaaacatacgtcggacgggacgacgcctccactgaacaggatattgtgttacacgggctggaccttgaaagtgaacactgcatcttcgagaatataggagggacagtgaccctcatacccttgtctgggtctcagtgttcagtgaacggcgttcagatcgtggaagccactcatctcaatcaaggcgccgttatcttattaggaagaacaaacatgtttagatttaatcatcctaaagaggctgccaaactgagggaaaagagaaagtcagggctgctgtcctcattttccctgagcatgactgatttatccaaatcgcgagagaacctgagcgcggtgatgttgtacaatccaggactggagttcgaacgtcaacagagagaagaactggagaagctggaatctaaacgtaagctgattgaagagatggaggagaaacagaaaagcgataaggctgaactcgagaggatgcagcaagaggtggaaacccaacgcaaggaaacggaaatcgtccagctgcagatccggaaacaggaagagtcactcaaacgtagatcctttcatatcgagaacaagctcaaagaccttcttgccgagaaggaaaagttcgaggaagaacggttgcgagagcaacaggagattgagctgcaaaaaaagaggcaggaggaggaaacattcttgagagtccaagaggaactgcaacgcctaaaggaactcaataacaacgagaaggctgagaaattccagatcttccaggaactcgatcagttgcagaaggaaaaggatgaacaatacgctaaactcgagctcgagaaaaaaaggcttgaagaacaggagaaagagcaggtgatgctcgtggctcatctggaagagcagctgcgggaaaaacaggagatgatccagctgcttaggcggggcgaagtgcagtgggttgaagaggaaaaaagagacctcgaaggaatccgcgaatcactgctcagagttaaggaggccagagccgggggcgatgaagacggcgaggaactcgagaaagcacaactcagatttttcgaatttaaaaggcgccaattggttaagttggtgaacctggaaaaagacctggtgcaacagaaagatatcctgaagaaggaggtccaggaagaacaggagatcctggagtgcctgaagtgcgaacacgataaggagagcagactgctagaaaaacacgatgagtccgtgacggacgtgaccgaagtgcctcaagactttgaaaagataaagcctgtggagtacaggctgcaatacaaggagcgccaactccagtacctacttcaaaatcatctgccaaccctgctagaagaaaagcagagggcattcgagattctggatcgcggtcccctgtcacttgataacactctataccaggtcgagaaggagatggaggagaaggaagagcagttggcacagtatcaggctaacgctaatcagctccagaagcttcaagccacctttgaattcaccgccaatattgcccgccaggaggagaaggtgagaaagaaggaaaaggagattctggagtctagggagaagcagcagcgggaagcactggaacgcgctcttgctcggttggagcggcgtcactcagccttacaacgacattctacacttgggatggagatagaggaacagcgacagaaacttgcgagcctgaattctggctctagggagcagtccggcctccaggcttcactcgaggcggaacaagaggcacttgagaaggatcaggaacggcttgaatacgagatccagcagctcaagcagaaaatttacgaggtggacggtgtacaaaaggaccaccatgggacgctggagggaaaagtggcatcaagcagcttaccagtgtccgccgagaagagccatttagtacctctcatggacgcgcgcatcaatgcctacattgaggaagaggtgcagcggagactccaggatcttcaccgcgtgattagtgagggttgtagtaccagcgccgacacgatgaaagacaatgaaaagctccacaatgggactattcagcgaaaactcaagtacgagagaatggtgtcacggtcactcggcgcaaatcctgacgacctgaaggatcctataaagatcagtataccaagatacgttctatgtggccagggtaaagacgcccactttgagtttgaagtcaagttggctgcactggagtttccccctaagaaactcttcggcaataaagatgagcgggtgattgcagaaaggcgttctcacctggagaagtacctgcgggatttttttagcgtcatgctgcagtccgccacctctcccctgcatattaataaggtcggccttacgttatccaaacatactatctgcgaattctcgcccttcttcaagaaaggcgtgtttgattactctagccacgggaccggatag

SEQ ID NO: 42927 - DNA, 3486 bp, Artificial Sequence
  Description of Artificial Sequence: Synthetic coding sequence
atggccagcgtgaaggtggccgtgcgggtgcggcccatgaaccggagggagaaggatctggaggcaaagttcattatccagatggagaagtcaaaaaccacaatcacaaatctgaagattcctgaggggggcaccggagattcaggccgggaaaggaccaagacatttacctacgactttagcttctacagtgccgacaccaagagccccgattatgtctcacaagagatggtttttaaaactctcggcactgacgtggtcaagtccgccttcgagggctacaatgcttgcgtttttgcatacgggcagacaggctctggcaaatcctacaccatgatgggcaactctggggacagcggattgatcccacggatctgcgagggtttgttttccagaataaacgagacaacaagatgggatgaggcctcattccggacagaagtctcctacctcgaaatctataatgaacgcgtaagagacttactacggagaaaatcttccaaaacctttaacttacgcgtgcgtgagcaccctaaagagggaccatatgtggaagacctgtcaaagcatctcgtccaaaactacggggacgtggaagagctaatggatgccggaaacattaacagaactaccgctgcgacagggatgaatgacgtttccagcaggagccatgctattttcacaatcaagttcacccaggctaagttcgactcggagatgccatgtgagacggttagtaaaatccatctggtcgacctggcaggcagcgaaagagcagatgctacaggagcgacaggagtaagattgaaggaaggcggaaacattaacaagagtttagtcaccctcggtaacgttatctccgctttggccgacctgtctcaggatgctgctaacaccctcgccaagaagaaacaggtgttcgtgccgtacagggatagcgtcctcacatggttgttaaaagattcactgggtgggaactccaaaactatcatgatcgcaacaatttctcccgctgatgtgaattacggggaaactttgagcacattgaggtacgcaaaccgcgcaaaaaacataatcaataagcctaccatcaatgaggacgctaatgtaaaattaattagagagctgagggccgagatagctagactcaagacactcctcgctcagggaaaccagatcgcacttctggacagccctacagcattgtccatggaggaaaagctccaacagaatgaggcgcgcgttcaggagctgacaaaggaatggacaaataaatggaacgaaacccagaacattcttaaagaacagacactggccctacgcaaggaaggaatcggagtggtcttagactccgaactccctcacctaattggaattgacgacgacttgctgtccacaggtattatcctttatcaccttaaggaaggccagacatatgttggtagagatgacgcctccaccgagcaagatattgtccttcatggcctggatctcgagagtgagcactgcatcttcgagaatattggagggacagtcactttgatacctctatcgggctctcaatgctccgtaaatggagtgcaaatcgtcgaagctacccatctgaatcaaggcgcagtaatcctcctgggaagaaccaacatgttccggtttaatcaccctaaggaggccgccaagctgagagagaagcgcaagtccggactgctctcctctttcagcttgagtatgacggacctgtcaaaaagccgggagaatctgagtgctgttatgttgtacaatcccgggctcgagttcgagaggcagcagcgagaggagctggaaaagctggagagcaaaaggaagctgatcgaggaaatggaggaaaaacagaaaagcgacaaagccgaattggagagaatgcaacaggaagtagaaacccagcggaaagagacagagattgtgcagctgcagatccgcaagcaggaagagtccctgaaacggcggagcttccacatcgaaaataagttgaaagaccttcttgccgaaaaggagaagtttgaggaagagcgcttgaaggatctggtgcaacaaaaggatatactgaaaaaggaagtgcaggaggagcaggagattttggaatgcctgaaatgtgaacacgacaaggagtccagactcctcgagaagcacgatgagtctgtgacagatgtgactgaggttccacaagacttcgagaaaattaagcccgtggagtacaggttgcagtacaaagaaaggcagttgcaatatctgctgcagaaccaccttcctacccttctcgaggagaagcagcgggccttcgaaatcctcgatagaggaccgctgagtctggataatacgctgtaccaagtcgagaaggaaatggaggagaaagaggagcagctggcacagtaccaggccaacgcaaaccagctccaaaagttgcaggccacattcgagttcactgccaatatcgccagacaagaggaaaaagtccggaagaaagaaaaggagatccttgagagccgcgagaagcagcaaagggaagcactggaacgggccttggctcgtctggagagacgacacagtgcccttcaacggcactccaccttgggaatggagatcgaagagcagcgacaaaaactcgcgagccttaatagtggatccagagagcagagtgggctgcaagccagcctggaagccgagcaggaggctctcgaaaaggaccaggagagactggagtacgagattcagcagcttaagcagaagatttatgaagtcgacggtgttcagaaagatcaccatggaacgcttgaaggcaaggtggccagctcttcgctccccgtctctgcagaaaaatcccaccttgtcccacttatggatgctcgaatcaacgcgtacatcgaagaagaagtccagaggcgccttcaagatctgcaccgggttatatctgagggttgtagtacatccgcagacaccatgaaagataatgagaagttgcataatgggacgatccagcgcaaactaaagtacgaacgcatggtaagcaggtctttgggagcgaacccggatgatttgaaggatcctatcaaaatctccataccaagatacgtgctttgcgggcagggcaaggatgctcacttcgaattcgaagtgaagatcaccgtgcttgatgaaacatggacggtcttccggcgttacagtcgcttccgcgagatgcacaagaccctaaagctgaaatacgcagaactggccgccctcgagtttccccccaagaagctgtttggcaacaaagacgagagagtgattgccgaaaggcgctctcacctggaaaagtacttaagggacttcttcagcgttatgcttcagagtgctacttctccactgcacattaataaggttggccttactctttccaaacacacgatttgtgagttttctccattcttcaagaagggggtctttgactattcgtcacatggaaccggctag

SEQ ID NO: 42928 - DNA, 1509 bp, Artificial Sequence
  Description of Artificial Sequence: Synthetic coding sequence
atgatccagctgctgcggcggggcgaggtgcagtgggtggaggaggagaagagggacctcgagggcatcagggaaagcctcctgcgcgtgaaggaagcacgtgctggtggcgacgaggatggagaggaattggagaaggctcagttgcggttcttcgagtttaagcgaaggcaactggtgaaactggtcaaccttgagaaagacctggtgcaacagaaagatattctgaagaaagaggtgcaagaagaacaggagattctggaatgtctgaagtgtgagcacgataaggagtcacggctgttagagaagcacgacgagtcagtgacagatgtcaccgaggtgccacaagactttgaaaagataaaacccgtagagtacaggctccagtataaagagagacagttacagtacttactccagaatcatcttcccaccctgctggaggagaaacaacgagcctttgaaattttggaccgtgggcccctgagcctggataacactttgtatcaggtggagaaggagatggaggaaaaggaggagcaactcgcccagtaccaagcaaatgcaaatcagttgcagaagctgcaggcgaccttcgagtttacagctaatatcgcgcgacaggaggagaaagtccgaaagaaggagaaagaaatactggagtctcgggagaagcagcagagggaggcgctggagagagcgctggccagacttgagcgccgtcactctgctctccaaaggcattcaactctcggaatggagatcgaggagcaaagacagaagctcgcttcccttaatagtgggtctagagagcagagtgggcttcaggctagcttagaggctgagcaggaggctcttgaaaaagaccaggagaggcttgaatatgagattcaacaactaaagcaaaaaatctacgaagtagacggggttcagaaggatcatcatggtacactggagggcaaggtggcgagtagctccctccctgtgtctgcagagaagtctcacttggtcccattgatggatgccaggattaatgcctacattgaggaagaggtccaacgtcgactgcaggatctgcacagagtgatcagtgagggttgctccacatctgccgacacaatgaaggacaatgagaagcttcataacggtactattcaacgaaaattgaagtatgaaataactgtgctggacgaaacttggaccgtgtttcggaggtacagtcggttccgggaaatgcacaaaacattaaaacttaaatacgcagaattagccgcactcgaatttccacctaagaaactgttcgggaacaaagacgaacgcgtaatagccgagcgcaggagccaccttgaaaaatatttgcgggatttcttcagtgtaatgctgcaaagtgctacctcccccctccacatcaacaaggtcggtttgactctgtcaaagcacacaatctgcgagtttagtcctttctttaaaaagggggtgtttgattacagtagccacgggaccggttag

SEQ ID NO: 42929 - DNA, 4179 bp, Artificial Sequence
  Description of Artificial Sequence: Synthetic coding sequence
atggccagcgtgaaggtggccgtgcgggtgcggcccatgaaccggagggagaaggatcttgaggccaagttcattatccagatggaaaaaagtaaaacgaccatcacaaatcttaagatccctgaaggtggaaccggggactctggtcgagaacgcactaagactttcacttacgacttcagcttttattctgccgatactaagtctcctgactacgtgtcccaagaaatggtctttaaaacacttggtaccgatgtcgtcaaatctgcctttgaagggtacaatgcttgtgtgttcgcctacggacagacaggcagtgggaagagttacactatgatgggcaattccggagacagcggactgataccccgcatttgtgagggcctatttagcaggattaacgaaaccacccgttgggatgaggcttcattcagaaccgaggtgtcatatctggaaatttacaacgagagagtgcgcgatttgcttagacgaaagagttctaagacattcaacttgcgagttagagaacacccaaaagaagggccttacgtagaggacctgagcaaacacctggtccaaaactatggtgacgtggaggaactgatggacgcgggaaatatcaatagaactacagcagccactggcatgaatgatgtgtcatcaaggagtcacgccatctttaccataaaatttactcaggccaagttcgattcagagatgccgtgcgagacagtgtccaagattcacctcgtggacctggcaggctccgaaagagctgacgccactggcgccacaggcgtccgccttaaggaaggtggcaacattaacaagtcgctggtgactcttggtaacgttatctcagccctagctgatctgtctcaggacgccgcaaatactttagcaaaaaagaagcaggtttttgtcccttacagagatagcgtactgacatggctgctcaaggacagtctgggcggcaactccaagactattatgattgccaccattagccctgctgacgtcaattatggcgaaacactgagtactctgaggtatgccaatcgggccaaaaacattattaacaaacccaccatcaatgaggatgccaatgtgaagctgattcgcgagctgcgcgccgagatcgctcgactgaaaacactgttggcgcagggtaatcagattgccctgctggattcccctacagctttatccatggaagaaaaattacagcagaacgaagcacgtgtgcaggaactgacaaaggaatggaccaacaagtggaacgagacccagaacattctcaaggaacaaacattggcccttagaaaggagggtatcggggttgtattggatagtgaactcccccacctgatcggcatagatgatgatctactgagcaccggtatcattctataccaccttaaagagggacagacatatgtggggcgggacgacgcctccaccgaacaggatattgtgctgcatgggctcgacctggaatcggagcactgcatcttcgaaaacatcggcggcacggtaactctgataccccttagcggatcccagtgtagcgtgaacggagtgcaaatcgtagaggccactcacctgaatcagggcgctgtgatcctcttgggccgtaccaacatgttcaggttcaatcaccctaaggaagcagcaaagctgcgggagaagcgtaagagtggacttctctcttctttctccctttccatgacagacctgtcaaaatcccgtgaaaatctctctgccgtgatgctgtataatcccggtttggagtttgagcgccagcagcgagaggaactggagaagctcgagagtaagagaaagctcatcgaggaaatggaggaaaagcagaagtctgacaaggctgagctcgaaagaatgcagcaggaagtcgaaacgcagagaaaggaaaccgagatagttcagctgcagattcggaaacaggaggagagtctaaagcggcgatccttccatattgagaacaagcttaaagatctcttagccgagaaggagaagttcgaagaggagcggctgagagaacagcaggagattgaattacagaaaaagagacaagaagaggagactttcctgagggtgcaggaggaactgcagcggctcaaagagctcaacaataacgagaaggccgaaaagtttcagatcttccaggaactagatcagctgcagaaggagaaggacgagcagtacgcgaaactcgagctcgagaagaagcgcctggaggaacaggaaaaagagcaggttatgttggtggcacatctggaagagcaactgagggagaaacaggagatgattcagcttttgaggcggggggaagtccagtgggtagaggaggaaaagagggatttggaggggatccgagagtcactgctgcgcgtgaaagaggccagggccggaggagacgaagatggggaggagttggaaaaggcccagttgcggttcttcgaatttaagcggaggcagctggtcaagctggtcaaccttgagaaagacctagtgcagcagaaggacatcctgaagaaggaggttcaagaggaacaggaaattctggagtgcttaaagtgcgaacacgataaagaaagccgtttgttggagaaacatgacgagtcagtgacggacgtgacagaggtgccccaagactttgagaagatcaagcccgtggagtatcggctccagtataaagagcgccagcttcagtacctgcttcagaaccatctgccaacactgctggaggagaaacagagagcattcgaaatcctggatcgcgggcccctgtctctggataatacactgtaccaagtagagaaagagatggaagaaaaggaagaacagctggctcagtatcaggctaacgctaaccagctacagaaactccaggccacattcgagttcaccgccaacatcgcaagacaggaggagaaggtgcggaagaaggaaaaagagatcctggagagccgcgaaaaacaacaaagggaagccctcgagcgggccctggctagacttgagaggcggcattctgcccttcagcggcactcaaccctgggaatggagatcgaggaacagcgccaaaaactggcttcactgaacagtgggtcaagagagcagtctggcttgcaggccagcctcgaagctgagcaggaggccctggagaaggatcaggagcgtttggaatatgaaatacagcagctgaaacagaaaatctacgaagtcgatggcgtgcaaaaggatcatcacggaacactggagggcaaggtagcgagtagcagcctccctgtgtcagcagagaagtcccacctcgttcccctgatggacgcccggattaacgcgtacattgaggaggaagttcagcgcaggttacaagacctccatcgggtcattagcgaagggtgttctacatctgctgacactatgaaggataatgagaaactgcacaacggtaccatccagcgaaaactcaagtatgagctgtgccgggacctgctctgcgtgctgatgcctgagcctgacgctgccgcatgcgctaaccacccacttctgcagcaggatctggtgcagctgtccttagactggaagactgagatacctgacttggttctcccaaacggggtgcaggtgtcttcgaaatttcagaccaccctcgtagatatgatctattttctacacggcaacatggaggtcaacgtgcctagtctggctgaagtgcaacttttactgtatacaaccgttaaagtcatgggcgactccggtcacgaccaatgccagtccctggtgttgctgaacacgcacattgcgttggtcaaggaggactgtgtgttttatcctcgcattcgctccagaaatattccgcctcccggagctcagttcgatgtgattaaatgtcacgccctttccgaatttcgatgtgtcgtggtgcctgaaaaaaaaaatgtgtctacagttgagcttgtcttcctgcagaaactaaaaccatctgttggaagccgcaatagcccccctgaacatctgcaggaggcacccaatgtgcagctcttcactacccccctgtacctgcagggtagccagaacgtcgccccagaggtctggaaactgaccttcaacagccaagatgaagccctatggttgataagtcatctgacccgcttgtag

SEQ ID NO: 42930 - DNA, 2697 bp, Artificial Sequence
  Description of Artificial Sequence: Synthetic coding sequence
atgagcgtgaccgaggaggacctgtgccaccacatgaaggtggtggtgcgggttagacctgagaacacaaaagagaaagccgccggcttccataaggtcgtccacgtggtggacaaacacattttagtctttgacccaaaacaagaggaggtttccttctttcatgggaagaaaaccaccaatcagaacgtcatcaaaaagcagaataaagacctaaagttcgtgtttgacgccgtattcgatgaaacgtctacacagagtgaagtgtttgagcataccacaaagcctattcttcgctcatttcttaatggatataattgtactgtacttgcttacggcgccacaggagctggtaagacccacacaatgctaggcagcgctgacgagcccggggtgatgtatctgaccatgctacacctgtataaatgtatggatgaaatcaaagaagagaaaatctgtagtactgccgtgtcatatcttgaagtttacaatgaacaaatccgcgatctcctcgtgaattcgggcccactggccgtgcgagaagacacacagaagggagttgtagtgcacggcctaactctacatcagcccaagtcttctgaggagattctccatttgctggataacggcaataaaaaccggactcagcatccgacagacatgaatgccacctcctcacgcagtcacgctgtgtttcagatctacctgcggcagcaggataagacagcaagcataaatcaaaacgtccgcattgcgaagatgagcttgatcgatctggccggttcagagagagcttcaacctctggtgcgaagggaaccaggttcgtagaaggaactaacatcaaccggtccttgctggctcttggaaacgtgatcaacgcactggctgatagtaaaagaaaaaatcaacacatcccttaccggaattccaagctgacacgcttgcttaaagacagtctgggtgggaattgtcagactatcatgatcgcggctgtctcgccgtccagcgtgttctatgatgacacctataacaccctcaagtatgcaaacagggcaaaggatatcaagtcaagtctcaaaagcaatgtcctaaatgtgaacaaccacattactcaatatgtcaaaatctgcaatgaacagaaagcagagatcctattgctgaaagagaagttgaaggcttacgaagaacaaaaggccttcacaaatgagaacgaccaggctaaacttatgatttcaaacccccaggaaaaagaaatagagaggttccaggaaattctcaactgcttgttccagaaccgggaagagatacgccaggagtatcttaaactggaaatgcttttaaaagaaaacgaactgaagtctttctaccagcagcaatgccataaacagattgaaatgatgtgttcagaggacaaggttgagaaagctacggggaaacgagatcacagactggctatgttgaaaacgcggcgtagttacctggaaaaacggcgcgaggaggagctgaagcagttcgacgagaacaccaactggctgcaccgcgtggagaaggagatgggcctcctgagccagaatggtcatatccccaaagagctgaaaaaggatctccactgtcaccatctccatcttcagaacaaggatctgaaggcccagataagacatatgatggacctggcatgcctgcaggagcagcagcataggcagacggaggccgtccttaacgccttgctacccactctgcgcaaacagtactgcacgctgaaggaggccggactgagtaatgccgcttttgagtcggattttaaagagatcgagcaccttgtcgaacggaagaaagtggtggtctgggctgaccagaccgcagagcaacctaagcagaatgacctgccggggatttctgtgctcatgactttcccccaattgggccccgtacaacccattccctgttgttcgtcttccggcggaactaacttggtcaagatcccaaccgaaaaacgtactagacggaagctcatgccaagtccacttaagggtcagcacactcttaagtcaccccctagtcagtccgtgcagttaaatgattcattatccaaggagctccagcctatcgtgtacacccctgaggattgccgcaaggccttccagaatccaagtaccgtgaccctgatgaagccgagttcattcaccacgtcctttcaggctatctcgagtaacattaacagcgataattgtctcaagatgttgtgtgaggtcgccatccctcacaacaggcggaaagagtgcggacaggaagatctggactctaccttcaccatttgcgaggatattaagagttccaagtgcaagctacccgagcaagagtcactgcccaacgacaataaggatattctacaaagacttgatccttcctctttttctaccaaacactccatgcccgtacctagcatggtcccatcctatatggctatgaccaccgcggccaagcggaaaagaaagttaacttcgagcacttccaatagctcactgacggctgacgtgaatagcgggtttgctaagagggtgcggcaggataatagctcagagaaacacctgcaggagaacaagccaaccatggaacacaagcgcaatatttgtaaaataaacccctcaatggtacggaagtttggtcggaatataagcaagggcaacttgcgttag

SEQ ID NO: 42931 - DNA, 1479 bp, Artificial Sequence
  Description of Artificial Sequence: Synthetic coding sequence
atggccccccccgccgcccggctggccctgctgagcgccgccgccttgacattagctgctcggcctgctcctagccccggtctgggccctggaccagaatgctttaccgcaaacggcgcggattaccggggtacccaaaattggactgctctgcagggcgggaagccctgcctgttttggaacgaaacatttcagcacccctataatacactaaagtacccgaacggtgaggggggactgggcgagcacaattactgtagaaatcccgatggcgacgttagcccatggtgctacgtcgccgaacatgaggatggagtctattggaaatattgcgaaattccagcttgccagatgcctggtaatctgggttgttataaagaccatggcaatccaccccccctgacaggaaccagcaaaaccagcaacaagctcacaattcaaacttgtatttccttttgtcgatcccagcggtttaagttcgccggtatggagagtggttacgcctgtttctgtgggaataaccccgactactggaaatacggtgaagcggcttccaccgagtgtaacagcgtgtgtttcggcgatcatacacagccttgcggcggggacgggcggattattctcttcgatacccttgttggcgcttgtggcggcaattacagcgcaatgtcaagcgtggtttatagccccgatttccctgatacctacgcgactgggcgtgtgtgctactggacgatccgggtaccaggggcatcccatatccactttagttttcctttgtttgacattcgagactctgcagacatggtggaattattggatggatacacccatagggtgctggcacgctttcacggtcggagccgccccccattgtcttttaatgtatccctggacttcgtgatcttatatttttttagcgatagaatcaaccaagcacagggcttcgccgtgctgtaccaggctgtcaaggaagagctgcctcaggagcgacctgccgtgaaccagacagtggccgaggtcataacagagcaggcaaatctaagcgtcagcgcagcaaggagtagcaaagtgttgtacgtgatcaccaccagtcccagtcacccacctcagacagtgccggggagtaattcttgggctccaccaatgggtgccgggtctcacagggtcgaaggctggaccgtctatggccttgcaactctactgatcctgactgtcaccgccattgtcgctaagatcctgctccatgtcactttcaagtcccatcgggtgcctgcaagcggcgacttgcgagactgtcaccagcccgggacgtctggcgaaatttggagtatattttacaagccaagtaccagtatctctattttcaaaaaaaaacttaagggccagtctcagcaggatgataggaaccccttggccatacaggattctgaggtgacttctctgatatggtcgcagggacaacctagatcgatctag

SEQ ID NO: 42932 - DNA, 1377 bp, Artificial Sequence
  Description of Artificial Sequence: Synthetic coding sequence
atggccccccccgccgcccggctggccctgctgagcgccgccgccctgacgcttgctgctagacctgctccctcacctggcctggggcccggaccggagtgcttcacagctaacggcgctgattacagaggaacccagaactggactgcactccagggcgggaagccctgcctgttctggaacgagacattccagcacccttataataccttgaaatatccaaatggagaaggcggactcggggagcataactactgtaggaatcctgatggagatgtctccccttggtgttatgtggctgagcacgaggatggcgtgtattggaaatactgcgagattcccgcttgccagatgccagggaacctggggtgttacaaggatcacggcaacccgcccccgctgactgggacatccaagacatctaataagctgaccattcagacctgtatctcattttgccggagccaacgctttaagttcgccgggatggagagtggctacgcctgcttttgcggaaataatcccgattattggaaatacggcgaagcagcctccactgagtgcaacagcgtctgctttggcgaccacactcaaccttgcggaggcgacggacgcattattctctttgacaccctggttggagcctgcggaggcaattactcagctatgtcttctgtggtgtactcacctgattttccagatacatatgctactggcagggtgtgttactggaccatcagagtaccaggagcctctcacatacacttctccttccctttatttgacattcgcgactccgccgacatggtagaacttctcgatgggtacacccatcgagtgttggccagattccacggcagaagccggccccctctgagctttaacgtttctctggactttgtgattctctactttttttccgatagaatcaatcaggcccaggggtttgccgtcctgtaccaagcagtgaaagaggagctgccgcaagagaggcccgctgtgaaccagaccgttgcggaagtcattactgagcaggcaaacctgtcagtgagcgctgctcgctcaagtaaagtactgtacgtgataactacctcaccttcacacccgcctcagaccgttcctggatggaccgtttacggcctggcgacattgctgatactgacagtgacagcaatagttgccaagatcctcctccatgttacctttaagtctcacagagtgcctgcctcaggagatctcagagactgtcatcagcctgggacatccggtgagatttggagtatcttttacaagccgtctacctctatatctatctttaaaaagaaattgaagggacagtcccagcaagatgaccgtaatccactcgtttccgattag

SEQ ID NO: 42933 - DNA, 1428 bp, Artificial Sequence
  Description of Artificial Sequence: Synthetic coding sequence
atggccccccccgccgcccggctggccctgctgagcgccgccgcccttactctggcagcgagaccagctccatcccctggtctgggcccagggccagagtgtttcactgctaacggggcggactaccgcggtactcagaactggacggctttgcaaggtggtaagccttgtttgttttggaatgaaacttttcagcacccatataatactctcaaatatccgaacggggaaggcgggctgggtgagcataattattgcaggaaccccgatggagatgtttctccctggtgctatgtggctgagcacgaagatggggtctactggaagtattgtgaaatccccgcctgtcagatgcccggtaatttgggttgttataaagatcacggtaacccacctcctctcacaggcacttctaaaaccagtaacaaacttaccattcagacttgcatcagcttctgtcgatctcagaggttcaaattcgctggcatggagagtggttatgcctgtttttgcgggaacaatccagattactggaagtatggggaggcggccagcactgaatgcaactccgtctgtttcggagaccatactcagccttgcgggggagacggacgaatcatcctttttgacactctggttggcgcctgtgggggaaactattctgccatgtcatcggttgtttattcacccgactttcctgatacctacgccactggacgggtctgttattggactattagggtcccaggcgcgagtcacattcatttttctttcccattgttcgacatcagagacagcgcagatatggtggagcttctggacgggtatacccatcgcgtgctggccaggttccatggccgcagccgcccacccctgtcatttaatgtgtccctcgattttgtgattctatactttttcagtgacaggattaaccaggcacagggcttcgccgtattataccaggccgtgaaggaggaactgccacaagagagacccgctgtgaaccaaacagtggcggaagtgataactgaacaggctaatttgagcgtcagcgcagcacgcagctccaaggtgctatacgtcattacaacatccccgtctcatcctccgcagacagtgcccgggagcaactcttgggcgccaccaatgggagctggttctcacagggtcgaaggttggaccgtatacggcctcgctaccctgctcatactaaccgtgacagctatcgtcgctaagatccttctgcatgttaccttcaagtcccaccgagtgcctgcctccggagatcttagggattgccaccagcccggaaccagcggtgagatatggagcatcttttacaaaccttcgacatctatatcgatctttaagaaaaaattgaaaggtcagtcccagcaggatgacaggaaccctctggtgtctgattag

SEQ ID NO: 42934 - DNA, 1422 bp, Artificial Sequence
  Description of Artificial Sequence: Synthetic coding sequence
atggccccccccgccgcccggctggccctgctgagcgccgccgccctcaccttggccgccaggcccgcaccatctcccggacttgggcctgagtgctttactgccaacggagccgactatcgaggtacccagaattggactgcactccaaggggggaaaccctgtctcttctggaacgagaccttccagcacccctacaataccctgaagtatccgaacggggaaggcgggctgggagaacacaattattgtcgaaacccagacggcgacgtaagtccctggtgttatgtcgctgagcacgaagatggggtgtattggaaatactgtgagatcccagcctgccaaatgcccgggaatctgggatgttataaggatcacggcaacccaccaccacttacaggaacatctaagacttccaataagttgacaatccagacgtgtatctcgttttgccgcagccaaagatttaaattcgccgggatggaatccggttacgcttgtttctgcggtaataaccccgactattggaagtatggtgaagccgcctcaaccgaatgtaactcggtctgcttcggagaccacacgcagccttgtggcggggatggaaggatcatcctatttgatactttggtgggagcctgcggtggcaattactccgcaatgtcatcagtggtgtattcacccgatttcccagatacttacgctactggtcgggtgtgttactggaccattagagtgcctggcgcaagtcatatacatttttccttccccctgttcgacatacgggatagcgcagacatggtggaactcctggatggctatacgcaccgcgttctagcaaggttccatgggcgctctaggccccctctaagttttaatgtctccctggattttgtcatactgtacttcttctctgatcggattaatcaagctcagggctttgccgtcctgtatcaagccgttaaggaagagcttcctcaggaacggcctgctgtgaatcaaacggtggccgaagttatcaccgagcaagcaaacctgtcagtgtctgccgcccgtagtagtaaagtgctttatgtcattacaacctccccatcacatccgccacagacggttcctggctcaaacagctgggcaccacccatgggtgccggctcccatcgggttgaaggttggacagtttatggcctggccacactgctgattctgactgttaccgctatcgtcgcgaaaattctccttcatgttacatttaaatcccatcgggtgcccgcttccggggatctcagagattgccatcaacccggcacttctggggagatctggtcaattttctataagccttctacaagcatctctatatttaaaaaaaagttgaaaggtcagtcccagcaggacgataggaaccccttggtgagcgactag

SEQ ID NO: 42935 - DNA, 867 bp, Artificial Sequence
  Description of Artificial Sequence: Synthetic coding sequence
atggccgccgtgctgcagcgggtggagcggctgagcaaccgggtggttagagtcctcggctgcaatccgggccctatgaccctgcaggggaccaacacctatctagtgggtacagggccgagacgcatcttaatagacacaggagagcctgccattcccgagtatatcagctgtctaaagcaggctctcactgagttcaacaccgccattcaagagattgtggtgacacattggcatcgcgaccacagcggcggcataggcgacatttgtaagtctatcaacaatgatacaacttattgtataaaaaagctgccacgtaacccacagagggaggagatcattggaaatggtgagcaacagtacgtatacctgaaagacggtgacgtaatcaaaactgagggcgctactctcagggtgctctatactcctggtcacactgacgaccatatggctcttctgctggaggaggaaaacgctattttttctggtgactgcattcttggcgaagggacaactgtcttcgaggacttgtatgactacatgaattctctgaaagagctgctcaagattaaagctgatattatttatcctggtcacggacctgttatccataatgcggaggcgaaaatacagcagtatattagtcaccgcaatattcgggagcaacaaatactcactctgttcagggagaacttcgagaaaagtttcacagtcatggagctcgtcaagatcatttacaagaataccccagagaatctgcacgaaatggccaaacataacctgctgttacacctgaagaagttggaaaaagaaggaaagattttctctaacacagatcccgataagaaatggaaggcccacctttag

SEQ ID NO: 42936 - DNA, 867 bp, Artificial Sequence
  Description of Artificial Sequence: Synthetic coding sequence
atggccgccgtgctgcagcgggtggagcggctgagcaaccgggtggtgcgagttctgggctgcaatcccggtccaatgacgcttcagggtacaaacacatacctggtcggaaccggtccacgccgcatcctaatcgacaccggagagccggctatacccgagtacatcagctgcctgaaacaggctctgacagaattcaacactgccattcaggagatcgtcgtcactcactggcatcgggatcatagcggaggaattggcgacatttgtaaaagtattaacaacgatactacctattgtataaagaagctgccaaggaatccgcaacgcgaagaaataatcgggaacggagaacagcagtacgtatatctgaaagacggcgacgtcattaagacggagggggccacactccgagtgttgtatacgccaggtcataccgatgatcacatggcactgctgctggaggaggagaatgctattttcagtggggactgtatcttgggagagggaactacagtgtttgaggatctctatgattatatgaatagtctcaaagagctgctgaagataaaagcagatatcatataccctggacatgggccggtcatccacaatgctgaagctaaaattcagcagtatatatcacataggaacataagggagcaacagattcttactctctttcgagaaaattttgaaaagagctttacggtgatggagctcgtgaagattatctataagaatactccagaaaacttacatgagatggccaagcacaacctgttactccatcttaaaaagcttgagaaggaagggaaaatctttagtaacacagaccctgacaaaaaatggaaagcacatttatag

SEQ ID NO: 42937 - DNA, 1704 bp, Artificial Sequence
  Description of Artificial Sequence: Synthetic coding sequence
atgaagcccgtgtgggtggccaccctgctgtggatgctgctgctggtgccgagattaggagcagcacgcaaagggtcccccgaagaagcatctttctattatggaactttccccctgggcttttcttggggtgtagggtcctctgcctatcagaccgaaggcgcctgggatcaggatgggaaggggccatccatctgggacgtgttcactcactctggtaaaggcaaggtgctaggaaacgaaactgccgacgtggcctgtgacggatactacaaagtgcaggaagatatcattcttctgagggagctacacgtgaatcactatcggttcagcctaagctggcccagacttctccctaccgggatccgggcagagcaggtaaataagaagggaattgaattctatagtgacctgatcgatgcccttctttctagtaacataaccccaattgttactctgcaccattgggatctcccccaattgttacaggtgaaatacggcggctggcagaacgtctccatggctaactattttcgggactacgccaatttatgcttcgaagcctttggagacagggtaaagcattggattacattctccgaccccagggctatggccgagaaagggtatgaaactggccaccacgcccccggtttgaagctgaggggaacagggttgtataaagccgcccaccacattatcaaggctcatgctaaggcctggcacagttataatactacttggcgctcaaagcagcaaggactggttggcatctccctaaattgtgactggggagagcccgtggacatttcgaatcctaaggatctggaagccgccgaacggtatttacagttctgtctgggttggttcgccaacccaatttatgccggcgactatccacaagttatgaaagactatattgggcgaaaaagcgctgaacaggggttagagatgtctagactacctgttttcagcttgcaggagaagtcttatattaaggggactagtgacttcctggggctcgggcacttcactactcggtatataactgagcgaaattacccatctcggcagggaccttcatatcagaatgatagggatctcattgagttggtggacccaaattggccagacctgggctccaagtggttatacagtgtcccttgggggttccggcggttactgaatttcgcgcagactcagtatggcgatccacccatctacgtgatggagaacggtgcctcccagaaatttcattgcacccaactttgcgatgagtggcgtatccagtatctgaaaggatacataaacgaaatgctgaaggccataaaggatggcgctaatattaagggatatacatcctggagccttttagataaattcgagtgggaaaagggctattccgacagatacggattctattatgtggagttcaatgatcgaaataaacccaggtaccctaaggccagtgttcaatactataagaagatcatcattgccaacggctttcccaaccccagagaggtggagtcctggtatttgaaagccctggaaacctgcagcatcaacaaccagatgcttgcagcggagccactcttgtctcacatgcagatggtgacagaaatcgtggtgccgactgtgtgcagcctttgtgtcttgatcaccgcagtgctgcttatgctgctcttaagacgccagagttag

SEQ ID NO: 42938 - DNA, 1185 bp, Artificial Sequence
  Description of Artificial Sequence: Synthetic coding sequence
atggccaactacttccgggactacgccaacctgtgcttcgaggccttcggagacagggtgaaacattggataacttttagcgacccaagggctatggctgagaaggggtatgagacgggccaccacgcccctggcctgaaactcaggggaacgggtctctacaaagctgctcatcacatcattaaggctcacgccaaggcatggcactcatataatacgacttggagatcgaagcagcagggcctcgtggggatctccctcaactgtgactggggcgaacccgtggatatttcgaaccccaaagatctggaagcggcggagagatatctgcagttctgcctgggctggttcgctaatccgatatatgccggggattatcctcaggtgatgaaagactatataggtaggaaatcggcagaacagggtctggaaatgtcaaggttacctgtattctcactacaggagaaatcttacatcaaaggaacttctgattttctgggattaggacacttcactacacgctacatcactgaacggaattacccctcccgccagggtcccagttatcagaatgatagagatcttatagaactcgtagatcctaactggcctgatctgggaagcaagtggctatattcagtgccgtgggggttccgtcgcctcctgaattttgcacagacccagtatggtgacccccccatttacgtcatggagaatggtgcctcccaaaagttccattgtacccagctttgcgatgaatggcgtatccaatacttgaagggatatatcaatgaaatgctgaaggctattaaagatggggccaatattaagggctatacatcttggtctcttctggataaattcgaatgggaaaagggctatagtgaccgctatggcttctattatgtggagtttaatgacaggaataaaccaagataccccaaggcatctgtacagtactataagaagatcattatcgcaaacgggtttcctaatccccgcgaggtggagtcttggtatttaaaagctctggagacttgtagcatcaataatcagatgttagctgcggagccgctcctttcccatatgcaaatggtcactgaaatagtagtcccaaccgtttgttctctctgtgtcctgatcaccgccgtgctgttgatgctgctgttacgacgccaaagctag

SEQ ID NO: 42939 - DNA, 1446 bp, Artificial Sequence
  Description of Artificial Sequence: Synthetic coding sequence
atggccgccagctggagcctgctggtgaccctgcggcccctggcccagagtcctctgcggggcagatgcgtgggctgcggcgcatgggctgcagccctcgcccctctggctactgcccctggcaaacccttctggaaagcctacaccgtgcagacttccgaatccatgacgcctacagctacctccgagacctacctgaaggccctggcagtctgtcatggaccacttgatcattacgattttctgattaaggcccacgaactgaaagacgatgagcatcagcggagagtcatccaatgtcttcaaaaactgcacgaagacttaaagggttacaatatcgaggccgaagggctgttttccaagctcttttctcgctcaaagccgccccgtggcctttatgtatatggtgacgtgggtacaggaaagacgatggttatggacatgttttatgcttacgtagaaatgaaacggaagaaaagagtgcacttccacggattcatgctggatgtgcacaagcgcatacataggctgaaacagtcccttcccaagcgcaagcccgggttcatggcaaagtcttacgatcctattgctcctatagcagaggaaatatctgaggaggcatgcctgttgtgtttcgacgagttccaggttactgatattgctgatgccatgattcttaagcagttgtttgagaatctattcaagaacggcgttgtggtcgtggctacgtccaacaggccccctgaggatctgtacaaaaatgggttacaaagggccaactttgttccttttatcgcagtgcttaaagaatactgcaacacagtacagcttgacagcggtatcgactaccgaaaaagggagctgcctgccgcgggtaagctttattatctgacttccgaagcagatgtggaggccgtgatggacaagctatttgatgagctggcccagaagcagaatgatctgaccagacctcgcattctgaaggtacaagggcgagaactgcgcctcaacaaagcctgcgggacagttgccgattgcaccttcgaagaactgtgcgaacgacccctgggagcctccgattacttggaactttccaaaaacttcgacacaatattcttacgcaacatcccccagtttactctggccaaccgcactcagggacgcagatttatcactcttatcgataatttttacgatctgaaggttagaataatttgctctgcttcaacccctatttctagcctcttcctacaccaacaccacgactctgaattagaacagtcccggattctgatggatgacttggggctcagccaagacagtgctgaaggcctaagcatgtttaccggcgaggaggagatcttcgccttccagagaaccatttcccgactgaccgaaatgcagacagagcagtactggaacgaaggggatcggactaaaaaatag

SEQ ID NO: 42940 - DNA, 486 bp, Artificial Sequence
  Description of Artificial Sequence: Synthetic coding sequence
atgggctgctgctacagcagcgagaacgaggacagcgaccaggaccgagaggagcgcaagctcctgctagatccctcttctcctcccaccaaagccctgaatggtgccgaacctaattatcactctctcccctccgctagaaccgacgaacaggccttattgtctagtatcctggccaaaacagcctcgaatattatagacgtgtcagccgcggacagccagggcatggagcagcatgaatacatggatagagctagacaatactctactcgtttggccgtcctcagcagttcgctgacacactggaaaaagctcccccctctgccttcacttacctcacaacctcaccaggtgctggcctcagagcctattccattttcagatctacagcaggtcagtcgtatcgctgcgtatgcctactctgctttgagccaaatcagagtggacgccaaagaagaattagttgtccagttcggaatcccttag

SEQ ID NO: 42941 - DNA, 453 bp, Artificial Sequence
  Description of Artificial Sequence: Synthetic coding sequence
atgctgcggcccaaggccctgacccaggtgctgagccaggccaacacaggcggtgtgcaatctacattgttgctcaataatgagggctcgcttttggcctattctggatacggagatacagacgccagagtgaccgccgccatcgcctccaacatctgggcagcttatgatcgaaacggaaatcaggccttcaacgaggataacctcaaattcatcctaatggattgtatggagggaagagtagcaatcactcgtgtggcgaacctgctcttgtgcatgtacgccaaagagaccgtggggttcggaatgttgaaggctaaagccgtatgcgggacagacctgtgcagtccatcagctggcccagggtttggagccgtgcctggaggagcacctcacccaagcggcggcatcctaaccgcactggtagaggccggtgtcagaaaagagaagtag

SEQ ID NO: 42942 - DNA, 288 bp, Artificial Sequence
  Description of Artificial Sequence: Synthetic coding sequence
atgctgcggcccaaggccctgacccaggtgctgagccaggccaacacgggcggcgtgcaatccacactactactcaacaacgaggggagtctgcttgcctacagcgggtatggagatactgatgcgagagtaaccgctgcgattgccagtaatatttgggccgcctacgataggaacgggaatcaggcattcaatgaagacaacctgaaatttatcttgatggattgtatggcgcaagcattagtgcagtatctcgaggaacctttgactcaagtggcagcttcttag

SEQ ID NO: 42943 - DNA, 378 bp, Artificial Sequence
  Description of Artificial Sequence: Synthetic coding sequence
atgctgcggcccaaggccctgacccaggtgctgagccaggccaacactggtggcgtccagagcaccttattgttgaataatgagggttctcttctcgcttacagtggctacggcgacacggacgcgcgcgtcacggcagctatcgcgtctaacatttgggcagcttatgatagaaacgggaatcaagcttttaatgaagacaatctcaagttcatcctcatggactgcatggaaggacgcgtcgccatcacacgggtggcaaacctgctgctctgcatgtacgccaaggaaaccgttggtttcggcatgctcaaagctaaagctcaggccctcgtacagtatctagaggagcctttgacacaggtcgccgccagctag

SEQ ID NO: 42944 - DNA, 375 bp, Artificial Sequence
  Description of Artificial Sequence: Synthetic coding sequence
atggccgacgacctgaagcggttcctgtacaagaagctgcccagcgtggaagggctacacgcaattgttgtgagtgatcgcgatggagttcctgtgatcaaagtggcgaatgataacgctccggagcacgccctgcgcccaggattcttgtctacattcgccctcgccacagaccaggggagtaaactgggactgagcaaaaacaagtctatcatttgctattataacacttaccaggtggtgcagtttaatcgcctgccgctggtggtatcctttattgcctcctctagcgccaacaccggcctgattgtgtcgcttgaaaaagaactggcgccactgttcgaagaactccggcaagtggtcgaagtgagttag

SEQ ID NO: 42945 - DNA, 4425 bp, Artificial Sequence
  Description of Artificial Sequence: Synthetic coding sequence
atggcccggctggccgccgtgctgtggaacctgtgcgtgaccgccgtgcttgtcacgagcgcaacacaagggctctcacgagctggcctcccctttggcctcatgcggagagaactcgcctgcgagggctatccgattgagctgcggtgccccgggtctgatgtcatcatggtggagaacgcgaactacggacgaactgatgataaaatatgtgacgcagatccttttcagatggaaaatgtgcagtgttatctcccagacgcctttaaaatcatgagccagcgctgtaacaaccgaacacagtgtgtggtcgtggctggatctgatgcttttcccgatccttgtcctggaacatacaaatatcttgaagtgcagtatgattgcgttccttacaaggtcgaacaaaaagtctttgtatgccctggcaccctccagaaggtgctggaaccgacttctacccatgagtcggagcaccagtctggggcctggtgcaaggaccccctgcaagctggggatcgcatctatgtcatgccgtggatcccatatcgaactgataccctaacagaatacgcttcctgggaggattacgtggcagcaagacacactacaacatacaggctgccaaaccgggtcgacggaaccgggtttgtggtgtacgacggtgctgttttttacaacaaagaaagaacccgtaatatagtgaagtacgatctgcgaacccggattaagagcggtgaaactgtgataaacaccgccaattatcacgacacaagcccctaccgatggggtggtaagactgatattgatcttgccgtggatgaaaacggcctatgggtgatctatgccactgagggcaacaatggcagactggtggtctctcaactgaacccatatacccttcgcttcgagggcacatgggaaacaggttatgataagagaagtgcatcaaatgcgttcatggtgtgtggcgttttgtacgtgctgcggtccgtgtacgtggacgacgacagtgaggccgccggcaatcgggtcgactacgcattcaacaccaatgcaaatcgcgaagagcccgtgtccctgacctttcctaatccataccagttcatatcaagcgtcgactataatccaagggacaaccagctctatgtgtggaataactacttcgtggtgcgctatagtctcgagttcggccctcctgacccttctgctggaccagccaccagtccacctctgtctactaccaccacagcccggcccacccctcttactagtacggcatcccccgccgccacaacaccgctgcggcgtgcacccttgactactcacccagtgggagccattaaccagttgggcccagacttaccccccgctacggcccccgttccttccacccggcggccacctgctccaaacttgcacgtgagtccagagctattttgtgagccacgggaagtgcgtagggtgcaatggccagctacccagcagggtatgctcgtggaaagaccttgtcctaagggtacaagaggcattgcctcctttcagtgtctacctgccttaggcttgtggaatcctagaggcccagacctgtccaattgtacaagtccttgggtgaaccaagtggcccagaaaatcaaatctggcgagaatgcagcaaacatagctagtgagctcgcacgccacacccgcggatccatttacgctggcgatgtaagcagcagcgtgaagctgatggaacagctgctggatatcctggatgctcagctgcaagcactcagacccattgaaagggaatccgctggaaagaactacaataaaatgcataagcgcgagaggacatgcaaagattacattaaagccgtggtggagacggtggacaatctactgaggcccgaggctctcgagagttggaaagatatgaacgcaaccgaacaggttcacacagctactatgttactcgatgttctcgaggagggcgccttcctcttagcagataacgtgagagagcccgccaggttcttggctgcgaaagaaaacgttgtgctcgaggtgactgtcctgaatacagaaggacaagtacaagagctcgtttttcctcaagaggagtaccctaggaagaattcgattcaactgtctgcgaaaacgattaagcaaaacagtcgtaatggtgtggtgaaagtcgtttttatcctctacaacaacctggggctcttcctgagtaccgaaaatgctaccgtgaaactagcgggagaggcgggacctgggggaccagggggggcatccctggtcgttaattctcaggtgatcgcggcttcgatcaacaaggaatctagccgcgtgtttcttatggatccagtgatattcacagtcgcccacttggaagataaaaatcacttcaatgcaaactgttcgttttggaactattctgagagatctatgctcggatattggtccacacagggatgccgacttgtcgagtcaaacaagactcacacgacatgtgcttgtagccatctcactaactttgcggtgcttatggcacacagggagatttaccagggacgcatcaatgagctgcttttgagtgtgattacatgggtggggattgtgataagcctggtgtgtctggccatatgtatatcaacgttttgtttcctgcgtggcttgcagacggaccggaatactatccataagaacctctgtatcaacctatttctcgcagaactgctctttctggttggcatcgacaagacccagtatgagatcgcttgcccaatattcgccggactgctacactacttcttcctggctgccttctcctggctgtgtttagagggtgttcacttatatctgctgctggtcgaagtcttcgagagcgagtactcccgaactaagtactactaccttggaggctactgcttccctgcgcttgtggttgggatcgctgctgctattgattaccggagttacggcactgaaaaggcatgctggttgcgagtggataactattttatctggtctttcataggccctgtttcttttgtgattgtggtcaatttagtttttctgatggtgacgttgcataagatgattagatcatcctccgtgctcaaacccgattcaagcagattggacaatatcaagagctgggctctcggagcaatcgctctgttatttcttctgggtttaacatgggccttcggattgctcttcataaataaagagagcgtagtaatggcatacttatttacaacttttaatgccttccagggcgtttttatcttcgtgttccactgcgcattgcagaagaaggtgcacaaagaatattccaaatgtctgcggcactcatattgttgcatacgcagccccccgggcggtactcacggatcccttaagacatctgccatgcggtccaatacgcgctattatactggcactcagtctagaattcgaaggatgtggaatgataccgtgcggaaacaaactgagagttcctttatggctggagacatcaatagtacacctacactcaataggggaaccatgggtaatcacctcttgaccaacccagttctacagccaagaggaggtacctcgccttataacactttgatcgctgagagtgtgggtttcaaccctagtagccccccagtgtttaactctcccgggtcttaccgtgaacccaagcatccccttggaggccgggaggcatgcggcatggacaccctgccgctgaatggtaattttaacaactcctatagcctgagaagtggagattttccgcccggagatggcggccccgagcctcccagaggcaggaatttggccgatgccgctgcttttgagaagatgattataagcgaactggtgcacaacaacctgcgcgggtcttctagcgcagccaaaggtcccccacccccggaaccaccggtacctccagttcccggaggaggcggcgaggaagaagcgggaggccccggaggtgccgacagagccgaaattgaactcctgtataaggcattagaggaacctctgctgttaccaagagcacaaagcgtgctatatcaaagcgatctggacgaaagcgagagctgtaccgccgaggacggcgccacctctagaccactgagctcgcctccagggcgggattcactgtatgcctcaggggccaatcttagagattcgccctcttatccagattcttcaccggagggtcccagcgaagccttaccacccccccccccagcgccccctgggccccctgagatttactatacttcacgtcctccagccctcgtcgccagaaacccattgcaaggctactaccaggtacggagaccatcacatgaaggctacctcgcggcccccggcctggaggggcccggaccagatggcgacggacagatgcaactcgtgaccagcctttag

SEQ ID NO: 42946 - DNA, 4410 bp, Artificial Sequence
  Description of Artificial Sequence: Synthetic coding sequence
atggcccggctggccgccgtgctgtggaacctgtgcgtgaccgccgtcctggtgacatctgcaactcagggtctcagtagggccggtttaccgttcggcctcatgcgcagggaactcgcatgtgagggatatccaatcgagttacgctgccccggctctgatgtaatcatggtggagaacgcgaattacggcagaacggacgacaagatttgcgatgcagaccctttccagatggagaacgtccagtgctacttgcccgacgctttcaaaatcatgagccaaagatgcaacaatagaacccagtgtgtggttgtcgccggttccgacgcctttccagatccctgtccaggcacctacaagtatttggaggtgcagtacgactgcgtaccctatatctttgtctgcccggggaccctgcagaaggtgcttgagcccaccagcacacacgagagcgaacaccaaagcggagcctggtgcaaagatccacttcaagcgggtgaccgcatctacgtgatgccttggatcccttatagaaccgacacgctgacagaatacgctagctgggaagattatgtagctgccaggcacacaacaacatatcgactgccgaaccgcgtggatggaaccggtttcgtcgtctacgatggtgccgtattttacaacaaagaaaggacccgcaacatcgtgaaatacgacctgcggacgcgcataaaatctggggagacagttattaataccgcaaactaccatgatacaagcccatacagatgggggggcaaaaccgacatagatctggccgtggacgaaaatggactgtgggtcatctacgctacggagggaaacaacggccgccttgttgtgtcgcaactcaatccttataccctgagatttgagggaacctgggaaaccggttatgataaacgtagtgcaagtaacgccttcatggtgtgtggggtgctgtacgttttaaggagtgtatatgtggacgacgatagcgaagctgccggaaatagggtggattacgcgtttaacaccaatgccaacagggaagagccagtgtcactgaccttccccaatccctatcagttcatcagttccgtggattacaacccaagggacaatcaattatatgtttggaataattactttgtcgtcagatactccttggagttcgggcctcctgacccctccgccgggcctgccacttcacccccactgagcacaaccaccaccgccaggcctacccccctcacttcgacggcatccccagccgctaccactcccctaaggcgtgcccccctcacaacccatcctgttggagccattaatcaactcggtccggatttacctcccgccacagcacccgtgccgagcaccaggagaccacccgccccaaacctccacgttagtccagagttattttgcgagccccgcgaagttcgacgtgtccagtggcctgcaacacagcaggggatgttggtggaaaggccatgcccaaaaggtacacgcggcatagcctcctttcaatgtttaccagcactggggttgtggaaccccagaggcccagacttgagcaactgtacatccccttgggtcaatcaggttgctcagaagatcaaatctggcgaaaatgccgcgaatatcgcctccgagctcgcccggcacacccggggatccatctacgcaggtgatgtgagctcttctgttaagctcatggagcagttacttgacattctggacgcacagttacaggctttaaggccgatcgagagagaaagtgctggcaagaactataacaagatgcacaaaagggaaaggacctgcaaggactatattaaagctgttgtggaaaccgtagacaacctcttgagacccgaggcacttgagtcctggaaggatatgaatgcgactgaacaggtccacaccgcaacgatgttgctagacgttctggaagagggtgcgtttctgctggccgacaacgtccgggagcccgcacggttcttggctgccaaggaaaacgtggttttagaagtcaccgtgctcaatacagagggtcaggtgcaggagctggtgttcccacaggaagaataccctagaaagaacagcattcagctgtccgcaaagacaattaagcagaactctcgtaacggagttgtgaaggtggtgttcatcctgtataataacctgggtcttttcctgagcacagaaaacgcgactgtcaagcttgctggggaggccggccccggcggccctggaggtgcatctctcgttgtgaacagccaggtgattgcagcttccattaataaggaatcatccagagtgttcctgatggatcctgtcatttttacagttgcgcacttagaggacaagaatcatttcaacgccaactgttccttctggaactatagtgaacgatcaatgctgggctattggagcacacagggctgtcgcctcgtggaaagcaataagacccacacaacttgtgcctgctcgcatttgactaacttcgccgtgctgatggcgcacagggagatttaccagggtcggattaatgagcttctgctgagcgtaatcacttgggtggggattgtgatctctctcgtgtgccttgctatttgtattagcacattctgcttcttgagaggtttgcaaacagaccgcaacactatacacaaaaacctgtgcatcaacctctttttagctgagctgctgtttcttgtgggaatcgataagacgcaatacgaaatcgcctgtcctattttcgccggcctgctgcattactttttcctggctgccttttcgtggctttgcctcgagggggtgcacctatatctgctccttgtcgaggtgtttgagagcgagtatagccgaaccaagtactattacttgggcgggtattgctttcccgccctggttgtgggcatagccgctgccatagactatcggagttacggcactgaaaaggcttgttggctaagggtcgataattacttcatttggtcattcatcgggccagtcagctttgttatcgtggtcaatcttgtgttcttgatggttacacttcacaagatgatccgatctagcagcgtgcttaaacccgacagctccaggttggacaacatcaaaagttgggctttaggggccattgcattactgtttctgttggggctgacttgggcatttggtttactgttcatcaacaaagagtccgtagtgatggcctacctcttcaccacatttaacgcattccagggtgtttttatttttgtcttccactgtgctctccagaaaaaagtgcacaaagaatattccaagtgtctgcggcatagctactgctgtatccggtccccgccaggcggtactcacggatcccttaaaacttcagctatgcgctcaaacacacgctactacaccggaactcaatctagaattcgtcgaatgtggaacgataccgtccgcaagcagaccgagtccagcttcatggctggggatattaatagcactccaacattgaacagaggaactatggggaaccacctacttacaaaccccgtgctgcagccccgggggggaacctcaccgtacaataccctgattgcagaatccgtgggatttaatccaagctccccacccgtgtttaattccccagggagctaccgggaacccaagcacccccttggagggcgggaggcctgcggcatggatacgctccctctgaatgggaattttaataattcctattcactgaggtcaggtgattttccccctggtgacggcggacctgaacccccgaggggcagaaatctggcggatgccgcagcctttgagaagatgataatctccgaactggtgcataacaatctgaggggctcctcttcagcagccaaaggaccacctccacctgagccgccggtgcctccagtgcctggagggggtggggaggaggaagccggtggacccggaggagccgatcgcgccgaaattgaattgctatataaggcgctggaagaacctcttttgctccccagagcccagagtgtgctgtatcagagtgacctggacgagagcgaatcttgcactgccgaagacggagccaccagccgcccgctttctagtcctcctggtagggacagcctgtacgcctccggagcaaatcttcgggactcaccttcctatcctgacagcagccccgagggcccatccgaagcgcttcctcccccccctcccgctccacccggccctcccgagatctactataccagccgcccgccagccctcgtagcgcgcaacccccttcaagggtactaccaggtgagacggccgagccacgagggttacctggcggccccaggtcttgaggggcctggcccagacggcgacggtcagatgcagctggtaacgtccttatag

SEQ ID NO: 42947 - DNA, 4296 bp, Artificial Sequence
  Description of Artificial Sequence: Synthetic coding sequence
atggtgagcagcggctgccggatgcggagcctgtggttcatcatcgtcatctcctttcttcccaatactgaaggctttagtcgggccgcactgccatttggactggtgcgacgagaactgtcctgtgagggctacagtattgatcttaggtgcccaggctcagacgtaatcatgatcgagtccgcaaactacggccgcacagacgacaaaatctgtgatgctgatccctttcagatggaaaataccgactgttacctacccgacgcatttaagataatgactcaacgatgtaacaatcgcacgcagtgcattgtggtaactggttcagacgtcttcccagatccctgtccagggacctataagtaccttgaagtgcaatatgaatgcgttccatatatctttgtgtgtccgggaaccttgaaggctatcgtcgactcaccatgcatatacgaagccgagcaaaaggcaggtgcctggtgcaaagatcctctccaagctgctgacaagatctacttcatgccttggacaccttaccgaacggataccctgatcgaatacgcctctttggaggactttcagaatagccggcagaccacaacctataaattgccgaacagggtggacggaactggtttcgttgtctatgatggcgcggtgttctttaacaaggaacgcactagaaacatcgttaagtttgatcttcggaccagaataaagagcggagaggcgataatcaactacgctaactaccacgatacgagtccctacagatggggaggaaaaaccgatatcgacctggctgtagacgaaaacggactctgggtaatctacgcgacagaacagaataacgggatgatcgtaatctcccagctgaacccatacacactacgctttgaggctacttgggaaacagtctacgacaagcgtgctgcttcaaacgctttcatgatctgtggggtgctgtacgttgtgaggagcgtgtatcaagacaacgagagcgagaccggcaaaaattctatcgattatatctacaacactcggctgaatagaggcgagtacgtcgacgtgccatttcctaaccagtaccaatacattgccgctgtggactataatcccagagacaatcagctatacgtgtggaacaacaatttcatcctccgctacagcctggagttcggtcctcctgaccccgcccaggtccccaccactgccgtcaccataaccagcagcgcagaactctttaaaaccatcataagcacaacgtccactaccagccagaaaggccccatgtcaaccacagttgctgggtctcaggaaggttctaagggaacgaagcctcctccagctgtgagcacaacaaagatccctcccatcactaatatcttcccacttccggagcgcttctgcgaagccctggactcaaaggggatcaagtggcctcagacccaacgcggcatgatggtcgagcggccctgtcctaaggggacacggggaactgctagctacctttgtatgatttctacagggacatggaatcccaagggccccgatctaagcaactgcacatcccattgggttaaccagcttgcacaaaagatcagaagtggcgagaatgccgcctctctcgcaaatgaactcgcaaagcacactaaagggcccgttttcgcgggcgacgtgtcctcctcagtgcgactgatggagcagctcgtcgatattttggacgcccagctccaggaacttaaaccatcagaaaaagattccgcaggaaggagctataacaaactacaaaagcgcgaaaagacttgccgcgcctatctcaaggcgatcgtcgataccgttgacaacttgttacgtccagaggccttggaatcctggaaacatatgaatagtagcgagcaagcccatacggctacaatgttgttggacactttggaagaaggtgcttttgtgctcgcagacaacttattagagcccacgagggtttctatgccaactgagaacatagtgctcgaggtagctgtgctgagcactgagggccagatccaggattttaaattcccattggggatcaaaggggcgggttcgtcaatccagctgtccgcaaacaccgtaaagcagaattcacggaatgggttagctaaattggtgttcattatatataggtcactggggcaattcctctctacagaaaacgcgacgataaaactgggggcggacttcatcggcaggaatagtaccatagcagtgaatagtcatgtgatcagtgtttccatcaataaagaatcatctcgcgtctatctcacagatcctgtgctattcacgctgcctcacatcgatccggataactactttaatgccaattgcagtttttggaattatagcgaacgtacaatgatggggtattggagtacacaggggtgcaagctagttgatacaaataaaacacgcactacctgtgcctgttctcacctgaccaacttcgctatcctgatggcccaccgggagatagcttacaaggatggtgtgcacgaattactgctgaccgtgatcacctgggtgggcattgtgatctctctcgtctgcctcgccatctgcatatttacattttgtttcttccgcggattacagtcagacagaaacaccatccacaagaacttatgcatcaacttgttcatcgctgagttcatttttctgataggaatcgacaaaaccaagtatgccattgcttgcccaatctttgcaggcctgctgcatttcttctttcttgctgccttcgcgtggatgtgtctggagggtgtgcaactgtacttgatgctagtggaagtttttgagagtgagtactcacgcaagaagtattattatgtcgcaggatatttattccccgccactgttgtaggtgtgtctgccgctatcgattataagagttatggaaccgagaaggcctgctggttgcacgtggataactattttatttggagcttcattggccccgtgacgttcatcatcctgctcaatatcatttttctggtgattacattatgtaagatggtaaaacactctaacactttgaagcctgactcaagtcgtctggaaaacattaataactatcgtgtttgtgatgggtattataacacagacctgcccggaagctgggtgctcggtgcctttgctctgctctgtctcctggggcttacttggtcttttggactgctgttcatcaacgaggaaactatcgtgatggcctacttgtttacaattttcaatgcttttcaaggagtctttatcttcatcttccactgcgccctgcagaagaaagtacgtaaagaatacgggaagtgctttcgacatagttactgctgtggtggtctgcctactgaaagcccgcattccagcgtgaaagcctcaactacacgcacctccgctaggtactctagcggtacacagagtcggatccggcgaatgtggaatgatactgtccgcaaacagtcagaatcaagctttatcagcggagatatcaactctaccagcactctgaaccagggacactccctcaataacgcaagagatacttctgcaatggatacccttcctctgaacggcaacttcaataacagctattcactccacaagggggactacaacgactccgtacaggtggttgattgtgggcttagccttaatgacacagctttcgaaaaaatgattatttccgagctggtccacaacaacttgcgtggatcatcaaaaacacacaacctggagctgactctgcccgtgaaacctgtaatcggcggctcctcaagcgaggacgacgccattgtagccgatgcctcctctctgatgcactccgataaccccgggctcgaactgcaccacaaagaactggaggcacccttgatccctcaaaggactcactccttgctataccaaccgcagaagaaggtgaagtcggaggggaccgattcctacgtgtctcagctgaccgccgaagcggaagatcacctgcaaagccccaatcgggatagtctatacacaagcatgccaaatctacgcgatagtccatatccagagtcgtctcccgatatggaagaagacctctctccatcacggcggtccgaaaacgaagatatttactacaaatctatgcccaacctgggcgctgggcatcagctacagatgtgttaccagatttctcgcggaaacagcgacggctacatcatccccattaacaaagaaggatgtattccagaaggcgacgtgcgggagggtcaaatgcagctcgtgactagtctgtag

SEQ ID NO: 42948 - DNA, 4212 bp, Artificial Sequence
  Description of Artificial Sequence: Synthetic coding sequence
atggtgagcagcggctgccggatgcggagcctgtggttcatcatcgtgatctcttttctcccaaacacagagggattctcgcgagctgcgctccctttcggcctggtgagacgggaactcagctgtgaaggatacagcatcgacctgcggtgccctggcagtgacgtgattatgattgagtccgccaattacgggcgcaccgatgacaagatttgcgacgccgatccatttcagatggagaataccgactgttaccttcccgatgcttttaaaatcatgactcagcggtgcaacaataggacacagtgcatagtggttacaggatcagatgtgttccccgacccttgccctggtacatacaagtatctcgaggtgcagtatgagtgcgtgccatatatattcgtttgtccaggcactctcaaggctattgttgactctccatgtatatatgaggccgagcagaaggctggcgcctggtgtaaggacccattgcaagctgccgacaaaatatacttcatgccttggactccatacaggacggacacactgattgagtatgccagccttgaggactttcagaatagtcggcagacaacaacctataagttgccaaacagggtcgatggcaccggattcgtggtttacgacggtgcagtattctttaataaggagcgcaccaggaatatcgttaagtttgacctgcggactaggatcaaaagcggcgaagctatcatcaattacgccaactatcacgacacctccccttatcgatggggcgggaagacagatattgatctggctgtagatgaaaatggtctgtgggttatctacgctacagaacagaataacgggatgattgttatctctcagttgaatccatacactctgcggtttgaggccacttgggagacggtgtatgacaagcgcgcagcaagcaatgccttcatgatctgtggagtgctatacgtggttaggtccgtgtaccaggacaatgaatcagagactggtaagaactcaatcgattacatctataatacgagactgaatcggggcgagtatgtcgacgtgccgtttccaaaccagtaccaatatatcgcagctgtcgactacaatccgcgcgataaccagctgtatgtttggaacaacaattttattcttagatacagcttggagttcggcccgcccgatcctgcccaagtacccactacggccgtgaccataacctcttctgccgaactgttcaagacaattatctcgaccactagtactacctctcagaagggccccatgagcacgactgttgcaggcagccaggagggatcaaaaggtaccaaaccacccccagccgtgagtactacaaagattccacccatcaccaatattttcccactgccggagcgtttttgcgaggctctcgatagtaaaggaatcaagtggcctcaaacccagaggggaatgatggtggaacggccctgccccaagggaactaggggcacagcgagttacctttgcatgattagtaccggcacctggaacccaaagggacccgatctttctaattgcacgagccattgggtcaatcagctggcacagaaaattcggtctggcgaaaacgctgcttcactggccaacgaacttgctaagcataccaaagggcccgtctttgccggagacgtctctagttccgtgaggcttatggaacagttagtcgacattttggatgcgcagctccaagagttgaagcccagtgaaaaggactcagctggccgcagttataacaaggccatcgtggacacagttgacaacttactccgtcccgaagctctcgaatcatggaagcacatgaattccagtgagcaggcccacacggctactatgttgctggatacactggaggaaggagcattcgtgctcgctgacaatctcctggagccaactagggtgtcaatgcctaccgaaaacatcgtgctggaggtggccgtactctctactgaaggccagattcaggacttcaagttcccactgggaattaagggggcaggttcttctatccagttgagcgccaacactgttaagcaaaacagccggaacggacttgcaaaacttgtcttcatcatctatcgatctttggggcagtttctgtctaccgaaaatgcgacaattaagcttggggccgactttatcggacgaaactctaccatcgctgtgaatagccatgtgatctcagtgtctatcaataaggagtcctctagggtctatctaaccgaccctgtcctgttcactctgcctcatattgatcccgataactatttcaatgctaactgctcattctggaactacagcgagcgtactatgatgggatactggtcgactcagggttgtaagctagtagacaccaataaaacacggaccacatgcgcctgtagtcacctaacaaactttgctatattgatggcacaccgagaaatcgcttacaaggacggtgttcacgagctcctcctgactgtgattacttgggtgggaatcgtgatttcactggtctgcctggccatttgtattttcaccttctgcttcttcagggggttgcagtccgacagaaatactattcacaaaaatctctgtattaacctgtttattgctgaattcatattcctgatcggtatcgacaaaaccaagtacgccatcgcctgcccgatctttgccggcctgctgcacttcttctttctggcagctttcgcttggatgtgtctcgagggcgtccagttgtatcttatgctcgtcgaggtgttcgaaagcgaatacagtcgtaagaaatattactacgttgctggctacctgttcccggccacagtagtgggggtctccgctgccatcgattacaagtcgtacggcactgaaaaggcttgctggctgcacgtagataactacttcatttggagctttattggccccgtcacctttataattctgctgaacatcatcttcctagtaattaccttatgcaagatggtcaagcatagcaatacgctgaagccagactccagccgcttggagaacattaaaagctgggtcctgggggccttcgccctcctctgcctgctgggtctcacttggtcttttggtctcctgtttatcaacgaggagaccatcgtgatggcctacctgtttaccatctttaacgcgttccagggcgtcttcatttttattttccactgtgcactgcagaagaaggtccgcaaagagtacggtaagtgctttcgccattcttactgttgtgggggtctgccgacagagagtcctcatagtagtgtcaaggcatcaactactcgcaccagcgcaagatattcctcaggtacgcagtccagaatacgacggatgtggaatgatacagtgcggaaacaaagtgagtcctctttcatatctggggacataaacagcacctctaccctgaaccagggccactctttgaacaatgcgcgtgacacgtctgccatggacacattgcccctcaatggaaatttcaataattcctatagcctacacaagggcgattacaatgactcggttcaggttgtggattgcggcctgtcattgaatgatacagctttcgagaagatgatcatatccgaactggttcataacaacctccgggggtcttcaaaaacacacaacttggaactgacgttgcccgtgaagccggtcattggtgggtcaagctccgaggatgatgccattgtggcggacgcctcctcccttatgcactccgacaatccgggactagagttgcatcataaggaactggaggctcccctgatcccacagaggacacactccctgctgtaccaaccccagaagaaggtgaagtcagagggcaccgacagctacgtgtcccagctcaccgccgaagccgaagaccaccttcagagccccaacagagactccttgtacacatctatgccaaatttgagggatagcccctaccccgaaagtagccctgacatggaggaggatctcagccctagccgtaggtccgagaatgaggacatatattataaatccatgcctaacttaggcgcgggtcaccagctccagatgtgttaccagatctcccggggaaacagcgacgggtatatcatcccaattaacaaagaaggctgcattccagagggtgatgtgcgagaggggcagatgcaacttgttacttcgctgtag

SEQ ID NO: 42949 - DNA, 4251 bp, Artificial Sequence
  Description of Artificial Sequence: Synthetic coding sequence
atggtgagcagcggctgccggatgcggagcctgtggttcatcatcgttatctcatttttgcccaatacggaaggcttttcaagagccgctctgccgtttggactggtccgcagagaactctcctgcgaaggttactccatcgacctccggtgccctggctccgatgtgattatgattgaaagcgcaaactacggtcgcaccgacgataagatttgcgacgcagaccccttccaaatggagaataccgattgctacctgcctgatgcatttaagatcatgactcagcgatgcaataatcggactcagtgcatcgtggttacagggtcagacgtgttcccggatccttgcccagggacatataagtatctcgaggtgcaatacgaatgcgtcccctacatttttgtctgccccggcacacttaaagcgatagtggattccccgtgtatttatgaagccgagcaaaaggctggcgcttggtgtaaagaccctttacaggccgccgataaaatctattttatgccgtggacgccctatagaacggatacattaatcgaatacgcttcccttgaggacttccagaattcgcgtcagactactacttataagctaccaaacagagtagacgggacaggtttcgtggtgtacgatggcgcagtcttctttaacaaagaaagaacacgaaacatagtcaaattcgatttgcgaacaagaattaagagtggagaagcaatcattaactacgcaaactaccacgacacatctccctaccggtggggcgggaaaactgacatcgacctagccgtggacgaaaatgggctgtgggtgatttacgctactgagcagaataatggtatgatcgtgatttcacagttaaacccatacactctccgcttcgaggcaacctgggaaacagtctatgacaagagggccgccagtaatgccttcatgatatgcggcgtgttatacgtggttcgatcagtctaccaggataatgagagtgaaaccggcaaaaactctattgactacatctacaacactcgcctcaaccgaggtgagtatgtggatgtgcctttcccaaaccaatatcagtacattgctgctgtcgactataacccgagggataatcaactgtatgtttggaacaataacttcattctccgttattctctcgagtttgggcctccagacccggctcaagtgccaacaaccgcggtgactatcaccagcagtgcagagcttttcaagacaattatctcaactacctccacgacgagccaaaaggggcccatgagcaccactgtggccggctcccaggaaggctctaagggtactaagccacccccagccgtttctacaacgaaaatcccaccaatcactaacattttccctctaccagagaggttttgcgaggccctggactcaaaaggaattaaatggccacagactcagaggggaatgatggtggagaggccctgtcccaaggggacccggggtaccgctagctacctctgcatgatcagtactggtacttggaacccaaaaggccccgatctatccaactgcaccagccattgggtgaaccagttagctcaaaagatcagatccggtgagaacgctgcctccctggctaacgaactggctaagcacaccaaaggacccgtcttcgccggagatgtatcttcctcagtaagattgatggagcaacttgtggacatcctggacgcccagctccaggagctgaagcctagtgagaaggatagcgcggggcggtcgtacaacaagttgcagaaaagagaaaagacctgccgagcatacctgaaggctatcgtggacactgttgacaatctgctgcgcccagaggcgctggaatcatggaagcatatgaatagtagcgagcaagcccacacggcaaccatgctccttgacacccttgaagagggtgcatttgtcttggctgacaacctcctggagcccacgcgcgtgtccatgcctaccgaaaacatagtcctggaagtggctgtgttgagcacagaaggccaaattcaggatttcaagttccccttgggcataaagggagccggcagctccattcagctgagcgccaacactgtgaaacagaatagccgcaacgggctggctaaactagtctttattatctaccgctcgctggggcaattcctctcaacggagaacgccacaatcaagcttggggctgattttatcgggagaaattccacaatcgctgtaaactcacacgtgatctcagtgagcattaacaaggaatctagtcgggtctatctcaccgatcctgtgctgttcaccctgccacacattgatcctgacaattactttaacgccaattgttccttctggaactattccgaacgtactatgatgggctactggagtactcaaggttgcaagctcgtggacaccaataagactaggacaacttgtgcctgctcacatctgacaaattttgccatcttgatggcccatagagagatcgcatataaagacggagtccatgaattgctgttgacagtgataacatgggttggcatcgtgatttctttggtttgccttgccatttgcatcttcaccttttgtttcttccgcggtctgcaatccgatagaaatacaatccacaaaaacctgtgtattaatctctttattgcggagttcatctttctcataggtatcgataagacgaaatacgccattgcttgcccaatattcgccggcttgctgcactttttcttccttgcagcctttgcctggatgtgtctagagggggtgcaactatatctgatgctggtcgaagtgttcgagtctgaatatagtcgtaaaaagtactactacgtcgctggatatctgttccctgccactgtcgtgggggtctccgctgccatcgactataagagttatggaactgaaaaagcctgctggctgcacgtagacaactacttcatttggagtttcatcggacccgttacattcattatccttctgaatattatcttcctggtcattactctgtgcaaaatggtgaaacacagcaatacactgaaacccgattcgagccggttggagaacatcaaatcctgggtcctgggagcctttgcacttctgtgtctgctggggcttacgtggtccttcggcttattgtttataaatgaagagaccattgtgatggcatacctctttaccattttcaacgcatttcagggcgtctttatatttatctttcattgtgccctgcaaaagaaggtgcgcaaagagtatggcaaatgtttccggcattcctattgttgcggggggctgcccaccgaatcccctcacagctctgttaaggccagtaccactcgtacctccgcacgatacagctccggaacccagtcgcgcatcagaaggatgtggaacgacaccgtaaggaagcagtcagagagcagctttatttccggggatataaatagtacatccactctaaatcagggtcacagcctcaataacgcaagagatacgagcgccatggatactctccctttgaatggaaatttcaacaactcctatagtctgcataaaggtgactacaacgatagcgtgcaagtggtggattgcggcctttctttgaacgataccgcttttgagaaaatgatcatcagcgagttagtccacaataatctgcgtggttccagtaaaactcataatctcgagttgaccttgccagtgaaaccagttatcggtgggtcttccagcgaggatgatgccatcgttgccgatgccagtagccttatgcacagtgacaacccagggctggagttacatcacaaggagctggaggcccctttaattccacagcgtacccatagtttattataccaaccacagaagaaagttaagagcgaagggacagatagctatgtgagccaactgacagcagaggctgaagaccatctacagagcccaaacagggatagtctgtacacctcaatgccaaacctgagagattcaccatatccagaatcatccccggacatggaagaagacctcagccccagcaggcgctccgaaaacgaagatatatactacaaatccatgcctaacctgggcgcaggccaccagcttcagatgtgctatcaaatttctcgaggcaacagcgatggttacattattccgatcaacaaagagggttgcatccccgaaggtgatgtcagagaagggcagatgcagcttgttactagtctgtag

SEQ ID NO: 42950 - DNA, 4212 bp, Artificial Sequence
  Description of Artificial Sequence: Synthetic coding sequence
atggtgagcagcggctgccggatgcggagcctgtggttcatcatcgtcattagcttccttcctaacaccgagggcttctctcgcgccgccctgcctttcggcctggtcaggcgggaactcagctgtgaaggatacagcatagacctacggtgccctggctctgatgtgattatgatcgaatcagcgaattacggccgcaccgatgataagatctgcgacgcggatcctttccagatggaaaataccgactgctatctgcccgatgcatttaaaataatgacgcagagatgcaacaatcggacgcagtgcatcgtggttaccggatccgatgttttccccgatccttgtcctggtacttacaagtacctcgaggtgcagtatgaatgtgtgccctatatcttcgtttgccccggcactctgaaggcaatagtggacagcccatgcatctatgaagccgagcagaaggctggcgcttggtgtaaggacccattgcaagcagccgataaaatatactttatgccatggaccccttataggacagatacactcattgaatacgcatccctggaggatttccagaacagcaggcagaccaccacctacaagcttcccaatcgagttgacggtactggatttgtcgtctacgacggtgccgtgttcttcaataaggagaggactaggaatatcgttaaattcgacctgcgtacccgcattaaatcaggcgaggccattatcaattatgccaactaccacgacacatcaccatacagatggggagggaagacagacattgacctggccgttgacgagaacggtctgtgggttatttacgccaccgaacaaaataatggtatgattgtgatcagtcagttgaatccctacactctcaggttcgaagctacttgggagaccgtttatgataagcgcgccgcctcaaatgcattcatgatctgcggagttctgtacgttgttaggagcgtttaccaggataacgaatcagaaactggtaaaaattcaatcgattatatttacaacaccaggctcaaccgcggtgaatatgtggacgtgcccttccctaaccagtaccagtacatcgctgccgttgactacaatcctagggacaatcagctgtacgtctggaataacaactttatcctgcgctactctcttgagttcggccccccagacccagctcaagttcccacaaccgctgtgactattacgagcagtgctgagctcttcaaaacaattattagcacgacctctacaacctctcaaaagggaccaatgagcacaaccgtggccggcagtcaggaagggtccaagggtacaaagccaccgccggcagtgtctaccaccaagatcccacctatcactaacatctttcccttgccggagagattttgtgaggccctcgacagcaagggtataaaatggcctcagactcagcgtggcatgatggtcgagcgcccatgtccaaagggcacccgcgggacagcctcctacctgtgcatgatctcaaccggtacatggaatccaaaggggcctgacctgagcaactgtacatcgcattgggtgaatcagctcgctcagaaaattcggagtggtgaaaatgctgcctctctggctaacgaactggcaaagcatacaaaaggccctgtgtttgctggcgacgtttcatcttccgtccgactgatggaacagctggttgacattctcgatgctcagctccaagagctcaagccatccgagaaagattcggctggcagaagctataacaaagcaatcgttgataccgtggataatctcctaagacccgaagctttggagtcatggaagcacatgaacagtagtgaacaggctcataccgcaactatgctcctggatacgttagaagaaggtgccttcgtgcttgccgacaatctgctggagccaacgagagtttccatgcctacggaaaatatagtcctggaggtggccgttttgagtacggaaggtcagatccaggattttaaattccctctgggtatcaagggagccgggagttcaatccagctgagtgcaaatacggtgaagcagaactccaggaatggcctcgctaagctcgtgttcatcatataccgatctctcggccagttcctgtcaacagaaaacgctactattaaattaggtgccgattttataggtcgaaacagcacaattgccgtgaactctcatgttatctcagtcagtatcaacaaagagtctagccgggtgtaccttaccgaccctgtgcttttcaccttgccacacatcgaccccgacaactattttaacgccaactgcagtttctggaactacagtgagcgcacaatgatgggctactggtctacgcagggatgtaaactagtcgacactaacaagacaaggacaacttgcgcctgcagccatctgacaaactttgccatcttgatggctcacagggagatcgcttataaggacggggtgcacgagctgcttctcaccgttatcacttgggtcggtatcgtgatatccctggtttgcttggccatctgcatttttactttttgcttttttaggggcctgcagtctgaccgaaacaccatccacaagaacctttgcattaacctttttatcgcggagttcatttttcttattgggatcgacaagacgaagtacgctattgcctgccctatatttgcaggcctgttgcacttttttttcctggcagcattcgcctggatgtgtctggagggtgtacagctgtatctcatgttggtggaggtgtttgaatccgaatatagcagaaagaaatattactatgtcgctgggtatctatttcccgctacagttgttggtgtgagcgctgcgatagattacaaatcatacggcaccgaaaaggcgtgctggctacacgttgataattactttatctggtccttcatcggaccggtgacttttattattctgctcaatatcattttcctggtaatcacgctgtgcaaaatggtgaagcacagcaacaccctgaaacctgatagtagcaggttagaaaacattaagtcatgggtgttgggcgcatttgcacttctttgtctgcttgggctaacgtggagcttcggcctcttgttcataaacgaagagaccattgtaatggcgtacttgtttacaatttttaacgcatttcaaggagtgtttatcttcatttttcattgcgctttacagaagaaagtgagaaaagagtacggcaaatgtttccggcactcttactgctgtggcggcctgccaacagagtcccctcactcttccgtcaaagcctccaccactcggacatcagcacgctactcaagtggaactcagtctcggataaggcgcatgtggaacgacacagtcagaaaacagtccgagagttcttttatcagcggcgacataaatagcaccagcactctgaaccagggccactccttgaataatgctagagacacctcggcgatggacactttgcccctaaacggaaactttaataacagttactccctccacaagggtgactataacgatagtgtccaagtggtagactgcggcctgtccctgaatgacaccgctttcgaaaagatgatcatctctgaactagtccataacaaccttcggggcagttctaagacccacaatctggagttgaccctgcctgtaaagccagtgatcggggggtcctcatctgaggacgacgcgattgttgccgacgcttccagtctgatgcactctgacaatcccggtctcgagctgcaccacaaggagctcgaagctccactgattccccagagaactcactcactactgtatcagcctcagaaaaaagttaaatcagaagggaccgattcttacgtgagtcagcttacagccgaagcggaagaccacctgcagtccccaaatagagactctctgtataccagcatgcctaacctacgggacagcccctatccggagtcctctcctgacatggaggaggatctcagcccaagcaggcgtagcgagaatgaggacatttattataagtccatgccgaacttaggggccgggcaccagctgcagatgtgctaccagatcagtcgcggcaactctgatggctatataataccaatcaataaggaggggtgcatccccgagggcgacgtgcgcgagggccagatgcaactggttacaagtttatag

SEQ ID NO: 42951 - DNA, 3372 bp, Artificial Sequence
  Description of Artificial Sequence: Synthetic coding sequence
atggtgagcagcggctgccggatgcggagcctgtggttcatcatcgtgattagctttctgcccaatacagaggggttctccagggcagctctacccttcgggttggtcagacgggagctgtcttgcgaaggctacagtattgacctccgctgccccgggagtgacgtcatcatgattgagtcagcgaactacggaagaactgatgacaagatatgtgacgccgacccatttcagatggaaaatacagactgttacctgcctgacgcattcaagatcatgacccagcggtgtaataatcgaacacaatgcatcgtggtcactgggtcagatgtgttccccgacccctgcccaggtacatacaaatatcttgaggtgcagtacgaatgtgtgccgtacatctttgtgtgcccagggacgctcaaggctatcgtcgactctccgtgcatctacgaggccgaacagaaagctggagcctggtgtaaggatcccctgcaggcagctgacaagatctacttcatgccctggaccccttacagaacagacacgttaatcgagtacgccagcctcgaggattttcagaattcgagacaaaccactacctacaaactccccaaccgtgtcgacgggactggattcgttgtgtacgacggagcagttttctttaacaaagaaaggactcggaatattgtgaagttcgacctaagaaccaggattaaaagtggagaggccatcattaactatgccaactaccacgacacttcaccgtatagatggggcggcaaaacagatatcgatctcgccgtagacgagaacggtttgtgggtaatctacgcaactgagcagaacaatggtatgatcgtgatctctcagctgaatccgtataccctgcgatttgaggccacatgggaaacggtgtacgacaaacgcgctgccagcaatgccttcatgatatgtggggtcctttacgtagttcgaagcgtgtatcaagacaacgagagcgagacaggcaaaaatagcatcgactacatttacaacacgagactgaacagaggggagtacgtcgacgtccctttccccaatcagtatcagtacatcgctgccgttgattacaatcctagagataaccaactgtatgtgtggaacaacaactttatcttgaggtattctcttgagttcggtcctccagaccccgcccaagtgcctactacggccgtgaccatcaccagctctgctgagttgttcaaaactattatttccacgacttccaccacctcgcaaaaagggccaatgtctacaacggttgccggctcccaagaaggcagcaagggaactaagccaccccctgctgtatcaaccacgaaaataccgccgatcactaacatcttcccgctgcctgagcgtttctgcgaggcgctcgactctaagggaatcaaatggcctcaaactcagcggggcatgatggtggaacgaccatgtcctaagggcacacgcggtacagcatcctacttatgcatgataagcacagggacgtggaaccccaaagggccggatttgtccaattgcacgagccattgggtgaaccagctcgctcagaaaataagatccggagaaaacgccgcttctcttgcaaatgaactcgcgaaacacaccaagggccccgtctttgctggagacgtgagctccagcgtgaggttaatggaacagctggtcgatattctggacgcacagctacaagagctgaaacctagcgaaaaggattctgccggccggtcatataacaaggccatcgtagatactgtggacaacctgttgaggcctgaggcccttgagtcttggaagcatatgaatagttctgagcaggcccacacagcaacgatgctgctggacaccctcgaggaaggagcctttgtgttagcagacaatctcctggagcctacacgtgtaagtatgccaactgagaacatagtgcttgaggtggctgtgctcagtaccgagggccagattcaggacttcaagtttccactgggcatcaagggtgctggctcctctattcagctgagcgcaaacacagtaaagcagaactcaaggaacgggctcgccaagttagtgttcatcatatatagaagcctgggtcagtttctgagcactgagaacgcgaccatcaaactcggagccgacttcatagggagaaacagcaccatcgcagtgaattcccacgttatttctgtcagcatcaacaaggaatcctcacgagtatacctgaccgaccccgtactgttcaccctgccacacattgaccctgacaactattttaacgctaattgctcgttctggaactatagcgaacgcaccatgatgggctactggagcacgcaggggtgcaaactggtcgatactaacaaaactcgcacaacttgtgcttgctcgcatcttactaattttgcgatactgatggcgcaccgggagatcgcttataaggatggggtgcacgaacttttactcaccgtgataacttgggtgggcatcgttatctctctggtttgtctcgctatctgcatctttactttctgctttttccgcggcctgcaatcggaccgcaataccatacacaaaaacctttgcattaatctctttatcgcagaattcatcttcctaattgggattgataaaacaaagtacgcaattgcatgcccaattttcgcaggtctgctccatttcttcttcctcgcggccttcgcctggatgtgcctcgagggcgtgcagctgtatctgatgctggtggaagttttcgaatctgagtactccaggaaaaaatattactacgtggcagggtatctcttcccagccactgttgtcggagtgtcggctgccattgattacaagagctatggcactgaaaaagcctgttggcttcacgttgataactacttcatatggagctttatcggtcctgtaacatttattatcttgctgaatatcatattcttggtgattacactctgcaagatggtaaagcatagcaataccctaaaacccgactcctcgaggcttgagaatatcaaatcttgggtcctcggagcctttgcattactgtgtctgttaggactgacctggtcgtttggcttgctgttcatcaacgaggagactattgtgatggcttacctgttcacaatctttaatgctttccagggcgtttttatctttatttttcactgcgcattgcaaaagaaggtccgcaaagagtatgggaaatgcttccgacactcctactgttgtggcggcctcccgacagagtcccctcacagttccgtgaaagcttctaccacccggacatctgctcggtattcctccggcacccaggacatccattag

SEQ ID NO: 42952 - DNA, 3534 bp, Artificial Sequence
  Description of Artificial Sequence: Synthetic coding sequence
atggtgagcagcggctgccggatgcggagcctgtggttcatcatcgtgatttcctttttgccgaacaccgaaggcttctctagagccgccttacccttcgggctggtccgaagggaactcagctgcgagggctatagcatcgacctgaggtgtccaggttctgatgtgattatgatcgagtcagccaattacgggagaacggacgacaagatctgcgatgcggatcccttccagatggaaaatacagactgctatctgccggatgctttcaaaatcatgacccaacggtgtaataatagaacacaatgtattgtagtgaccggcagtgatgtctttccagacccttgccccggtacctacaaataccttgaagtgcaatacgagtgtgttccatacattttcgtctgtcccggtactttgaaggccatagtggactctccatgcatatacgaagccgagcagaaggccggtgcctggtgtaaagatcctcttcaggctgccgacaaaatctatttcatgccctggactccatacagaaccgacacacttatagagtatgctagtctcgaggatttccagaattcacgccagaccacaacttataagctgcctaatagagttgacggtacaggtttcgtggtatatgacggagcagtctttttcaataaggagcgaactcggaatatcgtcaaatttgatctcaggacccgaattaaaagtggcgaagccattatcaattatgctaactatcacgacactagcccttatcggtggggcggcaagaccgatatcgacctggctgtagatgaaaacggcttatgggtcatctacgctactgaacagaataacggcatgatagtaataagccagcttaacccatacacactcagattcgaggccacctgggaaacagtatacgataagcgagctgcttctaacgcttttatgatttgtggggtgttgtacgtggttagaagcgtgtaccaggacaatgagtctgagacagggaaaaatagcattgactacatttataatactagactgaacaggggtgaatacgttgacgtgccgttccctaatcagtatcagtacattgccgcagtagactacaatcctcgggacaaccagctgtacgtgtggaacaataactttatactgagatactctctagaattcggccctccggatccagcccaggttcccactactgctgtgaccatcacctcctccgcagagctgttcaaaactataattagcacgacatccacaacttcccagaaaggtcctatgagtactactgtggccggatcccaagagggatctaaaggcactaagccgccccccgccgtgagcaccacaaaaatacctcccataactaacatctttcctctgcccgaacgcttctgtgaagcccttgactctaaggggataaaatggccccaaacgcagagaggcatgatggtcgaaaggccatgtccgaagggtactcgcggcactgcctcttacctttgcatgatctctactggcacatggaatccaaagggcccagacctgagcaactgtactagccattgggtcaatcagttggcccaaaaaatccgcagcggtgaaaatgccgcctccctggccaacgagctagctaagcataccaaaggacccgtattcgcgggcgacgtctcatcctccgtcagactcatggagcagttggtggatattctcgacgcacagctccaggaactaaagcctagcgaaaaagacagtgcaggcaggtcgtataataaagcgattgtggacactgttgacaacctgcttaggcctgaagccctggagagctggaagcacatgaattcctcggagcaggctcatactgccacgatgctgttagataccctggaggaaggtgccttcgtcctggcggacaatttgctggagcccacccgtgtctctatgccaaccgaaaatatagtcctggaagtggccgtgttgagcaccgagggccagatacaggattttaagttcccactgggcattaaaggagctggcagttccatccaactctcagccaatactgtaaaacagaacagtcgtaacggcctggccaagcttgttttcattatttaccgatccctcggtcagtttctatcaactgaaaatgcaactattaaattaggtgccgattttatagggcgtaacagcactattgccgtgaacagccacgtaataagcgtgtctattaacaaggagagttcacgagtctacttgaccgatccagtacttttcacgctgccccatatcgatccagataattactttaatgctaactgttcattctggaactacagtgagaggacaatgatgggctattggagtactcagggatgtaaattggttgatacaaacaagactaggacgacttgtgcctgtagccatctgactaatttcgcaatccttatggcacatagggaaatagcgtataaagacggcgtgcacgaactactgctcaccgtcataacttgggtggggatcgtcatcagcttggtgtgcttggccatttgtatctttaccttctgcttctttcgtggtttgcagtcggaccggaacaccatccacaagaatctatgcatcaatctgttcatcgccgaattcatctttttgatcggaattgataaaacaaaatatgcaatcgcttgtccaatattcgctggcctcctccatttcttttttctggcagccttcgcgtggatgtgtctcgaaggagtacagctgtacctgatgctggtggaggtgtttgagtcagagtactcaagaaaaaaatattattacgtcgcaggatacctgttccctgccaccgtcgtcggcgtgtcagccgcgatcgattacaagtcctatggaactgaaaaagcctgctggcttcatgtggataactacttcatctggagctttataggacctgtcacctttattatactcctgaacatcatctttctggtgattactctgtgcaagatggttaaacattccaataccctgaagccggactcttcccgtctcgagaacataaagagttgggtgttaggagccttcgccttactgtgtttactgggcttgacctggagctttggtctcctgtttattaatgaagagaccattgtgatggcatacttgtttacaatcttcaatgcctttcaaggcgtcttcatctttatattccattgcgccctccaaaaaaaggttagaaaggagtacggaaagtgtttcaggcactcttattgttgtgggggcctcccaacggagtccccacactcctcggtgaaagcctcgactaccagaactagtgctagatacagttcgggcacccagagtcgtatcagaagaatgtggaacgataccgtgcggaagcagtctgagtccagcttcatctcaggcgacattaattctacatcaaccctgaaccaagggctcaccagtcacgggctcagagcacatctgcaagacctgtatcacctggagctcttactgggacagatcgcttag

SEQ ID NO: 42953 - DNA, 4425 bp, Artificial Sequence
  Description of Artificial Sequence: Synthetic coding sequence
atggtgagcagcggctgccggatgcggagcctgtggttcatcatcgtcatatccttcttgcctaacactgaaggcttttcacgcgccgcgctaccctttggactcgtgcggcgcgaattgtcttgcgaaggctattctatcgatttgcgttgccccggctcagacgtgataatgattgagagtgccaactacgggcggaccgacgacaagatttgcgacgctgatccattccaaatggagaataccgactgctaccttcccgacgccttcaagattatgactcagcgatgcaataaccgcacgcagtgcatcgtggttaccggatcagacgtgttcccggacccgtgtccaggcacatacaaataccttgaagttcagtacgagtgtgtcccttatatttttgtctgtcctggcacactaaaagctatcgttgacagtccttgcatatatgaggccgagcagaaggccggcgcctggtgcaaggatcccttgcaggcagccgataaaatctattttatgccgtggaccccatatcgcaccgacaccctgatcgaatatgcatcgctggaggactttcagaactcccgccagactactacatataaactgccaaatagagtagatggaaccgggtttgtcgtttacgatggagccgtgttttttaataaagaacgcacgcgcaatatagtaaagttcgacctcaggaccaggattaaatccggagaggcaattattaattacgccaattatcatgacacctcgccgtacagatggggcgggaagaccgatattgatctcgcagtagacgagaacgggttgtgggtcatttacgccacggagcagaacaacggtatgatagtaatatctcagctaaatccctacactctgcggtttgaagcaacatgggagacggtgtacgataagcgagcagctagcaacgcatttatgatttgtggcgtcctgtatgtggtgcgctctgtctaccaggacaatgaatctgagactggaaagaattctattgactacatttacaacacacgactgaacaggggagagtatgtggacgtgcccttcccgaatcagtatcaatacatagctgccgttgactataaccctagagataatcaactgtatgtgtggaataacaatttcatactccggtactccctggagttcggcccgcccgaccccgctcaggtccccactactgccgtcacaataactagctcagctgagttgttcaagaccataatctctaccacctccaccactagccagaagggaccaatgagcactactgttgccggaagtcaagagggcagcaaagggacaaaacccccccccgccgtgtccaccactaagattccccctattaccaacatttttcctctgcccgagaggttctgcgaggccctggattctaaaggaattaaatggcctcaaactcagcgcggaatgatggtggagagaccctgtcccaagggaaccaggggtaccgcatcatatctgtgtatgatctctacaggtacttggaatccgaagggacctgacttgagcaattgtacctcccattgggtcaaccagctggcccagaaaatccggagtggggagaatgctgccagcctggccaacgagctcgccaagcataccaagggtcctgtttttgcaggagatgtttcaagcagtgtgcgactgatggagcaattggtcgatatcctggatgcccagttgcaggaattgaaacctagtgagaaagattcagcgggcagaagctacaataaactgcagaagcgggagaaaacctgtagagcttacctgaaggctatcgtcgacactgtggacaacctccttcgacccgaggcgcttgagagttggaagcacatgaacagcagcgaacaggctcacacagccacaatgctcctcgataccctggaagagggcgcgtttgtgctcgccgacaacctactagaacccacccgagtgagtatgcctacagagaacatagtgctggaagtggctgtgctcagtacagagggccagatccaggatttcaagtttcccctgggaataaagggagctggctcaagtatccaactgagtgcaaataccgtgaaacaaaattcgcgcaacggtttggcgaaactcgtgtttatcatctaccgttctctcggacagttcctgtccacagagaacgctaccatcaagctgggggccgattttatagggcggaactctaccatcgccgtgaacagccacgtgatctccgtgtctatcaacaaagagagtagtagagtgtatctgaccgatccagttctcttcactttaccacacatcgaccccgataattacttcaacgccaactgctctttttggaactatagcgaacggacaatgatgggatactggtcaacacaggggtgtaagttggtcgacaccaacaaaactcgcaccacatgtgcttgctcccacctgaccaattttgccatcctgatggcacacagagagattgcctacaaagacggggtacatgaactgctgcttaccgttatcacatgggtgggcattgtgatctctctcgtttgcctggctatctgtattttcactttctgcttctttcgtggtttgcagtctgatcggaatacaatccataagaacctgtgtatcaatctcttcattgccgagttcatattcctgatcggtatcgacaaaacaaagtacgctatagcttgccccatcttcgccggtctgctgcacttctttttcctggccgcctttgcttggatgtgccttgagggagttcagctctacttgatgttagtggaggtcttcgaaagcgaatactcccgcaagaagtattattatgtcgccggatatctttttccggccaccgtcgtcggagtctcagcagcgattgattacaagtcatatggcactgagaaggcatgctggctgcatgtggacaactacttcatctggtccttcatcgggccagtcacattcattatattactcaatatcatcttcctggtcattaccctctgcaaaatggttaaacatagcaatacgctcaagcctgactcgagccgcctggaaaatatcaacaattacagggtttgcgacggatactacaacacagacttacctgggtcctgggtgctcggcgcattcgccttattgtgccttctcgggctgacatggtcattcgggctgctgtttattaacgaagaaaccatcgttatggcatatctgttcacaattttcaatgcttttcagggggtcttcatttttatttttcattgcgctctgcagaagaaggtcaggaaggaatacggcaaatgcttcagacactcctactgctgcggtggactccccacagaaagcccccactccagtgtaaaggcttctaccacgcgtacatccgcaaggtatagctctggtacacagagccgcattagacgaatgtggaatgacactgtgcgaaaacaatccgaatcctcattcatttccggggatatcaacagcacctcaaccttaaaccaggggatgactggcaattatctgctgaccaacccactgctccgaccccacggaacaaacaatccttacaacacactgctggccgaaacagtagtctgcaatgctcccagcgccccagtttttaattcacccggccactctctgaataatgccagagacacctcagccatggatactctgcccctcaatggaaactttaataactcttattcattgcacaagggagattataatgacagtgtccaagttgttgattgcgggttatctctgaatgatactgcatttgaaaagatgatcataagcgagctggttcacaataacctgagggggagcagcaagactcacaatctggagttaaccctgcccgtgaagccagtgatcggcgggtcttctagtgaggacgatgcaatcgtagctgatgcaagctccctgatgcactcagataatcctgggctggagttacaccacaaagaactcgaggctccactgatcccacagagaactcacagcctgttgtaccagcctcaaaagaaggtcaaatccgaaggtacagactcttacgtgagccagcttacagctgaggctgaagatcaccttcaaagccctaatcgagactcactgtatacgtcaatgcccaatctccgcgattccccttatcccgagtcttccccagatatggaagaggatctgagcccgtcccgccgcagcgagaatgaggacatttattacaagtctatgccgaatctgggcgccggccaccagctgcagatgtgctaccagatttcaaggggcaactcagacgggtatatcatccccatcaataaggaaggatgcatcccggagggagacgtgagagagggacagatgcaactcgtgacttccctgtag

SEQ ID NO: 42954 - DNA, 4155 bp, Artificial Sequence
  Description of Artificial Sequence: Synthetic coding sequence
atggtgagcagcggctgccggatgcggagcctgtggttcatcatcgtgatctcctttctgccgaatacagaaggcttcagtcgggccgcccttccttttggactggtgagaagagagctctcctgtgaaggatacagcatcgatctgagatgccccggctccgatgtgataatgatcgaatcagccaactatggaaggaccgacgacaagatttgtgatgctgacccttttcagatggaaaatacagactgctacctccccgacgccttcaaaatcatgacacagaggtgtaacaatagaacccaatgcattgtggtgaccgggtctgacgtgttccctgatccctgccctggtacatacaagtatctagaggtgcagtatgagtgcgtcccgtatatggaacaaaaagtgttcgtatgccccggcaccctcaaagccatcgttgactctccttgtatctacgaggcagagcagaaggccggagcatggtgtaaggatccccttcaagctgcagacaagatctattttatgccctggacgccatacagaactgacacactgatcgagtatgccagtctggaggactttcagaatagcaggcagaccaccacatacaagctgcccaaccgcgtggatggcactggctttgtggtgtatgacggggcagttttttttaataaggagagaacacgtaacattgtaaagttcgatttgcgaacaaggataaaaagtggggaggcgataatcaactatgccaattaccacgatacttccccataccggtggggcggtaagactgatattgaccttgcagtcgatgagaatgggttatgggtcatctacgccaccgaacagaacaacggcatgattgttatctcacaactgaatccctacacgctccggttcgaggctacctgggagacagtgtacgataagagagctgcaagtaatgctttcatgatttgcggcgtcttatacgtcgttagatccgtgtaccaggacaacgagtctgagacagggaagaatagcatcgattatatttacaacacaagattgaacaggggggaatacgtggacgtgccctttcctaatcagtatcagtacatcgccgctgtagactacaatccaagagacaaccagctctatgtgtggaataacaatttcattctccgatactccctggagtttggacccccagacccagcccaagaacggttttgtgaggcgctggatagtaagggaataaagtggcctcagacccaaaggggcatgatggttgagcgtccatgtcctaagggcacacgcgggacggcatcatacctgtgtatgatttctaccggcacgtggaacccaaagggccccgacttgtcaaactgcacctcgcattgggttaatcagctggcacaaaaaatacgttcaggcgagaacgctgccagtctggcaaacgagctggctaaacacacaaaaggccccgtcttcgctggcgacgtgagcagcagtgtgcgtctcatggagcagttggtcgatatcctcgacgcccagctccaggagctgaagccatccgagaaggatagtgcgggcagatcatacaataaggccattgtcgacacggtggataatttgctgagacccgaggccctagaaagttggaagcacatgaatagctctgagcaggcacacacagctacaatgcttttggacacattggaggaaggcgcattcgtgctggcagataacctcctggagcccacaagggtcagtatgcccacagagaatattgtactggaagtggccgtgttgtccaccgagggacagattcaggactttaagtttcccctggggattaaaggcgccggtagctccatacagctctctgccaataccgtcaagcagaactcgcgtaatgggcttgccaaactggtcttcatcatctaccgtagcctcgggcagtttctttcaactgagaatgcaaccataaagttgggtgcagattttatcgggcgaaactctactattgctgtcaacagtcacgtgatcagtgtgtctattaacaaggagtcctcccgggtctatctgactgaccctgttctgtttacccttccacatatagaccccgataattatttcaacgccaactgcagcttctggaattattctgagcgaaccatgatgggctattggagtacacaaggttgcaaacttgtcgacactaacaaaacccgaaccacctgcgcttgctcccatctcaccaactttgcaatcctgatggctcaccgggagatcgcatacaaggacggcgtccatgagttgcttctgaccgttatcacctgggtcgggatcgtgataagtctggtgtgtctcgcaatatgtatcttcactttttgcttcttccgcggactccagtccgatcggaacaccattcacaaaaatctgtgtatcaacctctttattgcagagttcatttttctgatcggcatagataaaacaaaatacgccatcgcttgcccaatctttgctggactgctgcatttttttttcttggccgccttcgcttggatgtgcttggaaggcgtgcagttgtacttaatgttagtagaagtcttcgagtccgagtattctcggaagaaatattactacgtggctgggtatctcttccccgccacggttgtaggtgtcagtgctgctatagattataaatcttacggaaccgagaaggcgtgctggctccacgttgacaactattttatctggagctttattggacctgtgaccttcatcatcctcctcaacattatttttctagtcatcacgttgtgtaaaatggtcaagcattcgaataccttgaagcctgatagctcaaggctggagaatatcaagtcatgggtcttaggggcattcgctcttctctgtctgctagggcttacatggagcttcggcttgctgttcatcaacgaagaaaccattgttatggcctacttgtttaccatcttcaacgcctttcagggcgtctttatcttcatcttccactgtgctttacagaagaaggtcagaaaagagtatgggaagtgcttccgccactcgtactgctgtggcggccttcctactgagagccctcactcatctgtgaaggctagcactactcgcacctcagcacggtactcaagcggtacccagagcaggatacggagaatgtggaacgatactgtgagaaagcagtctgagagcagcttcatttccggtgatataaattctacatctaccctaaatcaaggcatgacaggcaattacctgctgactaaccctctgctgaggccacatggaaccaataatccttataacaccctgctggctgaaaccgtggtttgtaatgcacccagtgccccagttttcaactcacccggacacagtttaaacaacgccagggacacctccgcaatggatacactaccgctgaacggtaactttaataattcctattcacttcacaagggagattataacgactcagttcaggtggtggactgtggactatctctgaacgacacagcctttgagaagatgattattagcgaacttgtgcacaataacctgcggggttcttcaaagacacacaatctggaacttactctgcccgtgaaacctgtgataggcggaagttcgagtgaagacgacgcaattgtcgccgatgcctccagtctgatgcattctgataacccaggtctggagcttcaccataaggagttggaagctcccctcataccccaaagaacccatagtcttctataccaaccgcagaagaaggtcaaatccgaaggcaccgattcttatgtctcacagctcaccgctgaagcggaagaccacctgcagtcaccaaatagggattctctttataccagtatgccaaatcttcgagacagtccatacccggaaagtagtcccgacatggaggaggacctctctccatctagacggagtgaaaacgaagatatctactacaaaagcatgccaaatctaggcgccgggcaccagctccagatgtgttatcaaatctcacgaggtaacagtgacgggtatatcattcctattaacaaggaaggatgcatccccgaaggggatgtaagagagggacagatgcagcttgtcacgtctctgtag

SEQ ID NO: 42955 - DNA, 4386 bp, Artificial Sequence
  Description of Artificial Sequence: Synthetic coding sequence
atggtgagcagcggctgccggatgcggagcctgtggttcatcatcgtaatttcatttctgcccaacacggagggcttctccagagccgccctgccattcgggctggtgcgtcgggaactgtcctgtgaggggtacagcatcgacttgcgatgccccggttctgacgtgattatgatcgaatccgctaattacgggcgcaccgatgacaagatttgcgatgccgacccattccagatggaaaacactgattgctatctgcccgacgcctttaagataatgacccagaggtgtaacaatcgtacacagtgcattgtggttaccgggagcgacgtcttcccagatccctgtcctggcacgtacaaatatctggaggtgcagtacgaatgtgtaccctacatcttcgtatgtcccggtacattgaaggccatagtagactcaccatgtatctacgaggctgaacagaaggccggtgcttggtgtaaggacccactccaggcagctgataagatctacttcatgccatggacaccctatcgtactgacaccctaatcgagtacgcgtccctggaggacttccagaacagccggcagacaactacatataaactgcccaacagagtcgacgggaccgggttcgtggtatatgacggtgccgtcttcttcaataaggagcgcacaaggaatatagtgaagttcgacctcaggacccggattaagagcggggaagccattatcaattatgcaaattatcacgatacgtctccctacaggtggggcggaaaaaccgacattgaccttgctgtggatgagaacggcttatgggtaatttacgcaaccgaacagaataatggcatgattgtaattagccagctaaatccatacactcttcggttcgaggccacttgggaaaccgtatatgataaacgcgccgcctccaatgccttcatgatctgcggggtactatacgttgtgagatccgtctatcaggacaatgagtctgagacaggaaaaaattcaatagactacatctataacactaggctgaaccggggcgagtacgttgatgtgccattccccaatcagtaccagtatattgcggccgtcgactataacccccgggataaccagctttatgtgtggaataataacttcattctgcggtacagcctggaattcggccctcccgaccccgcacaggtgccaacgaccgcagttactatcacatcttccgcagagctgtttaaaaccatcatatccaccaccagcacaacaagtcagaagggccctatgtcaactactgtggctggttcccaggaaggcagcaaaggaactaagccccccccagccgtaagtacgacaaagattcccccgatcactaatattttccctctgccagagcggttctgcgaagccctcgactccaagggaatcaagtggccacagactcaacgcgggatgatggtcgagaggccttgtccgaaagggacccggggaacagctagctacctatgcatgattagcacaggcacctggaaccctaagggcccagaccttagcaattgcacctctcactgggtgaatcagctggcacaaaagattcggtccggcgaaaacgctgcttccctggccaatgaattagccaagcacactaagggccccgtatttgcaggcgatgtttcgtccagtgtacgcctcatggaacagctcgtggacatccttgacgcccaactgcaggaacttaagccaagcgagaaggacagcgcaggcaggagctataataaagccatcgtcgacacagtggacaacttgctgcggcctgaggcactggagagttggaaacatatgaattccagtgagcaggcgcatacggcgactatgctgctggatactctcgaggagggcgctttcgtgctggctgataatctgctggaaccaaccagggtgagtatgccaacggagaatattgttctggaggttgccgttttgagcaccgagggacagattcaggattttaaattccccttgggaatcaagggagcggggtcttctattcagctgagtgcgaacactgtgaagcagaactcccgtaatgggctggctaaacttgtttttattatttacagatcactggggcaattcctctcaaccgagaacgctactatcaagcttggtgctgactttatcggtcgcaacagcacaattgccgtgaacagtcatgtcatcagtgtgtccattaataaggaaagctctagagtctatttgaccgaccccgtcctatttaccctaccccatatcgatcccgacaattatttcaacgcaaactgttctttttggaactatagcgaaaggaccatgatgggctactggtccacccagggctgtaagttagttgacacaaataagactcgaacaacctgcgcctgctcccacctgactaactttgctattctgatggcacaccgagagatcgcctataaggacggagtccatgaactcttgttaacagttatcacatgggtaggtatcgtaatctcacttgtttgcctggctatctgcatcttcactttttgcttcttccgcggcctgcagagcgacaggaacaccattcacaaaaacctgtgtatcaatttatttattgccgaatttatctttctaatcgggatcgacaaaacaaaatatgccatcgcatgtcccattttcgccggactactgcacttcttcttcctggcagctttcgcttggatgtgccttgaaggtgtccagctctacctaatgctcgtagaagtgttcgagagcgagtatagccggaaaaaatactattatgttgctggatacctgtttccagctactgtggtgggcgtatctgccgccatcgattataaaagctatggtaccgagaaggcctgttggctgcacgtggataactacttcatctggagcttcatcgggccagtaacattcataatccttcttaacattatctttctcgtcataaccctttgtaaaatggtgaagcacagcaatacgctgaagcctgactcttcccgcctggagaacattaacaattatcgcgtgtgtgacggctactacaacaccgatcttcccggcagctgggtcctgggcgcattcgccctgctgtgcctgctcggcctcacatggtccttcggactgttattcatcaacgaagaaacaatagtcatggcttatctttttacaattttcaacgcattccaaggcgtgtttatttttatctttcactgcgccctccagaaaaaggtgcggaaggaatatggcaaatgttttagacactcctattgttgtggcggtttgccaaccgaaagcccccacagctctgtcaaagcttccacaaccaggacatccgcacgttactcatctggaacacagagtcgaatccgcagaatgtggaacgataccgttcgtaagcaaagcgaaagttcatttatttctggagacattaattcaacatccactctgaaccagggtatgacaggaaactacctcttgactaaccctttgctcagaccacacggaaccaacaatccgtacaatactcttcttgcggaaactgtggtatgcaatgctccatctgctccagtgtttaacagccctggtcatagcctaaacaacgcaagagacacaagcgccatggacactctgcccctgaacggaaacttcaacaacagctacagtctacacaagggagattataatgacagtgtgcaggttgtggactgtgggctgtccctcaatgacaccgcgttcgagaagatgataatttccgaactggtccataataacctccgcggctctagcaagactcacaacctcgaacttacgttacctgtgaaacctgtcatcggcggcagcagttcggaagatgacgccattgtggccgatgcttcatcactcatgcattcagacaacccaggactcgaattgcatcataaagaactggaagcacctctgatcccccagcgaactcactctctgctgtaccagccacaaaagaaggtcaaatctgaagggacggactcctacgtgagtcagctgaccgctgaggccgaagatcatttgcagtcaccaaacagagactcactctacacctcgatgcccaacctacgcgattccccctaccccgagagctcgccggatatggaagaggatctcagccctagtcgtagatctgagaatgaggatatctattacaaatcaatgcctaacctgggcgccggtcatcagctgcagatgtgctaccagatatctaggggaaactctgatgggtatatcatcccgattaataaggagggatgtattccagagggtgatgtacgggagggacagatgcagttggtgacttctctgtag

SEQ ID NO: 42956 - DNA, 4425 bp, Artificial Sequence
  Description of Artificial Sequence: Synthetic coding sequence
atggtgagcagcggctgccggatgcggagcctgtggttcatcatcgtgataagcttcctgcccaacacagaagggttttcaagagctgccctcccctttggactggtgagacgcgaactgtcctgtgagggctactccattgatcttaggtgtcccggcagtgatgttattatgattgagagtgccaactacgggcgtacagatgacaagatctgtgatgcagacccctttcagatggagaatacagactgctatttgcccgatgcctttaagataatgactcagcggtgtaataataggacgcagtgcattgtggtgaccgggtcagacgtgtttccggacccttgtcccggcacatacaaatatctcgaggtgcaatacgaatgtgtgccttacatttttgtctgcccgggtactcttaaggcgattgtcgattctccctgtatctacgaggcggaacagaaggctggggcttggtgcaaggaccccttgcaggcagcagataaaatatacttcatgccctggactccataccgtactgacacattgatagaatacgcttcgctggaggatttccagaattcacgccagacaactacttataagttgccaaaccgtgtggacgggacaggttttgtggtgtacgacggagctgtcttctttaacaaggaacgcacgcgcaatatcgtgaagttcgatttgagaacacgcatcaaatctggagaagccataattaattacgccaattaccacgatacttctccttaccgctgggggggtaagaccgacatcgatctggctgtggacgagaacggcctgtgggtcatttatgcaacggagcagaataacggaatgattgtcatctcccagcttaatccatacactctcaggttcgaagccacctgggaaacagtctacgacaagcgcgccgcttccaacgcattcatgatctgcggagtgctgtacgtggtgcggtctgtgtaccaggataatgaaagcgagacaggcaagaatagtatcgactacatatataacaccagactgaatcgcggcgaatacgttgacgtgccttttcctaaccagtaccagtacattgccgcagtggattataacccacgagacaaccagctgtacgtgtggaataataacttcatcctcagatatagtctggaattcggaccccccgatcctgcccaggtccccaccaccgctgttactatcaccagtagtgcagagctgttcaaaactatcattagcactacgtctacaacatcgcagaaaggacccatgtctacgacagtagccggcagccaggaaggtagcaaggggaccaaacctccaccagccgtctccacgacaaaaatcccacccattactaacatctttccactgcccgagcggttttgtgaagctctggactcaaaagggatcaaatggccgcagactcagcggggaatgatggtagagagaccttgccccaagggcacccggggcactgcctcgtacttatgcatgatttctaccggcacatggaacccgaaagggcctgatttatctaactgcacaagtcactgggtcaaccagttggcccagaagattcgctctggggagaacgccgcctctttggctaatgagcttgcaaagcacacaaaaggccctgtgttcgctggagacgtctcttcaagcgtgagactcatggagcagctggtggatatcttggacgctcagctgcaggaattgaaaccctccgaaaaggactccgccgggagatcgtataataagctgcagaagcgagagaaaacatgccgggcttacctgaaagctatcgttgatacggtggacaacctgctgcggccagaagccctggagtcttggaaacacatgaacagttccgagcaagctcataccgcgaccatgctcctggacaccctggaggagggggcctttgttctggcagataacctactcgaacctacacgagtcagtatgccaacagagaatatcgttttggaagtggcagtgttgagcaccgagggccagatccaggacttcaaattcccattgggaataaaaggcgccggcagctccatacaacttagcgccaacacagtaaaacagaactcccggaatgggttagccaaactggtttttatcatttaccgctcattagggcagtttctgtcaaccgagaatgcaaccataaagctgggagccgacttcatcggtcgcaatagcacgatcgccgtcaacagccacgttattagtgtttccataaataaagagtcgagtcgggtctaccttacggacccggtgttattcacattacctcacatagaccctgataattacttcaacgcaaattgttctttttggaactacagcgagagaacgatgatgggatactggtccacacagggttgtaagctggtcgacactaacaaaaccaggaccacctgcgcatgttcacacttgaccaactttgctatattaatggcacaccgtgaaattgcatataaggatggggtgcatgaactgctcctgaccgtgatcacgtgggtgggcattgtgatcagcctcgtatgcctggccatctgtattttcacattttgtttcttcagaggtcttcagtccgacagaaatacaatccataaaaatctgtgcattaacctgtttatagcagaatttattttcctgattgggatcgataagacgaagtacgcaattgcctgccccatctttgccggtttgttacacttctttttcctggcagcctttgcctggatgtgtcttgaaggggtgcagctctatcttatgttggtggaggtcttcgagagcgagtactctaggaaaaaatactattacgtggccggctatttattccctgcgaccgtcgtaggggtctcggctgcgattgattataagagctacggcaccgagaaggcctgttggctgcacgtcgacaactattttatttggtccttcatcggccctgttaccttcattatcctcctaaacatcatattcctcgttatcaccctctgcaaaatggttaaacacagtaacacattgaagccagatagtagcaggcttgagaacatcaacaattaccgcgtgtgcgatgggtactataacaccgatctgcctggcagttgggtactgggagcgtttgcacttttatgcctcttgggtctgacttggagttttggtcttttattcatcaatgaggagactatagtgatggcttatttgtttacaattttcaacgccttccagggcgtttttatattcatatttcattgcgcccttcagaagaaagtcagaaaggaatatgggaagtgtttccggcactcgtactgttgcggtggactgcccacggagtctcctcattccagcgttaaggcctcaaccaccagaactagtgccagatacagctctggcactcagagtcgcatacgccgaatgtggaacgatactgtgcggaagcagagcgaaagttcctttatttccggcgatatcaacagcacttcaacactgaatcaggggatgactggcaactatctgcttaccaatccgctgctgaggccccacgggactaataacccctataatactctgttggctgaaaccgtcgtgtgtaatgccccctcagctccagtgttcaacagtcccggccatagcctcaataacgcacgtgacaccagtgccatggataccctccctcttaatggcaactttaacaatagttattcgttgcacaagggcgactataatgactcagtccaggttgtcgactgcggattgtctctgaacgataccgccttcgagaaaatgattatatcggagctggtccacaataacctgcgcggatcctcaaaaacacataacctggaactgaccttgcctgtgaaacccgtaattgggggttcctcttctgaagatgacgccattgtagctgacgcaagtagcttgatgcacagcgacaatcctggattggaactgcatcacaaagagttagaggccccactgataccccagcggacccacagcctcctgtatcagccgcaaaagaaagtgaaatctgagggcaccgacagctatgtttcccagctaactgcggaagccgaggaccacctgcagagcccaaatcgcgacagcctgtacacttcaatgcccaacctccgtgattccccataccctgaaagctctcccgatatggaggaggacctgagtccctcccgaagatcagaaaacgaagacatctattataagagtatgcccaatcttggggccgggcatcagttgcaaatgtgctatcagatatcgaggggaaatagcgacggatacatcattccgatcaataaggaagggtgtattccagaaggggacgtaagagagggccaaatgcaactggtgacttcactctag

SEQ ID NO: 42957 - DNA, 4296 bp, Artificial Sequence
  Description of Artificial Sequence: Synthetic coding sequence
atggtgagcagcggctgccggatgcggagcctgtggttcatcatcgttatctcattcctgcccaataccgagggtttttctcgagccgcactcccatttggcctggtccggcgggagctgagctgcgagggatacagtatcgatctgcgttgtccaggatcagatgtgatcatgatcgaatccgctaactatggaaggaccgacgataagatctgcgatgcagacccgttccagatggagaacacagactgctacttacccgatgcttttaaaattatgacccaacgttgtaataataggacccagtgcatcgtagtcacaggatccgacgtgttccctgacccgtgtccaggcacctataagtatttagaggtacagtacgagtgcgttccatacatctttgtgtgcccaggcacccttaaagcgattgttgacagtccatgtatttacgaggccgagcagaaggccggtgcttggtgtaaagatcccctgcaagccgctgataaaatttactttatgccctggaccccctataggaccgataccctgatcgaatatgcaagcctggaggacttccagaattcgcgacagacaactacttacaaattgcccaatagggttgatggtactggcttcgtagtgtacgacggtgccgtgttttttaacaaggagaggactagaaacatcgtcaagtttgatctccgcacacgaattaaatccggggaagcaatcataaattatgccaactaccatgatacttctccgtatagatggggtggaaaaacagatatcgacctagcagttgatgagaatgggctgtgggtgatttacgctactgaacagaacaacgggatgatcgtgattagccagcttaacccgtatacactgcgcttcgaggccacctgggaaaccgtgtacgataaacgggccgcctccaatgccttcatgatctgtggggtgctgtacgtggtgaggagcgtgtaccaggacaatgagtcagagaccggtaagaacagtatagattacatctacaacactagactgaacaggggagaatacgtcgatgtgccatttcctaaccagtaccagtacatcgccgcggtcgattataatccccgagacaaccaactgtacgtgtggaacaacaacttcatcctacggtactccctggaatttggccctcccgatcccgcgcaggtcccaaccactgcagtgacaataacctcctctgcagagctgttcaagaccataattagcactacttctaccacatcccaaaaagggccgatgtctacaaccgttgctgggtcacaggagggctccaagggcaccaagcccccccctgcagtgtccacgacaaaaattcccccgatcaccaatatctttcccctgccagagaggttctgtgaagctcttgattcaaagggaatcaagtggccgcaaacacaaagaggcatgatggtagagagaccatgtcccaaagggacccggggtacagcttcatatctgtgcatgatcagcacagggacctggaaccctaaaggtccagatttgagcaactgcacctcgcactgggtgaaccagctagcccaaaaaatacggtccggcgagaatgctgcttctctggccaacgagctggcgaaacacaccaaggggcccgtgtttgctggcgacgtctcctcctccgttcggttgatggaacaactagtggacatactcgatgctcagctacaggagttgaagccttctgagaaggattcggcggggagatcctacaataaactgcagaaacgtgaaaaaacctgcagagcttatctgaaggctattgtggacacagtggataatctgctgcgcccggaagctttggaatcctggaaacatatgaatagtagcgagcaggcccacaccgctactatgctgctggataccctggaggagggtgcctttgtcttagctgacaatctgttggagcccaccagggtgtccatgccaactgaaaatatcgtcctggaggtagccgtcttgagcacagaagggcaaatccaggacttcaagtttccattggggattaaaggagcaggtagcagcatacagctgtcagccaacacagtgaagcagaacagcagaaatggcctggctaagttggtgttcataatttatcggtctttgggccaatttctgtcaaccgagaatgcgaccatcaagctgggtgccgacttcatcggaagaaactccacgatcgcagttaactctcacgttatcagcgtctccatcaataaggagtctagccgtgtttatttgaccgatccagtactgttcacactgcctcacattgacccagacaattatttcaacgccaactgcagcttttggaactactccgagagaaccatgatggggtattggtcaacacagggctgcaagctggtcgataccaataagacacgcacaacctgtgcgtgtagccaccttacaaacttcgcgatccttatggcccatcgcgaaattgcttataaagacggcgtgcacgaacttcttcttacggtcatcacctgggtggggattgtgatcagcctcgtctgcctggccatctgcatttttaccttctgcttttttagaggactccagtctgacaggaataccatccataagaacctttgtattaacttgttcattgctgagttcatctttctgatcggcatcgataagacaaagtacgccattgcttgtcccatattcgccgggctgttgcacttcttcttcttagcggccttcgcctggatgtgcctcgaaggtgtgcaactgtacctaatgctcgtagaggtgttcgagagcgagtacagtcgcaagaagtattattacgtcgctggatatctgttccccgcaaccgtcgtgggagtgagtgccgctatcgactacaaaagctatggtacagaaaaagcctgctggttgcatgtggataactactttatctggtcgttcattggaccagtcacctttattattctcctgaacattatattcctcgtcattactctgtgtaagatggtgaagcacagcaacaccctgaaacccgattcctctcggctggagaatataaataattatagggtctgcgacggatactataacacagatctgcctgggtcttgggtcttaggcgcatttgcattgctgtgcctgttgggactgacctggagcttcggcctgctgtttattaatgaagagaccattgtgatggcgtacctcttcaccatattcaacgcctttcagggagtgtttattttcatcttccattgcgcgctgcaaaaaaaagtgagaaaagagtatggcaagtgtttccgccactcatattgctgtggaggtctgcctacagagtcaccccactctagcgttaaagccagtacaacccggacaagcgcaagatactccagtggcactcagagtaggattcgccgcatgtggaatgatactgtacgcaagcagtcggaaagcagcttcatatcaggcgacatcaatagcacgtccacattaaaccaaggtcactcgctgaataatgctcgggacacttccgccatggacacactccctctcaacgggaactttaacaacagctacagccttcacaaaggagattataatgacagtgtccaggttgttgattgtgggctttccctgaatgatactgcttttgagaagatgatcatttcggaactcgtccacaataatttgaggggctcctccaaaacacataatctcgagctgaccctgccggtgaagccagtcatcggtgggtcttcttccgaggatgacgcgatcgtggctgatgcttccagcctgatgcattctgacaatcctgggctagagttgcaccataaagaacttgaggcaccgctgattccccaacggactcatagtctgttataccagcctcaaaaaaaggtgaagagtgagggaacggacagttatgtctctcagcttacagcagaggccgaggaccacctgcagtctcccaatagagacagcttgtataccagcatgcccaacctgagagactctccatatcccgagagtagccctgacatggaagaggatttatcccctagtcgacgtagcgagaacgaagacatctattacaaaagcatgcccaacctgggggctggtcaccagctacagatgtgttatcagatatcacgtggcaattcagacggatatattataccgataaataaggaaggttgcatccccgaaggagatgtgcgcgagggacagatgcagcttgtgacatcactgtag

SEQ ID NO: 42958 - DNA, 4380 bp, Artificial Sequence
  Description of Artificial Sequence: Synthetic coding sequence
atggtgagcagcggctgccggatgcggagcctgtggttcatcatcgtgatctcgtttctcccaaacacagaagggttttctcgagcagccctgccattcggattggtgcggagagagttaagctgcgaagggtatagtattgatctgaggtgccctggcagtgacgtgatcatgattgaatccgccaattacggccgaactgacgataagatctgcgacgctgatccattccagatggaaaatacggattgctacctgcctgatgcatttaagattatgacccagagatgtaacaatagaacacagtgtatcgtcgtcactgggagcgatgtgttccctgatccctgcccaggaacctataagtatttagaggttcagtatgagtgtgtaccatatatttttgtgtgccctggaacccttaaggctatagtggattcaccatgtatctacgaggcagagcagaaagctggtgcgtggtgtaaggatcctctgcaggctgcagacaagatatattttatgccgtggactccctaccgcaccgatactctgattgagtacgcaagtctcgaagattttcagaacagccgacaaactacaacgtataagctacctaatcgggtggacggcacggggtttgtggtctacgacggtgctgtcttctttaacaaggagcgtacacgaaatatcgttaagttcgatcttagaacaaggattaagagcggcgaggcaataattaactacgcaaattaccacgacaccagtccttaccgatggggtggaaaaactgacatcgatctggcagttgacgaaaacggcttgtgggtaatttacgctacggagcagaataacggaatgattgttattagccagctgaatccttacacccttaggttcgaggccacctgggagactgtgtatgataagcgagcagcgagtaacgcttttatgatctgtggagtactgtacgtggtgaggtctgtgtatcaggataatgaatcagaaaccggcaaaaatagtattgactatatctacaatacgaggctcaacagaggcgagtatgtagacgttcctttccccaatcagtatcagtatattgccgcagtagactacaacccccgggataaccagctctatgtctggaacaataatttcatcctgaggtactctctggaattcggcccccccgatccggcgcaggtacctactaccgcagtgacgatcacttcatcagctgaactgttcaaaacaattatttccactacgagcactaccagccaaaagggacccatgagtaccactgtcgcaggatctcaggaggggtcaaaaggtaccaaacctcccccagctgtgtcaactacaaaaatcccgccaatcacaaacatctttcccttgcctgaacgtttctgtgaggctctggattctaaaggaattaagtggccccagactcagaggggcatgatggtggaaaggccctgtcctaaggggaccagaggaacagcctcttatctatgcatgatatctaccgggacatggaacccaaaagggccagacctatccaactgcaccagccactgggtaaaccagctcgcccaaaaaattcggtcgggagagaatgctgctagtttggctaatgaacttgcaaagcatacaaaggggcctgtgttcgccggcgacgtctccagctctgtccgcctgatggagcagttagtggatattctggacgctcagctgcaggaacttaagcccagcgaaaaagactctgcaggacggtcttataacaaattgcagaaaagggagaagacttgtcgggcatatctgaaggctatagtggataccgtggacaatctgcttcggcccgaggctctggagtcctggaagcatatgaatagctctgaacaggcccatacagccactatgctgctggatacccttgaagagggtgcatttgtgttggctgataatctgctggagccaacacgagtctcgatgcctaccgaaaatatagttctggaggtggctgtgctgagcactgaaggccagatccaggactttaagtttcccctcggcattaaaggagcaggcagctcgattcaactgtctgcaaatactgtaaaacaaaacagccggaacgggctcgcaaagttggtcttcattatctaccgcagtttgggccagtttctgtcgaccgagaatgccaccatcaaactcggagccgactttatcggacggaattcgacaatcgctgtgaattcgcacgtgatttctgtgagcattaacaaagaatctagcagggtatacctaacagatcctgtactgtttacattgccgcacattgaccccgacaattattttaacgccaactgttctttttggaactactccgaaagaactatgatgggctattggagcacacagggctgtaaactcgtcgacaccaataaaaccagaacaacctgcgcctgcagtcacctcacaaatttcgccatactcatggcccatagggagatagcttataaggacggcgttcatgagttactgttaaccgtgatcacctgggtgggtattgtgatctccctcgtctgcctcgccatatgtatctttactttctgtttcttccgcggcctacagagcgatcggaatacaatccataaaaatttatgtattaacttgtttattgctgagttcattttcctcattggaatcgataagaccaagtatgccatcgcttgtccgatttttgccggtctattgcactttttttttcttgccgccttcgcctggatgtgcctggagggtgtgcagctgtatttaatgctcgtcgaagtgtttgaatccgagtactctagaaagaaatactactatgtcgccgggtatctcttccctgctaccgttgtgggcgtgtccgctgcgatagattacaagagctacggcaccgagaaggcctgttggctgcatgtggacaattattttatttggagcttcatcgggccagtaaccttcattattttgcttaacataatctttctcgttattacactgtgtaagatggtgaaacattcaaacacccttaagccagactccagccggctggaaaatattaagtcatgggttctcggtgcctttgcactcctttgtctgttaggcctgacctggagttttgggttgctgttcattaatgaagaaacaatcgtgatggcatatctgttcactatctttaatgcatttcagggcgtgtttatatttatattccactgcgcactacagaaaaaagtcagaaaagagtacgggaagtgcttccgccattcatactgttgtgggggactgccaactgagtccccacacagttcagtgaaggcatccaccactaggacctcagcaagatattcgtctggaacacaaagtcgaattcgaagaatgtggaacgacaccgttcgtaagcagagcgagtctagtttcatcagcggcgatatcaattctacctctaccctgaaccaggggatgaccggcaattatttgctaactaatcctctgctgcgcccccacggcaccaataacccgtacaatacattgttggccgagactgtggtatgcaatgccccatccgcccctgttttcaatagccctggtcactctctgaataacgctagagacacctctgccatggatactctacctctcaatggaaactttaacaactcctactctctgcataaaggcgattataacgatagcgtgcaggtggttgattgtggcctgtccctcaacgacacggcttttgagaagatgatcatctcagaactggtgcacaacaaccttcggggctccagcaagacgcataacctcgagctaactctcccagtaaagcctgtgatcgggggctctagctccgaggatgacgctatcgtggctgatgcttcttccctgatgcactcagacaatccaggcttggagctccatcacaaagaactcgaggccccattgatcccgcagcgaacacattccctgctgtaccagccccagaaaaaagtgaagagtgaaggcacggactcgtatgtttcacagctaaccgctgaagcagaagatcacctgcagagccccaacagggacagcctctatactagcatgccaaatcttcgcgacagcccctatcctgagtcaagcccagatatggaggaggacctgagccccagtaggagatccgagaacgaagacatttattacaagagcatgcctaatttgggagccggacaccagctgcagatgtgttatcaaatctccagagggaactccgatggttacatcattcctattaataaggagggatgtataccagagggcgatgttcgggaaggtcagatgcagctggtgactagtctctag

SEQ ID NO: 42959 - DNA, 4251 bp, Artificial Sequence
  Description of Artificial Sequence: Synthetic coding sequence
atggtgagcagcggctgccggatgcggagcctgtggttcatcatcgtaatctcctttctgcctaacactgaagggtttagcagggcagcactaccatttggactggtccgaagggagctgagctgtgaaggctactcaatcgacctgcgctgccctggttcagacgtgatcatgatcgaatcagcaaattacggccgaactgacgataaaatttgcgacgctgatccctttcagatggagaatacggattgctacttacccgatgcctttaagatcatgacacagcggtgtaacaacagaacacagtgcatagtagtcactggcagcgacgttttccctgacccatgcccgggcacctacaagtacctcgaggtccaatatgaatgtgttccatacatattcgtttgcccgggcactctcaaggcgatcgtggattccccttgtatttacgaggccgaacaaaaagctggcgcatggtgtaaggacccactgcaagcagcggacaagatatacttcatgccctggaccccctacagaaccgacaccctaatcgagtatgcatcgttagaggactttcagaactcccgtcagaccaccacttacaaattgcctaaccgcgtcgacgggacaggctttgtcgtgtacgacggtgccgtcttcttcaacaaggagagaacacgcaacattgttaaattcgatttacggacaaggattaaatctggcgaagctatcattaactatgcaaattaccatgatacatcaccctataggtggggtggaaagaccgatatcgatctggctgtggatgagaatggactgtgggtgatctatgcgacagaacagaacaacggtatgatcgttatcagccagctgaatccatacactttgagatttgaagcaacttgggagactgtatatgataaacgagcggccagcaatgcgtttatgatctgcggggtcctctacgtcgttcggtctgtctatcaagacaacgagagcgagacaggaaagaattccatagattatatctataatactaggctcaatcggggtgaatacgtcgatgttccctttccaaaccaataccaatacattgcggcggtggactataatccgcgggataaccagctctatgtctggaataacaatttcattctgcgctactccctggagttcggacctcccgatcctgcacaggtgcccacaactgccgtaaccattacaagttcggccgaactctttaaaaccatcatcagtacaacttcaaccacatctcagaagggtcccatgtccactactgtcgcaggcagccaggaaggctcgaagggaactaagccacctcccgcagtgtccactacaaagatcccacccattaccaacattttccctctgccagaacgcttctgcgaggctctcgattccaagggaatcaaatggccacagacacagcgcggcatgatggtcgagaggccttgccccaagggcacacgaggcacagcctcctacttgtgtatgatatccactgggacttggaaccctaaggggccagatttgagcaattgcaccagccactgggtgaatcagttggcccagaagatccgcagtggcgaaaacgccgcttctttggccaacgagctcgcaaagcataccaaggggcctgtcttcgcaggggatgtgtcctcgagcgttaggctcatggagcagctggtggacattttggacgcccagttgcaggagctcaaacccagtgagaaagactccgcaggacggtcttataataagctacaaaaacgagagaagacctgcagagcatacctaaaggccatcgttgataccgtggacaacctcttgcgaccggaggcactcgagagttggaagcacatgaactcctctgagcaggcccacaccgctacaatgctgctggatactctcgaagagggtgcttttgtgcttgctgacaatcttctggagccaacgcgcgtgagtatgcccaccgagaacattgtcctcgaggttgctgtgctgagcactgaggggcaaatacaggacttcaaatttcctctggggatcaagggagcaggttcttctattcaactcagcgcaaacaccgtgaaacagaattctcggaacgggttggccaaattagtcttcatcatatacaggtcactgggacagttcctgagtacagaaaatgcgaccattaagttgggggccgactttattgggaggaacagtaccatcgcggtgaatagccatgtgatcagcgtgtctatcaacaaggagtcttcccgtgtctatttaaccgacccagtgctgtttactctgcctcatattgatcccgacaattattttaacgctaactgttcattctggaattacagtgaaagaaccatgatgggttactggtcaactcagggttgtaaactcgttgatacaaacaaaacgaggacaacatgtgcatgtagtcatttgacaaatttcgctattctgatggcacatcgtgagatcgcatacaaggatggagttcatgaacttttactcacggtgatcacctgggtgggaattgtgatcagcctggtctgcctggccatatgtattttcacattctgcttcttccggggtctacaaagtgaccggaatacgatccacaaaaatctgtgcatcaacctgttcatcgctgagtttattttcttaatcggcatcgataaaaccaaatatgccattgcgtgcccaatttttgctggcctcctccactttttcttcttagccgccttcgcatggatgtgcctagagggagtgcagctatacctcatgctggtggaagtgttcgaatctgaatactccagaaaaaagtactactacgtcgcggggtatttgttccccgctactgtcgtcggcgtgtctgcagcgatagactataaaagttacggcacagaaaaggcctgttggcttcacgtcgataattattttatctggtccttcatcggtccagttacgtttattatactgcttaatattatattcttggtgattacactttgcaagatggtcaagcattcaaacaccttgaagcccgatagctccagactggagaacatcaagtcctgggtgctgggggccttcgccctgctctgtctgctaggactgacatggtcattcggcctactgtttattaatgaggaaaccatagtcatggcctacctgtttacaatttttaatgcatttcagggtgtcttcattttcatttttcattgtgccttgcagaagaaggtcagaaaagaatatgggaagtgttttagacattcgtattgttgcggcggccttccaaccgagagccctcacagctcagtcaaagcctcaactaccaggaccagtgctaggtactcaagcggtacgcagtcacgcatacgacgcatgtggaatgatactgtgcggaagcagagtgagagttcatttataagtggagacattaactctactagcacattgaaccagggacactccctgaacaatgcaagggatacctccgctatggacactctgcccctgaatggcaatttcaacaatagctattctctgcacaagggtgattataacgacagcgtccaggtggtggactgcggtttatcactgaatgacaccgcttttgagaagatgattatcagtgagctggtacataataatttaagggggagctcaaaaacgcacaatttggaactgacactgccagtgaaacccgtcataggagggagctcttctgaggacgatgccatcgtggctgatgccagtagtttgatgcatagtgacaatccgggactggagctacaccataaggaacttgaagcccctcttataccacaaaggacacactccttgctctaccagccacagaagaaagtgaagagcgagggaacagattcatatgtgagtcagcttactgctgaggctgaggaccatctgcagtcccctaaccgggacagcctgtatacctctatgccaaatctgcgcgactctccttaccctgaatcttccccagacatggaagaggacctgagtccatcgcgccgaagcgagaatgaagacatttactacaaaagcatgccaaatctgggagctggacaccagctgcagatgtgctaccagatctcccgcggcaactcagacggttacatcattcctatcaataaagagggatgcatccctgaaggcgatgtccgcgaggggcaaatgcagctggttacgagcctttag

SEQ ID NO: 42960 - DNA, 4386 bp, Artificial Sequence
  Description of Artificial Sequence: Synthetic coding sequence
atggtgagcagcggctgccggatgcggagcctgtggttcatcatcgttatcagctttctgccgaacactgaggggttctcgcgcgcagctttgccctttggattagttaggagagagctctcctgcgagggatattcaatagatcttagatgccccggcagcgatgtaatcatgatagaaagtgctaattatggaagaacagacgacaaaatctgtgacgccgaccctttccagatggagaacactgactgctaccttcccgacgctttcaagatcatgacacagagatgcaacaaccgcacccaatgcatcgtggtgacaggcagcgatgtgttccctgatccttgtcctggaacatataaataccttgaggttcagtatgaatgcgtgccatacatcttcgtgtgcccagggaccctgaaggccatagtggacagcccctgtatttatgaagccgaacagaaagcaggagcgtggtgtaaggacccactccaagcagcagacaagatttatttcatgccttggaccccctataggacggacaccctgattgaatacgcctctctggaagacttccagaattccaggcaaacgactacgtataagcttcctaatagggtggatggtactggttttgtggtgtacgacggggcggtgttctttaataaagaacggacaagaaacatagtgaagttcgatctgcggaccaggatcaagtctggggaagctattattaactacgctaactaccacgatacttccccttatcggtggggaggcaaaactgatattgatctcgctgtcgatgagaacggtttgtgggtgatttacgccactgagcaaaacaatgggatgattgtgatctcccagcttaatccatacaccctccgtttcgaggccacctgggaaaccgtttatgataaaagagccgcctcaaacgccttcatgatttgcggtgtgctgtacgttgtgagatccgtctatcaggacaacgagtccgaaactgggaagaacagcatcgattatatttacaacacccggctgaataggggggagtatgtcgacgtgccattccctaaccagtatcaatacatcgccgccgtggactataatcccagagacaatcagttgtacgtctggaataacaatttcattctcagatactccctggaatttgggccacccgatcccgcacaggtccccactaccgcggtgactattaccagtagcgctgagctgtttaagactattattagcaccacgtcaacaacgtcccaaaagggccccatgagcacgaccgtcgctggcagccaggagggtagtaaagggaccaagccacccccagctgtctcaaccacaaagattccacccataaccaacatatttcccttgcctgaaaggttctgtgaggccctggactctaagggaattaagtggccccaaacccagagaggcatgatggtggagaggccctgcccgaaaggaacccgggggacggcttcatatctatgtatgatcagcacagggacgtggaaccctaagggtcccgatctgtccaattgcacgtcacactgggtgaaccagttggcgcagaaaatacggagcggcgaaaatgccgcatcactcgcgaacgagctagcaaagcacacaaagggaccagtattcgccggggatgttagcagtagcgttcgacttatggaacagctcgtggacattctcgatgcgcaattgcaggagctgaagccttcagagaaggattccgcagggcgatcttataataaggccatagttgatacagtggacaacctccttcgccccgaagctctggagtcatggaagcacatgaattctagcgaacaggcgcatactgccactatgctcctcgacactctcgaagagggcgcctttgtgctggccgataacttgcttgagccaaccagagtttccatgccgaccgagaacatcgtgctggaggtggccgttctctctaccgagggtcaaatacaggactttaagttcccactcggcatcaagggggctggaagttccattcaattatcagcaaacaccgtcaagcagaatagccgcaacgggctggctaagctcgttttcataatctacaggagtctgggacagtttctgagtactgagaacgcaactatcaagcttggtgcagatttcataggaaggaatagtacaattgctgttaatagtcacgtcataagtgtgagtattaataaggaatcgtcacgtgtctatctaaccgaccctgttttgttcaccctgccacacattgaccctgataactatttcaatgccaattgctcattctggaattactcggaaaggacaatgatgggctattggtccacccagggttgtaagctggtggacacaaataagaccagaactacctgtgcctgtagccacttaacaaattttgccatactcatggcacaccgcgagattgcttacaaagatggcgttcacgaactcttgctcactgttatcacctgggtgggcatcgtgattagcctcgtctgcctggctatctgtatatttacattctgtttttttaggggacttcagagcgacagaaatactattcataaaaatttgtgtattaatctgttcattgcagagtttatattccttattggcatcgacaagaccaagtacgcaatcgcttgtcctatcttcgctggtttgttgcatttcttctttctggcagctttcgcttggatgtgcctggagggtgttcagctgtacctgatgctggtcgaagtgttcgagtcagaatacagtcgaaagaaatactactacgtggccggctacctctttcccgcgactgtggtgggggttagcgcggccatcgattataagagctacggcacagaaaaggcctgttggctgcatgtggacaactacttcatatggtcctttatcgggcccgtcacgttcataattttgctgaatattatttttctagtgattacgctctgtaaaatggtgaaacacagtaacaccctgaagccagatagctctcgcttggagaatataaacaactatcgggtgtgcgacggctattataacacagacctcccagggagttgggtactgggggcctttgcacttttatgcctgctgggactaacctggagttttggactgctctttataaacgaggagacaatcgttatggcctatctgttcaccatcttcaacgctttccaaggagtgtttatcttcattttccattgtgcactgcagaagaaagtgagaaaggaatacgggaaatgcttccgccactcatactgctgcggcgggttaccaacggaaagcccccactcctcagttaaggcctcaacgactaggactagcgctaggtattcttccggaacccagtcacggattcgccggatgtggaatgacaccgtgcggaagcagtctgagtcctctttcatcagcggggatatcaattcaacgtctaccctgaaccagggcatgacgggcaattacctcctaactaatccactacttcgcccccatggcaccaataatccctataacacactcctggctgaaacggtggtgtgtaatgctccaagcgccccggtgttcaatagtcccggacacagcctaaacaatgctcgcgacacttcagcaatggacacgctgcccttgaatggaaattttaacaatagctactcactccacaagggtgattacaacgactcagtccaggttgtggattgtggcctgtccttaaatgacactgcctttgagaagatgattatatcggaactcgtccacaataacctgcgggggagcagcaaaacacacaatctagaactgacattgcccgtgaaacctgtgataggcggttcatcctccgaggatgatgccattgtggcagatgccagtagcctgatgcactctgacaatcccggactggagctgcaccataaagagctggaggccccactgatcccacagagaacccatagtcttctgtaccagccccagaagaaggtgaagtctgagggtaccgactcctacgtgagccaactgaccgcagaggcggaagaccacctccagtcaccaaatagggattctctgtacacatcgatgcctaacctgagagactctccctaccccgagtcttctcccgacatggaggaagacttaagcccatctcgccggtcggaaaacgaggatatctactacaagtcaatgcctaacttgggtgccggccaccaactgcaaatgtgttaccagatctctagaggcaactcagatggttatattatccctattaacaaagaaggatgtatcccagagggcgacgtcagagaaggtcagatgcagctggttacttccctgtag

SEQ ID NO: 42961 - DNA, 1416 bp, Artificial Sequence
  Description of Artificial Sequence: Synthetic coding sequence
tgaatcaccctgtgcaagatggtgaagcacagcaacaccctgaagccagacagttcccggttagaaaatatcaacaattatagggtatgtgatggctattacaatactgacctgcctggctcctgggtccttggcgcctttgcccttctgtgcctcttgggactgacctggtcttttggactgctattcattaatgaagagactatcgtgatggcttatctttttacgatatttaacgctttccagggcgtctttatcttcatcttccactgtgcactgcagaagaaggtgcggaaggagtacggcaagtgttttcggcattcttattgttgcggaggtctgcccacggagagcccgcactcctcagttaaagctagtacgactagaactagtgctcggtattcttctgggacacagtcgagaattagaaggatgtggaatgataccgtgcggaaacagtcggagagttccttcatttctggcgatattaattccacctccactctcaatcagggaatgacggggaactacctcctcaccaacccgttgctccgacctcacggcacaaacaatccttacaataccctacttgctgagacagtggtatgcaatgccccatctgcccccgtgttcaattcacccgctacttaccgtgagaccaggcatagcctgaacaacgctcgggatacctccgccatggataccttgcctctgaacggcaatttcaacaacagctactctctgcacaagggtgattacaacgactctgttcaagtggtagactgcgggctttctctgaatgacaccgcttttgagaagatgatcatttccgagctggtgcataacaacttgcgaggaagctccaagactcacaaccttgagcttactctgcctgtgaagcctgtcatcggaggatcatcaagtgaagatgatgccatcgtggccgacgcgagtagtttgatgcactccgataatcccggccttgaattacaccataaagagctggaagctcccctgatacctcagcgtacacatagcctgctttaccaacctcagaagaaagtgaagtctgaaggcacagattcctacgtcagccagctaacagctgaggctgaggaccatctgcagtcccctaatcgggatagtctttacaccagtatgcccaatctccgcgactcgccatacccagaaagcagtcccgatatggaggaggacctgagcccaagccgaaggagcgagaacgaggatatctattataagtcaatgcctaatctcggcgctggccaccaactgcagatgtgctatcagatctctagggggaatagcgatggttacatcattccaattaacaaggaaggatgcattcccgagggagatgtgagagagggacagatgcaactcgtcactagtctgtag

SEQ ID NO: 42962 - DNA, 4056 bp, Artificial Sequence
  Description of Artificial Sequence: Synthetic coding sequence
tgattcgtgtgccccggcaccctgaaggccatcgtggacagcccctgcatttatgaagctgagcagaaggctggagcatggtgcaaagatcccctccaagcagccgataagatatatttcatgccatggactccttatcgaactgacaccctaatcgagtacgcttccctggaggactttcagaattcacgtcagaccaccacctataagctgccaaaccgggtcgacggaacgggatttgtagtgtacgacggagcagtcttttttaacaaggaacggaccaggaatatcgtcaaattcgatcttcgaactcggatcaagagcggtgaagcaattatcaattatgcaaattatcacgacacaagcccgtaccgatggggaggcaaaacagacatcgatctcgccgtggatgaaaacggcctgtgggtcatttacgccacggagcagaacaatggcatgattgttatatctcaacttaatccctatacacttcgtttcgaggccacttgggaaacagtgtatgataagcgggctgcctcaaatgcctttatgatttgtggcgtgctttacgtcgttcggtcagtctatcaagacaatgagagtgagaccggcaaaaactcaattgattacatctacaatacacgcctgaataggggcgaatatgtcgacgtacccttccctaaccaatatcagtatatcgcggctgtggattacaatcccagggacaaccagctgtatgtatggaacaataacttcattctgcgctattcactggaattcggcccccctgacccagctcaagttcctacaaccgctgtcactatcacctcatctgcagagttgttcaagaccattatctccacgactagtaccacctctcagaaaggacctatgagtactactgtagctggaagccaagaaggcagtaaagggaccaaacctccaccagcagtgtcaacaactaagatccctccaatcacaaatatcttcccgcttcctgaaaggttctgtgaggccctcgactccaaaggaataaaatggccccagacccaaagagggatgatggtagagagaccatgtcctaaggggacccgtggcacagcctcctatttatgcatgattagcaccggcacatggaatccaaagggcccagacttgtctaactgtacaagccattgggtgaatcagctggcacagaaaatccggagtggagagaacgccgccagtttagctaatgaacttgcgaagcatacgaaaggacccgtgttcgctggcgacgtgtcatccagcgtgaggctgatggagcagctggtagatatactggatgcgcagctgcaggaactgaagccatcagagaaggattccgccgggagatcttataacaagttacagaagcgggagaagacatgtagggcctatcttaaggctattgtcgatacagttgacaatctgttgcgtcccgaggccctggagtcctggaaacacatgaactccagcgaacaggcccatacagctaccatgctgttggacacattagaagaaggggctttcgtgcttgccgacaacctccttgagcccactagagtgagcatgccaaccgaaaatatcgtcctggaggttgcagtactctccaccgaaggtcagatccaggacttcaaattccctctcggcatcaagggggctggatcatccatccaactttctgcaaatacagtgaagcagaatagtcgcaacggccttgcaaaactggtgtttattatatataggagcctggggcagttcctgagtacggagaatgccacaataaaactgggtgcagacttcattggcaggaacagtaccatcgccgtgaattcccacgttatctcagtgagcatcaacaaggagtcctcgcgggtctatctcacagatcccgtattgttcactctgccacacattgatccggacaactattttaatgccaactgttccttttggaactacagcgaaagaaccatgatggggtactggagcacacagggctgcaagctggtggacactaacaagactagaacgacatgcgcctgctcccatctaacaaatttcgccatcctgatggctcatcgcgaaattgcctataaagatggagtgcatgagcttctgctgactgtcatcacatgggtaggaatcgtgatctcactggtctgccttgcaatctgcatctttacattttgtttttttcgagggctgcagagtgaccggaacacgattcacaagaacttatgtataaacctgttcattgcggagttcatatttctcattggcattgacaagactaagtatgccatagcttgtcccattttcgccggattattacattttttcttcctggctgctttcgcttggatgtgcctcgaaggtgtgcagctctatcttatgctggtggaagtcttcgagtcagagtattcccggaagaagtattactacgtggctggatacctttttcctgccaccgtcgtgggagtgtccgctgccatcgattacaaatcatatggaacagagaaagcatgctggctgcacgtagacaactactttatctggagttttatcggccccgttaccttcatcatactcctcaacatcattttcctcgtcattacgctatgtaagatggtgaaacactcaaacacattgaagcccgattcctccaggctcgaaaatatcaataattatagggtttgcgatggatattataacactgatctgcctggttacgaggacaataaaccattcataaaatcttgggtgctcggagctttcgcgctgctgtgcctgctcggtttgacctggagcttcggcctgctcttcatcaacgaggagacaatcgtgatggcatacctgttcacaatattcaacgctttccagggggtcttcatctttatctttcattgcgctctgcagaagaaagtcaggaaagaatacgggaagtgctttcgtcatagctattgctgcggaggcctgcccacagagtccccccatagctccgtgaaagcttcgaccacccgaacctccgcgcgctactcttccgggacacagtctcgtatccggaggatgtggaacgataccgttagaaagcagagcgaatcctccttcatcagcggcgacattaattctacgtctacactgaaccagggcatgaccggtaactatctgctgacaaaccctctgttgaggcctcacggaacaaataacccatataacacactcctggctgaaacggtggtctgcaacgctccatctgcccctgtcttcaactccccgggccactcgctgaacaacgcacgtgacaccagtgctatggatacactgccactgaatggcaatttcaacaacagctactcgctacacaaaggcgactacaatgatagcgtgcaggttgttgactgtgggctgtctttaaacgacactgcttttgagaagatgataatctccgaactagtgcataataatctgcggggcagctcaaagacccacaacctggaactcaccttgcccgtgaagcctgtgatcggaggaagcagcagtgaagatgatgctattgtcgctgatgctagctctctgatgcacagtgacaacccaggcttggaactgcaccataaggagctggaggcgcccctgattcctcagagaacacattcgcttctgtaccaaccacaaaaaaaggtcaagtccgaaggcacagattcatacgtgagccagcttaccgccgaggccgaagatcacctacaatcccctaacagggattctctgtatacatcgatgccgaacctccgcgattccccataccccgaatcctcgccagacatggaggaggatttgtcgcctagcagacggtctgaaaacgaagacatttattacaaaagcatgcccaacctgggggcgggacaccagcttcagatgtgttatcagatctctcgcggtaattctgacggctacattatccccatcaacaaggaggggtgcatccctgaaggcgacgtccgcgagggacagatgcagttggtcaccagcctgtag

SEQ ID NO: 42963 - DNA, 3723 bp, Artificial Sequence
  Description of Artificial Sequence: Synthetic coding sequence
atgtggcccagccagctgctgatcttcatgatgctgctggcccccatcattcatgctttcagccgtgcaccaattccaatggcggtggtgcgacgggagctgagctgcgagagttaccccatcgagttgcggtgtcccgggaccgacgttattatgatcgaatcagcaaattatggaaggactgacgacaaaatttgcgactcagaccccgcccagatggaaaacatccgatgttatctcccagatgcctacaaaattatgagccagcggtgtaataacaggacgcagtgtgcagtggttgccggccctgacgtgtttcctgatccatgtcccggtacgtacaagtatctggaagtgcagtatgagtgcgttccttatagggtggaccaaaaggttttcctgtgccccgggctgctcaaaggtgtgtaccaaagcgagcatctgttcgagagcgaccaccagtctggcgcctggtgtaaggaccctctccaggcctccgacaagatttattatatgccttggaccccatacaggacggataccctcaccgaatacagctctaaggatgatttcattgctggccgacccacaactacatataaactgccacacagggtggatggtacaggctttgttgtatacgatggagctttgttcttcaacaaggagaggactagaaacatcgtgaaatttgatttacggactagaatcaagagcggcgaggcgattatagccaacgccaattatcatgacaccagcccctatcgctggggcgggaagtctgacattgacctggccgtggacgaaaacggcctgtgggtaatctacgctaccgaacagaataacggaaaaattgtcatcagtcagctcaatccttacaccctgcgaatcgaggggacttgggacaccgcctatgataagagatccgccagcaacgcctttatgatctgcggcatcctgtacgtcgtaaagtctgtctatgaggacgacgataacgaagccacaggtaataaaatcgactacatatacaacacagaccagtcaaaagactctctggtggacgtgccctttccgaacagttatcagtatattgccgccgtagactacaatcctagagataatttgctgtacgtctggaataattatcacgtggtgaaatactcccttgactttgggcctctcgatagcagatcgggccaggcccaccacggacaggtctcgtatatttcccctcctattcatttagactcagagctcgagaggcctagcgtgaaagacatttcaacaactggacccttggggatgggatcaacaacgacatctactaccctgcgaaccacaactctatcgcctggaagatctactactccgtccgtcagtggtagaagaaatcgctctacaagcaccccatctccagccgtggaagtgctggatgacatgacgacgcatttaccctcagctagctcccagatccctgcacttgaggaatcttgcgaagccgtggaggcacgagaaataatgtggtttaagacccgccaaggccagattgctaagcagccatgccccgctgggacaattggagtatcaacttatctgtgtctcgccccggacggcatctgggaccctcaggggcccgacctgtctaactgtagttccccttgggtgaaccatatcacacagaagctcaaatccggagaaacagccgccaatatcgccagggagttagccgagcagacccgtaaccatctgaatgctggagacatcacgtactcagtgcgggcaatggatcagctcgtcgggcttcttgatgtgcagttacgtaaccttacgccagggggcaaggattccgccgcgaggtcattgaacaaacttcagaagcgcgaacgtagttgtagagcatatgtgcaagcaatggtagaaactgtgaacaacttgctgcagccccaggccctgaatgcgtggcgcgatctgaccacaagcgaccaattgcgggccgccacgatgctgctgcacaccgtcgaggagtcagcctttgtcctggcagacaacctgctaaagactgatatcgtgagggagaacacggataacattaaattggaggtcgcgcggctgagcactgagggcaatctggaggacctgaagtttccagagaatatgggacatggatctaccattcagctcagcgctaataccctgaaacagaacgggagaaatggagaaatccgcgtggccttcgtgctgtataataacctgggcccatacttgagcaccgaaaacgcttctatgaaactgggcacagaggcattatcaaccaaccatagcgtgattgttaactcccccgttattactgctgctataaacaaagaattcagcaataaagtttatctcgccgatccggtggtcttcaccgtgaaacatatcaagcagtcggaggagaactttaaccctaactgcagcttttggtcatacagcaaacgcactatgaccggatactggagcacgcagggttgtaggctcctgacaacaaataaaacacacaccacctgctcatgcaatcaccttacaaacttcgcagtgctgatggcacatgtggaggtgaagcacagcgatgcggtgcacgatctgctgctggatgtgatcacatgggtcggcatactgctctccctagtgtgccttttgatctgcatctttaccttctgtttcttccgcgggctgcagtccgatcgcaatactattcacaagaatctctgcatcagtctgttcgtggccgagcttctgttcttgataggcattaatcgcaccgaccagcccatagcctgcgctgtttttgccgctctcttacattttttcttcctggcagcctttacttggatgttcttggagggcgtgcagctctatattatgctcgtcgaggtcttcgagtcagaacacagccgacgcaagtacttctacctggtggggtacggtatgcccgcactaattgttgccgtttccgccgccgtcgattacagatcttacgggacagacaaagtctgctggctgaggctcgacacctacttcatctggtccttcatcggacccgctaccttgataatcatgctcaacgtaatttttttggggatcgctctctacaaaatgttccatcatacagccattctgaagcccgaaagcggctgtctcgacaatattaactatgaggataatagaccatttatcaagtcatgggtaattggggcaatcgccctactttgtctgcttggcctaacttgggcttttggtttgatgtacataaatgaaagcacggtgattatggcttacctcttcacgatcttcaattctcttcaagggatgtttattttcatttttcactgcgttcttcagaaaaaagtgcggaaagagtatggcaagtgtctgagaacacactgctgctccggcaaatccacagaatcctcgattggcagtggtaaaacctccggttcccgtactccagggagatattcaacaggaagccagagtcgtattagacgaatgtggaatgatacagtgaggaaacagtctgaatctagcttcatcactggcgatataaacagcagcgccagcctcaatagagagccctatcgagagactagcatgggtgtgaagcttaatatagcctaccagatcggagcatccgagcagtgccaagggtataaatgtcacggctactctactaccgaatggtag

SEQ ID NO: 42964 - DNA, 4344 bp, Artificial Sequence
  Description of Artificial Sequence: Synthetic coding sequence
atgtggcccagccagctgctgatcttcatgatgctgctggcccccatcattcacgcattttcgagggctcctatcccaatggccgtggtgaggcgggaattgtcttgtgaaagctaccctatagaattgaggtgtccgggaactgatgtgatcatgatcgagtcagctaactacggacgcactgatgacaaaatctgtgactccgaccccgctcagatggaaaatatccggtgttacctgccggacgcctacaaaatcatgtcccaacggtgtaataacaggacccagtgtgcggttgtggccggacccgacgtgtttcccgacccctgccctggcacttataaatatctggaggtgcagtacgagtgcgtgccttatcgcgttgaccaaaaggtttttttatgcccaggactcctaaaaggagtttaccagagtgaacatcttttcgagagcgaccatcagagcggggcctggtgtaaagacccactgcaggcgagcgataaaatctactatatgccctggaccccttatcgaacagatacccttacagaatacagctctaaagacgatttcattgccggaagacctactacaacatataagctgccacatcgggttgacgggacgggtttcgtcgtttacgacggagctctattttttaataaagagagaactagaaatattgtgaagttcgacctgcgtactcgcattaagtccggtgaggccataattgctaacgcgaactatcatgacacgagcccatatcggtggggaggaaagagcgatatcgacctggcggtggacgagaatggactgtgggtgatatatgcaacagagcagaataatggcaagattgtcattagccagctgaacccttacactctgaggatcgaaggtacatgggataccgcgtacgacaagcgtagtgcttctaacgccttcatgatatgtgggattttgtatgtggttaaatctgtgtatgaagatgacgacaacgaagccaccggaaataagatcgactacatttacaacaccgaccaaagtaaagattccttagtcgacgtgcctttcccaaactcttaccagtatatagcagccgtggactataatccacgggataatctcctttatgtttggaacaattaccacgtggtcaaatactccttggacttcggccccctcgacagcagaagtggacaggcacatcacggacaggtctcgtatatttccccacccatacatctggacagtgagctcgaacgtccttctgtaaaggacatttccacgacaggcccattgggcatgggaagtaccactacctccacaacattacggaccaccacactgtcaccaggcagaagtaccacaccctcagtttctggacgtcggaacagaagtacctcaacgccaagccccgcggtagaagtgctggacgacatgactacacacctgccaagcgccagctctcagatacccgctctggaggagagctgcgaagcagtggaggctcgagaaattatgtggttcaagaccaggcagggacaaattgcaaagcagccctgtcctgctgggacaataggtgtatcaacgtacctgtgtcttgctcccgatggtatttgggatccccaagggccagacctttccaactgcagctctccatgggtgaatcacattacccagaagctgaaaagcggcgagaccgccgccaatatcgcacgcgagctcgcggagcaaacacgaaaccatctcaacgccggagacattacttactctgtgcgggcgatggatcagcttgttgggctactcgacgtgcagctaaggaaccttacacccggcggcaaggactcagcagcacgatcgcttaacaaagccatggtcgagaccgtgaacaatctgttacagcctcaggctctgaacgcttggcgcgatctgaccacttcagaccagctgagagcagcaacaatgctgctgcacaccgtggaagagtccgcattcgtactggccgataacctcctgaaaacagatatagtccgcgagaataccgacaacataaaattggaagtcgcacggctgtcgacagagggcaacctcgaagaccttaagttccccgagaacatgggccacggatcaaccatccaactctcagccaacaccctcaagcaaaacggtagaaacggcgaaatcagagtcgctttcgtgctgtataacaacttagggccatacctttctacagagaatgcgtccatgaagctcggcactgaggctctctccaccaaccactctgtcatagtaaacagtcctgtcataaccgccgctattaacaaggagttttctaataaggtgtaccttgccgatccagtggtgttcacagtcaagcatattaagcaaagcgaggagaacttcaatccgaattgctccttttggagctatagcaagcgcaccatgactggatactggtccacccaaggttgcaggcttttaacaacaaataagactcacacgacttgcagctgcaatcacctgaccaactttgccgtcctgatggcccacgttgaagtcaagcattcagatgccgttcatgacctgttactcgatgttattacctgggtgggaatcttattgtcactggtttgcctgctgatttgcatcttcaccttctgcttttttagggggttacaaagcgaccgcaacaccatccataaaaacctttgtatcagcctctttgtggcggagctgctgttcttgattgggatcaataggacagaccaacctattgcttgcgccgtttttgctgcccttctgcacttcttttttttagcagccttcacatggatgttcctggaaggcgtccagctgtacatcatgttggtggaggtctttgagtccgaacattccaggcgtaaatacttttacctcgtgggctatggaatgcctgctttgatcgtcgcagtgtctgccgcggttgattatcgctcttacggaacagacaaagtgtgttggctgcggctggacacttacttcatatggtcttttataggcccagcaaccctgatcatcatgctaaacgtaatcttcttgggaatcgcgctgtacaaaatgtttcatcacaccgcaatactaaagcctgagtcggggtgcctcgataacattaagtcgtgggttatcggagccattgcgttgctgtgcctgctcggactgacatgggcttttggcctgatgtacatcaatgagagcaccgtgatcatggcttatttgttcactatttttaacagcctgcaaggcatgttcattttcattttccactgtgtcttacagaaaaaggtccggaaagagtacggaaagtgtctgcgcacccattgttgttctggtaagagcacggaaagctccatagggagcggaaagacatccggctctaggacgccgggtcgttactctaccgggagccaaagcagaatccggagaatgtggaacgacactgtcagaaaacagtctgaaagttcattcattaccggggatatcaattcatctgcctctctgaatcgtgaaggcctgctcaataacgcccgagatacctcagtgatggatactctgccactgaatggcaatcacggaaactcctactcaatcgccagtggagagtacctgagtaactgcgttcagatcatcgatcggggctataaccataacgagacggccttggagaagaagatcttaaaggagctaacctcaaactacatcccatcttacctgaacaaccacgagagatcatcagagcaaaatcgcaatctcatgaacaagctggtcaacaatcttggatccggtagagaggatgacgcaatagttctcgatgacgccaccagttttaatcacgaggaaagccttggactcgagctaatccatgaagaatctgatgcgcctctgctgcccccacgcgtgtacagcacagagaaccaccagccccatcactatacacgcagaagaatccctcaggaccattccgagtcctttttccccctgctgacaaacgagcatacagaggatcttcaatcgccacacagggacagcctctatacttccatgcccacgctggccggcgtggccgccaccgagtccgttactacttcaactcaaactgagccgccgcccgccaagtgtggagatgctgaggatgtgtactataaatccatgcctaatctcggctcccggaatcacgtccaccagctgcatacttactaccaactagggcggggatctagcgatggcttcatagtgccccctaataaagatgggactccccccgaagggagcagtaaagggcctgcccacctggtgacgtccttatag

SEQ ID NO: 42965 - DNA, 2757 bp, Artificial Sequence
  Description of Artificial Sequence: Synthetic coding sequence
tgatacctgtgcctggcccccgacggcatctgggacccccagggccctgacctgtccaactgcagtagcccatgggtaaaccatatcacacagaagctaaagagtggggagactgcggctaatatcgcacgagagctagcggagcagaccagaaatcatctgaacgccggagacatcacttacagtgtgagggcaatggaccagctggttgggcttctggacgtgcagctgagaaacctcacgcctggcggcaaggactcggccgcccgaagtctgaataaggccatggtcgagaccgtgaacaatctcctccagcctcaggcccttaacgcctggcgagacctcactactagtgaccaactcagggcggctacaatgctgctgcacactgtcgaggagtccgcatttgtactggcggacaatctgcttaagaccgatatcgtcagagaaaacacggataacatcaaactcgaagtggcccggctgtcaactgagggaaatctcgaagatcttaaatttcccgaaaatatgggacatggcagcacaatccagctttctgccaacacactgaagcagaacggcagaaacggagagattcgagtggcttttgtactgtacaataaccttgggccgtatctgtctaccgagaatgccagtatgaagctggggaccgaggccttgtcgaccaaccactcagtcattgtgaactcacccgtcatcaccgccgcaatcaataaagaattcagtaataaggtctacctggccgatccggttgtctttactgtgaagcacattaagcaaagtgaagagaatttcaatcctaattgttctttctggtcctactcaaaacggaccatgaccggctactggtctactcaaggctgccgtctgctgaccacaaacaaaactcacactacctgcagttgtaaccacttgacaaacttcgccgtgctgatggcccacgttgaggtgaaacattcagatgctgtacacgatctgctcctcgacgtgatcacgtgggtaggaattctcctgagcttggtctgtctcctgatttgcatctttacgttttgcttctttcgaggtctgcagagcgatcgcaataccatacataagaacctgtgtatcagtctcttcgtggccgagttgctgttcctcataggtataaacagaactgatcaacccatcgcatgcgccgtgtttgctgctttgctgcacttcttctttctggcagcgttcacctggatgttcctcgagggtgtgcagctgtacatcatgcttgtggaagtcttcgaatccgagcatagccgcagaaagtacttctatctggtaggctacggtatgcccgcgcttatcgttgctgtgtccgctgccgttgattatagaagctacggcaccgacaaagtgtgctggctgaggctagatacctacttcatctggtcctttatcgggccagctactctgattatcatgttgaatgtcatttttttggggatagccctctacaaaatgttccaccatactgccattcttaaacctgaatcagggtgcttggacaacatcaaatcttgggtcattggcgcgatcgcactgttgtgcttgctgggactaacctgggcctttggtctaatgtatatcaatgagtcaaccgtgattatggcttacctcttcaccatctttaactcattgcaagggatgttcatctttatctttcactgtgtgttgcagaaaaaagttagaaaggagtacggtaaatgcttacgcactcattgctgctcaggcaagtctactgagagcagtattgggtccggtaaaaccagtgggtctcggacgcccggccgctattccaccgggtctcagtctcgtatcaggcgaatgtggaacgacacagtgagaaagcagtccgagagttcatttatcaccggcgacatcaattcctctgcctctctcaatcgcgaaggattgctgaacaacgcccgcgacacctctgtcatggacacactgccgcttaacggaaatcatggaaatagttacagcattgcgagtggtgagtacctatccaactgtgtgcagattatcgaccgtggctacaatcacaacgaaaccgccctggaaaaaaaaatcctgaaagagctcacctcaaactacattccctcatacctgaataaccatgaaaggagttccgagcagaatcgcaatctgatgaacaaactggttaataatctaggaagtggcagggaagacgacgctatagttttggatgacgccacatcctttaatcatgaagaatctctgggcctcgaactgattcacgaggaatcagatgcacccctgctccctcctagagtgtactcaactgagaatcaccagcctcaccactacaccaggcggcgaattccacaagaccattcagaatcatttttcccactgctcacaaatgagcatacagaagacttacagtccccacacagagattctctgtatacatcgatgcccacactcgccggggtggccgccaccgaatccgtgaccacctccacacaaacagaaccgccaccagctaagtgtggcgatgccgaagacgtgtactataaatccatgccaaatttagggtcgagaaatcacgtccatcaactgcacacctactaccagctgggccgtggctcaagcgatggcttcatcgttcctccaaacaaggatggaactccgcctgaaggtagctcgaagggcccagctcatctggtcacgtccctgtag

SEQ ID NO: 42966 - DNA, 3852 bp, Artificial Sequence
  Description of Artificial Sequence: Synthetic coding sequence
atgtggcccagccagctgctgatcttcatgatgctgctggcccccatcatccatgccttcagtagagcaccaatccctatggccgtggtgcggcgcgaattaagttgtgaatcctaccccattgaactcagatgtccaggaaccgatgtcatcatgatcgaatcagccaactatggccgcaccgacgacaagatttgtgatagcgatcctgctcagatggaaaacatccgctgttatctgccagatgcctataaaatcatgtcgcaacggtgcaacaatcgcacccagtgtgccgtggtggcggggcccgacgtcttccccgatccatgcccaggaacgtacaaatacttagaggtgcagtacgagtgcgtgccctacaaggtggagcagaaggtgtttctgtgccctgggcttctgaaaggcgtgtatcagagcgaacatctctttgaatcagaccaccagtctggagcctggtgtaaagatcctcttcaggcctctgataagatctattacatgccctggacaccctacaggacggatacactgaccgagtacagttccaaagacgacttcatcgccggaaggcccaccacaacatacaagctccctcatagggtggacggcacaggctttgtggtgtacgacggcgctctgttcttcaataaggagcggactcgcaacattgtaaagtttgatttgagaaccagaatcaaatcaggggaagccataatcgcgaatgcgaattaccacgacacctcaccgtacaggtgggggggcaaatcagacatcgacctggccgtggacgagaacgggttgtgggtgatctatgcaaccgaacaaaacaacgggaaaatcgtcatcagccagctgaatccttatacgctgagaattgaggggacttgggataccgcctatgataagaggtcagcaagcaatgcattcatgatttgtggcatactgtacgtggtgaagtctgtgtacgaggatgacgacaatgaggcaaccggtaacaagattgactacatctacaacacagaccagtcaaaagattccctggtcgatgtcccattcccaaatagctaccaatacatcgctgccgtagactataatccaagggataatcttttgtatgtgtggaataattaccacgttgttaaatacagcctggactttggaccgcttgattctaggtccgggcaggcacatcacggccaggttagttacatcagcccaccaattcaccttgatagtgagctggaacggccctcggtgaaggatatctccaccacaggcccacttggcatgggctcaactaccaccagtactacactccggacaaccaccctgagcccaggccggagcaccacaccaagtgtctctggacgtcgcaatcgtagcaccagtacgccctcccctgcagtggaagtactggatgatatgactactcaccttccgtctgccagtagtcagattcccgctctggaggagagctgtgaggccgtggaggcaagagaaatcatgtggttcaaaaccagacaagggcagattgccaaacagccatgtcccgcgggtacaattggtgtatctacttatctatgcttggcccctgatgggatctgggacccgcaaggccccgacttatccaattgttcttccccttgggttaaccacattacacagaaactcaaatcaggagaaactgctgctaacatcgccagagagctggccgaacagacgcggaatcacctgaatgccggggatatcacatatagcgtccgggcaatggaccagcttgttggtttactggatgtccagttgcggaacttgacccctggcgggaaggactcagcagcaaggtctctgaacaaactccagaagcgggaacgaagttgccgtgcctacgtgcaagcgatggtggaaaccgtgaacaacctcctacaaccccaggcccttaacgcatggagggacctgaccacgagcgaccagctcagagctgcgactatgcttctgcataccgtagaggagtccgccttcgtgcttgcagataaccttttaaaaaccgacattgttagggaaaacaccgacaatatcaaactcgaggttgctaggctgtccaccgaggggaacctagaggatctaaaattccccgaaaatatgggccatggcagtactatccagctctctgccaatactcttaaacaaaatggcaggaacggcgagattagagttgcgtttgtgctgtataataatctcgggccttacctgagcaccgaaaacgcaagtatgaaactggggacagaagctctgtctacaaaccacagtgtgatcgtgaatagcccagttatcacagccgcaatcaacaaggagttcagcaacaaggtgtacctggctgatccagtggtcttcactgttaagcacattaagcagtctgaggagaacttcaatcccaactgtagcttttggagttatagtaaaaggaccatgacagggtattggtcaacacagggctgcagacttctgacaactaataagacccataccacatgctcttgcaaccacctgaccaattttgctgtgctcatggcccacgtcgaggtgaaacacagcgatgccgtgcatgatctgcttttggacgtaatcacgtgggtcggaatattgctgtcacttgtgtgtcttctgatctgtatcttcaccttctgcttcttccggggactccaatctgaccggaacaccatacacaaaaatttgtgtatctccctgttcgtggccgaactcttattcctaattggcatcaaccgtacagatcagcccattgcctgtgctgtgttcgctgccttgctgcacttcttcttccttgctgcattcacatggatgtttctggagggagtgcagctgtacatcatgctagtcgaggtcttcgaatctgagcactcacggcggaaatatttctaccttgtgggatatggaatgcccgcactcatcgtggcagtgagtgccgccgtcgattacaggagctatggaactgataaggtctgctggctgcgcctcgatacgtatttcatatggtcctttatcggacctgccactctgatcattatgctgaatgtgatatttctcggtattgctctctataagatgttccatcataccgccatcctcaagccggagtcaggatgcctggacaatatcaactacgaagacaatcgccccttcatcaagagttgggttatcggcgccatagctttgctctgtctgctcggacttacctgggcgttcggcctgatgtacatcaacgaaagcacggtcatcatggcttacctgtttaccatttttaactcacttcaaggcatgttcatctttatcttccattgtgtcctgcaaaagaaggtcaggaaagagtatggaaagtgtctcagaactcactgttgcagcggaaaaagtactgaatctagcattggatctgggaagacatctgggagcaggacgccggggaggtattcaacaggctcccagagcaggatccgccgaatgtggaacgacaccgtgagaaagcagagcgagtcctccttcatcacgggtgatatcaatagttcagcttcactgaataggggagccatggcaaatcatctgatcagcaacgcactgcttcgtccacacggtacaaacaatccatacaacactttattaggggaacccgcagtctgcaataacccgtcggtgtcaatgtataatgcacaagagccctacagggagacctccatgggcgtgaaactgaatatagcctaccagatcggagccagtgagcaatgtcagggatataagtgtcatggctacagtactactgaatggtag

SEQ ID NO: 42967 - DNA, 3696 bp, Artificial Sequence
  Description of Artificial Sequence: Synthetic coding sequence
atgtggcccagccagctgctgatcttcatgatgctgctggcccccataattcacgccttctctagggcacccatacctatggccgtcgtgaggcgagagctaagttgcgaatcgtatccaattgagctgcgttgtcctggcactgacgtgattatgatcgagtcggcgaactacgggagaacagacgacaaaatttgcgacagcgatcctgcccagatggagaatattcgttgctatctcccagatgcctataaaattatgtcacagagatgtaacaatcgtacccagtgtgccgtggtggccggccctgacgtgttccccgacccctgcccaggtacatacaaatacctggaggtgcagtacgagtgcgtgccatacaaggtggagcagaaggtgttcctgtgccccggcctgcttaagggcgtgtaccaatcagagcacctgtttgaaagtgatcaccagagcggcgcgtggtgcaaagacccgctccaggcctccgacaagatatactatatgccttggaccccatataggactgataccttgactgaatattcaagcaaagatgatttcatagccggccggcctacaaccacctacaagcttccgcaccgagtggacggtactggctttgtggtttacgacggcgcactttttttcaataaagagagaacgagaaatatagtcaaattcgatctgcggactcggataaagagtggcgaggctattattgcgaatgctaactatcacgacacaagcccgtatcggtggggtggcaaaagtgacatcgaccttgcggtcgacgagaatgggctgtgggtgatttacgcaactgaacagaataacggtaagatcgtgatctcccaactcaatccatacaccctgcggattgaaggcacttgggacaccgcctacgacaagcggagcgcgtctaacgcctttatgatctgcggcattctttacgttgtgaaaagcgtttatgaggatgatgataatgaagcgacaggcaacaagatcgactatatctacaataccgaccagagcaaggactctttggttgacgtgccatttcctaattcataccagtacatcgccgctgtggactacaacccccgggataatttgctttacgtatggaacaactaccacgtagtgaaatatagtctggactttggcccactggatagtcgttcaggtcaagcacatcacggtcaagtaagctacataagcccccctatccacctcgacagtgaacttgaacggccctctgttaaagacatcagcactaccggccccttggggatgggttccactaccaccagcactaccctacggacgaccacgctttcacctggaagatcgacgacgccctccgtgagcggccgccgtaaccggtccacttccaccccctcaccggcagtcgaagtgctggacgatatgacaacccatctacctagtgcctcttcccaaattcccgcactggaagagtcctgcgaagccgtggaagctcgggagatcatgtggttcaagacccgccaggggcagatcgctaagcaaccttgcccagcaggcaccattggcgtcagcacctatctctgcctagctcctgacggaatctgggaccctcaggggcctgacctctcaaattgttctagtccctgggtgaaccacatcacacaaaaactcaaatctggagagaccgccgcaaacatagcaagagaactggcggaacagacacgtaatcatttaaacgcgggcgacattacttatagcgttcgcgctatggaccagctagttggattgctggatgtgcagctgcgaaacctcacccccggaggaaaggattcagcggcacgatcgctgaataagctgcaaaaaagggaacgatcctgcagagcctatgtgcaggcgatggtggagacagtcaataacctgttgcagccacaggccctgaatgcgtggcgggacttgaccacatctgatcaattgagggctgcaacgatgttgctacatactgtggaagaatctgcctttgtgctggctgacaacctgctgaagactgacattgtgagagagaatacagataacattaagctggaagtcgccagactgtccaccgagggaaacctggaagacctgaagttccctgaaaatatgggacacggttccacaattcagctttccgccaataccctgaaacagaacggaagaaatggagagatcagggtggcatttgtgttgtacaacaacctcgggccctacctcagtacagaaaacgcaagcatgaaactcggtaccgaagccctcagcactaatcacagtgtgatcgttaattctccagtgatcacggcggccattaataaggaatttagtaataaggtctatctggctgaccctgtggtcttcactgttaagcacattaagcagtctgaggaaaacttcaaccccaattgttccttttggtcctatagcaagcgtactatgactggatactggtctactcaggggtgccggctgttgaccaccaataaaacacacactacttgctcatgcaatcacctgaccaacttcgccgtgttgatggcccacgttgaagttaaacactccgacgcagttcatgatctgctgcttgatgtgataacgtgggtcggcatcctcttgagtttggtctgcctcctgatctgcatcttcactttctgcttctttcgcggtttacagtctgatagaaacaccatccataaaaacctgtgtattagtcttttcgtggctgaactactttttctgatcggcattaatcgcacagaccagcccattgcttgtgccgtgtttgcggccctgctacactttttcttcctcgccgcattcacctggatgttcttggaaggcgtgcaattatacattatgctagtagaagtgttcgaatcagaacactctcgcaggaaatacttctatctggtcggatatggcatgccagcgctgatcgtggccgtatccgccgctgttgattataggagttacgggacagataaggtatgttggctgcgattagatacctacttcatttggtcttttatcggtccggcgaccctaatcattatgctcaatgtgatattcctgggaatcgctctgtacaagatgtttcaccatacagcaatcctgaagcctgagtcaggctgtctcgacaatattaagtcctgggttattggggcaatcgcgctcctgtgcctgcttggcctgacctgggccttcgggctcatgtatattaatgagtctactgtgattatggcatatctgtttaccatatttaactcactccagggcatgtttatcttcatattccactgcgtgttgcagaaaaaggtgcgtaaggagtacggaaagtgcctccgaactcactgttgcagcgggaagagcacagagtcctcaatcgggagtgggaaaacctctggatcccgcacaccaggccgctactctacaggctctcagtctcgcataagacgcatgtggaatgatacagtccgcaagcagagcgagagctctttcatcacaggcgacattaatagctccgccagcctcaatagagaaccctaccgagagacttccatgggcgtcaagttgaatatcgcctaccagatcggtgcctccgaacagtgccagggatacaaatgccacggttactccactacagagtggtag

SEQ ID NO: 42968 - DNA, 4743 bp, Artificial Sequence
  Description of Artificial Sequence: Synthetic coding sequence
atgtggcccagccagctgctgatcttcatgatgctgctggcccccatcattcatgggggaaaacactctgaacgacaccccgctctcgctgctccactgagacacgcagagcgttcacccggcggcgccctcccacctagacacttgctgcagcaacctgctgcggaaaggacagccgcgcatcgtgggcagggcccacggggagcaacacgcggagtgcgcggtccgggggcccagggagcccagatcgcggctcaggccttttccagggcccctatccctatggccgtggtccgaagagagctctcgtgcgaatcatatcccattgagctgcggtgccctggcacggacgtgattatgatcgaatccgctaattatgggcgcaccgatgataaaatctgtgattccgaccccgcccagatggaaaacatacgatgctatcttcccgacgcgtacaagataatgtcacagcgttgtaacaatcgcacccagtgcgccgtggtcgccggcccagatgttttccccgatccctgccccggaacatacaaataccttgaggtgcagtatgagtgtgttccttacaaagtcgagcagaaagtgtttctgtgtccaggcctgctgaaaggtgtgtaccagagtgagcacttgttcgagagcgaccatcagtcaggagcctggtgtaaggatcccctgcaggcttccgataagatttattatatgccctggaccccctacagaactgacaccttgacagaatactcaagtaaggatgatttcatcgctggcaggcctacaaccacctacaagctgccgcatcgcgtggatgggactgggttcgtggtgtatgacggcgccctctttttcaataaagaacgcacccggaatatcgttaaattcgacttgcggacacgtatcaaaagtggagaggcgatcatcgccaacgccaactatcatgatacatcaccctaccgttgggggggcaagtccgatatcgacttggcggtggatgagaacggcctgtgggttatctacgcgacggaacaaaataatgggaagatcgtaattagccagctgaatccctatactttgcgtatcgagggcacatgggatacagcatatgataaacgttcagcctctaatgcgttcatgatctgcggaattttatacgtcgtgaaatctgtgtacgaggacgatgataacgaggctactgggaataagatcgactacatttacaacaccgaccaatcgaaggatagccttgttgatgttccgttcccgaattcttaccagtatatcgctgccgtggattataacccgcgcgataacctgctgtacgtgtggaataattaccacgtcgtcaagtactccctcgactttgggccacttgacagccgctcaggccaggcccatcacggacaggttagttacatcagtccaccgatccatctcgactcagagctggagcgcccctccgttaaggacatctccacaacggggccacttgggatgggctctactactacctcgaccactttgcggacaaccaccttaagccccggtagatcaacgactccatccgtgtccggccggcgcaatcggtccacctctaccccgtccccagctgtggaagtactggatgatatgacaactcatctgccatctgcttcatctcagatcccggcattagaggagtcatgtgaggccgtggaggcacgggaaattatgtggttcaaaacccggcagggacagatcgccaagcagccgtgcccagcaggcactattggggtctcgacctatctttgtctggcgcccgacggaatttgggaccctcaggggccagatctgtctaactgttcatccccctgggttaaccacatcacacaaaaactgaagagcggagagacagctgcaaatatcgcgagagagctggcggaacagacaaggaatcacttgaacgcaggagatatcacttattctgtgcgtgcaatggaccagctagtcgggctgcttgacgtgcaattgcgcaacctgacacccggagggaaagatagtgccgcacggtcacttaacaagctccagaaacgcgagcgctcttgtagggcctatgtgcaggccatggtggagaccgtcaataaccttctacagcctcaggctctgaacgcgtggagagacctgactacctcagaccagttgagagccgccaccatgcttctgcacaccgtggaagagtcagccttcgtgttggctgacaaccttctgaaaaccgacatcgtaagggagaacacagacaacataaagctggaggtggccagactcagcactgagggcaatctcgaggatttaaaattcccggaaaacatgggacacggcagtacgattcaactgagcgcaaacaccttgaagcagaacggccggaatggcgagatcagggtcgcattcgttctgtacaataacctcggcccttacctgtctaccgaaaacgccagcatgaaactgggcactgaggcattgagcactaatcatagcgtcatcgtcaattcaccggtcattacagccgccatcaataaggaattttccaacaaagtctacctggctgatcctgtggtgtttacagtcaagcacatcaagcagagcgaggagaatttcaaccccaactgttccttttggtcctactccaagaggaccatgacagggtactggtcaactcaaggctgcaggctcctgacaactaataagacacatacaacctgtagctgcaaccatcttacaaacttcgcagtgctgatggcacacgtggaggtcaaacactccgatgctgttcacgatctacttctcgatgtcataacttgggtggggatcctgctttccttagtgtgcctgctaatttgtatattcaccttctgtttcttccgaggcctccagtcagatcgcaatacaatacacaagaatctctgtatctcactttttgtggctgaattgttgtttctcattggaattaataggaccgatcaacctatcgcttgtgcggtttttgcagccttgctccacttcttttttttggcagcatttacatggatgttcctagaaggggtccagttatacattatgctggtagaggttttcgagagcgagcatagcagaaggaagtacttctatttggtgggttatgggatgccagctcttattgtcgctgtaagcgccgctgtggactaccggtcttacggtacagataaggtgtgctggcttagactggacacctatttcatctggagcttcatcggcccagccacactaatcattatgctaaatgttatcttcttagggatagcattatataaaatgttccatcatacggccatcttgaagccagaatcaggatgcctggataatatcaattacgaagacaatagacctttcataaagtcatgggttatcggagccatagccctcctttgtctgctggggctcacttgggcctttgggctaatgtatatcaatgagagcacggtgataatggcatatttgtttacaatcttcaacagtctgcaggggatgttcatcttcatttttcattgcgtgctccagaagaaagtaaggaaggagtatgggaaatgcctgagaacacattgttgttccgggaagagcactgaatcctccatcgggtccgggaagactagtggtagtaggacccctggccgttatagtactgggtcccagagccggataaggcgaatgtggaatgacacagtcagaaagcagtccgagagcagcttcatcacaggtgatatcaattcaagtgctagtctcaatcgcggggctatggcaaatcaccttatttccaatgctctgttgcgccctcacggcaccaataatccatataataccctgctaggtgagccagcagtgtgtaacaacccatctgtgagcatgtataacgcccaagagggccttctgaacaatgccagggacaccagtgtgatggataccctgccgttgaatggcaaccatggaaatagttactcgatcgcgtccggagaatacctgtcgaactgtgtgcagattattgatcgggggtataaccataatgagaccgccttggagaagaaaatattaaaagagctgacctcaaattatatcccaagctacttaaacaaccatgaaaggtcttcagagcagaatcgaaatttaatgaacaagctcgtcaacaatctcggctctggacgtgaggatgacgccatcgttctcgatgacgctacctccttcaatcatgaagagagcctcggtctggagctgattcatgaagaatccgatgcacctctcctgccaccgcgggtgtattccacagagaatcatcagccccatcactacacacgtcgtagaattccccaggaccacagcgaatctttctttccattgttgacaaatgaacacaccgaggacctccagtcgcctcatcgcgacagtctttacacaagcatgcctacccttgctggggtcgcagctactgagagtgtgaccacctcaacacaaaccgagccacctccggcaaaatgtggtgacgccgaagacgtgtactataagtcaatgcccaatctggggagccggaatcacgtccatcagctgcatacctattatcagctcggaaggggatcctccgacggctttatcgtcccccctaataaagatggaaccccacctgaggggtctagcaaggggcctgcccatctggtgacgagtctttag

SEQ ID NO: 42969 - DNA, 4716 bp, Artificial Sequence
  Description of Artificial Sequence: Synthetic coding sequence
atgtggcccagccagctgctgatcttcatgatgctgctggcccccatcatccacggtgggaaacactcagaaaggcaccccgctctggctgccccgttgcggcatgccgagcggtctcccggtggggccctccccccaaggcacctcctccagcagccagcagccgagcgcaccgcagctcaccgtggccagggacctcgcggagccactcgcggcgtgcggggacctggagcccagggcgcccagatcgccgcgcaggctttctcccgagcccccattcccatggctgttgtgcgtcgggagctgtcttgtgaatcgtaccctattgaattgaggtgccctggcacagatgttattatgattgaatcagcgaattacgggcgaactgatgataagatttgtgatagcgaccctgctcagatggagaacattaggtgttatcttccagatgcttataagattatgtcccaacggtgcaacaataggacacagtgtgcagtggtggccggtccagacgtctttccggatccatgtcccggtacctacaaatacctggaagtgcagtatgaatgcgtgccatacaaggttgagcagaaggtgtttctttgtccagggttgctcaagggcgtataccagtccgagcacctattcgagagcgaccaccagtccggagcatggtgtaaagaccccctgcaagcctcggataagatttattatatgccctggaccccctaccgcactgacaccctgactgagtacagttcgaaggatgacttcattgccgggcgaccaaccacaacatataaactccctcatcgcgtcgacgggactggctttgtggtatatgacggggcacttttctttaataaagagcggactagaaatatcgtgaagttcgacctgagaaccaggatcaagtccggcgaggctatcatcgccaacgccaattaccatgacaccagtccgtacaggtggggaggaaagtcagatattgacctggccgtagatgagaacggtctgtgggtgatctacgcgaccgagcaaaacaacggcaagattgtaatctctcagcttaacccctacactctgcgtattgaggggacatgggacaccgcgtacgataaaaggtctgcctcgaatgcctttatgatttgcggaatcctgtatgttgtgaagtccgtctacgaagacgatgacaatgaagccacagggaataagatcgattatatttataatactgaccaatccaaggactctctggtggacgtgccctttccaaactcttatcaatatatagccgcggtggactataacccacgggacaatctgctttatgtgtggaacaactaccatgtcgtgaagtactccctcgactttggcccactggactcacgctccggtcaagcacaccatggccaggtgtcctatatctcccctcccattcacttggatagcgaactagaacgtccctctgtgaaagacatcagcacgacagggcccctggggatgggctcaaccactactagtacgacactgcgaactaccactctgagtcccgggcggagtactactccttcagtcagtggacggagaaacagatcgacctcaactccatcaccagccgttgaggttctggacgacatgaccacgcatttaccctctgctagctctcaaatccccgctctggaagagtcctgcgaagcagtggaagcacgcgagataatgtggtttaaaacacggcaggggcaaatcgccaaacagccatgccccgccggtaccatcggggtgtccacttatttatgtctcgcccccgatggcatctgggatccacaaggccctgatttgagcaattgctcatccccctgggtgaaccatatcacccagaaactaaaaagtggagaaacggcggcaaacatcgctcgggagctggctgagcagacacgaaatcatttgaatgccggagacatcacatactccgttcgcgccatggatcagctggttggattactggatgtgcaattgaggaatctgacccctggaggaaaagactctgctgcacggagcctcaacaagctccagaagagggagagaagttgccgcgcttacgtgcaagccatggtggaaacagtgaataatttgctgcagccccaggctctaaacgcctggcgggatctgactacctcggaccagctgcgcgccgcaactatgcttctccacacagtagaagaaagcgcatttgtattagccgataatttgctgaaaaccgacatcgtgagggaaaacaccgacaatatcaaactggaggtggctaggttaagcactgagggtaatctagaggatctcaagtttcccgaaaacatggggcatgggtccacaattcagctcagcgctaatacgctgaaacagaatggacggaacggcgaaatcagagttgccttcgtgctgtacaataacctgggcccttacctgtccactgagaacgcatcaatgaaactgggcacagaggccctgtccaccaaccacagtgtgatcgtcaacagtccggtcatcacagctgctatcaacaaagagttttccaacaaggtctacctggctgacccagtggttttcaccgtcaaacatattaagcagagtgaagagaactttaatcctaactgttctttctggagttacagcaaaaggacaatgacaggttactggtcaacacagggttgcagactcctgactacaaataagacccacacaacctgcagttgcaaccatctgacaaacttcgcagttttaatggctcatgtggaagttaaacacagcgatgccgttcatgaccttctcctggatgtgattacctgggtagggattttgctgtccctggtgtgtcttctaatctgcattttcactttctgcttcttccgcggcctacagtcagacaggaacacgatacataaaaacctctgtatcagtctgttcgtagctgaactgctgtttttaattgggataaaccgtacagatcagcccatcgcatgtgctgtgtttgctgcgttgctgcactttttctttctcgccgcctttacatggatgtttctggagggagtgcagctctacatcatgttagtcgaagtttttgagagtgagcattcccgtcgcaaatatttctatcttgtgggatatggaatgcctgctctcatcgtcgcggtatccgccgccgttgattatcgaagctatgggacagacaaggtgtgctggctcaggttagacacctacttcatctggtcatttattggccctgctacattaatcatcatgctcaacgtgatatttttggggatcgctttgtacaagatgttccatcacacggcaatcttgaagccagagtccgggtgcctggataatataaagagttgggtaatcggggctattgcccttttatgccttttgggcctcacctgggcgttcggacttatgtatattaacgaaagcaccgttatcatggcttatttgtttacaattttcaattcgcttcaagggatgtttatctttattttccactgcgtgctgcaaaagaaggttcgtaaggagtatggcaagtgtctgcgaactcattgttgttccggtaaatctacggagtcgagtattggatccggcaagacatctggatcccgaacacctggacgttactccaccggttcccagtcacggatccggcgtatgtggaatgacactgtgcggaagcagtccgaatcctctttcatcacaggagatattaatagctctgcttctctgaatcggggggccatggctaaccacctcatctccaatgcattattaagacctcacggaaccaataatccctataacactcttctgggagagcctgcagtgtgcaacaaccctagcgtctctatgtacaatgctcaggagggcttattaaacaacgcacgcgacacctccgtgatggataccttgcccctgaacgggaaccatgggaattcttattccattgcctctggtgaatatctgtcaaactgcgtccagatcattgatcgaggatacaatcacaacgagacggctctcgaaaagaaaattctgaaggagttgacttcaaactatatccctagctatcttaataaccatgagcgcagctctgagcagaacaggaatctgatgaacaagctcgtgaataatcttgggagtggcagggaggacgatgccattgtgttagatgatgcaacttctttcaaccatgaggaatcacttgggcttgagctaattcatgaagagtcagatgcccccctactaccccccagggtctattccactgaaaatcaccagccccatcactacacaagaagacgaattcctcaggaccactccgagtctttcttcccgctactcacaaacgaacataccgaagatcttcagagcccccaccgggactctctttatacctccatgcctaccctggcaggcgtcgccgcaacagaatctgtcactacctccacccagaccgaacctccacccgctaagtgtggggacgccgaggacgtttactacaaatccatgccgaatctcggatcacggaaccacgtgcaccaacttcacacctactaccagctggggcggggcagctccgatgggtttatcgtgccgccgaacaaagatggtacccctccagagggaagctccaaggggccagcccatttggtcacttctctttag

SEQ ID NO: 42970 - DNA, 4029 bp, Artificial Sequence
  Description of Artificial Sequence: Synthetic coding sequence
atgtggcccagccagctgctgatcttcatgatgctgctggcccccatcatccacggcggaaagcatagtgaacggcaccctgctctggctgccccactacggcacgccgagcggtcgcctgggggagctctgccccccaggcatctccttcagcaaccagcagcggagcgcacggctgcacacagaggccaaggccctcggggagctactagaggagtcagagggcctggagcccagggagcccaaatcgctgctcaagctttcagccgggcccccattcccatggccgttgtccggcgcgaattatcatgcgagagttatcccatagaactccgatgtccaggaaccgatgttattatgattgagagtgccaattatggtagaacagacgacaagatctgcgacagtgacccagctcagatggagaatatccggtgctatctgcctgatgcctataagattatgtctcagcgctgtaataaccggactcagtgcgctgtcgtggccgggcctgatgtgttccctgatccctgcccaggtacttataagtacctcgaggtccagtacgaatgtgtaccatacaaggtggagcagaaagtttttctctgtcccggactcttgaaaggggtataccagagcgagcacttgttcgaatctgaccaccagagcggggcctggtgcaaagatcctctgcaggcttctgacaagatttattatatgccttggacaccctacagaaccgatactttaactgagtacagtagcaaagatgacttcatcgccggacggcctacaacaacctacaagcttccccaccgggttgatggcaccggttttgtcgtctacgacggcgcactctttttcaacaaggaaagaactcggaatattgttaaattcgacctaagaacgcgaataaagtccggagaggccattatcgcaaacgccaactaccacgacacgagtccctatcgatggggcggcaagtctgatatcgacctggctgtagacgaaaatggcctttgggtgatctatgctactgaacagaacaacggcaagattgtgatcagtcagttgaatccatatacccttagaatcgaagggacatgggatactgcctatgacaagagatctgcctcaaatgcgttcatgatctgtgggattctatacgtggtgaagtccgtgtacgaggatgatgacaacgaggcgaccgggaataaaattgactacatctacaataccgatcaatccaaggacagtctcgtagacgtgccgtttcccaacagttatcaatatatagccgccgtcgactacaaccccagagataatcttctttacgtatggaacaactaccatgtcgtgaaatatagcctggattttggtcctttagattcaagatcagggcaggctcaccatggccaggtctcttacatcagtccccctattcatctggactctgaactggagaggccctccgtgaaggacatatcaacaactgggcctctcggtatgggttcaaccaccacctccacaaccctgcgcactaccacactcagtcccggtcggtctaccacaccaagcgttagcggaagaaggaacagaagtacgtctacccccagccctgctgtggaggtccttgacgacatgaccactcatctgccctctgcatctagccagatccctgctcttgaggaatcatgcgaagccgtagaggccagagagattatgtggtttaagacacggcaggggcaaatcgcaaagcagccttgcccggctgggacaatcggcgtgagtacatacctttgtctggcccccgacggcatctgggatccccaggggcccgatctgtccaattgttcttccccgtgggtgaaccacattacccaaaagcttaaatccggagaaacggcggcaaatatcgcacgggaactcgcagaacagactagaaaccatctcaatgctggagacatcacctactctgtccgcgctatggaccagctggtgggtctgcttgacgtgcagctgcggaacctgacccccgggggtaaggattccgccgccagatcattaaataagctgcaaaaacgagagcgctcatgtcgcgcgtacgtgcaagctatggtcgagacagtgaataatctgctccaaccccaggccttaaacgcttggcgggatttgactacatctgatcaacttcgcgccgctacgatgctacttcacactgtggaggagtcggccttcgtgcttgctgacaatctccttaagaccgatatagtgcgtgagaatactgataatatcaagctggaagttgccaggctgtcgacggaggggaacctagaagatctcaagtttcccgaaaacatggggcacggcagcacaatccaactcagtgctaacacattgaagcagaatgggcggaacggcgagatacgggtagcctttgttctgtacaataatttgggtccttacctgagcacagaaaatgcatctatgaaactggggaccgaggcgcttagcacaaaccactcagtgatcgtaaacagcccagttatcacagctgccataaataaggaattctccaataaggtctacctggctgatcctgtggtgtttaccgtgaagcacattaaacaaagcgaagagaactttaatcccaattgctcattctggagctacagtaaacgcaccatgactggctactggtccacccagggttgtcgactcttaactacgaataagacacacaccacctgttcatgcaaccacctgactaacttcgccgtgctcatggcccatgtggaagttaagcatagcgatgccgtccacgacttactgttggacgttatcacatgggtggggatattattatccctcgtgtgcctcctgatctgcatctttacattttgtttttttaggggacttcagtcagatagaaacaccatccacaagaatctttgcatttctctattcgtggccgagctcctctttctcatcgggatcaataggactgatcagcccatcgcttgcgcagtgtttgctgcactgctgcatttcttttttttagctgcattcacctggatgttcctagaaggcgtccagctttacattatgctcgtggaggtgttcgaaagcgaacactcccgtagaaagtacttctacttggtgggctacgggatgccggctttgatcgttgctgtgtctgcagcagtcgattatcgcagttacggtaccgacaaggtctgctggctccgactagatacttatttcatttggtcatttattggcccagccaccctgatcataatgctaaacgtgattttcttaggcatcgcgctgtataaaatgtttcaccacacagccattttaaaacccgaaagcggatgtttggataacatcaagagttgggtcattggtgctattgctctgctctgtttgctgggattgacctgggcttttggcctgatgtacattaacgaatcgacagtgatcatggcctacttgttcactatttttaattcattacagggtatgttcattttcatctttcattgtgtgctgcagaagaaagtgcggaaagaatacggcaagtgtttgcgcactcactgttgtagcggcaagtccactgaatctagcataggctctggcaagactagtggaagccggacgcctggcaggtatagtaccggatctcagtctcggatccggagaatgtggaacgacaccgtgcgcaagcagtccgaaagctcatttataaccggagatataaattcctctgcaagcctgaataggggggctatggccaatcaccttatcagcaacgcccttttgcggccacacgggactaacaacccctataataccctcctgggcgagcctgctgtgtgtaataacccctccgtgagtatgtacaatgcacaagaaccgtacagggaaacctctatgggggtaaagctcaacattgcttatcagatcggagcctctgaacagtgccaggggtacaaatgccatggctactccactactgaatggtag

SEQ ID NO: 42971 - DNA, 4587 bp, Artificial Sequence
  Description of Artificial Sequence: Synthetic coding sequence
atgtggcccagccagctgctgatcttcatgatgctgctggcccccatcatccatgggggaaagcactcagagagacaccccgctctcgccgctcctttacgacatgccgagagaagtccaggcggggcccttccaccccgccatctattgcagcagccagcagccgaacggacagctgctcacagaggccagggccccagaggagctacaagaggcgtgcgaggccccggggcacagggggcccagattgcagcacaggccttctctcgagcccctatcccgatggcagtagttcggagggaattgtcctgcgaatcttaccccattgagctccggtgccctggtacagatgtcatcatgatcgagagtgctaactatggacgaacagacgacaagatctgtgactccgaccccgctcaaatggagaacatcaggtgctacctgcccgatgcctataaaatcatgtcacagcgatgcaataatcggactcaatgtgctgttgtcgccgggcctgacgtgttcccagatccatgtccgggaacttacaagtaccttgaggtccaatatgagtgcgtgccctacaaggtggaacagaaagtcttcctgtgccctggtctgctcaaaggtgtctaccagtcggaacatctgttcgagtctgatcatcagtctggagcctggtgtaaagatcccctgcaagcatccgacaaaatctactatatgccctggacaccttatcgcacggacacgttgaccgagtattcaagcaaggacgattttatagccggccgacccacgacgacatacaagctaccccaccgtgtcgacgggaccggcttcgtggtgtacgatggtgccctgttcttcaacaaggaacgcacaaggaatattgttaagttcgatctgagaacccggatcaaaagcggggaggccataatcgctaatgcaaattaccacgatacctccccttacagatgggggggcaaaagcgatatcgacctggccgttgatgaaaacgggctctgggtcatttacgcaacagagcagaacaacggaaagatagtgatcagccagctcaacccttatacactgcgtattgaaggcacttgggatactgcttacgataagcgatctgcgagcaatgcgtttatgatctgcggaattctatatgtggtaaagagcgtttatgaggacgatgacaatgaggctacaggcaataagattgactatatctacaacaccgaccaatccaaagactccctcgtggacgtcccctttcctaactcttaccagtatattgcagccgttgactacaatccccgagacaacctactgtacgtgtggaacaactatcacgttgtaaagtacagcttagatttcggccctttggactcccggagtggccaagcgcaccatggacaggtcagttacatttccccgcctatccatctcgactccgagctcgagcgcccaagcgtgaaagacatttcgaccactggaccattaggcatgggtagtaccactacctcaaccacccttaggacgacaacactgtccccggggaggagtaccactccctccgtgtctggaagaagaaaccgaagtacatctaccccctctcctgccgtcgaggtgttggatgatatgaccacacaccttcccagcgcctctagtcagatcccagccctcgaggagagctgtgaggccgtggaagcgagggagatcatgtggttcaagaccagacagggccagatcgctaagcaaccttgtccagctggtaccatcggggtgtcaacctacctgtgtctagccccagatggcatatgggatcctcagggcccggacctcagcaactgttcatctccttgggtgaatcacatcacacaaaagttgaaatccggagagaccgcagcaaacatcgctcgggagctggcggagcagacgaggaatcacctcaacgccggagacataacttacagcgttcgagcgatggatcagctggtaggcctgctggatgtgcagctacgaaacttaacgcccgggggaaaggactcggccgcaaggagtctgaacaagttgcagaaaagggaacggtcatgtcgagcctacgtccaggctatggtggagacagtcaacaatcttctgcagccccaagctttaaatgcatggagggatctgactacaagtgatcagctccgggcggcaacaatgctacttcacaccgtggaagaatctgcattcgtgctagccgacaatcttcttaaaacggatatcgtgagggagaacactgacaatatcaagcttgaggtagcacgactgtccaccgagggtaatctggaagatctgaagtttcccgagaacatggggcatggatcaactatccaactgtccgcaaacactctgaaacagaacggccgaaacggagagatcagagtggcattcgtactgtataacaatcttggaccgtacctgagcaccgaaaatgctagcatgaagcttgggactgaggctctttccaccaatcacagcgtgattgtcaacagcccagtgataacggccgcaattaataaggagtttagcaataaggtctaccttgccgatcccgtcgtctttaccgtgaaacacattaagcagtctgaggagaatttcaatccaaactgttccttctggtcctactcaaagcggaccatgacaggctactggtctacccaaggttgtaggcttctaaccactaataagacccatacgacttgctcatgtaatcacctcacgaatttcgccgtacttatggcacacgtagaggtgaagcattctgacgctgtgcacgacctactcctcgatgtgatcacatgggtggggattctgctaagcctagtgtgcttgttaatctgtatatttacattctgcttctttagaggcctacaaagcgatcgcaatactattcacaagaacctatgtatctccctgtttgtcgccgagcttttatttttaatcggcattaaccgaactgaccaacccatcgcttgcgctgtattcgctgcgcttcttcacttctttttcctcgctgcatttacctggatgttcctcgagggagtgcagctctacattatgctggtggaggtgttcgagtccgaacactctcgtaggaaatacttctacctcgtcggatacggaatgccagcactgatcgtagccgtttctgctgcagtggactatcgcagttacggtacagacaaggtgtgttggctacgtctggatacatacttcatctggtctttcattggaccagccaccctgataataatgctgaacgtcatctttctgggaatagctctatacaagatgtttcatcacacagccattcttaaaccagagtccggttgcctggacaatattaaatcctgggttattggcgctattgcactgctttgtctcctcggcttaacatgggcctttggcctgatgtatattaatgagtccacagtcataatggcttacctgtttacaatcttcaacagtctccagggtatgttcatctttatcttccactgcgtcctgcagaaaaaagttagaaaggagtacggaaaatgtctgcggacccactgctgttctggcaagagcacggagtccagcatcgggagtggaaaaacaagtgggtcacgcacgcctggacgatacagcaccggttcacagagccgtatacggcgcatgtggaatgacacggtgaggaagcagtcggagagcagctttataactggagacattaattcgtcagcatcattgaatagggaggggcttttaaataacgcacgggataccagcgttatggacaccttgcccctgaatggcaaccacgggaactcatattctatcgctagcggggaatacctgagcaactgcgttcagattattgatcgaggctataaccacaatgagacagccttggaaaagaaaatactcaaggagctgacaagcaattacataccttcctacctgaataaccatgagcgatcatcagagcagaatagaaacctgatgaataagctggtcaataacttagggagcgggcgagaggacgatgctatagtactggacgatgcaaccagtttcaatcacgaggagtccctcgggcttgagctcattcatgaagaatccgacgctcccctgctgccccccagagtgtatagtacggagaaccatcagccacaccattacacacgccgccgaatccctcaggaccattccgagtctttcttccccctgctcaccaatgagcacactgaggatctccagagcccacacagagactctctatacacgagcatgccaaccttggcaggggtggcagctactgagtccgtgaccaccagtacacagacagagcctcctcccgctaagtgcggggatgccgaagatgtgtattataaaagtatgcctaacttaggatcccgaaatcacgtgcatcagctgcatacatactatcagttgggccgaggctccagcgacgggttcatagttcccccaaacaaggacgggacccctccagaaggctcatccaaggggcctgcgcacctggtgacaagtctctag

SEQ ID NO: 42972 - DNA, 4056 bp, Artificial Sequence
  Description of Artificial Sequence: Synthetic coding sequence
atgtggcccagccagctgctgatcttcatgatgctgctggcccccattatccatggaggaaaacactccgagagacatcccgcactcgctgccccgttaaggcacgccgagcgatctccgggaggggctctccctccaaggcacctgctccagcaacctgccgcagagcggacggcagctcaccggggacaagggcctcgaggggcgactagaggagtgcgcggccctggggcgcagggcgcccagattgcagcccaggcgtttagtcgcgctccaatacccatggccgtcgtacggcgggagttatcctgtgagtcttatcctatcgagttgaggtgccccggaacagatgtgatcatgatagaatccgccaattacggccgcaccgatgataagatctgcgactccgatcccgctcagatggaaaatatccgttgttatctgcctgatgcatacaagattatgtcacagcggtgcaacaatcggacccagtgtgcagttgtggctggacctgacgtctttccagacccatgccctggaacatataagtatctggaagtccagtacgaatgtgtgccctataaagtggagcaaaaagtgttcctgtgtcctgggttactgaagggggtttaccaatcagagcatctctttgagtccgaccatcagtctggtgcttggtgcaaggatcccctgcaagcatccgacaagatctattacatgccttggactccatacaggaccgacacattgacggagtactcttcaaaggacgacttcattgccgggcggccaacaacaacctacaaacttcctcacagagtagatggaacaggcttcgtggtgtatgacggcgcgttgtttttcaacaaggagcgcactaggaacatcgtcaagttcgacctccggactaggatcaagagcggtgaagccattattgccaacgcgaattaccacgatacatcaccatacaggtggggcggcaagtccgacattgacctggccgtcgatgaaaacggactgtgggtgatatacgccacagaacaaaacaatgggaaaatagttatcagccagctgaacccctacactctcaggatcgagggtacctgggacactgcttacgataaacgttccgccagtaacgctttcatgatatgtgggatcttgtatgtggtaaagtctgtatacgaagacgatgacaatgaggccacaggcaacaaaattgactatatatacaacaccgatcaatcgaaggattccctcgtggatgtgccttttccaaacagctaccagtacatcgcagcggtggattacaacccgagagacaatctactttacgtatggaacaactatcatgtggtgaaatacagtctagactttgggcccctcgattctcggagcggacaggctcaccacggtcaagttagctacataagcccccccatccatcttgatagtgagttagaacggccatctgtgaaagacatttctactactggacctctgggcatggggtcaacgacaaccagcacaactctacgcaccacaacactgtcgccgggccgttccacaaccccttctgtatccggccgacgcaataggagcacttctacaccttctccagcggtggaggttttggacgatatgacaacccatctaccttctgcatcttcccagatccctgcactggaggagagttgtgaggccgtggaggcccgtgagataatgtggttcaaaaccagacaggggcagatagcaaaacaaccctgcccagccgggaccatcggggtgtccacctacctgtgcctcgcacccgatggcatctgggatcctcagggacctgacctgtccaattgcagcagcccttgggtgaatcatattacacagaaactcaagtctggggagacagcagccaatattgcgcgcgagctagcggagcaaacccgcaaccatctgaacgcaggcgacattacttactccgtccgagccatggatcagctggttggtctcctggacgtgcagctcaggaatcttacccctggcggcaaggacagcgcagcaagaagtctgaacaaattacagaaacgcgaacggtcttgcagggcctatgtccaggccatggtggagaccgtcaataacctgctgcaaccacaggcgctgaacgcatggagagatctcaccacttcagaccagttgcgggcagctacgatgttgctacacactgtggaggagtccgctttcgtgctcgccgacaacctgctgaaaacagatattgtccgcgaaaacacagataacattaagttggaagtggcacggctgtccacggaagggaatttagaggacctgaaatttcctgagaacatgggccacggaagtacgattcagctgtccgcgaacacattgaagcagaatggacgtaacggggagataagggtggcgttcgttctgtataacaacctggggccttacctttccaccgagaatgcttcaatgaagcttggcaccgaggccttaagcacaaaccatagcgtcatcgtaaattctccggttattaccgcagccatcaataaggagttctccaacaaggtgtacctcgccgatcctgtcgtgttcacagtcaagcatatcaagcagtctgaagaaaatttcaatcctaactgctcgttttggtcttattcaaagcggaccatgacaggctactggagtacccaaggttgtagactgctgaccacaaataagacacacacaacgtgctcctgtaaccacctcacaaactttgctgtcttaatggctcacgtggaagtgaaacactccgacgctgtccacgatctgctcctcgatgtgattacttgggtcgggatacttttgagtcttgtttgcctgctcatatgcatttttaccttttgctttttcagaggtctccaatccgacaggaatacaattcacaaaaatctgtgtatctccctgtttgtggcggaactgctcttcctcattggtatcaaccgtaccgatcagcctatcgcctgcgccgttttcgccgccttactccattttttcttcctggcagccttcacttggatgttcttagagggtgttcagttgtacatcatgctagtggaagtgtttgagagcgagcactctcgtcggaagtatttttatctagtgggctacggcatgccagctctgattgtggctgtgagcgcagcagtcgattatcgctcttatggtaccgacaaggtttgctggctgcgcctcgatacttattttatttggtcctttatcgggcccgcaacactcatcattatgctgaacgtcatcttcttgggtatcgctctttacaaaatgttccaccatacagctatactaaaaccagaatccggatgcctcgacaatatcaattatgaagacaaccggccgttcatcaagtcttgggtcattggtgcaatcgcactcctgtgtctgctcggccttacatgggccttcggactgatgtatattaatgaatctaccgttatcatggcctatcttttcactattttcaactcccttcagggcatgtttatatttatattccactgtgtgctgcaaaagaaggtgcgcaaggaatacggtaagtgtctcagaactcattgttgttccgggaagagcaccgagagctcgatagggtccggcaagacaagcggcagtcgcacgcccggaagatattctactggctcccagagtaggattaggcggatgtggaatgacacggtgagaaaacagagtgagtcatcattcatcactggggatataaactcttccgcatcacttaatcgtggggctatggccaaccaccttatctctaatgcgctgctgaggcctcacggtacgaacaacccatacaacaccctcctgggggagcctgctgtctgtaacaatcccagcgtttcgatgtacaacgcccaggagccctaccgcgaaaccagcatgggagtcaagctgaacattgcataccagattggcgccagtgaacagtgccagggctataaatgtcacggatattcaacaaccgaatggtag

SEQ ID NO: 42973 - DNA, 4539 bp, Artificial Sequence
  Description of Artificial Sequence: Synthetic coding sequence
atgtggcccagccagctgctgatcttcatgatgctgctggcccccatcatacacgcgttctcaagggctcctatccctatggcagtcgttcggcgcgagttatcttgcgagagttacccaatcgaactaaggtgtcccgggacggacgtcattatgatcgaatctgctaactacggtcgtaccgacgacaagatatgcgactctgatcccgcacagatggaaaacattcgttgctacctcccagatgcatacaagattatgtctcagcgctgtaacaatcggacccagtgtgctgtggtggcagggccggacgtgttccccgatccctgccctgggacgtataaatatctggaagtacaatatgaatgcgtgccctacaaggttgaacagaaagtcttcttgtgtcctggcctcctcaaaggcgtttatcagtccgagcatttatttgagtccgaccaccagagtggtgcctggtgcaaggacccactccaagccagtgacaaaatttattacatgccctggacaccctaccggacggatactcttactgaatactctagcaaggatgactttatcgcaggacggccaaccactacctataagctgccgcaccgtgtggatggcactggcttcgtagtgtacgacggagccctcttcttcaacaaggaacgcacacggaacatcgtcaagtttgacctgcgtacccggatcaagtcgggtgaggcgatcattgcaaatgccaattaccatgacacaagcccctataggtgggggggtaagtctgacattgatctcgccgtggatgaaaacggcctttgggtcatttacgctaccgagcagaataacggcaagattgtcataagccagctgaacccttatacattgagaatcgaggggacttgggacaccgcttatgacaagagaagcgctagcaacgcctttatgatctgcggcatcttatacgtagttaaatcagtctacgaagacgatgacaatgaagccaccgggaataaaattgactacatttataacaccgatcagtcgaaggactctctggttgatgtcccgttccccaacagctaccagtatattgctgcagtcgactataatcccagggataacctgctatacgtgtggaataactaccacgtcgtaaaatactccctggattttggccctctagacagccggagcgggcaggctcaccacggccaggtttcctacatatccccccccattcacttagactccgaactggaacgcccatccgtgaaagacatttccaccactggaccccttggaatgggttccactactacatccactaccctgaggaccacgacgctgagcccagggaggtccaccacaccaagtgtatcaggtcggcggaaccggtccacttcaaccccgtccccagccgttgaggtgctcgacgacatgaccacacatctgccttccgccagcagtcagatacccgcattggaggagtcatgcgaagctgtagaggcccgcgagatcatgtggttcaagacccggcaggggcaaatcgctaaacaaccctgtccagccggcactatcggagtgtctacctatttatgcctggcacctgatgggatatgggaccctcaaggccccgatctgtctaactgttcctcaccctgggtcaaccacatcacgcaaaagctgaaatccggagaaaccgccgccaatatcgcccgagaacttgctgaacagacacgtaaccatctaaacgcaggcgacattacatactcagtgcgtgccatggaccagttagttggactattggatgttcaattacgcaatctgacccctggtggcaaggattcagccgccaggagcctcaataaattgcagaagcgcgagaggtcctgtcgcgcatacgtccaggcaatggtggaaaccgtgaataacctgcttcaaccacaggccctgaacgcctggcgcgacctcacaacgagtgaccagttgcgagcggccaccatgctgctgcacaccgtcgaggagagcgctttcgtcctggcggataaccttctcaagaccgacattgtgcgggaaaacaccgataacattaaactcgaggtagctcgtctgagtaccgaagggaatctggaggacctgaaattccccgagaatatggggcacggctcaaccattcagctctccgcaaataccctgaaacagaacggacggaacggcgagatcagggtggccttcgtgctttataataatctggggccttatttgtcaacagaaaacgcctccatgaagcttggcactgaggcactcagtactaatcactccgtgattgtgaattctcccgtcattactgccgccattaataaggagtttagtaacaaagtgtacctggctgatcccgtggtgtttaccgtgaagcacatcaaacagagcgaggaaaattttaatccgaactgcagtttttggtcctacagtaaaaggacgatgacaggttattggtccacccagggctgtcgcctcttgaccacaaataaaacccataccacgtgtagttgcaatcacctaaccaatttcgccgtgcttatggcccatgtcgaggttaaacattcagacgccgtgcatgatctgctgctggatgtgattacgtgggtagggatattgctttccctcgtttgccttctaatatgtatcttcacattttgcttcttccgaggtttacaaagtgatcgcaacacgatccacaagaatttgtgcatctccctgtttgtagcagagctactcttcctgataggcattaacagaactgaccaacccatcgcatgcgccgtgtttgccgcacttttacacttcttttttttggctgcttttacatggatgtttctcgaaggtgttcagttgtatatcatgctagtggaggtattcgagtccgagcactcccggcggaaatacttttatcttgtggggtacggcatgcctgcactgatagttgccgtgtcagctgcagttgactaccgctcctacgggacggataaggtttgttggttgcggttagacacatatttcatatggtcctttataggaccggcgacgctgataattatgctgaacgttatatttctcggtatcgcactgtacaaaatgtttcaccacaccgccatcctgaaacccgagtcagggtgtctcgataacataaattacgaggacaaccgccccttcatcaagtcgtgggtcataggagcaattgctctgctgtgcctactcggcctcacctgggcgtttggcctgatgtatatcaacgagtcaacagttattatggcatacctctttacgatattcaactccttgcaaggcatgttcatttttatattccactgcgtgctgcagaagaaggtgagaaaggagtacggaaagtgcctccgaacccactgttgctcgggcaaatctaccgagtcatctatagggtccggaaagacaagcggaagtagaacacctggccgctatagcacgggctctcagtccaggatccgtaggatgtggaatgataccgtacgcaaacaatccgagtccagctttatcactggggacattaattctagtgcctcccttaatcggggtgccatggcaaaccatctaatctccaatgcactcctccggccacatgggactaataacccgtacaacacattactgggggaacctgctgtttgcaacaacccctcggttagcatgtacaacgcacaagaagggcttctgaacaatgcacgggacacatctgtaatggacacattgcctctcaacgggaatcatggcaactcgtattctatcgcgagcggcgaatacctttcaaattgtgtccagattatcgatcggggatataaccataacgagactgccctggagaagaaaattctgaaggagctcacaagcaattatattccctcctacctcaacaatcacgagagatcttccgaacagaacagaaatcttatgaataaacttgtgaacaatttgggttctggcagagaggacgacgccatcgtgctcgatgatgcaacatccttcaatcacgaggagtccctgggactcgagctgatccatgaagaatccgatgccccattattgcctcccagagtctactccactgagaaccaccagccgcaccactacacgagaagaaggattccgcaggaccattctgagagtttctttcctctcctcaccaacgaacacacagaggatctccagtccccccacagggattccctgtatacgtccatgcctacactggccggggtggccgccaccgagtcggtgaccactagcactcagactgaaccgcctcccgccaagtgtggggatgccgaggatgtctattacaaatcaatgcccaacctcggctcaagaaatcacgtccaccagctacacacctattaccagttgggaaggggtagctccgatggctttattgtacctcccaataaggacggtacacctcccgagggctcatctaagggtcccgctcatttagttacctctctgtag

SEQ ID NO: 42974 - DNA, 3927 bp, Artificial Sequence
  Description of Artificial Sequence: Synthetic coding sequence
atgtggcccagccagctgctgatcttcatgatgctgctggcccccattatccatgggggcaaacacagtgagcggcaccccgctctggccgccccacttcggcatgccgaaaggagtcctggcggcgcacttccgccaaggcatttgctgcagcagcctgccgccgagcgcacagctgctcacagaggacagggacctagaggagccacccggggagttcgcggaccaggcgcccagggtgctcagattgcagcccaggctttttctcgcgcaccaatccctatggccgttgtccgcagagagttatcatgtgaatcttatccgatcgaactgcgctgtcctggaaccgatgttattatgattgaatcagcaaattatgggcgcactgacgacaagatatgtgactcagaccctgcgcagatggaaaacatccgctgttatctgcccgatgcctataagatcatgagccaaaggtgtaataataggacacagtgcgccgtcgtcgctggcccggatgtgttccccgatccatgtcctggtacttacaagtatctggaagtgcaatatgaatgtgtgccttacaaggtcgaacagaaggtcttcttatgcccgggcctcctaaagggcgtataccagagtgagcacctcttcgaatccgatcatcagtctggcgcatggtgcaaagatccactgcaagcctcggacaagatctactatatgccatggaccccatatagaaccgatacgctgactgaatactcaagcaaggacgatttcatcgcggggagacctactacaacttataaactgccacatagggtggatgggactgggttcgtagtgtatgatggcgcactgttctttaataaggagagaacaaggaacatagtaaaatttgacctcaggacaagaatcaagtcaggagaagcaatcatcgcgaatgccaactaccatgatacttccccctaccgctggggaggcaaaagtgacatcgacctcgccgtggacgagaacggcctttgggtgatttacgctactgagcagaataacggcaagattgtgatttctcaacttaatccgtatacccttcgcatagaggggacatgggatactgcatacgacaaacgcagtgcctctaatgcattcatgatctgtggaatattgtatgtcgtcaaatccgtgtacgaggacgatgacaatgaggccaccggcaataaaatagactacatctacaacacagaccaaagcaaggatagcctcgtggacgttcccttccctaatagctaccagtacattgcggccgttgattataatccccgggacaatctgctctacgtatggaacaactaccacgttgtcaagtattctctcgacttcggacccctggactctagatcagggcaagcacaccacggtcaggtaagctatatatccccaccaattcatctcgattccgagctcgagcgaccatcggtaaaggacattagcacgaccggcccgctgggtatgggaagcaccactacgtccacaactcttcgaacaaccacactgagcccaggtcggtcgacgactccatcggtgtcagggcgtcgcaacaggagcacatctacgcctagcccggccgtcgaggtcctggacgatatgacgactcacttgccctctgcatcatcccagattccagccctggaagaatcctgtgaggcggttgaggctagagagatcatgtggttcaaaacccgccaagggcagattgcaaaacagccatgtcctgcagggacgattggtgtttctacatatttatgtctggccccggacggcatctgggacccccaaggccccgatctgtcgaattgttcgagtccctgggtcaatcacatcacccagaagctcaaatctggagagacagccgccaacatagctcgtgagctcgcagagcaaacacgcaaccaccttaatgccggagacatcacctattctgtgcgggccatggatcagctcgtcggactactcgacgtccagttaagaaaccttacccccggcggcaaggatagcgccgctcgttctctgaacaagttacagaagcgggagagaagttgccgcgcttatgtgcaggccatggtagagaccgtcaataacctgctgcagccccaggcccttaatgcctggagggatctgacgacctctgatcagctgcgcgctgcaacaatgctcttacacaccgtggaggaatctgcgtttgtactggccgacaacctactgaagacagatatcgttagggagaacacggacaatatcaagctggaggtggcaaggctctcaaccgaggggaacctggaagatcttaaattccccgaaaatatgggccacggctcaacaatacagctgtctgccaacacactaaagcaaaatggtaggaatggcgagattcgagtggctttcgtgctctacaacaacctgggcccctacctgtctacggagaatgccagtatgaagttgggaacggaagcattgtccacaaaccacagcgtgatcgtaaattcccccgtgatcaccgcagccatcaacaaggagttctccaataaggtgtatctcgccgatccagttgtattcactgtcaagcacatcaagcaaagtgaggagaactttaatccaaactgttcattttggagctactccaaacgtactatgactggctactggtccactcagggttgtaggctgctgaccacaaacaagacacataccacttgctcttgtaatcatcttactaattttgcagtgctgatggcacacgtcgaagtgaagcattcagacgctgtgcatgatctgctcctggacgtgattacttgggttggaatcttgctctccttggtgtgcctgctaatatgcattttcacgttttgttttttcagaggactgcaatccgatcgaaacactattcacaagaatctctgcatttcactcttcgtggccgagctgctctttttaatcggaataaatcggacagaccagcctattgcatgcgctgtgttcgccgcgctcctgcattttttttttctcgccgccttcacttggatgttcctggagggagtgcagctttatattatgctggttgaagtgttcgagtctgagcactctaggagaaagtacttttatctcgtcggctatggcatgcccgctctgatcgttgctgtgagtgcggctgtagactaccggagctacggtaccgacaaggtgtgctggctccgactggacacctattttatttggagcttcatcggacctgccaccttgattataatgctgaacgttatctttcttggtattgcgctttacaaaatgtttcaccacacagcaatcctgaaacctgaatccgggtgcctggacaacataaactacgaggataacaggcctttcattaagagttgggtcataggcgctatagctttgctgtgtttactgggtctcacttgggcatttggcttaatgtatattaacgagtcgacagtcatcatggcgtacctgtttacgattttcaatagcctgcaagggatgttcattttcatcttccactgcgtgctgcagaaaaaagtcagaaaggagtacggtaagtgtttaagaacacactgctgcagcgggaagtctaccgagtcatctatcggatcaggtaagacaagcggctcccggactcccgggcgatactctacaggaagccagtctcgaatccggaggatgtggaatgatactgtgcggaagcagagtgaatccagctttatcactggcgatattaactcgagcgcctctctgaatcgagagccctacagggagacttctatgggggttaaactaaatatcgcttatcagatcggagcatctgaacaatgccaagggtacaaatgtcacggatattccactacagagtggtag

SEQ ID NO: 42975 - DNA, 3900 bp, Artificial Sequence
  Description of Artificial Sequence: Synthetic coding sequence
atgtggcccagccagctgctgatcttcatgatgctgctggcccccattatccatgggggaaaacattccgagcgacatccagccctagctgcccctctgagacacgctgagcgttcccccgggggtgcgttgcctcctcgacacctgctccagcagccagctgccgagcgaaccgccgcccaccggggtcagggcccccggggcgctactcgcggcgtgaggggccccggagcccagggagcacagatagcagcgcaagcattttcacgagccccgatccccatggcggttgtcaggagggagttgagttgcgaaagctacccaattgaactgcggtgcccgggaacagatgttattatgatcgaatccgccaactacggccggacagatgacaagatctgtgactccgaccccgcacagatggagaacatccggtgctatctgccagatgcctacaagataatgagtcagagatgcaataaccggacccagtgtgccgtggtcgccgggcccgatgtctttccggacccctgtccaggaacctacaagtatcttgaggtccaatacgagtgtgtgccgtacaaggtggagcagaaggtcttcctgtgccccggcctgttaaaaggcgtgtatcagagcgagcatctgtttgagtccgatcaccaaagtggggcatggtgtaaagacccacttcaagcatccgacaagatctattacatgccatggaccccctatcgcactgacaccctaaccgagtacagttctaaggatgatttcatcgccggaaggcccaccaccacatataaattgccccatagagtagacggcactggatttgtggtgtacgatggggccttatttttcaataaagagcgaacccgtaacatcgtaaagttcgatcttcgaactaggatcaagtctggggaagccatcatcgccaatgcaaattatcacgatacatccccttacaggtggggcggtaaaagcgacatcgacctggcagttgatgagaatggactctgggttatttacgccacggagcaaaataatggaaagattgtgatctcacagctgaacccatacacgctgcgtatcgagggcacatgggacaccgcttacgacaagcggtccgcttctaatgcttttatgatctgcgggatattgtatgtcgtcaaaagtgtctatgaggacgatgacaacgaggcaacaggcaataagatcgactacatttacaacacggatcaatccaaggactcactggtagatgtaccattccccaacagttatcagtacattgcggctgtcgattacaatcccagggacaacctgttgtatgtgtggaataactaccatgtagtgaagtattcactggacttcggtccgctggattcccggtccggccaggcgcatcacgggcaggtatcctatattagtccacccatccacctggactctgagcttgagagacccagcgtgaaggatatctctactaccgggcctctgggtatgggatccaccacaacgtccaccacactgcgtactaccaccttgtctcccggtcggtccactaccccttctgtatctggtaggcgcaaccgttctacgtcaaccccgagcccagccgtcgaagtcctggatgacatgacaacacatttgccatctgcaagctcgcagattcccgcgctcgaggagtcttgcgaggctgtcgaagcgagggaaattatgtggttcaaaacccgtcagggccagatcgctaagcagccatgtcccgccggtaccatcggcgtatcgacatacctctgccttgcacctgatggtatctgggaccctcagggtcctgacctgagcaactgtagttccccatgggttaatcacatcactcagaagctcaaatcaggcgagactgccgccaacatagctagagaactcgccgaacagacccgcaatcatctgaatgctggggatattacctattccgtgcgcgctatggatcagttggtcggactcctggatgtgcagctgcgcaatctgacaccgggaggaaaggattctgcagctaggagtttgaataaactacagaagcgtgagaggagctgccgtgcttatgtgcaggccatggtcgagaccgtaaacaatctgctgcagccccaggcgttaaatgcctggagagatctgacaacctccgatcagttgagagccgcgactatgctgcttcacacagtggaagaatcggccttcgttctggctgataacctcctcaaaacggacattgtcagggagaatacagataacataaagttggaggtggccaggctgtccaccgaggggaacctcgaagacctcaagtttcctgaaaatatgggccacgggtccaccatccagttgagtgcaaatacgctcaagcagaatggtcgtaatggggagatacgggtagcttttgttctgtacaataacttgggcccctacttatctacagagaacgcctccatgaagctggggacagaggccctgagtacgaaccactccgtgatcgttaacagtccagtgattacagcggccattaataaggaatttagcaacaaagtgtatcttgccgatcccgtcgtgtttacagtcaagcatatcaagcagagtgaagaaaactttaatccaaactgttcattctggtcatactccaagcggacaatgacaggatattggagcactcagggttgtaggctgctcactactaacaagactcatactacatgttcgtgtaaccacctgactaatttcgctgtgttgatggctcatgttgaagtgaagcattctgatgccgtgcatgaccttctgctggatgtgattacttgggtggggatactgctatccctggtttgtctgctgatttgtatattcacattctgtttttttaggggtctgcaatcagaccggaatacaatacacaagaatttgtgcattagcctgttcgtggctgaactcctatttctgataggcattaacagaactgatcaaccaattgcctgcgccgtattcgctgccttgttgcacttttttttcctcgctgcttttacctggatgttcctcgagggggtgcagctgtacatcatgctcgtggaggtcttcgagtccgagcatagccggagaaaatatttttacctggtgggttacggtatgccggctcttatcgtcgctgtctcggcagcggtcgattacaggtcctatggaactgacaaggtgtgttggctcagactcgatacttattttatctggtccttcattggacctgccacactcatcatcatgctgaacgtcatctttctcggcatagccttgtataaaatgtttcatcatactgccattctgaagcctgagtcaggatgtctggataatataaagtcttgggtaattggagctattgcgctcctttgtctgctgggcttgacatgggccttcgggctcatgtatatcaacgagtccaccgtcattatggcttacctctttaccatttttaactcgctgcaaggaatgttcatctttatctttcactgtgtgttgcagaagaaggtacggaaagagtacggaaagtgccttagaacccactgttgtagcggtaaatcaaccgaatcttcgatcggctcagggaagacctctggcagtagaactcctggaagatatagcactgggtctcagtccaggataagaagaatgtggaatgataccgtccgaaaacagtcggaatcgagctttattactggggacatcaattcaagtgcctcactgaatcgggaaccataccgagagaccagtatgggggttaagctaaacatcgcctatcagataggcgctagcgaacaatgccagggctacaagtgccacgggtattctacaaccgaatggtag

SEQ ID NO: 42976 - DNA, 3723 bp, Artificial Sequence
  Description of Artificial Sequence: Synthetic coding sequence
atgtggcccagccagctgctgatcttcatgatgctgctggcccccatcattcacgccttttcacgggctccaattccaatggctgtggtgcgccgcgagctctcctgtgagagttatcctatcgagctgcgctgcccggggaccgacgtgataatgattgagagtgccaattacggtaggactgatgataagatctgtgattcggacccagctcagatggagaacatccggtgttatctgcctgacgcttataagatcatgagccagcggtgtaacaaccggactcaatgcgctgttgtggcaggcccggatgtcttccctgacccctgccctggaacttacaagtatttggaggtgcaatacgagtgtgtcccttacaaggtcgaacagaaggtctttctgtgccctggtctgttaaagggtgtgtatcagtcagaacacctttttgaatctgaccaccagagtggcgcgtggtgcaaggaccctcttcaggcgtcagataagatttactacatgccatggaccccttaccgtaccgacacactgactgagtactctagtaaagatgacttcattgcgggaagacctacaacaacttataagcttcctcaccgggtggacggtactgggttcgtggtgtacgacggtgcgctgtttttcaacaaggagagaacccgaaacatagttaaatttgatctaagaacaagaataaaaagtggagaggctattattgccaacgcaaattatcacgatacatcgccttatcgttggggcgggaaaagcgatattgatttggccgtcgacgagaacggcctctgggtgatctatgccacggagcagaataacgggaaaatcgtgatctcacagctgaacccatatacactccgcatagaggggacatgggacacagcgtatgacaaaaggagcgcgtctaacgcctttatgatttgtggaatactgtatgtcgtcaagtctgtgtacgaagacgacgacaatgaggccaccggcaataagatcgattatatttacaacactgatcaatctaaggacagtctggtggatgtgccattccctaactcctaccaatatattgccgccgtagattacaatccccgggataacctgctatacgtctggaacaattaccacgtggtcaaatatagcctggattttggcccactggattctcgctcaggccaggcccatcatggccaggtgtcatatatctcaccaccgatccatcttgacagtgagttggagagaccatctgtcaaggacatctccactacaggacccctgggtatgggtagtaccaccactagcactaccttacgcacaacaactcttagcccagggcgctccacaactccttccgtgagcgggaggagaaaccgcagcacctctacgccatctcctgccgtggaggtgctggacgacatgacgacccacctcccaagcgcctcaagccaaattcctgctctcgaggaaagttgtgaagccgtggaggctcgggagatcatgtggtttaagacaagacagggacagatcgctaaacaaccgtgccccgcagggactatcggtgtgtccacctacctatgcttggcccccgatggcatatgggaccctcagggacctgacctctcgaactgtagtagcccatgggtcaatcacatcacccaaaagttgaaatcaggcgagaccgccgctaatatagcccgcgaacttgctgagcagacgagaaaccacctcaacgctggcgatattacatactctgttagagctatggatcaattagtggggttgctggacgtacagctgaggaacttgacgcccggtggcaaggattcggccgctaggagcctcaacaagctgcaaaagcgggagcggtcctgccgagcatacgtccaggctatggtcgagacggtgaacaatcttctgcagcctcaagcactcaatgcctggcgcgatctcaccacaagcgatcaactgagagccgctactatgctgttgcatacggttgaagagagcgcatttgtgctggcagataaccttctgaaaaccgacatcgtccgggagaacaccgacaatatcaagctcgaggtcgcccgattaagtaccgagggtaaccttgaagaccttaagtttcctgagaacatgggtcatggttctacgattcagctgtcagccaacacactgaagcagaacggaaggaacggcgagatcagggttgctttcgtcttgtacaacaacctggggccgtacctcagtacagagaatgcttccatgaaactgggcactgaagccctgtccaccaaccactcagttatcgtcaactcaccagttatcacagccgccattaataaggagtttagtaacaaagtctacctggcagaccccgtcgtctttacggtgaaacatatcaaacagtcagaagagaactttaatcccaactgctcattttggtcctacagtaaacggactatgacaggctactggagcactcaaggctgccggctgcttaccacaaacaaaacgcataccacatgctcttgtaatcacttaactaacttcgcagtcctgatggcccacgtggaagtgaagcattccgatgccgtgcatgatttactgctggatgtgattacatgggtgggaattcttttgtcattggtgtgcttgctcatttgtatctttacgttttgcttcttccgggggctccagtcggaccgcaatactatccacaaaaatctgtgcatctcattgtttgttgctgagctgttgttcctgatcggcattaacaggacagatcagcccattgcctgtgcagtgttcgccgccctcttgcattttttctttttggccgcgtttacctggatgttcctggaaggggtccagctgtacatcatgctcgtcgaggtttttgaaagtgagcatagccgcaggaagtatttctatttagtgggctacggcatgccagctcttattgttgctgtaagtgcagccgtcgattatcgttcatatggaacagacaaggtgtgttggctgcgtctggatacctacttcatctggtccttcataggacctgctactcttatcataatgctgaacgtgatcttcctcgggatcgcactgtataagatgttccaccacaccgccattctcaaacccgaaagtggatgcttagataatattaattacgaagataatagacctttcataaaaagctgggttattggcgctattgccctcctctgtctattaggtctgacctgggcgttcggcttgatgtatatcaacgagtctactgtgattatggcttacctattcacaatctttaactctttgcaaggaatgtttatatttatcttccactgcgtgctacagaaaaaagtgaggaaagagtacggcaaatgcttaagaacccattgttgcagtgggaagagtactgagtctagcataggatccggcaaaacgagcggcagccgaactcccggtcggtattcgacaggctctcagagcaggatccggaggatgtggaatgatactgtacgaaaacaatcagagagcagcttcatcactggagatatcaattcaagcgcaagcctaaaccgagaaccatatcgggagacaagcatgggcgtgaaattaaacatagcttaccagatcggcgcatctgaacagtgccagggctataaatgtcacgggtacagcaccactgaatggtag

SEQ ID NO: 42977 - DNA, 3825 bp, Artificial Sequence
  Description of Artificial Sequence: Synthetic coding sequence
atgtggcccagccagctgctgatcttcatgatgctgctggcccccatcatccatgcgttctccagggcccctatccccatggccgttgttaggcgtgagctttcatgtgaatcgtatccaattgaacttcgatgtcctggaacagatgtcatcatgatcgaaagcgccaactacggaaggacagatgacaagatttgcgactctgaccccgcgcaaatggaaaatattcgctgctacctccctgacgcctataagatcatgtcccagcggtgcaataatcggacccaatgtgccgtcgtcgcgggacccgacgtttttcccgatccatgccccgggacatataaatacctagaggtgcagtatgagtgtgttccatataaggtagagcagaaagttttcctttgtccgggcctcttgaaaggcgtttatcagtcagaacacctgtttgagtccgatcaccagtccggggcttggtgtaaggaccctttacaggcatcagataaaatttattacatgccttggactccctatcggacagacacacttactgagtattcctccaaggatgacttcattgcaggccgccctacgacaacctacaaattaccccatcgagtcgatggaacaggcttcgtcgtttatgacggggccctgtttttcaacaaggagaggacccgcaatatcgtgaagttcgatcttagaaccaggattaaatcaggagaggcaatcatcgcaaacgcaaactaccacgacacgagcccttaccgatggggcggcaagtcagacatcgacctcgccgtggacgaaaacggtctgtgggtgatctatgctactgagcaaaacaacggcaaaattgtgatctcccagctgaatccctacacactgcgcattgaaggcacatgggacacagcctacgataaaagaagtgcgtccaatgccttcatgatctgtggcattctatatgtggtaaaatctgtgtacgaggatgatgataatgaagcgactggcaacaagatcgactacatttataatacagatcaatctaaagatagtctggtggacgtgccattccctaactcttaccagtacatcgctgcagttgactacaaccctcgagacaatctgttgtatgtctggaataactatcatgtcgtcaagtacagcctcgatttcggcccccttgattcacgtagtggacaggcccatcatggccaggtgagctatatcagcccccctatccatctcgattctgagctggagagaccctcagtaaaagatataagtacaacaggtccacttgggatgggctcgactacaacaagcacaactcttcgcaccacaacactcagtcccggcagaagtacaacaccctctgtgtccggcaggcggaataggtctacatctacacccagcccagctgttgaggtgctggatgatatgaccacccacctcccctccgcatcatcccaaattcccgccctggaagagtcatgcgaggcagtggaggccagagagattatgtggttcaaaactaggcaggggcagatcgccaaacagccctgtccagccggaacaattggggtgtccacatacttgtgtttggcacccgacgggatatgggaccctcagggccccgatctgtcaaactgttcgagtccatgggtgaatcacatcacgcaaaagttaaaatctggggaaactgcagctaacatcgcaagagagctggctgagcagacaagaaaccatctcaacgccggcgacatcacttatagtgtccgggctatggatcagttagtgggcctgctggatgtccagctccggaacctcactccggggggcaaagacagcgctgcgaggtcactcaacaagttgcagaaacgtgaacgatcttgccgcgcatacgtgcaagctatggtcgaaactgtcaacaacttgctccagcctcaagccttgaatgcatggagggaccttaccacttcagaccaattgcgcgccgctaccatgctgctccataccgtggaggagagcgcctttgtgctcgctgataacctgctgaagactgacattgtgcgggaaaatacagataacattaaactggaggttgccagactatcgacagaaggaaatctcgaggacctgaaatttcctgagaatatggggcacggctccaccattcagctttccgccaacactcttaagcagaatggaaggaacggtgagataagggttgcgttcgtgttgtacaacaatctgggcccatatctttcgacggagaacgcttcaatgaaactcgggacagaggccctgagtactaatcactccgtgattgtcaacagtcccgtgatcactgctgcaatcaataaggaattttccaataaagtgtacttggcggatcccgtggtgtttactgtaaagcacattaagcaaagtgaagaaaacttcaatccaaattgttctttctggtcctacagtaagcgcacgatgaccggatactggagtacgcagggctgtaggctgctcaccacaaataaaactcatacgacatgtagctgtaaccacctgacgaactttgcagtattaatggctcacgtagaagtaaagcatagcgacgcggtgcacgacctcctgttagatgtcatcacatgggtcgggatcctcctctctctggtatgtctcttgatctgtatatttactttctgtttttttcgcggcctgcagtccgatcggaatacgattcataagaatttatgtataagtctctttgtggccgaactgctgttcttaatcggtataaataggaccgatcagccaatcgcctgcgccgtgtttgccgctctcttgcatttttttttcctggccgctttcacttggatgttcctggaaggagtccaactttacatcatgctggtcgaagtgtttgagagcgaacatagcagaagaaagtacttctatctggtagggtatggcatgccagccctaattgtggccgtgtctgccgcagtagactatcgttcctacgggactgacaaagtgtgttggcttaggctagacacctactttatttggtctttcataggacccgcaacactcatcataatgctcaatgtcatctttttagggatagcgctatataagatgtttcatcacaccgcaatccttaagcccgagtcagggtgtcttgataatatcaaaagttgggttataggagccatcgcgttgctctgcttattaggcctgacatgggccttcggcctgatgtacatcaacgaatccactgtgatcatggcctacctgtttacaatctttaatagtctccaggggatgtttatcttcatattccactgtgtcctccaaaaaaaggtgcgcaaggagtacggcaagtgtctacggactcattgctgttccggtaagagcacggaatcatccataggaagcgggaagacaagtgggagtaggactcctggcaggtattctaccgggagccagtccaggatccgccgcatgtggaacgatactgtgagaaaacagtccgaaagttcgttcattactggggacataaacagcagcgccagcctgaatcgaggagctatggctaaccatctgattagcaacgccctgctgaggcctcacggcacaaataatccctacaacacactgctgggcgaaccagccgtgtgcaacaacccttctgtgagtatgtataacgcacaagagccatatcgcgagactagtatgggtgtcaaactgaatattgcttaccaaattggggcatcagaacaatgccaagggtacaagtgccatggatactcaactaccgaatggtag

SEQ ID NO: 42978 - DNA, 4410 bp, Artificial Sequence
  Description of Artificial Sequence: Synthetic coding sequence
atgtggcccagccagctgctgatcttcatgatgctgctggcccccattatccatgcctttagtcgcgcccccatccctatggctgtagtgagacgtgagttaagttgcgaaagctacccaatcgaactgcgttgccctggcaccgacgtcattatgatcgaaagtgccaactatgggcgaacggatgacaaaatctgtgacagcgaccctgctcaaatggaaaatatacgctgttacctgccagatgcgtacaagatcatgagtcaacgctgtaacaacagaacccagtgtgccgtggttgcagggcctgatgttttccctgacccatgtccggggacctataaatacctcgaagttcaatatgagtgtgtgccctacaaggttgaacagaaggtgtttctttgtccaggtttgctgaagggcgtgtatcagagcgagcacctgtttgaaagcgatcaccaaagtggggcctggtgtaaggaccctctgcaggctagtgacaaaatttactacatgccatggacaccatacaggaccgatacactcacagagtacagctctaaagacgactttatcgcgggtcgtcctacaacaacctataagctaccacatagggtcgatggtacaggattcgtggtttatgatggcgccctcttctttaacaaggagcggactaggaatatagtgaaatttgatctgcggacacggatcaagtctggcgaggccattattgccaatgccaactaccacgatactagcccttaccggtggggtggaaagagcgacattgacctcgccgttgatgagaacgggttatgggtgatctatgccactgaacaaaataatggcaaaatagtgatctcccagttaaacccttataccctaagaattgaaggaacatgggacaccgcctacgacaaacgctcagcttcaaatgccttcatgatctgtggtatactgtatgtggttaagtcagtctatgaagacgatgataacgaggcaacaggcaacaagatcgattatatttataataccgaccagtccaaggattctctggtggacgtccccttccctaattcttaccagtatatcgccgcggtggactacaacccaagagataacctgctgtacgtatggaacaactatcacgtggttaagtacagcctcgactttggcccgctcgattcacgttctggacaagcacaccacggacaggtatcttacatttcaccacctatacacctcgactcagaactggaacggccctccgtgaaggacatctcaacaactgggccccttggcatgggatcaacaaccacttctacaaccctgcggacaactacactaagccccggccgcagcacaactccctccgtctccggcaggaggaatagatcaacatctacccctagccccgctgtggaggtcctggacgacatgacaacacatctcccgagcgcgtcttcacagataccagctcttgaagagtcttgcgaagcggtggaggcacgagagatcatgtggtttaagactcgccagggtcagatcgccaagcaaccttgtcccgctggcaccattggtgtctccacatacttatgtctggcccccgacggtatttgggacccccagggtccagacctcagcaactgtagttctccttgggtcaaccatattacgcagaaactcaagtcaggggaaaccgccgctaatatcgcccgagagctggcggaacagaccagaaaccatcttaatgccggcgacatcacatattccgtgagggctatggaccagctcgtagggcttcttgacgttcaactgagaaatttgactccaggtggaaaagattctgccgcccgtagcctgaacaaactgcagaaaagggagcgctcgtgccgggcatacgtacaggctatggtggagacagtgaataacttgctgcagccacaggctctcaatgcctggcgagatctcaccaccagtgaccagcttagagccgccaccatgttgctccatacggtggaggaatctgccttcgtattagcagataacttacttaaaacagacattgttcgcgaaaacaccgataatatcaagctggaggtggctcggctctctaccgaaggaaatttggaggacttaaagtttcccgaaaacatgggtcacggcagtaccattcaactctctgccaataccttaaagcagaatgggagaaatggagagatccgtgtggcatttgtcctttataacaacctgggcccttacctgagcacagagaatgccagtatgaagttagggaccgaggccctgtcaactaatcattccgtgatcgtgaacagtcccgtaatcacagcagccatcaacaaagagttttccaataaagtgtacctggccgatcccgtagtgtttaccgttaagcatataaagcagagcgaggaaaacttcaacccaaactgcagcttctggtcttattctaagcgcacgatgactggctattggtctacccaaggttgccggctgttaactactaataaaacccacaccacatgctcatgtaaccacctgacaaattttgccgtgcttatggcccatgtggaggttaaacactcagatgccgtacatgacctgttactcgatgtaatcacctgggtaggaattctcctgtcactggtctgcctgctgatttgcatctttactttttgtttctttcgcggcctccagagcgaccggaatacaatccataagaacctttgcataagcctgttcgtcgccgagctgctgttcctgattgggattaatcgcacagatcagccgattgcctgcgccgtcttcgcagcgctgctacactttttcttcctagccgcattcacttggatgtttttggagggcgtgcagctgtacatcatgctggtcgaagtctttgagagtgaacacagccgtaggaaatacttctatctagtgggatacggtatgcctgcactgattgtggctgttagtgctgccgtggactatcggtcttatggaaccgacaaagtgtgttggttgagactggacacctatttcatttggtccttcataggacctgctacattaatcataatgcttaatgtaatatttttggggatcgcgttatacaagatgtttcatcacaccgctatattaaaacccgaaagtggctgcctggacaatataaactatgaagacaacaggccttttataaagtcatgggtgattggtgccattgctttactctgtcttctgggcctgacctgggcttttggattgatgtatatcaacgagtccacggtgattatggcttatctcttcactatttttaactcgctccaagggatgtttatcttcatctttcactgcgttctgcagaagaaagtgcggaaggaatatgggaagtgtttgagaactcattgctgttcaggcaaaagtactgagtcctctataggctcagggaaaaccagcgggtctaggacccctggtaggtattcgactggatcgcagagccgaattcgacgaatgtggaatgacacagtacggaagcaatccgagagcagcttcattacaggcgatatcaatagctctgcaagtctgaaccgcgagggactcttgaataatgctagggatacctctgtcatggacactctaccgctgaacgggaatcatggaaacagctactcaatcgcctcaggcgagtatctctctaattgtgttcagatcattgacagaggttacaaccacaatgagacagccctcgagaaaaagatcctgaaagagttgacttccaattacatacccagctacctcaataaccacgaacggtcttccgaacagaacagaaacctgatgaataagctcgtgaataatctcgggtctggccgggaagacgatgcgattgtgctggacgatgccacgagcttcaaccatgaggagtcattgggactagagctaatacacgaagaatcagatgcacccctattgcccccccgggtttactctactgagaaccaccagccgcaccattatactagacggagaatccctcaggatcacagcgagtctttcttccccctgctgacaaatgagcatactgaagaccttcaatcaccacatagagactccctgtatacctccatgcccaccctggctggggtagctgccactgaatcagtgaccacgagcacacaaaccgagccccctcccgctaaatgtggagacgccgaagacgtgtactataagtctatgcccaacctgggaagccgcaatcacgtgcaccaactccacacttactatcaattgggaagagggtctagcgacggcttcattgtgcccccgaacaaggacgggaccccaccagaggggtccagcaagggtcctgctcaccttgtcactagtctgtag

SEQ ID NO: 42979 - DNA, 4512 bp, Artificial Sequence
  Description of Artificial Sequence: Synthetic coding sequence
atgtggcccagccagctgctgatcttcatgatgctgctggcccccatcatccacgctttctcccgcgcacccatccctatggccgtggtgagaagagagctgtcttgtgagagttacccaatcgaactgcgatgtcctggaaccgatgtcatcatgatcgagtcagccaactacggacgcaccgacgacaagatctgtgattccgatcccgctcagatggagaacatccggtgctacctgcctgacgcttataaaattatgagccagaggtgcaataataggacacaatgcgccgtcgtggctggccccgacgtgttcccggacccctgtcctggcacctataagtatcttgaggtgcaatatgaatgcgtgccatacaaggtcgaacagaaggtgtttctgtgccctggcctgctcaaaggtgtctatcagtctgaacacctgtttgaaagcgatcaccagtccggggcttggtgtaaggatcccctgcaggcgtcggataaaatttattatatgccatggactccataccggacggacacactgactgagtatagcagcaaagacgacttcatagctggccgccctacaaccacatacaagctgcctcatagggtggatgggacagggttcgtggtgtatgatggggctttattttttaataaggagcggacacgcaatatcgtgaaatttgacctcaggactagaattaagtccggggaagctattatcgcaaatgctaattatcatgatacctccccctacaggtggggcggaaagtcagacatcgatctcgctgtggatgaaaatggcctctgggtcatttatgctacagaacagaacaacgggaaaatcgtgatttctcagctcaatccctacactctgcgaatagagggcacatgggacaccgcatatgacaagaggtccgcttccaacgctttcatgatctgcggaatcctctacgtggttaagtccgtctacgaggatgacgataacgaagctaccggaaataagatagactacatttacaacaccgaccagtccaaagatagtctcgtcgacgtcccttttccgaattcttaccaatatatagcagccgtggactacaatccaagggacaatcttctttacgtgtggaacaattaccacgtagtgaagtactctctggattttggacccttggattcacggtctggacaggcacaccacgggcaggtcagttatatctctccaccgatccatttggactcagagctggaacggccgagcgttaaggatatctctacaacaggccctttaggaatggggtctacaactacgtcaactaccctccggacgactaccttgagccccggacgctcaaccacacctagcgtgtccgggcggcgcaacagatctacctcgacacccagccccgcagtcgaggtcctcgatgatatgacaacgcacctgccctctgcgagctctcaaattcctgccctggaggagtcctgtgaggctgtggaagctagagaaatcatgtggttcaagacacgtcagggacagattgccaagcagccctgcccagcgggtacgatcggcgtgtctacctacctgtgtctcgcccctgatggcatctgggatccgcagggccccgacctctccaattgttcctccccctgggtgaaccatattactcagaaactgaagagtggggagacggccgcaaacattgcccgcgagctggcggaacagacccgtaatcatctaaatgcaggagacatcacctacagtgtgagagccatggatcaacttgtcggtctcttggacgtccagctacgcaatctaacccccgggggtaaggactcggccgcacggagccttaacaaactacaaaaacgggagcggtcgtgtagagcatacgtccaagccatggtggagacagtgaacaacctactccagcctcaggctttaaatgcttggagggacttgacaactagcgatcaattaagagctgcgacaatgctcctgcacacagtggaagagtctgctttcgttctggcggataacttactgaagacagacattgtgcgcgaaaacacggacaatatcaagctggaggtggccaggctgtctactgagggtaatcttgaagatctgaagtttcccgagaacatgggtcatggatccaccatacagttaagcgccaacacactgaaacaaaacgggagaaatggcgagatccgggtggcctttgtattgtacaacaacttgggcccctatctgtcaacagagaacgcatctatgaagttggggactgaagccctgagtacaaatcatagtgtcatagtcaattctcccgtgatcacagctgcaattaacaaagaattcagtaacaaagtgtacctggcagatcccgttgtttttacggtcaagcacatcaagcagagcgaagaaaactttaacccaaattgttcattttggtcgtactctaaacgcactatgactgggtactggagcacacaaggctgccgtctcctcactacaaacaaaacacacaccacttgctcgtgtaatcaccttacgaactttgctgtgcttatggcccacgtggaggtgaaacattcagatgcagtccacgatctgcttctcgacgtgattacctgggtgggaatcctgttgtctttagtttgcctgctaatttgcatatttaccttttgtttctttagaggcctgcagtctgacagaaataccattcataagaacctgtgcatttcattgttcgtggccgaactgctgtttctgatcggaatcaatcggaccgaccaaccaatcgcctgtgctgtgttcgcagccttgctgcactttttcttcctggccgcctttacctggatgttccttgagggggtccagctgtatatcatgctggtggaagtgtttgagagcgaacacagcagacgcaagtacttttacctcgttgggtacggaatgccggcactgattgtggctgtgtcagccgctgttgattataggtcatatggcacggacaaggtgtgctggctgcggttggacacctacttcatatggagctttattggccctgccacactgattataatgctcaatgtgatatttttgggcatagctctgtacaagatgtttcaccatactgccattctgaagccagaaagcggctgtctggataacatcaagtcctgggtgatcggcgccattgctttactttgccttctgggtctgacttgggcttttggcctaatgtacattaacgagtccaccgttatcatggcgtacctcttcacaatcttcaatagtctgcagggtatgttcattttcatattccactgcgtgttacagaagaaagttcgaaaggagtatgggaagtgcttgaggacgcactgctgcagcgggaagtctactgagtcaagcataggtagtggtaagaccagtgggagtcgcacacctggcaggtattctaccgggagccagagcagaatcagacggatgtggaacgacaccgtgagaaagcagagcgagtcctcttttattactggggatattaattctagtgccagtctgaaccggggcgccatggccaaccatctcatcagcaatgcacttctgcgcccacatggcactaacaatccttacaacactctgttgggagagcccgccgtgtgcaacaatccctcagtttccatgtacaacgctcaggagggattgctaaacaacgctagggacacatcagtgatggacacactgcctctgaacgggaaccatgggaattcctactccattgcaagtggagagtatttgtccaattgcgtgcagattattgatcggggatacaaccataacgagactgccctcgaaaagaagattctcaaagagttgacttccaactacatcccatcctacctgaacaaccacgaaagatcttccgagcagaatagaaatctgatgaacaagctggtcaacaatcttgggagcggacgcgaggatgatgcgatcgttctcgacgatgcaactagctttaatcatgaggaatctctcggcctcgagcttattcatgaggagtccgatgcaccattgctcccaccaagggtgtattccacagaaaaccaccagccccatcactacacccggcgtcgcatacctcaggatcacagtgagagcttttttcctcttttgacaaatgaacacactgaagatctacagagtcctcatcgcgattctctgtacacttctatgcctaccctcgccggcgtggctgcaaccgaatcagtgaccacaagcacacagaccgaacctcctccagctaaatgcggtgacgctgaggacgtgtattacaagagcatgccaaatctaggcagtcgaaaccatgttcaccagctgcacacatattatcaactgggacgtggatcctccgatggatttatcgtgccccctaataaagacggcaccccccccgagggatcttctaaaggccctgcccacctggtgacatccctgtag

SEQ ID NO: 42980 - DNA, 2124 bp, Artificial Sequence
  Description of Artificial Sequence: Synthetic coding sequence
atgtggcccagccagctgctgatcttcatgatgctgctggcccccatcatccatgccttctcacgggcccccattccgatggcagttgtcaggagggagcttagctgtgagtcctaccccatagaattgcgttgccccgggaccgatgtaataatgatcgaatctgcaaactatggccggaccgatgataaaatttgcgattctgaccctgcccagatggagaatataaggtgttaccttcctgatgcttacaaaatcatgtcccagaggtgtaataatcgtacccagtgcgccgtggtagccgggccagacgtgtttccagatccttgtcccggcacatacaaatatctcgaggtccagtatgagtgtgttccttatagagtagaccaaaaggtgttcctttgccctggcctcttgaaaggtgtataccagtccgaacatttattcgagtccgatcatcaatccggcgcttggtgtaaggaccccctgcaagccagcgacaaaatttactacatgccatggacgccataccggacggatacactcaccgaatatagctccaaggatgactttatcgccgggcggcctacaaccacctacaagctgccccaccgggtcgatggtaccggattcgtggtctatgatggcgccctgttcttcaataaggaacgcactcgtaatatcgtcaagtttgatctacgcacccggatcaaatcaggtgaggcaattattgctaacgcaaactaccatgatactagcccataccgatggggcggaaagtctgatattgatctggctgtggacgaaaacgggctatgggtgatctacgctactgagcagaataacgggaagatagttatcagccagcttaatccctatacactgcgcatcgaagggacctgggatacggcttatgacaaaaggtccgcttctaatgcttttatgatttgcggaatcttgtacgtcgtgaagagtgtttacgaagatgacgacaacgaagctaccggcaacaaaatagattacatttacaatactgatcagtcaaaagattcactggtagacgtgcctttcccaaactcttatcagtatatcgctgctgtcgattataatccccgcgacaacctcctgtacgtgtggaataactaccacgtggtaaagtatagcctggattttgggccgttagactccagaagcgggcaggctcatcatgggcaggtgagttacatcagtcccccaattcaccttgatagcgaactggagcgtcctagcgtgaaggacatctcaactactggcccgctcggtatggggagcaccaccacttcaaccacgctgagaactacaactctgagtccagggcgcagcacgactccctcggtctccggccggcgaaaccgtagcacctccactccaagcccagcggttgaagtgctggacgatatgacaacccatctcccttccgcgagctcgcagatccctgctttagaagaatcttgtgaggctgtcgaggctcgggagattatgtggttcaaaacaagacaagggcaaattgctaagcagccttgccccgctggcaccataggggtcagcacttatctgtgtctcgcaccggacggaatatgggacccacagggaccagatctgagcaattgctcttctccatgggtgaaccacataactcagaaactaaaatccggagagacagcagcgaatatcgcccgtgaactcgctgaacaaactcgaaaccatctgaatgctggcgacataacctatagtgtgagggcgatggaccagttggttgggctgttggatgtacaactccgcaacttaacccctggaggtaaagatagcgcagctaggagtttaaacaaagcaatggtggaaacagtgaataatcttctgcagccccaggccttgaacgcctggcgtgacctgaccacgagcgaccagttgcgcgccgcgaccatgctcctgcatactgtagaagagtctgccttcgtactggttttgcaagtgtgtttacccgtccgagaacagtctttcctcccttttttcagcttttttattttcttctttagctttctgccattcatcccactcaaatttcggctcgctaagaataagtag

SEQ ID NO: 42981 - DNA, 4410 bp, Artificial Sequence
  Description of Artificial Sequence: Synthetic coding sequence
atgtggcccagccagctgctgatcttcatgatgctgctggcccccatcatccatgcgttcagtcgggcccctattccaatggcagtggtgaggagagaactctcatgtgagagttacccgattgagttgagatgccctgggactgatgtgatcatgatcgaaagcgctaactatgggaggacagacgacaaaatctgtgattcggaccccgcccagatggaaaatattcgctgttatcttcccgacgcctacaagattatgtcacagagatgcaacaaccgcacacaatgcgcagtcgtggctggccccgatgtcttccccgatccttgtcctggaacctataagtacttagaggtgcagtatgaatgtgtcccttacaaagtcgaacaaaaagttttcctttgcccagggctcctgaaaggggtgtatcaatcagagcacttgttcgaatccgatcatcagagcggcgcctggtgcaaagatcccttacaggcttccgataaaatctattacatgccatggactccataccgaaccgacacactgactgaatactcttccaaagatgattttatcgctggtcgccctactacaacttacaagctgccacatagagtcgacggtaccgggtttgtggtatacgatggcgcgttgttcttcaataaagagcgcacgaggaatatcgtgaaatttgatttaagaacccggattaagtcaggcgaggcaattatcgccaatgccaattaccacgatactagtccttacagatggggtgggaagagcgatatcgatctcgccgtggatgagaatggactatgggtcatttatgctacagaacaaaacaacggtaagattgttatctcacaattaaatccttacactctgcggattgagggtacttgggacaccgcttatgataaacgcagcgcatccaacgcttttatgatctgcgggatcctgtatgtggttaaaagcgtgtatgaggatgatgacaacgaggcaacagggaacaagattgactacatttacaatacagaccagagtaaagactccctcgtcgacgtgccattccccaacagctatcagtacattgcagcagtcgattacaacccccgggataatttgttgtacgtgtggaataactaccacgtggttaaatatagcttggatttcggccccctggactctcgatccggtcaagcacatcatggccaggtgagctacatctcacctcctatccacctggattctgagctggaacgaccttctgtgaaggatatttcaactactgggccacttgggatggggagtacaacgacgtcgaccacactgaggactactaccctgagtccaggtagaagcactacaccgtccgtgagtggtcgcagaaaccgctccaccagtactcctagccctgctgtggaggttttggacgatatgactacgcatctgccaagcgctagttcccagatacctgccttagaagaaagctgtgaggccgttgaggcgcgagagataatgtggttcaagacacggcagggacagatcgctaagcagccctgtccggctggcacaattggcgtgtccacttatttgtgccttgcgcctgatggaatctgggatccacagggacctgatctgtccaattgtagtagtccttgggtaaatcacatcacccagaaattgaagagtggcgagactgccgccaatatcgcgcgggagttagctgaacagactcggaaccacttgaatgcaggcgacatcacttatagtgtgagagcaatggaccagctggtcggccttttagacgtgcagctccgcaaccttacaccaggtggcaaggatagcgctgcccgaagccttaacaaactccaaaagagggaacggagctgtcgcgcatacgttcaagcaatggttgagactgtgaacaacttactgcaaccccaagcactgaatgcatggagggatctgacaacatccgaccagctgcgcgccgctactatgcttttgcatacggtcgaggagtccgcattcgttttggcggacaatcttctcaagactgatattgtgagagaaaacaccgacaatataaaattggaggtcgcgcgtctcagcaccgaaggcaatctcgaggacctgaagtttcccgagaatatgggacatgggtctactatccaactctccgcgaacacactcaagcagaacggcaggaatggtgaaatccgcgttgcattcgtactgtataataacctcggcccctacttaagcacggagaacgcctctatgaaactcggcactgaggccctgagtactaaccacagtgtcattgtgaattcacctgtgatcacagcggccatcaataaggaattttccaacaaagtgtaccttgccgatcccgtagttttcacagtaaagcatattaagcagtctgaggaaaactttaacccaaactgctccttttggagctacagcaagcggacaatgacaggctattggagtacccagggttgccgtctccttacgaccaacaagacccacacaacctgttcatgtaatcacctgactaattttgcagtgttaatggcgcacgtcgaggtgaagcatagcgatgccgtgcacgacttgctgctcgatgtgatcacttgggttggcattcttctgtcactcgtgtgtctgcttatttgcatcttcaccttctgcttttttagggggctgcagagcgaccggaatacaattcataagaacctctgcatctcactattcgttgctgagctgctcttcctcatcggaataaatcgcaccgaccaacccatagcttgtgctgtttttgccgcactcctgcacttcttttttctggcagccttcacgtggatgttcctggagggggtgcaactgtacattatgctcgtcgaagttttcgagagcgagcactccaggaggaaatacttctatctggttggctatgggatgcccgcactcatcgtggccgtttcagctgccgtggattacagaagctacggaaccgacaaagtatgctggctgcgcctggacacttattttatttggagcttcataggccctgctacacttattatcatgctaaacgtgatctttctggggattgccttgtataagatgttccaccacaccgcaatcctgaagcctgaaagcggctgcctggataacataaattatgaggataaccgcccatttatcaagtcttgggtcatcggcgctatcgccttattgtgtctcttgggtttgacctgggctttcgggctcatgtacatcaatgaatcaacagtgattatggcttacttgtttactatttttaacagtctgcaggggatgttcatttttatttttcactgtgttcttcaaaaaaaggtgcgcaaagagtacgggaagtgtctcaggacccattgttgttctggcaaatctaccgaatcctcaatcggttctgggaaaaccagtgggagccgcacgcccgggcgctacagcaccggatcccaatcccgcatacggcgcatgtggaatgataccgtgcgtaagcagtccgaatctagtttcataaccggagacatcaacagcagcgcaagcttgaatcgggaagggctgctgaacaacgcgagggacacctcagtcatggatacccttcccctgaacggtaatcacggaaatagctattctatcgccagcggcgagtatttatctaattgtgtccagatcatcgacagaggatacaaccataacgaaacggccctcgaaaaaaaaatactgaaggagctgacctcaaattatatccctagctacctgaacaaccacgaacgatcctccgaacagaacagaaacctcatgaataagctggtgaacaatctgggctccgggcgagaggacgatgcaatcgtccttgatgatgccacgtcattcaaccatgaggagtcattaggacttgaactcatccacgaggagagtgatgcacctctgctccctcctcgagtttatagtactgagaaccaccaacctcaccactacacaaggcgacggattcctcaggaccattctgaatcttttttccctctgttgaccaatgagcatacagaagacctacagtctccacaccgagactccctgtatacatccatgcctaccctcgctggcgtggccgctaccgaatccgtgactacatccacacagacagagccaccgcctgctaaatgtggcgacgccgaggacgtgtattataaatctatgccgaacctggggtcacggaaccacgtgcaccagctccacacatattaccaacttggtagaggctctagtgatggcttcatcgtccctccaaataaggacggaacaccccctgagggctcaagtaaaggacctgcccatctagttacttcgctatag

SEQ ID NO: 42982 - DNA, 1125 bp, Artificial Sequence
  Description of Artificial Sequence: Synthetic coding sequence
atgcggcccggcaccgccctgcaggccgtgctgctggccgtgctgctggtggggctgcgggccgccaccggccgacttttgagcgggcaaccagtgtgtcgcggaggcacccagcgcccctgctataaggtcatttacttccatgacacttcacgccgactgaacttcgaggaggctaaagaggcctgccgtagagacggcggccagctcgtgagtatagagtctgaagacgaacagaagctcatagaaaaattcatcgagaacctgctccccagtgacggtgatttctggatcgggctgaggcggcgggaggaaaagcaatcaaacagcaccgcctgccaggacctgtacgcctggaccgatggatctatctcacagttccggaactggtacgtcgacgagccgtcctgcggctccgaagtatgtgtggttatgtatcatcagccatcggcgcccgcaggaataggaggaccttatatgtttcagtggaatgacgaccggtgtaacatgaaaaacaacttcatctgtaagtactctgacgaaaagcctgcggtcccttctcgagaggcagagggagaagaaaccgagctcacgacaccagtcttgcccgaggaaacccaggaagaggatgccaaaaaaaccttcaaggagagcagggaggccgcgctgaacctcgcatacatcctgattccctctatacctctgcttctgctactggtggtcactacagtagtttgttgggtttggatttgccgcaagagaaagcgagagcagccggaccccagcacaaaaaagcagcataccatatggccctcacctcaccaaggcaattctccggacctggaggtttataacgtgatccggaaacaaagcgaagcagacttggctgagactagacccgacctgaaaaatatttcattcagggtttgcagtggagaagctaccccagatgatatgtcttgcgattatgataacatggcagtaaatcccagcgaaagcggatttgtgaccctggttagcgtcgagagcggcttcgtgactaatgatatatatgaattctctccggatcagatgggccggagtaaagagtccgggtgggtggagaacgagatctacggctactag

SEQ ID NO: 42983 - DNA, 1149 bp, Artificial Sequence
  Description of Artificial Sequence: Synthetic coding sequence
atgcggcccggcaccgccctgcaggccgtgctgctggccgtgctgttggtaggcctccgagccgccacaggtagacttctgtcagcctccgacttagacctgaggggaggccagccagtgtgtcgaggtggaactcagcgaccttgctacaaggtcatctattttcacgacacatcccgccgcctgaattttgaagaggccaaagaagcatgcaggcgggacggggggcagttagtctccatcgagagtgaggacgaacaaaagctgatcgaaaaattcattgagaatctcctcccatcagacggtgatttttggattggactgcggagacgggaggaaaaacagagcaatagcacggcctgccaggacctatacgcttggaccgacggtagtattagccaattccgcaactggtacgtggatgagccatcctgtggcagcgaagtatgtgtggtcatgtatcatcagccatccgctccagccggaattggcggaccttacatgttccaatggaacgacgatagatgtaacatgaaaaacaatttcatttgcaaatattctgatgagaagcccgctgtgccctctcgagaggctgagggggaagagactgagctcacgacccctgtactgcccgaagagacgcaggaggaagacgctaagaaaacctttaaggagtcccgcgaagcagctctgaatctcgcttatatactgataccttccatacctttactgctgcttctcgtggtcacaacagtcgtatgttgggtgtggatctgtaggaagagaaaaagggaacagcccgatccttcgactaaaaagcagcacaccatctggccatctccgcatcaagggaatagcccagatctggaggtgtataatgtgatacgcaaacaatccgaagctgatctggccgagacccgccctgaccttaagaacatctctttcagagtatgctctggggaggccacccctgatgacatgagctgtgattacgataacatggccgtgaatccctctgaatcgggcttcgtcaccctggtttcagtggagtctggcttcgtgacaaatgatatctacgagttttctcccgatcagatgggtagaagcaaagagtccggttgggtagaaaatgaaatatacgggtattag

SEQ ID NO: 42984 - DNA, 690 bp, Artificial Sequence
  Description of Artificial Sequence: Synthetic coding sequence
atggtgaccagcggcctgggcagcggcggcgtgcggcggaacaaggctattgcacaaccggcgaggacattcatgctaggactcatggcggcctaccacaatctcgagaagcccgccgtaccatcccgggaagccgaaggcgaagagacggaattgacaactcccgtcttgccggaagagacgcaggaggaggacgccaaaaagacttttaaagagtcgagagaagcggccctcaatttggcatatatcttaattccttctatccccctgttgctgctgcttgtggtgaccaccgtggtgtgttgggtgtggatttgtcggaaacgaaaacgggaacagccagatcctagcacgaaaaagcagcatacgatttggccttccccccaccaggggaatagtcctgatctcgaagtttacaacgtgatccgcaagcaaagtgaagccgatctcgccgagacacggcctgacttgaaaaacatctcgttccgagtgtgttctggggaggccaccccagatgatatgtcctgtgactatgataacatggcagtgaacccatccgagagcggcttcgtgaccctggtttctgtagaaagtggcttcgtgacaaacgacatctatgaattttcacccgaccaaatgggccggagtaaggagagtggttgggtggaaaatgaaatctacggttactag

SEQ ID NO: 42985 - DNA, 1014 bp, Artificial Sequence
  Description of Artificial Sequence: Synthetic coding sequence
atgcggcccggcaccgccctgcaggccgtgctgctggccgtgctgctggtcggactacgggctgcaactggacggctgctttccgggcagcccgtgtgcagaggaggcacccaacggccttgctacaaagttatctattttcatgatacaagtcggagattgaactttgaggaggcaaaggaggcctgccggagacgtgaggagaaacagtccaatagcacggcctgtcaggacctgtacgcgtggacagatggttccattagtcagttccgtaactggtacgtggatgagccttcctgcggtagtgaggtctgtgtggtgatgtatcatcagccctccgccccggctgggatcggcggcccttacatgttccagtggaacgacgacagatgtaatatgaaaaacaactttatttgcaagtactctgacgagaaacccgcggtcccctccagggaggccgaaggcgaagaaaccgaattgactacccctgtacttccagaggagacccaggaggaggacgccaaaaagaccttcaaggagagcagagaggccgccttgaatctggcctacattttgatcccttctatcccgctgttgctgttgctagtggtgacgaccgtagtgtgctgggtttggatctgtcgaaaacgcaagcgcgagcagcctgatccaagtactaaaaagcagcacactatttggccctcgccgcatcagggaaactctccagacctagaggtgtataacgtcatacggaaacagtccgaagccgatctggccgaaactcgaccagatctgaaaaacatctcctttagagtctgttccggcgaagctactccggacgacatgtcttgcgactatgacaacatggccgtgaatccaagcgagagcgggtttgttacactcgtgtctgttgaatctgggtttgtgacaaatgacatctacgagtttagcccggatcagatgggccggtctaaagagtctggctgggtcgagaatgagatctacggctattag

SEQ ID NO: 42986 - DNA, 405 bp, Artificial Sequence
  Description of Artificial Sequence: Synthetic coding sequence
atgcggcccggcaccgccctgcaggccgtgctgctggccgtgctgctggtggggttacgggcagctacaggacggttgttgtcaggccagccagtgtgccggggcgggacccagcgaccatgttataaggttatttattttcacgacacatcacgtcgcctcaacttcgaggaagctaaggaagcatgccgacgcgacgggggtcagctcgttagcatcgagtccgaagacgagcaaaaattgatagagaaatttatcgaaaatttgctgccaagcgatggcgacttctggattggcctccggaggagagaggagaagcagtctaactctacggcatgtcaagatttatatgcctggactgacggatctattagccagtttagagagacgtcaagtagcttttag

SEQ ID NO: 42987 - DNA, 1071 bp, Artificial Sequence
  Description of Artificial Sequence: Synthetic coding sequence
atggccgccgagggctggatctggcggtggggctggggccggcggtgcctgggccgacctggactcctgggcccgggaccaggtccgacaaccccactctttcttctgttgctcctgggatctgtgactgccgacatcactgacgggaacagcgagcacctgaagcgagaacactcactgataaagccttatcagggcgtaggatctagttctatgcccctctgggattttcagggatccacaatgctgacatcccagtatgtccgcctgactccggacgaacggtccaaggagggctcgatctggaatcaccagccatgtttcttaaaggattgggaaatgcacgtccacttcaaagtgcacggcactggtaaaaaaaaccttcacggagatgggatcgcactgtggtacacccgggacaggcttgtccctgggccggttttcggaagtaaggataatttccacgggctcgcaatttttctggatacataccccaacgatgagaccacagagagggtcttcccctacatttcggtcatggtcaacaacggctcactgagctacgaccatagcaaggacggacggtggaccgagctggctggctgtacggctgattttaggaacagagatcatgacaccttcctggctgtgcgatattcgcgcgggaggctgactgtcatgactgacttagaggataaaaatgagtggaagaattgtatagatatcacaggcgtgagactgcccactgggtactactttggagcctctgccgggaccggtgatctctccgataaccatgacatcatttctatgaagcttttccagctgatggtggagcacacaccagacgaggaatcaattgattggaccaagatcgagccgtctgtgaattttctgaagtccccaaaggataatgtggatgatcccacaggaaactttaggtccggtccgctgaccggatggcgagtctttctattgctcctgtgtgcgctgctcgggattgtggtctgcgctgtggtgggcgcagtcgtttttcaaaagagacaggagcgcaataagcgattctattag

SEQ ID NO: 42988 - DNA, 858 bp, Artificial Sequence
  Description of Artificial Sequence: Synthetic coding sequence
atgcccctgtgggacttccagggcagcaccatgctgaccagccagtacgtgagattgactccagacgagaggtccaaagaaggctccatatggaaccaccagccctgtttcctgaaggattgggagatgcatgttcacttcaaagtgcacggcaccgggaagaaaaatctgcacggtgatggcatcgccctgtggtacacacgagaccgactggtgccaggccccgtgtttggcagtaaggacaatttccatggacttgccatattcctggacacttacccaaatgacgagacaactgagcgggtgtttccttacatctcggtgatggtcaataatggctcattgtcatacgatcacagcaaagacgggaggtggaccgaactggctggctgcacagccgatttccggaaccgggaccacgacacattcttggctgtaagatactcgcgaggccgcctgacagtcatgacagatttagaggacaagaacgagtggaagaattgcatagatattacaggggttcggctaccaacggggtattatttcggcgcaagcgccggaaccggagatctgtcggacaaccatgatattatcagcatgaaactattccagctgatggtggagcatacgcccgatgaggagtccatagactggaccaagatcgagccatctgtcaacttcctaaagagccccaaggacaatgtggatgatccaacaggtaattttaggtccggccctctgacgggttggcgcgtattcctgctgctactgtgtgctctgctcggaatagttgtgtgtgccgtggtaggggccgtggtctttcagaaacgccaggagagaaataaaaggttctattag

SEQ ID NO: 42989 - DNA, 1047 bp, Artificial Sequence
  Description of Artificial Sequence: Synthetic coding sequence
atggccgccaccctgggccccctgggcagctggcagcagtggcggagatgtttgtccgcgcgcgacggcagcagaatgttgctgttgctgcttctgctagggtcaggacaggggccacaacaggtgggcgccggccaaaccttcgagtatctcaagagagagcactccctctcaaagccatatcaaggagttgggacaggcagcagttctctttggaatctaatgggcaacgctatggtcatgactcagtatattcggttaaccccagatatgcaaagcaagcagggtgcgctgtggaatagggtgccgtgcttcctgcgagactgggagcttcaagtgcacttcaaaattcacggacagggcaaaaaaaatctgcatggggacgggctggcaatttggtacacaaaggaccgtatgcaacccggcccagtgtttggtaacatggacaagtttgtgggactgggcgtgttcgtggacacatatccgaacgaagaaaaacagcaagaacgcgtgtttccgtacatttcggcaatggtgaacaacgggtctttatcatatgatcacgagagggacggccgacccacagagctaggggggtgcaccgccatcgtgcgcaacctccattacgatacttttctcgtgattaggtatgttaaacggcaccttacaatcatgatggacattgacggcaagcacgaatggcgcgattgtatcgaggtccctggagtccgtctgccccgaggctactatttcggcacaagcagtataacaggagatcttagcgacaatcatgatgtgatcagtcttaaactttttgagctgacagttgagagaactcctgaggaggaaaaactccaccgcgacgtttttttgcctagcgtcgacaatatgaagcttcctgagatgaccgcgccccttccgccactgtctgggctggccttattcctgatagttttctttagcctcgtgttctcggtctttgcaatcgttattgggataatcctgtataacaaatggcaggagcagtcacggaagcggttctactag

SEQ ID NO: 42990 - DNA, 1080 bp, Artificial Sequence
  Description of Artificial Sequence: Synthetic coding sequence
atggccgccaccctgggccccctgggcagctggcagcagtggcggcgttgcctttctgcccgagacggcagccgcatgcttctcctgctgctgttgcttggatccggccaaggaccacagcaggtgggagccgggcagacctttgagtatctgaaaagggaacattccctgtccaaaccctaccagggtgtgggtacgggctcctcttccctgtggaatctcatgggtaacgctatggtcatgacccagtacatcaggctgacacctgacatgcagtccaaacagggggcactgtggaaccgggtgccctgttttctcagggattgggaactccaggtgcacttcaaaatccacggacaagggaagaaaaatctgcacggggatggactcgcgatctggtacacaaaggaccgcatgcagcctggacccgtgtttggcaacatggacaagtttgtcggactcggagtgttcgtagatacgtacccaaatgaagagaagcagcaggaagcacagaaacgtaggtattctcccggtgtccagcgcgttttcccttacatcagcgctatggtgaataatgggtcactgtcgtatgatcacgagcgcgatggcaggccaaccgaactggggggatgcaccgctatagtgagaaacctgcattacgacactttcctcgttattagatacgttaaacgccaccttacaattatgatggacattgatggcaaacatgaatggagagactgcatcgaggtgcctggagtaaggttaccacggggttactattttgggacatcctcaatcacgggggatttatccgacaaccatgatgtgatcagtctaaagctgttcgagctgacggttgagcgcactccggaagaagagaagcttcaccgcgatgtattccttccctctgtcgataacatgaagctccccgaaatgacggcccccctcccaccactgagcggtctcgcgctcttcctcatcgtgtttttcagtttagtgttctccgtgtttgctatcgtaatcggaataatactttataacaagtggcaagaacagtctcgcaagagattttactag

SEQ ID NO: 42991 - DNA, 645 bp, Artificial Sequence
  Description of Artificial Sequence: Synthetic coding sequence
atggacaaggagcggcggatctgcatgggcatggcctggcagagcggaacccaacgaatcggatgttcccaagcccagaaacgccgctacagtccaggagtgcaacgtgtgttcccttatatttctgctatggtgaataacggcagtctgtcttatgaccatgaaagagatggccgcccaaccgagctgggtggatgcaccgccattgtcaggaaccttcactacgataccttccttgtgatcagatatgttaagcgccacctgactatcatgatggatatcgacgggaagcacgagtggcgcgactgtattgaggtgcctggcgtacgactgcctaggggctattactttggcacctcttctatcactggggatctgtcggataatcatgatgttatctccctgaagctgttcgaactgacagtcgagcggactccagaagaggagaaactgcatagagatgtgtttctgccatctgtggataatatgaagctgccagaaatgacggccccgctcccacccctcagcgggctggctctttttctgatcgtgttcttcagcctggtattctcagtgttcgctattgtgattggcatcatcctgtacaacaagtggcaggaacagagtcgaaagagattctactag

SEQ ID NO: 42992 - DNA, 612 bp, Artificial Sequence
  Description of Artificial Sequence: Synthetic coding sequence
atggacaaggagcggcggatctgcatgggcatggcctggcagagcggtactcaacgcatcggatgctcccagagggtgttcccctacatttcagctatggtgaacaacggaagcctgtcttatgatcacgagagggacgggcgacccaccgagttgggagggtgcacagctattgtgaggaatctgcattatgacactttcttagtcatcagatacgtgaagaggcacctgaccatcatgatggacatcgacgggaagcatgagtggagagactgcatcgaagtccctggagtgagactgccaagagggtactatttcgggacgtccagtataaccggtgacctgagcgataaccacgacgtcatttctctcaagctgtttgaactcacagtggaaagaacccccgaggaggagaaactgcatcgcgacgtctttttgccgtcagtagacaacatgaagttgccagagatgaccgcccctcttccacctttgagcggtctggctttgtttctgattgttttttttagtcttgtcttttcggtttttgctattgttatcgggatcatcctgtacaataagtggcaagaacaatctcgcaaaagattctattag

SEQ ID NO: 42993 - DNA, 633 bp, Artificial Sequence
  Description of Artificial Sequence: Synthetic coding sequence
atgcagcccggccccgtgttcggcaacatggacaagttcgtgggccttggggttttcgttgacacctatcctaatgaggagaagcagcaggagcgagttttcccttatatctctgccatggtgaataacggcagcctgtcttacgatcacgagcgggatgggcgcccaacagaattaggagggtgcactgctattgtgcggaacctgcactatgacacgtttctcgtgattcgatacgtaaagcgccatctcactatcatgatggacatcgacggcaagcatgaatggcgtgattgtatagaggtgccgggagtgcgcctgcctaggggctactactttgggacaagttctataacaggggatttgagtgataaccacgatgtgatatctctgaagctgttcgagctcacagtggaaaggacacccgaggaagagaaacttcacagagatgtgttcctgccttccgtcgataacatgaaactgcccgaaatgaccgccccgctgccacctttgtcgggacttgcattatttctgatcgtctttttcagtttggttttctccgtgtttgctatcgtaatcggcatcattctgtataataaatggcaggaacagtcccgcaaaagattctattag

SEQ ID NO: 42994 - DNA, 1581 bp, Artificial Sequence
  Description of Artificial Sequence: Synthetic coding sequence
atgcccgccgtgagcggccccggccccctgttctgcctgctgctgctgttactcgaccctcattctcctgagaccggctgcccccctctgcggaggttcgagtacaagctatctttcaaggggccaaggctggcgctgcccggcgccggcatcccgttctggagtcaccacggagatgcaatacttggcttagaggaggtgcgcctgaccccatccatgaggaatcggagcggcgctgtgtggagccgcgcatctgtccccttcagcgcgtgggaggtcgaggtgcagatgcgcgtgactgggttgggccgaagaggggcccaggggatggcagtctggtacacacggggcaggggccacgtggggagcgtgctggggggtttggcgtcatgggatggcatcggcatcttcttcgattcccctgcggaagacacacaggattcacccgctatcagggttctggcgagcgatggccacatccctagcgaacagccgggggatggggcgagccaagggctcggaagctgccattgggacttcaggaatagaccccatccctttagagccagaatcacctattggggccaaaggttaaggatgagtctgaattccggactcactcctagcgaccctggcgaattctgtgttgatgtggggcctctgttgctagtgcccgggggctttttcggtgtgtcagccgctactggcacccttgcggacgatcatgacgtcttaagttttttaacattctctctatccgaaccctctccagaagttcccccacagccgttcctagagatgcaacagcttaggctggcaagacagctggaggggttgtgggcccgcctggggttgggtacccgcgaggacgttactccgaaatccgactccgaggcgcagggtgagggagaaagattgttcgacctagaggaaaccctgggtcgccatcggcgtatcttgcaggcattgcgtggcctgtccaaacagcttgcccaggcagagcgacagtggaagaagcaacttgggcctcctggacaagccaggccagacggaggatgggccttagacgcgtcatgccagattccgagcacaccaggaaggggggggcatctgtccatgtctctgaacaaggacagtgccaaggtcggggcgttgttacacggacagtggacgcttctacaagcgctgcaggagatgagagacgcagctgtgcgcatggcagccgaggctcaagtctcctatctgcctgtcgggatagagcatcactttctcgagctagatcacatactcggtcttctgcaggaagagttgagaggccccgctaaggctgccgcaaaggctcccagacctcccggccagcctcctcgcgcgagctcatgtctgcaacctggcatctttttgttttacctgcttattcagacggttggcttctttggctatgttcacttccggcaggagctaaataaaagtctccaagaatgtctaagcaccgggagtctgccattaggcccggccccccatacaccgcgagctctgggaattctccgacgccagcctctgccagcatcaatgcccgcctag

SEQ ID NO: 42995 - DNA, 1545 bp, Artificial Sequence
  Description of Artificial Sequence: Synthetic coding sequence
atgcccgccgtgagcggccccggccccctgttctgcctgctgctgctcctcttagatccccacagtcctgagactgggtgccccccgctcaggagattcgagtacaagctgagcttcaaggggccacggctcgccctacccggggcaggcatacccttctggagtcaccatggagacgctatcctgggacttgaagaagtgcgtctaactccttctatgagaaaccgttcgggagccgtatggagtagggcctctgttccattttctgcttgggaagtggaggtgcaaatgcgagtcactggtctgggacggcgaggtgcacaagggatggccgtgtggtatacgcggggacgcggccatgtggggtccgtgctcggaggattagcttcatgggacgggattggtatcttctttgacagtcctgctgaagacacccaagactcacctgctatcagggtgctcgcctcagacggacacattccttcagagcagccaggtgacggggcctctcagggacttgggtcatgtcattgggacttcagaaaccgccctcacccctttcgagccaggatcacctattggggccaaagactgaggatgagtctcaatagcggcctcacgccatccgatcccggcgagttctgtgtggatgtgggaccactgttgctggtgccaggcgggttcttcggggtaagtgcggccaccggcactcttgccggcgaagaccccacgggccaggttcccccccagcctttcctcgaaatgcagcagttacggctcgcaagacagctggaggggctatgggctcggctgggattgggtaccagggaagatgtgactccaaagtcagacagtgaggcgcaaggagagggtgaacgcctcttcgatcttgaagaaaccctcggaaggcatcggaggattctccaggccctgagaggactgtccaagcaattagcacaggcggaaagacagtggaagaagcagctcggacccccgggacaggcaagacccgacgggggttgggcactagacgcttcttgccagatcccctctaccccgggaagaggcggccacctttctatgtccctgaataaagactcagcgaaggtgggcgcccttttgcacggccagtggacactgctgcaagcactgcaggagatgcgcgatgccgccgtgagaatggcagccgaggcgcaggtctcatacctgcctgtaggcattgagcaccactttcttgagttggatcacatcctaggtcttctacaggaggagcttcgggggcctgcgaaggcagccgccaaggccccccggcctccaggtcagccaccccgcgcatcctcatgcctacagcccggaatcttcttgttctacctgctcatccagacagttggctttttcggctacgtgcactttaggcaggagctcaataaatccctgcaggaatgcctgagcaccggtagcctgcctttgggacccgctccccacacaccccgcgccctggggatcttacggagacagcctctgcccgcatcgatgccagcttag

SEQ ID NO: 42996 - DNA, 435 bp, Artificial Sequence
  Description of Artificial Sequence: Synthetic coding sequence
atgcggaaccggagcggcgccgtgtggagccgggccagcgtgcccttctccgcatgggaagtagaggtccagatgcgagtcaccgggcttggtcgaagaggcgcacaaggcatggactccccggccatccgcgttcttgcatcggatggccacattccatctgaacagccaggcgatggagctagtcagggactgggcagctgtcactgggacttcagaaacaggccacacccatttagagcccgcatcacctattgggggcagcgactgagaatgagtctcaactccggactaacaccttccgacccgggagagttttgtgtggatgttggtcccctgctgctggtgcctggtggcttcttcggtgtgtcggcagcaactggaaccctcgctggtgaagatccaacaggacaggtaagggccgagggccagtag

SEQ ID NO: 42997 - DNA, 204 bp, Artificial Sequence
  Description of Artificial Sequence: Synthetic coding sequence
atggtggacgtgaagtgcctgagcgactgcaagctgcagaaccagctcgagaagctgggcttcagtccaggtcccatcctacgcggactgcaggaacaccaggcacctgaaagtcacatgggcctgagccccaagcgcgaaaccaccgctcggaaaacacggctctcacgagccggtgagaagaaggtcagccagtgggcatag

SEQ ID NO: 42998 - DNA, 423 bp, Artificial Sequence
  Description of Artificial Sequence: Synthetic coding sequence
atggtggacgtgaagtgcctgagcgactgcaagctgcagaaccagctcgagaaactaggatttagccccggacctatacttcaactgaacattatcctgcaaggcaatattatcctttccactgaaaagagcaagaaactcaagaagtggcctgaggctagcaccactaaaagaaaggccgtagacacatactgccttgattacaaaccttccaaaggcagacgatgggcagctagagccccaagtacccgtatcacatacggaacgatcacaaaagaacgcgattattgcgctgaagaccagacaatcgaaagctggcgggaagagggcttccctgtcgggctgaaactggctgttctcggcatttttatcatcgtggttttcgtttatctgacagtcgagaataaaagcctctttggctag

SEQ ID NO: 42999 - DNA, 423 bp, Artificial Sequence
  Description of Artificial Sequence: Synthetic coding sequence
atggtggacgtgaagtgcctgagcgactgcaagctgcagaaccagctggaaaaattaggtttcagccccgggccaatcctgcaacttaatattattcttcagggcaatatcatcctgagcactgagaaaagcaagaaactgaagaagtggccagaggcctctacgaccaagcgaaaggccgtggatacctattgtttggattacaagccaagtaaaggccggaggtgggccgccagggcacccagtacaaggattacctatggcactattacaaaagaaagagactactgtgctgaagaccaaactattgaatcttggagagaggagggattccccgtcggtctaaagctggcggtgctggggatatttatcatagtagtctttgtgtacttaactgtggagaacaagtccctctttggctag

SEQ ID NO: 43000 - DNA, 546 bp, Artificial Sequence
  Description of Artificial Sequence: Synthetic coding sequence
atggtggacgtgaagtgcctgagcgactgcaagctgcagaaccagttggagaagctcggattctctcctggaccaattctcccttccacaaggaaactgtacgaaaaaaagctggtgcagctgctcgttagccctccatgcgctcccccagtgatgaatgggcctcgggagctggacggagcccaggactccgacgactcagaagagctgaatatcatcctgcagggcaacatcatcctttctacggagaaaagcaaaaagttgaaaaaatggcccgaagcgtccaccaccaaaagaaaggcggtcgatacctattgcctggactacaagccctccaagggtcggcgctgggcggctcgggctccttctacacgaattacgtatgggaccattacaaaggagcgtgattactgtgccgaagaccagactatcgaatcctggcgagaggagggcttccccgtcgggctcaagctggcggtgttgggcatattcattatcgtggtgttcgtgtatctgactgtggagaacaagtccttatttggctag

SEQ ID NO: 43001 - DNA, 327 bp, Artificial Sequence
  Description of Artificial Sequence: Synthetic coding sequence
atggtggacgtgaagtgcctgagcgactgcaagctgcagaaccagctcgaaaaattagggttcagccctggcccaattctcccaagcacgcggaaactctacgaaaagaaactcgtgcaactcctggtgagcccaccctgtgccccacctgtaatgaatgggcctcgcgagcttgacggtgcccaagattctgatgactctgaaggtggcctgcaggaacaccaggcccctgaatcacatatgggcctgtcccctaaacgcgagacgaccgcccggaaaaccaggctcagtagggctggcgaaaaaaaggttagccagtgggcctag

SEQ ID NO: 43002 - DNA, 327 bp, Artificial Sequence
  Description of Artificial Sequence: Synthetic coding sequence
atggtggacgtgaagtgcctgagcgactgcaagctgcagaaccagctagagaagctgggatttagccctggacctattctgcctagtacaagaaaactctatgaaaagaagctagttcagctgctggtgagccccccatgcgcaccacctgtgatgaacggcccacgcgaattggatggtgcccaggatagcgatgactccgagggaggcctgcaggagcaccaagctccagagagccacatggggctgtcccccaaaagggaaaccacagctcgcaagacccgcctttctcgcgccggtgagaaaaaagtgtcgcaatgggcctag

SEQ ID NO: 43003 - DNA, 1512 bp, Artificial Sequence
  Description of Artificial Sequence: Synthetic coding sequence
atggccggcctgagcgacctggagctgcggcgggagctgcaggcccttggttttcagcccgggcccatcaccgatacgacacgggatgtctaccggaacaagctaaggcgacttcggggggaggcgcgattgcgggatgaagaaagactgagagaagaggcccggccccgcggcgaagagcgcttacgcgaggaggcccgtcttcgggaagatgctccgctgcgggctcgacccgcggccgcaagtccgcgcgccgagccttggctcagccaacctgcaagcgggagcgcttacgctactcctggggcctatggagatataagaccttctgccgccagctgggtgggtagtagggggctcgcctacccggcccggcccgctcagcttagacgacgcgctagcgtccgcggatcatctgaggaggatgaagatgcccggaccccggatcgggccactcagggccccggattggccgcaaggaggtggtgggcagcctcccctgctccagcccgactcccatcctcacttctcggcccagatccgcggcccggcctgcgagccaccagggccggaccggccggggctgcaagagcacgcccagaagtgggtcgacggctcgaaaggtggctgtccaggctcctgctttgggcaagccttggcctgttgctggtatttctcggaattctttgggttaagatgggaaagccttcggctccacaagaagccgaagacaatatgaagctcctgcccgtggactgtgaacgcaagaccgacgaattctgtcaggctaaacagaaagccgccttactagaattgctgcacgagctgtataactttctagctattcaagccggcaatttcgagtgcggcaacccagaaaatctgaaatccaaatgtattccagtaatggaggcccaggaatatatcgctaacgtgacttcgagttccagtgcaaagtttgaagccgccctgacttggatcctgtcgtcaaacaaagatgtgggtatttggctcaaaggcgaagaccagtcagagctggtgaccacagtggacaaggtagtctgtctggaaagtgcccatcctcggatgggagttgggtgtaggctgagccgggcgcttctgactgccgtgaccaacgtccttatttttttttggtgcctggcgttcctttggggtctacttatcctactgaagtaccgctggcgtaagctggaagaagaggagcaggcgatgtatgagatggttaaaaagatcattgatgtggtccaggaccactacgtagattgggagcaggacatggagcgctacccttatgtcggcatacttcacgtgagagattcactcatccctccccagagtcgaagaagaatgaagagggtctgggacagggccgtcgaattcctcgcatccaacgagagccgcattcaaactgagtctcatcgcgtagccggtgaggatatgctggtatggagatggaccaagccatcaagcttttctgattctgagagatag

SEQ ID NO: 43004 - DNA, 606 bp, Artificial Sequence
  Description of Artificial Sequence: Synthetic coding sequence
atggaggcccaggagtacatcgccaacgtgaccagcagcagcagcgccaagttcgaggcagctctgacttggatcctgtctagcaataaagatgtgggtatatggctgaagggggaggatcagtctgagttagtaacgaccgtagataaagttgtgtgcctcgaatcggctcaccctagaatgggggtagggtgccgtctttctcgcgccctgctgacggccgtcaccaacgtgctgatcttcttttggtgtttagcttttctgtggggccttctcattttgctgaagtaccgttggcgcaaactcgaagaggaggagcaggctatgtacgagatggttaaaaagataattgacgttgtgcaggatcattacgtggattgggagcaggacatggaacgatatccctatgtgggtatattgcatgtgcgggactccctgattcctccacagagccgtcgccgaatgaagagggtatgggaccgggcggtcgagtttctggcttcaaatgagagtcggattcagaccgagtctcatcgggtggcaggagaggatatgctcgtttggcgatggactaagcccagctctttctcagattctgaacgctag

SEQ ID NO: 43005 - DNA, 165 bp, Artificial Sequence
  Description of Artificial Sequence: Synthetic coding sequence
atggaggcccaggagtacatcgccaacgtgaccagcagcagcagcgcaaaattcgaggcagccctaacatggatcctaagctctaataaggacgtggggatctggcttaaaggggaggatcagagtgaattggtaactacggtggataaagtcgtgtgcctgtag

SEQ ID NO: 43006 - DNA, 4470 bp, Artificial Sequence
  Description of Artificial Sequence: Synthetic coding sequence
atgcggcaggtgctgtggctgtgcaacgtgtgcgtgaccgcccgggaaacacgtcaccatctgcatctgccggcaattttggacaaaatgcccgcaccaggcgccctcatcctcctggccgccgtctccgcttccggatgtctcgcgagccccgctcaccccgacggattcgccctgggccgggctcccctggcacctccctacgcagtcgtgctcatctcatgtagcggattattggccttcatatttctgctcctcacatgtctgtgttgcaagaggggtgacgtgggatttaaggagtttgagaatccagaaggggaggactgttccggcgagtacacccctccggccgaggagacgagttcctcgcaatccctgcctgatgtttacatactacctctggcagaggtaagtctgccgatgcccgcaccccagccctctcactccgatatgaccacgccattaggcttgagtaggcaacacctctcttacctgcaagaaataggatccggttggttcggcaaggtgattttgggagagatcttcagtgattacaccccagcacaggtggtagttaaggaactgagggctagcgcagggcccctcgagcagcgaaaattcatcagtgaggcacagccatataggtccctgcagcacccaaatgtgctgcagtgtctaggcctgtgcgtggagactctgcctttccttctgattatggagttctgccagttgggggacctgaaacgctatttacgggcacagcgcccgccagagggactgtctccagaattgcccccaagggatctgcgaacactgcaacggatgggcctggaaattgcccggggacttgctcacctgcacagccacaattatgtacatagtgacttagccttgagaaactgcctgctcacaagtgacctgaccgtccggatcggagactacggcctggctcattcgaattataaagaggattactacttaacgcctgagagactgtggatcccattgcggtgggccgctcccgagctgttaggcgaattacacggtacatttatggtggtcgaccagtcaagagaatcaaatatttggtctttaggagttacactctgggagctcttcgagtttggtgctcagccctataggcaccttagcgacgaagaagtcctggcgttcgtggtccgccagcaacacgttaagttggcacgtccaaggctgaagctcccttacgccgattattggtacgatattctgcaatcttgctggaggccgcctgcccagaggccctctgcctctgatttacagttgcagctgacctatcttcttagtgagagacccccaaggccccccccgcccccacctcctcctcgcgacggcccatttccttggccgtggccccctgctcacagcgctccacgccccggtaccttaagttcgcctttcccgctgctggatggatttcccggtgcagaccctgatgacgttctgactgtgactgagtctagccgaggcctgaatctggaatgtctgtgggagaaggccagacgtggcgccggaagagggggaggggcccccgcttggcagcccgcttcagctcccccagccccacacgctaacccaagtaaccctttctatgaagcgctgagcaccccatctgtactgcccgttatctctgctaggtcaccgtccgtctctagcgaatattatatacggctggaagaacacggatcaccacctgagcctctctttccgaacgactgggaccctctggatcctggggtgcccgcaccacaggctcctcaggccccgtccgaagtgcctcagctcgtctccgagacttgggcctccccgttattcccagcaccccggcccttccctgctcagtcaagcgcatccggttccttcctgctgtctggatgggaccctgaaggaagaggcgcaggagagactctggcaggtgaccccgcggaagttttaggtgaaagaggcacagccccatgggttgaagaggaggaggaagaggaagaagggagctcccctggtgaggatagttcctctctcggagggggcccctcgcggaggggaccactgccgtgcccactatgttcacgggagggcgcctgttcttgtctccccctagaacgcggagatgctgtcgccggatggggcggtcatccagccctggggtgccctcacccgccagaagacgattcaagcttgcgcgccgaaagggggtcccttgcagacttaccaatggcacctcccgcaagcgccccaccagagtttttggacccgctgatgggggcagcagcgccccagtaccccggcagagggccaccccctgcgccaccaccacctcctccgccaccacgggctcccgcagatcccgccgcctctcccgacccaccaagtgccgtggcctctccaggcagcggactctccagccccgggcctaaacccggggactcagggtacgaaacagaaactcctttctctcctgaaggtgcatttcctggtggcggcgctgctgaagaggaaggagtgccccggcccagggccccgccagagccccctgatccaggagcaccacgaccacccccggacccgggtcccctgcctctgcctggtcccagagagaagccaaccttcgtggtgcaagtttctaccgaacaactactcatgtccttgcgcgaggacgtgacccggaaccttctgggagaaaagggggccacagcccgcgagaccgggccacggaaagctggcagggggcccggcaatagagaaaaggtgcccgggttgaacagggaccccacagtcctgggcaacggtaagcaagccccttcgctgtccctgccagtgaacggggttaccgtcttggagaatggagaccaacgggctcccggtatcgaggaaaaggccgctgagaatggcgcgctcggctcgccagagcgggaagagaaagtgctggaaaatggggagctaacaccaccccgtcgggaagagaaggccttagagaatggcgaattgaggtcgcctgaagccggcgaaaaggtgcttgtcaacggcggtctgacccctccaaagagcgaagacaaggtgtccgaaaatggcgggcttcgttttccccgcaatactgaacgacctcctgaaacggggccttggagagcgcctggaccttgggaaaaaactcccgagtcatggggacctgcccccacaattggagagcccgccccagaaactagcctggaacgcgcccctgcaccttccgccgtggtctccagccggaatggaggcgaaacagcccccggacctctgggacccgcacccaaaaatggaacattggagccgggcacagagcgacgcgcccctgaaactggtggggcaccaagagcacctggtgcaggccggttagatctaggcagcggagggagggcgccagtgggcaccggtacggcacccggcgggggccccggttctggagttgatgcaaaggccggctgggttgataatacacggccacagccaccgccaccgccgctgcccccccctcccgaggcccagccccggaggcttgaacctgctcctccccgagcaaggcccgaagttgccccggagggggagcccggggctccggacagcagagccggcggggataccgccttgtccggcgatggcgatcctccaaagcctgagcgaaaggggcccgagatgccaaggctgttcctggatctcggccccccccagggaaattccgagcaaatcaaagcaaggctctctcggctctccctggccctgccgcctctgaccctgacaccctttcctgggcccggcccacggcgaccaccctgggaaggcgccgacgctggggctgcagggggagaagctgggggggccggcgctcctggcccggctgaagaagatggtgaagacgaggatgaagacgaggaagaggacgaagaggccgcagcccccggggctgccgcaggaccccgcgggccaggccgcgcccgtgccgctccggtacccgtggtggtctcctccgctgatgccgacgctgcacggccgctccgaggcctattaaagagtccccgcggagctgacgagccggaggattccgaactggagagaaagcgaaaaatggtgagttttcacggagatgtgaccgtgtacctttttgaccaggagaccccaaccaacgagctaagtgtgcaggccccacccgaaggcgatacagacccttccacgccaccagcccccccgaccccgccccatccggccactccaggggacggattcccatccaatgactctggtttcggcggctccttcgagtgggcggaggatttccctctgttgccgccccccggcccccccctctgtttctcacggttttctgtgagtcctgcactcgagactcccggcccccccgctagggcaccggatgctaggccagctgggccagtggaaaactag

SEQ ID NO: 43007 - DNA, 1656 bp, Artificial Sequence
  Description of Artificial Sequence: Synthetic coding sequence
atgcacctgcagatgcgggaggacatggccaagtaccggcggatgagcggagtgagaccccagagtttccgagacttggaaactcccccacactgggctgcctacgacacaggcctcgaactgctcgggcggcaggaggccggtctggctctgccgcgtctagaggaggcactgcaaggcagtcttgcccagatggaaagctgtagggcagactgcgaaggtccagaggaacagcagggcgccgaggaagaagaggacggagctgctagccaggggggtctgtacgaagcaatcgccggacactggattcaggtgttgcagtgccgccagcggtgcgtgggtgagactgctacccggcccggacgtagctttcccgtgcccgacttcctaccaaatcagttaagaaggcttcacgaggcccacgcgcaggtgggaaatcttagccaggccattgagaatgtgctcagcgttctgctgttttatccagaggatgaagcagcgaaacgagcgctcaaccagtatcaggctcaactgggagaaccaagacccggcctagggccccgcgaagacatccagcgattcatcttgcgtagcctgggcgagaagcgacagctgtattatgcaatggagcacctgggtacatcattcaaagaccctgatccttggacccctgccgcgctgatccccgaagctctgagggagaaactgcgcgaagatcaggagaagagaccctgggaccatgagccagtgaagccaaaaccccttacctactggaaagatgtgcttttgctggaaggtgttacccttacccaagattctcgccaactcaatggatcagagcgggccgtactggacgggctgcttaccccagctgaatgcggtgtgctcctccagctggcgaaagatgccgctggtgctggtgcccgaagcggataccgggggcgtcgcagtcctcacactccacatgaaaggttcgagggtctgacggtgttgaaagccgcacagcttgcaagggcgggcactgtgggaagtcaaggcgcaaaattactgttagaagtgtcagaacgggttaggactctcacccaagcctacttctctcccgagagacccctccacctgtcctttacacacctggtatgcagatctgcgatcgaaggagagcaggagcagagaatggacctaagtcatcccgttcacgctgacaattgtgttctggatccagataccggggaatgttggagagagccccccgcgtacacttacagagattattccgggctgctctatcttaacgacgacttccaagggggggatctgttttttacggaacccaacgccctgacggtgactgcgcgtgtccggccacgctgtggcaggctggttgcattctcgtccggtgtagagaacccacatggcgtttgggctgtgacccgtggtcgccgctgcgccctagcactgtggcacacgtgggctcctgagcacagggagcaggagtggatcgaggccaaagagctgctgcaggaatctcaagaagaggaggaggaagaagaagaggaaatgccttcaaaggacccaagtcctgagccaccgagccggcgccatcagagggtgcaggataagactggacgggctcctagggtgcgggaggagctgtag

SEQ ID NO: 43008 - DNA, 2208 bp, Artificial Sequence
  Description of Artificial Sequence: Synthetic coding sequence
atgctgcggctgctgcggcccctgctgctgctgctgctgctgcccccccctggtagtccggagcctccgggactgacccagctgtcccctggagcacccccccaggcccccgatttgctctacgcagacggtctacgcgcctacgccgcaggagcatgggctcccgctgtggcgttattacgggaagctctgagatctcaggctgccctaggccgggtgaggctggattgtggcgcaagctgtgctgctgatccaggtgcggccctgcccgctgtgctgttgggggcaccagaacccgattcgggaccaggccccacacagggctcttgggagagacaactgctcagagctgccttaaggagggctgactgcctcacccagtgcgctgccaggcgactcgggccaggcggcgctgcaagaagagtaggcagcgccctgagggatgcttttcgccgccgggaaccttacaactatttacagagagcctattaccaactgaaaaaacttgacctggccgctgccgctgcacacaccttttttgtggctaatcctatgcatttgcagatgcgtgaggacatggccaaatataggaggatgagtggggttaggccacaaagcttccgcgatcttgagactccaccccactgggccgcctacgacactggactcgaactcctgggcaggcaagaagccggtctggccctcccccgtctagaggaggctttacagggtagcttagctcagatggaaagttgccgcgcggactgtgagggcccagaagaacagcaaggcgcagaggaagaagaagacggcgccgcatcacagggggggttatacgaagcgatcgcaggacactggattcaggtgcttcaatgcaggcagcgctgcgttggtgagacggcaacccggcccggccgctcttttccggttcctgattttctacccaaccagctgaggcgactccacgaggcccatgctcaggtcggcaacttgtcccaggcaatcgagaacgttctttctgtcctgttgttttatcccgaagacgaggccgctaaaagggcgctcaaccagtaccaggcgcagctgggtgagccaagacctgggctagggcccagagaggatatccagcgctttatacttcgatccctgggggagaagcggcagctgtactatgccatggagcacctgggcacatccttcaaggaccccgatccgtggacaccggccgccctgatccctgaggcccttcgggagaaactgcgggaggatcaggagaagagaccctgggaccacgagcccgttaaacctaagcctttgacgtactggaaagacgtcctgctattagagggggtgactcttacacaggattcaaggcagctaaacggatcagaaagggctgtgctggatgggcttttgactccagcagaatgcggtgtgctcctccagctagccaaagatgccgctggagccggcgcccggagcgggtatagaggcagaagatcaccccacaccccgcatgagagattcgagggactgaccgtactcaaggccgcacagctagcccgggcgggcacggtggggtcccagggagcaaagcttctacttgaagtgagcgagcgggtgcgcactctcacccaggcctacttctctccagaacgcccactgcacttgagtttcacgcacctggtgtgtcgctccgccatcgaaggagaacaggagcagcggatggacctgtctcatcccgttcacgctgacaactgcgtgttggaccccgatacaggtgagtgttggagggagcctccagcgtatacttatcgcgattacagcggactgctatacctgaatgacgattttcagggtggggacctcttcttcacagaacctaatgcactgacggtgacagccagggttcgccctcgctgtggtcgtttggtagctttcagtagcggagtcgaaaacccacatggagtctgggccgtgacgaggggcaggagatgtgcgctcgccctgtggcacacatgggccccagaacaccgtgaacaggagtggattgaggccaaagaactcctgcaggaatcacaggaggaagaggaggaagaagaagaagagatgccttcaaaggaccctagtccagagccaccttcacgccgtcaccagcgcgttcaagataagactggaagggcccctagagtcagggaagaactttag

SEQ ID NO: 43009 - DNA, 492 bp, Artificial Sequence
  Description of Artificial Sequence: Synthetic coding sequence
atgctgcggctgctgcggcccctgctgctgctgctgctgctgcccccacccggtagtccagagcctcccggccttacccagctgagccctggcgccccacctcaggcacccgacctgctctacctcaatgacgatttccaaggaggagacctttttttcaccgagcctaacgctctcaccgtgaccgcccgcgtccgcccccgctgcgggaggctggtagcattttcatccggagtcgaaaacccgcatggagtgtgggcagtcacaaggggtagacgatgtgctctcgccttgtggcatacctgggcaccagaacaccgggagcaggagtggatcgaggccaaggagctgctgcaggagtcacaggaggaggaagaggaagaggaggaagagatgcccagcaaggaccccagccccgagcccccatctagacgacatcaaagggtgcaagacaaaaccggtcgggcacctcgggtcagggaggagctgtag

SEQ ID NO: 43010 - DNA, 1083 bp, Artificial Sequence
  Description of Artificial Sequence: Synthetic coding sequence
atggccctgagccgggtgtgctgggcccggagcgccgtgtggggcagcgccgtgacaccaggccattttgtgacacggagactacaactcgggcggtcaggtttggcctggggggccccaaggagtagtaaactgcatctgtcacctaaggccgatgtcaagaatttgatgtcctacgttgtgaccaaaacaaaggctataaacggtaaataccaccgattcctgggtcgacactttcctcgtttttacgtcctttacacgatctttatgaaaggcctgcagatgctgtgggccgacgctaagaaggcccgccgaattaagacaaacatgtggaaacataatataaagtttcatcagctgccctaccgcgagatggaacatcttcgacagtttaggcaggacgtgacaaaatgtcttttcctagggatcatctccatccccccctttgccaattacctggtcttcctcctcatgtatctatttcctcgccaactgctgattaggcatttttggacgccaaagcagcagactgacttcctcgacatttaccatgctttcaggaagcagtcgcatccggaaattatcagttatctggaaaaggttatccccttgatctcagacgcggggctacgctggcggctgaccgatctctgtacaaagattcaacggggcacccatccagccattcacgacattttagccctgagagaatgcttctccaaccaccctctgggcatgaatcagctgcaggctctccacgtaaaagcactgagtagagccatgctgcttacttcatatctaccacctcctctgctcagacaccgcctgaagactcataccactgtgatccatcagttagacaaggcacttgcaaaactcggtatcgggcaactaaccgcccaggaggtcaagtccgcttgctacttaaggggactcaattctactcacatcggggaagatcgctgtagaacctggttgggcgagtggttacagattagctgctctcttaaggaggcggagctgagtctcttactgcataatgtggtactgctctctactaattatctgggcactaggcggtag

SEQ ID NO: 43011 - DNA, 300 bp, Artificial Sequence
  Description of Artificial Sequence: Synthetic coding sequence
atggccctgagccgggtgtgctgggcccggagcgccgtgtggggcagcgcagttacacctgggcatttcgtgactcgcagactgcaattgggccgctccggcttggcttggggcgccccaaggtcttcaaaattgcatttaagcccaaaggccgacgttaaaaatcttatgtcctatgttgtgacaaaaactaaggctattaacggaaaatatcaccgcttcctaggtcggcattttccacgattttacgtgttatacacaatcttcatgaagggcacatgctttcctggtaactattag

SEQ ID NO: 43012 - DNA, 822 bp, Artificial Sequence
  Description of Artificial Sequence: Synthetic coding sequence
atggccctgagccgggtgtgctgggcccggagcgccgtgtggggctcagctgtgacccctggccattttgtaacccgccggctgcagctagggcggtccggtctcgcgtggggcgctccgagatcctctaagctgcacctgtctccaaaggcagatgttaagaacctgatgtcctatgtagtcacaaaaaccaaggctattaatggcaagtatcatagattcctcggtagacacttccccaggttctatgttctttacactatctttatgaaaggaatcatcagtattccgcccttcgctaactatcttgtcttcctgctgatgtacctcttcccaagacaactcctcatccggcacttctggacaccaaaacagcagaccgatttcctcgacatctatcatgcgttcagaaagcaaagtcatccggagataatctcatacctggagaaggtgattcccctgatctccgacgcgggtctacgctggaggctgactgatctgtgcacgaagatccaacgcgggacgcatcctgccattcacgacattctggcactgcgggagtgtttcagcaaccatcccctggggatgaaccagctgcaggccctgcatgttaaggccctgtctagggcgatgcttctgacttcatacctgccaccacccttactccgacatcgacttaagacgcacactactgtaatccaccagctcgataaagccctggcaaagctgggaatcggccaacttacagccttgcatcaactgccatgggacaaagccttgaacgaaccttggagcggttggcactgcccagccgtggtgtag

SEQ ID NO: 43013 - DNA, 915 bp, Artificial Sequence
  Description of Artificial Sequence: Synthetic coding sequence
atgagctacgtggtgaccaagaccaaggccatcaacggcaagtaccacagatttctgggccggcattttcccaggttctatgtgctctacactatcttcatgaagggcttgcagatgctgtgggctgatgcaaaaaaagctaggaggatcaagaccaacatgtggaagcataatataaaattccaccagctcccctaccgggagatggaacacttacgtcagtttcgacaagacgtgaccaagtgtctgtttcttggcataattagtattccacctttcgccaattacctggtgttcctccttatgtaccttttcccccgacaactgttgatccgccacttttggactcctaaacagcaaactgattttcttgatatctatcacgcctttagaaagcagtcccacccagagatcatttcttatctagagaaagtgatccctctcatatcagatgcaggccttagatggcgcctcaccgatctgtgcacaaagatacagcgcggaacacaccctgccattcacgatattttggctcttagggaatgtttttctaatcatccccttgggatgaaccagttacaggccctgcacgtgaaggccttgtcgcgtgccatgttactgacgtcgtatcttcctcctcccctgctccgccaccggctgaaaactcatactactgtgattcatcagctggacaaagcgctggcaaagctgggtatcggccagcttaccgcccaagaggtcaagtctgcttgttacctaaggggactaaattcaacacacattggagaagataggtgccgaacttggctcggagagtggcttcagatatcttgttccttaaaggaagccgaactttctttgttattgcacaatgtggttttactatccacaaattacctcggcaccagacgctag

SEQ ID NO: 43014 - DNA, 1122 bp, Artificial Sequence
  Description of Artificial Sequence: Synthetic coding sequence
atggccctgagccgggtgtgctgggcccggagcgccgtgtggggctccgctgtgaccccaggacatttcgtgaccaggagactgcagctcgggcgctccggactagcttggggcgcaccaaggtccagcaaacttcacctgtctcctaaggccgacgttaaaaatctgatgagctatgtcgtgacaaagacgaaagcgataaacgggaagtatcatcgattcttagggaggcattttcccaggttttacgttttgtacactatctttatgaaaggtcttcaaatgctttgggccgacgccaaaaaggcacggagaataaagactaatatgtggaagcacaatattaaatttcatcagcttccttatagggaaatggagcacttgcgccaggtctgggctcgaggaagataccccgaggttcacggcgaattccggcaggacgtgaccaaatgtttatttctggggataatttccatccccccatttgcaaattatttggtgtttctcctgatgtatcttttcccccgtcaactgcttattaggcatttttggactcccaagcagcagacggatttcttagatatctaccacgcctttcggaagcagtcacacccggaaatcatctcatacttagaaaaggtcatcccactcatttcagatgctggattacggtggagactgacagacctctgcacgaagatccagcgtggcacccatccagccatccacgatatcctggccctgcgggaatgtttttcaaaccatccattaggcatgaatcagctgcaagcacttcacgtaaaagcgctctccagagccatgctccttacttcatacttgccccctcctctgctgcgacacaggctaaagacccatacaaccgtaatccaccagctggacaaagccctggccaagctcggtattggacaactcaccgctcaagaggttaagtccgcctgctatctcagggggctcaattctactcatattggcgaggacagatgccggacatggcttggcgagtggctccagattagttgttccttgaaggaagccgagctcagtctcctcctgcataatgtggtactgttgtccaccaactatctcggcacacgacgctag

SEQ ID NO: 43015 - DNA, 1782 bp, Artificial Sequence
  Description of Artificial Sequence: Synthetic coding sequence
atggacgccgccaccgcccccaagcaggcctggcccccctggccccccctgctcttcctgctactgctgccaggcggatctgggggctcctgccctgctgtgtgtgactgcactagccagcctcaggccgtgctatgcgggcaccgtcagctcgaggcagtgcctggtggactaccgctagatactgaactcctggatctgtcaggcaatcgactgtggggcctccaacaagggatgctctccagactgtccctgctccaggagctagatctaagctataatcagctgagcactctggaaccaggcgccttccatggattacagtcgttgcttacgcttcgactccagggcaatagactacgtattatgggccctggagtctttagcgggctctctgcattgaccttacttgatctgaggctgaaccagatagtgctgtttctagacggcgcctttggagaactcggatccctccagaaactcgaagtgggggacaatcacctggtgttcgtcgcccctggagcctttgccggtctcgccaaactttccacgctcaccctcgagcgttgcaacttgtccacggtgcctggcctggcactcgcccggctccctgcactagttgctttgagactgcgggagctggacatcggacggctccctgctggcgcgcttcgaggcctaggccagctgaaggagctggaaatccatctgtggccatcactcgaggctctggaccccgggtccctggtgggcctgaacctgagctccttagcgatcaccaggtgcaacctctcctccgtgccatttcaagccttgtaccatctaagctttctgagagtattggacctatcccagaaccccatttcagccatccccgcaaggcggttaagccccctggttcgactgcaggaactccgcctgtccggggcctgcctgacatcaattgccgcccatgccttccatggcctcacggctttccatctgctagacgtggcagacaatgccctccagactctagaagaaactgccttcccgtcaccggacaaacttgtgacccttagactgagtgggaacccactgacttgtgattgcagattattgtggctcctgcggttgagaagacacctggatttcggaatgagcccacccgcgtgtgccggaccacatcacgtccagggtaagtccctgaaggaattcagtgatatcctgcctccagggcatttcacatgcaagccagccctgatcaggaagtcaggaccccgctgggtgattgccgaagaaggggggcatgctgtcttttcctgctccggggatggagaccccgctccaactgtgtcgtggatgcgaccccatggggcctggttgggccgagccggcagagtgagggttctggaagatggtacattagaaattcgctccgttcagctaagagacagaggcgcctatgtctgtgtagtgagtaacgttgccggcaacgattccctgcggacatggctcgaggtcattcaggttgagcctcccaatgggaccctctctgaccctaacattaccgtccccggcataccgggtcctttctttctggattcccgcggcgtcgcaatggttttagctgtgggcttcctaccgttcctcacaagtgttactctgtgcttcggactcattgcgctatggtccaagggcaagggcagggttaagcaccacatgactttcgatttcgtggcacccagaccatctggcgacaaaaatagcggaggtaaccgcgtcaccgcaaaactgttttag

SEQ ID NO: 43016 - DNA, 1746 bp, Artificial Sequence
  Description of Artificial Sequence: Synthetic coding sequence
atgcccctgaagcactacctgctgctgctggtgggctgccaggcctggggagctggtctggcgtaccacggctgcccatccgaatgtacctgtagcagggcatctcaggttgagtgcactggcgcaagaattgtcgcagtcccaactcctctgccctggaacgcaatgagtttacagatccttaacacacatattactgagctgaatgaatcgccgttcctgaacatctcagccttaattgccttgcggatcgagaaaaacgagctatctaggatcactccgggggcttttagaaacctcgggtctctgcgctatctctctctggccaacaacaagctccaggtcctgccaataggcttgttccagggactcgattctctggaatcactcttactcagcagtaatcaactcctgcagattcagcctgctcacttttcacagtgttcaaatctcaaggagcttcaactgcatggcaaccacctcgagtacatcccagacggcgcatttgaccatctcgtgggcctcaccaagctgaacctggggaagaactccctgacccacatctctcctcgcgtgttccagcatttgggaaatctacaggtgctgaggttatacgagaatcgcctaacagacattcctatggggactttcgacggtctggttaatctccaggaacttgccttgcagcagaaccagataggtttactgtctcctgggctgtttcataacaatcataatcttcagcgtctctacttgtcgaacaatcatattagccagctgccaccatcagtgttcatgcagctcccccagctgaacaggctgacgttatttggtaactctctgaaagagttatcccccggtattttcggccccatgccaaatttgcgggagctgtggctttatgataaccacatcagctccctccccgataacgtgttttccaatctgagacagcttcaagtgctgatactttcccggaatcagattagttttatctcaccaggcgcttttaacgggttaactgagctacgtgaactgtccttgcatactaatgccttgcaggatctggacggaaacgtttttcgcatgctcgccaaccttcagaatatctctctccagaataacaggttgcgccaacttccaggcaatatcttcgcaaatgtgaacggcctaatggccatccaattgcagaacaaccaacttgagaatctcccgctgggtatattcgatcaccttgggaagctctgtgaactgcggctctatgataatccttggaggtgcgacagtgacatcttgcctcttaggaactggctgttactgaaccagccacggctgggaactgacaccgtacctgtgtgcttcagtccagccaacgtgcgcggccagtcacttattattatcaacgtgaacgtagctgtcccctctgtgcatgttcccgaggttccaagttatcccgaaactccctggtacccggataccccatcctatcctgacacgacatctgtgagcagtacaacagagttgaccagccccgttgaagattacactgatcttacaacgatccaggtgactgatgaccgatccgtgtggggaatgactcaggctcaaagtgggctggctattgccgctattgttataggcattgttgcccttgcgtgctcgttggcagcctgtgtgggctgttgttgttgtaaaaagcgctctcaagccgtgttgatgcagatgaaggctcctaacgagtgctag

SEQ ID NO: 43017 - DNA, 1764 bp, Artificial Sequence
  Description of Artificial Sequence: Synthetic coding sequence
atgcccctggacaaggccatgcccctgaagcactacctgctgctgctggtcggctgccaagcttggggtgcaggtctggcttatcatggttgccccagcgaatgtacttgcagcagggcctctcaggtggagtgtactggcgctaggattgtggccgtgccaacacctctcccatggaatgcaatgtcgctgcagatcctcaatacacacattacagagctgaacgagtccccctttcttaacatatcagccttgattgctttgcgcattgaaaagaacgagctttccagaattactcccggcgcgtttcgtaatctggggtccttgcggtacctgagtctcgcaaacaacaaactgcaggttttgcctattgggttgtttcagggacttgactcactcgagtccctgctcctgtcatccaatcagctccttcagatacagcctgcacatttctcccaatgctctaatctgaaagagcttcagctacatgggaaccatcttgaatatatccccgatggcgcatttgatcacttagtgggactcacgaaacttaacctgggcaagaacagccttactcacataagtcctagggtgtttcagcacctgggaaatctgcaggtactgagattgtacgaaaataggctcacggacattccaatgggaacattcgacgggctcgtcaacttacaggaattggccctgcagcaaaaccagatcggtctgctcagcccggggctgttccacaacaaccacaatctgcagcggctttacctgtctaacaaccacattagccaactgcccccttcagtctttatgcaactgccacagctgaatagactgacgctgtttggcaatagccttaaagaactctcccccggaatcttcgggcctatgcccaacctgagggaattatggctgtacgacaatcatatctctagcctgcccgacaatgtgttcagcaatctgaggcagctccaagtgcttatcctcagtcgaaatcagatttcctttatttcccccggggccttcaatgggttgacagaactccgggagctgtccttgcacaccaacgcgctgcaggatctggatggcaatgtctttcgtatgctcgcaaatcttcagaatatttccttgcagaataatcgcttgcggcagctgccgggaaacattttcgcaaacgtgaacggattgatggctatccagctgcagaacaaccaattagagaaccttcccctcgggatctttgaccatctggggaagctctgtgaactccgactatatgacaatccctggagatgtgacagcgacatactgccattacgcaattggctgctgctaaaccaaccccgcttgggtacggatacagttcccgtctgtttctctcccgcaaatgtcagaggtcagagcctcatcataatcaacgttaatgtggccgttccctcagtgcacgtgcccgaagtgccatcctacccggagactccttggtatccagataccccttcctaccccgatactactagtgtctccagtacaacagaactgacatctcccgtcgaggattacacggacctgacgaccatccaggtcaccgatgacagatcggtttggggaatgacccaggctcagagtggccttgctattgctgctatcgtgattggaatcgtcgccttagcatgcagcctcgcggcttgcgtcggctgctgttgttgcaaaaagaggtcacaggccgtgctaatgcagatgaaagcccctaatgagtgttag

SEQ ID NO: 43018 - DNA, 1764 bp, Artificial Sequence
  Description of Artificial Sequence: Synthetic coding sequence
atgcccctggacaaggccatgcccctgaagcactacctgctgctgttagtcgggtgccaggcctggggagctgggcttgcatatcatggctgtccaagcgagtgtacatgcagtcgtgctagccaggtggagtgtaccggggcccgcatagtggccgtccctacgcccctgccgtggaatgccatgagcctgcaaatcctcaatacccatatcacagaactgaatgaatctcctttccttaacataagcgccctgatagctctgcgaatcgaaaagaacgagctgtcaagaataacaccgggagcttttcgaaatctcggcagcctccggtatctgtccctggccaacaataaactgcaggtgctccctataggcctgttccagggattggactcacttgaatctctgctgctgtctagtaatcagctcttgcagattcaacccgcccacttctcgcagtgtagtaacctgaaggaactccagttgcatggcaaccatttagaatacatccctgatggggcgttcgaccatctggtgggactgaccaagctgaatcttggcaaaaacagtctgacccatataagcccccgggtgttccagcacctcggtaacttgcaggttctccgcttatatgagaacagacttaccgacatccctatgggcaccttcgatgggttggtcaatttgcaagagctagctttacagcaaaaccaaatcggacttctttcccctggcctcttccacaataaccacaacctgcagaggctttacttgagcaataaccacattagccagctgcccccaagtgtgtttatgcaactccctcagcttaatcgtctgacactgtttggcaactcgctcaaggaactaagccccgggatcttcggaccgatgcccaacttaagagaattgtggttgtacgacaatcatatctcctccctgcctgataacgtgttctccaatctgcgccagctgcaggtgctcattctctcgcggaaccagatctcctttatttcaccaggggctttcaacggcctgacggagttacgagagcttagtttacacacaaatgcacttcaggatttggacggaaatgtttttcggatgcttgctaatctccagaatatctcactgcagaataaccgactgcgacagctgcctggtaacattttcgccaacgtaaatggtctgatggccatccaactgcagaataaccaactcgagaacctgcccctggggatcttcgatcacctcggcaagctttgcgaacttagactctacgacaatccctggagatgtgacagtgacattctcccactgaggaactggctgctcctgaaccagcctcggcttggcacagatacagtgcctgtttgttttagtccggcaaatgtgcgagggcagagtttgatcattatcaacgttaacgtagcagtcccctccgtccatgttccagaagtgcccagttaccctgaaactccttggtatcccgacacaccctcatatccggacaccacaagtgttagttcaaccaccgaactgacatctcccgttgaagactacacagatcttaccacaatccaggttacagacgacagaagcgtttggggtatgactcaggcacaaagtggattggcaatcgctgcgattgtgatagggatcgtggctcttgcgtgttctttggcagcatgtgtcggctgctgttgctgtaagaagcgctcccaggcagtgctcatgcagatgaaggcccctaacgagtgctag

SEQ ID NO: 43019 - DNA, 1113 bp, Artificial Sequence
  Description of Artificial Sequence: Synthetic coding sequence
atgaaggtgaccggcatcaccatcctgttctggcccctgagcatgatacttctgtccgacaagatccaatctagcaagcgggaggtgcagtgcaatttcaccgagaagaactacacgttaattccggcggatatcaaaaaggatgtgacgatcctggatttatcctacaatcaaatcacactgaatgggaccgacacccgagtcctccaaacatactttctgctcactgagctttacttgattgaaaacaaagttaccatcctgcataacaacgggtttggcaatctaagctcattagaaatcctgaatatttgtcggaacagtatctatgtcattcagcagggggctttcctgggactcaacaagctgaagcagctttatctatgccagaacaagattgagcaactgaacgccgacgtgttcgtgcctctgcggtctctaaagttacttaacctacaaggcaatcttatcagctatctggatgtcccccccctttttcaccttgagttgataacattgtacggcaacctctggaattgcagttgctctcttttcaacctgcagaactggctgaatacatccaacgtcacactcgaaaatgagaatattacaatgtgcagttatcccaacagtctccagtcctataatatcaagacagttccacacaaggccgagtgccactccaagttcccatcctcagtgaccgaagatctgtacatacactttcagcctatctctaacagtatttttaactcaagcagcaataatctcacccggaatagcgaacatgaaccccttggaaaaagctgggccttcctagtgggagttgttgtgacagtactaaccaccagcctattgatcttcatagctatcaaatgcccaatttggtataacattttattgtcatacaatcaccacaggctggaagaacacgaggccgaaacatacgaagatggatttacgggaaaccctagcagcctttctcagattccagagaccaactcggaagaaactacagttatcttcgagcaactgcactcctttgtggtcgatgacgatggcttcatcgaagataagtacatcgacatccatgaattatgcgaagagaattag

SEQ ID NO: 43020 - DNA, 1542 bp, Artificial Sequence
  Description of Artificial Sequence: Synthetic coding sequence
atggccctgcgggcccccgccctgctgcccctgctgctgctgctgttgccactcagagcagcaggctgtcctgccgcatgtcgttgttattccgccacagttgaatgcggggctctgcgtctgagagtggtcccattgggaatcccaccaggtacacagaccctttttttgcaggacaataatattgcccgcctggaacccggtgccctggccccacttgccgctctgcgccggctttatctgcacaacaacagtctgcgagccttggaggctggtgccttccgggctcagcctcggttactcgagttggcactgacatctaatcggctccggggcctgaggagcggcgcctttgttggactagctcaattgcgcgttctgtatctggctggcaaccagctggcccgcctgctggacttcaccttcctgcatctgccacgacttcaggagttacacctccaggaaaatagcattgaacttctcgaggaccaggccctggctggcttgagctccctggcgttacttgatctgagccgcaaccagctgggaacaatcagccgggaggctctgcaaccactggcttctttgcaggtgttgcgcctgactgagaatccctggcggtgcgactgtgcgttgcattggctgggtgcgtggattaaagaaggggggcagcggctcctgacctcaagagacaggaaaattatgtgtgctgagccaccaaggctcgccctgcagagtttactcgatgttagtcatagcagcctgatttgtatcccacccagcgtgcatgtccaaccccttgaactgactgccaacttgggcgaagacctgagggtggcttgtcaggccagtggctatcctcagccgctagtcacttggcgcaaggtcccccagcctagagaaggccgcccccgcgctcaagcccaacttgaaggcgggctgttgggcttaggcggccacagtgccagtgatacaggctccggtatgctgttcctctccaatattacccttgcccacgccggtaaatatgaatgtgaagcatcgaacgccggaggcgccgcccgagtccctttccgactgctggtgaacgcatctaggcagcagccacagcaacccgctcagcctccacctcccgctgctaggccagcaggcagtgagcccagacccgaggctggtagcatggccttcagagcactaggggtggccacccaaaccgccattgccgccgccatcgccctgttagccctgacagccctcctgctcgttgcaatgatatgtaggagaaggcgcagaagaaaaaaggcaagagggccgcctggagagggggctctttttgtgaatgattacctggatggtccctgcaccttcgcccagctcgaagagttaagagatgaacgtggccatgaaatgttcgtgatcaacagatcaaaacctctgtttgctgaaggaccagcagaggctccggccgattgtggcccggagcaaggcgctgggcctggactgagggtcccaccacccgtggcttacgaaatccactgttag

SEQ ID NO: 43021 - DNA, 774 bp, Artificial Sequence
  Description of Artificial Sequence: Synthetic coding sequence
atgggcaccgtgcggcccccccggcccagcctgctgctggtgagcacacgggagtcttgccttttcttgctgttttgcctccatctgggtgcagcttgtccacagccctgtagatgcccagatcacgcaggggcagttgccgttttctgctcccttcgcggcctccaagaggtgccagaagatatccccgcgaacaccgttttgctgaagctagacgccaacaagatctcccatctacccgacggtgcattccaacacctccaccgcctgcgtgaactagatctctctcacaacgccatcgaagcaattggatccgcaaccttcgctgggctggcagggggattgaggctgctggacctgtcatataacagaatacagcggattcctaaagatgctctgggtaaactctctgccaagatcaggctcagccataacccactccattgcgagtgcgctctgcaggaggcactgtgggagctgaagctcgatcccgacagcgtggacgagatagcttgccacaccagcgtgcaggaggaattcgttggtaagcccctggtccaggcccttgacgccggggcttctttgtgttccgttccccaccggactacagatgtagccatgctggttaccatgttcggttggttcgctatggtgatagcctacgtcgtctattacgtgaggcataaccaggaagacgcaaggcggcacctggaataccttaagagccttccttcggccccagcgagcaaggaccctatcggaccgggaccatag

SEQ ID NO: 43022 - DNA, 414 bp, Artificial Sequence
  Description of Artificial Sequence: Synthetic coding sequence
atgggcaccgtgcggcccccccggcccagcctgctgctggtgagcacccgagagtcatgcctttttcttctcttttgcctgcacctgggcgccgcttgccctcaaccttgcagatgtcctgatcacgccggcgcagtggcggtcttttgttccctgaggggtctgcaagaggtgcccgaagatatcccagcgaacacagtgctccttaagctcgatgccaataaaatatctcatctcccggacggtgctttccaacatctccaccggctgcgagagttggacctgtcacacaatgccattgaagctatcggctcagcaacgttcgcagggctggccggaggtctccggctgttggatttatcttacaacagaatccagcggataccaaaagacccgatcggtcctgggccctag

SEQ ID NO: 43023 - DNA, 1989 bp, Artificial Sequence
  Description of Artificial Sequence: Synthetic coding sequence
atgcggccccagatcctgctgctgctggccctgctgaccctgggcttggccgcccaacatcaggacaaggtcccatgtaagatggtggacaagaaggtgtcgtgccaggtacttggccttctccaggtgccttctgtgcttcctcccgacacagaaacacttgatcttagtgggaaccagctacgtagtatcttggcaagtcctctcggattttataccgccttacgtcatttagacttaagcactaacgagatcagctttcttcagcccggtgcctttcaggctctaacgcacctcgagcatctgtctctggcccacaaccgactggctatggcaacagccctgagcgcgggaggactcggaccactgccacgagttacctccctggacctcagcgggaattcactctactctgggctcctggaaagattattgggggaggctccctctctccacacccttagcctggccgaaaacagtttgactagactgactcgccacaccttccgcgacatgccagccttggaacagttagatctccattccaacgtgctgatggacatcgaggacggcgcatttgaggggttgcctagattgacccacctgaacctgagccgcaacagcctaacttgtataagcgacttttccctgcagcagctccgggtgcttgacctcagttgtaatagtatcgaggcctttcagaccgctagtcagcctcaggctgagtttcaactgacctggctcgatcttcgggaaaacaagcttcttcattttccggatctggccgccctcccgaggcttatttacctgaatctgagtaacaatctgattcgtctccctacggggcctccccaggactcgaagggcatccacgccccttccgagggatggagtgcgctgcccttgtctgccccaagcggcaatgccagcggacgtcccctttcgcaactgctcaatctggatctgtcgtataatgaaatcgaactgatccctgacagttttttggagcacttgacatctctgtgctttttgaatctgagcaggaactgcttaagaacatttgaagccaggcgattggggagcctgccatgtttaatgctgcttgacctgtctcacaatgctctggagactttagagctaggggcgagagcccttggtagcctccggaccctgcttctgcagggaaacgctcttcgcgacctgccaccatatactttcgcaaacctggccagtctgcagcggttaaatcttcagggaaatagggtaagtccctgtggagggcctgacgagcccggccctagcggctgtgtggcattcagcgggatcacatctctaagatcattgagtctggtcgacaatgagatcgaactcttacgagccggagctttcctgcatacgcccctgaccgagctcgacctcagttccaacccgggattggaggtggccacgggcgccttggggggactggaagcctcactcgaagtcttagctctacaaggtaacggactgatggtcctgcaggtggatctaccttgcttcatctgcttaaagaggttgaatctagcggaaaaccgactgagccacctgccagcctggacccaagctgttagtctggaggtcctcgatctgaggaacaactcatttagtttactgcccgggagcgccatgggaggcctcgaaacgtccctgcggcgcctgtacttacagggaaatcccttgtcctgctgcgggaacggttggctggccgcacaacttcatcagggaagagttgacgtcgatgccacccaagacctgatttgcagattcagctctcaggaggaggtgtccctttcccacgttaggcccgaggactgcgaaaaaggcgggctgaaaaatattaatttgatcattattctgacttttatcctcgtgtcagctattcttttaacgacgctagctgcatgttgttgcgtgcgcaggcaaaagtttaaccagcaatacaaagcttag

SEQ ID NO: 43024 - DNA, 1989 bp, Artificial Sequence
  Description of Artificial Sequence: Synthetic coding sequence
atgcggccccagatcctgctgctgctggccctgctgaccctgggccttgcagcgcaacatcaggacaaggtcccttgcaagatggtcgacaagaaggtttcttgccaagtgctgggcttgctccaagtgccttcggtgctgcctcccgacacggagactctggaccttagtggtaaccagctgcgctccattctagcttccccactcggcttctacaccgcattgcggcacttagatctcagtaccaatgaaatctcttttttgcaacctggtgccttccaggcactcacccatttggaacacttaagcctggcccacaaccgactggccatggctacggccctgtctgccggggggctgggacctttaccacgtgtgactagtcttgacctgtctggcaatagtctgtatagtggcctcctggaacggctcctcggagaggccccttccctgcacactctgtcgctcgctgaaaattcccttacacgcttgaccagacacacctttagggacatgccagcactcgagcagctcgacttgcattcaaatgtgctgatggacattgaagacggggcgtttgaggggcttccaagacttacccacctgaacctgagccgaaattcactcacttgtattagcgattttagcctccagcagctacgtgtgcttgatctatcgtgtaactccattgaggccttccagacagcatctcagcctcaggccgaattccaactgacctggttagatttgcgcgaaaataagttgctccattttccagacctagctgccctgcctagactgatttacctgaacctgtctaataacctcattcgactacctaccggcccccctcaagactcaaaaggaattcacgctcctagcgaagggtggtcagccctccctctgtctgctccttctggcaatgcctccggccgcccactgagccagctgctgaacttggatctgtcctataatgagatagagctgatccccgatagctttctggaacacctaacctctttatgttttctgaatctcagcagaaattgtctccggacctttgaagccagaaggcttggaagcttgccctgtcttatgttactcgatctttctcacaacgccttggagaccctcgagctgggggcccgtgctctgggctctctgcgcactttgctgctacaaggaaacgctctgagagatctgcccccttacaccttcgcaaatcttgcctctctgcaacgactgaacctgcagggaaatagggtctctccatgtggagggccggatgaaccaggccccagcggctgcgtcgccttcagtggaataaccagtcttcgcagcctcagcctggtcgacaatgaaattgagctgcttagggctggagcttttctgcacacaccgttgacagaattggatttaagtagtaatcctgggctcgaagtggctactggggcactggggggactcgaagcgagtctggaagttttggcactccagggcaacgggctgatggtgctgcaggtggacctgccgtgttttatatgcctgaaacggctcaaccttgcagaaaataggctgagccatctgcctgcctggacccaggcagtgagcttagaagtcttagacctgaggaacaacagcttcagcctgctgcctgggagcgccatgggcggtctggaaacctcattacggagattgtatcttcagggaaatcctctctcatgttgtggcaatggctggctagcggctcagctgcaccagggtcgagtcgacgtggacgccacacaggatctgatatgccggttctccagccaggaagaagttagcctgtctcatgttcggcccgaggattgtgaaaagggtggcttgaaaaatataaatttaatcatcattctgacatttatattagtttctgcaattctcctgacaacattggcagcttgctgctgtgtcaggagacagaagttcaatcaacagtataaggcttag

SEQ ID NO: 43025 - DNA, 1989 bp, Artificial Sequence
  Description of Artificial Sequence: Synthetic coding sequence
atgcggccccagatcctgctgctgctggccctgctgaccctgggcttggcagcccaacaccaggataaagtgccttgtaagatggtagacaaaaaggtgtcctgtcaggtgttaggtttactgcaagttccttctgtgcttccaccagatacggaaactctggatctctctggaaaccagcttcggagcatcctggctagcccattgggcttctatactgccctgcggcatctggacctgagtaccaatgagatcagctttctacagccgggagctttccaggctctgactcatctagaacatttgtcactggcacacaacagattggccatggctaccgcactgtcagcaggtggcttggggccgctaccccgagttacaagtctggacttatctgggaattcactctattccggcctgctggagcggctgttaggggaagcccctagcctccatacccttagtctggccgagaactctttgacccgcttgacgaggcacacttttcgcgacatgcctgccttggaacagctagacctccatagcaacgttttgatggatattgaggacggggccttcgaggggctgcctcgcctgacccatctgaacttgagccggaattcccttacctgtatttccgacttcagtctgcagcagctgagagtgcttgacctatcctgcaattctatcgaagcctttcagacagcgagccagccccaggctgagtttcagctgacctggttggatctgcgcgagaataagttgctgcattttccagacttagccgccctccctagacttatctatctcaacctttcaaataatttgattcgactccctaccggccctccacaggactccaaaggcatccatgccccctcggagggatggtccgcactgccactttcggcgccctcaggcaacgcttccggccgtcccctgagtcagctgctgaatttggacctcagctacaatgaaatcgagctcattcctgattcgtttttggaacacctaacaagtctgtgcttccttaatctcagccgcaattgtctgaggacttttgaggcccgtcggctgggtagcctgccctgcctgatgttactagacctgtcgcacaacgcgttagagacattagagctcggagcaagggcactgggatctctgcggacactcttactgcagggcaacgcattgcgcgacctccctccatacaccttcgccaacttggcttcacttcagcggttgaatctccaaggaaatcgagtgtcaccttgcggcgggccagatgagcccggaccgagtggatgcgtggcatttagcgggatcacgtcgctgaggagcctgtcactggttgacaatgagatcgagctcctcagagcaggagcatttctacacacgcctctaacagaattagatctgtccagtaaccccggactagaagtggctactggcgcactgggtggcctggaagcaagtctggaagttctcgcacttcaggggaacggactaatggtgctacaggtcgacctgccctgcttcatctgtctgaaaagactgaacttggccgagaataggcttagtcatcttcctgcctggactcaggccgtatcattagaggtgctggacctgcggaataattccttttcgctcttgcctgggagtgcaatggggggcctcgagaccagcctccgtagactatacctacaggggaatccattatcgtgctgcggaaacggatggctggccgcccagctgcatcaaggacgcgtcgacgtggacgcaacacaagacttaatctgccgctttagttcccaggaggaagtaagcttatctcatgtccggccagaagactgtgagaaggggggcctgaagaacataaacctgattattatccttacctttatcctcgtttcagctattttacttacaaccctcgctgcctgttgctgcgtcaggagacaaaagttcaaccagcaatataaagcctag

SEQ ID NO: 43026 - DNA, 561 bp, Artificial Sequence
  Description of Artificial Sequence: Synthetic coding sequence
atgcggccccagatcctgctgctgctggccctgctgaccctgggcctggctgcacagcaccaagataaggtgccatgtaagatggttgacaaaaaggtgagctgtcaggtattaggcttgcttcaagttccctcagttctccctcccgatacagagacgctggatctgtccgggaaccagctccgctcgattctcgcttccccactgggattctacacagccctgcgtcacttggacctctcgactaacgagatcagcttcctccagccaggtgcctttcaggcattgacccacttggagcacctgtctctagcgcataacagacttgctatggcaactgctctgtcagctggcggtctgggacctcttccgcgcgtcacatcgttggatctcagtgggaactcattatacagcggcttactagagcgcctgcttggagaagcgccctcactgcataccctatcacttgctgagaattcactgactagactgactcgacacacctttagggacatgccagcactcgagcagctggacctgcacagcaatgtcctgatgtag

SEQ ID NO: 43027 - DNA, 2079 bp, Artificial Sequence
  Description of Artificial Sequence: Synthetic coding sequence
atggagctgctgcccctgtggctgtgcctgggcttccacttcctgaccgtgggatggagaaaccggagtggtacggcgacagccgcttcacaaggagtgtgcaaactggtggggggtgcagcagattgtcgggggcagtcgttagcatcagtgccttcctccctgcccccgcatgcccggatgctcactttggacgccaatccactcaaaacactctggaaccacagtcttcagccataccccctgctggagagtctgagtctgcactcttgtcatctggaaaggatcagccgcggcgcctttcaggagcaggggcatctccgaagtttggtactgggggataactgcttgtccgagaattatgaggagacggcggccgctttgcacgccttgcccggactcaggaggctcgatctgtccggcaacgccctcactgaggatatggctgcattgatgttgcaaaacctgtcgtccctacgctccgtgagtctggctggcaatacaattatgcgattagacgactctgtgttcgaaggcttggaaaggctgcgcgagctggatcttcagcgcaattacatattcgagattgaggggggcgcttttgatgggctcgccgagctacgccaccttaacttagctttcaataatcttccttgcatcgtggacttcgggctaactcggctgcgcgtcttaaatgtttcttataacgttctggaatggtttctggcaaccggtggcgaggcggcattcgaattagaaactcttgatctgtcacacaatcagctgctgttctttcctctgctaccacagtattcaaagctgcggaccctcctgctgcgggacaacaacatgggcttttaccgagacttatacaataccagttcccctagagaaatggtagctcagttcctgttggtggatggaaacgtgactaacattacaactgtgtctctgtgggaggaattttctagctctgatctggctgacctgaggtttctcgacatgtctcagaaccaatttcaatacttacccgatgggtttcttcgcaagatgccttctttgtcacaccttaatctgcaccagaactgcctaatgaccttacacattagagagcatgaacctccaggcgcactgaccgaactcgatctcagccacaatcaactgtcagagctgcatctggcgccagggctggcaagctgcttgggcagcttgcgccttttcaatctgtcttcaaatcagcttctcggggtgccaccagggttgttcgccaatgcacgtaatatcacaaccctggatatgtcccacaatcagatatccctgtgccctttacccgctgcatccgacagggttggccctcccagctgcgtggacttcaggaatatggcctctctgcgaagtctcagtttagaggggtgcgggcttggggcactacctgactgcccatttcagggcacaagtcttacgtacctggacctgtcctctaattggggcgtgctgaacggaagccttgcccccctgcaggacgtggcgcccatgttgcaggtgctatctctgcgaaacatgggactgcatagctcatttatggccttggacttctcaggatttggtaacctccgcgatttggatctctctggcaattgcctgaccacgtttccaaggttcggtggctctctcgctctggagaccctcgacctgcggaggaactcgttgaccgcactccctcagaaggccgtgtcagaacagctgtccaggggactgcgcactatctacttatctcaaaatccctatgattgctgtggcgttgacgggtggggggcccttcagcatggtcagacagtggccgattgggccatggtcacatgcaatctatccagtaagatcattagagtgacagaactgcccggaggtgttccaagagactgcaaatgggaaagactcgacctaggcttactttacctggtgctcatcttgccctcctgtctcacactgttggtggcttgcacggtgatagtgctgacatttaagaaacctctcttgcaggtcatcaaatcccgctgccactggtcaagcgtgtactag

SEQ ID NO: 43028 - DNA, 4905 bp, Artificial Sequence
  Description of Artificial Sequence: Synthetic coding sequence
atgaccagcgcccagtgccccgccctggcctgcgtgatgagccccttgaggttctgggggccatggccactactaatgtggcagctcctgtggctgctggtgaaagaggcccagccactggaatgggtaaaggatcctttgcagcttacatccaatccactcggaccccccgagccctggtctagccactctagccacttcccacgggagtctccacacgccccaaccctgcctgcggacccctgggactttgatcacctcgggccctcagctagctccgagatgccagccccaccccaggagagtaccgaaaatctggtcccattcttagatacctgggactccgctggagagctcccactggaacctgagcaatttttagcttcccaacaggacttgaaagataaacttagtccacaggagaggttgccagtgagtcccaagaagctgaaaaaggatcctgctcagcgctggagcctggccgagataattgggataatccaccagctttcgacaccgcagtcgcagaaacagaccctgcagaacgagtacagctccacggatacgccttatcccggctcattgcccccagagctccgagttaagtcagatgaacctcctggcccgtcagagcaagtcggcccatcacaattccacctagagccggaaacacaaaacccagaaactctagaagatatccagagttcttcacttcagcaggaggctccagctcagctcccacagttactggaagaggagcctagtagtatgcaacaggaagcacctgcgctcccacccgagtcctctatggagtccttgaccttgccaaaccatgaggtgtccgttcagccacctggtgaggaccaggcctactaccacctgccaaatataacagtaaagcctgcagacgtggaagtgacaatcacctcagaacccacaaacgagactgagtcatcccaggcgcagcaagagacccctatccagttcccagaggaggttgaaccatccgcaacccagcaggaggctccaatcgagcctcccgtgcctcccatggaacacgagttgagcattagcgaacaacagcagccagtacagcccagcgaaagctccagggaggttgagtcctccccaacccagcaggagaccccaggacagccacccgagcatcatgaagtgacagtatcaccgcctgggcaccaccagacccaccacctggcgagtccctctgtctcggtcaagcctcccgatgttcagctgacaatcgccgctgagccctccgcggaggtgggcacttccctggtgcatcaagaagcaacgacccggctctccgggtcaggtaatgacgttgagcctcctgcaattcaacacggaggaccaccactcctgcctgagagtagcgaggaggcagggccgcttgcggtacagcaagagacttcctttcagtcccctgaacctataaacaacgagaatcccagtcccactcaacaggaggcggccgccgagcacccacagacggccgaggagggcgaaagctcattgacccatcaggaagcccccgcccagacacccgaatttcctaatgtggtggtagctcagcccccagagcacagccacctcactcaggcaactgtgcagcctctggatctgggcttcacgattactcctgaaagtatgaccgaggtggagctttcccccactatgaaggagactcctactcagccgcccaagaaggtcgtgccccagctgcgggtgtatcagggagtgaccaatccgaccccaggacaggaccaagcgcagcacccggttagcccatcagttacagtccagttgctggatttaggcctcacgattacgccagagccaaccacggaagttggacatagtacaccgccaaaacggacaattgtgtccccaaagcatccagaagtgacgctgccacaccccgaccaggtgcagacacagcattctcacctgacacgggccactgtgcagcctctggacctcgggttcacaataacacctaaatcaatgaccgaagttgagccttcaacagcactgatgactaccgcccccccccctggtcaccctgaggtgactttaccaccgtctgacaagggtcaggcccagcactcgcatctgacacaggctacagtgcagccacttgacctggaattgaccatcaccacaaaacctacaactgaagtgaaaccttcaccaacaaccgaggaaacttctacgcaactgccagatctgggactcgctatcattccagagcctaccacagaaaccggccacagtaccgcgctggagaaaacgactgccccacggcctgatcgcgtacagacacttcatcgaagtctgactgaagtcacaggcccacccactgagctggagcccgctcaggatagccttgtgcagtccgaatcgtacactcaaaacaaggccctgaccgctccagaagagcataaggccagcacaagtaccaatatttgcgaattatgtacctgcggggatgaaatgctctcatgtattgacctcaatccagagcagcggctgaggcaggtgccagtgcctgagccaaacacacataatggcacctttaccattttgaatttccaggggaattacatcagttacatagatggtaacgtgtggaaggcatattcttggacagagaagttgattctgagagaaaataacttgactgagcttcataaagacagttttgaggggctgctgtccctacagtacttggacctcagctgcaacaaaatccagtcaattgagcgccatactttcgaacctctgcccttcctgaagttcattaacctctcttgcaacgttattactgaactctccttcggaactttccaagcctggcatggcatgcaattcctgcataagctgatcctcaatcacaatcctctgacaacagttgaggacccgtacctatttaagctcccagctctcaagtatcttgacatgggtactacgctcgtgcccctgaccacactcaagaacattctgatgatgactgtggagcttgagaagctgatcgtaccatctcacatggcatgttgcctgtgccaattcaaaaacagtatcgaggcggtgtgtaagactgtcaagttacattgtaatagcgcatgtctgaccaataccacccactgtcccgaggaagctagcgttggtaacccagagggagcattcatgaaagtgttgcaggcccgcaagaattacacctccactgagctgattatagaacctgaggaaccctctgatagcagtggcataaacctgtccggattcggctcagaacaattggataccaatgatgagtccgacgttacctccaccctcagttacatcttgccttacttcagcgctgtgaacttagacgtgaaatctctcttgctgccgttcattaaacttcctaccacgggtaattccctggcgaagatacagaccgtggggaaaaaccgccaaagactgaaccgagtactgatgggccctcggtctattcagaagcggcacttcaaggaagtgggtaggcagagcataagacgagaacagggagcgcaggcctcagtggagaacaccgctgaagaaaaacgcttaggatcacccgcccccagagagctgaagcaaccccatactcagcagggtccagagaaactcgccggaaacgccgtgtatacgaaacctagcttcacccaggaacacaaggccgctgtctccgtcttgaagcctttttctaagggggcccctagcacttcctcgccagccaaagcacttccccaggtcagggatcgctggaaggatctgactcacgccatcagtatcctcgagagtgcaaaagccagagtaacaaatatgaaaacatctaaacccattgttcattcccggaagaaatatcgattccacaagacacgctccagaatgacacaccgcacccctaaggtgaagaagtctcctaaagttaggaagaaatcctatctatcccgactcatgttgtcaaatcgcttaccattcagtgctgctaagtcactgattaactccccatcccaaggggctttttcttcgttgcgcgatctttcgccccaggagaacccgttcctcgaggtgagcgcacctagcgaacacttcatcgaaaacaacaacacaaaagacacaactgcacggaacgccttcgaggagaacgtattcatggaaaacaccaacatgcctgagggcaccatcagtgagaataccaactacaatcaccctcctgaggccgattctgctgggacggcatttaatctcggtccaacagtgaagcagacggaaacaaagtgggagtataataacgtgggtacggatctgagccccgaacctaaatcattcaactaccctctgctgagctcaccaggtgaccagtttgaaatccagctgacccagcagctccaaagtgtaattccgaacaataatgtgcggcgcctgattgctcacgtgatcaggactcttaagatggactgtagcggcgcacacgtgcaggtcacctgcgccaagctggtgagccggactggtcatctgatgaaattgctgtcagggcagcaggaggtgaaagcatctaagattgagtgggacaccgaccaatggaaaacagagaactatattaacgaatctacagaggctcagtcggaacagaaggagaaatccctcgagtttacgaaagagctgcccggctacgggtatacaaagaaattgatactggctctcattgtgaccggcatcctcaccattctgatcatcttgctgtgcctcatagagatttgctgtcaccgccgaagcctgcaggaggatgaagagggattttcacgggactctgaagcccccacagaggaggagagcgaagccctcccctag

SEQ ID NO: 43029 - DNA, 4905 bp, Artificial Sequence
  Description of Artificial Sequence: Synthetic coding sequence
atgaccagcgcccagtgccccgccctggcctgcgtgatgagccccctgcgcttctggggaccctggcccctgcttatgtggcaacttctgtggctccttgttaaggaggcccagcccctcgaatgggtaaaggatccactccagctgacatcaaatcctttagggccaccagaaccttggagttctcatagttcccacttcccacgcgaatccccccacgctccaaccctgcctgcagacccctgggattttgatcacctggggccctcagccagctccgaaatgcctgcaccaccacaggagagtacagagaacttagttccctttcttgatacatgggactcggccggagagttgcccctggaaccagaacagtttcttgcctcacaacaagatttgaaagacaaactgtcaccccaggaacggctgccagtgagccctaaaaagcttaaaaaagatcccgcccagcggtggtccctggcagagatcatcggcataattcatcagctgagcaccccgcagtcccagaagcagactctccagaatgaatattctagcactgatacgccttatccaggctcactgcctcccgaattgagagtgaagtcggacgagccacctggccctagcgagcaggtgggaccttcccagtttcacctggagcccgagacgcagaaccctgagaccctggaggacattcagtcttcctccctgcagcaagaagcgccggcacaactgccacagctcctggaggaagaacccagcagtatgcagcaggaagcaccagcccttcctcctgaaagcagtatggagtctctcacccttccaaaccatgaagtcagtgtgcaacctcctggcgaagatcaggcgtactatcacctgccaaatatcaccgtgaagcccgccgacgtggaggtaaccatcactagcgaacccacaaacgaaactgaatcgagccaggctcagcaggaaacacctatacagtttccagaggaagtagaaccgtcggcaacacaacaggaagccccgatagaaccacccgtacctcctatggaacatgagctctcgatctccgagcagcagcagccggtgcaaccatccgaatcatcacgcgaggtcgaaagctcgcccacgcagcaggagactcctggccagccaccagagcaccatgaggtgactgtgagcccccctggtcatcaccaaacccaccacctggcctcgcctagcgtgagtgtgaaacctcctgacgtccagctcaccatagcagctgagcccagcgcggaggtgggcacgtcactagtgcaccaggaggctacaacgcggctctccggctctgggaacgacgtggagccaccggctatacagcacggggggcctccacttctgcccgagtcctcggaggaggctggacccctggcggtgcagcaggaaacttcctttcaaagtcctgaaccgatcaacaacgaaaaccctagccctacccaacaagaggccgcagcggaacatccccaaaccgcagaggagggagaatcgtcgcttactcatcaggaagcccccgcccagacacctgagtttccaaacgtagttgtggcacaaccgcccgagcattctcacctgacacaggccacagtacaaccactcgacctgggttttaccattaccccagagtctatgaccgaggtggagctgagcccaaccatgaaagaaaccccaacgcagccacctaaaaaggtggtgccccaattgcgggtgtaccagggcgttacaaacccaaccccgggccaggaccaggcccagcaccccgtttctcctagtgttacagtgcaactactggacttaggtctgaccatcaccccagagcctactaccgaagtaggtcattctactcctcctaagcgtacaattgtgagccctaaacatccggaggtcaccctgccccacccagaccaagtgcagacacagcattcccatttaacaagagcaaccgtgcagcctctcgacttgggcttcacgattacccctaaaagcatgacggaggtagaaccctcaaccgcgctgatgaccaccgccccacctcccggccaccctgaggtcacgctccccccctcagataagggacaggctcagcacagccatctcactcaggctaccgtccaacctcttgatctggaattaacaattacaacgaaacccactacagaggtgaagcccagccctactaccgaggagaccagtacacagctcccagaccttggccttgcaatcattcctgagccaaccacagaaacagggcacagtaccgctcttgagaaaactaccgcaccccggcccgatagagtccagactctgcataggtctctaaccgaggtcacaggtccacctacagagttggagccagctcaggacagcttggtgcaaagtgagtcctacacccagaataaggcactgacagcccccgaagagcacaaagcaagtactagtacaaacatctgcgagttgtgtacatgtggagacgagatgctttcatgcatcgacctgaatccagagcagagattgagacaggtacctgtgcctgagcctaatactcataacggaacttttactatccttaattttcaggggaactacatttcatatattgatggaaacgtttggaaagcctatagttggacggagaagctgattctaagggagaataatctgacagagctccataaggattcattcgaagggctgctatctctgcagtatttagacctgtcatgcaataagatccagtcaatcgagcggcacacattcgaaccgctgccgttcctgaagtttattaaccttagctgtaacgtcataacagaattgagtttcggaaccttccaggcttggcacggcatgcaattcttgcacaagcttatcctgaaccataatcctctgactactgtggaggacccgtacttgtttaagcttccagcgcttaaatatctggacatggggaccaccctggtgccattaaccacattgaagaatatccttatgatgacagtcgagctggagaaactcatagtcccaagtcacatggcctgctgcctatgtcagtttaaaaatagtatagaagctgtgtgcaagaccgtgaagttgcactgcaatagtgcttgcctcacgaatacaacacattgcccagaagaggcgtctgtcggtaaccccgagggagcgtttatgaaggtactccaggcaagaaagaactatacttctacggagctgattattgagcctgaggagcccagcgatagctccggtatcaacctgtcaggtttcggcagcgaacagctcgatacaaatgatgaatctgacgtgacttctacgctttcatacattctcccatacttctctgctgtgaacctagacgtgaaaagcctgctgctgccctttatcaagttgccgaccaccgggaatagcctggctaagatccaaactgtgggcaagaatagacaaaggctaaacagggtcttgatgggtccacgcagcatccagaagcgacatttcaaggaggtgggtcgccagtcgatccgccgggagcagggcgcccaggcttctgtggagaataccgcagaagagaagcggctgggtagtcccgctcctcgagagctgaaacagccccacacccagcagggccctgaaaagcttgccgggaacgcagtttataccaagcccagtttcacgcaggagcacaaagctgccgtaagcgtattgaaacccttctctaaaggcgccccaagcactagcagccccgccaaggcactgccacaggtcagggacaggtggaaagatctgacccacgcaatctctatcctggagtccgcaaaagcccgagttaccaatatgaagactagtaaaccgatcgtgcattctaggaagaaatatcgcttccacaagacacgaagtcggatgacgcatcgcacaccaaaggttaaaaagtcacctaaggtccgtaaaaaatcctacttgtctcgactgatgttgtccaaccgcctgccatttagtgctgctaaatctctgattaacagtcctagtcagggcgcattcagcagcctgagagatctgtctccacaagagaacccgttcctggaagtcagtgccccctcggagcattttattgagaacaacaataccaaggacactaccgctcgcaatgccttcgaggaaaacgtttttatggagaatacaaacatgcccgaaggaacaatcagcgagaacaccaactacaatcatccccctgaagcagacagcgcaggtacagcctttaacctggggcctaccgtaaaacaaaccgagaccaaatgggaatacaataacgtgggcactgacttgagccctgagcccaagtcatttaactatccgttattatcctcaccaggtgaccagtttgagattcagctgactcagcaactgcaatcagtgatcccaaataataatgtgaggagactgatcgcccacgtgatccggactctcaagatggattgtagcggcgcgcacgtccaagttacctgcgccaagctggtatccaggaccggacatctcatgaagctcttgagcggacagcaggaggtgaaggcctctaagattgagtgggacaccgaccaatggaagactgaaaattacattaatgaatcgaccgaggcgcagtctgaacagaaagaaaagtcattggaattcactaaagagttaccgggctatggctacactaaaaaactgattctggcccttatcgtgactgggatcctgaccatcttaataattctgttgtgtctgatcgagatctgctgccaccggcgctcactgcaggaggacgaggaaggattcagcagagatagtgaggcaccaactgaagaggagagtgaggccctgccgtag

SEQ ID NO: 43030 - DNA, 1836 bp, Artificial Sequence
  Description of Artificial Sequence: Synthetic coding sequence
atggcctgctgcctgtgccagttcaagaacagcatcgaggccgtgtgcaaaacagtgaagctccactgcaattcagcctgcttgaccaacactacacactgccctgaagaagcgagcgtgggcaatccagaaggcgcattcatgaaagtgctgcaggcccgcaagaactacacctctactgagctcataatagagcctgaagaacccagcgattcttccgggataaacctttctggatttgggagcgagcagctagatactaacgacgaatctgacgtaacgagcactctgtcttatattttgccatatttctccgcagtcaacttggacgtcaagagcttgttgctgcccttcatcaagctgcccaccaccggcaactccctcgctaagatacagacagttggtaaaaaccggcagagattgaaccgcgttctaatggggccgaggtccatccagaaacgccattttaaggaggtcggccgtcaatccattcgaagggaacaaggggcccaggcgagcgtggagaacaccgcagaggaaaagaggctgggttctccggcccctcgggagctcaagcagcctcacactcaacaaggaccagaaaagcttgcggggaacgccgtgtacaccaagccttcttttacccaggaacataaggcagctgtctcggtgctgaaacctttctcaaaaggcgccccttccacctccagcccagccaaggcattgccacaggtgagagatagatggaaggacctgactcatgctatcagcatcctggaatcagccaaagctagggtaactaatatgaagacttcaaaaccgattgtccactctcggaagaaataccggttccacaagacccgctccagaatgacgcaccgcacccctaaggttaagaaatcacccaaagtgagaaagaagtcctacctgtcgcgtcttatgctctctaataggttgcccttcagtgcggctaaatctctgatcaatagtccatcacagggtgctttctcgtccctcagggacctctccccccaggaaaaccctttcctggaggtgtccgcaccatctgaacatttcatcgaaaacaacaacaccaaagacactacagcccggaacgcctttgaggaaaatgtgtttatggaaaacactaacatgccagaaggaacaatcagtgagaatactaattacaaccacccgccggaggctgattcagccgggacggccttcaatcttgggccgaccgtgaaacaaacagaaaccaaatgggaatataataatgtgggaaccgatctcagccctgaaccaaaatcgttcaattatccactgctgagctcccccggagatcagttcgaaattcagttgactcagcagttgcaatcagtcatccctaataataacgtgcggcgtcttatcgcacacgtgatccgaaccctaaagatggactgtagcggcgcccatgtccaggttacttgtgcgaagctggtgagcaggacagggcacctgatgaaactgttgagcggacagcaggaggtcaaggcctccaaaattgagtgggatacagatcagtggaagactgagaactacatcaatgaatcgactgaagcccagtccgaacagaaagaaaagtctctggagtttactaaggagcttcctggatacggttacacgaagaagttgattttagccctcatcgtgaccggtatcctgacaatccttatcattctactttgcttgatcgaaatctgctgtcatagacggagtctacaggaggatgaggaggggttttcgcgagactcagaagcacctacagaggaggaaagcgaggctctgccctag

SEQ ID NO: 43031 - DNA, 2148 bp, Artificial Sequence
  Description of Artificial Sequence: Synthetic coding sequence
caccggaacttccagggcaactacatcagctacatcgacggcaacgtctggaaggcttattcatggaccgagaagctcatcctgagggagaacaacctcacagagctccacaaagatagtttcgaaggcctcctctccctccagtatctgatcttgaatcacaatcccctaacgacggtcgaggacccctacctgttcaaattgcctgccctaaagtacctagatatgggcaccacactcgtgcctttaacgacgctcaaaaatatcttaatgatgactgtggagcttgagaagctaattgtgccttcccacatggcttgttgtctctgtcaatttaaaaattccatcgaggctgtgtgcaagaccgtgaaattacactgtaactctgcctgcctcactaatactacacactgccccgaagaagcctccgtgggcaatcccgagggagctttcatgaaggttctgcaggcacgcaagaattacaccagtaccgagctcattatagagcctgaggagccgtctgacagctcaggcatcaatctcagtggtttcgggtctgagcagctggatacaaacgacgagtctgatgtgacctcgacgctctcttacattttaccctatttttctgcagttaacctagacgtgaagagtctgctgctgccatttattaagttgcctaccacaggtaactctctggcaaagattcaaactgtgggaaagaaccgacaaaggttaaatcgtgttttaatgggaccccgatctatacaaaagagacattttaaggaggtggggagacagtcaattaggagagagcagggcgcccaggcgagcgtggagaacaccgctgaagagaaacgtctgggatctcccgcgcccagggagctgaaacagccacatacacagcagggaccagaaaaattggcgggaaatgcagtgtatacaaagccttccttcacacaggagcacaaagctgccgtgagtgtcctgaaaccgttttctaaaggtgcaccttctacaagctcccctgcgaaggccctgccacaagtccgcgaccgatggaaagatcttacccatgccattagcattctggaatctgcaaaggcccgagttaccaacatgaaaacctctaagcccattgtccatagccggaaaaaatacagattccacaaaactcgatctcgtatgacacaccgcacccctaaagtgaagaaaagtcctaaagtacggaaaaaaagttatctttcaaggctgatgctctccaatcgtctgcccttctcggctgcgaaatccttaataaatagtcccagtcagggcgcgttctcctccttgcgagacctcagcccgcaggaaaacccttttctggaagtttctgccccctcagaacacttcatcgaaaacaacaacacaaaagataccacagctcggaacgctttcgaagagaatgtttttatggagaacaccaatatgcccgagggcactatcagtgaaaacacgaactacaaccacccccccgaagccgacagtgccggcacagcatttaatctggggcctaccgtgaaacagactgagacaaagtgggaatataataatgttggaaccgacttaagtcctgagcccaagtccttcaactatcctctcctaagctctccaggagatcagttcgaaattcaattaacacagcagctccagtcagtcatcccaaataacaatgtacgtaggctgatcgcccacgtgatcagaacactcaaaatggattgcagtggtgcacatgtccaggtgacatgcgcaaagctggtgtctcgcacagggcatctgatgaaattgctttccggacagcaggaagtaaaagccagtaagatcgaatgggatacggaccagtggaagacagagaactatataaacgagtcaaccgaggcacagtcagaacagaaggaaaagtctttggagttcaccaaggagctgccaggctacggctacacaaaaaagcttattctcgccctgattgtgaccggcatcctgacaatccttattatcctgctgtgtttgatcgagatttgttgtcaccggcgctctctacaagaggacgaggaaggcttttccagagattccgaagcaccaaccgaagaagaatcagaggcattgccatag

SEQ ID NO: 43032 - DNA, 2019 bp, Artificial Sequence
  Description of Artificial Sequence: Synthetic coding sequence
atgcagttcctgcacaagctgatcctgaaccacaaccccctgaccacagtggaagatccgtatctttttaagctgcccgcactaaagtacctagatatgggtacaacactggtccctctcaccacattgaaaaacattctcatgatgaccgtggagcttgagaaactgatagttcctagccatatggcctgctgcttatgccagttcaaaaactccatcgaggccgtgtgtaagacggtgaagttacactgcaattccgcctgccttaccaacaccacgcactgtccggaggaagcttctgtgggcaatcccgaaggtgcttttatgaaggttctgcaggcgcgaaaaaactacacctctactgagttgatcatcgagccagaagaaccctcggacagctctggcattaacctgagtggatttggcagcgaacagcttgataccaatgatgagtctgacgtgacttccaccctgtcttatattttaccttatttttccgcagtgaaccttgatgtaaaaagcctgttacttccctttatcaaactccctactaccggtaacagcctagccaaaattcagaccgtggggaagaatcggcagcggctgaatagggttctgatgggaccccgctccatccaaaaacgacattttaaagaggtgggtagacaatctatacgcagggagcagggagcccaagcgtcagtcgagaacaccgctgaggaaaaacggctcgggtctcccgcacctcgggaactaaaacaaccccacacccaacagggaccggaaaagctcgccggtaacgccgtgtatacgaagccgtccttcactcaggaacacaaggccgccgtaagcgtgctgaagccctttagcaagggcgctccatccacgtccagtcccgcaaaggcactacctcaggttcgcgatcgctggaaggacctgacccacgctattagtatcctcgaaagcgctaaggcccgggtgaccaacatgaaaacgagcaaaccaattgtacattcaagaaagaaatacaggttccacaagacaagaagccggatgacacacaggacaccaaaggtaaaaaaatcacctaaggtgcgcaagaaatcctacctgagtcgcttaatgctctccaataggttacctttttcagccgcaaagagccttattaactctccctcgcagggtgccttctcctctttacgtgacctcagccctcaggaaaatccctttttagaggtgagcgccccctcagaacacttcattgagaacaataatactaaggacaccaccgctcgaaacgcgttcgaggaaaacgtgttcatggagaataccaacatgccagaggggacaatcagcgagaatacaaattacaaccaccctcctgaagccgacagcgccgggaccgctttcaacctcggccccacagtgaaacagaccgagaccaaatgggagtacaataacgtgggaactgatctatcaccggaaccgaaaagcttcaactaccccctgttgagttccccaggggaccagttcgaaatccagcttactcagcagttacagtcggtcataccaaataataacgtccgacggctgatcgctcacgtcatcaggacccttaagatggactgcagtggagctcatgtccaagtcacctgtgcgaagctagtaagcagaaccgggcaccttatgaaactcttgagcggccagcaggaagtcaaggcttccaaaatcgagtgggatactgaccagtggaaaaccgaaaattacatcaacgaatccactgaggcacagtcggagcagaaagaaaaatctcttgagtttacaaaggagctgcctgggtacgggtacactaagaaactgatcctcgccctgatcgtgacaggaatactcaccattttgattatccttctgtgcttgattgaaatttgctgccatcgccgttcgcttcaggaagatgaggaggggttctcccgggatagcgaagcaccaacagaagaagaatcagaggccctcccgtag

SEQ ID NO: 43033 - DNA, 5103 bp, Artificial Sequence
  Description of Artificial Sequence: Synthetic coding sequence
atgagcagcgcccagtgccccgccctggtgtgcgtgatgagccggttgaggttttggggaccttggccgctccttatgtggcagctgctgtggttattggtgaaggaggcacaacccctggagtgggtcaaagacccactacagttaacttctaacccactcgggccacctgagagttggtcgagccacagctcacacttcccacgggaaagtccacacgccccaactctccccgctgatccatgggatttcgaccacctggggccatcggcctcaagtgaaatgccagccccaccccaggagagcactgaaaacttggtgccattcctcgacacgtgggattcagccggcgaacagccgctagagcccgagcagttcttggcttctcagcaggatctcaaggacaagctttccccccaggagaggctgccagtcagtcccaaaaaactgaagaaagacccagcccagcgctggtctctcgccgaaataatcgggatcacgcgacagctgagcaccccacagagccaaaaacaaacactgcagaatgagtattcatccaccgacactccatatccgggatctctgcctcctgaactcagggttaagtcagatgagccacctggcccctccgagcaagtgggtccatctcagttccatcttgagcctgaaacccagaatcctgaaacgctggaggacattcagagcagcagcctccagcaggaggctcctgcgcaactgccccagttgttagaagaggagccaagtagcatgcagcaggaggctcccgcactgccaccagagagttcaatggagagccttactctgccaaatcatgaagtgtcggtgcagcctccaggtgaggaccaggcctactaccacctgcccaatatcactgtgaagccagccgacgtggaagtcactatcacttcagaaccaaccaacgagaccgagtccagccaagcccagcaggagacacccattcagttccctgaggaagtggagccttcagcaactcaacaggaagccccaatcgagccccctgtgccgccgatggagcacgagctctcaatctctgaacaacagcagccagtgcagccaagtgaaagtccaagggaggtggagagctccccaacacagcaggagactccaggacaacctcctgagcaccatgaagtgactgtgtcccccccaggccaccaccagacgcaccatctggcttcacccagtgtgtccgttaaaccacccgacgtacaactcaccattgccgccgagccctcagcggaagtgggtacgtccctggtacaccaagaagccaccacacgattatccggctccgggaacgacgtggaaccaccagcaatacaacatgggggtccaccactactgcccgagtcatcagaggaagctggtccgctcgccgtccaacaggagacaagcttccagtctccagagccaattaacaacgaaaacccgagccccacacagcaagaagccgccgccgagcacccacagaccgccgaagaaggggaatcatcccttacacaccaggaagccccggcccagacccctgaattccccaatgttgttgtggctcaaccgcccgagcatagccaccttacacaagctactgtgcagcctctggatctgggtttcactataaccccggaaagcaagactgaggttgagctcagtcctacaatgaaggagactccaacacagcccccgaagaaagtcgttcctcagcttagggtgtatcagggggtcacaaacccgactccgggacaggatcaagcccagcatcctgtttctcctagcgttacagtacagctgcttgatcttggtcttactataactccggaaccgaccactgaagtaggccattccacacccccaaagcgaaccattgtcagtcctaaacaccccgaagtgaccctgccccaccccgatcaagtgcagacccagcattcacatctaacccgcgccactgtgcagcctctggacttgggttttaccatcacacctaagtccatgactgaggtcgagccctccacggcgctaatgaccacagcaccaccaccaggtcaccccgaagttacccttccgccttccgataagggacaggcccaacactctcatttgacccaggctacagtacagcccctggatctggaactgacaattaccaccaaaccaaccactgaggtgaaaccaagtccaactactgaggaaacttccacacagcctccggacctggggcttgcaattatcccggagcccacaactgagacaggacactctacagccttggaaaagacgacggccccacggcccgaccgagtgcagaccctgcaccgctccttgaccgaggtaacgggaccaccgacagagcttgagcccgcgcaggatagcctggtgcagtccgaaagctacacacagaataaggcccttacggctccagaggagcataaggcatctactagcacaaacatatgcgagctgtgtacctgtggagacgagatgctgagctgtatcgacctaaatcccgaacagagactcaggcaagtgccggtaccggagcccaacacacataacggcacttttaccattcttaacttccaggggaactatatctcttacattgacggaaatgtgtggaaagcttattcttggacagaaaagctcattctgcgggagaacaacttaacagaacttcacaaagactcctttgaaggactcctgagcctccagtatttggacctgagttgcaacaaaatccagtcaattgagaggcacacttttgaaccgctgcctttcttgaagtttataaacctgtcatgcaacgttattacagaactgtcttttggaacattccaggcgtggcacggtatgcagttcttgcataagctcattctgaatcacaatccgctcactacagttgaggacccatatctgttcaagctccctgctcttaagtatcttgacatgggcaccacactggtaccactcaccaccctcaaaaatatcctaatgatgaccgtcgagctagaaaagcttattctgccaagccacatggcttgctgtttgtgccagttcaaaaattctatcgaggcagtgtgcaaaactgtcaagctgcactgcaatagcgcctgtctgaccaataccacccattgcccagaggaggctagtgtcgggaatccggagggtgcgttcatgaaggtgctgcaggcccggaaaaattacacaagcacagaacttatcgtcgagcccgaggaacctagcgacagcagcgggattaacctgagcggatttgggtcggagcagctcgacaccaacgacgagtccgattttataagcaccctgtcatatatcctgccatacttttcagcagtgaacctcgatgtgaagtccctcttgctgccttttatcaaactcccgacaactggaaattcactggccaagattcagaccgttgggcagaacaggcagagggtgaagcgggtcctgatgggacctcggagcattcaaaagcggcatttcaaggaggtggggaggcaaagtatcaggcgggagcagggagcccaagcttcagtggaaaacgccgctgaggagaagagattgacctcccccgcccctagagaggtcgaacagccacacacacaacaggggcccgaaaaactggcaggcaatgctgtgtatactaaaccttcttttacgcaggaacacaaagctgcggttagcgtgctcaagcctttctctaaagggactccatctacctcctccccagcgaaggccctcccacaagtgagggaccgttctaaggatttaacccacgccatcagcatacttgagtccgcgaaagccagagtgactaacacgaaaacctcaaaacctattgtccatgcccggaagaagtaccggttccataagaccagatcgcatgtgacccacaggacaaccaaagtgaagaagagtccgaaagtccgtaagaagtcctatctttccagattaatgcttgccaatcggttgccattctctgccgctaaaagcctcattaacagtccctcccagggagcattctcctccctgggcgatcttagccctcaggagaatccttttttagaggtgagtgccctctccgagcacttcatcgaaaagaacaatactaagcataccacggccaggaatgcctttgaggagaacgacttcatggaaaacaccaacatgccagaaggaaccatctcagaaaacactaactataatcaccctcccgaagccgatagcgctgggaccgcctttaatcttggaccaaccgtgaaacaaacggagaccaagtgggagtacaataatgtgggaacagatctcagccccgagcctaaatcttttaattaccctttattgagcagtcccggcgatcagtttgaaatccagctgacgcagcaactgcagagtctgatccctaacaataacgtccgccggctgatcgcccacgtaatacggacacttaagatggattgctccggcgcccacgttcaggttacatgcgcaaagttgatcagccggaccggacatctcatgaaactgctcagcggacagcaggaagtgaaggcttcaaagatcgagtgggatacagatcagtggaaaatcgaaaactatatcaacgaatcaaccgaggcgcagagtgaacagaaagagaagagtctggagctgaagaaggaggtccctgggtatgggtacaccgataaactgatcctcgcgttgatcgtgacaggaatcctcacaattcttattatccttttctgcctgattgtcatatgttgccacaggcgcagtctgcaggaagacgaggagggattctccaggggcatattccgttttcttccgtggaggggctgtagtagtcgcagggaatcccaggatgggcttagcagttttggacagcctttatggtttaaggatttgtataaaccactgtctgcaacgagaatcaacaatcacgcctggaagttacataaaaagagtagtaatgaagacaagatccttaacagggaccctggtgactctgaagccccaacagaggaagaggaatctgaggcgctgccatag

SEQ ID NO: 43034 - DNA, 5103 bp, Artificial Sequence
  Description of Artificial Sequence: Synthetic coding sequence
atgagcagcgcccagtgccccgccctggtgtgcgtgatgagccggctccggttttgggggccttggcccctgttgatgtggcagctgctttggctgctggtcaaggaagcacaacctcttgagtgggtgaaagatcctctccagctcactagcaacccgttaggcccacctgagagttggtcctctcatagcagtcactttcctcgtgagagccctcacgcaccaacattgccggctgatccttgggactttgaccatctgggcccttctgcctcctctgaaatgcctgccccaccccaagagtctaccgaaaacctggtgcctttcctcgacacctgggactctgccggtgagcagccacttgaacctgaacagtttttggcctcccagcaggacctgaaggataaactgagtccccaggaaaggctaccagtttctccaaaaaagctcaagaaggatcctgcacagcggtggagcttggcggagattatcgggattactaggcagttgtccactcctcaaagtcaaaaacaaactctgcagaacgagtacagtagtaccgacaccccctaccctggcagcctgcctccagagctgagggtcaaatcagacgaaccccccggaccatcagagcaggtaggtccttcacagtttcacctggaacctgagacacagaacccggaaaccctggaggacatccagtcttcatctcttcagcaggaggcgccggctcagctcccccagctgctggaggaagaaccatccagtatgcagcaagaggctccagcactgccccctgagtcttctatggaatcactgactcttccaaaccacgaagtgtccgtgcaaccccctggagaagaccaagcttattaccacctgccaaacatcaccgtgaagcccgcagacgtcgaagttactattactagcgagccgacaaacgaaacggaaagtagccaggcccagcaggagacacccattcagttcccggaggaagtggaaccttctgctacgcaacaggaagcacctatcgagcctcctgttccccctatggagcacgagctttccataagcgaacagcagcagcccgttcagccctccgaatctccccgcgaggtcgaatcatcaccaacacaacaggagaccccaggtcagcctcctgaacaccacgaagtcaccgtaagcccccctggacaccaccaaacacatcatttagcctccccaagcgttagtgtgaagccaccggacgtgcagctgactatcgccgctgaaccttcagccgaggtgggaacctcgctggtgcatcaggaggctactacccgcttgagcggaagcggcaatgacgtagaacccccagcaatccagcacggtggaccacccttgctgcccgaatcatcagaggaagcgggcccgctggcagtgcagcaggagacttcgtttcaaagtccggaaccaataaacaacgagaatccctccccgactcaacaagaggcagctgccgagcacccccagaccgctgaagaaggagaatcgtctctgacccaccaagaggcacccgcacaaacccccgagttccccaacgtcgtcgtcgcccaaccaccagaacattcacacttgacacaggccaccgtgcagcctcttgatctgggcttcacaatcaccccggagagtaagacagaggttgaactgagccctacaatgaaagaaacccccacccagccccccaagaaagttgtaccgcagctgcgtgtgtaccagggggtgaccaaccctacgcctggtcaggaccaggcccagcaccctgtttcccctagtgtgaccgtgcagctgctcgatcttggcctgactatcacgcccgaacccacaaccgaagttggtcactcaaccccgccaaaaagaacaatcgtaagtcccaagcacccggaagttaccctcccacaccccgaccaggtgcagacccagcacagccacctcactcgggcaacggtacagcctctcgatttgggttttactatcactcccaagagcatgactgaagtggagccgagcaccgccctcatgaccactgcaccccctcccggccatccagaggtgacactgccaccaagcgataaggggcaggctcagcactcgcacctaactcaagccactgtgcagccccttgacctcgagcttactataacgaccaagcccacaactgaggtgaaaccctcacctaccacagaagagacgagcacgcagccgcccgacttgggacttgctattattcctgaacctaccacggagacaggccactctaccgctttagaaaagactacagccccacgccctgaccgcgtgcaaacgcttcacagatcgctcacagaagtgactggcccgcctaccgaactggagcccgcacaggatagtttagtgcagagcgagagttacactcagaacaaggccctgactgccccagaagagcacaaagcaagcacatccaccaatatttgcgaactttgtacctgcggagacgagatgctgagctgtatcgaccttaatccagagcagaggctcagacaggtgccagttccggaacctaacacccataacgggacttttactatactcaatttccaggggaactacattagctacatcgatgggaacgtctggaaggcatactcttggactgagaaactgatcttgcgcgagaacaatctcaccgaactccacaaggactccttcgaggggttgctctctttgcaatacttggatctgagctgtaataaaattcagagtatcgagcgtcacacctttgaacctttgccattcctaaagttcataaacctctcttgcaacgtaattacagaattgagctttggaactttccaagcatggcacgggatgcaattccttcacaaactgattctgaaccacaacccactgactacagtagaggacccctatctcttcaagctacctgcactgaagtatttggatatggggaccacattggtgccgctgactactttaaagaatattctgatgatgaccgtcgaactggagaaattaattctaccttctcatatggcttgttgcctgtgccagtttaagaacagtattgaagccgtgtgcaagactgttaaattacattgtaacagtgcatgtttaacaaatactacccactgtcctgaagaagcctcagtgggcaatccggaaggagcttttatgaaggtgctacaggcacggaagaattacaccagcaccgagcttatcgtcgagcccgaagagcctagcgattcctcgggaatcaacctgtccggattcggctcagaacagctggatacaaatgacgagtcagactttatttctacattgtcctatattctgccttacttttctgctgtcaatttggacgtgaagagtttgctccttccattcatcaaattgcccactacgggaaacagcctggccaaaatccagactgtgggtcagaatagacagcgcgtgaaacgagtgctgatgggaccaagaagtatccagaagcgccattttaaagaggtcggtaggcagtcgattagaagagagcagggcgcacaagcatctgtcgaaaatgccgcggaggagaaaaggttgacgtctcccgcccctagggaggtcgagcagccacacactcaacaggggccggagaagctagccggtaacgcagtgtataccaaaccgagcttcacacaggaacacaaggctgcagtgtctgtcctgaaaccattttccaagggaacaccgtcaacctcttccccagcaaaggccctcccccaagtgagagatcgatccaaggatctgactcatgcaatctcgattctggaaagtgccaaagcccgtgttaccaatacaaagacgagtaaaccaattgtgcacgcaagaaaaaagtatcgatttcataaaacccgcagtcacgtaacgcatcgaaccactaaggttaaaaagagcccaaaagtccgtaaaaagagctacttgtcacgcttaatgttggctaacagattacctttctcagctgctaagtctcttatcaatagtccaagccagggcgctttcagctcccttggagacctgtccccacaggagaacccatttttagaggtatccgcactgtctgagcattttatagagaaaaataacaccaagcacactaccgccagaaacgctttcgaagagaatgattttatggagaacaccaacatgcctgaaggcaccatcagtgaaaacactaattacaaccatccacccgaggccgacagtgcaggcactgcatttaaccttggacctaccgttaagcaaaccgaaacaaaatgggagtacaataatgtgggtacagacctgtcacccgagcccaaatcattcaactatcctctgctcagtagccccggcgaccagttcgagatccaactgacacagcagctgcaatctctgattcccaataacaatgtccgacgcctcattgcccacgtgatccgcactctgaagatggactgctctggggctcacgtgcaggttacgtgcgccaaactgatttctaggacgggccatttaatgaagcttctgagcggccagcaggaggtaaaagcttctaaaattgaatgggacaccgaccagtggaagatcgaaaactacatcaacgaatcgacagaggcacagtctgaacaaaaagagaaatcactcgaactgaaaaaagaggtcccagggtacggatacaccgacaaacttatcctggccttgatcgtgacggggatcttgacgatcctgatcatcttgttttgccttatagtgatatgctgccataggagaagcctccaggaggatgaggaaggcttctctagggggatattccgctttctgccatggcgcgggtgcagttcaagacgggagtctcaggatggcctttctagcttcggccaacccctgtggttcaaggatctgtataagccactcagcgcaacgcggattaataatcatgcatggaaattgcataaaaaatcttccaacgaggataagatcctgaaccgtgaccctggcgacagtgaagctccaacagaggaagaggagagtgaagcccttccttag

SEQ ID NO: 43035 - DNA, 2925 bp, Artificial Sequence
  Description of Artificial Sequence: Synthetic coding sequence
atggcccacgcctacaagggccacgagcacctgcgggccgcccggatggcttttgccgaatgcatagcccctgcttgcgtgatgtcctggctccgattctgggggccatggccactgttaacctggcaactcctgagcttactggtgaaagaggctcaacctctggtctgggtcaaggatccattgcagctgacttcaaatcccctgggaccccctgagccctggagttccaggtctagccacctgccatgggagagtcctcacgccccagcccctccggcagccccgggcgatttcgactatttaggccccagtgcctcatcccaaatgagtgctcttcctcaggaaccaaccgagaatctggccccctttctcaaggagcttgacagcgcaggcgaactccccctcgggccagaacctttcttggcagctcaccaagatttaaacgataagcgcacgcctgaagaaaggctgcctgaggtcgtgccactgcttaatcgggaccagaatcaagctctcgtgcaactgcctagactcaaatgggtgcagacaacggacctagatcgggcggctggacatcaggctgatgaaattctggtgccactggactctaaggtctctcgacccacgaagtttgtggtcagtccaaagaacttaaaaaaggatttggcagagaggtggtcacttcctgaaatcgtgggcataccccaccagctttctaagccccaaagacagaagcagactctgcccgatgactacctctcgatggatacactttaccccggttctctgccccccgagttaagagttaatgctgacgagccaccaggtcctcctgaacaggtggggctgagtcaatttcacttagaacctaaaagtcagaaccccgagacgttggaggacattcagtcctcgtctttacaggaagaggcccccgcccagctgctgcaactgccccaggaggtggaaccgtccacccagcaggaggcccccgccctcccgcccgaatcgtctatggaatccttagcccaaacacctcttaatcatgaggttaccgtgcagccacccggcgaggaccaagcacactataatttacccaaattcacggtgaaacccgcagacgtggaggtcaccatgacttcagagcccaaaaacgagaccgagtccacccaagcacagcaggaggccccaatacagccacctgaggaggcagagccctctagcactgccctgcgcaccactgacccccccccagagcacccggaggtgactcttccaccatctgataagggccaggcgcagcacagccatctgactgaagccacagtgcagcccttggacctggaactgtctatcactaccgagcctacaaccgaagtgaagccttctccgactacagaggaaaccagcgcgcagccccctgatcctggactcgcgatcacccctgaaccaactactgagatcggccacagcaccgctctggagaagacacgtgcaccccaccccgatcaagtgcaaacactgcatcggagtctcaccgaagttacaggcccccctaccaaactcgaatcatctcaggactccctcgtgcagtcagaaaccgcccctgaggagcagaaggccagtacctccacaaacatctgtgagctatgtacgtgtggagacgaaaccttgtcttgcgtcggccttagtcctaaacagaggctgaggcaagtgccggtgccagaacccgatacttacaacggcatatttaccactctaaattttcagggaaactatatttcttaccttgatggcaacgtatggaaagcatacagttggactgaaaagttgattctcagcgagaattacctcactgaacttcccaaggatagctttgaaggcctattgtatctacaatatcttgacctgtcctgtaataagattcgctatatcgagcgacagacttttgagagcctgccttttctgcagtacattaatctggggtgtaacttgatcaccaagctgtccctgggaacatttcaagcctggcacggcatgcagttcctgcataatctcattctgaatcgcaatcccctaaccaccgttgaggatccttacctcttcgaactgcctgccctgaaatatctggacatggggactacacatattactctgacaactttgaaaaatatcctgacaatgacagtggaactggaaaagcttatactgccaagtcacatggcctgctgcctgtgtcagtttaagaatagtattgaggccgtgtgtaaaacagtgaaattgcactgtaacacggcctgcctgaccaattcaatccactgtcccgaagaagccagcgtggggaatcccgaaggagcctttatgaagatgctccaagccaggaagcaacatatgtccactcaactgacgatcgaaagcgaagcgccttccgatagttccgggattaatctatctggtttcggaggcgaccagctggaaattcagctgacagagcaactgcggtcactgatccccaacgaagacgttcggaagttcatgtcacatgtgatcaggactctgaaaatggaatgctccgaaacgcacgtgcaaggatcctgtgcgaagctgatgctccgcaccgggctgttgatgaagctgttatcagagcagcaggaagctaaagccctgaatgtagaatgggacaccgaccagcagaagaccaactacattaacgaaaacatggaacagaatgagcagaaagagcagaaatcttccgagctgatgaaggaagttcccggcgacgactacaagaacaagcttatctttgcaatctcagtcaccgtcatccttattattctgattatcatattttgtctgattgaggtgaattcccataaacgggcctctgaaaaatataaggataatccgagtatttctggagcttag

SEQ ID NO: 43036 - DNA, 2844 bp, Artificial Sequence
  Description of Artificial Sequence: Synthetic coding sequence
atgagctggctgcggttctggggcccctggcccctgctgacctggcagctgctcagcctccttgtgaaagaggcacaaccccttgtctgggtcaaggatcctctgcagctgacctccaaccctctcgggccgcctgaaccatggtcttcccgctcatctcaccttccttgggagtcgcctcatgcaccagccccgccagccgctccaggcgacttcgactatctcgggccatcagcgagttctcagatgagcgccctcccgcaggagccgaccgagaatttggctccttttcttaaagaactcgacagtgcgggtgagttgcccctggggcctgagccattccttgctgctcatcaagacttgaacgacaagcggacccctgaggagcggctgcctgaggtggtccccctcctcaatagagaccagaaccaagccctcgtgcagttgcccagattgaagtgggttcagacgactgacctggatagagcagctggtcatcaggccgacgagattctggtgcctctggattcaaaagtctcacgccccaccaagtttgtggttagccccaaaaacctcaagaaagatctagcagagaggtggagccttccagagatagtcggaattccgcaccagctgtccaaaccacagcgccaaaaacagacactgcctgacgattaccttagcatggacaccctctatccaggcagcctgcctcctgagctgcgagttaatgcagacgaacctcctggaccccctgaacaggttgggctatctcagttccacctggagcccaagtcacaaaacccagagacattggaggacattcagagcagttccttgcaggaagaagcacccgcgcagctcttgcagcttcctcaagaagtagagcccagtacgcagcaggaagcccctgccctaccccctgagagttctatggagtcattagctcagactcctttgaatcatgaggtaactgtccaaccccccggggaggatcaggcccattacaatctgccaaaatttactgtcaaacctgctgatgtggaagtaaccatgaccagcgaacctaaaaacgagaccgaaagcacacaggcccaacaggaagccccgattcagccaccagaagaagccgagcctagtagcactgcgctgagaactactgaccctccccctgaacatcctgaggttaccctccctcctagcgacaaggggcaggcccaacatagtcatcttacagaggctacagtgcagccacttgatctggagcttagcataaccaccgagcccacaaccgaggttaaacctagtcctactacggaagaaacgtccgcccagccccccgaccccggactggccatcacccccgagcctacaactgaaattgggcatagcactgctctcgagaagacacgcgcacctcatccagaccaggttcagaccctgcaccgttctctgactgaggtgaccggcccacccacaaaactggagtcatcacaggattctcttgtgcagagcgaaacagctcccgaagaacagaaagcaagtacatccaccaatatctgcgaactgtgcacatgcggcgacgaaactctctcttgtgtgggcctgtccccaaagcagcggctcaggcaagtacctgtacctgaacctgacacatacaatggcattttcactaccctgaattttcagggtaattacatctcctaccttgatggaaacgtgtggaaagcgtactcatggaccgagaagctgatcctaagcgaaaactatctgacggaactgcccaaggattctttcgagggtctgctttacctccagtatctcgacctatcgtgtaacaagattcgttatatagaaagacagacgtttgaaagcctacccttcctgcagtacatcaacctgggatgcaatctgatcaccaaattatcacttggtaccttccaggcatggcatgggatgcagttcctgcataacctgattctcaatcggaacccattgacaaccgtggaggacccctatttattcgaactccccgcattgaagtacctcgatatgggaactacacacatcacgctgacaaccctgaaaaatatcttaactatgactgtggaactggaaaaattgatcctcccatcacatatggcctgttgcctctgccagttcaagaactctatcgaagcggtgtgcaagactgtgaaactgcactgtaacacagcttgccttaccaactcaattcactgtcctgaagaagctagtgtcggcaaccctgaaggtgcctttatgaagatgctccaggccaggaaacagcacatgagtacacagctcaccattgaaagcgaagctccttccgactcatcaggcatcaatctgtcgggttttgggggcgatcagctagaaattcaattgactgaacaactacgttccttgatccctaatgaggatgttcgcaaattcatgtcgcacgtaatcagaactctgaagatggaatgctccgaaacacacgtgcaaggctcctgcgcaaagctgatgctgcggacaggcttattaatgaaacttctgagtgaacaacaagaggcaaaggctctcaacgtcgagtgggataccgaccagcagaagacaaactatatcaacgagaacatggagcaaaacgaacagaaggaacagaagagctctgagttgatgaaggaggttccaggtgacgattacaaaaacaaactgattttcgctatctctgtcacggtcatccttattattcttattatcatcttctgtcttatagaggtcaactctcacaaaagagccagcgagaagtacaaggacaaccctagtatctccggggcttag

SEQ ID NO: 43037 - DNA, 2691 bp, Artificial Sequence
  Description of Artificial Sequence: Synthetic coding sequence
atgagctggctgcggttctggggcccctggcccctgctgacctggcagctgctgtccctcctggtgaaagaggcccagccactcgtttgggtgaaagatccattacagctgacaagtaatccactcggtccacctgaaccctggtcgtccagatcatcacacctcccctgggagtcaccgcatgctcctgctccacccgccgcccccggagattttgactatctcggccccagcgcgtcctcacagatgtctgctcttccgcaggagcccaccgagaatctcgcccccttcttgaaggagctcgatagtgccggcgagttgccgctgggacccgaaccatttctggctgctcatcaggatctgaacgataagcgcacgccagaggagcggcttccagaagttgttccgttactgaacagggatcaaaaccaggccctcgtgcagctgcccagactgaagtgggtacagactacagacctggatagagctgccggccatcaagccgatgaaatcttagtccccttggatagcaaagtttctcgaccaacaaagttcgttgtgtcacctaagaatctcaagaaagacctggcagagcgatggtctctccccgagattgttggaattcctcaccagctctctaaaccacaacggcaaaaacagacgctccctgacgactacctgtccatggatacactatatccgggttctttgcctcctgagttgcgtgttaatgcggatgagccaccaggcccccctgagcaggtgggactgtcccagttccatctcgaacctaagagtcaaaaccctgaaacgctcgaagatattcaaagttccagtttacaggaggaggccccggcccagctgctgcagctgcctcaggaggtagagccatcaactcagcaggaagcacccgccctgccgcctgagagttccatggagagtctcgctcagacacccttaaatcatgaggttacagtccagcctcctggggaggaccaggcccactacaacctacccaaatttacagtgaagccagccgatgtggaggtgacaatgacatcagagcccaaaaatgagacggaatcaacccaggcacagcaggaggctcccatccaacctccggaagaagctgagccaagctcaacagcattaagaacaactgatccccctccggaacatccggaggtcacactccctccgtccgataagggacaggcccagcacagtcacctgaccgaggcaacggtccaaccattagaccttgagctctctatcactaccgaacccaccaccgaggtaaaaccctcacctaccacggaagagacgagtgctcagccccctgacccgggccttgcaatcacgcccgaaccaaccacagagatcggacacagtactgcactggaaaagacccgagcaccccaccctgatcaggttcagactctccatagatctttgaccgaggtcacaggcccgcccactaaactcgagtctagtcaggattcattggtccagagcgaaaccgctcctgaggagcagaaagcctctaccagcacgaacatctgcgagctatgtacgtgtggtgatgagaccctttcttgcgtggggttgtctccaaaacagcggctcagacaggtgcccgtccctgagcctgatacatacaatgggatattcactaccctgaactttcagggaaactatatttcatatcttgatgggaatgtgtggaaggcatatagttggactgagaagttgattttgagcgagaattacctgactgaactgccaaaagattcctttgaaggacttctctatttacagtatctcatcctcaatagaaaccctcttactactgtggaagatccttacctcttcgagttaccagcactaaaatatctggacatgggcactacgcacataacattgacaactctgaaaaatattcttactatgaccgtcgaactggagaagctgattttgccatctcatatggcatgctgcctgtgtcagttcaaaaactccatcgaggctgtatgtaagaccgtgaaactccattgcaataccgcatgtttgaccaatagcatccactgccctgaggaagcatctgtaggcaatcctgagggagcatttatgaaaatgctgcaggctagaaagcagcatatgtcgactcagttgactattgaaagcgaagccccaagtgacagttctggcataaacttgtccgggtttggaggagaccaactggagatccagctcactgagcaactgcggtcactgatccctaatgaggatgtgcgcaagttcatgtcccacgtgatcaggacactgaaaatggaatgctcagaaactcacgtgcagggaagttgtgccaagctgatgctgcggacagggctacttatgaagctcttgtccgagcagcaggaagcgaaagccttaaacgtcgaatgggatacagaccagcagaagacaaactacattaacgagaacatggagcagaatgagcagaaggagcaaaagtcttcggagctcatgaaggaggtgcctggagatgattacaaaaacaagctgatcttcgccatctcggtgacagtcattctcatcattctgattattattttctgcttgatcgaggtgaactcccacaaacgggcttctgaaaaatataaggataacccctccatcagtggcgcctag

SEQ ID NO: 43038 - DNA, 2598 bp, Artificial Sequence
  Description of Artificial Sequence: Synthetic coding sequence
atgagcgccctgccccaggagcccaccgagaacctggcccccttcttaaaggaacttgacagcgcaggagaactcccgctgggtcccgaaccttttttggctgctcaccaggacctcaatgacaagcggacacccgaagagcgactgccagaggttgttcccctgttaaacagagaccagaaccaggccctggtacagctgcctagacttaagtgggtgcagacgacagaccttgatagagccgccggacaccaggcagatgagatcctggtgccactcgatagtaaagtgagtcgccctacgaagtttgtggtgtcacctaagaatctgaaaaaggacctcgccgagcgatggagcctgccagaaatcgtcggaattccacaccaattatccaagccacagcgccagaagcagacattaccagacgactacttgtcaatggacaccctataccctggttcacttccacctgagctacgagtcaacgcggatgagcctccgggacctccagaacaggtgggcctgagccagttccaccttgaaccaaagtcccagaaccccgagacccttgaggacattcagtcctcttccctccaggaagaggcacctgcccagttgttgcagctgcctcaggaagttgagcctagcacgcagcaggaagcaccggctctccccccagagtcaagcatggagtctttggcgcagactcccctgaaccacgaagtgacagtgcagccgcccggagaggatcaggcccattataatctgcccaaattcactgtgaagcccgccgacgtagaggtcactatgacatctgaaccaaagaatgagaccgaatctacacaagcacaacaagaggcccctattcagcccccagaggaagccgagccctcatctaccgctctgcgcaccaccgaccctccaccagaacatcctgaagtgacactacctccgagtgataaggggcaggcccagcatagtcacctcaccgaggctactgtgcagccgctggatctcgaactcagcatcaccacagagcccaccaccgaggtgaagccctcccccactaccgaagaaacaagcgcccagcctcctgaccccggtttagctattacgcctgagcctacgaccgagatagggcacagtaccgcactggagaagacgagggcaccacaccctgatcaggtgcagacccttcaccgttctttgaccgaggtgacagggccacctacaaaactggagtccagccaggattcattggtgcagagcgagactgctccagaggaacaaaaggcttcaacaagcaccaatatttgcgaactatgcacatgtggagatgagaccctctcctgcgtagggttatcacctaaacagaggctaaggcaggtacccgtgcccgagcccgatacctataatggaatcttcacgacccttaacttccagggtaattacatatcctacctggacggcaacgtatggaaagcatacagctggactgaaaagctgattctcagcgagaattacctgaccgaacttcccaaagattcctttgaaggcctgttatacctacagtacctggacttgtcctgcaataaaattcgctatatagagcggcagacatttgagagcctcccctttctgcagtatatcaatctcggttgcaatcttattacaaagctctctctcgggacatttcaggcctggcacggaatgcagttcctgcacaacctaatcttaaacaggaatcctttgacgacagtggaggacccctacctgttcgaactgccggcgctaaagtatctggatatgggtacgacccatattaccttgacgacactcaagaatatcctcactatgaccgttgaacttgagaagctaattctgccatcccacatggcatgttgtctctgtcaatttaaaaactccatcgaagccgtatgtaaaaccgtcaagctccattgcaataccgcatgcctgactaatagtatacattgccccgaggaggcatctgtaggtaaccccgagggggcgttcatgaagatgctgcaggctcgaaaacagcatatgtccactcagcttacaatagaatccgaagccccatcagatagctctgggatcaatctgagcggattcggaggagaccagttagagattcagttgactgagcaattacgatctctgattcctaacgaagatgtgcgaaaattcatgtcacatgtgatccgcactctaaagatggagtgtagcgagacacacgttcagggaagctgtgccaaacttatgctccgtaccggactattgatgaagctcctgtccgagcagcaggaagccaaggccctgaacgttgagtgggataccgatcagcagaaaacaaactacattaacgagaacatggagcagaacgaacagaaggaacagaagagctccgaattgatgaaggaggtgcccggcgacgactataaaaataagcttatcttcgctatatccgtgacggtgattctgatcatccttatcatcatattttgcttgattgaagtgaatagccacaagcgtgcatctgaaaagtacaaggataatcccagtatatctggcgcatag

SEQ ID NO: 43039 - DNA, 885 bp, Artificial Sequence
  Description of Artificial Sequence: Synthetic coding sequence
atgcggccccgggcccccgcctgcgccgccgccgccctgggcctgtgcagcttactgctgcttctggcgcccggccatgcctgcccggccggctgtgcttgcacagatccccataccgttgactgccgcgatcgtggcttaccctcggtgcctgaccccttccctctggatgtgagaaaacttcttgtggccggcaatcgtatccagcgcattcccgaagacttcttcattttctacggagatctggtctacctcgatttccggaataactccctccgcagtctggaggagggcactttctctgggagcgccaaactagtgtttttggacctttcttataacaacctgactcagttaggagccggagcatttcgttccgccgggaggctggtgaagctgtccctcgccaataataatcttgtgggagttcatgaggatgcctttgagacccttgagtctctgcaggtgttagagttaaatgacaacaacctcagaagtctctctgtggcggcgctggcagccctgcctgccttaagatctctacggttggacggcaatccatggttgtgcgattgcgatttcgctcacctgttctcatggattcaggagaacgcctctaaactaccaaagggtctcgacgaaatccaatgcagcctgccaatggagagtcgccgcattagcttgcgcgaattgtccgaggcctcctttagtgagtgcaggttttccctgtcgcttaccgatctgtgcatcatcatattttcaggggtcgccgtgagcattgcagccataatttcatctttttttctcgccaccgtagtccaatgtctgcagagatgtgccccgaataaggatgctgaggacgaggacgaggacaaagatgactag

SEQ ID NO: 43040 - DNA, 780 bp, Artificial Sequence
  Description of Artificial Sequence: Synthetic coding sequence
atgaacctggtggacctgtggctgacccggagcctgagcatgtgcttgttactgcagtctttcgtgctaatgatactctgttttcattccgcttccatgtgtcctaaaggctgtctgtgtagctctagtggcgggctcaatgtcacctgctccaatgcgaatcttaaggaaattccgcgcgatctcccaccagagactgtgcttctctatctagactccaatcagattactagcatccctaacgaaattttcaaggacttgcaccaactgagagtgcttaacctgagtaagaacggcatcgaatttattgatgagcacgcctttaaaggcgtagccgagactctccagacactggaccttagcgacaaccgcattcaaagcgtgcacaaaaatgccttcaataatttaaaagctcgagcgcgcatcgcgaacaacccctggcactgcgactgcacactgcagcaggttctgcgttcaatggcttccaatcatgagacagcacataatgtgatttgtaagactagtgtcctggacgagcacgccggcaggccctttctcaacgctgcaaatgacgccgatctgtgcaatctgcctaaaaagactaccgattacgctatgttggttactatgtttgggtggtttacaatggtcatttcatatgttgtatactacgtgcggcagaatcaagaggacgcccgccgacatctcgaatacctgaaatctctgccttctcggcagaaaaaagctgatgaaccagatgacattagcacggtagtttag

SEQ ID NO: 43041 - DNA, 168 bp, Artificial Sequence
  Description of Artificial Sequence: Synthetic coding sequence
atgaacctggtggacctgtggctgacccggagcctgagcatgtgccttttgctgcagagttttgtcttaatgattttgtgctttcactcagcgtccatgtgtccaaaaggttgtttgtgctcgagctccggtggcttgaatgtcacttgttccaatgccaatctttag

SEQ ID NO: 43042 - DNA, 780 bp, Artificial Sequence
  Description of Artificial Sequence: Synthetic coding sequence
atgaacctggtggacctgtggctgacccggagcctgagcatgtgcctcctcctacagtctttcgtgcttatgatcctctgcttccacagtgcaagcatgtgtccgaaagggtgcctgtgttccagctctggggggctgaacgttacctgctccaatgcaaacctcaaggagatcccccgagatttgccacctgagaccgttcttctttacctggacagtaaccagattacctctatccccaacgagatttttaaggacttacaccagctccgggtgctgaacctgagtaagaatggaattgagtttatcgatgagcatgctttcaaaggcgtggccgagacactgcaaaccctagatctctcagacaatcgaatccagagtgtacataaaaacgccttcaacaacttgaaagctagagctagaatagccaataatccctggcactgcgactgcacccttcagcaagtactccgcagcatggcttcaaatcacgagaccgcccacaatgtgatttgcaagacatctgtcctggacgaacatgccggacgcccatttttgaacgcagcaaacgatgccgacctgtgcaatttgcctaagaagacaaccgattatgctatgctcgttacaatgtttggatggttcaccatggtgatctcatacgtggtctactacgtgaggcagaatcaggaagacgctcggcgccatcttgaatatctgaaatccctgccctctaggcaaaaaaaggcagatgagccggatgacatttccaccgtcgtctag

SEQ ID NO: 43043 - DNA, 492 bp, Artificial Sequence
  Description of Artificial Sequence: Synthetic coding sequence
atgaacctggtggacctgtggctgacccggagcctgagcatgtgccttttattgcagtcattcgtcctcatgattctttgctttcattccgcctcaatgtgccccaaaggatgtctgtgctcctcgtctggtggtctgaatgttacttgcagtaatgctaatctgaaggaaatcccacgagacctgccgcccgaaacagtgttgctttacttagacagcaaccagataacaagcattccgaatgaaatatttaaggatctgcatcaacttcgcgtcctaaacctgagtaagaacggtattgagtttatcgatgagcacgccttcaagggggtagccgagacactgcagacactggatttgtcagacaacaggattcagtccgtacataaaaacgcctttaacaatttgaaggcacgggcccgaatagcaaacaacccttggcactgcgactgtaccctgcagcaggttctgaggtccatggctagcaactag

SEQ ID NO: 43044 - DNA, 780 bp, Artificial Sequence
  Description of Artificial Sequence: Synthetic coding sequence
atgaacctggtggacctgtggctgacccggagcctgagcatgtgcctgttgctccagagtttcgtcttaatgatcctgtgcttccactctgctagtatgtgccccaagggctgtctatgctcttcatctggaggactcaacgtgacctgctctaatgcaaatctcaaagagatcccaagggatctacctcctgaaaccgtgttgctgtatctggactccaatcagattacttcaattccgaatgagatttttaaagatctgcaccagctacgcgtcctcaacctgtcgaagaatgggattgagttcattgatgagcacgccttcaagggtgttgccgagacactgcagactctggatttaagcgataatcgcattcagtcagtacacaagaatgcattcaataacttgaaggcgcgggcccggatcgcaaataacccatggcactgcgattgtaccttgcagcaggttctgaggagcatggccagcaatcatgaaaccgcacataatgtgatctgtaaaacatccgtgcttgacgaacacgccggacggccattcctgaatgctgccaatgatgcagacctctgtaacttgcctaagaagaccactgattacgctatgctggtcactatgtttgggtggttcaccatggttatctcatatgttgtgtattacgtgcgccagaaccaggaggacgctaggagacacctggagtacttgaaaagtctgcctagtcggcaaaaaaaagccgatgagcccgatgatattagcactgtcgtttag

SEQ ID NO: 43045 - DNA, 828 bp, Artificial Sequence
  Description of Artificial Sequence: Synthetic coding sequence
atgcggatgaccagcagcagcttcgtgagctactgcacccccggcctttgccagtttatggccatgctgccaacagcaggtcacttgctgcctctcctgctggtgatcggaacaggtggcactgtcccctcccctcaggtacctccaagggggtgctatgtggccaaagaggctggagagcgaacattcaggtgctcccaggctggcctttctgcggtgccatcaggaattcccaacgatactagaaagctctatctcgatgccaatcagctggctagcgtgccagcaggcgcatttcaacatctaccagtgctcgaagagttagatcttagtcacaacgcactggcacatctctcaggagctgcatttcaaggtctggagggaacccttaggcatctcgacctttccgccaatcagctcgcttcagtacctgtggaggcgttcgtaggactgcaaatccaagtgaatttatctgctaacccgtggcattgcgattgcgcgctacaggaagtgctgcgacaggtacgactcgtgccaggcacgggtacaggcatagtgtgcggctcaggagcaaggcccgacctcgtagggcaagaatttctgttacttgcaggcgaggaggagttgtgtggcagtgggtgggggggagccagaagaagcactgatgtggccctgctagtcactatgggaggctggctgactctgatggtcgcttacctcgttcattacgtgtggcaaaaccgggatgagaccagacgctccctaaagagagcccccgtgctccccgtgcggtcagaagattctagtattctgagcacagtcgtgtag

SEQ ID NO: 43046 - DNA, 1962 bp, Artificial Sequence
  Description of Artificial Sequence: Synthetic coding sequence
atgaagctgctgtggcaggtgaccgtgcaccaccacacctggaacgccatactgctgccgtttgtgtacctgactgcacaggtgtggatcttgtgcgctgcgatcgcagcagcagcctctgctggccctcagaactgcccttctgtgtgctcatgtagtaatcaattctccaaagtggtttgcactcgccggggcctctcggaagtgccccagggcatcccatccaatactcgatatctgaaccttatggagaacaacatccagatgattcaggccgacacgtttaggcacctgcatcatttggaggtactgcaattggggcgaaatagtatcaggcagatcgaggtgggcgcctttaatgggctggccagtctcaacacactggaactcttcgataattggctgacagttatccctagcggggcgttcgagtacctctccaaattgagagaactgtggctgcgtaataaccccattgagtctataccttcctacgcctttaaccgggtccccagcctcatgcgactggaccttggcgaactcaagaaactcgagtacatctctgagggggctttcgagggcctattcaatttaaagtacctgaacctgggtatgtgcaacatcaaggatatgccgaatctgacacccttagtgggattggaggaacttgagatgtctggtaatcattttcccgagataagacccgggagttttcacggcctgagcagccttaaaaaactgtgggtaatgaactctcaagttagcctgatcgagcgcaacgccttcgacggcctggcttctcttgtggaactcaatctagcacacaataatctctcatccttaccccacgatctatttacacccctgaggtacttggtggagctgcacctacatcacaatccatggaactgtgactgtgacattttgtggctggcttggtggctgcgcgaatatatccccacaaacagtacatgttgcggaagatgccacgccccaatgcatatgagaggtcgctacctcgtagaggtcgaccaggcgtcctttcagtgcagtgcccccttcattatggacgcccctcgggatcttaatatcagtgaaggaaggatggccgaattgaagtgcaggacacccccaatgtcctccgtgaagtggctcttgccaaacgggacggtgctgagccacgccagtcgtcacccccgaattagtgtcttgaacgacggtacgctcaatttttctcacgtgttgttgtcagacacaggtgtgtacacatgcatggtcaccaatgtcgccggtaattccaacgcgtcagcatacctgaatgtttccaccgccgagctgaacacaagcaattatagtttcttcacgacagtgaccgtcgagaccactgaaatctctcccgaagatactactaggaaatacaagcccgtgcccactaccagtacggggtaccagcccgcctacaccacatcaaccacagtcctcattcagacaacgcgcgtccctaaacaggtggctgtgcctgccacggatacaacggataaaatgcaaacaagcttggacgaggtcatgaagaccactaaaatcatcataggatgtttcgtagccgtaacgctcctcgccgccgcaatgctaatcgtcttctacaagctccgtaagcgccatcagcagaggtctactgtgactgccgcccgcaccgtagaaatcatccaggtggacgaggatatccccgcagctactagtgccgccgctactgccgctccttctggggtttcaggagaaggcgccgtggtgctgcctacaattcatgaccacattaactataacacttacaagccagcgcacggggctcactggacagaaaatagcctcggaaatagtctgcacccgacagtgacaacaatttcagagccttatataatccagacgcacaccaaggacaaagtgcaagagacacagatctag

SEQ ID NO: 43047 - DNA, 285 bp, Artificial Sequence
  Description of Artificial Sequence: Synthetic coding sequence
atgaagctgctgtggcaggtgaccgtgcaccaccacacctggaacgccattttgctgccttttgtatatctgacagctcaggtttggatcctctgcgccgcaatagctgctgcagcttccgctggtccccagaattgtccctccgtgtgtagctgcagcaaccagttttccaaggtggtttgcacccgtcgtggacttagcgaagttccacaaggaattccaagcaataccaggtatctcaacctcatggagaataacattcaaatgatccaggctgacacttag

SEQ ID NO: 43048 - DNA, 156 bp, Artificial Sequence
  Description of Artificial Sequence: Synthetic coding sequence
atgaagctgctgtggcaggtgaccgtgcaccaccacacctggaacgccattctgctgcctttcgtgtacctgactgcgcaagtgtggattctgtgcgccgccattgcggccgccgcatctgcagggcctcaaaactgtccttctgtctgttcatag

SEQ ID NO: 43049 - DNA, 2142 bp, Artificial Sequence
  Description of Artificial Sequence: Synthetic coding sequence
atggcccgggcccggggcagcccctgcccccccctgccccccggcagaatgagctggcctcatggtgccttgctgtttctgtggctgttttcgccgccacttggggctggcgggggaggtgtagccgtaacatccgcggctggtggggggtcgcctcccgctaccagctgcccggtggcttgctcttgctcaaatcaggcgtctagagtcatctgtactcggcgcgatcttgccgaggtgcccgccagtatccccgtcaatacacgatacctgaatttgcaggaaaacggaattcaggttatccgaactgatacgttcaaacatcttagacacctagagattttacagctgtctaagaatcttgtgcgcaagatagaagtgggagctttcaatggcttacccagcctcaacaccttggaactatttgataatagactcactacagtgcccacgcaggcctttgagtacctgtcgaaactgagagaattgtggctgaggaacaaccccattgaatccattccatcttatgctttcaatcgggtcccatccctcagacggttggaccttggcgagctgaaaagattagaatacatctcagaggccgcctttgagggtttagtgaacctgagatacctgaacttgggaatgtgtaacctaaaggacataccaaacctcacagctctcgttcgactcgaggaactcgagctttcaggcaataggcttgacctgattcgaccgggttccttccaaggcctgacctccttgcggaaactgtggctcatgcacgctcaggtggcaacaattgagcggaacgcgttcgatgacctgaagtccctggaggaactcaacctgagtcacaataatctgatgagcctgccgcacgacttgttcacgcccttacatcgactggaaagagtgcatcttaatcataatccatggcactgtaactgtgacgtcctttggctctcgtggtggctcaaggaaaccgtgcctagcaacactacctgttgtgctcggtgccatgcacccgctggcttgaaaggacggtacataggggagctggatcaatctcacttcacctgttatgcgcccgtgatcgttgaaccaccgacggacttaaatgtgacagaaggcatggccgccgaactgaagtgtcggacgggaacctcgatgacatccgtcaattggctcacacctaacggcaccctcatgacacacggttcatatagagtgcggatttctgtcctccacgacggtacattgaactttacgaacgtgaccgtgcaggatacgggccagtatacctgtatggtaactaactccgctggcaacacaacagcctcggctacacttaatgtcagtgccgtggatcccgtagccgctgggggtacaggcagtggaggcggaggacctggtggatctggcggcgtagggggcgggtcaggtggctacacctattttactaccgtgaccgttgaaaccctggaaacacagccaggggaagaagctttgcaaccaagaggaactgagaaagagcctccaggccctacaaccgatggggtctgggggggcggcaggcccggcgatgctgcaggtccagcgagcagtagtaccaccgcccccgcgccccggtcatcacgacccaccgaaaaggctttcaccgtacctatcaccgacgtcaccgagaatgccctcaaggatctagacgatgtcatgaagacaacgaaaattatcatcgggtgttttgtggcaatcacattcatggccgccgtgatgctcgttgctttctataaattaagaaagcagcaccaacttcacaaacaccacggtccaacaaggacggtagagattataaatgtcgaggacgagttgccggccgctagtgctgtctccgttgctgctgcagccgcagtcgctagcggcggcggggtcggtggcgattctcacctggcattgccggccctggagcgagaccacctaaatcaccaccactacgtggctgcagcgttcaaggcccactacagcagcaacccaagcgggggtgggtgcggggggaaaggacccccagggctgaactcaattcatgaacctctactttttaagagcggctcaaaggaaaacgtgcaggagacccaaatatag

SEQ ID NO: 43050 - DNA, 1266 bp, Artificial Sequence
  Description of Artificial Sequence: Synthetic coding sequence
atggcccgggcccggggcagcccctgcccccccctgccccccggccggatgtcttggcctcatggtgcacttctgttcctatggctgttcagcccacccctgggagcaggagggggaggcgtggctgtgacaagtgctgccggcggaggctctcccccagccacttcttgtcctgtggcttgcagctgtagcaatcaagcctctagggtgatatgtaccagacgcgacctagccgaagtgcctgcgtccattcccgttaatacgcgatacctcaacttacaggaaaacggcattcaggttattcgaactgacacgtttaaacatttgaggcacctcgaaattttacaacttagtaaaaatctggttcgcaaaatcgaggtgggagccttcaacggactgccttccctgaatacactcgagctgtttgataataggttgaccaccgtgccaacccaggcgtttgagtatctgagtaagctgagggaattatggctccgaaacaatcctatcgagtctatccctagttatgcatttaatcgcgtgccatccctgaggagactggatctcggggaacttaaaaggttggaatacatctctgaggccgccttcgaaggcctggtgaacttaagatacttaaacctcgggatgtgcaatctcaaggatattcctaacctgactgccttagttagactcgaggagctagaactctcagggaataggctagacttaattcgccctggaagttttcagggcctgaccagcctacgtaaattatggctcatgcacgcccaggttgccaccatagaaagaaacgccttcgatgatctgaagtcgctcgaggagttaaatctgtcgcataataatttaatgagcttgccgcacgacctgtttactcccttgcaccggctggaaagagtgcatcttaaccataatccctggcactgcaattgtgatgtgctgtggttaagctggtggctgaaagaaaccgtgccttccaatacgacctgctgcgcacggtgtcacgcccccgctgggctgaaagggcgctacatcggcgaactagatcagtcacacttcacgtgttacgcccccgtaattgtcgagccccctacagatctgaacgtaacggaaggaatggctgccgagttaaaatgtcgaacggggacatcgatgacttctgttaactggtggccccagctccatcccagaaccagcgccctgcaggagcggttgcagggcgaacgggccagagacgctgacttgtag

SEQ ID NO: 43051 - DNA, 942 bp, Artificial Sequence
  Description of Artificial Sequence: Synthetic coding sequence
atgagcctggccagcggccccggccccggctggctgctgttcagcttcgggatgggcctcgtgagtggatccaagtgtccaaataattgcttatgccaggcccaggaggtcatatgcactgggaagcagctgacagaatatcctctggacatacctctgaatactcgccgactctttctcaacgaaaatagaattacaagcctacccgccatgcatctcggtcttttaagcgacctggtatatctggattgccagaataacaggattcgcgaggttatggattacacgttcatcggcgtctttaaactaatctatctggatctcagctccaacaatctgacctcaatcagccctttcacctttagtgtcctctcgaatttagttcagctcaatatcgctaacaatccacacctcttgtctcttcacaagttcacatttgccaacaccaccagtctgaggtacctcgatctgagaaacacgggcctgcagacattggactcagcagcactgtaccacctgactacattagaaacactattcctgtcaggcaatccgtggaaatgcaattgcagcttccttgacttcgcaattttcctgatcgtatttcacatggacccctccgacgacctgaatgccacttgcgtggaacctaccgagttgacaggttggccaataacgagagtcggaaatcctctgaggtacatgtgtattacccatttagaccacaaggattatatttttttgcttctcattggattttgcatattcgccgctggcactgtcgcggcctggctgacaggagtgtgcgcggtgctgtaccagaacactcggcataagtcctccgaagaggatgaagatgaagctggtactcgagtagaggtgtccaggcggatattccagactcagacatcctctgtccaagagttcccacagctgatttag

SEQ ID NO: 43052 - DNA, 1026 bp, Artificial Sequence
  Description of Artificial Sequence: Synthetic coding sequence
atgctgcggagccccaccttcaccgacgccggcccccggtgcagctgcctgccagtgtcccagacacttgacagcatggatacagtattaatgggttcgctccagcattgttgttgtctgctccctaaaatgggcgacacctgggcccagctcccatggcctggtcccccacatcctgccatgcttctgatctctcttcttcttgcagccggcctcatgcattcggacgcaggcacatcctgtcccgttctatgcacatgtcggaatcaagtcgtggattgctcctctcagcgtctgttttccgtaccgcccgatctgcctatggatacaaggaatctgagcctggcccacaaccggataactgctgtgccacctggatatctgacctgttatatggagctccaggtgcttgatctccataataacagtttaatggagttaccccgaggcttattccttcatgccaagaggctggctcaccttgacctgtcatacaacaacttctctcatgtgcctgctgatatgtttcaggaggcacacggactggtccatatcgatctgtcacacaacccttggttgcgccgtgtgcacccccaggcttttcagggcttgatgcaactacgcgatctggatctgagttatggcggcttggccttcctgtccctcgaggctctcgagggactcccagggcttgtgacattgcagatcggcggaaatccatgggtttgcggctgtacaatggaaccactgctcaaatggctgcggaaccggattcagagatgcaccgcggacagccagcttgctgagtgtcggggccctcctgaagtcgaaggggcccctctgttttcactcacagaggagagtttcaaagcctgtcacctgaccctgactctggatgactatctctttatcgcgtttgtaggtttcgtggtcagtatcgcgtccgtggccactaattttctgctggggattacagccaactgctgtcatcgttggtctaaagctagcgaagaagaggagatatag

SEQ ID NO: 43053 - DNA, 447 bp, Artificial Sequence
  Description of Artificial Sequence: Synthetic coding sequence
atggccagcgtggtgctggccctgcggacccggaccgccgtgacctccttgctgtctcccactccagcaaccgctctagccgtgcggtacgcatctaagaaatctggcggctcttcaaaaaatcttggtggcaagtcttctggaaggcgccaggggatcaaaaaaatggaaggccattacgtccatgcagggaacatcatagcaacgcagcggcattttcggtggcatccgggagcacatgtaggagttgggaagaacaagtgtctgtacgcattggaggaggggatcgtgagatacacgaaggaagtgtacgttcctcatcctaggaacacggaagctgtggatctgatcacgcggctccccaaaggcgccgtcctgtacaagacctttgtgcatgtagttccagcgaagcccgaaggcacctttaaactggtggccatgctttag

SEQ ID NO: 43054 - DNA, 2643 bp, Artificial Sequence
  Description of Artificial Sequence: Synthetic coding sequence
atgaagaacctgtacttccgggtgatcaccatcgtgatcggcctgtactttaccgggatcatgacaaacgcctccaggaagtcgaacattctgttcaacagtgaatgccagtggaatgagtatatactcacgaactgtagcttcacaggcaagtgcgatatcccagtggatatttcccagactgcagccacggtggatgtgtccttcaacttttttagggtcctgcttcaatcccatactaagaaggaggagtggaagataaaacacttggacctgtccaacaacctgatcagtaagatcacacttagcccctttgcatatttgcacgcactggaggttcttaacctgtcaaataatgcgatacactctctgagcctggacctgttaagccctaagagctcatgggttaagcgccaccgcagcagctttcgaaaccgatttccacttctcaaggttttgattctgcaacgaaacaagctgagtgatacaccaaagggattgtggaaactcaagagtctccaaagcttagacctatcattcaatggcatcctgcagatagggtggagcgactttcataattgtctgcagttggagaatctctgtctcaaatcaaacaaaattttcaagattcctcctcaggctttcaaagacttgaaaaagctgcaggtgatcgacctctcaaacaatgcactgataacaattctccctatgatgattatagcgttagagtttccgcaccttgtggtagaccttgcagacaacaattggcagtgcgacgattctgtggctgtgttccagaatttcatcagcgagtcctggcggaagaagtggaatgtgatttgcaaccgaagcattgggtctgaggaggctaacggcgggacgccgcagtcccgtatctcacgtgaaaccaggctacctcctatccacctccaccgtatgaaatccttaatacgctccaaagcagagaggccacagggaggacgccatactgggatttcaaccctcggaaagaaagctaaggctgggtcaggactgcgtaaaaaacagcgccgactgccccgatcggtaaggtccacacgggatgtgcaggccgcaggcaaaaaggaagatgctccccaggatctggctctcgccgtttgcctgagtgtgtttataacctttcttgttgcttttagcttgggggccttcacacgaccatatgtggacagactatggcagaagaaatgtcaaagtaagagccccgggctcgacaatgcctattcaaacgagggattttacgatgatatggaagctgctgggcacacccctcaccccgaaactcatctgagacaggtcttccctcacttatctctgtacgaaaaccagacacccttctgggtgactcagcctcacccgcacgctacggtgattcccgaccgcaccctgggaaggagcagaaaggaccccggttccagccaaagccccggccagtgcggagacaatactggcgctggctcaggtaatgatggtgccgtttacagtatcctgcaaaggcaccctcacgcaggaaatagagagctgatgtctgccgcacaggaccacatccatcgcaatgatatcctcggagagtggacctatgaaacagtggctcaagaagaacccctgtccgctcatagtgtcggcgtttcttctgtggccggaacttcacatgctgtgtccgggtctagtcgctacgattccaatgagctcgacccatctctgtctggcgagataactgcttccctgtgtaagatgctgactcacgcggaagcccagagaaccggagatagcaaagagaggggtggtactgagcagagtctttgggactcccaaatggaattttctaaagaacggcaggtttcttccagcatcgaccttttgtcaatacagcagccacgattaagtggggctcgagccgaagaggccctgtccgctcactattcggaagtgccatacggcgaccccagggatactggcccgtcggtgttcccgccccggtgggattcgggccttgacgtgacaccagccaacaaggaacccgttcagaagtcaaccccctctgacacctgctgtgagttagagtctgattgtgacagcgatgagggatcactgttcaccctgagctccatcagcagcgaatcggcccgtagcaaaactgaagaggccgttcctgatgaggaatcgctgcaggatgagtcttccggcgcctcgaaggataacgtaactgctgttgactccctggaagaaaatgttacattccagactatccctggtaagtgcaagaaccaggaggatccgttcgagaaaccgttaatttcagccccagatagcgggatgtataaaacgcaccttgagaacgcatcggataccgaccgatcagaagggctaagcccttggccgaggtccccgggtaactctccgctgggagatgagtttcccggaatgttcacctatgattatgacacagcgctgcagtcaaaggccgccgaatggcattgttctctgagggacctggaattctccaatgtggacgtactgcagcagacccctccatgcagcgccgaggtgccgtctgacccagacaaggctgcttttcacgaacgcgattccgacatcctcaaatag

SEQ ID NO: 43055 - DNA, 1869 bp, Artificial Sequence
  Description of Artificial Sequence: Synthetic coding sequence
atgtgcggcctgcagttcagcctgccctgcctgcggctgttcctggtggtgacatgttaccttctgcttctcctgcataaggagattctcggttgctcgagcgtgtgccaactgtgcactggcaggcagatcaactgtcgaaatcttggcctcagctcgattcctaagaacttccctgaatcgacagtgttcctttatctgactggtaacaacatctcctacatcaacgaatctgagctgactggtctccattcgctcgttgctctctatcttgacaactcaaatattctgtatgtgtatcctaaagcctttgtccagctgaggcacctgtactttctgtttctcaataacaattttattaagcgactggatcccggcatcttcaagggcctgcttaacctcaggaacttgtacttgcagtacaatcaagtatcatttgtaccgcggggagtttttaatgacctcgtgtcggtgcaatatttaaacctgcaacgcaaccggctgacagttctgggttcaggcacatttgtgggcatggttgccttacgcatactcgacttgagtaataacaacatcctccgcatctctgagagcggcttccagcatctggagaatcttgcttgcctgtacctgggctcgaataatttaacaaaggtgccttccaatgcatttgaggtgctaaaaagcctcaggagattaagcctctcccataaccccatcgaagcgattcagccgtttgccttcaagggcctcgcaaacctggaatacctcttgttgaaaaattcgcggatccgtaacgtcacccgggatggattctcaggtattaacaatctgaagcaccttatccttagtcacaacgacctggaaaatttgaatagcgatacattctcactgctgaagaacctgatttaccttaaattggataggaacagaattattagcatcgacaacgacaccttcgagaacatgggtgctagtctcaagatcttgaatctttcctttaacaacctgacagcattgcacccacgagtcctcaaacccctctccagtctaatccaccttcaggcaaactccaatccatgggagtgcaactgcaaactacttggactgagggattggctggcgagttctgcaattaccttgaatatttactgccagaacccaccctcaatgagaggacgggcccttaggtatataaatatcacaaactgtgtgacctcatcgattaacgtgtccagggcatgggccgtcgtgaaaagcccacacatccatcataagactaccgcactgatgatggcttggcataaagttaccaccaacgggagccctcttgagaacacagagaccgagaacatcacattctgggaaagaatccctacatcccctgccggccgattttttcaagagaatgcgttcgggaatccactcgaaaccacagctgtgctgccagttcaaatccaacttactacttccgtcaccctaaacctcgagaagaactccgccctgccaaatgatgccgcaagtatgagtggcaaaacctctctgatttgcacacaggaagtggagaaactcaatgaagcattcgacattttgctagccttcttcatacttgcatgcgtgctgatcatcttcctcatttataaagtggtgcagtttaagcagaagctcaaggcatcagagaacagccgggagaataggctagagtattattccttttaccagtctgcgagatacaatgtgactgcctcaatctgtaacacatcccccaactcgttagagtctcctggtctggaacagatccgccttcacaaacagatcgttcccgaaaatgaggcccaagttatattgttcgagcattctgcactttag

SEQ ID NO: 43056 - DNA, 2151 bp, Artificial Sequence
  Description of Artificial Sequence: Synthetic coding sequence
atggcccggatgagcttcgtgatcgccgcctgccagctggtgctgggactgctgatgacgtctctgacagagtctagtatccagaacagcgaatgccctcagctatgcgtatgcgagatacggccatggtttacacctcagtcaacttaccgagaggcaacaacagttgattgtaacgacctgcgcctcaccaggattccgtctaacctttcgagtgacacccaggtattactacttcaatcaaataatattgccaaaaccgtggacgagctgcagcagctctttaacctgacagagctcgacttcagccaaaataatttcactaacatcaaggaagtgggtttggcaaaccttacccagttgaccaccttgcaccttgaggagaaccagatcactgaaatgaccgactactgtctccaggatctgagtaacttacaggaactgtacatcaaccacaatcagatttcgaccatctcagcgcacgctttcgctgggcttaagaaccttcttaggctacaccttaactctaataaactgaaagtgatcgacagtcgctggtttgacagtactcctaacctggaaatcttaatgatcggcgagaaccctgtgatcggaatactggacatgaatttcaagccgctggcaaatctccggtctctagttctggcggggatgtatctgaccgacattcccggaaacgccctggtcggattagactcactagaatctctcagcttttatgacaacaagctggtaaaggtgcctcagctggcattacagaaggtgcccaatctaaagtttctggacctgaacaaaaacccaatccacaaaatccaggagggtgatttcaagaatatgttgcgtcttaaggagctggggataaacaacatgggcgagctggtgtccgtggatagatatgccttagacaatctaccagaactgacgaaacttgaagcaacgaataatcctaaactgtcctatatccataggctcgcattccgctcagtacccgcgctcgagagtctgatgcttaacaacaatgcactgaatgccatttatcaaaaaacggttgaaagccttcccaatctgagagaaattagtatacattccaatccgctccgttgtgattgcgtcatccactggattaatagtaacaagactaacatccgcttcatggaacccctgtcgatgttttgcgccatgccccctgaatataaaggtcatcaagttaaagaggtcttgatccaagactccagcgagcagtgtttacccatgatttcccatgatagcttccctaacagactgaatgtggatatcggtactactgtatttctggactgcagagctatggctgagccggagccagaaatttattgggtcacccccattggaaacaaaatcaccgttgagacattaagtgataaatataagctgagcagtgaggggacccttgagataagcaacatccaaatcgaagacagtggcaggtatacttgtgtggcccagaacgtacagggcgctgatacaagggtggccaccattaaggtgaatggaaccctgctggacggaacccaggtcctaaaaatttacgtaaagcagactgaatcccattccatactggtcagctggaaagtcaactctaacgtcatgacgagcaacctcaagtggagctcggcaacaatgaagatcgacaacccccacatcacgtataccgcccgggtaccagtggatgtgcatgagtacaacttgacgcatctacagcccagcaccgattatgaggtctgcctgaccgtatcaaacattcatcaacagacccagaaatcttgtgtgaatgttaccaccaaaaatgcggccttcgccgtcgacatatctgatcaggagacttccactgcgctagcagcagtcatggggagtatgttcgctgtgatctctctggcttcaattgccgtgtatttcgcaaagagattcaagagaaaaaattaccaccatagtttgaagaaatatatgcaaaagactagcagtatacccctcaacgaactgtatcccccgctgataaacttatgggaaggggatagtgagaaggacaaggatggttcagcagacaccaagccgacacaagtagatacttccaggtcgtactacatgtggtag

SEQ ID NO: 43057 - DNA, 2142 bp, Artificial Sequence
  Description of Artificial Sequence: Synthetic coding sequence
atgcggctgctggtggcccccctgctgctggcctgggtggccggcgccacagcagccgtgccagtcgtgccttggcacgttccttgtcctcctcaatgtgcctgccaaatacggccatggtatacaccccggtcgagctatcgcgaggcaaccaccgtcgactgcaatgacctgtttttgacagctgttccccccgcgctgcctgctggaacacagaccttactcctccagtcaaacagcatagtgagggtggatcagtccgagctcggctatctggctaatcttactgagctggatctgagccagaattccttcagtgatgcacgggactgcgatttccacgcactgcctcagcttttaagcctgcacctagaggagaaccagttgacacggctcgaggatcattctttcgcgggactggcaagtctccaggagctgtacctgaaccataatcagctgtacagaattgcacccagagctttctccgggctcagtaacctcctgcgcctgcacctgaactccaatctgctgagggctatcgacagtaggtggtttgagatgctccccaacctcgaaatattaatgattggaggaaataaggttgacgcgattctggacatgaactttaggcccctggctaacctcagatccctcgtcctggcggggatgaacctgcgggaaatctcagattatgcgcttgaaggacttcagtctctcgaatccctctcattctacgataatcagttagccagagtccctagacgggcactggagcaggtccctggactgaagtttctagacctcaataaaaatccactgcagagggtcggtcctggcgactttgctaacatgctccatctgaaagaactgggtttaaacaacatggaagagctcgtttctatcgacaaattcgcgttggtgaacctgcctgagttgacaaagctggacatcactaacaaccctcgcctctcgtttatccatccgagagcattccatcatctccctcagatggagaccctgatgctgaataataacgccctgtctgctttgcatcagcaaaccgtggagagcctcccaaacctgcaagaagtgggtctacacggcaatcctatcagatgtgattgtgtgattcggtgggctaacgcgacaggcacgcgagtccgttttattgagccacagtcaactttatgtgccgagccaccggacttacagcgtctgcctgtccgagaggtgccattcagagaaatgacggatcactgtctgcctctcatctctccccgttcctttcccccgtccctccaagtggcgtctggcgagtctatggtattacactgccgcgctctcgccgaacctgaaccggaaatttactgggtgacacctgccggattgcggcttacccccgcgcacgcagggcgccgctacagagtgtatcccgaaggaactctggaactcagaagagtaacagctgaggaagctggactgtacacctgcgtcgcccagaacctcgtgggtgccgacacaaagacagtgagcgtggtcgtgggacgagccctcctgcaaccagggcgcgatgaagggcagggcctggaactgcgggtgcaagagacccatccatatcatattctcctgtcctgggttactcctcccaatactgtgtccaccaatctcacttggtccagcgccagctctctccgcgggcagggggccactgcactggcacgcttgcctcggggaacccatagctataatattactaggttgctccaggcaaccgaatactgggcttgccttcaggtggcattcgctgacgcccatactcaactggcttgcgtatgggccagaaccaaagaggccaccagctgtcacagggctttaggggacaggccaggccttatcgccatcctggcactcgcagtcctactcctcgcagccggcttggccgctcacctcggaacaggtcagccaagaaagggcgtaggaggtaggaggcctttgccacccgcttgggccttctggggatggagtgctccctctgtgagggtggtgtccgctccccttgtgcttccatggaaccctggacgtaaactgcctcggtccagtgaaggcgaaaccttacttccacccctgagccagaactcctag

SEQ ID NO: 43058 - DNA, 2142 bp, Artificial Sequence
  Description of Artificial Sequence: Synthetic coding sequence
atgcggctgctggtggcccccctgctgctggcctgggtggccggcgctaccgcagccgtacctgtggttccttggcacgtcccgtgtccgccacagtgtgcctgtcagattcgcccctggtatacgcctagaagtagttacagagaggcaacgaccgtcgactgcaacgacctgttcctgaccgccgtcccacctgccctcccagcgggtacacagacactcctccttcaaagcaatagcatagtgcgcgtggatcagtccgaactcggatatcttgccaatctgaccgagctggatctgtctcagaacagtttctccgacgccagagattgcgacttccacgccctcccccagctactgtccctccatctcgaagaaaaccagctgacaagattagaggatcatagcttcgcaggactggcgtcgctccaggaactgtacctgaatcataatcagttataccgtattgcacctcgggctttttctgggctaagtaatctcctcagattgcacctgaactccaatcttctgcgggcgattgacagtaggtggtttgaaatgctccccaacttggagatcttaatgattggagggaacaaggtagacgctattttagacatgaatttcaggcccctggcaaatttacgcagcctcgtgctcgcaggcatgaatttgcgggagatctccgactatgcattggaaggcctccaatctctcgagagcctctctttctacgataaccagctcgcaagagtacctagacgggctctggaacaggtgccaggcctgaagttcctcgatctcaataaaaatcctctgcagagagttgggccgggagactttgccaatatgctgcacctcaaggaactggggcttaacaacatggaggagcttgtcagcatcgacaaatttgcattggtgaatctcccagaacttaccaaacttgacatcaccaataacccccgcctatcgttcatacatccgcgcgctttccaccatctgccccagatggaaacactgatgttgaacaacaacgccctgtcagctctccatcagcagactgtggagtcgctgcctaacctgcaagaagtcggactgcacggcaaccccattaggtgtgactgtgtgattcgttgggccaacgcaacaggaacccgcgtgaggttcattgagcctcagagcacactttgcgccgagcccccagacctccagaggcttcccgtgagggaggtcccctttagggagatgaccgatcactgcctgcccttgatctccccccgctccttcccaccctctctgcaggtggctagcggagaatcaatggtgttgcattgcagggccttggccgaaccagagcctgaaatatactgggtgacacccgctggcctccggctcacccccgctcacgccggccgtcggtatagagtctatccagagggtaccctggagctgcgtagagtgaccgcggaagaagctggattgtatacctgtgtggcgcaaaacttggtcggcgcagacacgaaaacagtctcagtggtggtgggtcgcgcactgctgcaaccagggagggacgagggccagggactcgagttgcgagtgcaggaaacgcacccttatcacattctgttgtcatgggtcacaccccccaatacagtaagcaccaatttgacgtggtcgtctgccagctcactcaggggacaaggcgcaacggccctggcccggctgccaagaggaacacactcttacaatattactcggctgttgcaggctacagagtattgggcatgcctccaggtcgcctttgcggatgcacacacacagttagcctgcgtgtgggcacgcaccaaggaggctacgtcatgtcaccgggccctgggggacagacctggcctgattgcaattctggccctcgctgtcctgctattggccgcgggtttggccgcccacctaggcacgggtcagccccggaagggggtcggaggaaggaggcctctgcctcctgcctgggcgttctggggatggagcgctcccagcgtgcgggtcgtcagcgccccgttggtcttaccatggaatccaggccggaaactgcctagaagcagcgaaggggagactctgctgccacctctgagccagaatagttag

SEQ ID NO: 43059 - DNA, 2142 bp, Artificial Sequence
  Description of Artificial Sequence: Synthetic coding sequence
atgcggctgctggtggcccccctgctgctggcctgggtggccggcgccactgccgctgttcctgtagtgccgtggcatgtcccttgccccccacaatgtgcttgtcaaatccgcccttggtataccccacgtagctcatatagagaagccacaaccgtcgattgcaatgacttgttcttgactgccgtcccaccggctctacccgccggcacccagacactactgctgcagagcaacagcatagtgagagtcgatcaatccgagttgggctacctggcgaatctcacggaactagacctgtcacagaacagttttagtgacgcccgtgattgtgacttccacgccctgcctcagctgttaagcctccatctggaggaaaatcagctcactcgcctggaagaccacagcttcgcaggcctcgcctccctccaagagctctatctgaaccataatcagctataccggatcgctccacgggctttcagtggactgtccaacctcctgcgcctccacctgaactcgaatttgctccgcgccattgacagccggtggttcgaaatgttgccaaacttggagatcctgatgataggcggcaacaaagtggatgccattctcgacatgaattttcggccactcgcgaatcttagaagtctggttctggcggggatgaatttacgggagatctctgattatgctctggaaggcttacagagtctggagtccctgagtttctatgataaccagttagcacgggtacctcgcagagctcttgagcaagtgcccggactcaagtttttagacctgaataagaacccccttcagagggtgggacccggcgattttgctaacatgctccacctcaaagagcttgggctgaataacatggaagaactggtgagcatcgacaaattcgctctcgtgaatttgcctgagctgaccaaactggacataaccaacaatcctcggctgtccttcatccatccgcgggcattccaccacctcccccagatggagactcttatgctcaacaataacgccctgtccgcccttcatcaacaaacagttgagagcctgcctaacttacaagaggtgggcctgcatggaaatccaattaggtgcgactgcgtgattagatgggctaacgccacaggtacacgcgtacggtttattgagccacaaagcactctatgcgcagagccccccgacttgcaacgtctccccgtcagggaggtgccattccgtgagatgacagaccactgtcttccactgatctccccccggtcattccccccaagcttgcaggtggcgtctggtgaatcaatggtgctgcattgcagggctctagccgagcccgaacctgaaatctactgggtgacccccgcgggcctcagactgacccccgcacacgccgggcggcggtacagagtgtatcctgaagggacccttgagctgcgccgcgtcacagctgaggaggctggcctgtatacttgtgtggcccagaacctggtaggcgccgatactaagactgtgagcgtggtagtgggacgggctctgctccagcccggcagagacgagggacagggcctagagcttcgcgttcaggaaacccatccctatcacattctgctgagttgggtgaccccaccaaacaccgtgtctactaatttaacgtggtccagtgccagctcattgcgggggcagggggctacagcacttgcaaggctgccaagaggaacccatagctacaatatcacccgactcctgcaggccactgaatattgggcctgtcttcaggtagccttcgccgacgcgcacacccaactggcatgcgtgtgggcccggacaaaagaggctacctcatgtcatagggccctgggggataggcccggactcattgccattttagccttggctgtgctcctcctggccgccggcttggcagcacaccttggaaccggccagccgaggaaaggcgtcggcggcagaagacctctccctcccgcgtgggccttttgggggtggtctgcgccatccgtgagagtggtctctgctccattggtgctcccgtggaaccccggtcgaaagctcccgagatcatccgaaggagagactctgctcccaccgctttcccagaactcttag

SEQ ID NO: 43060 - DNA, 2127 bp, Artificial Sequence
  Description of Artificial Sequence: Synthetic coding sequence
atgaaggacatgcccctgcggatccacgtgctgctgggcctggccatcaccaccctggtgcaagctgtcgataagaaagtagactgccccagactctgcacttgtgagatacggccctggttcactcctagatcgatttatatggaggcatccacggtcgattgcaatgatctgggtttactaacgtttcccgccagactgccagcaaatacacagatcctcttgcttcagaccaataacatagccaaaatcgagtatagcacagactttcccgtgaatctcacgggccttgacctctctcagaacaatctctcttcagtgacaaacattaatgtaaagaagatgccgcagctcctgagtgtatacttagaggaaaataaattaacagagttgcccgagaagtgtctgtcggagctgtccaatcttcaggagctgtacattaatcacaatctcctcagtacaatctcccccggcgcattcatcgggctgcataatttgctgcgtctgcacttgaattcgaacagactccagatgatcaacagcaagtggttcgatgctctacctaatctggaaatcctcatgatcggggagaatcctataattaggattaaagacatgaattttaagcctctgatcaacctgaggagcctagtgattgccgggattaacctgaccgaaatccctgataatgcgctggtgggattagagaatctcgagtcaatctcattttatgacaaccggctgataaaggttccgcacgtggctttacaaaaggtggtgaaccttaaatttttggatctaaacaagaatcccattaaccgaatacgccggggagattttagcaatatgttgcacttaaaagaactagggattaataatatgccggaactcattagcatagattccctggcagtagacaatttacctgatctaaggaaaatagaggctacaaataacccaagactttcatacatccaccccaacgcattcttcagactccctaaactggagagtcttatgcttaacagtaacgccctgtctgcgttgtatcacgggacaatcgagagcctcccaaatctgaaggagattagcattcatagtaaccctatccgttgcgactgcgtgatacgctggatgaacatgaataagaccaacatacgattcatggagcctgattccttattttgtgtggatccacccgaatttcaaggtcagaacgttcggcaagtgcacttccgtgacatgatggagatctgtctcccccttattgcacccgagtcttttcctagcaatttgaatgttgaagcaggatcatacgtctccttccattgtagggcgacggctgagcctcaacctgaaatttattggatcactccttccggccagaaattattgcctaatactctgacagacaaattctatgtccattcagagggaaccctcgatattaacggcgtgaccccgaaggaaggaggactgtatacttgtattgccaccaacctggttggggcagatctgaagtccgttatgattaaagtggacggctctttccctcaggacaacaacggctcgttgaacattaaaattagagacatccaggctaattcggtcctggtctcttggaaggcttcaagcaagatactgaaatcttctgtaaagtggacagcatttgtcaagacagagaattcacatgccgcccagtccgcacggatccctagcgatgtgaaggtgtacaacctcactcacttaaaccccagtaccgagtataagatctgcatcgacattcccacgatctaccaaaagaataggaagaaatgcgtgaacgtaaccaccaaagggctgcacccagatcagaaagaatatgagaagaataatacgacaacactcatggcctgcctcggtggattgcttggcatcatcggcgtgatttgcctgatatcttgcctgtcccccgagatgaactgtgacgggggtcactcttatgtaagaaactacctacaaaagcctacgttcgcactgggcgagctctacccgcccttaatcaatctgtgggaggccgggaaggagaaatccacatccctcaaagtgaaggccactgtaatcggcctccctacgaatatgagctag

SEQ ID NO: 43061 - DNA, 2127 bp, Artificial Sequence
  Description of Artificial Sequence: Synthetic coding sequence
atgaaggacatgcccctgcggatccacgtgctgctgggcctggccattactactttggtgcaggcagtggataagaaggtggactgccctcgactctgcacatgtgaaattagaccgtggtttacaccacggagtatttacatggaagccagtacagtggactgtaatgacctcggtctgttgacattccctgctagactgcctgccaacacccaaattcttctgcttcaaactaataatattgcaaagatcgaatactctaccgattttcccgtgaacctgaccggactggatctctctcaaaacaatctcagttcagtgacaaacattaatgtgaaaaagatgccacagttattgtccgtttacctggaagagaacaagctcacagaactgccggaaaagtgtctatcagagctatcaaacctacaggaactgtacatcaatcacaacctgctcagcacaatctctcctggagctttcattggtttgcataatctactcaggctccacctgaactcaaatcggctgcaaatgattaacagtaaatggtttgatgcgttgccaaatcttgagatactcatgatcggcgaaaacccgatcataagaatcaaggacatgaattttaagccactgataaacctacgctcgttagtgatcgccggaataaatctgactgaaataccggacaatgccttggtcggactggaaaatctcgagtcgatcagcttctacgacaataggcttatcaaagtacctcacgttgctcttcagaaggtggttaatctgaaattcctcgatttgaacaaaaatccaataaacaggatccggcggggcgatttctccaacatgctccatttgaaagagctcggtattaacaatatgcccgaactgatctccatcgactcacttgctgtcgataatctccctgacctgagaaaaattgaggccacgaataacccccggctgagctatatccacccaaatgccttctttcgcttgcccaaactagagtctctaatgctgaactctaacgctttgagcgccctgtaccatggtacaatagagtccttacccaacttaaaagagattagcatccactcgaacccaatacgctgcgattgcgtgattagatggatgaatatgaacaagaccaatatacgcttcatggagcctgacagcttattttgtgtcgatccccctgagttccaggggcagaatgtgcggcaggtccatttccgagacatgatggagatctgccttccactaatcgccccggagagctttccctctaatctaaacgtggaggccggctcatacgttagttttcactgtagggcaaccgctgaacctcagcccgagatttactggatcacgccttccggccaaaaattgctgccaaacacattgacagacaagttttacgttcattccgagggaacgttggatattaatggcgtcactcccaaagagggtggcctctatacctgcattgcgacaaacttagtaggcgcggacctgaaatccgttatgatcaaggtggacgggtcttttccccaggataataacggtagcctcaacattaaaatccgtgacattcaggcaaacagcgtgttggtgagctggaaggctagttctaaaattctgaaatcaagcgtgaagtggactgccttcgtcaagacggagaactcccatgccgcacagagcgcacgtattccttctgacgtgaaagtctacaacctgacacatttgaatcccagtacagaatataagatctgcatcgacatcccaacaatataccagaagaatagaaagaagtgcgtgaacgtaacgaccaagggtcttcaccccgatcaaaaagaatacgagaaaaacaacacaaccactctcatggcatgtcttggcgggctactcgggattataggcgttatctgtctcatcagttgtctgtcccccgagatgaattgcgacggcggacacagttatgtgagaaattatctgcagaaacctacattcgctctgggagaactgtatcctcccctgataaacttgtgggaggctggtaaagagaaatccaccagcctgaaggtaaaagccacggtgatcggactgccaaccaatatgtcctag

SEQ ID NO: 43062 - DNA, 2127 bp, Artificial Sequence
  Description of Artificial Sequence: Synthetic coding sequence
atgaaggacatgcccctgcggatccacgtgctgctgggcctggccatcacaaccctcgtgcaggctgtggacaagaaagtggactgtcccagactctgtacatgtgagattcggccttggtttaccccaaggagcatttatatggaggcttccactgtggactgcaacgacctgggattactgacttttcccgcccggctgcctgctaatacacagatcttgttactccagaccaacaatatcgccaaaatcgagtactcaacagacttccctgtgaacttgacgggactggacctgtcccagaacaacttgagctctgtaactaatattaacgtcaaaaagatgccccagctcttgtccgtttacttggaggagaacaaactgacagagctccctgaaaaatgcttgtctgaactctcgaatttgcaggagctctacattaaccataaccttctctccaccatatctcctggtgcctttattggccttcacaatcttctacgacttcacctgaatagtaaccggcttcagatgattaacagcaagtggttcgatgctctccccaatctggaaatcctgatgattggcgagaaccccattatccgtattaaggacatgaatttcaaacccctgattaacttgagatcactcgtaatcgcaggaataaacctcactgaaattccagacaacgcccttgtggggttagagaacctggagagtatcagcttctacgacaaccggctgattaaggtgccccacgtggctctgcagaaagtggtcaatctgaaatttctcgacctcaacaaaaacccaatcaatcgaattcgtagaggggatttctctaacatgctccacttaaaggagctggggataaataatatgcccgagttgatctcaattgactcactcgcagtggacaacctccccgatttacgtaaaattgaggcaaccaataatccgaggctgagttatatacacccaaacgcctttttccggttgcccaaactagagagccttatgcttaactctaatgcgctgtcagcactctaccatgggacgatagaatccctgcctaatttgaaggagatttcaatacacagtaatcctatcagatgtgactgcgtgatacgttggatgaacatgaacaaaactaacatccggttcatggagccagactcgctgttctgcgtggatccaccggagttccagggtcaaaacgttagacaggtacatttcagggacatgatggaaatctgtctccctttaatcgcaccagagagttttccaagtaacctgaacgtggaggcaggtagctacgtatcatttcattgccgggccaccgccgagcctcagcctgaaatttactggatcaccccaagtgggcagaaacttctgcctaacacactcaccgacaagttctacgtgcattctgaaggcacgctggatatcaatggcgtgacccccaaggaggggggtctttacacatgtatcgctaccaacctcgttggtgcagacttgaagtctgtcatgatcaaagtagacggtagctttccacaggacaacaatggatctctgaatatcaagatcagggatatccaggccaattcggtgttggtcagctggaaagcatcttctaagatcctcaagtcgtctgtcaagtggacagcctttgtgaagaccgagaattcccacgccgcacagagtgcaagaataccaagcgacgtgaaggtctataacctaacgcatcttaacccttcaactgagtacaagatatgtatcgatatacctactatctaccaaaaaaaccggaaaaagtgcgttaatgttactactaaggggcttcatccagaccagaaggagtatgagaaaaacaacacaacgacactgatggcttgcctaggaggtcttctaggaataatcggagtaatttgtttaatatcgtgtctcagccccgaaatgaattgtgacgggggacacagctacgtgcgtaattacctgcagaaacctacatttgccctgggggagttgtaccctccgctgataaatctctgggaggccggcaaggagaaaagcacttccctgaaagtgaaggccaccgtgatagggttgcctacaaatatgagctag

SEQ ID NO: 43063 - DNA, 2223 bp, Artificial Sequence
  Description of Artificial Sequence: Synthetic coding sequence
atgcggcagaccctgcccctgctgctgctgaccgtgctgcggcccagttgggcagacccaccccaagaaaaggtgcctctgttcagagtaactcagcaggggccctggggatcttccgggtccaacgccaccgattctccctgcgaaggactgccggccgcagacgcaacagcactgaccctggccaacagaaacttggaacgcctccctggctgtctgccaaggactcttcggagcctggacgccagccataatttgctgcgggccctatccaccagcgagctgggccacctagaacagctccaggtccttaccctccgtcataatcggatcgcagcccttcggtggggccctggtggtcccgccgggcttcacactcttgacctgagctacaaccaactggcagctctgccaccctgtacaggtccagcgctttcctctctgcgcgcgctggccctggctggaaatcctctgcgtgctttgcagcctagagcatttgcctgctttccagccttacagcttctcaacttgagctgcacagccctgggtagaggggcacagggggggattgcagaagccgcttttgcaggtgaggatggggcccccctcgttactctggaggttttagaccttagcgggactttcctggagagggtggagtctgggtggatcagagatttgcctaagctgacatctttgtacctccggaaaatgccacgcctgactactctggagggagatatatttaaaatgacgcctaaccttcaacagctagattgccaggacagtccagcactcgcctctgtagcgactcacatcttccaagacacaccacaccttcaggtcttgctgttccagaactgcaacctaagtagcttcccaccatggacactagacagctcccaagtcctgagcattaaccttttcgggaatcctctcacttgtagctgcgatctgagttggttgctcaccgacgccaagcggactgttctgtcccgggctgctgacaccatgtgtgccccagccgctggctcctccggccctttttccgcctccctgtccttgagccagctacctggggtgtgccagtctgaccagagcactacactcggcgcctctcaccctccttgttttaaccgctccacatacgcacagggcaccacggtggcccccagcgctgctcccgctacccgacccgccggtgaccagcagtccgtctctaaggcgccaaatgttggatcgagaaccatcgccgcttggcctcattctgacgcgagagagggcaccgctccatcaactacgaactccgtagctggtcactcaaactctagtgtgtttccccgggcagccagcaccacaaggacccagcacaggggcgaacatgcccctgagcttgtgctggagccggatatcagcgctgccagcactcctctggcctccaagctcctgggtcccttccctacttcgtgggaccggagcatttcttctccacagccagggcagagaacgcacgccacacctcaggcaccaaacccttccttgagcgaaggagaaattcctgttctgctgttggatgactacagcgaggaggaagaaggacgtaaggaggaggtgggcacaccacatcaggacgtcccttgtgattatcacccatgtaaacacctgcaaaccccatgcgcagagctccaacgtcgctggcgttgccgatgcccagggcttagcggcgaagacacaattcccgaccctccccgattacagggcgtcacagagaccactgacacatctgctctcgtacactggtgcgcccctaatagcgtggtacacgggtatcagatacggtactcggctgaagggtgggctggtaatcaaagtgtggtgggggtgatttacgccactgcaaggcagcaccctctctatggcttaagccctggcactacatacagagtctgtgtgctggcagcgaatcgcgccggtctcagtcagccgcggtcttctggttggcgctctccgtgcgctgctttcacaacaaaacccagctttgcacttcttctctcagggctctgtgcagcatctgggttgctgctggcttctaccgttgtgctttctgcatgtctctgcaggagaggtcagacactagggcttcagcggtgcgacacacatcttgtggcctacaaaaacccagcctttgatgattatcccctgggtcttcagaccgtttcctag

SEQ ID NO: 43064 - DNA, 1191 bp, Artificial Sequence
  Description of Artificial Sequence: Synthetic coding sequence
atgaagaactacgagagcaagaagtacagcgaccccagccagcccggcaacacagtcctccaccccggaacacgcctcatccagaaacttcacaccagtacctgctggctgcaggaagttccaggcaagccgcagctggagcaggctaccaaacacccccaggtgactagtccacaggcgaccaaagaaaccgggatggagattaaggaggggaaacaaagctaccgacaaaaaattatggatgaactcaagtattactataatgggttctatctgctgtggatcgacgcgaaagtggcggcccgcatggtgtggcgcctactgcacggccaagtgttgacacgcagggaaaggcggagggaagagaaacaaaaaaaaaaaatggccgtcaaattggaactggccaaatttctgcaggagacaatgactgaaatggcaaggaggaacagagcgaagatgggggacgccagtacgcagctgtccagctacgtgaaacaggtgcagactggacacaagccatctacaaaagaaatagtacgcttctccaagttgttcgaagaccagctggccctcgaacacctcgacaggccccagcttgttgctttgtgtaagcttctggagctgcagactttcggcactaataatctcctgaggtttcaactgttgatgaagctcaaatccataaaagccgacgatgagatcattgctaaagagggcgtgactgcactttccgtcagcgaactgcaggctgcatgtagggccagaggcatgagaagtctcggtctaactgaagaacagcttcgtcaacagctgacagagtggcaggacctgcacttaaaagaaaatgtgccaccatcccttcttttgttgagccggacattctaccttatcgatgtgaagcctaagccaatcgaaatacctctgagtggcgaagcccccaagaccgatatcctggtggaactgcctacatttaccgaaagcaaggaaaatatggtcgatctggccccccagctcaaagggactaaggacgaggactttatccaaccaccgccagtcacatcttcgcccataacgcccagcactcccatttccctgcctaagggccctatcacgtctagtgaggagcctactctccaggcgaagtcacagatgacagctcagaatagtaaagcgagctccaagggcgcatag

SEQ ID NO: 43065 - DNA, 1476 bp, Artificial Sequence
  Description of Artificial Sequence: Synthetic coding sequence
atggccttctacagctacaacagcgtgctggccatcgcccggacccgcttcccctcccattttgtccacccgacatgctcaagctactctccatcctgcgccttcctacacttgcccgattctcacttgaataagacatgcatgaagaactacgagtcaaagaagtacagcgatccatcccaacccggcaacacagtgctgcacccaggtaccaggttaatccagaaactgcatacttccacgtgctggctccaggaagtgccagggaaaccccaacttgaacaggccaccaaacatccacaggttacaagcccacaggctacaaaagaaaccggcatggagatcaaggaggggaagcaaagctaccgccaaaaaataatggacgaactgaaatattactacaacggtttttatttactgtggattgacgccaaggtggcggcacgcatggtttggcgtctcctgcacggacaggtgctgacccgtcgagagcgccggcgtctgctgcggacttgcgtggactttttccgactcgtgccttttatggtgttcttgatcgtgccctttatggagtttcttctgcccgtgtttctcaaattgtttcccgaaatgttacctagcacgttcgaatcagagagtaagaaagaggaaaagcaaaaaaagaaaatggccgtcaagctggagctggccaaatttttgcaggagacaatgacggaaatggcacgacgaaatagagctaaaatgggggacgcttccacccagctgtcttcatacgtaaagcaagtccagaccggccataagcctagcaccaaggaaattgttagatttagcaaactttttgaagaccagctggcactggaacacctggaccgcccacaactggtggccctatgtaaacttttggagttacagacctttggaaccaacaacctgctgaggtttcaactcttgatgaagttgaagagcattaaggcggatgacgagatcatcgctaaagaaggcgtcaccgctctgtctgtaagcgaactgcaagcggcttgtcgcgcccgggggatgagatcattgggactgaccgaggaacaactgagacaacaactgaccgagtggcaggatctccatttgaaggagaatgttccgccctctctgctccttctcagtcgtacattttatctcattgacgtgaaacctaaacccatagagataccgctcagcggcgaagcacccaagacagacatcctggtagaactgccaacatttacggagagtaaggaaaatatggtggacctagctccacaactgaagggtaccaaagatgaggacttcattcagcctccccccgtaaccagcagcccaattacgcccagtacaccaattagcttgccgaagggcccaataacgtcctccgaggaaccaacacttcaggccaaaagccagatgactgcgcagaatagtaaggccagctccaaaggcgcttag

SEQ ID NO: 43066 - DNA, 1332 bp, Artificial Sequence
  Description of Artificial Sequence: Synthetic coding sequence
atggccttctacagctacaacagcgtgctggccatcgcccggacccggtttccttcgcactttgtgcatccgacatgctcttcctattctccttcttgtgcctttctccacttgcccgattcacatcttaataaaacatgcatgaagaactacgagtccaagaaatacagtgacccatctcagccaggaaatacagtcctccatcccggcactagactaatccagaagctgcacacaagtacttgctggctgcaagaagtgccaggcaagcctcaattggaacaggctaccaaacatccccaagtgacctcaccacaggccaccaaggagacgggtatggagatcaaagagggtaaacagagctaccgtcagaaaataatggatgaattgaaatattactacaacggattctaccttctgtggatagatgctaaagtcgctgctcgcatggtatggcgcctactgcacggccaggtgctcaccaggcgtgagcgccgcagggaggaaaagcagaagaagaagatggctgtgaagctggagctggcaaagtttctgcaggaaacgatgactgaaatggctaggaggaacagggccaagatgggagatgcctctacacagctgtcgtcctacgtgaaacaggtgcaaaccggccacaagcctagtactaaggagatcgttcgcttctccaaactctttgaagaccagttggccctagaacacttggatcggccccagttagtggctttgtgcaagctgttggaacttcagacttttggaaccaacaatttgcttcggttccagctcctgatgaagttgaagtcgatcaaggccgatgacgaaattattgccaaggaaggagtgaccgccctctctgtctcagagctgcaggccgcctgtcgcgctcggggcatgcgcagcctgggacttactgaggagcagcttagacaacagttgacagagtggcaagaccttcatctcaaggagaatgtgcccccaagcctcctcttactcagccgcactttctatctcattgacgttaagcctaagcctatcgaaatacctctgagtggagaagcaccgaaaactgacattctggtggagcttcctaccttcacagagagcaaggaaaatatggtggacctagccccacaactcaaaggcaccaaggacgaagactttatacagccacccccagtcaccagttcgcccattacaccatctacacccatttccctgccgaaggggccaataacatcttctgaggagcccacactgcaagcgaagagccagatgaccgcgcaaaattccaaagcaagctcgaaaggtgcctag

SEQ ID NO: 43067 - DNA, 429 bp, Artificial Sequence
  Description of Artificial Sequence: Synthetic coding sequence
atggccttctacagctacaacagcgtgctggccatcgcccggacccgcttcccctcgcacttcgtacatccaacatgctcttcttattctccttcctgtgcatttctgcatctgcccgacagtcacttgaacaaaacctgtatgaaaaattacgagtcaaagaaatactcagatccttcccagccaggcaacacagtgttgcatcccggcacgaggctcatccaaaaactgcatacctctacatgctggctacaggaggtgcccggaaagccgcaattggagcaagcgacgaagcaccctcaggtgaccagcccccaggccaccaaagagaccgggatggaaattaaggaaggcaaacaatcgtatcgccaaaaaatcatggatgaactaaagtactattataatggattctacctcttatggatttag

SEQ ID NO: 43068 - DNA, 351 bp, Artificial Sequence
  Description of Artificial Sequence: Synthetic coding sequence
atggccttctacagctacaacagcgtgctggccatcgcccggaccaggttcccatcccactttgtgcaccctacctgttcgtcttacagcccttcctgcgcttttctccacctgcctgactcacaccttaacaaaacctgcatgaagaattatgaatcaaaaaagtactctgacccgtctcaacctggtaatacagtcctgcaccctgggacacggttgatccagaaactgcacacctcaacatgttggctgcaggaggtgcccggtaagcctcaactcgaacaagctacgaagcatccacaggtaacatccccacaggctacaaaggagacggggatggagatcaagtag

SEQ ID NO: 43069 - DNA, 834 bp, Artificial Sequence
  Description of Artificial Sequence: Synthetic coding sequence
atggaggagaagcagaagaagaagatggccgtgaagctggagctggccaagtttctgcaggaaaccatgacagagatggcgcggcgaaatagggctaaaatgggcgacgccagtacccagttgagctcctatgtcaagcaggtgcagaccggtcacaagcctagcacaaaagagatagtgagattcagcaaactgtttgaggaccaattggcactggagcacttggatcggccacagcttgtggccttgtgcaaactgctggagctccagaccttcggtaccaacaacctgctgcgcttccagctcctgatgaagcttaaatctatcaaggcagatgatgaaatcatcgcgaaagagggagtcacggctctgtctgtttccgagctgcaggcggcctgtcgcgcaaggggaatgcggagcctaggattgactgaggagcagctgaggcagcaactcactgagtggcaagatctgcacctgaaagagaacgtccctccttctctgctgctgctttcacgcaccttttacctgatcgatgtgaaaccgaagcccatagagatcccacttagtggagaggctcccaagactgacattttagtggaactacccacatttaccgagtccaaggagaacatggtagacctggccccccagctcaaggggacgaaagacgaagacttcattcagccacccccagtcacatcctcacccatcacaccatctacgcccatttcccttcccaaaggacctattactagctcggaggaacccactcttcaagctaagtcacagatgacagcccagaattctaaggcaagttccaaaggcgcatag

SEQ ID NO: 43070 - DNA, 369 bp, Artificial Sequence
  Description of Artificial Sequence: Synthetic coding sequence
atgaagaactacgagagcaagaagtacagcgaccccagccagcccggaaatacggttctgcacccaggcacccgtttgatccagaagttacatacttctacctgttggctccaggaggtgcccgggaaaccacagctcgaacaggctacaaagcaccctcaggttacctccccacaagccaccaaggagactggaatggaaattaaagaaggcaaacagtcctacaggcagaagattatggatgagctaaaatattattataatgggttttacttgctttggattgacgcgaaggtcgctgcccggatggtgtggcgccttctgcatggtcaggtcctcacccgtagagagaggcgtcgctgtttttag

SEQ ID NO: 43071 - DNA, 1335 bp, Artificial Sequence
  Description of Artificial Sequence: Synthetic coding sequence
atgaagaactacgagagcaagaagtacagcgaccccagccagcccggcaacaccgttctgcacccaggaacccgccttattcagaaattgcatacttccacatgttggctacaggaagtgccaggcaagccacagctggagcaagccacaaaacaccctcaagtgacttcgcctcaggcaactaaggaaacaggaatggagataaaagagggtaaacaatcttatcgccaaaagatcatggatgagcttaagtactattacaacgggttctatctcttatggattgacgctaaggtggctgctagaatggtatggcgcctcttgcatggacaggtactaacccgcagggaaaggcggcgactcttgcgtacttgcgtagatttctttcgactcgtccccttcatggtcttcctgattgtcccttttatggaattcctgctgccagtctttcttaaacttttccccgagatgctgcctagcacatttgagtctgaaagtaagaaggaggagaagcagaagaagaaaatggccgttaaactggagctggctaagtttctgcaggaaactatgacagagatggcacgccggaatcgggcaaaaatgggagatgcctccactcaactaagctcctatgtgaaacaggtccagaccggccacaagccttccacgaaggaaattgtgcgctttagtaagctgttcgaggatcagctagcactggaacacctggatcgaccacagctcgttgctttatgcaaacttctggaacttcagaccttcggtaccaacaatctacttcggtttcaacttctgatgaagctgaagtcaattaaggccgacgacgagataatagctaaggagggggtcaccgcgctgagtgttagtgagctacaagcagcgtgccgcgcccgggggatgcgcagcttaggactcacagaggaacagcttcggcaacagcttacagagtggcaagatctgcacctgaaagagaatgtgcctccatcccttctactcctgtcccgcacattttacctgatcgatgtcaagccgaagcccatcgagatacccctgagcggcgaggcccccaaaaccgacatcctggtcgagctgccaaccttcactgaatctaaagagaacatggttgatttagccccgcagcttaaaggaacaaaggatgaagatttcatccagccaccccccgtgacctcgtcccccatcactcctagcacgcctatttcactgcccaagggtcctatcacctcctcagaagagcccacactccaggccaaatctcagatgactgcgcagaatagtaaggcatcttccaaaggtgcctag

SEQ ID NO: 43072 - DNA, 1872 bp, Artificial Sequence
  Description of Artificial Sequence: Synthetic coding sequence
atgcgggtggccctgggcatgctgtggctgctggccctggcctggccaccgcaggcccgaggtttttgtcccagtcagtgttcctgctctctgcacatcatgggcgacgggtctaaggcgcgcacagtcgtgtgcaacgaccccgatatgacactgcctccagcttcaatcccccccgacacatccaggctccgcctcgagcgaactgcaattcggcgtgttcctggcgaagcttttcgccccctgggcaggcttgagcaactttggctaccctataatgctttgagtgagctgaacgccctgatgctgcgagggcttaggcgcctgagagagctcaggttacctggcaaccgcctggcagcctttccctgggccgccctacgggacgctcccaaactgcggctgctcgacctccaggccaaccggctgtctgcagtacctgccgaggctgcaagattcctggaaaatctcacgttcctcgatctctcctctaatcagctcatgcgccttccacaagagctgatcgttagctgggcccatctcgagaccggtatttttcccccaggccatcacccccgccgagtgttagggctccaggacaatccctgggcttgtgactgccgactttacgatctggtgcatctgctggacggatgggctccaaacctcgccttcatcgagacagaactgagatgtgcaagccccagatcattagccggagttgccttctctcagctcgagttacgcaagtgccagggacctgagctccatcctggcgtggctagcataagatcactactaggcggcaccgccctactgcgatgtggggcaacaggggtacctggcccggagatgtcgtggagaagggcaaatggtcgacctttgaacggtacggtccaccaggaggtgtccagtgacgggactagttggacgctattaggattgcctgccgtttcacatctagattcaggtgactatatttgccaagccaagaattttttgggggcgtctgagacggtcatcagtctgatcgtgaccgaaccaccaacaagcacggagcacagcggatcccccggcgccctttgggcacgaacagggggcggaggggaggccgccgcgtacaataacaagctggtggctcggcacgtgccccagattcctaaacctgcagtgttggctaccggccctagcgttccgtctactaaggaggagctaacactggagcactttcagatggatgccctcggcgagctgagtgacggcagagccggccccagtgaagcgagaatggtgcgctccgtgaaggtggtcggagatacttaccacagtgtctctttggtgtggaaggcaccacaggctaagaatacaaccgcgttctctgtgttgtatgccgtatttggccagcatagcatgagacgagtcatcgtgcagcctggtaagaccagagttactattacaggcttgctccccaaaactaagtatgtggcgtgtgtctgcgttcagggattggttcccaggaaagaacagtgcgtaatttttagtacaaacgaagtggtggacgccgagaatacccagcagttaatcaacgttgttgtgatcagtgtcgccatcgtgatcgcactccctctcaccctccttgtctgttgctcagccctgcagaaaagatgtaggaagtgtttcaacaaggattccacagaagcgaccgtgacatatgttaacctggaaagattgggatatagcgaggacggactggaagagctgtcaagacatagtgtctccgaagccgaccgcctgctgagcgcccggagtagcgtggactttcaggcttttggtgtgaaaggtgggaggagaattaatgaatacttctgttag

SEQ ID NO: 43073 - DNA, 1491 bp, Artificial Sequence
  Description of Artificial Sequence: Synthetic coding sequence
atggtggagccccaccaggagccccggcacagcaaggtgggcctgcaggataatccttggttttgtgactgtcacataagtaaaatgatcgagctgtcaaaagttgtggacccagcgattgtccttctggacccactgatgacatgttctgaacccgagaggctgactggtatacttttccagcgcgcagagctcgagcactgcctgaagccttctgtcatgacatcagctacgaagattatgtcagccctggggtccaatgttctgctccggtgcgacgcaacagggtttccaacaccgcagattacctggacccgaagcgacagctccccagtaaattacaccgtgatacaggagtccccggaggagggcgtgagatggagcattatgtcattgacaggcatttcctccaaggacgcgggtgactacaaatgcaaggccaagaatttggccgggatgtcagaagccgtggtgactgtgactgtgctggggatcacaactacgcctatccccccagacactagcgaacgcacaggggatcacccagagtgggatgtgcaaccaggctcaggccggtcaacgagtgtatcctcagcttcctcctacctgtggagcagttctttcagccccacttcatccttttctgcaagcaccttgagccctccttcaacagcctctttttccctgtctcctttctccagttctacggtgtcttccacaaccacactttcaactagtatttccgccagcacgactatggctaataagagaagcttccagctccaccaggggggaaaaaggaacttaaaagttgctaagaacggaagcaaactgccaccggcatcaacctcgaagaaggaggaactcgcacttctggaccagaccatgctcaccgaaaccaacgccgccatcgaaaacctgcgggttgtgtccgaaactaaagaaagcgtaaccctcacctggaacatgatcaacacaacgcacaattctgcggtgacagtgctctactccaaatacggcgggaaggatctcctcctgctgaacgcggatagctctaaaaatcaggtcaccatagatggcctggagccaggcggccagtatatggcctgtgtctgcccaaagggagtccccccccaaaaggatcaatgcatcacgttttccaccgagagagtcgaaggcgacgacagccagtggagtctgctcctagtggtcacaagcacagcttgcgtggtcatcctcccccttatatgtttcctgctttataaggtttgtaaactgcagtgcaagtcggaacctttctgggaggatgacctggcaaaggaaacctacattcagttcgaaacactgttccctcggtctcagagcgtaggcgaactctggaccaggtcacatagagatgactccgagaaactcctcctttgctctagaagttcagtggagtctcaagtgacctttaagtccgaggggtctagacctgaatactactgttag

SEQ ID NO: 43074 - DNA, 1905 bp, Artificial Sequence
  Description of Artificial Sequence: Synthetic coding sequence
atggacatgaacgagctgcccaccaacctgcccgtggacaccgtgaaactgcgaattgagaagaccgtaatccgtaggattagcgccgaagccttttactacctggtcgaactccaatatctctgggtgacatataatagcgtcgcctccatcgaccccagctctttctataatctgaaacagctccatgagctgaggttggatggtaatagcctggctgccttcccgtgggcctcacttctggacatgcccttgctgagaacactggacctgcataacaacaaaataacatccgttccgaacgaggccctaaggtacttgaagaatttggcttacctcgacttgtcatctaataggctgactacactgcctccggattttctggagagctggactcatctggtatccactccatctggcgtactggacctttccccgtcccgaattattttggggctgcaggacaacccttggttttgcgactgtcacatctccaaaatgattgagctgtccaaggttgtagatcctgccatcgtgttactagacccactgatgacatgctccgaacccgagcggttgactggcattctgttccaacgcgcagaactagaacactgtcttaaacccagcgtgatgacaagcgcgactaaaattatgagtgctctgggctctaatgttctgctaagatgcgatgctaccgggtttcccacacctcagattacgtggacacgttctgattcctccccagtgaactacacagttatccaggaaagtcccgaagaaggcgtgaggtggagcataatgagcttgacgggaatctcctccaaggacgccggcgattacaagtgcaaggcaaagaatttggcgggaatgtctgaagccgttgtcacggttacagttctggggatcaccactacgccgataccacccgacacatctgagagaactggggaccacccggagtgggacgtgcagcctgggagcgggcgcagcacgtcagtttcatccgcctcctcatacctatggagctctagcttttcaccaacctcctctttttcagcctctacactgtctcctccaagtacagccagtttttcactgtcaccattcagcagcagcaccgtctcgtccacaaccacactgagcactagcatatcagcatcaaccactatggctaataaacggtcattccaactgcaccaaggagggaagagaaacctgaaggtcgccaaaaatggatctaaactgcctccagcctctacctccaagaaagaggagcttgctctgcttgaccagaccatgctgactgagactaatgccgccatagaaaatctgcgcgtcgtcagcgaaacaaaggagagcgtgaccctcacctggaacatgatcaacactactcacaattcagctgtcaccgtcctatactcaaagtacggcggcaaagatcttctcctgctgaatgccgacagctcaaaaaaccaggtgaccatcgatggcctagagccaggcggacaatatatggcttgcgtctgccccaagggtgtgccaccacagaaggaccagtgcattacctttagtacagagcgtgtggagggcgatgatagccagtggagtctgctgctagtcgttacatccaccgcctgcgtggttattctaccgctaatctgctttctgctgtacaaagtgtgcaagttgcagtgtaagagcgaacctttttgggaagatgaccttgctaaagagacttacatccaattcgagactctgtttccacgcagccagtccgttggggagctgtggacccggtcacatcgcgatgactctgagaaattgttgttgtgtagccgtagctccgttgagagtcaggtgacctttaagagcgaggggtctaggcccgagtattattgttag

SEQ ID NO: 43075 - DNA, 1491 bp, Artificial Sequence
  Description of Artificial Sequence: Synthetic coding sequence
atggtggagccccaccaggagccccggcacagcaaggtgggcctgcaagacaatccatggttctgcgattgtcatatatccaagatgattgaactgagtaaagtggtggatcctgcaattgtactactggacccgctcatgacatgttcagagcccgaacgtctaactggtatcctgttccagcgcgccgagcttgaacattgcctcaaacctagtgttatgacctcagctactaaaattatgtctgctctgggtagcaacgtattactccgctgcgacgctactggcttccctaccccgcaaatcacctggaccagatcggacagttcaccagttaattacactgttattcaagaaagtcccgaagaaggcgtaaggtggtccatcatgtcccttacgggtatcagctctaaggatgctggggactacaaatgcaaggcaaagaaccttgcaggcatgtcagaggccgtggtgaccgttaccgtcctcggaatcacgaccacccctatcccacccgacacaagtgaacggaccggcgaccaccctgaatgggacgtacagccggggtctggccggagtacttctgtgtcctcagccagcagttatctgtggagctcctcatttagccccacatcgtccttcagcgcttccaccctcagccccccatcaactgcatccttctccctatcgcccttctcctcctccactgtctcgagcactactacgctgagcacaagcatatcagcgagcacgacaatggcaaacaagaggtctttccagctccaccagggaggcaagcggaacctgaaagtggccaagaacgggagtaagctcccgccagcttctacttcgaagaaggaagaactcgcattgctcgatcaaaccatgcttactgaaactaacgccgccatagaaaacctgcgagtcgtaagtgagaccaaggagagtgttacactgacctggaatatgattaatacgacacacaattctgctgtcacggtcctctacagtaaatatggcggcaaggacctcctcctgctaaatgctgattcctctaagaaccaggtgacaattgatggcctggagccgggcggacagtacatggcctgtgtgtgccccaagggtgtgcctccgcagaaggatcagtgtatcaccttttccaccgagagggtagaaggcgacgatagccagtggagccttttgctggtggtaacatcaaccgcatgtgtcgtgatcttaccacttatatgcttcctgttatacaaggtgtgtaaactgcagtgcaaaagcgagcccttctgggaagacgacttggcgaaagaaacatatatccagtttgaaacattgttccccagaagtcagtccgtaggggagctatggacaaggagccatagagacgactcagagaaactcctgctgtgtagccgtagctcagtcgaatcacaggtcacattcaagtcagaagggtcccggcccgagtattattgctag

SEQ ID NO: 43076 - DNA, 3360 bp, Artificial Sequence
  Description of Artificial Sequence: Synthetic coding sequence
atgagcgcccccagcctgcgggcccgggccgccggcctgggcctgttactatgtgcagtccttgggcgggccggcaggtccgattcagggggcaggggcgaattgggccaaccgtcgggcgtcgcggccgagagaccgtgccccaccacctgccggtgcttgggtgacctgctggactgttcccgaaagagactcgctcgtttgccagaaccactcccctcttgggtggccagactcgacctctcccacaatcgactgtcattcatcaaggcgagctccatgtctcatctgcagtctctgcgcgaggtgaagctgaataataatgaactggaaacaatcccaaaccttgggccagtgtcagcgaatattacccttctgagtctggctggtaatagaatcgtggaaatcctgcctgaacacttaaaagaatttcaaagtctggagaccctggacctgtcctcaaataacatttccgagctgcagactgcctttcctgctcttcagcttaagtacctttacctcaattcaaacagggtcacaagcatggagcctggctatttcgacaacctggccaatactctgctggtgttgaagttgaacaggaacaggattagtgccattcctccaaagatgtttaaactcccccaactgcaacatctcgagctgaataggaacaagatcaaaaatgttgatgggctcactttccagggcctaggcgcactgaagtctctgaaaatgcagaggaatggcgttactaagttgatggacggcgccttctggggcctcagcaacatggagatcctgcagctggatcataataacctgactgagattacgaaagggtggctctatggcttattgatgctccaggaactccacctttcgcagaatgccatcaataggatcagtcccgacgcttgggaattttgccagaagctttctgaactggatcttacctttaaccatctgtcccgcctggacgacagctctttcctgggcctgagcctgctcaacactctgcacataggcaacaacagagtcagttatatcgccgattgtgcctttcgcgggttatcaagcctcaagaccttggatctgaagaacaatgaaatctcttggactatcgaggatatgaacggagcctttagtggactggacaaactgaggcggttgatcctacaggggaatcggatccggtccatcaccaagaaagcctttacagggctggacgcccttgagcacctggacttatcagataatgccattatgtcgcttcaaggaaacgcattctcacagatgaagaagctacagcagttgcatctgaacacatcctcgctcctgtgtgattgtcagctgaagtggctgcctcagtgggtagcagaaaataacttccagtctttcgtgaacgctagttgcgcccacccccagttgctgaagggcagaagcatattcgcagtgtccccagacgggtttgtgtgcgacgactttccaaagccccagattactgtgcagcctgagactcagtctgcaattaaaggatccaatctaagctttatatgcagtgcggccagctctagtgattcaccgatgacatttgcttggaagaaggacaacgagctcctgcacgatgctgaaatggagaattatgctcacctgagggcccagggcggtgaagtgatggagtataccactatcctgcggcttagagaagtcgagtttgccagcgaaggaaaatatcagtgtgtaatctccaaccatttcggctccagctacagcgtaaaggctaagttaaccgtcaacatgctcccttcattcaccaagactcctatggatttaactataagggccggagcaatggctcgcttggagtgtgccgccgtgggacatcctgcccctcagatcgcctggcagaaagatggagggaccgatttcccagctgcccgtgagagaagaatgcacgtgatgccagaagatgacgtgttctttattgtggacgttaagattgaggacatcggggtttattcctgcacagcccagaatagcgctggaagtattagtgccaacgccactctcacagtcctcgaaaccccctctttcttgcgacctctgctggaccgaactgtaacgaagggggagactgctgttctgcagtgcattgccggtggtagcccccctccgaaactcaattggacgaaagatgatagccccttggttgtaaccgagcgacatttttttgctgccgggaaccagctgctgattatcgtcgacagtgacgtctcagatgcgggcaagtatacctgtgagatgagcaacacactgggtactgaacggggtaatgtccggctgtcagttattcccacaccgacctgcgacagcccgcagatgaccgccccaagcctcgatgacgatggttgggccactgtgggcgtagttattatcgccgtcgtatgttgtgttgtaggcacttccctggtctgggtcgtgattatataccacacgagacggcgtaatgaggattgctctattactaatacagatgagacaaatcttccagccgacattcccagttacctgtccagtcagggaactctcgccgataggcaggacggatacgtcagcagcgaaagtggctctcatcaccagttcgtgacgtccagcggagccggcttttttctgcctcaacacgactcaagcggaacctgccatatagataactcctctgaggctgacgtggaggcagcaaccgatttgttcctatgtccattcttgggaagcaccggacctatgtatctgaaagggaatgtgtatggtagcgaccctttcgaaacataccacacggggtgttcaccagacccccggaccgtgctaatggatcactacgagccttcctacattaagaaaaaagaatgctatccatgttctcatccatcagaggagtcgtgtgaaaggtccttctctaacatcagttggccgagtcacgtgaggaaacttctgaatacctcatattcgcacaatgagggtcctggcatgaaaaacctgtgtctcaataaatcctccctagactttagcgctaaccccgagcccgccagcgtggccagcagcaatagcttcatgggaaccttcggaaaggccctgcgccgcccccacctcgatgcctactcatcctttggccagcctagcgactgccagccaagagcattttatctgaaagcacactcctcaccagatctcgactccggcagcgaggaggacgggaaggagcggacagactttcaggaggagaaccacatctgtacctttaagcagaccctcgagaactacaggacaccaaattttcaatcctacgacctggatacatag

SEQ ID NO: 43077 - DNA, 3180 bp, Artificial Sequence
  Description of Artificial Sequence: Synthetic coding sequence
atggtggacgtgctgctgctgttcagcctgtgcctgctgttccacatttcaagacccgatctgtctcacaaccgactcagctttatcaaagcctcgtcgatgtctcatcttcagagcctcagggaagttaagctcaataacaatgaattggagactattccaaacttgggacctgtttctgcgaacatcaccttgctcagcctcgccggaaataggattgtcgagattctccctgaacacctcaaggagttccagagcctcgaaacgctggacttgtcgagtaataacatatctgaactgcagactgcattcccagctctgcagttgaaatacctgtatcttaatagtaatcgtgtcacttccatggagcccggatacttcgataacctggctaacactttgcttgttctcaagttgaataggaaccggatcagcgcaattcctccaaagatgtttaaactccctcaattacaacatctggaactgaataggaacaagattaaaaatgtcgatggtctcacctttcagggccttggcgccttgaagtccttgaagatgcagcggaacggggtgacaaagctgatggacggggccttctgggggctttccaacatggaaattctgcaactcgaccacaataatttgacagagataactaaaggttggctgtatggactgttaatgttacaggagctccacctgagtcaaaatgctattaaccggatctctccggatgcctgggaattctgccagaagctatccgaactcgatctaacttttaaccatctctcccgtctcgacgactcttcctttctaggactcagcctgcttaacactctacacatcggcaacaatcgcgtgagctacattgctgattgtgcgttccgaggcctctccagcctgaaaactctggatctgaagaataacgagatcagttggaccatcgaagatatgaatggagccttcagtggcctcgacaagttgcggagactgattctgcagggaaaccggattcgcagtattaccaaaaaagccttcaccgggcttgatgctttagagcacctggatttaagcgataatgccatcatgagtttgcaaggaaatgcttttagccagatgaagaaacttcagcagctgcaccttaacactagtagtctcctgtgtgactgccagctgaagtggctgccacagtgggtggctgaaaacaatttccaaagctttgttaatgcctcctgcgctcatccccaactgttaaagggccggagcattttcgcagtctctccagatggattcgtatgcgacgattttccaaagccacagatcactgtccagccagaaacgcaatctgctattaagggatcgaatctatcatttatttgctcagccgcgtcctctagcgacagtccaatgacttttgcttggaaaaaggacaatgagctgctgcatgacgctgagatggaaaattatgcccacttgcgggcgcaggggggtgaggtcatggagtatactaccatcttgaggctgcgtgaagtcgagttcgcatctgaaggcaaatatcagtgtgtgatctccaaccactttggaagctcctattctgtgaaagcgaaactgacagtgaacatgctacccagtttcacaaagaccccaatggacttgactatcagagcaggggctatggcccgtctggaatgcgctgcagtgggtcacccggccccccagattgcctggcagaaggacggcggaacagattttcccgccgccagggagcgccggatgcacgtaatgcccgaggacgacgtgttttttatcgtcgatgtgaagatcgaagacataggcgtgtactcttgcaccgcgcagaatagcgcaggtagtatatctgcgaatgctaccctaaccgtattggaaactcccagcttcctgcgccctctgctggaccggacagtgactaaaggggaaacagctgtcctgcagtgcattgctggcgggtcacccccccccaaattaaattggacaaaggatgatagtccgctggttgtgactgaaagacactttttcgccgcaggcaatcagttactgataattgtcgactcggatgtcagtgacgccggcaaatatacttgcgaaatgtcaaatacgctggggactgagcgcggcaacgtccgcttgagtgtcattcctactcccacttgcgattctccacagatgacggcacctagcctggacgacgacgggtgggcaaccgtgggagttgtgatcattgcagtggtgtgttgcgtggtaggtacatcactggtgtgggtagtgattatttatcatacccggagacgcaacgaggactgctccatcacaaatacagatgaaaccaacctccctgccgacataccctcatatttatcaagtcaggggaccttggcagatcgccaggatggctacgtgtcaagcgaatctggttctcaccatcagtttgtaaccagtagtggcgcaggatttttccttcctcagcatgactctagcggaacttgtcatatcgataactccagtgaggctgatgtagaggcagccacagacctgtttctttgcccattcctgggctccaccggtccgatgtatttgaagggtaacgtgtacgggtcagatcccttcgagacttaccacaccggatgtagtcctgatccacgcactgtgctgatggaccactacgaaccttcatacatcaaaaagaaggaatgttacccctgctcgcacccaagtgaggagtcctgtgagaggtcctttagtaacatttcttggccatcccatgtgcggaagctcctgaacacgagctactctcacaacgaggggcccggcatgaaaaacctctgcctgaacaagagcagtctggatttctcagctaaccctgagcccgcttccgtcgcctcatctaacagcttcatgggcactttcgggaaggccctccgcagaccgcatctagatgcatatagctcatttgggcagccttctgactgccagccgcgtgccttctacttaaaagctcattcatcacctgatctcgactcgggctccgaagaagatggcaaagaacgcacggactttcaggaggagaatcacatttgcacctttaagcagactcttgaaaactatcgaaccccaaatttccagtcatacgacctggatacttag

SEQ ID NO: 43078 - DNA, 1038 bp, Artificial Sequence
  Description of Artificial Sequence: Synthetic coding sequence
atgaagggcgagctgctgctgttcagcagcgtgatcgtgctgctgcaggtagtctgcagctgccccgataagtgttactgccagtctagcaccaacttcgtcgactgttcgcagcaaggcctggctgagattccctctcacctgccaccgcagacaagaacactgcacctgcaggataaccagatccatcacttacctgccttcgcgttccgctccgtcccttggttgatgaccttgaacctatccaacaatagtctaagtaacttggcccccggcgccttccacggcttgcagcacctccaggtcctgaatctgactcagaattctctgctgtcgttggagtctcgtctttttcattcgctcccccagctccgtgagcttgacctctcgtctaacaatatttctcacctgcccacctcactgggagagacatgggaaaacctaacgattctcgccgtacaacaaaatcaactgcaacagctggatagggccctgctggaatccatgccaagcgtgaggcttcttttgctaaaggacaatctgtggaagtgtaattgtcacctgcttggccttaagttgtggctggaaaagtttgtctacaaaggaggactcactgacggtatcatttgcgagagtcccgatacctggaagggaaaagatctgctcagaatcccccacgaattgtatcagccctgtccgctgcccgctcctgacccagtctcttctcaggcacaatggcccggtagtgcccatggtgtggtattgcggcctcctgagaaccacaatgcgggagagcgggaactactcgaatgtgaactgaaacctaaacccagacccgctaacttgaggcatgctatcgccactgtcattataaccggggtggtgtgtggaatagtgtgcctaatgatgctggccgctgcgatttatgggtgtacctacgcagctataactgcccaataccacggaggacccctggcacagacaaacgatccaggcaaggtggaagagaaagagaggtttgactccagtccagcatag

SEQ ID NO: 43079 - DNA, 810 bp, Artificial Sequence
  Description of Artificial Sequence: Synthetic coding sequence
atgaccctgaacctgagcaacaacagcctgagcaacctggcccccggcgcttttcatggcctgcagcacctgcaggtcctgaacttgacacaaaacagcctactgtcccttgagtcacgcctttttcattccttgccacagcttagggagctcgatctttcatcaaacaacataagtcatctgcctaccagtttaggcgagacctgggaaaacctcacaattctggccgtacaacaaaaccagctgcagcagctggaccgagccctccttgaatccatgccttctgtgcgactgctgctgcttaaagataatctgtggaagtgtaattgccaccttcttgggctgaagctctggctggagaagtttgtatataaaggcggattgaccgacgggattatctgcgagtcaccggacacatggaaggggaaggacctgctgcggatcccgcacgaactctatcagccttgcccactccccgctccggaccctgtctcatcccaggctcagtggccaggctcggcccacggagtcgtgctgaggcctcccgaaaatcacaatgccggggaaagagaattactggagtgcgaactgaaaccaaagccccgacctgccaacctccgacacgccattgccactgtcattataacaggcgttgtgtgcgggatagtatgcctcatgatgttggcagccgctatatacgggtgcacctacgctgctattacggcccagtatcatggtggaccactcgcacagacgaatgacccaggcaaagtggaagagaaggagcggtttgatagctccccggcttag

SEQ ID NO: 43080 - DNA, 1113 bp, Artificial Sequence
  Description of Artificial Sequence: Synthetic coding sequence
atgctggcccccggcagcagccccggccagcggggccggctggccctacagtggaggcaggtgagttggatcacatgctggattgcactgtacgccgtcgaggctcttccaacctgtcccttctcttgtaagtgtgactctcgcagtcttgaggtggattgtagtggcctcgggctgactacagtgccacccgacgtcccggctgctactcggactctgttgcttttgaataacaagctgagcgccctcccgtcttgggctttcgccaacctctcttctctgcaacggctggatctcagcaataacttcttggaccgcctgccgcggtccattttcggtgaccttactaacctgaccgagctgcaactacgcaacaactctattaggactttggatagagacctgctgagacatagccccctcttgcgtcatctggatctctccattaacgggttggctcagctgccaccagggctctttgacggcctgctcgcactgaggagtctcagcctgagatcaaataggcttcagaatctggatcgcctcaccttcgagcccctggcaaacctgcagctactgcaggtcggggacaatccctgggagtgcgactgcaacctgcgcgagtttaagcattggatggagtggttttcctatcgcggcggacggctggatcaattagcgtgtactctcccgaaggaactgcgcgggaaagatatgaggatggtgcctatggagatgtttaattattgcagccagctcgaggacgaaaatagttccgccgggctggacattcctggacctccctgcaccaaagctagccctgaacccgcaaagcctaagccaggcgcggaacctgaacccgagccttctacggcatgtccccagaagcagagacacagaccagcaagcgtaagaagagccatggggactgtgatcattgccggggtcgtatgcggagtggtgtgtataatgatggtggtggcagccgcgtacggctgtatctatgcttcgctgatggcaaagtatcatagagagttgaaaaagaggcagcctcttatgggcgaccctgagggggaacatgaggatcagaaacagatcagttctgtggcatag

SEQ ID NO: 43081 - DNA, 408 bp, Artificial Sequence
  Description of Artificial Sequence: Synthetic coding sequence
atgcggatggtgcccatggagatgttcaactactgcagccagctggaggacgagaacagtagtgccggtttggacatccccgggccgccttgtaccaaggcgtctcctgagcccgccaaacctaagcctggtgctcaacattctttgccaacagaagctgaggctccagccggggaaagggaggccagtcacgggcatggggaccactgccgtggcagagtaagaaggcggctccaccacgacggaggaggtcggtgtttgtggttacacctccgactgccccatggccaagtgcctccgggcgcccagaaagcccctgctcctgacggcgggcctcggggtagggctaggggacccgaagctgacctgttctgcggcctgtcagcccatccgcatccggccaggtag

SEQ ID NO: 43082 - DNA, 1113 bp, Artificial Sequence
  Description of Artificial Sequence: Synthetic coding sequence
atgctggcccccggcagcagccccggccagcggggccggctggccctgcaatggcggcaggttagttggattacctgctggattgctctgtacgcagtcgaagctctgcccacatgtcctttctcttgcaagtgtgactcccgatccctcgaggtggattgctctggcctgggactgaccaccgtgccccccgatgtgccagccgctacacgaactctgttactcctcaacaataagttatcagctttgccttcatgggcttttgctaatttgtcttccctccaaagactggatctgagtaataacttcctggatcggctcccaaggagcatcttcggcgacctcaccaatctgaccgaattgcagctcagaaataactccatccgaaccttggatagagacttgctaaggcattcacctctactcagacacttggaccttagtattaacggactggctcagctgcctcctggcctgtttgatgggttgttggccctgaggagcctaagcttacggagtaataggctgcaaaacctcgaccggctgaccttcgagccattggccaatctgcagctcctgcaggtgggggataacccatgggaatgtgactgtaatctcagggaatttaaacattggatggagtggttcagctatcgcggcgggcgactggatcagctggcttgtaccctccctaaggagttacggggtaaagacatgcggatggttcctatggaaatgtttaactactgctcccagcttgaggacgaaaactccagcgcggggctggacatccccggcccaccctgtaccaaggcgtctcccgagcctgcgaaacctaagccaggtgccgagccagagcctgagccctctacggcctgcccccagaagcaacggcatcggcctgcttcagtcagaagagccatgggcacagtgatcatcgcaggggtcgtttgcggagtggtgtgcatcatgatggtggttgccgctgcctatgggtgtatttacgccagtctcatggcaaagtatcacagagagctgaagaaacggcagcccctaatgggagaccccgagggggagcatgaggatcagaagcagattagcagtgttgcttag

SEQ ID NO: 43083 - DNA, 1113 bp, Artificial Sequence
  Description of Artificial Sequence: Synthetic coding sequence
atgctggcccccggcagcagccccggccagcggggccggctggccctgcaatggaggcaggtttcttggatcacctgctggatcgctctatatgctgtggaggctttgccaacctgtccgtttagctgtaaatgtgactcacgcagcctggaagtcgactgttcgggactcgggcttaccacagtgcctccagacgtgcctgccgctacacggactttgctactactcaataacaagctgtctgccctgccctcctgggcctttgctaacctatcgagccttcagcgcttggacctttcaaacaactttttggaccggctcccacgcagtatctttggagaccttactaatctcacggagttgcagcttcgaaataactcaatacgcacccttgatcgggacctgctgagacatagcccactgctgcgacacttagacttgtccattaacgggctggcccagctccccccaggactctttgatggattgctggcactgaggtccctctctctacgtagcaatcgactccagaacctggacaggctcaccttcgaacccctcgccaatcttcagcttcttcaagttggcgacaacccatgggagtgtgactgcaacctgagagagttcaagcactggatggagtggttcagttaccggggaggtaggctggaccagctggcctgtactttacctaaagagcttagaggtaaggatatgaggatggtccctatggaaatgttcaactactgttcccagctggaggatgagaactcctccgctggcctggacattcccggacccccatgtaccaaagcctctcctgagccagccaagcctaagcccggggccgagcctgaaccagagccgagcaccgcttgccctcagaagcagcggcacaggccggccagcgtcagacgggccatgggcacagtgattatagctggggtggtctgcggtgtcgtgtgtatcatgatggtggtcgcagcagcctatgggtgtatctacgctagcctgatggcaaagtatcatcgtgaacttaagaagagacagccgcttatgggggaccctgaaggcgaacacgaagaccagaaacaaatctcatcagtggcatag

SEQ ID NO: 43084 - DNA, 1500 bp, Artificial Sequence
  Description of Artificial Sequence: Synthetic coding sequence
atgaccctgatcctgaccagcctgctgttcttcggcctgagcctgggaccccgtacaagggtgcaggccgagaacttacctaaaccgattctgtgggccgagcccggaccggttatcacatggcacaacccagtgacgatttggtgccaggggacactagaggcccagggctaccgactggacaaagaggggaattccatgagcagacacatcttgaaaacccttgagtcggaaaataaggttaaactgtccattcccagcatgatgtgggaacatgcaggccgctatcactgctattaccagtcccctgctggatggtctgagcccagtgacccattagaacttgtggtgaccgcgtatagtaggcccaccttgtccgcgctgccgtcacccgtggttacctccggggtcaatgttacccttcggtgtgccagcaggctcgggttgggcaggttcactttgatcgaagagggtgatcataggctgagttggactctgaattctcaccaacataaccacggaaagtttcaggctctgttccctatgggccctctgactttttcgaatcggggaaccttccgctgctacggatacgaaaacaatactccttatgtttggagtgagcccagcgaccctctgcagctattggtgtctggggttagccggaagccaagcctgttgaccctacagggccccgtggtcacccctggagaaaacctgactctccagtgtggaagtgatgttgggtacatccgctataccctgtacaaggagggcgcggacggacttccgcagaggccaggacgccagccccaggccggtctgtcccaggctaactttaccctcagcccagttagtcggtcatatggcggccagtatagatgttacggagcacataatgtctcctccgagtggtctgcgccgtccgaccctctagatatactcatcgcaggtcagatctccgatcggccatccctatctgttcagcccggaccaacagtgacctcaggcgagaaagtgacgctgctttgccaatcctgggacccaatgtttactttccttttgacaaaggagggcgctgcacatccccccctgcggctgcggtctatgtacggcgctcacaagtatcaggccgagtttccaatgtcgcctgtgacatccgcacatgcagggacttacaggtgctatggttcgagaagctccaacccttatctgttatcccaccctagtgaaccactggaactggtagtgtctggggctactgagacgctcaaccccgcacagaagaaatctgattccaaaaccgctccccatttgcaggactacacggtcgaaaatctgatccggatgggggttgccgggcttgtgctattgttcctcggaatcctgctatttgaggcgcagcacagccagaggtctccgccaaggtgtagccaggaggccaacagcagaaaagacaatgccccctttcgagtcgtggaaccttgggaacaaatatag

SEQ ID NO: 43085 - DNA, 978 bp, Artificial Sequence
  Description of Artificial Sequence: Synthetic coding sequence
atggccaacgccctggccagcgccacctgcgagcggtgcaagggcggcttcgcccctgccgagaagatcgtaaatagcaacggagagctgtaccacgagcagtgctttgtgtgtgcacagtgcttccaacagtttccagagggactattctatgagtttgaagggcgaaagtattgcgagcacgacttccaaatgctgttcgcaccttgttgtcaccaatgtggcgaattcattatcgggcgggttatcaaggctatgaataactcttggcaccccgagtgttttcgctgtgatctctgccaggaggtgctggcagacatcggcttcgtgaagaatgcgggccgtcatctgtgccggccatgccacaacagggagaaggctcggggcctaggcaagtacatctgtcagaagtgccacgctattatcgacgaacaacccttgatctttaagaatgatccttaccaccctgatcacttcaactgtgccaactgcgggaaagagctaacagccgatgccagggaactcaaaggagagttgtattgtcttccatgccatgataaaatgggtgttcctatctgcggggcctgtcgccgacctattgaaggtcgcgtggtgaacgcaatgggcaagcagtggcacgttgagcactttgtgtgtgctaaatgcgaaaagcctttcctggggcacaggcattatgagcgcaaaggactggcctactgcgagacacattataatcagctttttggtgacgtgtgctttcattgtaacagggtgatagaaggcgatgtcgtttcggctctgaacaaggcctggtgcgtcaattgtttcgcgtgttctacatgtaacactaaattgactctcaaaaacaagtttgttgagttcgatatgaagcccgtgtgtaaaaagtgttacgagaagttccccctagagctgaaaaaaagactaaagaagctggccgagacattaggccgcaaatag

SEQ ID NO: 43086 - DNA, 978 bp, Artificial Sequence
  Description of Artificial Sequence: Synthetic coding sequence
atggccaacgccctggccagcgccacctgcgagcggtgcaagggcggtttcgctcctgccgagaagattgtgaactctaatggggagttatatcacgaacaatgcttcgtgtgcgcccagtgcttccagcagtttcctgagggtctcttttacgagtttgagggcagaaagtattgcgagcatgattttcagatgttatttgccccttgctgccaccaatgcggtgagtttattattggacgtgtgattaaggccatgaataattcgtggcaccctgagtgtttcaggtgtgatttatgccaggaggtcttggccgacatcggcttcgtgaagaacgcgggcaggcacctttgccgaccatgccacaatagagagaaagctcgcgggctggggaaatacatctgccaaaaatgtcacgcaataattgatgagcagcctctcatcttcaaaaacgacccttatcatcctgaccacttcaattgtgccaactgtggcaaggagcttacagctgacgctagagagctgaaaggagaactttactgcttgccttgccatgataagatgggggtccctatctgtggcgcctgccgcaggccgatcgagggcagggttgttaacgccatgggtaaacagtggcatgtagaacactttgtatgcgcaaaatgtgaaaagccctttctcgggcaccgccactatgagagaaagggacttgcttactgcgaaacccactacaaccagctctttggagatgtctgtttccactgcaacagggtcatagagggcgacgtggtgtcagcactgaacaaggcctggtgcgtgaactgctttgcatgttctacctgcaacactaaactgacgttgaaaaacaaattcgtggaatttgatatgaaaccggtttgcaagaagtgttacgaaaaattccccctggaattaaagaagcgccttaagaagcttgccgaaacgctcggaagaaagtag

SEQ ID NO: 43087 - DNA, 978 bp, Artificial Sequence
  Description of Artificial Sequence: Synthetic coding sequence
atggccaacgccctggccagcgccacctgcgagcggtgcaagggcggattcgccccggctgagaaaattgtgaactccaacggggaactctatcacgagcagtgttttgtctgcgcccagtgcttccagcagttccccgaaggactgttctacgaatttgagggccggaagtattgcgaacacgacttccagatgttgtttgcaccttgctgccaccagtgtggcgagtttattatcggccgcgtaatcaaggctatgaacaacagttggcaccctgaatgcttccgctgtgacctctgtcaagaggtgctggccgatattggtttcgtgaagaatgctggtaggcacttgtgtcgaccctgtcacaacagagagaaggcaagaggcctaggcaagtatatctgccagaaatgccatgcaatcatcgacgagcagcccctgatctttaagaacgatccatatcatccagatcatttcaattgtgctaattgcggcaaagaattgactgccgatgcacgggagctgaaaggggagttgtactgcttgccatgtcacgataagatgggcgttccaatttgtggagcatgtcggcggcctattgaggggcgggttgtaaatgcgatgggaaagcagtggcatgtggagcatttcgtgtgcgctaaatgtgagaaaccattcctgggccatagacattatgagcggaaaggcctggcctattgtgaaacccattacaatcagctgttcggcgatgtttgtttccactgtaacagggtcatcgaaggggacgtggtcagcgccctgaacaaggcgtggtgcgtgaactgttttgcatgctctacttgcaacaccaagctgacactcaaaaataagtttgttgaatttgacatgaagccggtatgcaagaagtgctacgaaaagttccctctggagctgaagaaaaggttgaagaaacttgctgaaactctggggagaaagtag

SEQ ID NO: 43088 - DNA, 354 bp, Artificial Sequence
  Description of Artificial Sequence: Synthetic coding sequence
atggccttcagcggccgggcccggccctgcatcatccccgagaacgaggagattccgcgagccgcattaaatacggttcatgaagcaaacgggaccgaagacgagcgtgctgtttcaaaactgcagcgtcggcattccgacgtgaaggtatacaaagaattctgcgatttctacgccaagtttaacatggctaacgctctggccagcgccacgtgtgagcgatgcaaaggcgggtttgccccggccgagaaaatcgtcaacagtaatggggagttgtatcatgaacagtgtttcgtgtgtgcacagtgcttccaacagtttcccgagggcctgttctacgaggagcgtacctag

SEQ ID NO: 43089 - DNA, 1089 bp, Artificial Sequence
  Description of Artificial Sequence: Synthetic coding sequence
atgaccgccctgcagctgaaggagctgagccacagcggcctgtacaggcggcgccgggaccgacctgattcattgcgcgtgaacgggctgccggaggaggagttgagtaacatggcaaatgccctcgccagcgcaacctgcgagcgctgcaagggtggatttgcgcccgccgagaagatcgtgaactccaacggagagctctatcacgagcagtgttttgtgtgcgctcagtgcttccaacagtttcctgagggattattctatgagtttgagggccgaaagtactgtgaacatgatttccaaatgctgtttgcgccctgttgccaccagtgcggggagttcattatcggccgagtgattaaggctatgaataactcgtggcatcccgaatgctttaggtgtgatctgtgccaggaagtgttggccgacataggctttgtcaaaaacgcaggtagacatctgtgcagaccatgtcataaccgcgagaaggccagaggtctggggaaatatatctgtcagaagtgccacgctataatagatgagcagccattaatcttcaagaacgatccctatcaccccgatcattttaactgtgcaaattgtggaaaagagcttacagcagatgctcgggaactcaaaggggaattatattgtcttccttgtcacgacaagatgggtgttcccatttgcggcgcatgtcgcaggcccattgaaggccgggtagttaacgctatgggtaagcagtggcatgtggagcactttgtctgtgctaagtgcgaaaaaccctttctgggccaccgtcattatgagcggaaaggtttagcctattgcgagacacattataatcagctgtttggggatgtgtgtttccattgtaatcgagtgatcgagggcgacgtggtctccgccctgaataaagcgtggtgtgtcaattgctttgcctgcagcacctgcaatactaagctgactctgaagaacaaattcgtcgagttcgatatgaagcccgtgtgcaagaaatgttacgagaaattcccactcgaacttaaaaagcggctgaagaagctggctgagacactgggtcggaaatag

SEQ ID NO: 43090 - DNA, 990 bp, Artificial Sequence
  Description of Artificial Sequence: Synthetic coding sequence
atgacctgcaacatggccaacgccctggccagcgccacctgcgagaggtgtaaggggggctttgcacccgcagagaaaatcgtgaacagcaacggggagctttaccacgagcagtgtttcgtttgcgctcaatgcttccagcagtttcccgaaggcctgttctatgagtttgagggtagaaaatattgcgaacatgatttccagatgttgttcgctccctgctgtcaccagtgcggcgaattcatcatcggtagggtgatcaaggcgatgaataattcgtggcacccggaatgcttcaggtgcgacctatgtcaagaagtgctggctgatatcggcttcgtgaagaacgccggacggcacctgtgtcgcccctgccataaccgcgagaaagcacggggcctggggaagtacatctgtcagaaatgtcatgccattattgatgagcagccactaatctttaagaatgatccatatcatcctgatcacttcaattgtgcaaattgcggcaaggagcttactgctgacgctcgtgagctgaagggagaactgtactgcctcccatgccacgacaagatgggggtgcctatatgtggagcctgtcgcaggcctatcgaaggccgggtcgtcaatgcgatgggcaagcagtggcacgtggaacactttgtgtgcgccaagtgcgagaagcccttcctcggccacagacactacgaacggaagggcttggcatactgtgagactcattataaccagctctttggagatgtgtgttttcattgtaatcgcgtgatcgaaggagacgtggtctccgctctcaataaggcatggtgtgttaactgctttgcatgttcaacttgtaacacaaagttaactctcaagaacaaattcgtggaatttgacatgaaacccgtgtgtaaaaagtgttatgaaaagttccctctcgaattgaagaagcgcctaaaaaagcttgccgaaactctgggacggaaatag

SEQ ID NO: 43091 - DNA, 1164 bp, Artificial Sequence
  Description of Artificial Sequence: Synthetic coding sequence
atggccttcagcggccgggcccggccctgcatcatccccgagaacgaggaaattcctcgtgcagcactgaacaccgtgcatgaagcaaacggcacagaagacgaaagagccgtgtcaaaactccagagacgacacagcgacgtcaaagtgtacaaagagttttgcgacttctatgctaaattcaatatggccaatgccctggcaagcgccacttgtgagcgttgcaagggcgggtttgcgcccgcggagaagatagtgaattcaaatggagaactgtatcatgagcagtgctttgtgtgtgctcagtgcttccagcagttcccagaagggcttttctacgagttcgaaggacgcaagtattgcgagcatgactttcagatgctgttcgccccatgctgtcatcaatgcggggagtttattattgggcgggtgattaaagccatgaacaatagctggcacccagaatgcttccgctgtgacctgtgccaggaggtcctggcagatatcggtttcgtcaagaatgccgggcggcacctatgccggccgtgtcacaatcgggagaaggcccgggggctggggaagtacatatgccaaaagtgtcatgccattatagatgaacagcccttgatttttaaaaatgatccctaccaccctgatcattttaactgcgccaattgtgggaaggagctgactgcagatgcccgcgagctgaagggcgagttatactgcttgccttgtcatgacaaaatgggggtgccaatttgtggagcctgtcggcgacctattgagggccgggtggttaacgccatggggaagcaatggcatgtggaacacttcgtttgcgcaaaatgcgaaaaaccgttcctgggccatcgccactatgagaggaaggggctggcttactgcgagacgcactacaatcagcttttcggcgacgtttgttttcactgcaatcgcgtgatcgaaggcgacgtcgtctctgccctaaataaggcttggtgcgtgaactgcttcgcatgttccacttgcaatactaagctgaccctcaagaacaagttcgtggagtttgatatgaaaccagtgtgtaagaagtgctacgagaaatttccattggaactcaaaaagaggctcaagaaactggccgagacgctcgggaggaagtag

SEQ ID NO: 43092 - DNA, 1014 bp, Artificial Sequence
  Description of Artificial Sequence: Synthetic coding sequence
atgctgggcgtggccgccggcatgacccacagcaacatggccaacgcgctggcctcagcaacttgcgagcggtgcaagggtgggttcgccccggccgaaaagatcgttaactccaacggcgagctctaccatgaacagtgttttgtctgtgctcagtgttttcagcagttccccgagggactcttttatgagtttgaagggcggaagtactgtgagcatgacttccagatgctcttcgccccgtgttgtcaccagtgtggggaatttattatcgggcgtgtcattaaggctatgaataattcttggcatcccgagtgctttagatgcgatctttgccaggaagtgctggccgacataggcttcgtgaagaatgccggtcgccatctctgccggccttgccataaccgtgaaaaggcccgcggcttggggaagtacatctgccagaaatgtcatgctattatcgatgagcagccactaatctttaagaacgacccctatcaccccgaccacttcaactgcgcaaactgcggcaaggaacttacagccgacgctcgggagttaaaaggagagctttattgcctaccctgccatgataagatgggcgtccctatctgtggcgcctgcagacggcctatcgaaggccgggtggtgaatgcaatggggaaacagtggcatgtggagcactttgtgtgcgccaaatgcgagaagccttttctgggccatagacattatgagagaaaaggacttgcctactgtgagacccattacaatcagctattcggcgatgtgtgttttcattgcaaccgcgtaattgagggagatgtagtcagcgctctcaacaaggcctggtgtgtgaattgttttgcctgctccacgtgcaataccaaactgaccctgaagaataagttcgtggaatttgatatgaagcccgtatgtaaaaagtgttatgagaagtttccactcgagctgaaaaagcgtctcaaaaaactcgccgaaacgctgggacgtaaatag

SEQ ID NO: 43093 - DNA, 1098 bp, Artificial Sequence
  Description of Artificial Sequence: Synthetic coding sequence
atggccgcccggctgggcgccctggccgccagcggcctgtaccggaggcgacagcatcgtcaatcaccaccgccagcaacgggaaacatgagcgatgccctggccaatgcggtttgccagaggtgccaggctcgattctccccagcagaaaggattgtgaatagcaatggggagctatatcacgaacactgcttcgtgtgcgcccagtgttttagaccgtttccggaggggctgttctacgagtttgagggccgaaagtactgcgagcacgactttcaaatgctgtttgccccctgctgcggatcctgcggcgaatttatcattggtagggtgattaaagcgatgaataataattggcatcccggttgcttcaggtgcgaattgtgtgacgttgaacttgctgatcttggcttcgtgaagaacgcggggagacatctttgtagaccgtgccacaatcgcgaaaaggcaaaaggcctgggaaaatatatctgtcagcggtgtcatttggtgatagatgaacagcccttgatgttcagatccgacgcgtaccaccccgatcactttaactgcacccattgcggaaaggagttgacagccgaagcacgagagctcaaaggcgaactatattgtctaccgtgtcacgacaaaatgggggtaccaatttgcggcgcatgcaggcggcctatcgagggccgggtggtaaacgccttaggcaaacaatggcatgtcgaacacttcgtgtgcgccaagtgtgagaagccctttttaggtcaccggcactatgagaagaagggcctggcctattgcgaaactcattacaatcagctgtttggcgatgtatgctacaactgctcccacgtaatcgaaggggatgtggttagcgccctcaataaggcctggtgcgtatcgtgcttttcgtgctcaacctgtaattccaagctcaccttgaagaataagttcgtggagtttgacatgaaacctgtctgcaagaggtgttatgagaagtttccattggagctgaaaaagaggctcaagaaactgtcagagctgacttcccgcaaggcgcaacccaaggccacagacctcaactctgcatag

SEQ ID NO: 43094 - DNA, 750 bp, Artificial Sequence
  Description of Artificial Sequence: Synthetic coding sequence
atggagagccggcaccccgccgtggccgagatcgcctgcacctgctgggcactgctgcacctggcaaacccagagggcaggggtcatttgtgcagaccctgtcacaatcgggaaaaagcaaaagggttggggaagtatatttgccaaagatgccacctcgtgattgacgaacagcccctgatgtttcgcagcgacgcataccaccccgatcattttaattgcactcactgcggaaaggagctgaccgccgaggctagggaattaaaaggcgagctgtattgcctgccgtgtcacgataagatgggagtgccaatttgtggcgcgtgtagaagaccaattgagggaagagttgtaaacgctcttggaaagcagtggcatgtggagcactttgtctgcgcaaagtgcgaaaagccattcctggggcaccgccattatgagaaaaagggcttggcctactgtgaaacccactataaccagctgtttggagacgtttgttacaattgcagccatgtgatcgagggtgatgtggtgagcgcccttaacaaagcgtggtgtgtgagctgcttcagttgctctacttgtaatagcaaactaactctgaaaaacaaattcgtggagtttgacatgaagcccgtctgtaagagatgttacgaaaagtttcccctggagctcaagaaaaggctgaaaaagctatcggagctcacatccaggaaagcacaacccaaagccaccgacctcaacagtgcgtag

SEQ ID NO: 43095 - DNA, 1026 bp, Artificial Sequence
  Description of Artificial Sequence: Synthetic coding sequence
atgaccggcagcaacatgagcgacgccctggccaacgccgtgtgccagcgttgtcaggcaagattctcccccgccgaaaggattgtaaacagcaatggcgagctgtaccatgagcattgctttgtgtgcgcccagtgttttagacctttcccagaaggcctattctacgaattcgaggggagaaaatactgtgagcacgactttcagatgctgtttgccccatgttgcggatcctgtggagagtttataatcgggagagttatcaaggccatgaataacaactggcaccctgggtgcttcagatgcgagctgtgcgacgtggaactggctgatctcgggtttgtaaagaatgcggggagacacctgtgccgtccatgtcacaatcgcgagaaggcaaagggcttgggcaagtatatttgccagcgctgtcacctggtgatagatgagcagccccttatgttccgctctgatgcataccaccctgaccatttcaactgcacccactgcggcaaggagttgaccgccgaagctagagaattaaaaggcgagctttactgcctcccatgccatgataaaatgggcgttccgatatgtggagcttgtcgacggcctatcgaagggagagtggttaacgccctgggcaagcagtggcatgtagagcatttcgtgtgtgcaaagtgcgagaagccttttttgggtcaccgccactacgagaaaaaaggtcttgcttactgtgagacccattacaatcaattgttcggagatgtgtgttataattgttctcacgtaattgagggcgatgtcgtttctgccctcaataaggcctggtgcgtcagttgtttttcgtgtagtacttgtaatagcaagctgacactgaagaataagttcgtcgaatttgacatgaagcccgtctgtaaacgctgctacgagaagtttcctttggagctgaagaaaagactaaagaagctgtccgagttgacctctcgtaaagcgcagcctaaagcaaccgacctgaattcagcgtag

SEQ ID NO: 43096 - DNA, 570 bp, Artificial Sequence
  Description of Artificial Sequence: Synthetic coding sequence
atgttccggagcgacgcctaccaccccgaccacttcaactgcacccattgcgggaaggaacttacggctgaggcaagagaactaaagggtgagctgtactgtctgccttgccatgacaaaatgggagtgcctatctgtggcgcctgtaggagaccaattgaagggagagttgtcaacgcgctcggtaaacagtggcacgtagaacattttgtgtgcgcgaaatgcgaaaaacctttcctgggccaccggcactacgagaaaaagggcctggcttactgtgagacccactacaatcagctcttcggggatgtctgttataattgtagccacgtgattgagggcgatgtcgtgagtgccctcaataaagcttggtgtgtgagctgtttcagctgctctacctgcaactctaagctgaccttgaagaacaaattcgtcgaatttgacatgaagccagtttgtaaacgatgttatgagaagtttccactcgagctcaaaaagcgtttaaagaagctttctgaactgaccagtagaaaggcccagcccaaggccaccgatctaaactccgcttag

SEQ ID NO: 43097 - DNA, 570 bp, Artificial Sequence
  Description of Artificial Sequence: Synthetic coding sequence
atgttccggagcgacgcctaccaccccgaccacttcaactgcacccattgcggaaaagagctgacagctgaagcgagagaactcaagggcgagctgtactgtctgccctgccacgacaaaatgggtgtaccaatttgtggcgcctgcaggcggcctattgagggtagagtggttaacgctttgggtaagcagtggcatgttgagcatttcgtgtgcgccaagtgcgagaagcccttcctggggcatagacattacgagaaaaagggccttgcatactgcgagacccactacaaccagctgtttggggacgtatgctataattgcagccacgtgatcgaaggggatgttgtctcagctttaaataaggcgtggtgcgtgagctgtttcagctgttcgacctgcaattccaagcttactctgaaaaataagttcgtagaattcgacatgaagcctgtgtgcaagcgctgctatgagaaattcccgctggagctgaagaaaaggctcaagaagcttagcgaactgacgtcccgcaaggcccagccgaaagcaaccgatctaaacagcgcctag

SEQ ID NO: 43098 - DNA, 1011 bp, Artificial Sequence
  Description of Artificial Sequence: Synthetic coding sequence
atgagcgacgccctggccaacgccgtgtgccagcggtgccaggcccggttttcccctgcggagcgtatcgttaactccaacggcgagctctaccacgagcattgctttgtgtgtgctcagtgttttagaccattccctgagggtctgttttatgaatttgagggtcggaaatattgtgagcacgattttcaaatgctcttcgctccgtgttgcgggagttgtggggagttcattatcggtagggtgattaaggctatgaataataactggcatcccgggtgttttagatgtgaattgtgcgacgtagaactcgccgacttaggattcgttaagaacgcaggtagacatctttgtcgaccttgccacaatcgtgaaaaagctaagggcctgggcaagtatatctgtcaacgttgccatctggtgatcgacgagcaacccctgatgtttagatccgacgcatatcaccccgatcatttcaattgtacccattgtggcaaggagttgacagcagaggctcgcgaactcaagggtgagttgtattgcctgccttgccatgataagatgggagtgccaatctgtggagcttgccgaaggccaattgagggaagagtcgtgaatgccctgggtaaacagtggcatgtggagcatttcgtttgcgccaagtgtgaaaagccctttctggggcaccgccactatgaaaaaaaggggcttgcctattgcgagacacattataaccagctttttggcgacgtatgttacaattgcagccatgtcatcgagggggacgtagtttccgcactgaacaaagcctggtgcgtatcctgtttcagttgcagcacttgcaactctaaactaaccctgaagaataagttcgtggagtttgacatgaagccagtctgcaagcggtgttacgaaaagttccccttagagctgaagaagcgcctgaaaaagttatctgagctgacctcaaggaaggcgcagcctaaggcaacggatcttaacagtgcttag

SEQ ID NO: 43099 - DNA, 570 bp, Artificial Sequence
  Description of Artificial Sequence: Synthetic coding sequence
atgttccggagcgacgcctaccaccccgaccacttcaactgcacccattgtggaaaagagctgaccgcggaggcgcgggagttgaagggagagttatattgcctgccttgtcatgacaaaatgggcgtgcctatttgtggggcatgtcggaggccaatcgaaggcagggtggtgaacgccctcggcaagcagtggcacgttgagcatttcgtctgcgccaagtgcgagaaaccttttctcggtcatcgacattatgagaagaaaggtctggcgtattgtgaaacccattacaaccagctctttggtgacgtctgctataattgttcccatgtgattgagggcgatgttgtgtccgctttgaacaaggcgtggtgtgtgtcatgttttagttgctcaacatgtaattccaaactcaccctgaagaataagttcgtcgaattcgatatgaagccagtgtgcaagagatgttatgaaaaatttccgcttgagttgaagaagcggctgaaaaaactcagcgagcttacctctcgtaaggctcagcctaaagccacagatctgaattctgcgtag

SEQ ID NO: 43100 - DNA, 1011 bp, Artificial Sequence
  Description of Artificial Sequence: Synthetic coding sequence
atgagcgacgccctggccaacgccgtgtgccagcggtgccaggccaggttctcgcccgccgaaaggattgttaactcaaatggcgagctgtatcatgagcactgctttgtgtgcgcacagtgtttccggccgtttcctgagggactgttttatgaattcgaaggccgcaaatactgtgaacatgattttcagatgctcttcgctccttgttgtgggtcctgcggcgaattcatcatcggcagggtaatcaaggcgatgaataacaattggcacccaggctgcttcagatgtgaattatgcgatgtagagctcgctgacctgggcttcgtgaaaaacgcgggacgtcatctctgccggccgtgccacaaccgagaaaaagcaaagggcctcggaaagtacatctgtcagaggtgccacctggttattgacgagcaacctctcatgtttcgctcagacgcgtaccaccctgatcactttaactgcacccactgtggaaaggagctgaccgccgaagcacgcgagttgaagggcgagctgtactgcctcccatgtcacgacaaaatgggcgttcccatctgcggcgcctgtcggcggccgatcgagggtcgtgtcgtgaacgctcttgggaaacagtggcatgtggaacacttcgtctgtgcaaaatgtgagaaaccctttttgggacataggcactatgagaaaaaggggctggcctactgcgaaacacactacaatcagctttttggcgatgtctgttataattgctcacatgtgattgagggcgacgtggtgagcgctctcaataaagcttggtgcgtgagctgctttagttgcagcacctgtaattctaagttaacactgaaaaacaagttcgtggaatttgacatgaagccagtgtgcaagcgttgctatgaaaagtttcctctggagctcaagaaacgtttgaaaaaactcagcgaacttacgtcgcgaaaggctcaaccaaaagctactgatcttaattctgcctag

SEQ ID NO: 43101 - DNA, 1011 bp, Artificial Sequence
  Description of Artificial Sequence: Synthetic coding sequence
atgagcgacgccctggccaacgccgtgtgccagcggtgccaggcccgcttcagtcctgctgagagaatagtgaactctaatggagaactgtatcatgagcactgctttgtgtgtgctcagtgctttaggcctttccccgagggactgttttatgagttcgagggcaggaaatactgcgaacacgacttccagatgctgttcgcaccctgctgcgggagctgtggagagttcattatcggaagagtaatcaaagccatgaataacaattggcatcctggatgtttcagatgtgaactgtgcgatgttgaacttgctgatctgggattcgtcaagaacgccggccgccacctctgtagaccctgccataacagggagaaggcaaagggtttaggtaagtatatctgccaacgctgtcaccttgtcatcgacgagcagccattaatgtttagatcggacgcctaccaccccgaccattttaactgcacccattgtggcaaggaactgacagccgaggccagggagcttaagggagagctgtattgccttccctgtcacgataagatgggggtgccaatatgcggggcctgtaggaggccgatcgaagggagggtggtaaatgcactgggaaaacagtggcacgtcgagcactttgtgtgtgcaaagtgtgaaaaacccttcctgggtcataggcattacgaaaaaaagggccttgcttattgcgagacccattataaccaacttttcggtgacgtttgctacaactgttcccatgttatagagggcgacgtcgtatctgcactgaacaaggcatggtgcgtcagctgtttcagttgcagcacctgcaactctaagttaaccctgaagaacaagtttgtggaattcgatatgaagcccgtgtgcaagcggtgctacgagaaatttcctctggaactcaagaaacggctcaagaagctgagtgaactgactagccgaaaggctcaacctaaagcaacagatctgaacagcgcgtag

SEQ ID NO: 43102 - DNA, 570 bp, Artificial Sequence
  Description of Artificial Sequence: Synthetic coding sequence
atgttccggagcgacgcctaccaccccgaccacttcaactgcacccactgtgggaaagaactgactgcagaagctcgcgagttgaaaggtgaactttactgcctaccttgtcatgacaagatgggcgttcccatttgcggggcatgccgccgtcccatcgaagggagagttgtgaatgctcttgggaaacaatggcatgtcgagcattttgtctgcgccaaatgcgaaaaaccctttctgggccatcgccactacgagaaaaaaggattagcttactgtgaaacccactacaatcagctgttcggcgacgtctgttacaactgtagccatgtcatcgagggcgacgtagtgagcgcgcttaataaggcctggtgtgtttcatgtttttcatgttctacctgtaactccaagctgacgctcaaaaacaaatttgtggaattcgacatgaaacccgtgtgcaaacgctgttacgaaaagtttccgctcgaactcaaaaagcggcttaagaaactctcggaacttacctccagaaaagcccaacctaaagcaaccgatctaaacagtgcctag

SEQ ID NO: 43103 - DNA, 1011 bp, Artificial Sequence
  Description of Artificial Sequence: Synthetic coding sequence
atgagcgacgccctggccaacgccgtgtgccagcggtgccaggcccgcttttctcctgctgagcggattgtcaactccaacggggagctgtaccacgaacactgctttgtgtgcgcccagtgcttccgaccgttccccgaagggttattctacgagttcgagggtcgaaaatactgtgagcacgactttcagatgcttttcgctccctgctgtggctcatgtggtgaattcatcattggccgcgtgataaaagccatgaataataactggcaccccgggtgtttccgatgtgagctgtgcgacgtggagcttgcggatctcggattcgttaaaaatgccggccgacacctgtgtcgcccatgtcacaaccgagaaaaggcaaaagggctaggaaagtacatctgccaacgctgccacttggtaatcgacgaacagcctctgatgtttcgttccgatgcttatcaccctgatcacttcaattgcacacactgtggaaaagagcttaccgcagaagcccgcgagctcaagggggagctatattgtctaccctgtcatgataagatgggagtccccatctgtggcgcctgtaggaggccaatcgaggggagagtcgtgaatgcgctaggcaaacaatggcatgtggaacacttcgtgtgcgccaagtgtgagaagccttttctcggacataggcattatgaaaagaaaggtttggcttactgtgagacgcactataatcagcttttcggtgacgtgtgttataattgttcccatgtcatcgagggcgacgtcgtgtccgccttaaataaagcttggtgcgtctcctgcttctcatgtagtacatgcaactcgaagctcacattgaagaataagtttgtcgagttcgacatgaagcccgtgtgtaagcgctgttacgagaaattccctctcgagctcaagaagcggctcaagaagttgtcagagttgacctccagaaaggctcaaccaaaagccacggatttaaactctgcttag

SEQ ID NO: 43104 - DNA, 441 bp, Artificial Sequence
  Description of Artificial Sequence: Synthetic coding sequence
atgagcgacgccctggccaacgccgtgtgccagcggtgccaggcccgtttttcacccgctgaaaggatcgtgaacagcaatggagagttgtatcacgagcactgcttcgtctgtgcccaatgctttaggccttttcccgaggggctcttttatgaattcgaggggcggaaatactgtgaacacgacttccagatgctgtttgcaccctgttgcgggtcatgtggagaatttatcataggtcgagttatcaaggcaatgaataacaattggcatccaggttgtttcaggtgcgagctatgcgatgttgagcttgcagatctgggttttgttaagaacgccggtagacatctgtgcaggccctgtcataacagggagaaagccaagggactagggaaatatatctgccagagatgccacctggtgatagatgagcagccttag

SEQ ID NO: 43105 - DNA, 570 bp, Artificial Sequence
  Description of Artificial Sequence: Synthetic coding sequence
atgttccggagcgacgcctaccaccccgaccacttcaactgcacccactgcggtaaagaactgacagctgaggctcgagagctgaagggcgaactgtattgtcttccttgtcatgacaagatgggtgtgccaatctgtggggcttgcaggcgtccaatcgaaggtagagtagtgaatgcactgggaaaacagtggcacgtggaacacttcgtctgtgcaaaatgcgagaaaccattcttggggcacaggcattacgagaagaagggtttagcctactgcgaaactcattataatcagctgtttggagatgtgtgttacaactgttctcacgttatcgaaggggacgtcgtttccgcgctaaacaaggcttggtgtgtcagctgtttctcctgctccacctgcaacagcaagctcaccctcaaaaacaagttcgtggaatttgatatgaaaccggtctgtaagcgatgttatgagaagttcccgctggaactcaaaaagcgcctcaagaagctctcagaactcaccagcaggaaagcccagcctaaagccaccgatctcaactctgcatag

SEQ ID NO: 43106 - DNA, 1092 bp, Artificial Sequence
  Description of Artificial Sequence: Synthetic coding sequence
atgaccggccggaagcggaagtggggcgagaccggcaccggcagcggcgccgcccctgccgccgccttgagatggtctaatatgagtgacgccctggccaatgccgtttgccagaggtgtcaggcaagattttccccagctgagcgcatcgttaatagcaatggcgagctataccacgagcactgtttcgtttgcgcccagtgtttcagacctttccctgagggacttttctacgaattcgaggggaggaaatattgcgagcatgatttccagatgctctttgctccctgctgcgggtcttgtggtgagttcatcattggacgggtcattaaggcgatgaacaacaactggcacccagggtgtttcaggtgcgagctgtgcgatgtggagcttgcggatctcggcttcgtaaaaaacgctgggaggcatctgtgtcggccttgccacaatcgcgagaaggccaaggggctggggaagtatatctgtcagcgatgtcacttggtgattgacgagcagccactgatgttccgcagtgacgcttaccatccagatcacttcaattgtactcattgtggaaaagaattaaccgcagaggcccgagagctgaaaggggaactgtactgtttgccctgtcatgacaagatgggcgtacctatctgtggtgcctgccgtcgtcccatcgaggggcgggttgttaatgccttaggaaagcagtggcacgttgaacactttgtatgtgccaaatgtgagaagcctttcctcggtcatagacactatgagaaaaagggacttgcctactgcgaaactcactacaaccagttgtttggcgacgtgtgctataactgtagtcacgtgattgagggtgacgtagtgagcgccctgaacaaggcttggtgcgtgtcttgcttttcctgttcgacatgtaatagcaagctcaccctgaagaataagttcgtagagttcgacatgaaaccagtgtgcaagcgttgctacgagaaattccccctggaactaaaaaagcggttgaaaaagctgtctgaactcacctcacgcaaagcccagcctaaagccaccgatctgaacagtgcctag

SEQ ID NO: 43107 - DNA, 1092 bp, Artificial Sequence
  Description of Artificial Sequence: Synthetic coding sequence
atgaccggccggaagcggaagtggggcgagaccggcaccggcagcggagctgccccagccgccgcacttcgctggagcaacatgagcgatgcactcgccaacgctgtttgtcaaaggtgtcaggctcgattctccccggccgaacgcatcgtaaactctaatggcgaactttatcatgaacattgttttgtgtgcgcacagtgcttccggccgttcccagaggggctgttctatgaatttgaaggacggaaatattgtgagcatgactttcagatgctcttcgcaccgtgctgtgggtcttgcggtgaatttattatcggtagggtgatcaaagccatgaacaataattggcaccccggctgcttcaggtgtgaattgtgcgacgtcgagctggcggatctgggattcgtgaaaaacgccggcagacacctgtgccgtccatgccataatcgagaaaaggctaaaggcctcggcaagtacatctgccagagatgtcaccttgtcattgacgagcaacctcttatgtttagatccgacgcctaccaccctgaccactttaattgtacccattgcggcaaggagctcacagccgaagcaagagaactcaagggagagctttattgcctgccctgtcacgataagatgggagtccccatttgcggcgcctgtaggagaccaattgaaggcagggtagtgaacgcgttaggcaagcagtggcatgtagagcattttgtgtgcgcaaaatgcgagaagccattcctgggacatcgacattacgagaaaaagggcctggcttattgtgagacccattataaccagctgttcggagacgtttgctacaactgttcacatgtcatagagggcgacgtcgtctccgccctgaacaaggcctggtgcgtgtcatgctttagctgttctacttgcaactctaagctgacgctgaaaaataaattcgtggaatttgacatgaaacctgtttgtaagaggtgctacgagaagttccccctggagctgaagaaacgcctcaaaaaactttccgaactcacctcacggaaggcccagcctaaggctacggacctcaatagcgcctag

SEQ ID NO: 43108 - DNA, 702 bp, Artificial Sequence
  Description of Artificial Sequence: Synthetic coding sequence
atgctgaagcccagcgtgaccagcgcccccaccgccgacatggccacactgactgttgtccagccccttacgctggaccgagatgtggctcgcgctatcgaattacttgagaaactgcaggaaagtggagaagtcccagtccacaagctgcagagcctgaagaaagtgctgcagtccgagttctgcacagcaatccgcgaagtgtatcagtacatgcacgaaactattacagtcaatggctgccctgaatttcgagctcgggctaccgcaaaggccaccgtcgccgcctttgctgcttccgaaggtcatagccatccaagagtggtggaacttcccaagacagacgagggactaggcttcaatgtgatgggggggaaggaacagaattcaccaatttatataagtcggattataccagggggagtagccgagcggcatggcggactgaagcgcggcgatcagcttctgtccgtgaatggagtctccgtggagggtgaacaccatgagaaagcggtcgagctccttaaggccgcaaaggattccgtgaagctcgtggtcaggtatacccctaaggttctggaagagatggaggctcgcttcgaaaaacttaggaccgcccgcagaaggcagcagcagcaacttttaattcagcagcaacaacagcagcagcaacaacagacccagcagaaccacatgtcttag

SEQ ID NO: 43109 - DNA, 858 bp, Artificial Sequence
  Description of Artificial Sequence: Synthetic coding sequence
atgaaggtgaccgtgggccccgaccccagcctggtgtaccggcccgacgtcgaccctgaggtcgcaaaagacaaggccagttttcgcaactatacaagcggcccattgcttgacagggtctttaccacctataaactgatgcatacacaccagaccgttgacttcgtacgcagcaagcatgctcagtttggcggcttctcgtacaaaaagatgaccgtgatggaagcggtcgaccttctagacggattagtcgatgaaagcgatcccgacgtggacttcccaaactcgtttcacgctttccaaaccgctgaggggatcagaaaggctcacccggataaagattggttccacttagtaggtctgcttcatgatctgggcaaagtgctggccctgtttggcgaaccgcagtgggcagttgttggggataccttcccagttggctgtcgcccccaagcatcggttgtcttctgcgatagcacttttcaggacaacccggatcttcaggacccccggtattcaaccgaacttggtatgtaccagccccattgcggcttagaccgtgtcctgatgtcctggggccatgatgagtatatgtatcaggtgatgaaattcaataagttcagccttcctccggaagcattttatatgattagattccactccttttacccctggcacacaggccgggactaccagcagctgtgcagtcaacaggatctggcgatgcttccctgggtgcgagagtttaacaagttcgacctgtacactaagtgcccagacttgcccgatgtcgacaagttgagaccatactatcagggactgattgacaagtattgccctggcatcctgtcctggtag

SEQ ID NO: 43110 - DNA, 1785 bp, Artificial Sequence
  Description of Artificial Sequence: Synthetic coding sequence
atggccggcagccggctgccccggcagctgttcctgcagggcgtggcagctgtttttatgttcgccttcgccagcctgtatacccaaataccagggctctacggacccgagggcattctgcctgccagacgcactcttcgcccccagggaaagggacgctggcaacagctctgggagactcccactctgctttgggaagccccacggctgggcttggacacagctcaaggcttggaactattaagcctccttggagccttagtggcccttggggctctgctgttgagcccactgaggcatccggtcatctaccttctgctttgggctgcctacctttctgcctgccaggtgggtcaggtcttcttgtatttccagtgggattccctgctcttggagacaggctttctcgcagtattagtcgccccactgcggccggcttcacacagaaaggaagccccgcaagggagacaggcaggagcattaccacacgaagatctgcctttttggctggtccggtggctcctgttccggctcatgtttgcatcaggagtagtgaagcttacatctaggtgcccagcatggtggggtttgaccgcactgacctatcactacgaaactcagtgcctgccaactcctgccgcatggttcgcccaccacttgcccgtttggctccacaaactttccgtcgtggcaaccttcctgatcgaaatagccgtcccaccgctcttctttgcgcctattagacggctgcgcctggcggctttctactcacaagtgttgctacaggtgctcattattatcacaggtaactataacttcttcaacttaatgacgctggttctcacaactgccttgttggacgatcagcatctcgccgctgagccagggcatggttctcggaagaagactgccacctcctggcctaaagcgctgctggctaccctttcgcttctcctggaactggccgtctatggcctccttgcctacggaactgtgcactactttggccttgaggtggattggcagcaacggactatccacagcaggaccactttcactttccaccagtttagccagtggctgaagacgcttactttgccaaccgtgtggctgggggtggcaagcctcgtctgggaattgctttcagccctgtggagatggacccaagtcagggactggcagatgtggttcgctgctctcggtccccatacccactccccttggttcacaagcctagtcttaagattactgcagggaaaggagcctgtgattcggctggtgcagtctcaagtggcacggtaccctttccataaacaacctccgacttacgtgcgagcccagcgttacaagtattggtttagccagccaggcgagcaaggccagtggtggcgcaggcagtgggtggaagagtttttcccgtccgtgagtctgggggatcccactctggagacactcctgcggcagtttgggctgcaagagaaatccccaccacgcaccaggagcgcaaattccaccctggctcaggcccttcattggactcgcagccagctgagtcccctggaggcccctgccctgctgtggggactgttgatggccgtgggggcagtccgcttcgtgcaagcactgctagctccatgtagtttgcgctccagccccctagcacccgtatccggggaaaaaagaaggccggccagtcagaaagatagtggcgccgcaagcgaacaggccacagccgcccctaacccttgttcatcatcgtcacggactacccgccggaaaaaatag

SEQ ID NO: 43111 - DNA, 2124 bp, Artificial Sequence
  Description of Artificial Sequence: Synthetic coding sequence
atggccggcagccggctgccccggcagctgttcctgcagggcgtggccgccgtgttcatgttcgcattcgcctctctgtatacacaaattcctggattgtatggccccgagggtattttgccagctcggcgcacgctaagaccccaaggaaagggccggtggcaacaactctgggagacccccacacttttgtgggaagcaccccgcttgggcctcgacaccgctcagggtctggaactgttaagcttactgggcgctcttgtagcactcggtgccctgctgctgtctcctctgagacacccagtgatctatctcttattatgggccgcctacctgagcgcgtgccaggttgggcaagtgttcctgtatttccaatgggattctctgcttctcgaaactggttttctcgcagttctcgtagctccgctaaggccagcctctcataggaaagaggcaccacaaggcagacaggccggcgcgttacctcatgaagaccttccattctggctagttcggtggctactgttcagactgatgtttgccagcggggtagtgaaactgacctctaggtgtccggcctggtggggattgaccgccctaacctaccattacgagactcagtgcctgcctacaccggcagcttggtttgcccaccacctccccgtctggttgcacaaactgtcggtcgtggcaacatttctcatagagatagctgtccctcccctcttttttgcccccattcgcagactgcggttagctgcattttactcacaggttttgttacaggtgctaataataataaccggcaattataactttttcaacctcatgacactcgtgcttactaccgccctcctggacgatcagcatttggccgcagagccaggccacggcagtcgcaagaaaacagccactagctggcctaaagccctgcttgccacccttagcctgctcctagaactggccgtatacggtctcctggcctacgggaccgtccactactttggcttggaggtagactggcaacagaggacaatccatagtcggaccacgtttacgtttcatcagttcagccagtggctgaagacccttaccttgccaacagtgtggctgggagtggcatccctggtgtgggaactgctgtccgccctgtggagatggacccaggtgagaggctggcttagaaagctttctgcggtagttcagctgtctcttgtaggaacggctacggtggcactttttcttatttcacttgtgccttacagctatgtggagccagggactcatggcagactgtggacaggagcccatagactgttcggcgctgtggagcacctccaactggccaacagctatggcctgttcaggaggatgaccgggctgggagggagaccagaggtggttctagagggctcatacgacggccatcattggacggaaatcgagttcatgtataagcctgggaacctctccagaccgccacccgtcgtagtaccgcaccagccaaggcttgactggcagatgtggttcgctgctttaggccctcacactcacagcccctggttcacctctcttgtccttcgccttctgcaaggcaaggagcccgtcattagattggttcagagtcaggtggctcgctatcccttccacaagcaacctcccacatacgtccgtgcccagcgctataagtattggttcagtcagcctggagaacagggtcagtggtggaggcgacaatgggtggaagagttttttccctctgtgagtctgggcgaccccactttggaaacgcttctgcggcagttcgggctgcaagaaaaaagcccccctcgaactcgcagcgcaaactcaacgctcgcgcaagccttgcactggacgcgttcacagctgtctcctctggaagcaccagccctcttatggggacttctcatggcagtaggcgctgtgaggtttgtacaggctttgctcgccccctgctcactcagatcctctcccctggcacccgtgagtggtgaaaaaagaaggcccgccagtcagaaagattcaggggcagcaagcgagcaggctacagccgccccgaacccatgctcaagcagcagcaggacaactagaaggaagaaatag

SEQ ID NO: 43112 - DNA, 978 bp, Artificial Sequence
  Description of Artificial Sequence: Synthetic coding sequence
atggccgtgggcaacaacacccagcggagctacagcatcatcccctgtttcatcttcgtcgagctcgtgattatggccggcaccgtcttattggcctactactttgagtgcaccgacacattccaggttcacatacagggttttttctgtcaggacggtgatctgatgaagccctatcccggcactgaagaagaatcctttatcacccccctggtgttatattgcgtacttgcggcaactcctactgcaatcatattcatcggggaaatttcaatgtacttcatcaaatcaaccagggagtcactcatagctcaagagaagactatcctcacgggagaatgctgttacctcaatcctcttctgcgtcgcattatacgattcactggggtgtttgcctttgggctattcgccacagatatctttgtaaatgcaggacaggtggtgacaggacaccttacaccatacttcctcactgtatgcaaacccaattataccagcgccgattgccaggcccaccatcagttcattaacaatgggaatatctgcactggagatctcgaagttatcgagaaggcccggcgtagctttccgtctaagcacgcagcactgtccatctattccgccctttacgcgactatgtacattacgtcgactattaagacgaagtcttccaggctcgcaaagcctgtgctgtgcctgggtacattgtgtacagcctttctgacagggttgaaccgggtcagcgagtacaggaaccactgctcagatgtgatcgctggcttcatcttaggcacagctgttgccctgtttctgggcatgtgcgtggtccacaatttcaaaggtacccagggctctccttccaagccaaagccggaggaccccaggggagtccccctgatggctttccctcgaatcgaatcacccctggaaacactgtccgctcaaaatcactcagcttctatgactgaagtcacgtag

SEQ ID NO: 43113 - DNA, 978 bp, Artificial Sequence
  Description of Artificial Sequence: Synthetic coding sequence
atggccgtgggcaacaacacccagcggagctacagcatcatcccctgtttcatcttcgtggagctggtcatcatggccgggaccgtcctgctggcctattactttgagtgcacagacaccttccaggtccatatccaaggatttttctgccaggacggcgacctgatgaagccttacccaggaaccgaagaagagtcatttattacacctcttgtgctctattgtgtcctcgccgctaccccaacagccattattttcatcggagagatatcgatgtactttataaagagtactagggaatctttgatcgcacaggagaagaccatcctgaccggcgaatgctgctatctgaaccctcttttgcggcgcataatacgattcacaggtgttttcgcctttggcttgtttgccaccgacatttttgttaacgctgggcaggttgtgaccgggcatctcacgccctacttccttacagtatgcaaacccaattacacctcagctgactgccaagcacaccaccagtttatcaataacggcaacatttgcacaggagatctggaggtgattgaaaaggctaggcgatccttcccaagcaagcacgctgccctctccatatatagtgcactctacgccacgatgtacattacaagcacaattaagaccaaaagtagtcggctcgccaaacctgtgctttgcctgggaacactctgtacagccttcttgacaggactgaacagagtatcggagtacagaaatcactgcagcgatgtaattgctgggtttatcctgggtactgccgtcgcactgttcctgggaatgtgcgtcgttcataacttcaaaggcacgcaaggaagcccatccaagccgaagcctgaggatccccggggcgtaccacttatggcatttcctcgtatagaatcacccctggaaaccctatctgcacagaatcattccgcatcaatgaccgaggtcacctag

SEQ ID NO: 43114 - DNA, 978 bp, Artificial Sequence
  Description of Artificial Sequence: Synthetic coding sequence
atggccgtgggcaacaacacccagcggagctacagcatcatcccctgcttcattttcgtcgagcttgtcatcatggcagggaccgtactgttggcatactatttcgagtgtactgacacgtttcaggtgcatattcaggggtttttctgccaggatggcgacctgatgaagccgtatcccggaactgaggaagaatcgtttataacaccactcgtcctgtattgtgtgttggcagccactccgaccgccattatcttcatcggggaaatctctatgtacttcatcaagtctacccgcgagtcactgatagctcaggagaagacgatactcaccggagagtgttgttacctgaaccccctccttcggaggattatacgatttaccggtgtgttcgccttcggacttttcgcaacagatatctttgtgaacgcaggccaggtcgtgacagggcacctcactccttattttctcacggtctgtaagccaaactacacctcagcagactgtcaggctcatcaccagtttattaacaacgggaacatctgtactggcgacttggaagtcatcgaaaaggccagaaggtcattcccttcaaagcacgcggccctgtcaatatactcagcactctacgctacaatgtatatcacatctaccattaaaaccaagagctcgaggctggccaagccggtgctctgcctgggaactctgtgcactgcattcttaacgggcctcaacagggtgtccgaatacaggaatcactgctcagacgtgatagccggattcattctgggcactgctgtcgctctgtttcttggaatgtgtgtggtgcataactttaagggaactcaggggtcaccaagcaagcccaaacccgaggatccacgaggggtgccactaatggcatttcctcgcatcgagtctccgctggaaactctgtctgcacagaaccacagcgcttctatgacagaagtaacatag

SEQ ID NO: 43115 - DNA, 312 bp, Artificial Sequence
  Description of Artificial Sequence: Synthetic coding sequence
atggccgtgggcaacaacacccagcggagctacagcatcatcccctgtttcatatttgtcgagctggtgatcatggcaggtactgttctgttagcatattactttgagtgcactgatacttttcaggtgcatatacaggggttcttctgtcaagatggggatctgatgaaaccttatcccggcactgaggaggaatctttcatcacgcccctcgtgctttattgcgtgcttgcagctacccccaccgccattatttttattggtgagatttctatgtactttatcaaaagcacgcgagagagcttgatttag

SEQ ID NO: 43116 - DNA, 1032 bp, Artificial Sequence
  Description of Artificial Sequence: Synthetic coding sequence
atggccggcggccggccccacctgaagcggagcttcagcatcatcccgtgcttcgtattcgtcgagtcggtcttactcggcatagtgattctgctggcatatcgcctcgagtttactgacacttttcctgtgcatacccaggggtttttttgctatgacagtacctacgccaagccataccccggacctgaagccgcatccagggtgccacccgcgcttgtctacgccctggtgacagcaggtcctacactgacaattctgcttggggagctggcacgggcatttttcccagctcccccctctgctgtccccgtaattggcgagagtactatagtatccggggcctgctgccgttttagcccacccgtgcggagactcgtgagattcctcggggtttacagcttcggcctgttcacaaccacgatattcgccaacgcaggacaggtcgtgactggcaatcctaccccacattttttgtctgtgtgtcggcccaactatacagccctgggctgcctgcccccgagccccgatcgcccagggccggacagattcgtcactgaccagggggcttgcgccggctcacctagcctggtcgctgccgccagacgggcctttccctgtaaagatgccgctttgtgcgcttatgcggtcacatatactgccatgtacgttaccctggtgtttagagtgaaggggagccggctggtgaagccgtccctgtgtctcgccctcctgtgccccgcattcttagtgggggtggtcagagtggcagagtataggaaccactggagcgacgtactggccggattcctcacaggggccgccatcgcgaccttcctggtgacatgtgtagttcataattttcagtcacggccacctagcggacgcagactcagtccttgggaggatttgggccaggccccgaccatggactctccgctggaaaagaacccacggtccgccgggagaattaggcaccgacacgggtcccctcaccccagtaggagaactgctcccgcagtggccacctag

SEQ ID NO: 43117 - DNA, 1284 bp, Artificial Sequence
  Description of Artificial Sequence: Synthetic coding sequence
atggccggcggccggccccacctgaagcggagcttcagcatcatcccatgctttgtttttgtggaaggcttcttctgctacgattcaacttatgccaagccatacccaggccccgaggccgctagtcgtgtgccaccggcgctggtgtacgcactggtgactgcaggccctacacttactattctattaggggaattagcccgcgctttctttccagccccaccttccgctgtcccggtcatcggcgagtctaccatagtgtcaggagcctgctgcaggttcagtccccccgtaaggaggctagttcgttttctgggcgtctactcattcggacttttcactaccactattttcgccaacgcgggacaggtggttacggggaacccgacacctcattttctttctgtgtgtcgtcctaactacacggcccttggatgtctgcctccgtcacccgatcgccctgggcccgataggttcgttaccgatcagggcgcctgcgccggatcgccctcgttggtcgccgccgcgcggcgagctttcccttgcaaagatgcagcgctgtgcgcctacgctgtcacttataccgcaatgtatgtcacactcgtgtttcgcgttaagggaagccggctggttaagccgtctctgtgcctggccctcctctgtcccgccttcctggtcggtgtggtcagggtggccgaatataggaaccactggtcagacgttctcgcgggcttcttgactggagcggcaatcgcaacctttctggtcacatgtgtggttcataattttcaatccaggccacctagtggccgccgcttatctccttgggaagacttgggacaggcaccaacaatggactcccccttggagaaactgtctgtggctcaagagcctgaagtgtgtaggccgcattccacacctgcccggcttaccccttcgaagagccagaattgtgccaggcgcgggcatctgatcccatcatgcgtgtcttcaagggctcccgccatgtgttctagtcctcgcgtgccgaggccacggctccgatccgagcccacccccttacctctccccttgcctttaccagctccaaccccatcacaggggccctccccttcgtctcccggccccggtggccccggaggtggcggagggcggggacgcaagctgcttctgcctactccattgctgcgcgacctgtatacactgagtggcctgtaccctagtccctttcaccgcgataatttctccccatacctctttgcgtcacgcgaccacctgctttag

SEQ ID NO: 43118 - DNA, 2160 bp, Artificial Sequence
  Description of Artificial Sequence: Synthetic coding sequence
atgatcagcaccaaggagaagaacaagatccccaaggacagcatgaccctcttgccctgcttctattttgttgaacttcccattgtggcctcttctatcgtgagcttgtatttcctggaactgactgatctgttcaagccagcgaaggtagggttccagtgttatgaccgaaccctgtcaatgccttatgtggaaactaacgaggagctcatccctctcctcatgctgttgtccttggcatttgcagctcctgccgcctctatcatggtggctgaagggatgctgtattgtttacaatcgcggctctggggtcgggcaggaggccctgcaggcgccgaaggctcaattaacgcgggtggttgcaattttaattctttcctcaggcgaaccgtgaggtttgttgccggggtgcatgtgtttggtctgtgcgccaccgcgttggtgacagacgtgattcagctggctacgggataccacacaccatttttcctaacagtgtgcaagccgaactatactctcctgggtacgagctgcgaagtaaacccatacatcactcaggatatctgtagcggccacgacatccacgcaatattgagcgccagaaaaacgtttccctctcaacacgccaccttgtctgcattcgctgccgtgtatgtcagtatgtatttcaattccgtaattagcgataccactaagttgctcaaacctatcctcgtgttcgctttcgcaattgctgccggcgtgtgtggcctgacacagattactcaatatagatcacatcctgtagacgtctacgccgggtttctcatcggcgcaggtatcgccgcatatttagcctgtcacgcagtgggtaacttccaagcacctccggccgaaaagcccgctgcccctgcccccgcgaaggacgccctccgcgctctgacccagcgcggtcacgactcagtttatcagcaaaacaaatccgtgagtactgacgagctcggtccgccaggcagactcgagggtgcgccccgtcccgtagcaagagaaaagacttctctgggttcattaaaacgcgcctctgtggacgtggatctcctggcccccaggagcccaatggccaaagaaaatatggtgacattcagccacaccctcccgcgggcaagcgcacctagtctcgatgacccagccagaaggcacatgacaattcacgtacccctggacgcatctcgttccaaacagttgatttcagaatggaagcagaagtcactggaagggcggggacttggcctgccggacgacgctagcccaggacatttacgggctcccgccgagcccatggctgaagaagaggaggaggaagaggacgaagaggaggaagaagaagaagaggaagaagaggatgaagggcccgccccccccagtctgtaccccacggtgcaggcccggcctggcttggggccccgcgtgatcttgccaccacgcgccgggcccccccctttggtccacattcctgaggagggcgcgcaaacgggagcaggactcagccctaagagcggggccggcgtgcgggctaaatggcttatgatggccgaaaagagcggggcagcagtcgccaaccctccgaggcttctacaggtgattgcaatgagtaaggctcctggcgcacctggccccaaagcagccgagacggcatcttcatcgagtgcaagtagtgacagctctcagtacagatctcctagtgaccgagattcagcctcaatcgtcaccattgatgcccacgccccccaccaccccgtggtgcacctgagcgcgggtggtgcgccatgggagtggaaagccgctggagggggcgctaaggctgaggccgacgggggttatgagctgggggacctggcccgcggatttcgtggcggagccaagccaccaggagtgtcacccgggtccagcgtttcagacgtggatcaggaggaaccgcgcttcggcgccgtggctaccgtgaaccttgcaacaggggaaggtctccctccactgggtgccgccgacggagctctcgggccaggatccagagagtctactctgaggcgacatgccgggggcctgggcctggctgaacgggaggcagaagctgaggctgaaggctacttcaggaagatgcaggcacgacggtttccagactag

SEQ ID NO: 43119 - DNA, 2241 bp, Artificial Sequence
  Description of Artificial Sequence: Synthetic coding sequence
atgatcagcaccaaggagaagaacaagatccccaaggacagcatgactctgttaccctgcttttatttcgtggagctacctattgtggcctccagcatcgttagcctgtacttcctggagttgaccgacctcttcaagccagcaaaggtgggcttccagtgctacgacaggaccctgtctatgccctacgtcgaaactaacgaagagctgattcctcttcttatgttactgtccctcgcattcgctgcccctgctgctagcatcatggtggctgaggggatgctgtattgtctgcagagccgtctttggggtcgcgctggcggccctgcaggagctgaggggtcgatcaacgctgggggctgcaattttaactctttcctgagacgaaccgtgcggttcgtgggcgtgcatgtgtttggtctgtgtgcgaccgccctagtcacggacgtgatccagctcgcaactggctatcatacccccttctttttgactgtgtgcaagccaaactacaccctgctggggactagctgcgaggtgaatccttatatcacacaggacatctgttccgggcacgatattcatgctatcctgtcggctcgcaaaactttcccatctcagcatgccacactctcagctttcgctgccgtgtatgttagcgtctctcctgccccacactgtccaagtcaagccctgctgctgacccgcggtgaacctagcctgacaccgactcccatgccacagatgtatttcaactctgtgatttctgacactaccaaactgctcaaaccgattctggttttcgcatttgcaatcgcagccggcgtatgcggtctgactcagatcacccagtaccggtcacacccagtagacgtgtacgcaggttttctgattggcgcaggcattgccgcatatttggcatgccacgccgtcggtaacttccaggctccccctgcggagaaacctgcagctcctgccccagctaaagacgccctgcgcgcactcacgcaaagggggcacgactctgtctaccagcagaacaagtccgtttccactgatgaactcgggccacccggccgcctagaaggagccccccgaccggtggcgcgggagaaaacctctttagggtccctcaagcgggctagcgtcgacgtggatttacttgccccccgcagcccgatggccaaggagaatatggttaccttcagtcacaccctcccgagggcctcagcccctagcttggacgacccagcgagacggcatatgaccatacacgtcccgcttgatgcctcacggtctaagcaactaatttccgagtggaagcagaaaagcctagagggtcgtggcctgggattgcccgacgacgcttcgcctggacatctgagagcaccagccgaacctatggctgaagaggaagaggaggaggaagatgaagaagaggaggaagaggaagaagaggaagaggacgaaggccctgccccccccagtctgtacccaacagtacaggcccggcctgggctcgggccaagagtcatcttgccgcctagagccgggcccccgccactggtccatattcccgaagaaggtgctcagaccggtgccggactctcacccaaatccggcgccggcgtgcgcgctaaatggctcatgatggcggagaaatccggagctgccgtggcaaaccctcctaggctgctacaggtgattgccatgagtaaggctccaggcgctcccggccctaaagctgccgaaaccgcctcttcctcttccgccagcagcgatagtagccagtataggagtcccagcgaccgcgacagcgcctccatagtgaccatcgatgcccacgcccctcaccaccctgtcgttcacctctcggccggtggagccccatgggagtggaaggctgcgggcggcggagctaaggccgaggcagacggcggctacgagctcggtgatttagctcggggattccgcgggggtgcaaagccaccaggcgttagtcctggctcttccgtgagtgacgtggatcaggaagagcctcgctttggagccgtggcgacagtgaacctcgccaccggcgaagggctaccaccactgggcgctgcggatggagccttggggcccggctctcgtgagtctacactgagacgccatgccgggggactggggctggctgagcgagaagcggaggcggaagccgagggttactttcggaaaatgcaagccaggcggtttccagattag

SEQ ID NO: 43120 - DNA, 2157 bp, Artificial Sequence
  Description of Artificial Sequence: Synthetic coding sequence
atgatcagcaccaaggagaagaacaagatccccaaggacagcatgacccttctgccatgtttttatttcgtggagcttcccatcgtcgccagtagtatcgtatctctatattttttagaactgaccgacctattcaagcctgctaaggttggcttccagtgttacgacaggactctttctatgccttacgtggagaccaacgaggaacttatccctcttctgatgctcctgtccctggcctttgcggctccggcagctagcattatggtcgccgaggggatgctttattgtctgcagtctcgcctctggggtcgtgccggaggtccggctggggctgagggcagcattaacgccggcggctgcaacttcaactcttttcttcggcggactgtgaggtttgtaggcgtgcatgtgtttggactgtgcgccaccgcattagtgacggacgtcattcaactggcgactggataccataccccattctttctgacggtttgcaagcctaattatactttgctgggcactagttgcgaagttaacccctatattacccaggatatctgttctggccatgacatccacgctattctgagtgctagaaagactttcccctcacagcacgccacacttagcgccttcgctgcagtgtacgtgtctatgtacttcaactctgtgataagcgatacaactaaactgctcaaacccatacttgtttttgccttcgccatcgccgctggcgtctgtggactcacccaaatcacccagtaccggtcccatccggtagatgtgtatgcagggtttttgattggggccggtatcgcggcatatctggcgtgtcatgccgtaggcaattttcaggctcctccagcagaaaagccagctgctcctgcacctgccaaggacgccttgcgggctctgacacagcggggtcacgatagcgtgtatcagcagaataagagtgtgtctaccgacgaactgggaccacctggcagattggaaggagcgcccagaccagttgcccgtgagaaaacttctttgggcagtctgaagagggcgtctgttgacgtagacctgctcgcccctcgatctccaatggcaaaggagaacatggtgaccttcagccacactctccctagggccagcgccccctccctagatgatcccgcccgccgtcatatgacaattcatgtgccactggacgcttcgcgcagtaagcagctgatcagtgagtggaagcagaagtcattggaggggaggggactcgggctgcccgatgacgcctctccaggtcacctgcgcgcccctgcagaacctatggcagaggaggaggaagaggaggaagacgaagaagaggaggaggaggaagaagaggaggaggatgagggaccagcacccccgagcctttatcctacagtgcaggcaaggcccggcctgggcccacgcgtcatcctgccccccagggcaggacctcccccgctcgtacacatccccgaggagggggcacagacaggcgctggactgagccccaagagtggcgcaggcgtgagggccaagtggcttatgatggcagaaaaatcaggggctgctgtcgcgaatccaccgcggttgctccaggttatcgcaatgtctaaggccccaggcgcgcctggacctaaggccgcggagaccgctagttcatcctccgcctcttctgactcctcacaatatcggagcccctcagacagagacagcgcgtctattgtaactattgatgcccatgccccccaccacccagtagtgcacctgagcgcgggcggtgcaccctgggagtggaaagctgcaggagggggggcaaaggcagaagccgacggaggatatgaactgggggacctggcacggggatttcgtggtggagctaagcccccaggggtatcaccgggcagctcagtgtctgatgtggatcaggaagagccgagattcggggcggtggcaaccgtaaatctggcaacaggggagggattaccccccctgggagccgcggacggcgccctaggtcccggaagcagagaaagtactttgcggcgccacgctggcggactggggttagctgaaagggaggccgaggctgaagccgagggctacttccggaaaatgcaggcacgtagattccccgattag

SEQ ID NO: 43121 - DNA, 1734 bp, Artificial Sequence
  Description of Artificial Sequence: Synthetic coding sequence
atgcagcgggccggcagcagcggcggccggggcgagtgcgacatcagcggcgccggaagactagggctggaagaggctgcccgtctctcctgtgccgttcatacgagccccgggggggggaggcgccccggccaggccgcgggcatgagtgccaaggaaagacccaaagggaaggtaatcaaagattctgttaccttactgccatgcttctattttgtcgagttacctatactggccagtagcgttgtcagtttgtacttcttggaattgaccgacgtatttaagcccgtgcatagtggcttctcttgctatgatcgtagccttagtatgccatatatagagcccactcaggaagccatccctttcctcatgttgctatcactagccttcgctggacctgcaattaccataatggtaggtgagggcatcctctactgctgtctctctaaacgcaggaacggtgtcggactggagccaaatattaatgccggcggttgtaatttcaatagtttcctgcgacgggccgttcgattcgtgggcgtgcacgtcttcggattatgttcaactgcactgatcaccgacatcatccagctcagtaccggctaccaagccccttacttcctcactgtgtgcaagccaaattacacatcccttaacgttagctgcaaagagaatagctatatagtggaggacatctgctccggctccgacctgaccgtcattaattccggcagaaagtcattccccagccagcacgccactctcgccgccttcgcagccgtgtacgtcagtatgtattttaattctacgttgaccgatagctctaaactactgaagcccctgctcgttttcaccttcataatctgtggtataatctgcgggctgactagaattactcagtataaaaaccatccagttgatgtttattgcgggtttctgatcggaggcggcatcgccctgtatttgggactatatgccgtaggtaatttcctgccctccgacgagagcatgtttcagcatcgggacgccttacgttctttaaccgatctcaaccaggaccccaacaggctcctcagcgccaaaaacggctcaagtagtgacgggattgcccacacagaaggcatcctcaatagaaaccatcgtgatgcttcctcactcaccaacctaaagcgagctaacgcagacgtagaaataatcaccccacggtcccccatgggtaaagagaacatggtcaccttttctaatactttgccccgggctaacacgccgtccgtggaggaccctgtaagacggaacgctagcattcacgctagcatggactccgcaagaagcaaacagcttttaacccagtggaaaaacaagaacgagtcccggaagctgagcctgcaggttatcgagccagagcccggtcaatcacccccacgcagcattgagatgcgctctagtagcgaaccttccagggttggtgtgaacggagatcaccatggcccagggaatcagtatcttaagattcagcctggcgctgttcctggttgcaataattcgatgcccggcggtccgcgcgtgagtattcagagtagaccagggagttcacaactggtgcacattccagaggaaacgcaggagaatatctcaacatctcccaaatcttcccgcgtatccagcaaagccgcccccaggacgcttaaagcagctcggagccccgctcttgctccaagcgctatcaaaccttag

SEQ ID NO: 43122 - DNA, 1818 bp, Artificial Sequence
  Description of Artificial Sequence: Synthetic coding sequence
atgaacatgttcgacgccgacaccaccaccaacctggtgaccatcagcttcatcctcccaatcggcgtccatgtttttggtctttgcagcactgccctgatcaccgacattatccaactatctacgggttatcaggctccatacttcctgaccgtctgcaaaccaaattatacctccttgaacgtttcttgtaaagagaacagctatattgtcgaggatatatgctccggctccgatctcactgtgattaacagtggccgtaaatcctttcccagccaacacgccactctggccgcctttgctgctgtttacgtgagcatgtacttcaacagcacactcacggattctagtaaacttcttaagccattactagtcttcacattcatcatatgtggcataatctgcgggttaacacgaattacgcagtacaagaatcatcctgtggatgtctattgcggcttcttaattgggggcggcattgccctctatctgggactgtatgccgttggaaactttctgcctagcgatgaaagcatgtttcagcaccgcgatgccttgcggtcactaaccgacctcaatcaggatcccaacagactcctgtcagcgaagaacggctctagcagtgacgggattgctcacacagagggaattcttaatcggaatcatcgcgacgcatcctcccttaccaaccttaagcgggccaacgctgatgtggaaattattacgccacgatctcccatggggaaagagaatatggtgactttttccaatactctgcctcgcgctaacactcctagtgtcgaggacccagtgcggcgaaatgcttccattcacgcttcaatggactcggctagatcgaaacagcttcttacccagtggaagaataagaacgagagccggaagctgagtctgcaagtgatagaacccgagcctggccaaagtccgccacgctctatcgagatgcgatcaagttcagagccaagccgggtcggggtgaacggcgatcaccacggccccggcaaccagtaccttaagatccaaccaggagccgtgcctggttgcaacaattccatgccgggtggcccacgggtttccatacagagccggccgggatcatcccagttagtgcacatacctgaagaaacccaggaaaatatttccacttctcccaagtctagttccgcccgggcaaagtggctaaaagcagctgagaagacagtagcttgcaaccgatccaatagccagcctcgaatcatgcaggttattgctatgtctaaacagcagggcgttttgcaatcctccccaaagaacacagagggctccacggtaagttgtacaggctcgatacgatacaagactctcactgatcacgaaccctccggaatcgtgcgcgtcgaggcccaccctgagaacaaccggccaataattcagatcccatcaaccgagggggagggttcaggcagctggaagtggaaagctcctgagaaagggagtttgcggcagacatatgagcttaacgaccttaacagggattcagagtcctgcgaatcactgaaggatagctttgggagtggcgaccggaagagatctaatatcgactcaaatgaacaccaccaccatggcattacgaccattcgcgtgacacccgtagaaggcagtgagatcggatctgagaccttgtcaatcagtagttcaagggactctacactgcgtcgcaaaggcaacataatcctcattccggaaaggtctaactctccagagaatacacgtaatatattttataaaggcacaagcccaactagagcttacaaagactag

SEQ ID NO: 43123 - DNA, 2292 bp, Artificial Sequence
  Description of Artificial Sequence: Synthetic coding sequence
atgcagcgggccggcagcagcggcggccggggcgagtgcgacatctccggagcgggacgcttaggccttgaagaggctgctagactctcctgtgcagtgcacaccagtcccggtggaggacggaggccaggccaagccgctggaatgtctgccaaagagcggcctaaggggaaggtcattaaagattccgtgacattgttaccctgcttctactttgtggaacttcctatacttgcttcctcagtggtttctctgtactttcttgagcttacagatgtgttcaagccagtccactcaggcttttcctgttacgaccgatccctgagcatgccttatatagagccaacacaggaagcaattcctttcctgatgctgctgtctctggcgtttgcagggcctgccatcacaataatggtcggggagggtatattatattgctgcttgtctaaacgcagaaacggggtcggtctcgaaccaaatatcaatgccggtgggtgcaatttcaactctttcctccggagagcggttcgtttcgttggagttcacgtctttgggttgtgctccaccgccttgatcacagacatcatccagctcagtactggttatcaggcaccgtactttcttacagtgtgtaaaccaaactataccagtcttaatgtgtcttgtaaggaaaattcttatattgtggaagatatctgtagtggaagcgatctgacagtgataaattcaggccgaaaatcattccccagccaacatgctaccctggcagccttcgccgccgtgtacgtgagcatgtactttaacagtactctgaccgactctagtaagctcctgaaacctctcctcgtattcacctttatcatctgtggcataatttgtggcttaaccaggataacgcagtacaagaaccaccccgtggacgtctactgcggttttctgattggcggtggtatcgccctgtatctggggctctatgcagtgggcaacttcctcccgtctgatgagagcatgtttcaacatcgcgacgccctgcggagccttaccgatctgaatcaggatcccaatcgactgctctcggccaagaacgggagtagctctgatgggatcgcccatacagaaggaattcttaacaggaaccatagagatgccagttcccttactaacctcaagcgcgccaatgcagacgtggaaatcatcaccccaagaagcccaatgggcaaagagaatatggtgacgtttagtaatactctccctcgagctaatacaccttccgtagaggatcctgttagacgcaacgcaagtatccatgcttccatggattcagccagatctaagcagctgctgacccagtggaaaaacaagaacgagtctcggaagctgagtctacaggtgatcgagccagaaccaggacagtcacccccaaggtctatcgaaatgcgcagctcctcagagccctccagggtgggggtaaacggggatcatcacggcccagggaatcaataccttaaaattcaacccggcgcagtgccaggatgcaacaatagcatgcctggaggaccacgcgtgagcattcaatcccgacctggctcctcacagcttgtgcacattccagaagagactcaggagaatatatccacaagcccaaaatcctcttccgccagggcgaagtggctaaaggcagcggaaaagactgtggcttgtaatcggtcgaactcccagccaaggatcatgcaggtgatcgctatgagcaagcagcagggagtcttacagtccagccctaagaatacagaaggatcgaccgtgagttgcaccggctctattcgttacaagactctgaccgaccatgaaccctccggtatcgtgcgagtagaagcgcatcccgaaaacaatcgccccatcattcagatcccttctaccgaaggagagggcagcggaagttggaagtggaaggctcccgagaaaggttcactgcgacaaacatatgagctgaatgatctgaatagggactcagagtcctgcgagagcctcaaggactctttcggatccggggaccgaaagagaagcaatatcgactctaatgagcatcatcaccacggcataacgaccataagagtgaccccagtggagggaagcgagatagggtccgaaacgttaagtatcagttcctccagagatagtacattgaggagaaaaggaaatattatcctaatccctgaacgttccaatagcccagaaaatactcggaacattttctataaagggacatccccgaccagggcctataaggattag

SEQ ID NO: 43124 - DNA, 2118 bp, Artificial Sequence
  Description of Artificial Sequence: Synthetic coding sequence
atgcagcgggccggcagcagcggcggccggggcgagtgcgacatcagcggagccggtcgcttagggcttgaggaggccgcacgcctcagttgcgccgtgcacaccagtccgggaggggggcggaggcccggccaggccgcaggtatgagcgccaaagagcgcccgaaaggtaaagtgatcaaggacagcgtgaccttgctgccttgcttctatttcgtcgagcttcccattttggcaagctccgtcgtatccctatatttcctagaattgactgacgtgtttaaaccggtccacagcgggttcagttgctacgacagatcgctgagcatgccctacatagaacccacgcaggaggccatccccttcttaatgcttctttctctggcattcgccggccccgctattaccattatggtcggcgagggaatcctgtattgttgcctgtccaagcgaagaaatggggtaggacttgaaccgaacattaacgcagggggttgcaatttcaatagctttcttcggagggctgtaagatttgttggtgttcacgtgttcgggctatgctccactgccctgattactgacattattcagctgtcaaccggataccaagccccctactttctaactgtgtgtaaacctaattacactagcttgaacgtgtcttgcaaagagaactcatacattgtggaggatatttgttcaggatccgatttaaccgtaattaattcagggagaaagtcattcccatcccaacatgccacgctggccgcattcgccgccgtgtacgtgtcgggattatacgcagtgggcaacttcctgccctccgacgaatcaatgtttcaacatcgcgacgccttacgctccctcaccgatctgaatcaagaccccaacagacttttgagcgccaagaacgggagcagctccgatggtattgcccataccgaaggcatcctgaatagaaaccacagagatgcatccagcctaaccaatctgaaaagggcaaatgccgacgtcgagataattactcctaggtcacctatgggaaaggagaatatggtgacatttagtaatactctgccacgggccaacactccctccgttgaagatcccgtacgcaggaatgcttccattcatgcaagtatggatagcgccagaagcaagcagctgcttacccagtggaaaaataaaaatgagtctaggaaactctctctgcaagtcattgaaccagagccagggcagtcaccgcctaggagcatcgagatgaggtcgtccagtgagccatccagggtgggcgtaaacggagaccatcatgggccaggcaatcagtacctcaagatccagcccggcgccgttcctggatgtaacaactccatgccggggggccccagggtaagcatccagtccagacctgggtcctctcagttagttcacatccctgaggagacacaggagaacatcagcacgtcacctaagtctagctcggcgagagccaagtggcttaaggctgccgaaaaaaccgtcgcttgcaatagatcaaatagccagcctcgcattatgcaggtcattgccatgagtaaacagcagggcgtactccaatcaagccccaagaacacagaaggcagtacggtgtcctgcaccggctcgatcagatacaagacccttaccgatcacgagccatccggaatcgtgcgcgtggaggctcaccccgaaaacaacaggcctattatccaaattcctagtactgaaggagagggaagcggcagttggaagtggaaagccccagagaaagggagtctgagacagacatatgagctgaacgacctaaacagagactcagagagttgcgagtccctgaaggattcctttggctccggggaccggaagcgctcgaacatcgattccaatgagcatcaccaccacggaatcaccactatcagggttactcccgtcgaaggcagcgagataggctccgagacactgagcatttcttcatctagggattctacactgagaaggaaggggaacattatccttattcctgaaagatctaacagtcctgaaaatacgcgcaatatcttttacaagggcacatcccccacgcgcgcctacaaggattag

SEQ ID NO: 43125 - DNA, 966 bp, Artificial Sequence
  Description of Artificial Sequence: Synthetic coding sequence
atgcccctgctgcccgccgccctgaccagcagcatgctgtacttccaaatggtcatcatggctggaactgtgatgttggcctactattttgaatataccgacaccttcaccgtcaatgtgcagggctttttttgtcacgactcagcttacagaaagccctaccccggtcccgaggactcttcagctgtgcctccagtgctcttgtactcgcttgctgctggagtgcctgtcctcgtcatcatagtaggcgaaaccgcagtgttttgtttgcagcttgccacccgagacttcgaaaatcaggagaaaaccattctcactggggattgctgttacatcaatccgcttgtacgtcgaaccgtacgattcctcggaatatatacatttggcttattcgccaccgacattttcgtaaatgccggccaggtagtcaccggcaatttagcaccgcatttcctggccctatgcaaacccaattatactgcactgggctgtcagcaatacactcagttcatttcaggagaagaagcctgcaccggcaacccagatctcattatgcgggcgcggaaaacctttccaagtaaggaagctgctctcagcgtatacgcagctatgtatctcactatgtacatcactaataccattaaggcaaaagggacacgtctggccaaaccagtactctgccttggacttatgtgcctggctttcctgactggcttgaatcgggtggcagagtataggaaccactggtctgacgttatcgcaggctttcttgtggggatctctatagccgttttcctcgtggtgtgcgtggtcaacaatttcaaaggccgtcaggccgaaaatgaacatattcacatggataacttagctcagatgcctatgattagtatacccagagtggaatccccgttagagaaggttacaagcgttcagaaccatattacagcctttgcagaagtgacctag

SEQ ID NO: 43126 - DNA, 951 bp, Artificial Sequence
  Description of Artificial Sequence: Synthetic coding sequence
atgcccctgctgcccgccgccctgaccagcagcatgctgtacttccagatggtcataatggctggcaccgtcatgcttgcctactactttgaatacactgatacctttaccgtgaacgtgcaaggcttcttctgtcacgattcagcctatagaaaaccatatccaggacctgaggattccagcgcggttccccccgtcttactttacagcctggcggccggcgttccagttttagtgattattgtcggggagacggcagtcttctgcttgcaacttgccacaagagactttgagaatcaggaaaaaaccatccttacgggggactgctgttatatcaacccgctggtcagaaggaccgtgcgttttctgggcatctatacctttgggctgttcgccacagacatatttgtcaatgctggccaggtggtgacagggaatcttgcaccacactttctcgcgttatgcaagccgaattatactgctctcgggtgtcagcaatacacacagtttatatcgggcgaggaggcatgcactgggaaccctgatctgataatgagagccagaaaaacctttccttctaaggaggccgcactctccgtttacgccgctatgtatctgaccatgtacattactaataccataaaggccaaggggacccgtctggcgaagccggtcttatgcttgggcctcatgtgtcttgcttttctgactgggctgaacagagttgccgaatatcgaaaccactggagcgatgttatcgcagggtttctggtgggtatctctatcgctgtgtttctggttgtctgcgtggttaacaacttcaaaggccgacaagctgagaacgagcatattcatatggacaatctggctcagatgcctatgatatccattccacgggtggaatcgcctctggagaagaatcatatcaccgctttcgccgaagttacatag

SEQ ID NO: 43127 - DNA, 744 bp, Artificial Sequence
  Description of Artificial Sequence: Synthetic coding sequence
atgctgcccagccaggaggccagcaagctgtaccacgagcactacatgagaaactctagagctatcggcgttctctgggcgatcttcactatctgcttcgcaattatcaacgtggtcgtattcatccaaccctactgggttggtgattcggttagtaccccaaagcccggctactttgggctcttccactactgcgtaggaagcggcctcgctggccgggagttaacctgtcgggggtcttttactgatttcagcacaattccatcaagcgcttttaaggccgctgctttttttgtattgctctcgatggttctcatcctgggctgtataacatgtttctcactattcttcttctgtaacaccgccaccgtatacaagatatgtgcctggatgcagctcctggcagccttgtgtcttgttcttggatgcatgatttttcctgacggatgggatgctgagaccattagggatatgtgcggcgctaagaccggaaagtactctctgggggactgctcagtgcggtgggcctatattctcgccattatcgggattttaaacgcattgattctgtcatttctggccttcgtcctagggaataggcagacagacctcctgcaggaggagcttaagcctgaaaacaaagacttcgtaggaagtacggtgtcaagcgttctccgccctgggggtgatgtttccggttggggggtgctgccgtgtcctgtcgcgcacagtcagggaccatag

SEQ ID NO: 43128 - DNA, 2088 bp, Artificial Sequence
  Description of Artificial Sequence: Synthetic coding sequence
atgagcggcgccgccctgggcctggagatcgtgttcgtgttcttcctcgcactctttctgcttcacagatacggtgatttcaagaaacagcaccgactcgttattattggaacattgctcgcgtggtatttgtgctttctcatcgtatttatcctccctttggacgtctccacaacaatctacaatcgctgtaagcacgcagccgcaaactccagcccccctgaaaacagtaacatcaccggactgtatgcaaccgccaatcccgtcccctctcaacacccctgtttcaagccctggagttacattcccgacggaattatgcctatcttctggagagtggtgtactggacttcccagttcctcacatggattctcctcccgttcatgcaaagttacgctagatccggcgggttctcgattaccggcaagatcaagacagctctcatcgagaacgccatctactatggaacgtaccttctgatatttggggcatttctgatctacgtggccgttaatccccaccttcatctggagtggaatcaattgcaaaccataggcatcgcagccgccaacacatggggactctttcttcttgtgttgctcctgggctatggcctggtagagatcccacgaagttattggaacggagcaaaacggggctatctccttatgaagacctatttcaaagctgccaagctgatgacagagaaagccgacgccgaagagaatttagaagatgcgatggaggaagtccgcaaagtaaacgaatccataaagtacaatcatcccctgaggaaatgcgtggataccatattgaagaagtgccccaccgaataccaggaaaagatgggaaggaacatggacgattacgaggacttcgacgaaaaacactcaatctatccttcagaaaaaagcttggtcaaattgcataaacaggttatatactccgtccaacgtcacaggcgcacacaggttcagtggcagatcctccttgagcaggcattttatctggaagatgtcgcaaagaatgagacatccgctacacaccagtttgttcacaccttccagtcaccggagccagaaaatcgcttcatacagtacttctacaatcctacctttgagtggtattgggaatgcctgctgagaccctggttttataaaatcttagcagttgtgctatccatatttagcgttattgtagtgtggtcagagtgtacttttttttccacaacgcctgtgctttccctctttgccgtcttcatccagctcgccgagaaaacatataactatatctacatcgaaatcgcttgctttctctcaattttcttcctttccatatgcgtctactcaacagttttccggattcgggtgttcaactactactacctggccagccatcaccagacagatgcctattcattgctcttttctggaatgctcttttgccggctgaccccccctctgtgcttgaatttcctgggcctgacccatatggacagtagtatcagccacaaaaatacccagcccacagcctatacatctatcatgggaagcatgaaggtgctttccttcattgccgatgggttctacatctactaccccatgctggtcgtgattctgtgtattgcgacttacttctctctcggtacgcggtgcctcaatcttttgggattccagcagtttatgggagatgacgatatgacttccgacttggtgaacgagggtaaagaattaattcgcaaagagaagcgcaaacggcaacgccaggaggaaggcgagaacagacgaagggagtggaaggagcgatacggccacaatagggaggacagcacacggaaccggaacatccatacggaccccaaagagtccaactttagcgacgtaaataccaaccgcagcgccttcaaatacacacgtgctaacaaccgcactgagcgggataggatcgagctccttcaggacgctgagccactcgattttaacgccgaaaccttcactgacgacccccttgagtcggaaagcggacggtatcaaccaggaggtcgatatctcagtatgagccgctccgatattttcaatgacgtgtag

SEQ ID NO: 43129 - DNA, 1770 bp, Artificial Sequence
  Description of Artificial Sequence: Synthetic coding sequence
atgcccatcttctggcgggtggtgtactggaccagccagttcctgacttggatacttctgccttttatgcaaagctacgcaagatcaggcggcttctccattaccggcaagatcaaaacagctctgatcgagaacgccatatattatggtacctatcttttgatctttggtgcttttctgatctacgtggccgttaatccccatttgcacctcgagtggaatcagctgcagacaatagggattgccgcagccaatacttggggcctcttcctgctcgttcttcttttaggatacggattggtagaaatcccgcggagctattggaacggagcaaagaggggctacctcttgatgaaaacctacttcaaagccgcgaagttgatgaccgagaaagcagatgccgaagagaacctggaagatgctatggaggaggtgcgaaaggtgaacgagtcaatcaagtacaaccatccactacgtaagtgtgtggacactatacttaagaagtgtccaacagaataccaggagaagatgggtcgaaatatggacgactatgaggactttgatgagaagcactcgatctatccttctgagaagtcgcttgtcaagcttcacaaacaggtgatttactctgtgcagcgccatcgccgcacccaggtgcagtggcagatactactcgagcaggccttttatttggaggatgtggccaagaacgagacttctgctacgcatcagttcgtacacacattccagtcccccgagcctgagaataggtttattcaatacttctacaaccctacctttgaatggtattgggagtgccttctgaggccctggttttataagattctggctgtggtgttgtctattttctccgtcatcgtggtgtggagtgaatgtacatttttctcaaccacccccgtgctgagtctgttcgccgtctttatccagttggccgagaagacctataattatatctacattgagatcgcgtgttttctgtctatcttcttcctgtcaatatgcgtgtacagcacggtcttcagaataagagtattcaactattactatcttgcttcccaccatcagaccgacgcatattccctgctgttttccgggatgctcttttgtcggcttactccacctctctgcttgaatttcctgggccttacgcacatggactcaagcatctctcacaagaacacacaacctacagcctacacatcaatcatgggatccatgaaggttctgagttttatcgctgacggattctacatttactaccccatgcttgtggtgatactatgtattgcaacctacttcagcctggggacccgctgtctgaacctcctcggtttccaacaatttatgggtgatgatgacatgacatccgatttggtaaacgagggtaaagaattaatccgcaaagagaaacgcaaaaggcagagacaggaggagggcgaaaaccgaaggcgggaatggaaggagaggtacggacacaacagagaggattctactaggaatagaaacatccacacagatccgaaggaatcaaatttcagcgacgttaatacgaatcgtagcgctttcaaatataccagagccaataaccgcacagagagagacagaatcgaacttttacaggacgcagagcctctggattttaacgccgagaccttcactgatgatcctctggaaagtgaaagtggtagataccaacctgggggccggtacctcagcatgtctcgatctgatatctttaacgacgtttag

SEQ ID NO: 43130 - DNA, 618 bp, Artificial Sequence
  Description of Artificial Sequence: Synthetic coding sequence
atgaacaaggtgttcccccagggcgagaacggctacaccgccgccgagagtaaggcccaccccggcggcgaggccggggggggccatttatgctgcagccgacgaggcgcctgtctttcagcaagcctgctgctgttgctcgccactgtagccgcccttatcgcgcttgtcacaattctgggtctgccctcatgtactccaggagcccaagcatgcattacacttaccaaccgaacgggttttttgtgtcacgatcagcgtagttgtataccggcgtctggcgtgtgtgacggagtgcggacgtgtacccacggcgaggacgaggatgagtcgctttgccgtgacgtcccacagagcttgcctcatttcttggtggctcattgcggggacccggcttcctggatatattctgaccagaagtgtgacggaactaataactgcggcgactgttctgatgaactgtcaccggtcactgtgtgcccaccttgtggacctggctggtggcggtgcccaagcacattcttcaaatattgcgactgtattccacgacacctatgccgggaccacgtgcagcactgctcagactggtcagacgaatacgcctgtcccggaccttag

SEQ ID NO: 43131 - DNA, 351 bp, Artificial Sequence
  Description of Artificial Sequence: Synthetic coding sequence
atgaacaaggtgttcccccagggcgagaacggctacaccgccgccgaatcaaaggctcatcctggaggagaaggagacgtgccgcaatcattaccccacttcctggtggcacactgcggggaccccgcgtcctggatatatagtgaccagaaatgtgatggtacaaacaattgcggtgattgctcggacgagctcagtcccgtgactgtgtgccctccgtgcggcccgggttggtggcggtgcccgtctaccttctttaagtattgcgactgcatcccaaggcatctttgccgcgatcacgtccaacactgctcagattggtccgacgaatatgcgtgtcccggaccttag

SEQ ID NO: 43132 - DNA, 819 bp, Artificial Sequence
  Description of Artificial Sequence: Synthetic coding sequence
atggaggcctgctgcctgctgcagctgccccagcggctgctgctgctgggagcagcagccttaaccgcaaccgctcttgagacagcagacttagcagagctgtgtggccagacttggcagggggatggcttgcttttgcggagccacgcagcatcccgccgcttctatttcgtggcccccgacaccgattgtgggttgtgggtgcaagctgccgcacccggcgatcgtatcagattccaattcaggtttttcttggtctatagcctaacacccgctccccctgccttgaataccagttccccagctcccgccgatccatgcgccccgggctcatatctgcagttctatgaagggcctccaggcgctcctcgccctttagggagcccactgtgcggactgaacataccggtccctgtggccagctctgggcctttcctgggactacgcctggtgacaaggggcaggcagccccgcgtggacttcgtcggcgaagttacatctttccggcttgggccttgtggggcctacttccggtgtcaaaacgggaggtgtatcccttcaagcctggtatgcgacccttgggggatggataattgcggagatggttcagaccaagggagctggagccccgcagattgccgaggccctagtcccgtacctagccaaaccggcagcactgacgcgcatacctctagaagcctgactccatcccccgcgctcggcagcgcggggagcctgtggatcgccgcagagcgcagtagcccggctggccgggaccccaccaggcaggatgctgccctagaaggcagcacggagtag

SEQ ID NO: 43133 - DNA, 819 bp, Artificial Sequence
  Description of Artificial Sequence: Synthetic coding sequence
atggaggcctgctgcctgctgcagctgccccagcggctgctgctgcttggggccgccgcactgaccgccaccgccctggagacagcggatctggctgagttgtgtgggcagacctggcagggagacgggctcctgctgaggtcccatgcagcatcaaggaggttctatttcgtggccccagatacggattgtggtctgtgggtgcaagccgctgcacccggcgatcgcatcagatttcagttccggttctttctggtttactctttgacccccgctcctccggcccttaacacctcatccccagcaccggctgatccatgtgcgcctgggtcttatctgcagttctacgaaggtcctccgggcgcccctcgccccttgggtagtcctctgtgtggactcaacattcccgtcccggtcgcctcatctggacctttcctggggctgcgactagtgactagaggaaggcagcccagagttgattttgttggagaagtgacttctttccgcctcggaccgtgcggagcatatttcaggtgtcagaacggacggtgtattcccagtagcctggtttgcgacccatggggcatggacaattgcggcgacggctccgaccaggggtcttggtctccggctgattgtaggggacccagccctgtgccttcccagaccggcagcacagacgcacacacaagtcgaagcctcacccctagcccggcgcttggctctgctggcagtctttggattgcagccgagcggtccagccccgcgggcagagatcccaccagacaggacgccgccttggagggatcaactgaatag

SEQ ID NO: 43134 - DNA, 1038 bp, Artificial Sequence
  Description of Artificial Sequence: Synthetic coding sequence
atgtggctgctgggccccctgtgcctgctgctgagcagcgccgccgaaagtcagctgctgcctggtaacaacttcactaatgaatgtaatattcctggaaattttatgtgtagtaatgggcgttgcatccccggcgcgtggcaatgcgacggactccctgactgctttgacaagtctgacgagaaagagtgccctaaggccaagtccaaatgcggtcccacttttttcccctgtgccagcgggatacattgcataattgggaggttccggtgtaatggattcgaagactgcccggacgggagtgacgaggagaactgcacagctaatcccttactctgcagtacagcgcgataccattgtaagaatggcctttgtatcgacaagagctttatttgtgatggacaaaacaactgtcaggacaacagtgatgaggagtcttgcgaaagctcccaggagcctgggtctgggcaggtgtttgtcacatcggaaaaccaactcgtgtattacccatctatcacatatgcaataattggtagtagtgtcatcttcgttctcgtggtggctctgctggcactggtgctgcaccatcagagaaagagaaacaacttgatgacattaccagtccacaggttacagcacccagtgctgctgtccaggctggtggttctggaccacccacaccactgcaatgtcacgtacaacgtgaacaatggaatccaatatgtggcaagccaagctgagcagaatgccagcgaggtcggctctcctccctcatatagtgaggcacttctcgatcagaggcccgcatggtacgatctgccgccaccaccgtactcttctgacaccgaaagcctgaatcaggctgacttacctccatatcggagccggtccggctccgctaattccgcgtcaagccaagccgcaagttctctcctgtccgtagaagacacttcccatagccctggacagcctgggccacaggagggaactgcggagccccgagactccgagccaagccagggcacagaagaagtctag

SEQ ID NO: 43135 - DNA, 468 bp, Artificial Sequence
  Description of Artificial Sequence: Synthetic coding sequence
atgtggctgctgggccccctgtgcctgctgctgagcagcgccgccgaatctcagctgctgcctggaaataactttacgaatgaatgtaacatccctggtaacttcatgtgctcgaacggcaggtgcatccctggagcttggcagtgcgatgggctccctgactgtttcgataagtcggatgagaaggaatgccccaaagccaaatccaagtgcggccctacattttttccctgcgcgtctggcattcactgtattatcgggagattcaggtgtaatggatttgaagattgtcccgacggctctgacgaagagaactgtaagaatggcctctgcattgacaagtcatttatttgtgacggccagaacaactgtcaagataatagcgatgaggagagttgtgaaagcagccagggactgagagggatgactttcctgcaccgaccaactttactgactcgcaatttgtag

SEQ ID NO: 43136 - DNA, 1503 bp, Artificial Sequence
  Description of Artificial Sequence: Synthetic coding sequence
atggccagcgtggcccaggagagcgccggcagccagcggcggctgcctccgagacacggcgctttgagggggctgctcctgctgtgcctttggctgccttcaggacgggcagcattgccacccgcagcacccttgtcagagctacacgctcaactgagcggggtggaacagctgttggaggagttccgccgacaactgcagcaggagcgtccccaggaggagttagagctggaattacgagctgggggtggtccccaagaggactgtccagggcccgggagcgggggctacagtgctatgccagatgccatcatccggacaaaggattctttggctgccggagcatcgtttttgagagcgccagcggccgtccgcggatggaggcagtgtgtggccgcttgttgcagcgaaccacgctgctccgtggccgtcgtggagctgccccgccggccggctccccccgcagccgtgctcggatgctacctgttcaactgtacagctagagggagaaatgtctgcaagttcgcgctgcactcaggctactcaagttatagtctgtcacgggcaccggacggagctgccctggctacagcaagagctagtccacgtcaagaaaaagatgcccctcctttgagtaaggccgggcaagatgtggttttgcatctgcctaccgatggagtggtcttagacgggcgagagtccacagatgaccacgctattgtgcagtatgaatgggccctactccagggcgacccgtcagtagacatgaaagtgccccagtccggtacacttaagttgtctcacctccaagagggaacctacacatttcagctgactgtaaccgacacagccggccagagatccagtgacaacgtaagcgtcactgtgctccgcgccgcatactctactggggggtgtctgcacacttgcagcagatatcactttttctgtgacgatggttgctgcatagacatcacccttgcctgtgacggggtccagcagtgccccgatggcagcgatgaagatttttgtcagaacctgggcttggacagaaaaatggtgacccacaccgcggcatcacctgccctccctaggactactggcccgtcagaggatgcaggaggtgactcgctggttgagaagagccaaaaggcaacggctcctaacaaacctccagcactgtctaacactgaaaagaggaaccactcggccttctggggacccgagtctcagataatacctgtcatgccggacagctcttcttccgggaagaatcgcaaggaggaaagttatattttcgaatctaagggagacggcggcggcggtgagcacccagcacccgaaacgggcgctgtcctgcccctggcgctagggctggccataacggccctactcctgttgatggtggcctgcagacttaggttggttaagcagaagctaaagaaagcaagaccaatcaccagtgaagagtctgattacctcatcaacggaatgtatctgtag

SEQ ID NO: 43137 - DNA, 978 bp, Artificial Sequence
  Description of Artificial Sequence: Synthetic coding sequence
atggccagcgtggcccaggagagcgccggcagccagcggcggctgcctcctcggcacggcgccctgagggggctcctgctgctgtgtttgtggcttccaagcgggcgggccgcgttacctccggccgccccattgagcgagctgcatgcccaactgagtggggtggaacaattgctggaggaattccgcagacaactgcagcaagaaagacctcaagaggagcttgagctggagctgcgagctgggggcgggccccaggaggactgtcccgggcctggatcaggtggttactcagccatgcccgatgcgattataaggactaaagactctctggccgccggcgcttctttcttgcgcgcgccagccgcagttcgcgggtggcgccagtgcgtggctgcctgttgcagcgagccacgatgctccgttgcagttgttgagctcccaaggcggcctgcaccgccagcagctgtgctagggtgctacctgttcaactgcacagctcgcggacggaacgtctgtaagttcgctctgcatagtggatactcgtcgtactcgttatcccgggcaccagatggggcagccttggcaactgcccgggcgtccccccggcaagagaaggatgcaccccctctgtcaaaggccggccaggacgtggtcctgcatctgccaaccgatggcgtggtgctcgatggccgtgagagtaccgacgaccacgctatagtgcagtacgagtgggcactcctacagggagacccaagcgtggacatgaaggtgccacagtcaggaacgttaaagttatcacatctgcaggaaggcacctacacttttcagctcacagtgacagatactgcagggcagcgaagctctgacaatgtgtctgtcacagtcctaagagcagcctatagcacgggagatggctggagcatctgttgtatctgtagcaagcgagaggccaaggagttctctgagacatcatag

SEQ ID NO: 43138 - DNA, 738 bp, Artificial Sequence
  Description of Artificial Sequence: Synthetic coding sequence
atgaaggtgccccagagcggcaccctgaagctgagccacctgcaggaaggcacctatacatttcagcttacagtgaccgataccgccggacagcgttcaagcgataatgtttccgtaactgtgctgagggccgcttactccaccggcggctgcctccatacatgctctaggtaccatttcttctgcgatgatggctgctgcattgacattacgctggcctgcgatggcgttcagcagtgccctgacggctctgatgaggatttttgccaaaatctgggtctcgatagaaagatggttactcataccgctgcctccccggcactgccgagaacaacgggcccctccgaggatgccggaggcgattccttggtcgagaagtcgcagaaagctacagccccaaataagcctccagccctctccaacacagaaaaaaggaatcatagtgccttttggggccctgagagccagatcatcccagtgatgccagactcgagttcaagcggcaagaaccgaaaagaggaaagctacatcttcgaatcgaagggagatggcgggggaggagaacacccagctccagagactggcgctgtgctgccactggctttgggtctggctattacggcacttctcctactcatggtggcatgcagactgcggctggtgaaacagaagttgaaaaaagctcggcctattaccagcgaagaatcggattatctcattaatggaatgtatttatag

SEQ ID NO: 43139 - DNA, 2580 bp, Artificial Sequence
  Description of Artificial Sequence: Synthetic coding sequence
atggcctgccggtggagcaccaaggagagcccccggtggcggagcgccctgttactgctgttcctggctggcgtctatggcaatggggctctggcagaacactcggaaaatgtgcacatctcaggtgtgtccaccgcttgtggggaaacaccggagcaaatcagagccccatccggaattatcacatcccctgggtggcccagtgagtacccagccaagattaactgtagctggttcattcgggccaatcctggtgagattatcacaatttcatttcaggactttgatattcaaggctcccgcaggtgcaacctggattggcttacaattgagacctataagaatatcgagagctaccgcgcttgcggtagcaccatcccacccccatatatctcatctcaggatcacatctggattaggtttcactccgatgataacatctctagaaagggatttagacttgcctattttagtggtaagtccgaggagccaaactgcgcctgtgaccaatttagatgtggcaatggtaagtgcatacccgaggcctggaaatgcaacaatatggatgagtgtggcgattcatccgacgaggaaatttgcgctaaagaagcaaatcccccaacagccgccgcttttcagccttgtgcctataaccagttccagtgccttagtaggtttacgaaggtgtacacatgcctcccagagtccttgaagtgtgacggtaatattgactgcctggacctgggcgacgaaatcgactgtgacgttccgacctgtggccagtggctgaagtatttctacgggacctttaactctccaaactatccggacttttatcctcccggttctaactgcacctggctcattgacactggagaccaccgcaaggtgatactgcgattcacagacttcaaactcgacggcacaggctatggtgactatgtaaaaatatacgacggactggaggagaacccacacaagctcctacgcgtgttaacagctttcgatagccacgcgccgctgacagtagtatcctccagcgggcagatcagggtgcatttctgcgctgataaagttaatgccgcccgcgggtttaacgcgacctatcaggttgacggcttctgtctgccttgggagattccctgcggcggaaattgggggtgttacaccgagcagcagagatgcgatggttactggcattgcccaaacggcagggacgagacaaactgcacgatgtgtcagaaggaggaatttccctgttccaggaatggggtgtgttacccccgctctgacagatgcaattatcaaaaccattgccctaatgggagcgatgaaaagaactgcttcttttgccagcccgggaacttccactgtaaaaataaccgatgcgtgtttgaatcatgggtgtgcgattctcaggatgattgtggcgatggttcagatgaggagaactgtccggtcatcgttcctacacgagtgataacagcggcagtcatcggctctctgatctgcgggctgctattggtaatcgctctcggatgtacatgcaagctttactctctgcggatgtttgaacggagatctttcgaaacccagcttagccgggtggaggccgagctacttaggcgggaagccccaccatcctacgggcaactaattgcacagggactgatcccgcctgtggaggattttcctgtgtgctcccccaatcaagcaagtgttctggagaatttacggctggccgtgagatcacaactcggtttcaccagcgtccgccttccgatggcggggcgtagctctaatatctggaatcgaattttcaattttgctcgctcccgacattcaggatctttagcactggtgtctgcggacggtgacgaagtagtaccttctcaaagcacgtcacgggaacccgaaagaaatcacacccaccgaagcctgttttcggtagagagcgacgacactgacaccgaaaacgagcgacgggacatggctggggcgtccgggggcgttgcagcacccctgccccagaaagtgccaccgacaactgctgtggaggccacggtgggggcatgtgccagttctagcacacagagtacccgcggcggtcacgctgataacggcagagacgttacttccgtggagccgccctcagtgagccctgcccggcaccagttaaccagcgccctatcgaggatgactcaggggctgcgctgggtgcgcttcacactcggacgctcgagttctctatcacagaatcaatcacctctgagacagctggataacggggtctctggaagggaggatgacgatgatgttgagatgttgatccccataagcgacggatcctcggacttcgatgtgaatgactgttcacggccccttttggacctggccagcgatcaggggcagggccttcgacaaccctataacgccacaaatcccggcgtgaggccatcgaatcgcgacggtccatgtgaaagatgtggcatagtgcacactgcccagatacccgatacgtgtttggaggtgactctgaaaaatgagactagcgacgacgaggctctcctgctgtgctag

SEQ ID NO: 43140 - DNA, 2523 bp, Artificial Sequence
  Description of Artificial Sequence: Synthetic coding sequence
atggcctgccggtggagcaccaaggagagcccccggtggcggagcgcgctcctactgctgtttctggcaggcgtttatgcctgtggcgaaactccggagcagatccgggcgcctagcgggattataacatcccctggctggcccagtgaataccctgcgaaaattaattgttcatggttcatccgcgccaacccaggcgagattattactatctcttttcaagatttcgatattcagggatcacgcaggtgcaacctggactggctaactattgagacctacaaaaatattgagtcctaccgcgcctgcggaagtactattccgccaccttacattagcagccaggatcatatctggatccgcttccatagtgacgataacatctcccggaaaggatttcgtctggcttatttctccgggaaatccgaggaacctaattgtgcatgcgaccagttccgttgtggtaacgggaagtgcatcccagaggcttggaagtgtaacaacatggacgaatgcggcgactcttcagacgaggagatctgcgccaaagaggcaaatccacctacggccgccgcattccagccttgtgcttataatcagttccagtgtctgtcacggttcactaaagtatacacatgtcttccggaaagcctgaaatgtgatggcaacattgactgcctagatctcggagacgaaattgattgtgacgtgcccacatgtggacagtggctaaaatacttttacgggactttcaatagtcctaactatcccgacttttacccgcccgggtcaaattgtacatggctgatcgatacaggagatcaccgcaaggtgattttaagatttaccgacttcaaactggacggcacaggatacggagattatgtcaagatctatgatgggcttgaagaaaaccctcacaaattgctcagagtgctgacagctttcgacagtcatgctccccttaccgtggttagcagctctgggcagattagagtacacttttgtgctgataaggtgaacgcagcaaggggattcaatgctacgtaccaagtcgatggattttgcctcccctgggagataccatgtggaggaaactggggttgttatacagaacagcagcgctgcgatggatattggcactgccctaacggacgagacgagacaaactgcaccatgtgccaaaaggaggaattcccttgcagtcgtaatggtgtttgctacccgaggagcgacaggtgtaactatcagaatcactgtcctaacgggagtgacgaaaaaaactgttttttctgccaacccgggaactttcactgcaagaataatcgctgcgtgtttgaaagttgggtgtgcgactctcaagacgactgtggggacggttccgatgaggaaaactgtcccgtgattgtccccactcgcgtgattactgccgcagtaattgggagtctgatctgcggcctgctgttggtgatagccctcggctgcacatgtaagctgtactctctgagaatgtttgagcggcgcagttttgagacccagctgagccgggtcgaagccgagctgctccgaagggaggccccaccctcttacggtcagttgatcgcccagggcctgataccccccgttgaggattttcctgtctgcagtccaaatcaggcatctgtgctggaaaacctgcgcctggccgtgcgctcacagttaggatttacctccgttagactgcctatggcaggcagatcaagcaacatctggaataggatcttcaatttcgctcggtcccgacatagtggcagcctggctctggtctcagccgatggcgacgaggtagtgcccagtcaatctacctcaagagagccagaacgaaatcacacacacaggtccctcttctcagttgaatccgatgataccgacactgagaatgaacggcgcgatatggcaggggccagtggcggcgttgccgctcctctgccacagaaggttcccccaacaaccgcagttgaggccacagtgggggcttgcgcctcctcttctacacagagtaccagaggaggtcacgccgataatgggcgggatgtgacaagcgtggagccaccctccgtgagcccggcccgccatcagctgacaagtgcactaagcagaatgacccaggggctgcgttgggtgcgctttaccttagggagatcgagcagcctgtcacagaatcagagccctctgcggcagttagacaacggcgttagtgggcgtgaagacgacgatgacgtggagatgctcatccccatttcagatggctccagcgatttcgacgtgaacgattgttcacggcccctgcttgacctcgccagtgatcaggggcaggggctgagacagccctacaacgccaccaatcctggcgtaagaccttctaatcgcgatggtccatgcgagcgatgtgggatagtacacactgcacaaatccccgacacctgtcttgaggtgacattaaagaacgagacttcagacgatgaagcccttctgctgtgttag

SEQ ID NO: 43141 - DNA, 8592 bp, Artificial Sequence
  Description of Artificial Sequence: Synthetic coding sequence
atggccagcgaggacaaccgggtgcccagccccccccccaccggcgacgacggaggcggcgggggtagggaggagacaccaacagaagggggggcgctgtctctgaagccaggtttgcctatcagaggaatccggatgaaatttgctgtgttaacaggactcgtggaggttggagaggtctccaacagggacatcgttgagaccgtttttaacttactcgtgggaggccagtttgatctggagatgaactttattatccaggagggagagagtataaactgcatggtggatttactcgagaaatgcgacataacttgccaggccgaagtgtggtcgatgtttactgcaattctcaaaaaaagcattcgcaatctgcaagtctgcaccgaggttggcctggtcgagaaggtgctgggcaaaattgaaaaggtcgataacatgattgccgacctcttagtggacatgctgggagtcctggccagttacaatcttacagtgagagaattgaaactgtttttctctaagttacagggtgacaaagggaggtggccaccacacgccggcaaactgttaagcgtgctgaagcacatgccacaaaagtacggccctgacgcctttttcaacttcccaggtaagagtgctgccgctatcgctctgcccccaattgcaaagtggccttaccagaacgggtttaccttccacacctggctccggatggaccccgtgaacaacatcaatgtcgataaggataaaccctacctgtattgctttagaacatccaaaggcctggggtattctgcacatttcgttggcggatgtcttatcgtgactagcataaaatcaaagggaaagggcttccagcactgcgtcaaatttgatttcaaaccccagaagtggtatatggttaccatcgtacacatttataacaggtggaagaactccgagctccgatgctatgtaaacggcgaactagcgtcatatggtgagatcacatggtttgtgaacacctccgataccttcgataaatgcttccttggcagctctgagacagccgacgcaaaccgggtcttctgtggacagatgacggccgtctacctgttttccgaggccctcaatgccgcccagattttcgccatataccagttggggctagggtataaaggaacctttaaattcaaagctgagtccgatttatttttggctgaacatcacaagctgctgctttacgacggcaagttgtcctccgctattgcatttacatataatccacgagctactgatgcacagctctgtttggagtcctctccaaaggacaatccatccatctttgtccattcaccccatgcgctgatgttacaggatgtcaaggcggtgctcacacactctattcagtcggcaatgcactctattgggggtgtgcaggtgttgttcccactgttcgcccagctcgattatcgccaatacctgtccgacgagatcgacctcactatctgctcaacattgctggcttttattatggaactgctgaagaattccatagctatgcaggagcagatgctggcctgtaaagggttcctggttattggttacagtctggagaagagctcaaagagtcatgttagcagggccgtactggagctgtgccttgccttcagcaaatatctgagcaacctccaaaacgggatgcccttgttgaaacagctgtgcgatcacgtcctcctcaatcccgctatctggattcatacaccggccaaagtacagcttatgttgtatacctacttgtcaaccgagtttatcggcactgtgaacatctacaataccataaggcgggtgggcacagtactgctgatcatgcacactctcaaatattattactgggcagtcaacccccaagaccgctcaggcatcacgcctaaaggactcgacggccctcggcccaaccaaaaggagatgctgtcgctgcgggcattcttactgatgttcattaaacagctcgtgatgaaggactccggtgtgaaggaagatgagctgcaggccatactgaattatcttttgacgatgcatgaggacgataatctgatggatgtacttcagctgttggtcgctcttatgtccgaacaccccaacagtatgatccccgctttcgatcagcgtaatggcttaagagttatatacaagttattagcttctaagagtgaagggatacgggttcaggcgctgaaggcaatggggtatttccttaaacacctggctcctaagcgcaaggctgaggtcatgctgggccatggcctgttctccctgctcgcagaacgcctgatgctgcaaacaaacctaatcacgatgactacgtacaacgtcctatttgagatcttgatcgagcagattgggactcaggttatccacaagcaacacccagacccagatagttctgtgaaaattcagaacccacaaatcttaaaggttattgctacccttcttcggaactcacctcagtgtcctgagtcaatggaggtgagacgcgccttcctgagcgacatgattaagttatttaataactcaagagaaaacaggcgcagtctgcttcagtgttctgtgtggcaggaatggatgctgagtctgtgctacttcaacccaaagaactctgacgaacagaagattacagagatggtgtacgctattttcaggattctgttataccacgctgttaagtacgaatgggggggttggagagtctgggtggacactttatccattacccatagtaaggtcaccttcgagattcacaaagagaatttagccaatatctttcgtgagcagcagggaaaagtggacgaggagataggcttgtgttccagcacatcggtccaagctgcttcagggattagacgtgacatcaacgtaagcgtgggatcccagcaacccgataccaaggactcaccggtctgtcctcacttcaccacaaacggcaacgagaattcctctatcgagaagaccagtagtctcgagtccgcaagcaacatagagctgcaaaccacaaatacttcatatgaggagatgaaggcagaacaggagaatcaggagctaccagatgaaggcacgttagaagagacactgaccaatgaaactaggaacgcagacgatctggaagtttcaagcgatattattgaagccgtggccataagcagcaactccttcataacaacaggcaaggacagtatgaccgtgagtgaagtaaccgctagcatctcctcgcccagcgaggaagacgcctctgaaatgcctgagttcctggataagtccattgtggaagaagaagaagatgatgactatgtggagctaaaggtggaagggtcccccaccgaggaggccaacctacccacggagctgcaagacaacagtttaagcccggctgcctccgaggccggggagaaactagatatgtttgggaacgacgacaagctcatattccaggaaggaaaacccgttactgagaagcagaccgacaccgagactcaggactcaaaagactccggcatccagacaatgacagcatctggcagttccgctatgtcccctgaaacaacagtgtctcaaatcgctgtagagagcgacttaggtcagatgctcgaggaggggaagaaagctaccaatctgaccagggaaaccaagcttattaatgattgccatggatctgtgagcgaggccagttccgaacagaaaattgcaaaattggatgtgtcgaacgtggccactgatactgagcggctcgaacttaaagcttcaccaaacgtcgaggctccgcagccacacaggcacgtactggagatttcgaggcaacacgagcagcccgggcagggaatcgccccagacgccgttaacggccagaggcgcgacagccggtccacagtgttccgcataccagagttcaattggtcccagatgcatcagagactgcttaccgatctcctttttagcatcgaaacagacattcagatgtggaggagccactccaccaagaccgtaatggattttgtgaactcctccgacaatgtgatttttgtccacaatacaattcacctgatttcccaggtcatggataatatggtcatggcatgtggaggtattttgcccctactgagtgctgccacatccgcgacccacgaactcgagaacatagagccaacacaagggctgtccattgaggctagcgtcacttttctgcagagactcatcagccttgtagacgtcctgatatttgcctctagccttgggtttaccgaaattgaagccgagaagagcatgtccagcggcggcattctgcgacagtgtttaaggctggtgtgtgccgtggctgtccggaactgtctagagtgccaacagcattcgcagttaaagacccgaggtgacaaagccttaaagccaatgcacagtctgatccctctgggcaaatccgcagctaagagtcccgtagacatcgtgactggcggtatttcacccgtccgggaccttgatagactgctgcaggacatggacatcaatagattgcgagcagttgtgtttagggacatcgaggacagcaagcaagcccaatttctagctctggcagtagtgtattttatcagcgtgctaatggtgtctaaatacagagatatcctggagccacagaacgagcgacactctcagagttgcactgagaccggatcagagaacgaaaatgtctcgctgtcagagattaccccagccgcttttagcactctgaccacggctagcgtggaggagagcgaaagcacatctagtgctcgacgccgggattctggcatcggtgaggagaccgccaccggcttgggatcacacgtagaagtcacacctcatacagcacctcccggcgtctctgcaggaccggacgctatttccgaagttctgtccaccttgtctctggaggtcaataaatcgccggagaccaagaacgacagagggaacgatcttgacacgaaagcaacccccagcgtgagcgtgagtaaaaatgtgaatgtaaaagatatcctgcgtagcttagttaacatccctgctgacggagtgaccgtagatcccgccctcctgcccccagcctgccttggcgcattgggagatttgtccgtggaacagccagtccagtttcgcagctttgatcgatccgtcatcgtagctgccaagaaatccgctgtgtctccatcaaccttcaacacttcaattcctaccaatgcggtgtcagttgtgtcctccgttgactcagcccaggcctctgacatgggcggagagtcccctggatctcgaagttctaatgccaagctgccgtccgtccccactgttgacagtgtttctcaggatcccgtaagtaacatgagcatcaccgaaagactcgaacatgctctcgagaaagccgcacccttactgagagagatttttgtagattttgcgccattcctcagtagaaccctccttgggagtcatgggcaggagctgctgattgaaggcacatcacttgtgtgtatgaaaagtagttcaagcgtggtggagcttgttatgcttctgtgctcccaggagtggcagaactccatccagaaaaacgcgggactcgccttcatagagctggtaaatgagggaaggctgttgagccagactatgaaggatcaccttgtaagagttgcgaacgaggccgagttcattctgtcccggcaacgggctgaagatattcatagacacgccgaatttgagagcctgtgcgcgcagtactccgctgacaaacgcgaggatgaaaagatgtgcgatcacctcatacgggcagcaaagtacagagaccatgtcacagctactcaactgatccagaagatcattaatatcctgactgataagcacggcgcctggggtaattcagctgtgagtcgaccccttgagttctggaggcttgactactgggaggatgacctgcgccggaggaggagattcgtgcgcaatcccctcggatccacgcacccagaggccaccctaaaaacagcagttgaacatgtctgtatttttaaactccgcgaaaatagcaaagccacagatgaggacatcctggccaagggaaagcagagcattcgaagccaggccctgggcaaccagaattccgaaaacgaaattttgctcgaaggcgacgatgatacactgtcgagcgtagatgagaaagacctagaaaacctcgccggccccgtgtctctgtctactcctgcccagctagtggccccttccgtggtggtcaagggcacactttccgtgacgagttcggaactgtattttgaagttgatgaagaggatcctaactttaagaagatcgatccaaaaattctcgcgtacaccgagggtttgcacggcaagtggctctttactgagatcagatccatttttagcagacgttacctgctacagaatacagcccttgaaatctttatggccaatagggtggctgtgatgtttaatttcccagatcccgccaccgtgaagaaagtcgtcaattatctgccgcgggtgggcgtaggcacgagtttcggacttccccagactcggcgtatatctctagcctccccacggcagcttttcaaggctagcaatatgactcaaagatggcagcatcgcgagatctccaacttcgaatatcttatgtttttaaacaccatcgcaggccgctcttataacgatctgaatcagtaccccgtgttcccttgggtgatcacaaactatgagtccgaggagttagacctgactctgcctacgaatttccgggatctgtccaagccaattggggcattgaaccccaaaagagccgctttctttgcggagcggtacgaatcatgggaagatgaccaggtgcccaaatttcattatggtacccactattccacagcttcctttgtgctcgcgtggctgctgcgcattgagccttttacaacttacttccttaacctgcagggcgggaaatttgaccacgcagacaggacgttttcatctatttcacgagcatggcgcaattctcaaagagacacttctgatatcaaagaacttatcccagaattctattacctgccagaaatgtttgtgaattttaataattataatctgggcgtgatggacgatggcaccgtcgtgagcgatgtggagctccctccttgggcaaagacgagcgaagaattcgtgcatattaaccgcctagcgctagagtctgagtttgtgagctgtcaactgcaccagtggatcgatctcatcttcgggtataagcaacagggacccgaggcagtgagagcgctaaacgtgttctactatctcacctacgagggcgctgtcaatcttaattctatcaccgatccggtgcttcgcgaggctgtggaggcacagatcaggtctttcggccaaacaccctcgcagctgcttatagagccccacccaccgcgggggtctgccatgcaggtgagcccgcttatgtttactgacaaagcccagcaggacgtaatcatggtactaaagttccctagcaatagccccgtgacacacgtggccgcaaatactcaacctgggctagccactcccgctgtgattaccgtgacagctaataggctgtttgctgtgaataagtggcataacctgccagcccaccagggagccgtccaggaccagccctaccagctgcctgttgagatcgaccctttaattgcctccaacacaggaatgcatcgtaggcagattacggacctcctagatcaatctatccaggtgcattcccaatgctttgttattacttctgataatcgttacattctggtgtgcggcttttgggacaagtctttcagagtatacagtactgatacaggtcgactaatccaggtcgtttttgggcactgggacgttgttacctgcttggcaagatcggagtcatatattggcggcaactgttatatcctttctggctccagagatgctacccttctcctttggtactggaatggaaagtgtagcggcataggtgataatcccggatccgagactgcagcgcctcgagctattctgaccggccacgattacgaagtcacttgtgccgcagtgtgtgccgaacttggactagtgctcagcgggagccaggagggtccctgtcttattcattcaatgaatggagacctcctgaggaccctagagggccccgagaattgtcttaagccaaaactgatacaagcaagcagggaaggtcactgtgtgatcttctacgaaaacggactgttctgtacattctctgtgaatggaaagctgcaggcaacgatggaaactgatgataatattagggcaatccaactcagccgggacggacaatacctgctgactggcggcgatagaggggtcgtagtagtgaggcaggtaagtgacctcaaacagctgtttgcttaccctggttgcgacgctggcattagagccatggcgctgtcatatgaccagagatgtatcatcagcgggatggcatctgggtctattgttctattttacaacgacttcaacaggtggcaccacgagtatcaaacacggtattag

SEQ ID NO: 43142 - DNA, 8559 bp, Artificial Sequence
  Description of Artificial Sequence: Synthetic coding sequence
atggccagcgaggacaaccgggtgcccagccccccccccaccggcgacgacggcggcggaggcggcagggaagagacaccaactgaaggtggggcccttagcttgaaaccggggttgccgatccgcggcatccgcatgaaatttgccgtgttgactggcctggtggaagtgggggaggtgtccaatagggatatcgtagaaaccgtttttaatcttctcgttggcggccagttcgatctggaaatgaatttcatcattcaggagggtgagtcaatcaactgtatggttgatctgctggagaaatgcgatattacatgccaagccgaagtgtggagcatgtttacagcaattctcaagaagtctatcagaaatctgcaggtgtgtacagaggttggactggtggaaaaagtgctgggcaaaattgagaaggttgataatatgatagccgatctactggtggacatgctgggcgtcctcgctagctataatctaacggtccgtgaattgaaactctttttctcaaagcttcagggcgacaagggccggtggcccccacatgccggcaagctattaagtgtgctcaagcacatgccacagaagtacggtccagacgccttttttaacttccctggtaagtcagccgcggccatcgcacttcccccgattgcaaaatggccgtatcagaacggattcaccttccacacctggctgagaatggacccagtcaacaacatcaacgtggacaaggacaagccatatctgtattgcttccgcacctccaaaggactggggtattcagcacattttgtgggagggtgcttgattgtaacatcgatcaaatcaaaaggcaaagggttccagcattgtgtaaagtttgacttcaaacctcaaaagtggtacatggtgacaattgtgcatatttataaccgctggaagaacagcgagctgagatgttacgtcaacggggaactcgcatcctacggagagatcacctggttcgtgaacaccagcgacaccttcgacaagtgctttttaggcagttcggaaactgcagatgccaacagggtcttttgtggccagatgactgccgtatatctcttcagtgaagccttgaacgccgcccagatctttgctatttaccagctcgggctaggatacaagggtacctttaaattcaaggcagaaagcgatctgttcctcgccgaacaccataaattgcttctgtacgatgggaagctttcctccgcaattgcattcacttacaatcccagggcaaccgacgcccagctttgcttagagtcctcacccaaagataatccatccattttcgtccactctcctcatgcccttatgttgcaggacgtgaaggctgtactgacgcatagtattcagtctgctatgcacagtatcggcggagtgcaagtattgtttccgttgttcgcccagctagactataggcagtatctgtctgacgagattgatttgactatctgcagcaccctgctggctttcattatggagttgcttaagaattctatcgccatgcaggagcagatgctcgcatgcaaggggttcctggtgatagggtattccctggagaaatcctctaaaagccacgtaagccgcgccgtcttagagttgtgtctggctttctcaaagtatctgtccaacctgcaaaatggaatgcctctgttaaagcagttgtgtgaccacgtgctcctgaaccccgcaatttggatccacacacctgccaaagtccagctcatgctgtacacgtatctcagtacagaattcatcgggacagttaatatatacaacacgattaggagggtcgggacagtgttgttgataatgcacaccttaaaatactattactgggcagtgaacccccaggaccgcagcgggatcaccccgaaagggctggatggaccaaggccaaaccagaaggagatgcttagtctgcgcgccttcctcctgatgttcattaagcagctagtgatgaaggactccggagtgaaagaggacgagctccaggccatcctgaactacctgctaactatgcacgaagacgacaatctgatggacgtgcttcagcttcttgttgcactcatgagcgaacaccctaactcgatgatcccggctttcgaccagcggaatggcctgagggttatctacaagttacttgcctctaagtccgagggcatccgggttcaggcattaaaggcaatgggatatttcctgaaacatctggcgccaaagaggaaggcggaagttatgctgggacacggcttgttctcacttctggctgaaagactgatgctgcagacaaacctcatcactatgacaacatataacgtcctctttgagatcctcatcgagcagattggaacccaggtgatccataaacagcacccagaccctgacagttctgtaaagatccaaaatcctcagatcctaaaggtgatcgcgacccttctacgaaatagcccgcagtgcccagaatcaatggaggtgagacgggcgttcctttcagacatgatcaagttgtttaacaacagtagagaaaatcggcgctcactgctgcagtgcagtgtctggcaggagtggatgttgagtctctgttactttaaccctaagaactccgatgaacagaaaattacagaaatggtgtacgctatatttcgaattcttctataccacgccgttaaatatgagtgggggggctggagggtctgggtggataccctttccattacacattcaaaggtgacgtttgagattcataaggagaacctggcaaacatctttcgggagcagcagggaaaagtggacgaagagattgggctgtgttcttcgaccagcgtccaagccgcctcagggattcgcagggatataaatgtgagtgtaggatcccagcaacccgataccaaggattctcctgtctgcccccacttcaccaccaatggaaacgagaactcatccatcgaaaagactagctcccttgagagtgccagtaacatcgagctgcaaaccacaaacacatcttacgaagaaatgaaggctgaacaagagaatcaggaactcccggacgagggaaccctcgaggagactttgacgaacgagactagaaacgcagacgatctcgaggtgtcaagtgacattatcgaagcggttgccatttcatcaaatagtttcattaccaccggtaaggactctatgacggtcagtgaggttacagcgagtatcagtagcccctccgaggaagacgcctcagaaatgcctgagttcttggacaagagcatcgtcgaggaggaagaagacgatgattacgttgaactgaaggtggagggcagcccaactgaagaggcaaatttgcccacagaactccaagataatagcctcagtcccgccgcaagtgaagccggcgagaagcttgatatgtttgggaatgacgataaacttatcttccaagagggcaagcccgtgaccgagaagcaaaccgataccgaaacgcaagattccaaggactcaggcatccagactatgaccgcatctgggtcctctgccatgtcaccggagacgaccgtgtctcagatagcggtggagagtgacctcggccaaatgctcgaagaaggtaaaaaggccacaaatctcacacgagagacaaaactgatcaacgattgtcacgggagtgtgtctgaggcctcatccgagcaaaaaatagctaagctggacgtgtctaacgtggcaacagatactgagcgcctggaattaaaggccagccctaacgtggaagccccacagcctcatcggcacgtactcgagatttcccgtcagcatgagcaacccggccaagggatcgccccagatgctgtgaatgggcagaggcgagatagcaggagcaccgtattcagaataccagagttcaactggagccagatgcaccaaaggttgctgaccgacctgttattctccatcgagaccgacattcagatgtggcgcagccattcaactaaaaccgttatggacttcgtcaactcctctgacaacgtcatttttgtccacaatacaatccatctcatctcacaggtcatggataacatggtcatggcttgtgggggcattttgcctttactgagcgccgccacctcagccacccacgaacttgaaaacattgaaccaacacagggactcagcatcgaggccagcgtgacgttcttacaaaggctgatctccctcgtagacgtgttaatattcgcctcaagtctgggcttcaccgaaatcgaggctgagaaatctatgtcctctggtggcattctccgtcaatgtttaaggctagtctgtgccgtggcagtgagaaattgtttagagtgccagcaacattctcaactgaaaacccgcggggacaaggccttgaaacccatgcacagcctcatccctctgggaaaaagtgccgctaaatccccagtggatattgtcacggggggcatctcaccagtgcgtgatctcgatagactgttacaagatatggatattaacagattgagggcagtggtattcagagacatcgaggattctaagcaagctcagtttctggctctcgctgtcgtctacttcatatcggttttaatggtctccaaatacagagacattctggagccacagaatgaaagacacagccaaagttgtactgagactgggtctgaaaacgagaatgtcagcttaagtgaaatcacacccgccgcattcagcaccctaacaaccgcctcagtggaggagtcggaatctacttcctcagcccggaggcgggacagtggtattggggaggaaactgctactgggttgggctcccacgtagaggttacaccccacaccgctcctcccggcgtaagcgctggccctgacgctatatccgaggtgttatccactttgtcactggaggtgaacaagtctcccgagaccaaaaatgacagaggcaatgacctcgatacaaaagcaaccccaagcgtctctgtttctaagaatgtgaatgtgaaagacattctacgcagcctggtgaacattcccgccgatggggttactgtggaccctgcattgctgcccccagcctgcctgggggctctaggagacctaagcgtagaacagcctgtgcaatttcggagcttcgataggagcgtgattgtggccgctaagaaaagtgcggtgtcaccaagcacattcaacacctccatacccacgaatgccgtgtccgtggtgagcagcgtggacagcgcacaggcctcagatatgggaggcgaaagtcccgggtcacggtcctcaaacgccaagctaccgagtgttccaacggttgactcagtgtctcaggaccctgtttctaatatgtccataaccgaacgcctcgaacatgctctagagaaagctgcccccctgctaagggagatctttgttgattttgccccctttctgtcccggaccctgctcggcagccacgggcaggaattgctgatcgagggtacctctctggtttgtatgaaaagcagttccagcgtggtagagctggttatgttgctgtgttcacaagaatggcaaaactccatccagaagaacgctggcttggccttcatcgagctagtgaacgaaggtcgtctgttatcacaaactatgaaagatcatctggtgagggtagccaatgaggccgagtttatactgtccagacagcgggcagaggacatccacaggcatgcagagttcgagagtctgtgtgcccagtattcagccgacaagcgggaggacgagaagatgtgtgaccaccttattcgcgcggcaaagtaccgagaccacgtgacagctacccagctcattcagaaaattattaatatattgaccgataaacatggcgcatggggaaatagcgccgtcagcaggcccttagagttctggcgacttgactactgggaagacgatcttcggcgtagacggcgcttcgtgcgtaatccgttagggtcaacccatccagaggccaccttgaagactgcggttgagcacgccacagatgaagacatcctggccaagggcaagcagagcataaggagccaagccctgggtaatcaaaatagcgagaatgaaattcttctagaaggtgacgacgataccctctccagtgtagacgagaaagacttggaaaacctggctggccccgtgtctctctccaccccggcccagctggtggcaccctcagtggtcgtcaaaggcaccctgagtgtcacgtcgtctgaactgtacttcgaggtggacgaggaggacccaaactttaagaaaatcgacccaaagatactcgcctacaccgaggggctgcacggaaaatggctctttacagagatccgaagtatcttctctagacggtacctgttacagaacactgcactggagatcttcatggccaatcgagtggctgtgatgttcaactttccagacccagccaccgtgaaaaaagtcgtgaattaccttcctcgtgttggagtgggcacgtcatttggactgccgcagacgcgccgtatctccttagcaagcccacgccagcttttcaaagccagcaatatgacacagcgatggcagcaccgggaaatctctaacttcgagtaccttatgttcctcaatacgattgccgggcggagttacaatgatctcaatcagtaccccgtgttcccctgggtgatcaccaattatgaatctgaagaactcgatctgactctcccgacaaactttcgcgatctgtctaaacctataggagcgctaaatcccaaacgggcagcttttttcgcagaaagatacgaatcatgggaggacgaccaggtgccaaagttccactacgggacacattactctacggccagcttcgttttagcatggctcctgcggatcgagccgttcacaacatattttctcaatttacagggtggcaagttcgatcatgcggatcggacattttcatctataagtcgggcctggcgcaactcccagcgcgacacctcagatattaaggagttgatccctgagttctattacttacccgaaatgttcgtgaacttcaataattataacctcggcgtgatggatgacgggaccgtcgtgagcgatgttgagcttcctccttgggccaaaacctctgaagaattcgttcatatcaatagactggctctggagtccgagtttgtgagctgccagttacaccaatggattgatctgatttttggctacaagcagcagggtcctgaagccgttagagccttgaacgttttctattatttaacatacgaaggtgccgtgaatctaaacagtattaccgacccggtactgcgtgaggccgtggaggcccagatccgcagtttcggacaaaccccaagccagcttctcatagagccccacccacccagaggaagcgcgatgcaggtctctcctctcatgtttacagataaagcacaacaagatgtgatcatggttttgaaatttccatccaattcacctgttacccacgtggctgccaatacccaacctggtctggccacccccgccgtgattaccgttacagcgaatcggttgtttgccgttaacaagtggcataacttgcctgcgcaccagggagctgttcaagatcaaccctaccagctgcccgtggagatcgatcccttaattgcttctaatacaggaatgcaccgtcggcaaattactgatctgctggatcagagcatacaagtgcacagccagtgcttcgttatcacaagtgacaaccgatacattctagtatgtggcttctgggataaatccttcagggtgtactcaacagatacaggtcgcttgatacaggtggtgtttgggcactgggatgttgtgacatgcctggccaggagtgagagctatattggaggcaattgttatatattgtccggcagtcgcgacgcaacgctgcttttgtggtattggaacggcaagtgcagcggcattggcgacaaccccggatccgagacagccgctccacgcgccatcctaactggacatgattatgaagtcacttgcgctgcagtttgcgctgaactgggtcttgttttgagtggttcccaagagggaccatgtctcatccattccatgaatggcgatcttctccgtacactggaaggcccagagaactgtctcaaacctaagctcattcaagccagcagagagggtcactgtgtaatcttttacgagaacggcctcttctgcactttttcggtgaacggcaaactccaggcgactatggagactgatgataatatccgcgccatccagctgtcccgagacggccagtatctgttgaccggtggggaccgcggagtggttgttgtcagacaagtcagcgacttaaagcagttgttcgcctacccgggttgcgatgccggaatcagagcaatggccctgagttacgatcagagatgtatcatcagcgggatggctagtggaagtattgtgctgttttacaatgatttcaaccgctggcaccacgaataccagacccgctattag

SEQ ID NO: 43143 - DNA, 717 bp, Artificial Sequence
  Description of Artificial Sequence: Synthetic coding sequence
atgctgggcagcccctgcctgctgtggctgctggccgtgaccttcctggtaccacgggcccaacctctggcgccccaagacttcgaggaggaggaggcagatgagaccgaaactgcttggccgcccttgcccgcggtgccatgtgattacgatcactgcaggcatttgcaggtgccctgtaaggagcttcagcgggtggggcctgccgcatgcctttgtcccggcctaagctcgccggctcagccccccgatccaccacgtatgggggaagtccggattgccgcagaagagggacgggcagtcgttcactggtgcgcccccttctctcccgtgctgcattattggctgctgctgtgggacggatcagaggcagctcaaaagggccctcccttgaatgccaccgtgagacgcgcggaactgaaagggttaaagcctggcgggatctacgtcgtttgcgttgttgcagccaacgaggccggagcatctagagtcccccaggcaggaggtgaagggctagagggcgccgatatccccgcatttggcccatgtagtcggttagcagtgcctcccaatcctagaaccctggtacatgctgccgtgggggtgggaacagccctagctcttttatcatgtgcagcactagtatggcacttctgtctgcgggatcgctggggatgtcccaggagagccgctgccagagcggcaggtgccctctag

SEQ ID NO: 43144 - DNA, 270 bp, Artificial Sequence
  Description of Artificial Sequence: Synthetic coding sequence
atgtgccagaaggaggtgatggagcagagcgccggcatcatgtaccggaagtcttgtgcctccagcgcggcttgtctaattgcttcagccggctatcaatcattttgctctcccggaaaactaaattccgtatgtataagctgctgcaacacccccctttgtaacggccctcggccaaagaaacgtggatccagcgccagcgcgctgagacccggactcagaaccaccattctgtttctaaagctggcgttattcagcgctcactgttag

SEQ ID NO: 43145 - DNA, 426 bp, Artificial Sequence
  Description of Artificial Sequence: Synthetic coding sequence
atgtgggtgctgggcatcgccgccaccttctgcggcctgttcctgcttccgggtttcgccctacagatccagtgctatcagtgtgaagaattccagctgaacaacgattgcagctccccagagttcattgtgaactgtacagtcaacgtgcaggatatgtgtcagaaggaggtgatggagcagagcgctggcatcatgtaccggaagtcctgcgcttcatccgcagcatgtttgatagcatccgccgggtaccagagcttttgttccccgggcaaactgaactcagtttgtatctcatgctgtaacacacctctctgcaacgggcccaggccaaagaagagaggcagcagcgcgtccgcccttcgccccggacttagaaccacaatcctcttccttaagctcgcactcttttcagcacattgctag

SEQ ID NO: 43146 - DNA, 495 bp, Artificial Sequence
  Description of Artificial Sequence: Synthetic coding sequence
atgcaggccccccgggccgcccccgccgcccccctgagctacgaccgcagaccacgcgacagcggccggatgtgggtcttaggtatagcagccacattctgtggactctttcttttacccggcttcgccctccaaatccagtgctatcagtgtgaagaatttcaacttaataacgattgcagcagccctgaatttatcgtgaattgtacggtgaatgtccaagacatgtgtcaaaaagaggtgatggagcagtcagccggaatcatgtaccggaagagctgcgcttcctctgcagcttgtttgatcgcatccgccgggtatcagagcttttgctcgccaggtaagcttaacagtgtgtgtatcagctgttgcaacacaccgctctgtaatggcccccgccctaaaaagcgaggaagcagcgcaagtgctcttcggcccgggctgagaactactatccttttcctgaaactggctttattttccgcccactgctag

SEQ ID NO: 43147 - DNA, 378 bp, Artificial Sequence
  Description of Artificial Sequence: Synthetic coding sequence
atgcggggcacccggctggccctgctggccctggtgctggccgcctgtggagagctggctcccgctcttagatgctacgtgtgccccgagcctacaggggtctcggattgcgttactatcgcaacttgtacaaccaatgagactatgtgtaaaaccacgctatactccagggagattgtctacccttttcagggcgatagcactgtaacaaaaagttgtgcgagcaagtgcaaaccatccgatgtagacgggataggacagacccttccagtgagttgttgcaatacagaattatgtaacgtggacggcgcccctgctctgaattccttgcattgcggagccctgaccctacttcctcttttgtccctgaggctttag

SEQ ID NO: 43148 - DNA, 741 bp, Artificial Sequence
  Description of Artificial Sequence: Synthetic coding sequence
atgggcccccagcacctgcggctggtgcagctgttctgcctgctgggcgcaatttcaaccctgcctcgggcgggagctctcctgtgttatgaagccacagctagcagattcagggccgtggctttccataactggaagtggcttcttatgagaaacatggtctgtaaactgcaggaaggatgtgaggagactctcgtttttatcgagaccgggacagctcggggagtcgtgggttttaagggctgctctagctccagttcttaccctgcccaaatatcctatctggtctcccccccaggcgttagtatagcatcctacagccgagtgtgtcggtcatatctctgcaacaatctcacaaatctggaaccatttgttaaactgaaggcctcaactcctaagtctattacttccgcttcttgctcatgcccgacatgtgtgggagagcacatgaaagactgtctgccaaacttcgtgacaacgaatagctgccctctcgccgcttcaacttgctattccagcaccttgaaatttcaagcagggttcctgaataccaccttcctactgatgggctgtgctagagaacataaccagctgttagcagactttcatcacattgggagcataaaagtcaccgaagtcctgaatatcttggaaaagtcacagatagtgggtgccgcatcatctagacaggatccggcctggggtgtggtcctggggttgcttttcgcgttccgggattag

SEQ ID NO: 43149 - DNA, 636 bp, Artificial Sequence
  Description of Artificial Sequence: Synthetic coding sequence
atgggcccccagcacctgcggctggtgcagctgttctgcctgctgggggccatcagcacattaccaagaatgtcatgcggagccggctgttacaagacacagaaaggcaccgctcgaggcgtcgtcgggtttaaaggctgttcgagcagtagttcctaccccgcgcaaataagctatctggtgagcccccctggcgtcagtatcgccagttactctagagtctgtcgttcttacctatgtaacaatctgactaatctggaaccctttgtgaagctgaaagctagtactcctaaatctattacaagtgccagttgtagttgccccacgtgcgtcggcgaacatatgaaagattgccttccaaatttcgttacaactaattcatgtccactggcggcctcaacttgctattcatccacactgaaatttcaggccgggttcttgaacaccacgtttttattgatgggctgcgcacgcgagcataaccagctcttggctgattttcaccacattggctctattaaggtaacagaggtcctgaatattctggagaagtctcaaatcgtgggcgctgcctcaagtcgtcaagatcccgcatggggggtggtgctggggttgctcttcgcctttcgcgactag

SEQ ID NO: 43150 - DNA, 756 bp, Artificial Sequence
  Description of Artificial Sequence: Synthetic coding sequence
atggccatgggcgtgccccgggtgatcctgctgtgcctgttcggcgcagctctgtgtctgaccggctctcaggctcttcagtgctactctttcgagcatacttactttgggcctttcgacctgcgggctatgaaacttccatcaatctcgtgccctcacgagtgcttcgaggctattctctctctcgacaccggctacagggcccctgtcaccctggtgcggaaggggtgttggacaggccctcccgccggccagactcaatcaaatgcagatgctctcccacctgactacagcgtggttagaggatgtaccaccgacaagtgtaacgcacatctaatgactcacgatgctctgccaaatctgagccaggcccccgatcccccgactctttccggggcagaatgttatgcttgcattggtgtgcatcaagatgattgcgccatcggacgaagtagacgtgtacagtgtcaccaggaccagactgcctgcttccagggaaacggccggatgacagttggaaacttctccgttccagtttacatcaggacctgtcatagaccttcttgcactactgagggtaccacaagcccctggacagcgattgacctgcaaggttcctgttgtgagggttacctgtgtaatagaaagtctatgactcaaccatttaccagcgcctccgccactactcccccccgggccctgcaagttctggccctcctactccccgtcctcctgctcgtgggactgagcgcatag

SEQ ID NO: 43151 - DNA, 627 bp, Artificial Sequence
  Description of Artificial Sequence: Synthetic coding sequence
atgaagctgcccagcatcagctgcccccacgagtgcttcgaggccatactctccctcgatacagggtacagagcaccagttaccctggtcaggaaggggtgctggactggaccacctgctggccaaacacagtcgaacgcggacgccttaccccccgactacagcgtggtccgcggttgcaccactgataagtgtaatgctcacttaatgacccatgatgcactccctaacctctctcaagcccctgaccctcctaccttatccggagctgagtgttacgcttgtatcggcgtccaccaggacgattgcgcaatcgggcgtagtcggagggtacaatgccaccaggatcagaccgcttgcttccagggcaatggaagaatgaccgtcggcaatttcagcgtccctgtctacattcgtacctgccaccggcccagttgtacgacagagggcactacatcaccctggactgcaatcgatctccaagggagttgttgtgaaggctacttatgcaacaggaaatcaatgacacagccatttacaagtgcaagcgctacaactccgccacgggcactgcaagtgctagccctgttactccctgtgctgctgctggttggtcttagcgcctag

SEQ ID NO: 43152 - DNA, 624 bp, Artificial Sequence
  Description of Artificial Sequence: Synthetic coding sequence
atgcggctgatcaccctgagcgccaacctgttcaccgtgcccgagaggagccttaccacaactttctctttttcgagatataagagttccgaccgccccgcccataaagttagtatgctgctcctctgccacgcgctggctattgccgttgtgcagattgtaatcttctcggagagctgggcttttgcaaagaacattaacttttataacgtacgacccccactggatccaacacctttcccaaatagttttaaatgtttcacctgcgagaacgctggcgacaactataattgcaataggtgggcagaggataagtggtgtccccagaatacgcagtactgcctcaccgtgcatcacttcacctcacacggtcgcagtacttcaattaccaagaagtgcgcctccagatcagagtgtcacttcgtgggctgtcaccacagtagagattcggagcacacagagtgcaggtcctgctgtgagggcatgatttgcaatgtggagctgcccaccaaccatacaaatgccgtgttcgcagtcatgcatgctcagaggacaagcggatcctctgcccccaccctgtaccttcccgtcttggcctgggtgttcgtgctgccactgctgtag

SEQ ID NO: 43153 - DNA, 552 bp, Artificial Sequence
  Description of Artificial Sequence: Synthetic coding sequence
atgctgtacaagagcagcgaccggcccgcccacaaggtgagcatgctccttctttgtcacgccttggcaattgccgtggtgcagattgtaatctttagcgagagttgggctttcgccaagaacataaacttctacaatgtgagaccccctctggatcccactccatttcctaactcctttaagtgtttcacttgcgagaatgctggcgacaactacaactgcaatcggtgggctgaggacaagtggtgtccgcagaatacccagtactgtttgaccgtgcaccactttacctcacatgggaggtccacaagcatcactaagaaatgcgctagtcggtctgaatgccacttcgtggggtgccaccatagccgcgactctgagcacacagaatgtaggagctgctgtgaaggaatgatctgtaatgttgagttgcccaccaatcataccaatgccgtttttgccgtgatgcatgcccaaagaacatcaggctcatccgcccctactctctatcttccagtcctggcttgggtgtttgttttgccgttgctgtag

SEQ ID NO: 43154 - DNA, 624 bp, Artificial Sequence
  Description of Artificial Sequence: Synthetic coding sequence
atgctgctgatcaccctgagcgccaacctgttcaccgtgcccgagcgttccctcacaaccaccttctcttttagccgttacaaaagttctgataggcccgcgcacaaggtgtccatgctgctcctctgtcacgcactggccatcgcggtggtgcaaatagtgatctttagtgaatcttgggcgttcgccaaaaacattaatttctataacgtaagacctccccttgatccgactcccttccccaatagcttcaaatgttttacctgtgaaaacgctggcgataactacaattgtaacagatgggccgaggacaagtggtgtccacaaaatactcagtattgtctgaccgtccaccattttacaagtcacgggcgcagcacatctattacgaaaaaatgcgcttcccgtagcgagtgtcacttcgtgggatgccaccattcacgtgattctgagcacactgaatgccgaagctgctgtgaagggatgatctgcaacgtagaactgccaacgaatcataccaacgctgtgttcgcagtgatgcacgcccagcgcactagcggcagcagtgctcccaccctctatcttcccgtgttggcatgggtttttgtgctcccccttctgtag

SEQ ID NO: 43155 - DNA, 552 bp, Artificial Sequence
  Description of Artificial Sequence: Synthetic coding sequence
atgctgtacaagagcagcgaccggcccgcccacaaggtgagcatgttgctcctgtgtcacgccttggccatagccgtggtgcagattgtcatcttttccgaaagctgggccttcgccaagaacatcaatttttataacgtacgtccgcctctggacccaacccccttcccaaattctttcaagtgctttacttgtgagaacgctggggataactacaattgcaaccgttgggcagaagataaatggtgcccacaaaacacacagtactgcctgacagtgcatcatttcacttcccacgggagatctacttcaatcaccaagaaatgtgcaagccggtcagaatgccacttcgttgggtgtcaccacagtagagacagcgaacataccgagtgtcggagctgctgcgaagggatgatttgcaatgtggaactgcccactaaccacactaatgccgtgttcgcagttatgcacgcccagcgtacttcaggatctagcgcccccaccttatacttgcctgtgctggcctgggtgtttgtcttgccgcttctgtag

SEQ ID NO: 43156 - DNA, 378 bp, Artificial Sequence
  Description of Artificial Sequence: Synthetic coding sequence
atgaaggccctgatgctgctgaccctgagcgtgctgctgtgctgggtgtctgccgatattaggtgtcatagctgctacaaagtcccggttttaggttgcgtagatcgccagtcgtgcagacttgagcctggtcagcagtgtctaacaacacacgcgtatctaggcaaaatgtgggtgttctccaatttgaggtgtggcacacctgaagagccatgccaagaagcctttaatcagaccaatcggaagttgggtctcacctacaataccacatgttgcaacaaggataattgcaacagcgccggccccaggccaactccggcattgggccttgtatttcttacttcactggcgggcttaggcctgtggttactccattag

SEQ ID NO: 43157 - DNA, 378 bp, Artificial Sequence
  Description of Artificial Sequence: Synthetic coding sequence
atgaaggccctgatgctgctgaccctgagcgtgctgctgtgctgggtgtcagcggatattagatgccatagctgttacaaggtgcccgtgcttggatgtgttgacagacagtcgtgccggcttgagccgggccagcagtgccttacaactcacgcatacctgggcaagatgtgggtcttctccaacttaagatgcggtacacccgaagaaccttgtcaggaggccttcaatcaaacaaatcgtaagctcgggttgacctacaataccacctgttgtaacaaagataactgtaacagcgctgggcctagaccgacaccggctttggggctggtgttccttactagcttggccggtttgggactctggctgctgcactag

SEQ ID NO: 43158 - DNA, 378 bp, Artificial Sequence
  Description of Artificial Sequence: Synthetic coding sequence
atgaaggccctgatgctgctgaccctgagcgtgctgctgtgctgggtgagtgcagacatcagatgccactcctgctataaggtgccagtcttgggatgcgtagacagacaatcctgccgccttgaaccaggccagcaatgtcttacaacccacgcgtaccttggcaaaatgtgggtcttctcaaatttgaggtgcgggacaccggaggaaccctgccaggaggcattcaatcagactaatcgcaagttgggattgacgtacaatacgacctgttgtaacaaagacaactgtaattccgctggcccccgacccacccccgcactcggacttgtattcctgaccagtctggccggtttgggtctctggctgctgcattag

SEQ ID NO: 43159 - DNA, 378 bp, Artificial Sequence
  Description of Artificial Sequence: Synthetic coding sequence
atgaaggccctgatgctgctgaccctgagcgtgctgctgtgctgggtctccgctgacatccgttgccattcgtgttacaaggtgcccgtgttgggctgcgtggacaggcagagctgccgtctcgaacctggacagcagtgcctgacaacccacgcatatttagggaagatgtgggtattcagtaatctaaggtgcggcacccctgaagaaccctgccaggaggcctttaaccaaactaataggaagctggggctcacttacaatacaacgtgctgcaacaaagacaattgtaatagcgctggacctagacctactcctgctctcggacttgtctttctcacctccctggcggggctagggctgtggctactccattag

SEQ ID NO: 43160 - DNA, 378 bp, Artificial Sequence
  Description of Artificial Sequence: Synthetic coding sequence
atgaaggccctgatgctgctgaccctgagcgtgctgctgtgctgggttagtgctgacatccgctgtcacagttgctataaagtgccggttctgggatgcgtggaccggcagtcatgcaggctggagccaggccagcaatgtctgacaacacacgcatacctaggtaagatgtgggtattttccaacctgaggtgtggaacacccgaggagccttgtcaagaagccttcaaccagacgaatcggaagctgggtcttacctacaacaccacctgttgtaacaaggacaactgcaatagtgcaggtccgcggcccacacctgcactgggattggtgttcctgactagccttgcaggattagggctctggttgctgcactag

SEQ ID NO: 43161 - DNA, 378 bp, Artificial Sequence
  Description of Artificial Sequence: Synthetic coding sequence
atgaaggccctgatgctgctgaccctgagcgtgctgctgtgctgggtgtcggctgacattcgttgccattcatgctataaggtgcctgtcctcgggtgtgtggataggcagtcctgtcggctggagcctgggcagcagtgcctcacaacccatgcttacttaggcaaaatgtgggtgttttccaatctgaggtgcggcacccctgaagaaccctgtcaggaggcttttaaccagacgaataggaagttagggctcacgtacaatacaacatgctgtaataaggataactgtaactccgccgggcccaggcctacacctgccctgggtttggtcttcttgacctcactggccggcttgggactttggctgctccattag

SEQ ID NO: 43162 - DNA, 378 bp, Artificial Sequence
  Description of Artificial Sequence: Synthetic coding sequence
atgaaggccctgatgctgctgaccctgagcgtgctgctgtgctgggtgtcggctgacatcagatgtcattcctgttataaagtgcctgtactaggttgtgtcgataggcagagctgccgcctggagccgggacagcaatgtttgaccacacacgcatacctgggcaagatgtgggtcttctcaaacctgaggtgtgggacaccggaagagccgtgccaggaagccttcaatcaaaccaataggaagctcggactgacttacaacacgacatgttgtaataaagataattgcaattctgccggccccaggcccacacctgccctcggccttgtgttcctgacctccctcgccggccttgggctgtggctgctacattag

SEQ ID NO: 43163 - DNA, 210 bp, Artificial Sequence
  Description of Artificial Sequence: Synthetic coding sequence
atgtgggtgttcagcaacctgcggtgcggcacccccgaggagccctgccaggaagccttcaaccagaccaaccggaagctgggactcacatacaacacaacctgttgtaacaaggacaactgcaacagtgctgggccacggcccacacctgccctagggctggttttcttgacaagcctggcaggcctgggcctctggctgctgcactag

SEQ ID NO: 43164 - DNA, 210 bp, Artificial Sequence
  Description of Artificial Sequence: Synthetic coding sequence
atgtgggtgttcagcaacctgcggtgcggcacccccgaggagccctgccaggaagcctttaaccagaccaacagaaaactgggtcttacatataacaccacctgctgcaacaaggacaattgcaactctgccggaccaaggccaactcccgcactaggtctggtattcttaacttcgcttgcaggtcttggattgtggctgttgcactag

SEQ ID NO: 43165 - DNA, 894 bp, Artificial Sequence
  Description of Artificial Sequence: Synthetic coding sequence
atggccgtgctgttcctgctgctgttcctgtgcggcaccccccaggccgccgacaatatgcaggccatatatgtggccctgggcgaagccgtggaacttccctgtccctcccccccaacgctgcacggcgatgaacatctctcgtggttttgcagtccagccgcaggttcattcaccactctggttgcccaggtgcaggtgggccgccccgcgcccgacccagggaaaccagggcgcgaatcccgtctgaggctgctgggaaattatagtctgtggctggagggcagcaaggaagaggacgctggtaggtactggtgcgccgtcctgggacaacatcacaattaccagaactggagggtgtatgatgtgttagtcctgaaaggctcccagctctctgcgcgggcagcagatggatcaccatgtaacgtgctgttatgctctgtggtgcccagtcggcgcatggactcagttacatggcaggagggtaagggccctgtgcgcggtagagtgcagagcttctggggttctgaggccgccctgctgctcgtctgcccaggggagggtttgagcgagccaagatcccggaggccacggattattaggtgtctgatgacccataacaagggggtgtcattcagcctggccgctagtatcgacgcctcacccgcactctgtgcacctagtacaggctgggatatgccgtggattctgatgctgctgctcacaatggggcaaggagtggtcatacttgctctcagtatcgtgctctggcgccagagggtgaggggagcaccaggcagagacgcatccattcctcagttcaaacccgagatacaggtgtatgaaaatattcaccttgcacgtctgggccccccggctcacaaacccaggtag

SEQ ID NO: 43166 - DNA, 894 bp, Artificial Sequence
  Description of Artificial Sequence: Synthetic coding sequence
atggccgtgctgttcctgctgctgttcctgtgcggcaccccccaggccgctgataatatgcaggccatttacgttgccctcggagaagcagtcgaactgccctgtcccagcccacctacacttcacggggatgagcatttgtcgtggttttgttctcccgctgctgggtctttcacaaccctggtggcgcaggtgcaagttggccgccccgcccccgacccagggaaacccggccgggagagccgtttgcgcctacttggcaattatagcctttggttagaagggtctaaagaagaggatgcgggaaggtactggtgcgccgtgctgggacagcaccacaactaccagaattggcgcgtgtacgacgtgctcgtgctcaagggcagccagctgtcagctcgcgccgcagacggatcaccatgtaatgtgttgctgtgctccgtggtgccaagccgccgtatggattcagtgacctggcaggaaggcaaaggccctgtgcgcgggagggtgcagagcttctggggctcggaagccgctttgctactggtgtgccctggcgagggattgtcagagccgcgctcccggcgtccacggatcatccggtgcttaatgacgcacaataagggtgtatctttcagcttagccgcctccatcgatgctagtccagccctctgcgctccttctaccggttgggacatgccatggatccttatgctcctcctcacaatggggcagggagtcgtgattttggcgctctcaatagttctgtggcgacagcgagtacgcggggcccccggcagggacgcctccattccccagtttaagcctgagatccaagtatacgaaaatatccacctagctagactgggacctccagctcataagccgcgatag

SEQ ID NO: 43167 - DNA, 894 bp, Artificial Sequence
  Description of Artificial Sequence: Synthetic coding sequence
atggccgtgctgttcctgctgctgttcctgtgcggcaccccccaggctgcagacaacatgcaggccatctatgtggcccttggggaggccgtggagctgccatgtccatctccacctaccctccatggcgacgagcatctgagttggttctgttctcctgccgccggcagtttcactactctagtcgctcaggtgcaagtaggtaggccggccccagaccccggcaaacctggtcgcgaaagccgtctaagattactgggcaactactccctttggttagagggttcgaaggaggaggatgccggcaggtactggtgcgcagtcttgggacagcatcacaattaccagaattggagagtgtacgatgtgttggtcctgaagggctcacagctctcagccagagctgccgatggttctccatgtaatgtattgttatgctcagttgtgcctagccgcaggatggatagtgtcacctggcaggaagggaagggccctgttcgaggcagagtgcagagcttttggggaagcgaggcagccttgctcttggtttgcccaggcgagggcctcagcgaaccaagaagcagacgacctcgtattattcgatgtctgatgacgcacaacaagggggtctctttctcactagcagcctctatagacgcgagcccggcattatgcgccccttctactggctgggatatgccctggatcctgatgctgctgctgacaatggggcagggggttgtcattcttgctttgtcgattgtgttatggcggcagcgggtgcgcggtgccccaggccgtgacgcatcaattccccagtttaagcccgagattcaggtctacgagaacatccaccttgctcggctaggccccccagcacacaagccacgctag

SEQ ID NO: 43168 - DNA, 894 bp, Artificial Sequence
  Description of Artificial Sequence: Synthetic coding sequence
atggccgtgctgttcctgctgctgttcctgtgcggcaccccccaggccgctgacaatatgcaggccatttatgtcgctcttggagaagctgtggaacttccctgcccttcacctccaactctgcatggggatgaacacttgtcttggttctgctccccggccgccggcagttttaccacgctcgtggctcaggtccaggtaggccggccagcccctgatccagggaaacccggtagagagagccgcctccgcctcttggggaactactccctgtggctggaagggtccaaggaggaggacgccggacgctactggtgtgcagtgctcgggcaacatcacaactaccagaattggagagtgtacgacgtcctcgtattaaagggatcacaacttagtgctcgcgccgcagatggttcgccgtgtaacgtgttgctttgttcagtagtgcccagccggagaatggattccgtaacttggcaagaaggcaaaggacctgtacgcggccgtgttcagtctttttggggatctgaagccgcgctgctgcttgtgtgcccaggagagggcttgagcgagccacgatctcgccgtccacggatcatccgatgcctgatgacgcacaacaagggcgtatcattctccctggctgcaagtattgacgcctctcccgcattgtgtgcaccatcaactggctgggacatgccctggatcctcatgttactgctgactatgggacaaggagtagtgatcctggccctgagcatcgtgctgtggcgccaaagggtgaggggcgccccgggcagggacgctagtattccacaattcaagcctgaaattcaggtgtatgagaacatccacctcgccaggttggggcctcccgctcacaaaccacgatag

SEQ ID NO: 43169 - DNA, 894 bp, Artificial Sequence
  Description of Artificial Sequence: Synthetic coding sequence
atggccgtgctgttcctgctgctgttcctgtgcggcaccccccaggctgccgacaatatgcaggctatttacgtcgcacttggcgaggctgtcgagctaccatgtccttcaccacctaccctccacggcgacgagcacctttcttggttttgctctcccgcggcaggaagcttcacaaccttagtagcccaggtccaagttggacgccccgccccagacccagggaaacccgggcgcgagagtaggctccggctgttgggcaattacagcctatggctcgagggaagtaaggaggaggatgcaggtaggtactggtgcgctgtgttggggcagcaccacaactatcaaaactggcgggtgtacgatgttctggtcttaaaagggtctcagctgtcagcccgtgccgctgatggatcaccatgcaatgtccttctctgcagtgtagtacctagcagacgcatggactccgtgacatggcaagaaggaaagggtcccgtacgtggtcgtgtgcaaagcttttggggatcagaagctgccctccttctggtgtgcccaggcgagggcctgagtgagcccagaagtagacgcccccgcatcatacggtgcttaatgacacataataaaggcgttagcttcagcctcgctgcctccatagatgcatcacctgccctgtgtgcccctagcaccgggtgggacatgccctggatcttgatgctccttttgacaatggggcagggagtcgtaatcctagcactcagcatagtcttatggaggcaacgggtccgcggcgcgccggggagggatgcctcaatcccccagtttaaacccgagatccaggtttacgagaatatccacttagcacggttgggacctccagctcacaaaccacgatag

SEQ ID NO: 43170 - DNA, 1149 bp, Artificial Sequence
  Description of Artificial Sequence: Synthetic coding sequence
atggccgtgctgttcctgctgctgttcctgtgcggcaccccccaggccgcggacaacatgcaggcaatctatgtggcccttggggaggccgtggagctgccgtgtccttccccccctaccctgcatggcgacgagcacctcagttggttttgcagtcccgctgccggatcttttactactttagtggcccaggtgcaggtgggccgcccagcccccgaccctggcaaacctggccgcgagtctagactgcgtttgttgggtaactactcactctggttggaagggtcaaaagaagaggacgccgggcggtactggtgcgcggttttgggtcagcatcataactatcagaattggagggtgtacgatgttctggtgttgaagggctctcagctaagcgctagagcagcggacggctctccctgcaacgtcctactctgctccgtcgttccaagcagacgtatggattccgttacctggcaggagggaaaaggacccgtcagaggtcgcgtgcagagtttttggggatctgaggccgcgctgctcctggtgtgcccgggtgagggcctctctgagccacgctcacggaggccaaggatcattcgctgcttgatgacacacaataagggagtgagtttttcacttgccgcctcgatagatgctagccccgcactgtgcgccccatcgaccggctgggacatgccatggatacttatgctcctgctgactatgggccaaggagtagtcatattagccctttcaatcgtcttgtggcgtcagagggttcgcggggctcctgggcgaggaaataggatgcgctgttacaattgtgggggcagtccaagctcctcctgtaaggaggctgtcactacctgtggcgagggacggccacaaccaggccttgagcagattaagctgcccggaaacccaccagttactctcatccatcaacaccctgcttgcgtggccgctcaccactgcaatcaggtggagaccgagtccgtgggggatgtgacataccccgcacatcgtgactgttatcttggcgacctgtgtaacagtgctgtcgcttcccatgttgcgcccgccggcatactggcagccgcagccaccgccctgacttgtcttcttcctgggctctggtcgggctag

SEQ ID NO: 43171 - DNA, 1149 bp, Artificial Sequence
  Description of Artificial Sequence: Synthetic coding sequence
atggccgtgctgttcctgctgctgttcctgtgcggcaccccccaggcggcagacaacatgcaggctatctacgtggcactcggagaggcggttgagttaccctgtccatctccaccaactctgcacggcgacgaacacctgagctggttttgtagccctgccgcaggcagttttactaccctcgtcgcccaggtgcaggtaggacgccccgcacccgacccaggaaagcccggcagagagagccggctccggttgctaggcaattattccctttggttggagggcagcaaagaggaagatgcgggccggtactggtgtgcagttctgggccaacatcataactaccagaactggcgagtttatgatgtgctggtgctcaagggtagccagctttcggctagagcagctgatggctccccttgcaatgtcctcctgtgctctgtcgttccatcacggagaatggattccgtgacttggcaggaaggcaagggacctgttagaggcagggtccagtcattttggggaagtgaagctgcgctcctgctcgtctgtcctggggagggcttgtctgagccgcgctctcggagacccagaattataaggtgtctaatgacccacaataagggcgtgagttttagccttgcagccagcattgatgcctctccagccctctgcgctccttctacaggctgggacatgccatggatattgatgctgctactgaccatgggccagggcgtggtgattctagccctgagcattgttctgtggcgccaacgagtgagaggagctcctggacgagggaacagaatgaggtgttacaactgcgggggatctccatcttccagctgcaaggaggcggtgaccacctgtggagaaggacgccctcagcccggactggaacagattaagctcccaggcaatcccccagtgacgctgatccatcaacacccggcatgtgtggccgctcaccactgcaaccaggttgaaacagaaagtgtgggggacgtgacataccctgcacatagggactgttatttgggtgatttgtgcaattccgctgtcgccagccacgtggccccagctggaatcctggcagcggctgccaccgctcttacatgtttgctcccgggtctatggagcggttag

SEQ ID NO: 43172 - DNA, 1149 bp, Artificial Sequence
  Description of Artificial Sequence: Synthetic coding sequence
atggccgtgctgttcctgctgctgttcctgtgcggcaccccccaggcggccgacaacatgcaggctatctacgttgcccttggcgaagccgtggaattgccctgtccctctcctcctactttgcatggagatgaacatctctcctggttttgttcccctgcagcaggctctttcacaactttggttgcccaagtgcaggtgggacgaccagctcctgacccaggtaaaccgggccgtgaatcccgccttcggctcctcgggaactatagcctgtggctggaagggagcaaggaggaggacgctggaaggtattggtgtgctgtgctgggccagcaccacaattatcagaattggagagtctacgacgtgctcgtgctgaaggggtctcagttatccgctcgtgccgctgatggaagtccttgcaacgtactcctgtgctccgtcgtcccaagtagaaggatggatagcgtgacctggcaggaaggcaagggacctgtccggggcagggtacagtcgttttggggctccgaagccgctcttttgcttgtgtgtcctggagagggtctgagtgaaccccgttcgaggagaccacgtattatcagatgcctgatgacgcacaataaaggggtctcttttagtctggccgcatcaatcgacgcaagccctgccctgtgtgcaccttccaccggctgggacatgccttggatcctaatgcttttactgacgatgggccagggcgttgttatcctggcattgagcatcgtgttgtggcggcagcgcgtgagaggtgcccctggcagaggcaaccgcatgaggtgttataactgcggggggagcccatcttcatcttgcaaggaggccgttaccacctgcggggaggggagaccacaaccgggtttggagcagatcaaactgcctggcaacccccctgtaaccctcattcatcagcaccccgcttgcgtagcagcacatcactgtaaccaagtggaaactgagagtgtgggcgatgtgacctacccagcacaccgtgactgctacctgggtgatttgtgtaattcagcggtggcaagccatgttgcgccggcaggcattctggcagctgcagccactgccctcacctgtctgcttccaggcctgtggtccggatag

SEQ ID NO: 43173 - DNA, 5169 bp, Artificial Sequence
  Description of Artificial Sequence: Synthetic coding sequence
atgcggaccggctgggccaccccccggcggcccgccggcctgctgatgcttttgttttggttcttcgacctggccgagcccagtggccgggctgctaacgacccttttaccatagtccacggcaatacaggcaagtgcatcaaacctgtatatgggtggatcgtcgccgacgattgtgatgagaccgaggataagctctggaagtgggtctctcaacacagactcttccacctccactctcagaagtgtctcgggcttgatattactaaaagcgtcaacgaattacgtatgttttcttgcgattcatcggctatgctttggtggaaatgcgaacaccactctctttacggtgcagccaggtacaggctggctctgaaggacgggcacggtaccgccatcagcaacgcgagtgacgtgtggaagaaagggggtagcgaagaaagcctttgtgatcaaccataccacgagatttacacgcgggacggcaatagctatggccgtccctgcgaattcccttttctgatagatggaacatggcaccacgactgcatcctggacgaagatcatagcggcccatggtgcgccaccaccctgaattatgagtacgacagaaaatgggggatttgcctgaagcctgaaaacgggtgcgaggacaattgggaaaaaaacgaacagttcggtagctgttaccagttcaacacgcagaccgccctcagctggaaggaggcttacgtttcttgtcaaaaccagggagccgatctcttgagcatcaattccgctgcagagctgacatatcttaaggagaaagagggtatagcaaaaatattttggattgggcttaatcagctttacagtgcccgcggctgggaatggtccgatcataagccgctgaattttctgaattgggaccctgataggccatctgccccaaccattggaggaagttcatgtgcaaggatggacgctgagtccggactctggcagtctttctcgtgtgaggcccagcttccatatgtgtgtagaaagcctctaaacaatacggtcgagctgacagatgtgtggacctatagcgatactagatgcgatgctgggtggctccctaataatggattctgctatctactcgtaaatgaaagcaactcgtgggacaaagcgcacgcgaagtgtaaggctttctcctccgacctgattagcattcattctctggccgacgtggaggtcgtggtgaccaaactacacaacgaagacatcaaggaagaggtgtggataggcctcaagaacattaacatacccactttgtttcaatggtccgacggcacagaagtgactttgacatactgggatgagaacgagcccaacgtcccttacaacaagactccaaactgtgtcagctatctcggtgaacttggccaatggaaagtgcagtcatgcgaggagaagttgaaatatgtttgcaagaggaagggggagaaactgaacgatgcctcctctgataaaatgtgtccccccgacgagggctggaaacgccatggagagacatgttataaaatctatgaggacgaagtccctttcggaactaattgtaatcttactatcacttccagattcgagcaggagtatctcaacgacctgatgaagaaatatgacaaaagtctgcgcaagtatttttggacgggcctgagagacgtggactcttgcggggaatacaattgggcaaccgtgggcggacggagaagggctgtgacgttttccaactggaattttctggaacctgcatctcccgggggttgcgtagctatgtctactggaaagagtgttggaaaatgggaggtcaaggactgccgctctttcaaagcactgagcatctgtaaaaagatgagcggtccgctgggtcccgaggaggcctctcctaaacctgatgacccctgccctgaagggtggcagtcatttcccgctagtctgagttgttataaggtgtttcatgcagaacgcatcgtgcgaaaacggaattgggaggaagctgagagattttgtcaggccttgggggcgcacctaagctccttcagccacgttgatgagattaaagaattcttacatttcctgactgatcagttcagtgggcagcattggctctggatcggattgaataagcgctcccccgacttacagggcagttggcagtggagcgataggacaccagtatcaacaatcatcatgcctaacgagtttcagcaagattacgatatccgcgactgtgccgccgtgaaagtatttcacagaccttggcgaagagggtggcacttctatgacgatcgagagttcatttatttgcgcccatttgcctgtgacacaaaacttgaatgggtatgccagatccccaagggaagaactcccaaaacacctgactggtataatcctgatcgggccgggattcatggtcctcccctgatcatagaaggctcagagtattggttcgttgccgacttgcatctgaattatgaagaagctgtactgtactgtgcctctaaccatagctttttggctaccatcaccagctttgtgggccttaaagccatcaagaacaagatagccaacatctcgggcgacggccaaaaatggtggattcggataagtgagtggccaatagatgaccatttcacctactcccgatacccttggcaccgcttccctgtcaccttcggggaggagtgtctctacatgagtgctaaaacgtggctcatcgaccttggaaaaccaacagattgctctaccaagcttccattcatatgcgaaaaatacaacgtgagcagccttgagaagtatagtccagattctgccgccaaggtgcaatgcagcgaacaatggattccattccaaaataaatgctttttaaagattaagcccgtgtccctcacattctcacaggccagcgacacatgccattcttacggcggaacccttccctcggtcctgagccagatcgaacaagattttatcacaagcttgctgcccgatatggaagccaccctctggattggattacgttggaccgcatacgaaaaaattaataagtggacagataaccgagagctgacatactcaaatttccacccacttttggtgtcaggccgtctgcgaatacccgaaaacttcttcgaagaggagtctaggtatcactgtgccctcatactgaacttgcagaaatcaccgtttacgggtacctggaattttacttcctgttccgagagacacttcgttagcttgtgccaaaagtactctgaagtcaagagcagacagactctgcagaacgccagcgaaactgtcaagtacctcaacaacctttacaaaatcattcccaaaacccttacctggcacagcgccaagcgggaatgcctgaaaagcaacatgcagctggtctccatcacggatccctaccagcaggcattcctttccgtacaggctctgcttcacaacagcagcctgtggatcgggctgtttagccaggacgacgaactgaactttggctggagcgatggcaagcgactgcacttctctaggtgggccgaaaccaacgggcagctcgaagattgcgttgtcctggatactgatggattctggaaaacagtcgactgcaatgacaaccagccaggagcaatttgttattattcagggaacgagactgaaaaggaagtgaaacctgtggattctgtgaaatgtccttcccctgtcctgaatactccgtggatcccgtttcagaactgttgttacaactttataattacgaaaaatcgccatatggccaccacccaggacgaagtgcacaccaaatgtcagaaactgaaccccaagagccatatcctctctatccgtgacgaaaaggaaaacaattttgtgctcgagcagctactatacttcaactatatggccagttgggttatgcttggcattacttacaggaataagtccttaatgtggtttgataaaacccccttgagctatactcactggagggcgggccgtccaaccatcaagaacgagaaattccttgccggactgtccaccgacggattctgggatatccagactttcaaagtgatagaggaggctgtgtattttcaccagcacagcattcttgcctgcaagatcgaaatggttgattataaagaggaatacaacaccacattacctcagtttatgccctacgaagacggcatttattccgtgatacagaagaaggtgacgtggtacgaggctctgaatatgtgcagtcagtcaggcggccacctcgccagcgtgcacaaccagaacgggcagctgttcctggaagacatcgtcaaacgcgacggctttcccttgtgggtagggctatcatcccacgacggctcggagtcctctttcgagtggtcagacggaagcaccttcgactacattccatggaaaggccaaacctctcccggcaattgcgtgctcctggatccgaaaggaacttggaagcatgagaagtgtaactctgtgaaagatggcgcaatatgctataagccaacaaagagcaagaagctgtctcggttgacctactctagtagatgtcccgcggccaaagagaacggaagccggtggatacaatacaaagggcactgctataaatcagaccaagcactccactccttcagtgaagccaaaaaactgtgcagcaaacatgatcattctgcgacgattgtttctattaaagacgaggacgagaataagttcgtctcgcggctaatgcgggaaaataataatatcacaatgcgcgtctggctgggcctgtcacagcattccgtagaccagagctggagctggctggacggatccgaggtcacttttgtgaagtgggaaaataaatcaaaatccggagttggtcggtgtagcatgctgatagcttctaatgaaacatggaaaaaggttgagtgcgaacacggttttggaagggtagtatgtaaggtgcctctcggtcccgactacactgccatcgccattatcgttgcaactctctcaattttggtgctgatgggcggcctgatctggtttctttttcagcgccacagactgcacttggctgggttcagcagtgtgaggtacgctcagggggtcaacgaggacgaaattatgctcccatcattccacgactag

SEQ ID NO: 43174 - DNA, 5454 bp, Artificial Sequence
  Description of Artificial Sequence: Synthetic coding sequence
atgcggaccggctgggccaccccccggcggcccgccggcctgctgatgctgctgttttggttctttgatcttgccgagccttccggccgcgcagccaacgacccatttactatagtgcacggaaataccggtaaatgtataaagccagtttacggttggatcgtggccgacgactgcgatgaaacagaggacaaattatggaagtgggtttctcagcatagactgttccacctgcactcccaaaaatgcctgggcctcgatatcactaagtctgtgaatgaactgcgaatgttcagctgcgactcaagtgcgatgctctggtggaaatgtgagcaccatagtttgtacggcgcagctaggtaccgactcgcccttaaggatgggcacgggactgcgatctcaaacgcaagtgacgtgtggaagaagggggggtccgaagagtctctctgcgaccagccctaccatgagatctacacccgtgatggcaacagttacgggcggccctgtgagttcccattcctgatcgatggcacatggcaccacgactgtattttggacgaagaccactccggcccctggtgcgctactacgctaaattacgagtacgatagaaaatggggtatctgcctgaagccagaaaatgggtgcgaagataactgggagaaaaacgaacagttcgggagctgctaccagtttaatacacagaccgcgttatcgtggaaggaggcttatgtcagttgtcaaaatcagggtgctgacttgctgtccatcaattctgccgccgaactgacctatttgaaggaaaaggagggaatagctaagatcttctggataggtctcaaccagctctattctgccaggggatgggagtggtctgaccacaagcccttaaattttctgaactgggaccccgaccgacctagcgcgccaactataggtggcagcagttgtgccaggatggacgctgaaagcgggctctggcaatcattcagttgcgaagcacagctgccgtacgtgtgtagaaagcccctcaataacaccgtcgaactcactgatgtgtggacgtactcagacactcgctgcgatgccggctggctacccaacaatggattttgctacctgcttgtgaacgaatctaacagctgggacaaagctcacgctaaatgcaaggcattttcctcagacctgatcagcatacactcccttgcggatgtggaggtggtggttactaaattgcacaatgaggacattaaggaggaggtttggatcggccttaagaacataaatatccccacgctgtttcagtggagtgatggtaccgaggtcacgctgacatactgggatgagaatgaacccaatgtcccttacaacaaaacccccaattgcgtctcgtacctcggtgaattgggccagtggaaagttcagtcttgcgaggagaagctcaagtacgtgtgtaagcgcaagggggaaaagctcaacgatgcctcctccgacaagatgtgccctccagatgagggctggaagagacatggcgagacttgctacaagatttatgaggacgaggtgcccttcggcactaactgtaaccttacaattacctcaagattcgagcaagaatacttgaacgaccttatgaaaaagtatgataagtccctccgcaaatacttttggacaggccttcgtgatgtcgactcttgcggggagtacaactgggcaactgtaggtgggaggcggcgtgctgtgacattttctaattggaattttctggaacccgctagtcctgggggctgtgtcgccatgagcacgggtaaaagcgtagggaaatgggaagtgaaggattgccggagctttaaggctctttccatctgcaaaaagatgtccggaccattaggcccagaggaggcaagtccaaagccggatgacccttgccctgagggatggcagagtttccctgcaagtctttcctgttacaaagtgttccacgccgaaaggattgtacggaagaggaattgggaagaggccgaacgcttctgccaagctttaggagcccatctcagcagtttttcccacgtagacgaaattaaggagttcctgcattttttgacggaccagtttagtggacagcactggctctggattggattgaataaaagaagccctgatctgcagggcagctggcagtggagcgaccgcactcctgtcagcacgatcatcatgcctaacgagttccagcaggactatgacatccgagactgtgccgcggtgaaagtgtttcaccgaccatggaggaggggatggcacttctacgacgaccgcgaattcatttatctcagacctttcgcctgtgacactaaacttgagtgggtctgtcagatcccaaagggaaggactccaaagaccccagattggtacaatcctgatagggcgggcatccatggtccacccttgatcattgaaggtagcgagtactggttcgtggcagatctccacctgaattacgaggaagctgtcctttactgtgctagcaaccacagtttcctcgccaccatcaccagttttgtcggcctaaaggctatcaagaataaaatcgctaacatctccggggatgggcagaaatggtggattcgcatctctgagtggccgatcgacgaccactttacatactctcggtacccctggcaccggttccctgttacatttggagaggagtgtctctatatgtctgccaaaacctggcttatcgatctcggtaagcccacagattgctcgactaaacttccattcatatgtgagaaatataacgtgtcatcccttgaaaaatattcccctgactctgccgctaaggtgcagtgtagcgagcagtggatacccttccagaacaagtgctttttaaaaataaagcctgtcagcctgactttttcccaagcgtcagatacatgccacagttacggcggcaccctgcccagcgtcctgtcacagattgagcaggatttcatcacgagtctgctcccggatatggaggcaacactatggatcgggttgcgctggacagcctatgagaagatcaataagtggaccgacaatagagagctcacttattctaacttccacccattgctggtttcaggtcggctgcgcatacccgagaactttttcgaggaggaaagcaggtaccactgcgcactgatactgaacctgcagaagagccccttcacaggaacgtggaactttacttcatgctccgaaaggcacttcgtctcattgtgtcagaagtactccgaagttaaatcgcggcaaactctgcagaacgctagcgaaaccgtgaagtacttgaataacttgtacaaaatcattcctaagacccttacctggcattcagcaaaacgcgagtgtctgaaatccaatatgcagctcgtgagtattaccgacccctatcagcaggccttcctgagcgtgcaggccctccttcacaacagctcgctgtggattgggctcttttctcaggatgacgagctgaacttcggttggtccgacggcaagagattacacttcagtagatgggccgagacaaatggccagctggaagattgcgtagtcctggatacagacggtttttggaagaccgtggactgcaatgataatcagccaggcgccatctgctactactccggaaatgagaccgaaaaggaggttaaacctgtcgatagcgtcaagtgcccaagccccgtgctgaataccccttggatacccttccaaaactgttgttataattttatcatcacaaagaacaggcacatggcaaccacacaggacgaagtacataccaaatgtcaaaaacttaaccccaaaagccatatactctccatccgggacgaaaaagaaaacaattttgtgctggaacagctgctttattttaattacatggccagttgggtgatgcttgggattacatacaggaacaagagcctcatgtggtttgataagacccctctgagctatacacactggagggccggacggcccactattaaaaacgagaagttcctggctggactctcaactgacggattctgggatatccagacttttaaggttatcgaggaggccgtctacttccaccagcatagtatcctggcctgtaagattgagatggtagattataaagaagagtacaacactactctgccgcagtttatgccttatgaggacggcatctattcagtcatccaaaagaaagtcacttggtacgaagccctgaatatgtgctcgcagagtggaggccatctcgcatcagtgcataatcagaatggccagctgtttctcgaggacatagtcaagcgcgacggatttcctctctgggtaggattgtctagtcatgatggctccgagtctagctttgagtggtccgacggctcaaccttcgactatatcccctggaagggtcagacatcacccggaaattgcgttctgctggatccgaagggaacctggaagcatgaaaagtgtaactccgtgaaggatggggccatttgttacaagcctactaaatctaagaagctgtccaggttgacatacagcagtcggtgccccgcagctaaagaaaatggatcaaggtggatacagtataaggggcattgttataagagtgatcaggctctgcacagcttcagcgaggctaagaagctgtgcagtaaacacgatcatagcgccactattgtatccattaaagatgaggacgagaataagtttgtcagtaggttaatgcgggagaacaataatatcaccatgcgggtatggctgggactgagccagcactccgtggattgtccctcttctacctggatccaattccaagactcctgctatatatttctccaggaagcgataaaagtggaatctatcgaggacgttaggaatcagtgtacagaccacggtgccgacatgatatccattcacaacgaggaagagaacgcctttatactggacaccctgaagaagcagtggaaaggcccagatgacattcttctcggaatgttttacgatacagacgacgcaagcttcaagtggtttgataacagcaacatgacctttgacaagtggacagaccaggatgacgatgaggatttagtggatacatgtgccttcttgcacatcaagactggggagtggaaaaaagggaactgtgaagtttcatccgttgaggggaccctgtgcaagacagccataccctataagcggaagtatctgtctgacaaccatatcttgatttctgctctggtgattgccagcacggtaattctgacagtgttgggtgcgatcatatggttcttatataagaagcattcagattcacggtttaccactgtcttttctaccgccccccagagcccctacaacgaagactgcgtgctcgtcgtgggcgaagagaatgaatatccagtgcagttcgattag

SEQ ID NO: 43175 - DNA, 5622 bp, Artificial Sequence
  Description of Artificial Sequence: Synthetic coding sequence
atgcggaccggctgggccaccccccggcggcccgccggcctgctgatgctgctgttttggtttttcgacctggccgagccttcagggagggcagctaacgaccccttcacgatcgtgcacggtaatacgggcaagtgtattaagcctgtttacggctggattgtggctgatgattgtgacgagaccgaggataaactgtggaagtgggtgtcacagcacaggctgttccacttacactctcagaagtgtctgggccttgacataacaaaatccgtaaacgagctccggatgttcagctgcgattcttcagctatgctgtggtggaagtgcgagcaccactccctttatggtgccgctcgatacagactggccttgaaggacgggcacggcactgcaattagtaatgcatccgatgtgtggaagaaggggggaagcgaggaatccctttgtgaccagccatatcatgagatttatacgcgagacggtaatagctatggccgaccttgtgagtttccctttctgattgacggcacctggcatcacgactgcatcttggatgaggatcatagtggcccttggtgcgctacaactttgaactacgagtatgatcgaaagtgggggatctgtctgaagccagaaaacgggtgcgaggacaactgggaaaagaatgaacagtttggatcctgttatcagttcaatacacagacagctctgtcttggaaggaagcctacgtgagctgtcaaaatcagggggccgaccttctgtccatcaactctgcggcagagttgacctacttgaaggaaaaagaaggcattgctaagatcttttggatcggactgaaccaattgtatagtgctcgaggctgggaatggtccgaccacaaacccctcaacttcctgaactgggatcctgatagaccctctgctcccacaatcggaggtagcagttgcgccaggatggatgcggagtcaggactttggcagagcttctcctgtgaggctcagttgccttacgtgtgcaggaaacccctgaacaacacagtggaattgaccgacgtgtggacgtacagtgatacccggtgtgatgcgggttggcttccaaacaacggcttctgctacttgttggttaacgagtctaattcctgggacaaggcccatgccaaatgcaaggcattcagttctgacttaataagcatacactctttggccgacgtggaagtggtggtcacgaaactccataacgaagacataaaggaggaggtgtggattgggttaaagaatatcaacatccccactctgtttcaatggtctgatggaaccgaagtcaccctcacctactgggatgagaatgaacctaatgtgccgtacaataagacccccaactgtgttagctatttaggagaactcgggcaatggaaggtgcagagctgtgaagagaagctcaagtacgtgtgcaaacgaaaaggcgaaaaactaaatgatgcttctagcgacaagatgtgccctcctgacgagggctggaaacgtcatggggagacgtgctataagatctacgaggacgaggttcctttcgggacaaactgtaacctcacaattacctccagatttgaacaagaatacctgaatgatctcatgaaaaagtacgataagtccctgaggaaatacttttggacaggactccgagacgttgactcctgtggggagtacaactgggctacagtcgggggtagacgcagggccgtgactttcagtaactggaattttctcgaacccgcctccccagggggctgtgttgcgatgtcgacaggcaaatccgtgggaaagtgggaggttaaggattgtcgatcatttaaggcactgtcgatctgcaaaaaaatgtccggccctcttggaccagaggaggctagtccgaagccggacgatccttgccccgaggggtggcagagcttccctgcatcactgagttgctataaagtctttcacgctgagcgcatcgtgcgcaagagaaactgggaagaggcggagcggttttgtcaagcactgggcgcccatttatcaagtttttcccatgtagatgaaatcaaagaattcttgcattttctaacagaccagtttagcgggcagcactggctctggattggacttaataaaaggtcccccgacttgcaagggtcctggcagtggagtgacagaacccctgtttctaccatcataatgccaaacgagttccaacaagattatgacattcgggactgcgccgcagtcaaggtattccatagaccctggagaaggggatggcacttttatgacgatagagagtttatttatctgaggccattcgcctgtgatacgaagctagaatgggtttgccaaatccccaaaggaaggacccccaagacccccgactggtacaaccccgacagagcaggaatccacggaccaccccttataatcgaagggtctgagtattggtttgttgccgatctgcacttaaattacgaggaagcagttttgtactgcgccagcaaccattcttttctcgctaccatcacatctttcgtaggcctgaaagccatcaaaaacaagatcgctaatatatccggagacgggcaaaaatggtggatcagaatttcagaatggccaatcgacgatcacttcacttatagcaggtacccatggcatcgctttcctgtgaccttcggcgaagagtgtctgtacatgtcagctaaaacctggctgatcgacttgggtaagcccactgattgctccacaaaactgccatttatttgtgagaaatataatgtcagttcgctcgaaaagtactctcctgattccgccgccaaggtccagtgttccgagcaatggatccccttccaaaacaagtgctttttgaaaattaagccggtcagccttacatttagtcaagcttctgacacatgtcattcctatggtggcactctgccctccgtcctgtcacagattgaacaagactttatcacttccttgctgcccgacatggaagccacactttggattggcctccggtggacagcttacgaaaaaatcaataaatggaccgacaatagggaactgacttattcaaattttcatcctctcctagtttctggcaggctgcgtatacctgaaaacttttttgaagaagagagtcgctatcactgtgctcttatactgaatctgcagaagagcccctttaccggaacatggaactttacttcatgcagcgagcgtcacttcgtgtccctatgtcagaaatactcagaggtcaaatccaggcaaacacttcagaacgccagcgagaccgtgaagtacctgaacaatctatacaagatcattccaaagacattgacttggcattccgccaagagagagtgcctgaaatctaatatgcagttagtctccatcaccgatccctaccaacaggcgttcctgtctgttcaggcgctgttacacaactcctctctttggatcggccttttctcacaggatgacgagctgaactttggctggagtgatggcaaacggctccactttagtcgctgggctgagacaaatggccaacttgaggactgtgtcgtactcgacaccgacggcttctggaagacagtggactgtaatgacaatcaacctggagccatatgttactacagtggtaatgagaccgagaaggaggtgaagccagtggacagtgtcaagtgcccgagcccagttctcaatacaccctggatcccatttcagaattgctgttataacttcatcatcaccaaaaacaggcatatggcgacaacccaggatgaagttcacaccaagtgccagaagctgaatcccaagagtcacatcctatcaattagagacgagaaggagaacaactttgtccttgagcagctgctgtactttaactatatggccagctgggtgatgctgggcataacataccgtaacaagtctctaatgtggtttgacaaaactccattgtcttacactcactggcgcgctggccgccctacaattaaaaacgagaaatttctggcgggcctatctactgacggtttttgggacatacagaccttcaaggtcatcgaggaagctgtgtacttccaccaacactcaatactcgcatgtaagatcgaaatggtagattacaaagaggagtacaacaccacattgcctcaattcatgccctatgaggacggcatttacagcgtcatccagaagaaagtgacgtggtacgaagccttgaacatgtgctctcaatctggtggacacttagccagcgtgcacaatcagaacggtcaactgttcctggaagacattgtgaagcgagatggatttcctttgtgggtcggtttgagctcacatgacgggagtgaatcatcctttgagtggtccgatggctcgacgttcgattacataccttggaagggacagacctcccctgggaattgcgttctgcttgacccaaaaggtacatggaaacacgagaaatgcaacagcgtgaaagatggtgcaatctgttacaaacctaccaaatcgaagaagctctctcgtttaacctactctagccgatgcccggctgctaaggagaacggtagcaggtggatccagtacaagggccattgttacaagtcagaccaggccctgcacagtttcagtgaggctaaaaaactctgtagcaaacacgatcatagcgcaactatagtgtctatcaaggacgaggacgagaacaagttcgtgtctcgcctgatgcgcgagaacaacaacattactatgagagtgtggctcggcctgagtcagcatagcgtcgatcagtcctggagctggctggacggctccgaagtaacatttgtgaaatgggagaataagagtaagtctggcgtgggtcgttgtagcatgctgatcgcgagcaatgagacctggaagaaagtcgagtgcgaacacgggtttggcagagtggtgtgtaaggtccctctcgactgtccttcctctacttggatccagtttcaggattcctgctacatcttcctccaggaagccatcaaagtggaatcaattgaagacgtgcggaaccaatgtacagaccacggagctgatatgatttccatacacaacgaagaagagaacgctttcatcttagatactctcaagaaacagtggaagggcccagatgatatcctgctaggaatgttttatgatacggatgatgcgtctttcaagtggtttgacaacagcaacatgacattcgataagtggaccgaccaggacgatgacgaagatcttgtggacacgtgtgcttttctgcatataaaaaccggggagtggaaaaaagggaattgtgaggtaagctctgtagaaggtaccttgtgcaaaaccgctattccgtacaaaagaaaatatctctcggacaatcacatcctcatctccgccttggtcattgcctcaacagtgatcttgaccgtgctgggtgctatcatctggtttctttataagaagcacagcgacagccggtttaccacagtgttctccacagcgccccagagtccctacaacgaggattgtgtcctggtcgtgggggaggaaaacgagtaccccgtgcagttcgattag

SEQ ID NO: 43176 - DNA, 1149 bp, Artificial Sequence
  Description of Artificial Sequence: Synthetic coding sequence
atgcggagccacttcctgcagtgggccctggccaccagccggaacaaggaccaaatcaccaatatatttagcggcttcgccggactgctggcgatcctcttggtcgttgcagtgttttgcatcctttggaattggaataaacgaaagaagaggcaggttccatatcttcgggttacagtgatgcctctgcttactctccctcagactcgccaacgcgccaaaaacatctacgacatcctcccatggcgacaggaggacttaggccgccacgaaagcagaagtatgaggatcttctccactgagtctcttctgagcagaaacagtgagagcccggagcatgttccctcccaggccggaaacgccttccaggagcacactgcacatatacatgcaacagagtatgctgtcggcatctatgacaatgccatggtgcctcagatgtgtggaaacctgaccccttccgcccactgtatcaatgtacgggcttccagagactgtgcgagcatttcatctgaggacagccacgactatgttaatgtccctaccgccgaagagatagccgagaccctcgccagcaccaaatcacctagcaggaacctgtttgtgcttccctccacacaaaaactggaattcactgaagaacgcgacgagggatgtggggacgctggtgattgcacatcactttactcaccaggcgccgaggatagtgatagcttgagcaatggtgaaggctcgagccagatctccaacgattacgtaaatatgacaggtctggatttgtctgcgatacaggagagacagctctgggtggcctttcagtgttgccgagattacgagaacgtgccagccgctgaccccagtggctcacaacagcaggcagaaaaagacgttccctccagcaatataggacacgtggaagacaagacagacgaccccggcacgcatgtccagtgcgtgaagcgcactttccttgcttctggagactacgcagactttcagccttttacccagtccgaggactctcaaatgaagcatcgcgaggaaatgtccaatgaggactcatcggactatgagaatgttcttaccgccaagctcggaggccgggatagcgagcagggacctggtacccagctgctgcctgacgaatag

SEQ ID NO: 43177 - DNA, 1197 bp, Artificial Sequence
  Description of Artificial Sequence: Synthetic coding sequence
atggacggcgtgacccccaccctgagcaccatccggggccggaccctagaatcttctacactgcacgtgaccccacggagtttggataggaataaagaccagattacgaacatattttctggcttcgccggcctgttggcgatcttgctcgtggtagctgttttttgtatcctctggaattggaataaacgaaaaaagcgacaagtgccatatctgagagtgaccgtaatgcccctgctgaccctcccccagacccggcagagggcaaagaatatttatgatattctcccctggaggcaggaggacttggggagacatgaatcgcgaagtatgagaattttcagtaccgagagtctgctgtcacgcaatagcgaaagccctgagcacgttccaagccaggccggcaatgctttccaagagcacacagcacatatacacgcaacagagtacgctgttggcatttacgacaacgccatggtcccgcaaatgtgcggaaacctcacacccagcgcacactgtattaacgtccgcgcatcaagggactgtgcgagcatttcttccgaggattctcacgactatgtcaatgtacccaccgcagaggagatagcagaaaccctggcgagcaccaagtctcccagtcgtaacctgtttgtgctgccctcaacacagaaactcgagttcacagaggaaagagatgaaggctgtggcgacgcaggtgattgtacttccctctacagtcctggggcagaggatagcgacagcctgagtaatggagagggaagtagtcagatctctaatgattatgttaatatgacgggactggatctcagcgctattcaggagcgtcagctgtgggtggcatttcagtgctgcagggactacgaaaacgtgcccgcagccgatccgtccggatcgcagcagcaagctgagaaggacgttccgagctctaacatcggccacgttgaagataaaactgacgatcctggcactcacgtgcaatgcgtgaaaagaacctttctggcatctggtgattatgccgacttccaaccctttactcagtccgaagactcacaaatgaaacacagagaggaaatgagcaatgaagacagctccgactatgaaaatgtcctgacagcgaaacttggggggagggactctgagcagggccccggcacccagctgctgccagacgagtag

SEQ ID NO: 43178 - DNA, 189 bp, Artificial Sequence
  Description of Artificial Sequence: Synthetic coding sequence
atggacccccgggagtgcgtgtgcatgagcggcggcatctgcatgtgcggcgataattgcaagtgcactacatgtaactgcaaaacctactggaaaagttgttgcccctgctgccctcccggctgtgccaagtgcgcacgtggctgcatctgtaagggtggcagcgataagtgttcctgttgtccttag

SEQ ID NO: 43179 - DNA, 369 bp, Artificial Sequence
  Description of Artificial Sequence: Synthetic coding sequence
atgaccaccgccacccggcaggaggtgctgggcctgtaccggagcatttttaggctggcccgtaagtggcaagccactagcgggcaaatggaagatactataaaggagaaacaatacattctgaatgaagcccgcaccctctttcgtaagaataagaacctgaccgataccgacctgattaaacagtgcattgatgagtgcacagcccgcatcgagattggactacactacaaaatcccatatccccggcccatccatctaccccccatgggccttacgccactccgcggaaggggcttgcgttcacaggagaaactgcgtaagctttccaaacccgtttacctccgctcccacgacgaggtgtcatag

SEQ ID NO: 43180 - DNA, 369 bp, Artificial Sequence
  Description of Artificial Sequence: Synthetic coding sequence
atgaccaccgccacccggcaggaggtgctgggcctgtaccggagcattttcaggctcgcccggaagtggcaagccacttctggccagatggaagataccatcaaggaaaagcagtatattcttaacgaggcgaggaccctgtttcgcaagaacaagaacctcaccgacaccgatcttattaaacaatgcattgacgaatgcacagctcggattgagataggacttcattacaagattccttaccctagaccaattcacttgccaccaatgggcctgacaccactgaggggacgaggcctccgctcgcaggaaaagcttcgcaagctcagtaaaccagtgtacctgagatctcacgatgaggtcagttag

SEQ ID NO: 43181 - DNA, 369 bp, Artificial Sequence
  Description of Artificial Sequence: Synthetic coding sequence
atgaccaccgccacccggcaggaggtgctgggcctgtaccggagcatattcagactcgccaggaagtggcaggctacttctgggcaaatggaagataccatcaaagagaagcaatacattctgaatgaggcccggacactgtttagaaagaataaaaatctgacagacactgaccttataaagcagtgtatcgatgaatgcactgcccgaattgagattgggctgcattataaaattccatatccgcgaccgattcacctgcctccgatggggctcacccctctgcgcggcagaggattgagatcgcaggagaagctgaggaagctcagcaagccggtgtatctccgatcccatgacgaggtttcatag

SEQ ID NO: 43182 - DNA, 267 bp, Artificial Sequence
  Description of Artificial Sequence: Synthetic coding sequence
atggccgccagccggctgccccccgccaccctgaccctgaagcagtttgtgagaagacaacaagttctccttttatacaggagaatattgcagactatccgacaggtccccaacgactctgataggaaatatttgaaagattgggcacgagaagagtttcggagaaacaagagcgccacggaggaagatacaatccgtatgatgatcacacagggaaacatgcagctgaaagaattggaaaaaactctagcgctagctaagtcctag

SEQ ID NO: 43183 - DNA, 273 bp, Artificial Sequence
  Description of Artificial Sequence: Synthetic coding sequence
atgaagatggccaacagcctgcggggcgaggtgctgaagctgtacaaaaacttactgtatctggggcgagactatcccaaaggggccgactattttaagaagagattgaaaaacatatttcttaaaaacaaagacgtaaaaaaccctgagaagatcaaagagctgatcgctcaaggagaatttgtgatgaaggagctggaagcgctgtactttttgaggaagtaccgggccatgaaacaaaggtattactcagacaccaacaagaccaactag

SEQ ID NO: 43184 - DNA, 105 bp, Artificial Sequence
  Description of Artificial Sequence: Synthetic coding sequence
atggccaacagcctgcggggcgaggtgctgaagctgtacaagaacctcctgtatctgggtagggattacccaaagggcgcggattactttaaaaagcgtctttag

SEQ ID NO: 43185 - DNA, 267 bp, Artificial Sequence
  Description of Artificial Sequence: Synthetic coding sequence
atggccaacagcctgcggggcgaggtgctgaagctgtacaagaacctgttatatctgggtagggattatcctaaaggcgctgattacttcaaaaaaagactgaagaacattttcctgaagaacaaagacgtgaagaatccggagaagattaaggaattgatagcccagggagaattcgtgatgaaagagttggaagccttatactttctaaggaagtaccgggctatgaaacagaggtattacagcgacaccaataagactaattag

SEQ ID NO: 43186 - DNA, 267 bp, Artificial Sequence
  Description of Artificial Sequence: Synthetic coding sequence
atggccaacagcctgcggggcgaggtgctgaagctgtacaagaacctcctctatttgggcagggattaccccaagggggctgactatttcaaaaaacgactgaagaatattttcctgaagaacaaagatgtaaagaacccagagaagatcaaggaactcatcgcccagggggagttcgtgatgaaagaacttgaggcactctactttttgcggaagtatagggcaatgaagcaaaggtattactctgataccaacaagactaactag

SEQ ID NO: 43187 - DNA, 267 bp, Artificial Sequence
  Description of Artificial Sequence: Synthetic coding sequence
atggccaacagcctgcggggcgaggtgctgaagctgtacaagaacctgctgtacctgggcagagactatcccaagggcgcagattacttcaagaagagattgaagaacatttttttgaaaaacaaggatgtaaagaacccggaaaaaataaaggagctgatcgcgcaaggggagttcgtcatgaaggagctggaagcactgtactttctgaggaaataccgcgcgatgaaacagcggtactattccgacacaaataagacgaactag

SEQ ID NO: 43188 - DNA, 267 bp, Artificial Sequence
  Description of Artificial Sequence: Synthetic coding sequence
atggccaacagcctgcggggcgaggtgctgaagctgtacaagaacctgctgtacctgggaagggattacccaaagggggcagattattttaaaaaacgactgaagaacattttcctgaaaaacaaagatgtgaagaatccagaaaaaatcaaggaacttatcgcccagggagaattcgtgatgaaagaactggaagcactctatttcctgaggaagtatcgagccatgaaacaaaggtattattctgatacaaacaaaactaactag

SEQ ID NO: 43189 - DNA, 315 bp, Artificial Sequence
  Description of Artificial Sequence: Synthetic coding sequence
atgggccgggccgtgaaggtgctgcagctgttcaagaccctgcacaggactcgccagcaagtctttaaaaacgatgcacgcgcgctagaggccgcacgcatcaagattaatgaggagttcaaaaataataaatccgaaactagcagtaaaaaaatcgaggaactgatgaaaattgggagcgatgtcgagctgcttctgcggacctccgttatccaaggtatccatacagaccacaatacactgaagcttgttccacgcaaggatctgctggttgaaaacgtgccatactgcgatgctcctacgcagaagcagtag

SEQ ID NO: 43190 - DNA, 921 bp, Artificial Sequence
  Description of Artificial Sequence: Synthetic coding sequence
atggccggccggcaccagaaccggagcttccccctgcccggcgtgcaatcttccggacaagttcacgcctttggaaattgttccgactccgatatcctggaggaagatgcagaggtgtacgagttgcggagtagaggaaaagaaaaagtaagaaggtctacgtctcgcgacagactggacgacattatcgtactgacgaaggacatccaagaaggcgatacactcaacgcaatcgctctacaatattgttgcaccgtcgccgatattaaacgtgtaaataacctgatatctgatcaggatttctttgcccttcgctccatcaagatccccgtgaaaaagttttcatctctcaccgagacattatgcccaccaaaaggtcgtcagacttcaagacactcaagcgtgcagtattcgagtgagcagcaagagatcctcccggccaatgacagtttggcctattccgactcagcagggtccttccttaaggaagtagacagggacatcgagcagatcgtcaaatgtactgacaataagcgggagaacctaaacgaagttgtgtcggctctgaccgctcagcaaatgaggttcgagccagacaacaaaaacactcagcggaaggatccttactatggtgctgactgggggatcggatggtggacagctgtcgtaattatgctgattgtgggaatcatcacacccgtattttacctgctgtattacgagatcttggctaaagtcgatgttagccatcactcaacagtggactccagtcatctgcacagcaaaatcacaccgccaagccagcagcgtgaaatggagaacggtatagtgccgacaaagggaatccacttctctcagcaagatgaccacaagctgtacagccaggacagtcagtccccagccgctcagcaagagacatag

SEQ ID NO: 43191 - DNA, 921 bp, Artificial Sequence
  Description of Artificial Sequence: Synthetic coding sequence
atggccggccggcaccagaaccggagcttccccctgcccggcgtgcaatcttctggtcaggtccacgcctttgggaactgcagtgactcagatatcctggaagaggatgccgaagtgtacgagttgaggtccagaggcaaagagaaggtgcggcggtctacctcccgagatcgcctagacgatatcattgttctgacgaaagatattcaggaaggggacacattaaacgccatcgcactacagtactgctgcactgtggccgacataaaaagagttaacaatctcatctccgatcaagacttttttgctctgcggtccataaaaatcccagttaagaagttttccagtctcaccgagacactatgccctcccaaaggcaggcagaccagccgacacagcagtgtccaatattcaagcgagcagcaggaaattctgccagccaatgacagcctggcctacagcgatagcgctggttcatttttgaaagaggtggatcgggatatcgaacagattgtcaaatgtactgataataaaagagagaatctgaacgaggtggtctcagccctgacagcccagcagatgagatttgagcccgataacaaaaatactcagaggaaagatccatattatggcgctgactggggcatcggatggtggaccgcagtggttattatgcttattgttggcatcataactccagtgttctatcttctgtattatgagattctggctaaagttgacgtgtcacaccacagcaccgtcgattcatcccacctgcactccaagatcaccccacctagtcaacagagagaaatggaaaacgggatagtgccaaccaaaggtatacatttttcccagcaagatgaccacaagctctactcacaggacagccagagtcccgccgcacagcaggagacttag

SEQ ID NO: 43192 - DNA, 384 bp, Artificial Sequence
  Description of Artificial Sequence: Synthetic coding sequence
atggccggccggcaccagaaccggagcttccccctgcccggcgtgcaatcaagcgggcaggtacacgccttcggaaactgtagcgactctgacattctcgaggaggacgccgaagtatatgaactgaggagcagagggaaagagaaggtaaggcggagcaccagtcgcgataggctcgatgatatcatcgtcctgaccaaggatatccaggagggggacaccctaaacgctattgcgctacagtactgctgcactgtttatcagaacagtagtaaaaaggtccagttcctcgatcggaataccctgtcaagcaaaagaaaaacagatttcacatcttttatctgctctatccttttcagaaccaccggaaactttgctagctag

SEQ ID NO: 43193 - DNA, 891 bp, Artificial Sequence
  Description of Artificial Sequence: Synthetic coding sequence
atgcggcacgaggagctgctgaccaagaccttccagggccccgccgtggtttgtggcacacctacgagccacgtctatatgttcaaaaacgggtcaggagacagtggcgattctagcgaggaagaaagccatagagtagtgttaagaccgaggggaaaggagcgccacaagtcgggagtgcaccagcccccacaagcaggcgccggggacgtggttctgctgcaacgagagttagcccaggaggattccctaaacaagctggcactccagtatggttgcaaggttgcggacattaagaaggtgaacaacttcattcgagaacaggatttatatgccctgaaaagcgtcaagatacctgtccgaaatcacggcatactgatggaaactcataaggaattaaagcccttacttagccccagcagtgaaaccacagttactgtcgaactgcctgaagctgaccgagcaggggccgggaccggtgcacaggctggccagctcatgggcttctttaaaggtatcgaccaggacatcgaacgagccgtacaaagcgagatctttctccacgaatcatactgtatggacacctcacatcaacctctgctcccagctccacccaagaccccaatggatggggccgattgtggaattcagtggtggaacgccgtctttatcatgttactgatcggcatcgtgctgccggtgttctatttggtgtacttcaagatccaagcttcaggagagaccccgaactcattaaacacgacagtcatccccaatgggtcgatggccatggggactgtacctggccaagcaccacggctggcagtagccgttcctgctgtgacctctgctgatagccaattttctcagacaacacaggccggctcttag

SEQ ID NO: 43194 - DNA, 894 bp, Artificial Sequence
  Description of Artificial Sequence: Synthetic coding sequence
atggccgtgggcacccggggcaccctgctgaagaagagcctgaccgtgtggttttgcgggcccggcgctagatcagccacaagggcggtgtccacttctctgccgcggcgggaacaggtaacctggtgctgctgcagcggtagttggccaaggcgcaccgctagcactagctggagatgttctatggcggcaaacacattctatttcagacccaacggcgcaggtgacacaagacagaacttgattccagatttctatgcctttcgcgtcattaataacggcaaagtagctgacattaagaaggtgaataattttatccgggagcaggatctttatgcattgaagtccgtgaaaatcccagtcaggaaccatggaatcctgatggagacccataaggagctaaagccactgttgagcccctcttcggaaactacagtgactgtcgaactccccgaggccgaccgggcaggggctgggactggggcccaggcaggtcagctaatggggttttttaaggggatcgatcaggatattgagagagcggttcagagtgagatatttctgcacgagtcatactgcatggatacttcacaccagcctttgcttcccgccccccccaaaacccctatggacggcgctgattgcggcatccagtggtggaatgctgtgttcatcatgctgctaatcgggattgttctgcctgtgttttacctcgtgtacttcaaaatccaagcctcgggcgagacccccaacagcctcaatactacagttatcccgaacggatctatggccatgggaacagtccctgggcaggcaccgcggctcgctgtcgccgtgcccgcggtgacctcagccgacagccagttttcacaaaccactcaggcaggcagctag

SEQ ID NO: 43195 - DNA, 891 bp, Artificial Sequence
  Description of Artificial Sequence: Synthetic coding sequence
atgcggcacgaggagctgctgaccaagaccttccagggccccgccgtggtatgcgggactcctacctcacacgtgtatatgtttaagaacggcagcggggactccggggatagtagcgaggaggaatctcatagagtagtgctccggcctcgcggtaaagagaggcacaaatcaggagtacaccagcccccccaagccggggctggtgatgtggtgctgcttcagcgggaactggctcaggaagacagcctgaacaagctggctttgcagtatggttgcaaagtcgccgatattaaaaaggttaacaacttcatacgcgagcaggatttgtacgcactcaagtcagttaagatccctgtgagaaaccacgggattctaatggagacgcacaaagagttgaaaccccttctgtccccatccagtgagacaaccgtaacggttgagttgcccgaagctgacagggctggcgctggtaccggtgctcaggccggacaactgatgggattcttcaaaggaattgatcaggacatagaaagagccgtgcagagtgaaatctttttgcacgagtcctattgcatggacaccagccaccaacccctcctgcctgcaccgcccaagactccaatggacggggccgactgcggaattcagtggtggaatgccgtgttcatcatgctgttgatcggtattgtcctgcccgtcttttaccttgtgtactttaaaatccaagccagcggagagactcccaactctttgaataccaccgtgattccaaacggttctatggccatgggaaccgtccctggccaggcccctcggttggcagtcgcggtccctgccgtgacttccgcagactcacaattttcccagactactcaggctggaagctag

SEQ ID NO: 43196 - DNA, 513 bp, Artificial Sequence
  Description of Artificial Sequence: Synthetic coding sequence
atggagacccacaaggagctgaagcccctgctgagccccagcagcgaaaccaccgtcacagtagagctgcccgaggcggaccgggcaggtgccggcaccggcgctcaggccggccagttgatggggttcttcaaaggcatcgaccaggatattgagagggctgtacagtcggagatttttcttcatgagtcctactgtatggatactagccaccagcccctgcttcctgcccctcctaaaacccctatggatggcgccgattgcggaatccagtggtggaacgccgtattcataatgctgctgatcggaatagtgctgccggtcttttatttggtgtatttcaagatacaggcgtctggcgagacacccaactccctcaacactactgtgattccgaatggcagcatggcgatgggtaccgtccccggtcaggcccctagacttgccgttgctgtaccagcagtgacatccgccgatagtcaattttcccagactacccaagcaggatcctag

SEQ ID NO: 43197 - DNA, 1635 bp, Artificial Sequence
  Description of Artificial Sequence: Synthetic coding sequence
atgagccggtgcgcccaggccgccgaggtggccgccaccgtgcccggcgctggtgtggggaacgttggcttgcggccccccatggtcccgcgccaggcctctttcttcccccccccggtgccgaatccgtttgtccagcaaacccagatcggcagcgccaggagggtgcagatcgtcctgctggggattatactgctgcccatccgggtgctgctggtggctctgatactgcttctggcgtggccattcgccgcgatttctactgtgtgctgccccgagaaattgactcatccaatcacgggttggaggaggaaaattacccagaccgctctcaagtttctgggtcgcgccatgtttttcagcatgggcttcatcgtagccgtaaagggcaagattgcttctcctttggaggccccagtctttgtagccgccccccacagtacctttttcgatggtatagcatgcgttgtcgccgggctgccctcaatggtgagtcgaaatgagaatgcccaagttccccttatcggacgcctcctgagagctgttcagcctgtactcgtcagtcgtgtcgatcccgactcccgaaagaatactatcaatgagattataaagagaacaacctcaggaggggagtggcctcaaatccttgtctttcccgagggcacctgcacgaatagatcttgtctcattacattcaagcctggcgcctttattccaggggtccccgtccagcccgtgctgctccgttatcctaataagttagacaccgtcacttggacgtggcagggatacacctttattcaactttgtatgctaacattctgccaattattcaccaaagtcgaagtcgagttcatgccagtccaagtccccaatgacgaggagaaaaatgacccggttctctttgccaataaggtgaggaacctaatggctgaggctctcggaataccagttactgatcatacctatgaggattgccgcctcatgattagcgctggacagctgaccctccccatggaggcaggtctagtcgagtttacaaaaatttcgcgcaaactgaaactggattgggacggtgtccgtaagcacctggacgagtacgcgtctatcgcgtcaagctccaagggagggaggatcggtattgaagaattcgctaaatacctgaaattgccagtatctgatgttctgagacagcttttcgcacttttcgaccgaaatcatgacggaagcatcgacttccgcgaatacgtcatcggacttgctgtgctgtgcaatccctccaataccgaagaaattattcaagtggcattcaagcttttcgatgtggacgaggacggatacatcacagaggaggagttttctaccatccttcaagcctcactgggcgtacctgatctagacgtgtctggactcttcaaggagatcgctcagggcgattcaatttcatatgaggagttcaaaagctttgcactgaagcacccagagtatgccaagatcttcacgacatatctggacttgcagacctgccacgtgttctcgctgcccaaagaggttcaaacgacaccttccactgcgtccaacaaggttagcccggagaagcacgaggagtcaacgtctgataaaaaggatgattag

SEQ ID NO: 43198 - DNA, 1113 bp, Artificial Sequence
  Description of Artificial Sequence: Synthetic coding sequence
atggccatcaccctggaggaggccccctggctgggctggctgctggtaaaggctctgatgcggtttgctttcatggtagtaaataatctcgtcgcaatcccctcctatatctgctacgtcatcattctgcagccactgcgggtgcttgattctaagcggttctggtatatcgaagggattatgtacaagtggctcctggggatggtggccagctggggttggtacgccgggtacacggttatggaatggggggaggatataaaggccgtgagcaaggacgaagctgtcatgctggtgaaccaccaagcaacaggggacgtgtgtacattaatgatgtgcctccaggataagggtttagttgtggcacagatgatgtggttgatggatcacatatttaagtatactaacttcggtatcgtatccctcgtccatggagactttttcattcgccagggacggtcgtaccgcgaccaacagctgcttctccttaagaagcacctggaaaacaactaccgtagccgggacaggaaatggattgttctgtttccagaggggggctttcttcgtaagcgaagggagacaagtcaggcctttgcaaaaaagaataacttaccgtttctaacaaacgtaaccctgccacgttcaggggcaaccaaaatcatcttgaatgcgctggtggcccaacagaagaacggaagcccagccgggggggacgccaaggaattggacagtaaatcaaaagggcttcagtggatcatcgatactaccatcgcctaccccaaggctgaaccaattgatatccagacatggatactgggatatcgtaagccaaccgtgactcacgtacactacagaatctttcctattaaagacgtgcctcttgagacagacgatttaaccacctggctataccaacgattcgtggaaaaggaagacctgctgtcgcacttttacgagactggtgcctttccacctagtaagggacataaagaggctgtctctagagaaatgacgttgtcaaacctttggattttcttaatccagtcatttgccttcctgtctggctacatgtggtataatataatccagtatttctaccattgcttgttctag

SEQ ID NO: 43199 - DNA, 1113 bp, Artificial Sequence
  Description of Artificial Sequence: Synthetic coding sequence
atggccatcaccctggaggaggccccctggctgggctggctgctggtcaaagctttaatgcgatttgcatttatggtcgttaacaatttggtggcaattccatcttacatttgttatgtcattatcctccaacctctgcgtgtgctggattctaaaagattttggtatattgaaggcatcatgtataagtggctccttggtatggtcgctagttggggttggtacgctggttataccgtgatggaatggggggaggatatcaaagctgtcagtaaagacgaagcagttatgctggtcaaccatcaggctacaggcgacgtttgcacactgatgatgtgtctccaagacaagggcctggtggtcgcccagatgatgtggctcatggaccatatttttaagtatacgaatttcggcattgtatctctggtgcacggcgattttttcattcggcaaggaagatcttaccgggatcaacagttactacttttgaagaaacacctagaaaataactataggagccgtgacagaaaatggattgtcctatttcctgagggcgggttccttaggaagcggcgtgagacatcccaggcttttgcaaaaaagaataatctcccctttctgaccaacgtcactctgccgagaagcggcgctaccaagattatcctgaacgcactcgtggcacagcaaaagaacggaagccctgccgggggcgatgcaaaggaactggattccaagagtaagggtttacagtggatcatcgacactactatcgcttaccctaaggccgagccaatcgatattcagacatggattttaggatatcgaaagcccacagtgacccacgtgcattaccgaatatttcccatcaaggatgtgccgctcgagaccgacgatctaacgacatggctgtatcagcgcttcgtggaaaaagaagacctactgagccacttttatgagaccggtgcgtttcctccttctaagggccacaaggaggctgtctctagagagatgaccctctcaaacctatggattttcctgattcagtccttcgccttcctgtctggctacatgtggtacaacataatacaatacttctatcactgtcttttttag

SEQ ID NO: 43200 - DNA, 702 bp, Artificial Sequence
  Description of Artificial Sequence: Synthetic coding sequence
atggtgagcatgagcttcaagcggaaccggagcgaccggttctacagtacccggtgctgcggctgttgccatgtcagaacaggtactatcatcctcggaacatggtatatggttgttaacttattaatggccattttgctgactgtcgaagtgactcatccgaactcgatgcctgctgtcaatattcagtatgaagtaatcgggaattactattcctccgaaaggatggccgacaacgcttgcgtgttattcgcagtttcggtgttgatgtttatcatttcatccatgctggtctacggggccataagctatcaagttggctggctgattccctttttctgctatcgtctcttcgactttgtattgagctgtttggtggctatcagctctctgacatacctgccccgtatcaaggaatacttagaccagctccctgacttcccttacaaagacgacctgctggcactcgacagctcctgtctgctgtttattgtcctggttttcttcgcactgtttattatcttcaaagcgtacctgatcaattgtgtatggaactgttataagtacatcaacaatagaaatgtccctgaaattgccgtgtatcctgctttcgaggcaccccctcaatacgtgctccctacgtacgagatggcggtgaaaatgcccgagaaagagccaccacccccgtatttgcccgcttag

SEQ ID NO: 43201 - DNA, 1251 bp, Artificial Sequence
  Description of Artificial Sequence: Synthetic coding sequence
atgccccggcagctgagcgccgccgccgccctgttcgccagcctggccgtcattctgcacgatgggtcccagatgcgcgcaaaggccttccccgaaactagggactatagtcagcccaccgcagctgcaactgttcaggacataaagaagcccgtacagcagcccgccaaacaggcgccacatcaaactctcgcggcacgctttatggacggtcatatcaccttccaaaccgccgccaccgtaaagattcccaccactacccctgcgaccacaaaaaatacagctacaaccagccctatcacatatactctggtcacgacacaggccactcccaacaacagccatacagctccgcctgtcacagaagtgacagtgggcccatcattagcaccttactcgttgccccccaccattactcctcccgcccatacgaccgggacctcttcatccacggtaagtcacacaacgggaaataccacacaacctagcaaccaaactactctgcccgccacgctttcaatcgcactgcacaaatctaccactggacaaaagccggtgcagcccacacacgctccaggtacgaccgcagctgcgcataacacaacccggaccgccgctccagcatctacagttccaggtccaactctggccccacaaccctcatcagtgaagacaggtatttaccaggtcctgaacggttctagattgtgcataaaggctgagatggggattcagctgatcgtgcaagataaggagagtgtgttcagcccccgcagatacttcaacatcgacccaaacgctactcaggcctccggcaactgcggcaccagaaaatcaaatctgctcttgaactttcagggggggttcgtgaatctcacttttaccaaagatgaggagtcatactatatttcagaagtgggggcctatctgactgtgagtgaccccgaaacaatttatcaaggtataaagcatgccgtggttatgttccagacagcagtaggccacagcttcaagtgcgttagtgagcagtcactgcagctgtcagcccatttacaagtgaagacaactgacgtgcagctgcaagccttcgatttcgaagatgatcacttcggcaatgtcgatgaatgtagcagcgattacaccattgtcctacccgtaattggggcgatcgtcgtaggcttgtgcctgatgggaatgggcgtgtacaagataagactgcgatgtcagtcttccggttatcagcggatctag

SEQ ID NO: 43202 - DNA, 543 bp, Artificial Sequence
  Description of Artificial Sequence: Synthetic coding sequence
atgccccggcagctgagcgccgccgccgccctgttcgccagcctggccgtcattttgcacgacgggtctcagatgcgtgctaaagcgtttcccgagactcgggattacagccagcctacagctgctgctaccgttcaggacattaagaagccggtgcaacagccagccaagcaagccccccaccagacactggctgctaggttcatggacggacatattactttccagacggcagccaccgttaagattcccacgacaacaccagccaccacaaagaacacggccaccacctctcccataacctatactcttgtcacaacccaggccactcccaacaactctcacacagcccctcccgtcactgaggtgacggttggccccagcctggctccttacagcctgccccccaccatcacgccacccgcccataccacaggtacaagctctagcacagtttcgcacactacaggtaataccacccaaccctcaaatcagaccactcttcctgccacactctccatcgcccttcacaagtctacctag

SEQ ID NO: 43203 - DNA, 843 bp, Artificial Sequence
  Description of Artificial Sequence: Synthetic coding sequence
atggacctgcagggccggggcgtgcccagcatcgaccggctgcgggtgctcttaatgctgtttcacacgatggcccagatcatggctgaacaggaagtagaaaacctgagcggactgtctacgaacccggaaaaggacatctttgtcgtgcgggagaacgggactacatgccttatggctgaatttgccgccaaattcatcgtcccctatgacgtgtgggctagtaattacgtggacctcataactgaacaggctgacatcgcactcactagaggcgccgaggttaaggggcggtgcgggcacagccagtcggaactccaggtcttttgggtggaccgggcatacgctttgaagatgctgtttgtgaaggagagccataatatgagcaagggacctgaggcaacctggcgcctctccaaggttcagtttgtgtacgacagctcggaaaaaacccatttcaaagacgcagtatccgcgggcaagcatacggccaacagtcaccacctgtcagcgctggtcacacccgccggtaagtcatatgagtgtcaggcccaacaaacaatttctctggcctccagcgaccctcagaaaacggtaacaatgattcttagcgctgtgcatattcaaccgtttgacatcatttctgacttcgtcttctctgaggaacacaagtgtccagtcgatgaacgcgagcaattggaagagacactcccactgattcttgggcttattctgggccttgtcattatggtaacactcgcgatctaccacgtgcaccacaagatgactgctaatcaagtccagatccccagggaccgcagccagtacaaacacatgggatag

SEQ ID NO: 43204 - DNA, 711 bp, Artificial Sequence
  Description of Artificial Sequence: Synthetic coding sequence
atggacctgcagggccggggcgtgcccagcatcgaccggctgcgggtgttgctgatgttgtttcacacaatggcgcagattatggctgagcaagaggtggagaacctgagtgggctgagtaccaatcccgagaaggacatctttgttgtgcgtgaaaatgggactacgtgcctgatggccgaatttgctgctaaatttattgttccctacgacgtctgggccagcaactacgtagatgagtcacacaacatgtccaaaggtccagaagcaacctggagactgtccaaggtgcagtttgtctatgattcaagcgagaagacgcactttaaggacgccgttagtgccggaaagcacactgctaactcgcaccatttatcagccttggtgacaccagccgggaaaagctacgaatgtcaggcacaacagacaatatctcttgcctcaagcgacccccagaaaacggtgacaatgatcctgtccgccgtccacatacagccatttgatattattagcgattttgttttctctgaagaacataagtgtccggtggacgagagggagcaactcgaggagacccttccacttattctgggtctaattctgggcttagtcataatggtcaccctcgcaatctaccacgtgcaccacaaaatgacagcaaatcaggtgcagataccaagagatcgatcccaatacaagcatatgggatag

SEQ ID NO: 43205 - DNA, 978 bp, Artificial Sequence
  Description of Artificial Sequence: Synthetic coding sequence
atgagcctgcagagccggctgagcggccggctggcccagctgcgggctgcaggccagctcctcgtacctccccgaccccggcctgggcacttggccggggccacccgcacgagaagctccacttgcggaccacctgcatttttgggggtcttcggcaggcgggcccggacctccgcaggtgtgggtgcttggggggccgccgccgtgggccgtacggctggggtgcggacctgggcccccctggcaatggcagccaaggttgacctgagcacatcaaccgactggaaagaggctaagagcttcctcaagggattgagtgacaagcaacgcgaggagcactatttttgcaaggatttcgttcgactaaagaaaatccctacgtggaaagagatggcaaagggcgttgctgtgaaggtggaagaaccgcggtacaaaaaggacaaacaactaaatgagaagatcagcctgctgcggagtgacatcactaaacttgaggtcgatgcaatcgttaacgccgccaattcttctctgctgggtgggggtggcgtagacggctgtatccacagagccgcaggcccattacttactgacgagtgtaggaccctacagtcttgcaaaactggcaaagctaagatcacaggtgggtacagactgccggctaagtacgtgattcacacagtgggccctattgcgtatggtgagccatcggcatcccaggccgctgagctgcgtagttgctacctctcatccctcgacctcctcctggaacatagactgcgctctgtggcttttccatgtattagcaccggcgtttttgggtacccatgcgaagctgccgctgagatcgtcctcgccaccctaagagagtggctcgagcagcacaaggacaaggtggacagattaatcatctgcgtttttctggaaaaagatgaagacatctatcgatccaggctgcctcattattttccggtggcctag

SEQ ID NO: 43206 - DNA, 2151 bp, Artificial Sequence
  Description of Artificial Sequence: Synthetic coding sequence
atgaacaacttccgggccaccatcctgttctgggccgccgccgcctgggccaagagcgggaagccctcgggagagatggatgaggtgggggtgcagaagtgcaagaacgcactaaagttgccagtgctggaggtgctgcctggcggggggtgggataaccttagaaatgttgatatgggtcgagtgatggaactgacctactccaactgccgcactaccgaggacggccagtatataatccctgacgagatcttcacaattccacaaaaacagagcaatctggagatgaactccgagatattggagagttgggcaaactaccagagttcaacctcttactcgattaacaccgaattgagcctcttcagtaaagttaacgggaagttttctacggaattccagcggatgaagaccttacaagtcaaagaccaagccatcaccactcgcgtccaagtccggaatctcgtgtatacagtcaaaatcaatccaactctggaactgagctccggattccgtaaagagctactggacataagcgatagactcgagaacaatcagaccaggatggcaacataccttgcagaactgctcgttttgaactacggcacccacgtaactacaagcgtcgacgccggagccgccttgattcaggaagaccatctgcgcgcttcttttcttcaagactcgcagtcatctcgctccgccgtcacagcaagtgccgggctagcctttcaaaacactgtgaattttaaattcgaggagaattacacctcccaaaatgtactaacaaaatcctatttatcgaaccgtaccaactctagagtccagagcattgggggtgtgccattttatccaggcatcaccttgcaggcgtggcagcaagggattacaaaccatctggttgcaattgaccgtagcggtctcccattacacttttttattaacccaaacatgctgccagacctcccgggaccactagtcaagaaggtatctaagactgttgagactgcagtgaaacggtattacacattcaacacctatccaggctgcacagatttgaactctcccaatttcaatttccaggcaaacaccgatgatgggtcctgcgagggcaaaatgacaaatttctctttcgggggtgtctaccaggagtgcacacaactctctggcaaccgcgatgttttactatgtcaaaaattggaacaaaaaaatcctctgaccggcgacttctcatgtcctagtggatattcgcctgtgcatctccttagtcagatccacgaagaggggtacaatcatctcgagtgccacagaaaatgtactctcttggtgttctgtaaaaccgtgtgtgaggatgttttccaggtggccaaggctgagttcagggccttctggtgtgttgctagctctcaggtgccggagaatagcgggttgctgtttggcggacttttttcttccaagtctatcaatccaatgacgaacgcccaatcttgtcctgctggctattttccactccggctgtttgaaaatctgaaagtatgtgtctctcaggattacgagcttggatctagattcgctgtgccttttggagggttcttctcgtgcacggtgggaaaccccctggtcgacccagccatttcccgcgacctgggcgcccctagtcttaagaagtgccccggcggcttctcccaacaccccgcattgatctccgacgggtgccaggtcagttattgtgtcaaatcggggctgttcacaggcggcagcttaccccctgctagactccctcctttcacgcgaccccccttgatgagtcaggctgcgactaacaccgtgatcgtaactaattccgaaaacgccagaagctggatcaaggactcccagacccatcaatggcgcttgggtgaacctatcgagttgcggagagccatgaatgttatccacggcgacggtggtgggctgtcaggcggtgccgccgccggagtaacggttggagtcacaacaatcctggctgtggtgatcacgttggcgatatacggcacccggaagtttaaaaagaaagcctatcaagccatagaagaaaggcagtcacttgtgcccgggacagcagctacaggcgataccacataccaggaacaggggcagtctccagcgtag

SEQ ID NO: 43207 - DNA, 495 bp, Artificial Sequence
  Description of Artificial Sequence: Synthetic coding sequence
atgaacaacttccgggccaccatcctgttctgggccgccgccgcctgggccaagagcgggaagccaagcggagagatggatgaagtcggcgtgcagaaatgcaaaaatgccttgaagctccccgtgctggaggtcttaccagggggcgggtgggataatcttcggaatgttgacatgggtagagtgatggagctcacctatagcaactgcaggacaaccgaggacggtcagtacatcattcctgatgagatctttactatacctcaaaagcagtcgaacctcgagatgaattccgaaattttggagtcctgggctaattatcagagttcgacctcatattcaattaataccgagctcagcttgttctcaaaagttaatggcaaattctcgactgagttccaacgggttcccgctccttgccaggctcccacgttccaccctgctacccctcacgaatcaggttgccaccagtactgtcactccgatcaattctag

SEQ ID NO: 43208 - DNA, 1398 bp, Artificial Sequence
  Description of Artificial Sequence: Synthetic coding sequence
atggaggaggaggacgaggaggcccgggccctgctggccggcggcccggacgaagcagacaggggtgcccccgccgctcctggcgccttacctgcactctgtgatccttctcgcctcgcacatcgcttgcttgtgctgctattgatgtgttttttaggatttggctcatatttttgctatgacaatccggctgccctgcagactcaggttaagagagacatgcaggtcaacacaacgaaattcatgctcctctatgcctggtattcctggcccaatgttgttttatgtttcttcggggggttccttatcgatagggtgtttggaattcggtggggcacaatcatctttagctgctttgtctgcatcgggcaagtggtgtttgctctgggcgggatattcaacgctttttggctcatggagtttggccgtttcgtgtttgggattggaggcgagtcccttgccgtggcccagaatacctatgcagtgagctggttcaaggggaaagaactcaatctggtgtttggcctgcaactttctatggcgcgcataggaagtactgtgaatatgaatttgatgggctggctgtactcgaagattgaggccctcttagggtcggccggccataccactctgggcattaccttgatgataggaggcattacgtgcatactctccctgatctgtgccctggccctggcttacctggatcaacgtgctgagaggattctacataaggagcagggtaaaacaggcgaagtgatcaagctgaccgacgtaaaggacttctcgctgcccctgtggctgatattcattatctgcgtttgctactacgtagcagtgtttccttttatcggattaggaaaggtttttttcactgaaaagtttggattttcctcacaggctgcatctgcaattaattcagttgtatacgttatctcagcaccgatgtccccagtcttcgggcttttggtcgataagacgggtaagaacatcatttgggtgctgtgtgccgttgccgctaccctggtgtcacatatgatgctcgctttcaccatgtggaatccatggatagccatgtgcttgctgggtctttcttattccctgctcgcttgtgcactatggcccatggttgcgtttgtggtacctgagcaccagctcgggaccgcatatggcttcatgcagtccatccaaaacttgggcctcgccattatctcaatcatcgccggaatgatcttagatagccgagggtatctgtttttagaggtgttcttcatcgcgtgcgtttccctgtcgctgttgagcgtggtacttctgtacctggtcaatcgcgcccagggtggcaatctaaactacagtgccagacaaagggaggaaatcaagttttcgcacacagagtag

SEQ ID NO: 43209 - DNA, 762 bp, Artificial Sequence
  Description of Artificial Sequence: Synthetic coding sequence
atggaggaggaggacgaggaggcccgggccctgctggccggcggcccggatgaggccgaccgcggtgctcctgctgcaccgggtgctcttccggcactctgcgatccctcacgccttgcacaccgactcctggtacttctcctgatgtgcttcctcggtttcgggtcttatttttgttacgataatcccgccgccctgcagacgcaggtcaagagggatatgcaagtgaacacaacaaaattcatgctcctgtatgcgtggtatagctggccaaatgtcgtcctttgcttctttggaggatttctgatcgaccgggtgttcggctccacagtaaatatgaaccttatgggatggctctattccaagatcgaagccctcctgggtagcgccgggcacacgaccctggggattacgctgatgattgggggcattacttgtatattgagcctgatttgcgcccttgcactggcctacctggatcaacgagcagagagaattctgcataaggagcagggcaagacaggggaggtaatcaaattaacagatgttaaggacttttccctgcctctctggctgatcttcatcatctgcgtttgctactacgtagcagtgttccctttcatcgggttgggcaaggtctttttcacagagaagttcgggttcagcagccaggctgcttccgcaattaactcagttgtttatgtcatcagtgcaccgatgagcccagttttcgggctcttggttgataaaacgggcaaatag

SEQ ID NO: 43210 - DNA, 1428 bp, Artificial Sequence
  Description of Artificial Sequence: Synthetic coding sequence
atgggcgtggccctgcgggacctgcccggccggcacgtgagcagccgcagccatgttacagccgtgctcactgtgtttcacggacggtgctttctgcccggattcggtgttgtcacaacatttccatctccctcccccgctggcgcgatggaagaggaagacgaggaggccagagctttactggctggaggtcctgatgaggccgacaggggagccccagccgcaccaggcgcgttacccgccctctgtgacccgagccgtctggcacatcgcctgttagtcctgctgctaatgtgctttctggggttcgcaatttttgctatgatcatcttgttgccgttccggctgaagcttaacgaatgggggactatcatattctcttgttttgtatgcattggccaagttgttttcgcccttggaggaattttcaatgctttttggcttatggagttcgggagattcgtgtttggtatcggaggcgaaagtctagccgttgctcaaaatacttacgcggtgagctggtttaagggtaaggaactgaaccttgtgttcggcctgcagctgtcaatggcaaggatcggctccactgttaacatgaatctcatgggctggctttactccaaaatcgaggcccttcttggcagtgctggccacactacactgggcattacactgatgatcggcggcatcacatgtatattgtctctgatctgtgcgttggcactggcttaccttgaccaacgagccgaacggatactgcataaggaacagggcaagaccggagaagtgatcaagctgacagacgtgaaggacttctctctcccactgtggctcattttcattatatgcgtatgttactacgtcgcagtgttcccattcatcggtctgggcaaagtattcttcaccgagaagtttgggttttcttcccaagccgcttccgccataaattctgtggtgtatgtgattagcgcacccatgagcccagtgttcgggctcctggtcgataagaccggtaaaaatataatctgggtgctctgtgcagtggcagcgacgctcgtgagtcatatgatgctcgcgtttactatgtggaatccctggatagcaatgtgtctccttgggctgtcgtactcccttctggcttgtgctctttggcccatggttgcttttgtcgtgcccgagcaccagctaggcacggcgtacggttttatgcaatcaatccagaacttgggcctcgcaatcatctccatcatcgccggcatgatcctggatagccgggggtacctatttctcgaagtgttcttcatcgcctgcgtgtcactcagcctgttatcagttgtgcttttatatttagtgaatagggcccagggcgggaatcttaactattctgctagacaaagagaagagataaagttctcccatacagaatag

SEQ ID NO: 43211 - DNA, 1545 bp, Artificial Sequence
  Description of Artificial Sequence: Synthetic coding sequence
atgggcgtggccctgcgggacctgcccggccggcacgtgagcagcaggtcccacgtaacagcagtgctgaccgtttttcatggccgctgtttcctgcctggtttcggcgttgtgactacttttcccagtccatctccagctggggccatggaagaggaggacgaagaggcccgggctctactggcaggtgggcctgatgaagctgatcgaggagctcccgcagccccgggtgcccttccggcgctgtgtgatccatctcggctagcacatcgcctgttggtgttgctgttaatgtgcttcctgggcttcggctcctatttttgttatgacaaccccgccgcactgcagactcaggtgaagagagacatgcaggtgaatacaaccaagtttatgctgctgtatgcttggtattcatggcctaatgtcgtcctctgcttttttggaggtttcctgatcgacagggtatttggcatccgatgggggaccattatcttctcctgctttgtctgcattggccaggtggtcttcgccctgggggggatattcaatgctttctggttaatggaattcggccggtttgtctttggaatagggggtgaatctctagctgtggcccagaatacctacgcagtgtcatggtttaaaggcaaagaactgaacctagttttcggcttacagctctcaatggcccgcatcgggtctacagtgaatatgaatcttatgggatggctttattcaaagatcgaagctttactgggatccgcaggtcacaccaccttaggtattacgctaatgatcggcggtattacttgtatccttagcttgatttgcgccctggctctcgcatacctggatcaacgagctgagcgcatcctgcataaggaacagggcaagaccggcgaagtgataaaactgacagatgtgaaggacttctccctccccctctggctgatattcatcatctgtgtatgttattatgtggccgtttttccctttataggactgggaaaggttttttttacagagaaattcgggttttcttcgcaagccgcttccgccattaatagcgttgtgtacgtgattagcgctccaatgagtcccgtgttcggactcctggtggacaagactggcaagaacatcatttgggtcctgtgtgcggtggcagctaccctggtctcacatatgatgctcgcatttaccatgtggaacccatggatagccatgtgtctgctcggactgtcctactcccttctggcttgcgctctgtggcctatggtagcgttcgtcgtacctgaacatcaattgggcaccgcctatggattcatgcaatccattcagaacttgggcctggccatcataagcataatcgctggcatgatcttggactcacggggatacctcttccttgaggtcttcttcattgcatgtgtgtctctgtcactcctgtctgtagtgctgctgtatctggtgaacagggctcagggcgggaacctaaattactccgcacgtcagagagaagagatcaagttctctcacactgagtag

SEQ ID NO: 43212 - DNA, 1368 bp, Artificial Sequence
  Description of Artificial Sequence: Synthetic coding sequence
atgggctggggcggcggcggcggctgcaccccccggccccccatccaccagcaacctcccgaacgacgggtcgtgaccgtcgtgttcctgggacttctgctggacttgctggcatttaccctgctcctgccactcttgcctggcctcctggagagccacggacgagctcacgaccctctatatggaagctggcaggggggagtggattggtttgccacagccatcggaatgccggtcgagaagaggtacaactccgttttatttggagggcttattggctcggccttcagcgttctacagttcctgtgtgcccccctgactggcgcaacgagtgattgtctcggcaggcggcctgttatgctgctgtgcttaatgggagtcgcaacgagttatgctgtgtgggccacaagccggtctttcgccgccttcctggcttcaaggcttatcggggggatctccaaagggaatgtgagtttaagcaccgctatcgttgctgatctcggcagcccactcgcaagatctcagggaatggcagtgattggggtggccttctcactgggcttcacgcttggacctatgctgggtgctagtctcccgttagaaatggctccctggttcgcactgcttttcgcggcaagcgatttgctatttattttctgctttctgccagagacgctccctcttgaaaagcgcgcgccctcaatcgcccttggattccgtgacgcagcagacctcctgagtcctttagctcttttgcgcttctctgctgtggctcgcgggcaggatccacctagcggagaccgcttgagctctttaagaaggttgggccttgtgtactttctttatttatttctcttcagcggcctggaatataccctatctttcctcacccaccagcggtttcaatttagtagcctgcagcagggaaagatgtttttcctgataggccttactatggcaaccatccagggggcttacgctcggcggatccatcctgggggggaggtggccgcagtgaagcgcgcccttctgctcctggtgcccgcgtttcttctaattgggtggggccgatcactgcccgtgctgggactcgggctgctgctatattccttcgccgcagctgtagtggtcccctgtctaagctcggttgtggctgggtacggtagtcccgggcagaaggggaccgtgatgggaacccttcggtcgctgggtgccctggctcgagccgcaggccctctggtcgctgcctctgtgtactggttggctggtgcccaagcgtgtttcacaacgtggagcgggttattcttgctgcctttcttcctgcttcagaaactgagttatccagcccaaacattgaaggccgagtag

SEQ ID NO: 43213 - DNA, 1368 bp, Artificial Sequence
  Description of Artificial Sequence: Synthetic coding sequence
atgggctggggcggcggcggcggctgcaccccccggccccccatccatcagcagccaccagaaagacgtgtcgtgactgtcgtgttcctaggtctcttgctggatctgctcgctttcaccctgcttcttccactcctcccaggactgcttgagtcgcacggccgcgctcatgaccccttgtacggcagttggcagggcggtgtagactggttcgcgacggccatcggcatgcctgttgaaaaaagatacaactcagtcctgtttggaggtctcattggaagcgccttttcagtgctccagtttctgtgtgcacctctgactggcgcaacctctgactgcttagggagaagacccgtcatgctgctatgcctcatgggagttgcgacgagttatgctgtgtgggctactagtaggagcttcgcagcctttctggcatcaagattgattggagggatatccaaaggaaacgttagtctctccacggccatcgtcgctgatctagggagtccacttgcaaggtcccaggggatggccgtcatcggcgtcgctttttctctaggatttactctgggtccaatgctgggagcttcactgccattggagatggcgccgtggttcgccttgctgttcgctgcttcagacctgctgttcattttttgtttcttaccagaaacactgcctctggagaagagggcaccctcaattgctctgggtttccgcgatgcggcagacctcctgagcccacttgcccttctccggttttcagctgtggcgcggggacaggatccgcctagcggagatcgcctgtcaagcctcagacgcctaggcttggtttacttcttgtatctgttcctgttctctggactggagtacactctcagctttctcacacaccagagatttcaattcagttctttgcagcagggtaaaatgttcttccttataggcctgacaatggcaactatacagggcgcctacgctagaagaattcaccccggtggagaggtagcagctgtcaagcgggccctgctactcttggtacccgcattcttactaatcggctggggtagatctctgccagtgcttggactgggccttctgttgtattcttttgccgctgctgtggtggtcccttgtctctcctccgtggtagcaggatacggcagccctgggcagaagggcaccgtgatgggtacacttaggtcccttggagccctggctagggcagctggtcctctggttgcggcttctgtctactggctcgcaggcgcgcaggcatgttttacaacatggagcggactcttcctattgcctttttttctgctgcagaagctctcttacccggctcagacactgaaggccgagtag

SEQ ID NO: 43214 - DNA, 1350 bp, Artificial Sequence
  Description of Artificial Sequence: Synthetic coding sequence
atgagccccgagagcaagaagctgttcaacatcatcatcctgggcgtggctttcatgttcatgtttaccgccttccaaacttgcggtaatgttgcccagaccgttattcggtccctaaacagaacagattttcacggttcaggctacaccagcatggccatcatttacggtgtattctccgcgagtaatctaattacgccctcagtcgtggccattgtgggcccacagctgtctatgtttgctagcgggctcttttactcaatgtacatcgctgtgttcatacagccttttccctggtccttttataccgcctctgtgtttataggcatagcagccgcggtgttatggaccgcccagggcaactgcctcaccatcaactccgacgaacacagcatcgggcgcaactctggcattttttgggccctgcttcagagctctctgttcttcggcaatctgtatatctacttcgcctggcaggggaagacccaaatatccgaatctgaccggcgcaccgtctttattgcactgactgtgatctccttagtcggcactgtcctgttctttctgatccgcaaacccgattcagaaaacgtgctgggagaggacgagagcagtgatgatcaggatatggaggtcaatgagtcagctcagaacaacctgacgaaagccgtcgatgccttcaagaagtctttcaagctctgcgtgacaaaagagatgctgctgttatctataacaactgcctatacagggctggagctcactttcttttcaggcgtctacggtacctgcattggagctactaataagttcggggccgaggagaagtctctcatcgggctgtcggggatcttcattggcattggcgaaattttgggggggtctttgtttggactgttgtcgaagaacaataggtttggccgaaatccggtggtcttgctggggattcttgtccattttatagccttttatctgatttttcttaatatgccaggcgacgcacctatcgcacccgtgaagggtaccgattcatctgcctatatcaagtcatccaaggaggtggccatcctgtgctctttcctcctcgggctaggagacagttgcttcaatacacagctcttatccattctggggttcctctattctgaagactctgcccccgccttcgcaattttcaaatttgtgcagtctatttgcgccgccgtggccttcttctattccaattacctgcttttacactggcagttgcttgttatggtgattttcggcttcttcggaacgatcagctttttcactgtggagtgggaggcagccgcatttgtcgcgagggggagtgattacaggtctatttag

SEQ ID NO: 43215 - DNA, 1194 bp, Artificial Sequence
  Description of Artificial Sequence: Synthetic coding sequence
atgagccccgagagcaagaagctgttcaacatcatcatcctgggcgttgccttcatgttcatgttcaccgcgttccagacttgtggaaacgtcgcccaaaccgtgatacgttcactcaaccgaaccgacttccatgggtcaggctacactagtatggccattatctacggcgtttttagtgccagtaatcttatcactccttcagttgtagccatagtaggccctcaactgtccatgttcgcttccggtctcttttattcaatgtacatagccgtgtttattcagccctttccctggtccttttacaccgccagcgtcttcatcggtatcgctgccgctgagagcgatagaagaacagtgttcatcgctctaaccgtcatcagtctggtgggaacagtgctgttttttcttattagaaagccagactcggagaatgtactgggcgaagacgaaagcagcgacgaccaggatatggaggtgaatgagagcgcacagaacaacctcaccaaagccgttgatgcattcaaaaaaagcttcaaactctgcgttacaaaagagatgctgctactgagcatcacaacagcctatactggcctggagctaaccttcttcagtggggtctacggcacttgcatcggcgccacaaacaaatttggggccgaggagaaaagtcttatcggtctttcaggcatctttatcggcattggcgagatcttgggaggctcgttgtttggacttcttagtaagaacaatcgattcggtcgcaacccagtggttcttctaggcatcttggtgcacttcatcgccttctacttgattttcctgaacatgcctggggacgcccccatagcacctgtgaaaggtacagattcaagcgcttatattaagagctccaaggaggtggccattctctgctcatttctcctggggctgggcgacagttgtttcaatacccagcttctcagtattctcggattcctgtactccgaggattccgccccggcgttcgctatttttaaattcgtgcagtcaatctgtgcagcagtcgccttcttctactctaactacttgctgctgcattggcagctgcttgtgatggtgatcttcgggttctttgggactatcagttttttcactgtggaatgggaggcagcggcctttgttgccagagggagcgactatcggagcatttag

SEQ ID NO: 43216 - DNA, 1443 bp, Artificial Sequence
  Description of Artificial Sequence: Synthetic coding sequence
atgggccccggcccccccgccgccggcgccgcccccagcccccggcctctcagcctcgtggcgagactctcatacgcagtgggacacttcttaaatgatctgtgtgctagcatgtggttcacctatctcttattatatctgcatagcgtcagagcatattcaagccgaggggcgggcctgctgctgttactcggtcaggtcgcagatggactgtgtacccccctggtgggctacgaggcggatagggctgcgagctgctgcgctcgctacgggcctcgcaaagcatggcacttggtagggactgtctgcgttttactcagctttcccttcattttctctccatgcctaggatgtggagctgctacccccgaatgggccgccttgctctattacggaccttttatagtgatattccaatttggatgggccagcacacagatatcgcacctgagccttatccctgagttagtgacaaatgatcatgagaaagtggagctgacagccttgagatacgctttcactgtcgtcgccaacatcactgtgtacggcgccgcgtggctgctgttgcacctccagggctcatctcgcgtcgaaccgacacaagatatctctatttccgatcagctcgggggccaggacgtccctgtgtttcgcaatctctctcttctggtggtgggagtgggcgctgtattctcgctgctcttccacttaggaactagagagcggagacggccacacgctgaagagcccggtgaacatacccctcttctggcccctgccacagcccagcccctattgctctggaagcactggctcagagagcctgccttttaccaggtgggtattctgtatatgacaaccaggctgatcgttaatttgtcccagacttacatggccatgtacctgacatactccctacatctgccgaagaaattcatcgccactatacctctggtaatgtacctgtcggggtttctgagttcattcctaatgaagcccatcaacaaatgcatcggcaggaacatgacgtacttctcgggactgctcgtgatcttggcgtttgctgcctgggttgccctggccgagggtctcggcgtcgcagtttatgctgccgccgtgctcctcggtgcagggtgcgccaccattctggtcacatctctagctatgaccgcagacctgattggaccccacactaactctggcgcgttcgtttatggaagtatgtcattcttggacaaggtagcgaacggcctggctgtcatggccattcagtctttacacccttgtcctagcgagttgtgctgcagggcgtgcgtgtccttctatcactgggccatggttgcagtgaccggcggcgtgggagtggctgccgcgctatgtctctgttctctgctcttgtggcctacaaggttacgcagatgggacagagacgcgagaccatag

SEQ ID NO: 43217 - DNA, 1422 bp, Artificial Sequence
  Description of Artificial Sequence: Synthetic coding sequence
atgggccccggcccccccgccgccggcgccgcccccagcccccggccactgtctttggtggctcgcctgagttatgctgtggggcatttcctcaatgacctctgcgcatcaatgtggttcacatatctgctgctttatctgcatagcgtgagggcgtactcatccagaggggctggactgctgcttttgctcggtcaggtcgctgatggcctatgcaccccactggtaggatatgaagctgatcgcgccgcatcctgttgtgctcgctatgggcccagaaaagcttggcacctcgtggggaccgtctgcgtgctgctttcctttcctttcatcttttctccatgtcttggatgcggtgccgcaacaccggagtgggccgccttactctattacggccctttcattgttatattccagttcgggtgggctagcacacaaatctcacacctctcattaattccagaactggtgacaaatgaccacgaaaaagtggagctgactgctttacggtacgcgttcaccgtggtggcaaacataactgtgtacggagcggcttggctgcttctgcacttacagggcagcagcagggtggagcctacccaggacatcagcattagcgatcagctgggtggccaggacgttcctgtgtttagaaacctatccttgttggtggtgggcgttggagccgtgtttagcctactgtttcatctgggcacaagggaacgccgacggcctcacgccgaggagccaggggaacatacccctctgctcgcccccgcaaccgcccaaccactgctactatggaaacattggctgcgggaacctgcattttaccaggtaggcatcctatatatgactactcgcctgatcgtgaatttgtctcaaacctacatggctatgtatctcacctattctttgcatttgccaaagaaatttatcgccaccattccactagtgatgtacttgagcggctttctaagcagcttcctgatgaaacctatcaacaagtgcattgggaggaatatgacttacttctccgggttgctggtgatcttagcatttgctgcctgggttgcgctcgccgaaggcctcggcgtggctgtgtacgccgccgccgtcttactcggagccgggtgcgccacaatcctggtgacgtcacttgctatgaccgcagatctgataggcccccacactaactccggtgctttcgtctatggatcaatgtcttttttggacaaagtggctaacggattagcagttatggcaattcagagcctgcatccttgtccaagcgagctgtgctgtcgcgcttgtgtgtcattctatcattgggctatggtggccgtcacaggaggcgtgggcgttgccgcagccttatgcctctgcagccttttgctttggccaactaggcttcgacgctag

SEQ ID NO: 43218 - DNA, 1617 bp, Artificial Sequence
  Description of Artificial Sequence: Synthetic coding sequence
atgggccccggcccccccgccgccggcgccgcccccagcccccggccactgagccttgtggcccgactcagctacgctgtcgggcatttcctgaacgatttatgcgctagcatgtggtttacgtacttgcttctttatttgcactcagtgcgggcctatagctcaaggggagccggtctgctactgctcctaggtcaggttgctgacggactgtgtactccactggtgggctacgaggccgatcgggcggccagttgctgtgccaggtacgggccccgcaaagcttggcacctcgtgggcacagtgtgcgtgctcctgtcattccctttcattttcagtccctgcttaggctgcggggccgcgacccctgaatgggctgctttgctgtactacggaccttttattgtgatatttcagtttggctgggcatcaacccagataagccacctgagtctgatcccagagctagtgactaatgatcacgagaaggtggaattgacggccctgcgttacgcctttaccgtcgtcgccaacattactgtctacggcgcggcctggctgctcttgcatttacagggcagttctcgggtggaacccacccaggacataagcatatccgatcaacttgggggccaagacgtaccagtcttcagaaatttgtctctgcttgtcgtcggcgttggtgctgtttttagcctgctgttccatctgggaaccagagaacgcagaagacctcacgctgaagagcctggggagcatactcccctgctcgcacccgccacggcgcagccattgttactttggaagcattggctccgagaaccagccttctaccaggtgggaatcttgtatatgaccacccggctcatcgtaaacctttcccagacttacatggctatgtacctgacctatagcctgcatctccccaagaagtttatagcgaccataccacttgtaatgtacctcagcggttttttatcttcgtttctcatgaagcctatcaataagtgcataggtagaaatatgacctattttagtggcttactggtgatactggctttcgccgcgtgggtcgccctggcagaggggctaggcgtcgccgtgtatgcggcagcggtgcttctaggagccgggtgcgccaccattctagtgacttcactagctatgacagccgaccttatcggccctcatacaaactctggagcttttgtttacggtagtatgagctttctcgataaagtggctaatggcttagcagtaatggcaatccagtctctccacccctgtccaagtgagctttgttgccgtgcatgcgtgtctttttatcattgggctatggtagccgtgaccgggggggttggggttgccgcggcgctttgcctttgcagcttactcctgtggcctacaaggctccgacggtccttcctggcctggagacggggtcgaggcgaagataagggacccggttatagttggataccaacagtcctcgttcaaccccccaggcccacatcacctttcttatgggaagcacctctcgcttggcgctgcacccggaagaagtggtccggtgcgggcaccaaaccatggccaagagaagattgggggactcattag

SEQ ID NO: 43219 - DNA, 1239 bp, Artificial Sequence
  Description of Artificial Sequence: Synthetic coding sequence
atgcggggcaagctgctgcccctggccggcctgtacctggtgcagggactcccttacgggctccagtccgggttgctgcctgtgctactgcgagccgggggtctgtcgcttacaagggttgggttagccaaggtcctatatgccccctggctcctgaaactggcctgggcccccctggtagacgcacagggatctgcaagagcctgggtgacgcgctcaacagcgggccttggccttgtgtgcggactgctggctggcctgcccccgcctggcgctggccaagctggtctgccagccgcagtcgccggtctgctgctgttattaaacttaggcgcagccatgcaagatgtggccctggacgctcttgctgtccaacttctcgagcctgccgagcttggacccggcaatactgtgcaggttgtggcttacaagctcggtgccgctctggccggaggcgcattgttagccctgttgccaaccttcagctggccacagctgttccttctgctggccgccacctactggctggcagcagccttggcctgggctgcaccagctctgcgccgccttccacagcagcccccatcagaacagaggcctcatacagcccatctgttacgcgatgtgctggctgtgcctgggaccgtgtggacggcgggatttgtattgacgtataaactgggtgaacaaggagccagtagcctgttccctctgctgctgctggatcatggggtctccgctcctgagcttggtctatggaacggcgtgggagcggtggtctgttccattgcaggcagttcactgggcggcacccttttggctaagcactggaaactcctccctctgctgcgtagtgtgctgcgattcagattgggcggtcttgcctgccagaccgccttggtcttccatctcgacacactgggggcatctatggacgccggcacgatccttaggggtagcgccttattgtcactctgcctccaacatttcctgggcgggctggtgacgaccgtgacatttactggcatgatgcggtgctctcagcttgcaccaagggccctgcaggccactcattacagcctcctggccacactagagcttctgggcaaactgttgctgggaacattggctggcggcctggcggatggactgggacctcatccctgtttcctcttgcttctaattctatccgcctttcccgtcctctacttagatctggccccttctacattcttatag

SEQ ID NO: 43220 - DNA, 1545 bp, Artificial Sequence
  Description of Artificial Sequence: Synthetic coding sequence
atgggctgcgacggccgggtgagcggcctgctgcggcggaacctgcagcccactctgacgtattggtcggtcttcttctcatttggcctgtgcatcgcctttttgggcccaacgctgctcgacctgcggtgtcaaacgcacagctccctcccccagatttcgtgggtattcttctcccagcaactctgcctgctgctgggttcagccctgggcggcgtgttcaagcggacactagctcagagcctgtgggctttatttaccagctccctagccatatccctggtattcgcggttatccccttctgccgtgatgtcaaggtgctggcgtctgtgatggccctcgccggcctcgcaatggggtgcatcgacacagtggcgaatatgcagttggtcaggatgtaccagaaggacagcgctgtgtttctgcaggttctgcacttcttcgtggggttcggggcgttgctgagccctctgatcgccgacccattcttaagtgaagcaaattgtctacccgcaaattccacagccaacactacttcgcgcggccatttgtttcacgtgagcagagtgctgggccagcatcatgttgatgcaaaaccttggagcaatcagacatttccaggactgacacccaaagacggggcaggaactcgggtgagttatgccttttggatcatggcactcatcaatctcccggtccccatggccgttctgatgctgctgtccaaggaacgtctgctcacatgttgtccccagagacgccctctgctgttaagtgctgacgagctggctctggaaactcagccccccgaaaaggaagacgccagcagtcttcccccaaagttccaatctcatctgggacacgaagatctgttttcctgctgccagcggaagaatctgagaggtgcaccatactcattcttcgcaatacatatcaccggggcccttgtcctttttatgacagacggtcttaccggcgcgtactccgcctttgtttattcatatgccgttgagaagcctctgagcgtggggcacaaagtcgccggatacttgccctctctcttctggggctttataacactgggtcggctgctcagtattcctattagctcccgcatgaagccagcaactatggtgtttataaacgttgtcggcgtggtggttacctttctcgtgttgctcatattcagctataatgtggtcttcctgttcgttggtacggccagcttagggttgttcctatccagtaccttccctagcatgctggcatatacagaggattctctgcagtacaaaggctgcgccactactgtgctggtcactggtgctggtgtaggagaaatggtgctccagatgctggtgggatccatcttccaagcccagggatcttatagttttctcgtctgcggggtgatcttcggctgcttggcgttcacattttatattctcctactttttttccacagaatgcaccctggcctgccaagcgtgcctacacaagatagatccatcggaatggaaaacagcgagtgctaccagcgctag

SEQ ID NO: 43221 - DNA, 1284 bp, Artificial Sequence
  Description of Artificial Sequence: Synthetic coding sequence
atgggctgcgacggccgggtgagcggcctgctgcggcggaacctgcagccaactctgacatattggtcagtgttctttagttttgggctctgcatcgctttcctggggccgaccctgctggacctccgctgccagacacactccagtctgccccaaatttcctgggtctttttttcccagcagctgtgtcttctgttaggatccgcactgggaggcgtgttcaagcgaacactcgcacagtccctatgggccttatttacaagttctctggctatcagccttgtcttcgctgtgatacctttctgtcgcgatgttaaagttcttgcgtccgtcatggcgctggccggacttgcgatgggatgtatcgacactgtggctaatatgcagttggtgcgcatgtatcagaaagattccgctgtattcctgcagttgcctgttccaatggcagttctcatgctcttgtcgaaggagaggctcctgacctgttgtccccagaggcggcctctgctgctgtccgccgatgagctggcactcgagacccaaccaccagagaaagaagatgcctcaagccttccgcccaagtttcaaagccacctagggcatgaagaccttttttcatgttgccaacgaaaaaatctcagaggggccccatacagcttcttcgctatccatatcactggagcactcgtgctctttatgaccgatggcctgactggcgcctatagtgcgttcgtctacagctatgccgtggagaagcccctctccgtcggccataaggtggccggctacctgcccagtctgttctggggctttatcacccttggccgactgctgtccattccaatatcctcaaggatgaaacctgcgaccatggtcttcatcaacgtggtaggtgtggtggtgacatttctggttctgctgatcttcagctacaacgtggtcttcctgtttgtgggaaccgcctctctcgggctttttctcagtagcaccttccccagcatgctggcttacaccgaggactcactgcagtacaaagggtgtgctacgaccgtgttggtgacaggcgcaggagtgggcgagatggtgcttcaaatgctcgtcggttcgatctttcaggctcaaggatcctacagctttctcgtgtgcggcgtcatctttgggtgtttagccttcacattttacatcttactgttgtttttccatcggatgcaccctgggctgccatctgtgcctacccaagatcgtagcatcggaatggagaacagcgaatgttatcagcgctag

SEQ ID NO: 43222 - DNA, 1323 bp, Artificial Sequence
  Description of Artificial Sequence: Synthetic coding sequence
atgggctgcgacggccgggtgagcggcctgctgcggcggaacctgcaacctacgctaacctattggagcgtttttttctctttcggcctctgcatcgcattcctggggcccacccttctcgacctgagatgccaaacccactcctcccttccccagatcagttgggttttcttctcccaacagctgtgcctgttgctagggtcagctctggggggggttttcaaacgcactcttgcccagagtctttgggctctgtttacatcttctctggccattagcctagtgttcgccgttattcccttttgtagagatgtgaaagtgctggcctccgtaatggccctcgccggactggccatgggctgcatagacacagtggcaaatatgcagctggtcaggatgtaccagaaggattccgcggtgttcctgcaggtactccacttttttgtgggcttcggtgccctcctgtcacccctcattgccgatccctttctgagcgaagccaactgtctgccagcgaattcaaccgctaacaccactagccgggggcacttgttccatgtaagtcgagtgctggggcagcatcacgtggacgccaaaccttggagcaaccagactttccctggacttacccccaaggacggcgccggtaccagggtgtcctacgctttctggataatggctctgatcaacctgccagtgcccatggccgtattgatgctgctgagcaaggagcgcctgctcacatgttgcccacagcgacgacccttgctcctgagcgccgatgagttagccctagagacccagccccctgagaaggaggatgctagttcactgccacctaaattccaaagccacttgggacatgaagacctgttttcatgctgtcagaggaaaaatctcaggggggcaccatattccttctttgccatccacattacgggcgccctcgtgttgttcatgactgatggcctgaccggtgcatacagcgccttcgtgtacagctacgcagtcgagaaacccctgtctgtggggcacaaggttgctggttaccttccttcgcttttttgggggttcatcactctgggtaggcttctgagcattccaattagctcccgcatgaaacccgcaacaatggtgttcatcaacgtcgtgggcgtagtggtcactttcttagtcctgctgattttcagctataacgtcgtatttctttttgtcgggacggcgagcctcggcctctttttgagcagtacttttcctagcatgctagcctacaccgaggacagcttgcagtataaagacattcccggatcagggcagctgtag

SEQ ID NO: 43223 - DNA, 1299 bp, Artificial Sequence
  Description of Artificial Sequence: Synthetic coding sequence
atggaggtgaccgccgtgggcgaggaggccaaccagggcgacctgttaggctttgggcaaagatgctgtagtttgggttcatctaacccttggctgtaccgaacggcagggatcttccccgaacactgcactgaggagaagaagattgggacatactttcgagtcgcaccacaagcgtctaagtctcagcgatctcggtgtcacggtatggcagccagtgaagcccgcccaggggaggcaacagccgcatcctatggccgcccgtttcctacacacccacggagacaggagtttagggctagggtcgtgagaggcccgactatgttagtgaccgcatatctcgcgtttgtcggtctcttagcctcctgcctaggccttgagctgtcaaggtgcagagccaaaccacccggacgggcttgttccaacccgtcatttttacgctttcagttagatttctatcaggtatatttcctggctctggccgcggattggctgcaagccccctacctgtataagttgtaccagcactactactttctcgagggacaaatcgctattctgtatgtgtgcggactggctagcaccgtcctgtttgggcttgtggcctcgagcctagtggactggttgggcagaaaaaactcctgtgtgctcttctccctcacctacagcctgtgttgcttaacaaagctcagtcaggactatttcgtgcttttggtgggcagggctttagggggactaagcactgcgctcctttttagtgcctttgaggcttggtatattcacgagcatgtcgaacgacatgacttcccagccgaatggatccccgccacattcgcaagagcagctttttggaaccacgttctggctgtcgtcgcaggtgtcgccgcagaagctgtcgcctcttggattggactcggaccggtggcacccttcgtggccgcaatacctcttctcgctttggccggtgcccttgccctgagaaattggggagagaattacgaccgccaacgggccttctccaggacatgcgcggggggcctccgctgcctcctgagcgatagacgtgttttactgctgggcaccatccaggctctatttgaatccgtgatttttattttcgtgtttctttggacccctgtactagacccccacggcgcacccttgggaatcattttttcctcctttatggctgctagtctgctgggctcttctctgtaccggatcgcaacctccaaaagaaccgtcatcgaaaagcaagccctgggcatatgtagcgcttttgcgctactcagttggtag

SEQ ID NO: 43224 - DNA, 1353 bp, Artificial Sequence
  Description of Artificial Sequence: Synthetic coding sequence
atgctggtgaccgcctacctggccttcgtgggcctgctggccagctgtctagggctcgagttatcacggtgcagggcaaagcctcccggacgagcttgtagcaatccatctttcctacgctttcagttggatttttatcaggtgtacttcctcgccctggctgcagattggctgcaggccccttatctctataagctgtaccagcattattacttcctggaaggacagatagccatcctgtacgtatgtggcctcgcaagtaccgtgctgttcggactcgttgcctcaagccttgtggattggctgggacggaagaacagttgtgttttgttttctctgacctactccctctgctgtcttactaagctgagccaagactactttgttctcctggtcggtcgggccttggggggcctgagcactgctctgttatttagcgcgttcgaagcctggtacattcacgagcacgtcgagcgtcacgacttcccagcagagtggattccagcaacattcgctcgtgctgcattttggaatcatgtattggctgttgtggcgggggtagcagcagaagccgtggcctcctggatcgggctgggccctgtcgctcccttcgtcgcagctattcccttgctggctcttgccggcgcactggcgttgagaaattggggcgagaattacgatcggcagcgagcattctctaggacttgcgcaggcggactgcggtgtttgctcagcgaccggcgagtcctgctgcttggcaccatccaggccctcttcgaatctgtgatattcatcttcgtgttcttatggacaccagtgctagaccctcatggagcgcctctgggcatcatatttagcagctttatggcagcatccctgcttggaagttctctataccgcatcgctacatccaagagataccacctgcagcctatgcacctcctgagcctcgctgttctgatcgttgtctttagcctgtttatgctgacattctcgacctcgcccgggcaagaatcgcccgtagaaagctttattgcgttccttcttatcgagctggcttgcggcctttactttcctagcatgagtttcctcaggcggaaggtcatccccgagactgaacaggctggggttcttaactggtttcgcgtaccgctgcactcattagcatgcttaggcttattagtgctgcacgattccgaccggaagaccggaacacgtaacatgttctccatttgcagtgcagtcatggtgatggccctcctagccgtagtaggcttgttcacagtggttcgccatgatgccgagttgagagtcccttcccctaccgaagagccctatgcgccagaactgtag

SEQ ID NO: 43225 - DNA, 1674 bp, Artificial Sequence
  Description of Artificial Sequence: Synthetic coding sequence
atggaggtgaccgccgtgggcgaggaggccaaccagggcgacctgctcggctttggccagagatgctgttctctcggatcatcgaacccttggctctaccgcacggcaggaatcttccctgaacactgtaccgaagagaaaaagatcggaacatatttccgcgtggccccccaagcctccaaaagtcagcggtcacgttgtcacgggatggccgccagtgaagctaggcctggagaggccacagcagcctcttatggacgccccttcccaactcacccaaggcgtcaggaattccgggccagagtggtccgcggccccacaatgttagttacagcgtatcttgccttcgtgggtcttctggcttcatgcttgggcctggagctcagcaggtgtcgcgccaaaccccccgggagagcatgctccaacccttcatttttgcgcttccaactggatttttatcaggtatacttcctggccttggccgccgactggcttcaggccccgtacctgtacaaattgtatcagcattattacttcctggaaggtcaaatcgcaatcctctatgtgtgtggtctggccagcactgtcttgttcggtcttgtggcaagttcactggttgactggctggggcggaaaaactcgtgcgttctttttagccttacgtacagtctctgttgcttaaccaaactctcacaggactactttgtcctgctggtgggtagggccctgggcgggttatcgacagctctgctgttttcagccttcgaggcttggtacattcatgaacacgtggagcgccatgacttcccggctgaatggatccccgctacctttgcccgggccgccttctggaatcatgtcttggctgtcgtggcaggcgtcgcagctgaagccgtggcctcttggatcggcctgggacctgtagcccctttcgtagccgccattcccttgctggccctggccggggccctcgccttgaggaattggggagagaattatgaccgacagagagccttctcaagaacttgcgcaggggggctcagatgtttgctgtccgatcgaagagtcttgctcctcggaactatccaggcactgttcgagtcggtgatctttatatttgtttttctctggacaccggtgcttgatcctcacggcgccccgctcgggatcatcttcagctcatttatggccgcaagcctcctaggctctagcctataccgcatcgcgaccagtaagcggtatcacctgcagccgatgcacctgctgagtctggccgtcctgatcgtcgtgttctctctgttcatgttgacattttctaccagccctgggcaggagtctccagtggaatcatttatagcattcctgctgatcgagctggcgtgtgggctgtactttccatcgatgtcttttcttagacggaaagtcatcccggaaactgagcaggccggcgtcttgaactggtttcgcgtcccccttcacagcctagcctgcttaggactacttgtcctgcatgactctgatagaaagactggcacaagaaatatgttctctatctgtagcgccgtgatggtgatggccctgctggctgtagtaggtctgtttacagtggtgcgacatgacgcagagctccgggtgcctagccctaccgaggaaccttacgcaccagagctgtag

SEQ ID NO: 43226 - DNA, 1395 bp, Artificial Sequence
  Description of Artificial Sequence: Synthetic coding sequence
atggaggtgaccgccgtgggcgaggaggccaaccagggcgacctgctgggatttgggcagagatgctgctctctcggatcatcaaacccatggctgtacaggactgcaggtattttccctgagcactgcactgaagagaagaaaattggaacctacttccgcgtggctccacaggctagtaaatcacagaggtcacgctgtcacggcatggccgccagcgaagctaggcctggcgaagctacggccgctagttacggacggccgtttccaacacaccccaggcgacaggagtttagagctagagtggtccggggccccactatgctagtgaccgcctacctggccttcgtggggctgctagcttcctgtctggggctggagctatctagatgcagggctaagccccccgggcgggcctgcagcaaccctagctttttgaggtttcaactagacttctatcaagtgtacttcctggccctagctgcagactggttgcaagcaccttacctctataaactgtatcagcattattacttcttggaaggacagatcgccatactttacgtttgtggcctggcatctaccgtactgttcgggctcgtcgcttcatcactcgtggactggctggggcgcaagaactcatgtgtgcttttctctctaacatatagcttgtgttgtctgacgaaactgagccaggattactttgtgttactggtgggcagggcgctcggcggtctgagcaccgcgctcctctttagtgcctttgaagcctggtacatccatgagcacgtagagcggcacgactttcccgcagaatggataccagctactttcgctagagccgctttttggaatcacgttctagccgtagttgcgggtgttgctgccgaggccgtcgcgagctggatcggcctcggacctgtggccccgtttgtcgccgctattcccctcctggcactcgctggggcactggccctgcggaactggggcgagaactacgaccgacagcgggccttctcaagaacctgtgcaggcgggctaaggtgcttgctgtctgacaggcgagtcttactacttggtactattcaagctcttttcgaatctgttattttcatcttcgtgtttttatggacaccggtgttggacccccatggcgcaccccttgggatcatattcagctcatttatggcagctagtctgctgggaagttctttgtaccgaatcgccacaagcaagtcagacaggaagacaggtactagaaacatgttcagtatttgttccgctgtgatggtaatggcacttctggccgtagttgggctgtttactgttgtacgacacgatgcggaactgcgcgtgccaagccccacagaagagccttatgctcccgaactgtag

SEQ ID NO: 43227 - DNA, 1761 bp, Artificial Sequence
  Description of Artificial Sequence: Synthetic coding sequence
atgagcgccaacccccggtgggacatcagccgggccctgggcgtggctaagctctttcaccttgtctgtggggtcagagaggcatgtgtgacccctttcttgaccctatatctgcgccagctgggtctggccgctccttgggtgggtactctgatgggaacaaaacatctgatcgccgctttttgggctcccgtctgtgcctttctggccaaaagctaccgaaaaagacgcgccctgttgattggctctctccttggatcggttggggcttcactgctcatggtacttgtgccgccagtggacaagaatagggtccattttccttgcaacggctcttcagggttgacctcgactgacgctttgccaggcgtcacattaccagttaatataacttccgcgcaagagagcgcctcgtcccacccagctaaacgcaccgccgaggtggaaatgccgggcttccggaaccctcctggagagtctgatagggagaccttccgcgacttgcacgtgtacctggcaccatccgtggaaggcgcaagaacaacatcgcaagctctgttacatcctgttacaagtggtctgaaggatcacccctgggaggttaccttcgaggttgtcaagacagcattgcccttgttgccagggggcaaggggcctggaaatccagcaaacctcagcggcactaaaggcaaggcctgggcattcgacctcagtttggaggcactgcgaaggacttttatcttgtcactcgggagcgtggcattctgggaactactgactgctcctcttgagcaggtcgccgacgactccctgtacgaattcttagatttcgttgatgctacggaccggtacagaagtctgtgggtgtggaggcttcttggtatgagtgccggagtttgcggtatcacagccctggtaggccagctggattgctttctgatgaccagtgggcctcggggtgtggtgcatttctacggctatagtgtagtgagcaccctggctttactagtctcaatagcttttcccatcccaatttgccagcagtgggaaccaagctataaaagggtgaaggccctctcaattgtcggaggcgacccccacctgatcttgttggcatccactaccgtgctggtgggagccatcgtcagcactgtccagaacttcttattctggcacatgaaggaccatggatccggggagctggttatggggttctctgtagccttatctctgctgggtgaaatcttattgcacccgtttaaagcgacgctattgagaaaacttagccgcacaggactggtagggttaggactgtcttgcctagccggtcagctactatattattctttcttgtggtcgtggtggagtgtgttgcctatccagatcctcagcgccatctctaacagggcactgtggtgggctgtcggagctagcgtagaagatcttgccaccccacgcatggaaagggcactgtcggccctgttccgcgggcatttctacgggtcaggctgctcattgggtagctttgttggcgggttcgtggttatgcgcttctcactggcagtgctgtaccaggcctgttgtgtggccctgttgctttggctggctcttctgttgtctatccaacggcggctgcccagggagcggaagataaagtattcaaagctgctctctatggaggtgtccgatacctcggacagcgagcagggcactgaacaggattggctggtaaaagcaatgcgcgaggagcactcggactag

SEQ ID NO: 43228 - DNA, 1680 bp, Artificial Sequence
  Description of Artificial Sequence: Synthetic coding sequence
atggccggccccaccgaggccgagaccggcctggccgagccccgggcgctgtgtgcccagagaggacaccgtacatatgcaaggaggtgggtcttcctgctggccatctcactattaaactgttccaacgcgaccctgtggctgtctttcgcccctgtcgctgatgtgatcgctgaggaccttgtactgagcatggaacagatcaactggctatctttagtctacttggttgttagtaccccttttggggttgcagctatttggatcctagactccgtgggactgcgcgccgccactatcttaggggcatggcttaattttgcaggttcagtgctgaggatggtcccgtgtatggtggtaggcactcaaaaccctttcgcatttcttatggggggtcagtccctgtgcgcgctcgcgcagagcctcgtcattttttcgcctgccaaactggccgcactatggtttcccgagcaccaacgtgccaccgcaaatatgcttgccaccatgagtaacccgctgggcgtgttggtcgcaaacgtcctttcaccagtgttggtgaaaaaaggtgaggacatcccgctaatgctgggggtgtacaccatcccagccggcgtggtgtgccttctctcgactatttgcttgtgggagtctgttcctcctactcctccttctgctggcgccgcctcctctacatctgagaaatttctggacggactgaagctgctcatgtggaataaggcctacgtgatcctggccgtttgcttgggcggcatgattggcatctctgctagcttctctgctctgctcgagcagattctgtgcgcgtctgggcatagctccggattcagcggcctatgtggcgccctgtttattaccttcggcattctaggggcattggctttaggcccttacgtagacaggactaaacactttacggaggcaaccaaaatcgggctctgtcttttcagcctggcatgcgtgcccttcgcactggtctctcagttgcaaggccaaaccttggccttggctgcaacttgttctttacttggtcttttcggattcagcgtcggacccgtagccatggagctcgctgttgagtgttctttcccggtgggagagggagcggccaccggcatgatctttgttctgggacaggctgagggcatcctaattatgttagccatgacagcactaacggtccgccggtctgaacctagcctttcaacatgccaacaaggcgaggaccctttggactggaccgtgagtctgcttctgatggcgggcctgtgcacattcttcagctgcatcctggcagttttctttcataccccctataggcgactgcaggcggagtcaggagagcctccatcaacacgcaacgcagtggggggagccgactccgggcctggggtcgaccgtggcggggcaggcagagcaggtgttctcggccccagtacggcaaccccagagtgcaccgccagaggagccagcttagaggaccctcggggccctggctccccacacccagcctgtcaccgcgctacccctcgcgcccaaggtccagctgctaccgacgccccatctaggcccggtaggctcgccgggagggtgcaggcttcacgttttatcgatccagcaggatcgcattccagcttttccagcccatgggtcatcacatag

SEQ ID NO: 43229 - DNA, 1326 bp, Artificial Sequence
  Description of Artificial Sequence: Synthetic coding sequence
atggccggccccaccgaggccgagaccggcctggccgagccccgggctctctgtgcccaaaggggtcatagaacatatgcaaggcgctgggtgtttctgctcgcgattagtcttctgaattgcagcaacgctactataaactggctcagtctggtgtacttagtggtaagcacgcccttcggggtggccgcaatttggattttagacagcgtgggtttacgcgcggcgttaggcgtgtataccattccagcaggcgtggtgtgtttgttaagcacaatctgtctctgggagagcgtaccccctacacccccctcggcaggcgctgcttcttccacatctgagaagttcctggatggcctaaagctgcaactgatgtggaataaagcttacgttattttagccgtttgcctgggaggcatgatcgggatttccgcttccttctccgctctcttggagcagattctctgcgccagcgggcatagctcagggttcagcggtctgtgcggggcccttttcattacatttggtattttgggcgccctcgctctcggaccttacgtcgacagaacaaaacattttaccgaggctactaaaattggcctgtgccttttttccctggcctgcgtcccattcgccctggttagccaattgcagggccagaccctggcactggcagcgacctgctcacttctcggcctgttcggcttttccgtgggaccagtggccatggaattggcggttgaatgtagtttcccagtgggtgagggtgccgcgactgggatgatcttcgtcttgggccaagccgagggcattcttattatgctcgctatgaccgccctgacagtccggcgttcagagcctagcttaagcacgtgccagcagggagaagatccgctggattggactgtctctttactgctgatggccggactgtgcacctttttcagttgtattttagctgtctttttccacaccccataccgccgtttacaggcagagagcggggagccacctagtactaggaatgctgtggggggggccgattccgggcccggcgtcgatagaggaggcgcagggcgcgctggtgtcctgggaccttccaccgccacccccgaatgtacagcacggggcgcctcactcgaagatccgcgagggcccggttcaccacaccctgcctgtcatcgggccacacctcgggcacagggccccgccgccaccgatgctccgtctcggccgggccgattagctggcagggtgcaggcgtctcgtttcatagatcccgcaggcagccattcatcgtttagctcgccatgggttataacatag

SEQ ID NO: 43230 - DNA, 1683 bp, Artificial Sequence
  Description of Artificial Sequence: Synthetic coding sequence
atggccggccccaccgaggccgagaccggcctggccgagccccgggccctttgcgcccagaggggccaccgtacttacgcaaggaggtgggtattcttgctcgctatttccctgctgaactgttccaatgccaccctttggttgagttttgcacccgtcgcagacgtgatcgctgaggaccttgtcctttctatggagcagatcaactggctgtcactggtttacctggttgtgtccacacccttcggcgtggcagcaatttggatcttagattcagtcggtctccgcgccgctactatcttaggcgcctggctgaactttgcgggatctgtgttacgcatggttccctgtatggtcgtgggcacccagaatccttttgcattcctaatgggcggacaaagtctttgcgctctagcccagtccctggttatttttagtccagcaaagctagccgccctctggttcccagaacaccagagggccaccgctaatatgctggctaccatgtccaaccccctgggggtcctggtcgcaaatgtactatctcctgtcctggtgaaaaagggcgaagatatcccattgatgctcggagtgtacactatcccagccggtgtggtctgcctgctgtcgaccatatgtttgtgggagtcggtgcccccaacccccccttctgctggagccgcctcctccacatccgagaaattcttggatggtctgaagttgcagttaatgtggaataaggcctatgtaattctggcggtgtgtcttggcgggatgatcggcatctcagcttctttttccgccctgctggagcagatcctgtgcgcctctggtcactcctccggcttctcagggctgtgtggcgctttatttatcacctttggcatccttggcgccttagcgttgggtccgtacgtggatagaacaaaacactttactgaagctacgaaaataggcttatgtctttttagcctagcgtgcgtgcccttcgccctggtctcacaattgcagggccagactctggcactagcggccacatgctcccttctcgggctcttcggatttagcgtcggccccgttgccatggagctcgctgtcgagtgtagtttccctgttggtgagggagctgctacggggatgatatttgtgctggggcaagcggagggaatcctcattatgctcgctatgacagctctcaccgtgagaaggagcgagccatccctctcgacatgtcaacagggggaggatccacttgactggacagtatcacttcttcttatggccggtctttgtacttttttctcctgcatcctggccgtgttttttcatacaccttacaggagacttcaggccgagtcgggggaacctcccagcaccagaaatgccgttggaggcgcagactccggcccaggcgtcgaccggggaggtgctgggcgtgcaggcgtgctaggtccgtcaactgcaaccccggaatgtaccgcacgcggggcctccctcgaggacccccgaggtcctggttcgcctcaccccgcctgtcaccgagctactccacgtgctcaaggtcctgcagcaactgacgccccttctaggccggggcgattggcaggacgggtccaagcttctaggttcatcgacccagctggttcgcacagttctttctcctcaccttgggtgatcacctag

SEQ ID NO: 43231 - DNA, 1425 bp, Artificial Sequence
  Description of Artificial Sequence: Synthetic coding sequence
atggagctgggcggccactgggacatgaacagcgccccccggctggtgagcgagacagcagagcgaaagcaggagcagaagacagggacagaggcagaggcagccgatagcggcgcagtgggagcccgccggttcctgctgtgcttgtacctggtcggatttttggatctttttggcgtttctatggtggtgcctctccttagtctgcatgtcaaaagtctgggagcctctcctacagtggctggcatagtcggctcaagctatggaattctgcagctattcagctccacgctggtcggatgttggtcggatgtggtggggaggcgttcttccctgttggcttgcattctgctgagtgccctcggctacctcctgctgggcgcagcgacaaacgtgtttctattcgtgctggctcgggtacccgccgggatcttcaaacatacgctgtcgatctcccgagcactcctgtctgatgttgttcccgagaaggagaggcctttggtaattgggcatttcaacacagcctccggcgtcggctttatcctgggacctgtggtcggaggctatctgacggaactggaggacggtttctatctgactgctttcatttgtttcttggtgttcattctgaacgccggcctcgtctggtttttcccttggcgggaggcaaaacccggttctacggaaaaaggattgcctttgagaaagacacacgtgttgctaggcaggtcccacgataccgtgcaggaggccgccacctcaagaagagctcgggccagtaaaaaaacagcacaaccctgggtcgaagtggtgctagccttacggaacatgaaaaacctcctgttctcggagatgtgggacatattcctggtgagactgctgatggccatggcggtaatgctgtactattcaaattttgtgcttgcccttgaggaaagatttggcgtgcgtccaaaagtgaccggctatctcatcagctactcaagcatgctgggcgccgtcgccggcctggcgctggggccaatcctccgcctgtataaacataatagccaagctcttcttctccacagctccatactcacgtgtactctcctgctgctttacagtttggctccaacgatgggcgcggtggtcctaagctcaacactcctcagtttcagcacagcaatcggacgcacgtgtattaccgaccttcaactcacagtgggaggtgcacaggccagtggtacccttatcggggtgggccaatctgtcaccgccgtcgggaggatcattgccccactactgagtggggtagcccaagaagttagcccgtgcggaccgccgtcactaggggcagtcctagcattagtggccatcttcatcatgagccttaataagcggcacagcagtggcgacggaaacagtaagcttaaatcagagtag

SEQ ID NO: 43232 - DNA, 465 bp, Artificial Sequence
  Description of Artificial Sequence: Synthetic coding sequence
atggccgtgatggccccccggaccctgctgctgctgctgagcggcgctctcgctctgacacagacgtgggcaggctcacatagcatgagatacttctttacatcagtgagtaggcccggacggggtgaaccaaggttcatcgccgtcggatacgtggacgacacacaattcgtgcgctttgacagcgatgctgctagccagcggatggaacctcgggcaccctggattgagcaggagggcccagagtactgggaccaggagacaaggaatgtgaaagctcagtcccaaacagatcgcgttgatttgggcaccctgcgaggttattataaccagtccgaggccggctcgcacaccattcaaatcatgtatggctgcgacgtgggttctgacgggcggtttctccgagggtaccgtttgcgatccccttctgccagcggacgtcgtcccatgaggcggagctcttag

SEQ ID NO: 43233 - DNA, 900 bp, Artificial Sequence
  Description of Artificial Sequence: Synthetic coding sequence
atggccgtgatggccccccggaccctgctgctgctgctgagcggcgcgctcgcgttaacccagacctgggcagggtctcacagcatgaggtacttttttacttcagtcagcaggcccggacgcggcgagcccagattcatcgccgtgggctacgtcgatgacacacaattcgtacggttcgactctgacgctgctagtcagcgaatggagccacgggccccctggatagagcaagaagggccggagtactgggatcaggagacgcgcaacgtgaaagcccagagtcagactgatcgtgttgacctggggactctcagaggctactacaaccaaagcgaagcaggatctcacaccattcaaatcatgtatggctgtgatgtgggttcagacggcagatttctgcggggttaccgacaagatgcttacgatggcaaggattacatcgcccttaacgaggacctgcgctcctggactgctgccgacatggcagctcagatcacaaagcggaagtgggaggccgcccacgaggctgagcagcttcgcgcttatctggacggaacttgcgtggagtggctgagacggtatctggagaatggaaaggagacgctccaaaggaccgatccacccaagacccacatgacgcatcaccccattagcgatcatgaagccaccctgcggtgctgggcactgggcttctaccctgccgagattaccttgacttggcagcgtgatggagaggaccaaacgcaggatacggaactcgtggaaacaagaccagcaggagatgggactttccaaaagtgggcagcagttgtggtgccttcgggggaagaacagcgatatacatgtcacgtccagcacgaaggcctgcctaaaccactgaccctgaggtgggtgtag

SEQ ID NO: 43234 - DNA, 1116 bp, Artificial Sequence
  Description of Artificial Sequence: Synthetic coding sequence
atggccgtgatggccccccggaccctgctgctgctgctgagcggcgcgctggccctgacccagacttgggcagggagtcattccatgaggtatttttttacatcggtgtcacgccccggcagaggcgaacctaggtttatcgcggttgggtacgtggatgacacgcagttcgtgcggttcgacagcgatgccgcctcacagaggatggaacctagagcgccatggatagaacaggagggccctgagtattgggaccaagagacaaggaatgtaaaggcacaatcacagacagatagggttgatctaggaactctccgcggctattacaaccagagcgaggcagggagtcacactatccagattatgtacggatgtgacgtgggaagcgacgggagatttctccggggctaccggcaagacgcttacgatgggaaggactacatcgccttgaacgaagatctacgcagctggactgccgctgatatggcagcccagatcacaaaaaggaagtgggaggccgcccacgaagcagaacagctgcgggcatacctcgatggcacatgcgttgaatggttacggcgatacctggaaaatggcaaggaaaccctgcaacgtaccgacccccctaagacgcatatgacacatcaccctataagtgatcatgaagccacactccgttgctgggcactcggattctacccagctgagatcacactgacatggcagcgcgacggagaggaccaaacccaagataccgagttggtcgagactcgaccagccggcgatggcactttccagaaatgggccgctgtggtagtaccatcaggcgaggaacaacggtacacctgccacgtacagcacgaaggactacccaagcccctgaccctaagatgggaactctcctcccagccaacaattcccatcgtggggatcatcgcgggcttggtacttcttggagccgtgattacaggagccgtcgtggcggctgtaatgtggaggagaaagagttctgggggcgagggagtaaaggatcggaagggtggaagctatacgcaggcggccagcagcgattccgcacagggtagcgatgtgagcctgacagcatgcaaggtgtag

SEQ ID NO: 43235 - DNA, 1098 bp, Artificial Sequence
  Description of Artificial Sequence: Synthetic coding sequence
atggccgtgatggccccccggaccctgctgctgctgctgagcggcgccctggccctcacccagacctgggccggaagccattccatgaggtatttctttaccagcgtatctcgtcctgggcggggggagcctcggttcatagctgtcgggtacgtagatgatactcagtttgtgcgcttcgacagtgacgccgcctcccagcgaatggaaccccgggcgccctggattgagcaggaaggaccagaatattgggaccaggagactaggaacgtgaaggcgcagagtcagaccgacagagtcgacttgggcactcttcgcgggtactataatcagtcagaggccggctcgcacaccatacagatcatgtatggctgtgacgtcgggtccgatgggcggtttcttaggggctacagacaggacgcttacgacggaaaagattacatagccctgaatgaagacctgagatcttggacagcagcggatatggccgctcagattacaaagcgcaaatgggaggccgcacatgaggctgagcagctgcgcgcatatctggacgggacatgtgtggagtggctaaggcgctatctcgaaaatggaaaagaaactcttcagaggaccgatcccccgaagacccacatgacacaccaccctataagcgatcacgaggcaacactgcgctgttgggccctgggcttctaccccgccgagattaccttgacctggcagcgagatggtgaggaccaaacacaggacacagagctggtggagacccgaccagctggcgacggcaccttccagaaatgggccgccgtggttgtaccctccggagaagaacaaaggtatacatgtcatgtgcagcacgagggactgccgaagcccctgactctgcgctgggaattgtcttctcagcctacaatacctatagtggggattattgctggccttgtgctgctgggggccgtgatcactggggcagtggtggctgccgttatgtggaggaggaagtccagcgaccggaagggcgggagttacacacaagcagcatcctcagacagtgcgcaaggcagtgatgtgtccctgaccgcctgcaaagtttag

SEQ ID NO: 43236 - DNA, 900 bp, Artificial Sequence
  Description of Artificial Sequence: Synthetic coding sequence
atggccgtgatggccccccggaccctggtgctgctgctgagcggcgctctggccttgacacagacttgggcaggtagccattccatgcggtatttctatacctctgtctcacggcctggacgcggcgagccgcgatttatagctgttggatatgtggatgacactcagttcgtccgcttcgatagtgacgctgcgtctcaacgaatggagccacgggccccttggattgagcaggaggggcctgaatattgggataggaatacaaggaacgtgaaggcccattctcaaactgatagggctaatctggggaccctcagaggctactacaatcaaagcgaggatggctcacataccatccagcggatgtatggctgtgatgtgggtccagatggccgcttcctccggggataccagcaggatgcctacgatgggaaagactatattgctctgaatgaagatctccgctcatggacagcagcagacatggcggctcagatcacacagcgaaagtgggagaccgctcatgaggctgaacaatggagggcctacctggagggacgttgcgttgagtggcttcggcgctacctcgagaacggcaaagaaactctacaacgcactgacgccccgaaaacacacatgactcatcacgccgtttccgatcacgaagctactcttagatgctgggcgttatctttttaccccgcagagataaccctgacgtggcagcgggatggtgaggaccaaacacaggacaccgagctcgttgaaacccgccccgcaggtgatggaacgtttcaaaaatgggcgagcgttgtcgtgccctcgggacaggaacaaagatacacttgccatgtccagcatgaagggcttccgaaaccgctgacactgagatgggtttag

SEQ ID NO: 43237 - DNA, 1098 bp, Artificial Sequence
  Description of Artificial Sequence: Synthetic coding sequence
atggccgtgatggccccccggaccctggtgctgctgctgagcggcgcattggcccttacccagacctgggccgggtcccattccatgaggtacttttacacctctgtgtctcgccctggtcgaggtgagcctcggtttatcgcagtgggatacgtggacgatacccaatttgtcaggttcgattctgacgccgcctcacagagaatggaacctagggccccatggattgaacaagagggccccgaatattgggacaggaacacacgcaacgttaaagcacacagtcagaccgaccgtgccaatctggggacactacgaggctattacaaccagtcagaagatggctcccacacaattcaacggatgtacggatgtgacgtcggcccagacggccggttccttcgtggctatcagcaggatgcatatgatggtaaggattacatcgcgctgaatgaagacctgcggtcttggactgcagctgacatggctgcccagatcacgcagagaaaatgggaaaccgcccacgaagcggaacaatggcgtgcctatctcgagggcagatgcgtggaatggctacgccgatatcttgaaaatgggaaagagaccctccaaagaactgacgcaccaaaaacccatatgacgcaccacgccgtctcagaccatgaggccactctgaggtgttgggccctgtccttctacccagctgagatcactcttacctggcaacgggatggcgaggaccaaacacaggacacagaacttgtggagactcggcctgccggggacggaacattccagaaatgggcatctgttgtggtccctagcggccaggagcagcggtacacatgtcatgtccaacacgaggggctgcctaaaccactgacactacggtgggaacctagcagtcagcctacgatcccaatcgtggggattattgctggcctggttctgtttggtgctgtgatcgccggcgccgttgtggctgccgttatgtggcggaggaagtcatcagatcgtaaaggcggaagttactctcaggcagcctcttccgattccgcccagggcagcgatatgagtctgaccgcctgcaaggtatag

SEQ ID NO: 43238 - DNA, 1116 bp, Artificial Sequence
  Description of Artificial Sequence: Synthetic coding sequence
atggccgtgatggccccccggaccctggtgctgctgctgagcggcgccctagcactcacccagacttgggccggctcacactcaatgaggtatttttacactagcgtttcccgcccagggaggggcgagccaaggttcattgcggtggggtatgtggacgacacccaattcgtcagattcgattcagatgctgccagccaaaggatggagcctagagccccatggatcgaacaggaaggaccggagtattgggaccgcaacacccggaatgtgaaggctcacagtcagaccgaccgtgcgaaccttgggacgttgcgcgggtactataatcagtccgaagacggatcgcacaccatacagcgcatgtatggatgtgatgttggcccggacggtaggttcctccggggataccagcaggacgcatacgacggaaaagactacatcgcgttaaacgaggaccttcgctcctggacggccgctgacatggccgctcagatcactcagagaaagtgggaaaccgcccatgaggctgaacagtggagagcctacctggaaggcagatgcgttgagtggctgcgacgatacctcgaaaatggcaaggagaccctgcagaggacggatgcaccaaagactcatatgacgcaccacgctgtctccgatcatgaggctacccttagatgttgggccctgagcttttaccctgcagagattactctgacctggcagcgggatggcgaggaccaaacgcaggatactgagctggtggagactaggcccgcaggagacggcactttccaaaaatgggcttccgtggtggtgcctagtggtcaggaacaacgttacacttgtcatgttcagcacgagggactgcctaagcccctgaccctaaggtgggagcccagctctcagcctaccattccaatcgtagggataattgccggtctggtgctgttcggtgccgtgattgctggcgccgtcgtggccgcggtgatgtggagacgaaagtcctctggtggcgaagggatgaaggataggaaaggcggctcctacagtcaagcagcttcctcggattccgcccaggggtcagacatgtcgttaaccgcgtgcaaagtgtag

SEQ ID NO: 43239 - DNA, 1098 bp, Artificial Sequence
  Description of Artificial Sequence: Synthetic coding sequence
atggccgtgatggccccccggaccctgctgctgctgctgagcggcgctctggccctgacccaaacctgggcaggatcccattctatgaggtacttttttacctcagtgtccaggccaggtcgaggcgaacctagattcatagctgtcggctacgtggatgacacacagttcgtgcgcttcgacagtgatgcggcaagtcagagaatggaaccccgtgctccctggatcgagcaagaggggccagaatactgggaccaagagactcgcaatgtcaaggcccagtcgcagacggatcgagtggatcttggtacacttcggggatactataaccagagcgaggctggatctcatacgattcagattatgtatgggtgcgacgttggctcagacggccgcttccttcgcggatatcgccaggatgcctacgacgggaaggactacatagccttaaacgaagaccttagaagttggacagcagccgacatggccgcccaaataaccaagagaaagtgggaggctgcgcatgaagccgagcaactgagagcttacctggacggcacttgcgtggagtggctgagaaggtacctagagaatggcaaggaaactctacaaaggaccgatcccccaaagacacacatgactcaccatccaatctcagaccatgaagctacccttaggtgctgggcactaggcttctatccagccgagataaccctgacctggcaaagagatggagaggatcagactcaggacacagaacttgtcgaaacgcggccagcaggcgacgggacgtttcagaagtgggccgccgtggtcgttccgagcggggaggagcaaagatacacatgccatgtccaacacgaaggattgccgaagccactgacactgcgatgggaattgtcaagtcagcccaccatccccattgtcggcatcatcgcaggactcgtgttactgggcgctgtgattacaggggctgtggtcgcagccgtcatgtggagacgaaagagctccgataggaagggtggcagctatacacaggccgcctccagtgacagcgcacagggtagcgacgtctctctgacagcttgcaaggtgtag

SEQ ID NO: 43240 - DNA, 900 bp, Artificial Sequence
  Description of Artificial Sequence: Synthetic coding sequence
tgagccgtgatggccccccggaccctggtgctgctgctgagcggcgctctcgcccttactcagacatgggcaggaagtcacagcatgagatacttctttacctctgtgagccgaccgggcaggggggaaccccgcttcattgcggtagggtatgtggacgatacacagtttgtccgttttgacagtgatgccgcctcacagaggatggagccaagggctccttggatcgagcaggaaggacctgagtactgggatggagagaccagaaaagtgaaggcccacagccagacccaccgagtcgacctggggaccctccgaggatattataaccagtctgaggctggctctcacacagttcagagaatgtacggctgcgacgtgggctcagactggagatttctcagaggatatcaccagtacgcctatgacggtaaagactatattgccctcaaggaagaccttcggagttggaccgccgccgacatggcagcacaaacaacgaaacacaagtgggaagcagctcacgtggcagagcagcttcgggcatacttggagggaacctgtgtggagtggctcaggcggtacttagagaatggcaaggagacattacagcggaccgacgctccaaaaactcacatgacgcatcatgccgtaagcgaccatgaggccaccttaagatgctgggcgctgtccttttacccggcagagataacacttacatggcagcgggatggtgaagatcagacccaggataccgagctggtggagacaagacccgctggtgatgggacgtttcagaagtgggcggctgtggtggtgccgtccggacaggaacagcgatatacctgccacgtgcagcacgaaggccttcccaaacctcttacactcaggtgggtgtag

SEQ ID NO: 43241 - DNA, 900 bp, Artificial Sequence
  Description of Artificial Sequence: Synthetic coding sequence
atggccgtgatggccccccggaccctgctgctgctgctgctgggcgctctggcactgactcagacctgggcaggatctcactctatgcgctatttttttacctctgtgtctcgccccggccgtggtgagccaaggtttatcgcagtggggtatgtcgatgatacccaattcgtgcggtttgatagcgacgcagcatctcagagaatggagccccgggctccttggattgagcaggaaggaccggagtactgggatcaggaaacgaggaacgtgaaggctcactcccagactgatagggaatccctgagaattgcgttgagatattataaccagtcagaagccggatctcatacaatacagatgatgtacgggtgcgacgtgggcccagatgggagactgttgagaggctatcaacaggatgcctacgacggaaaagactacatagcactgaatgaggatctgcgttcatggactgcggctgacatggctgcccagattacccagagaaagtgggaagccgccagggtggccgaacagcttagagcataccttgaaggtacctgcgtcgaatggttgcgtaggtatcttgagaatggaaaggagacccttcagagaaccgacgcccctaagacacacatgactcatcatgcggtctctgaccatgaggccaccctcaggtgctgggctctttccttttaccctgctgaaatcacgttgacttggcagagagatggagaggaccagactcaggacactgaattggtggagactcgacctgctggcgacggcacatttcagaagtgggcctctgttgtagtgccctctggacaggaacaacggtacacctgtcacgtgcaacatgagggattgcctaagccactgacattacggtgggtgtag

SEQ ID NO: 43242 - DNA, 900 bp, Artificial Sequence
  Description of Artificial Sequence: Synthetic coding sequence
atggccgtgatggccccccggaccctgctgctgctgctgagcggcgcactagccttgacacaaacctgggccggttctcactctatgaggtactttttcacatcagtgagtaggccgggccgcggagagccgcgatttatcgcagtcggatatgtcgatgacacgcagttcgtgagattcgacagtgacgcagcttcccaaaaaatggagccacgggccccctggatagagcaggaagggcctgagtactgggaccaggagaccagaaatatgaaggcccatagccagaccgatcgagcaaatctgggtacgctgcgcggatattacaatcagtctgaggacggatcccatacaatccagatcatgtacgggtgcgacgtgggtccagatggacgcttcctgagagggtatcgtcaggacgcttacgatggaaaggattatattgcactcaacgaggacctgcggtcatggactgcagccgacatggcggcacagatcactaagcggaaatgggaggccgtgcacgcagcggagcagcgaagggtctacctcgagggtcgatgtgtagacggattgagaagatacctagaaaatggcaaagagactctccagcgaaccgatcccccgaagacacacatgactcatcaccccatctccgatcacgaggctaccctgaggtgctgggctcttggcttttatccagcagagattactctaacttggcagcgcgacggcgaagaccaaacacaagacaccgagctggttgagacacggcctgcgggggatggaacattccagaaatgggctgccgtcgtagtccccagtggagaagaacaaaggtatacctgccacgtgcaacatgaaggactgccaaaacctcttacactgaggtgggtatag

SEQ ID NO: 43243 - DNA, 1116 bp, Artificial Sequence
  Description of Artificial Sequence: Synthetic coding sequence
atggccgtgatggccccccggaccctgctgctgctgctgagcggcgctctggctctgacgcagacttgggccgggtcccactctatgcgctattttttcaccagcgtgtcccgtccaggaagaggtgaaccacgcttcatcgcagtggggtacgtagacgacacccagttcgtcagatttgactctgatgctgcatcacagaagatggagccgagagctccgtggattgagcaggaaggccccgaatactgggaccaggaaacccgaaatatgaaggcacacagccagactgatcgcgccaatcttggcactctgagaggatactataaccagtctgaagatgggtcccacactatccagatcatgtacggatgcgatgtgggacctgatggccgttttctccgaggatacagacaagacgcctacgacggaaaagactacattgctctgaacgaggacctgcgctcttggaccgcagccgacatggctgctcagattaccaagaggaaatgggaggctgtccatgcagcggagcagcggagggtatacttggaggggcggtgcgtggacggactccgtcgttacctcgagaatgggaaggagactctccaacgaacggatccacccaaaacgcatatgacccaccatccaatttcagaccacgaggccactcttcggtgttgggcgcttggtttctatcccgcagaaataacgctcacatggcagcgggatggcgaggaccagacacaggatactgagctcgttgagacacgccctgccggggacggtaccttccagaagtgggctgcagtagttgttccctccggcgaggaacaaaggtacacttgtcacgtgcagcacgaagggctgccaaaaccactcactcttcggtgggagttgtccagtcaacccacaatcccaattgttggaattatcgcaggccttgtgttgctaggggcagtcattacaggagccgtcgtcgcagcggtcatgtggcggcggaagtcctctggaggagagggcgttaaggatagaaaaggtgggtcttatacacaggctgcaagctccgacagtgcacagggtagtgatgttagcctcactgcttgtaaagtctag

SEQ ID NO: 43244 - DNA, 1098 bp, Artificial Sequence
  Description of Artificial Sequence: Synthetic coding sequence
atggccgtgatggccccccggaccctgctgctgctgctgagcggcgctcttgccctcactcaaacttgggctgggtcccacagtatgcgttacttcttcacctcagtatcaaggcccggcagaggcgaaccaaggtttattgccgtgggatatgtcgatgatacacaatttgttagatttgactctgatgcggccagccagaagatggaaccaagggccccctggattgaacaggagggccccgaatattgggatcaggaaaccaggaatatgaaagcccattctcagacagaccgcgccaatcttgggaccctgcgggggtattataaccagtcagaggatgggagccatacgatccagatcatgtacggctgtgatgtgggcccagacggtagattcctgagaggttatcgccaagacgcctacgatggcaaagattatattgcactgaatgaagatcttcgttcttggactgcagccgacatggccgcgcagatcacgaaacggaagtgggaggccgtgcacgccgccgaacagcgccgggtgtaccttgaggggcgctgtgttgacggacttaggcggtacctcgaaaatggcaaggaaactctgcagcgcaccgatccacccaagacccatatgacacaccatccaatttctgatcatgaggcaactctgaggtgttgggctctcggattctacccagctgagatcaccctgacctggcagcgtgacggcgaggaccagacccaagacactgagctcgtagagacccggccggccggggacggtacatttcagaagtgggccgccgtagtcgtgcccagtggggaagagcaaagatatacatgtcacgtccagcatgagggcctgccaaaacccctgacactgcggtgggagctgtcctctcagccgacaatcccaatagtgggcatcatcgcaggcttagtcctccttggtgcggtcattacgggcgccgtggtagcagctgtcatgtggcgtcgcaagtccagcgaccggaaggggggtagttatactcaggctgcaagctccgactctgcacagggctccgacgtgagcctgactgcttgcaaagtttag

SEQ ID NO: 43245 - DNA, 1116 bp, Artificial Sequence
  Description of Artificial Sequence: Synthetic coding sequence
atggccgtgatggccccccggaccctggtgctgctgctgagcggcgccctggctcttactcagacttgggccggctctcacagcatgagatacttctttacatctgtgtccaggcctgggaggggcgaacccagatttattgcagttggatacgtcgacgatactcagtttgtgcgctttgactcagacgctgcaagtcagaggatggaacctcgcgcaccatggattgagcaggaaggcccagagtattgggacggagaaacccgcaaagtgaaagcccatagtcaaacccacagagttgatctaggtaccctacgtgggtactacaatcagtccgaagccggctcccataccgtgcagcgcatgtacggatgtgacgttggatcggactggcgcttcttgcgcggttaccaccagtatgcatacgatggtaaagattacatcgcattgaaggaggacctgagatcgtggacagcggccgatatggccgcccagacaactaagcacaagtgggaggcggctcatgtggccgagcagctgagggcttatctggaaggcacatgcgtggaatggctgcggaggtacctcgaaaatggaaaggaaaccctgcagcggaccgatgcccccaagacccacatgacccatcatgcggtttctgaccacgaggccacactgcgttgctgggccctttccttctaccctgccgaaatcactcttacctggcagagggatggtgaggatcaaacgcaagatacagaactggtcgagaccaggcctgctggagacggtacatttcaaaaatgggcggctgtggtagtgcctagtggacaggaacaacgatacacatgtcatgttcagcacgagggcttgcccaagccattgaccctccggtgggagccatcaagtcagcccaccattccaatagtcgggattatcgctggcctagtactgtttggggcagtgattactggcgcagtggttgctgcggtgatgtggcgacggaaatctagcggcggcgaaggagtgaaagataggaagggggggtcctacagccaggccgcgagttccgactctgctcagggaagcgatgtttctctcacagcttgcaaagtttag

SEQ ID NO: 43246 - DNA, 900 bp, Artificial Sequence
  Description of Artificial Sequence: Synthetic coding sequence
atggccgtgatggccccccggaccctgctgctgctgctgagcggcgctctcgcactgacacagacctgggccgggagtcactcaatgagatatttcttcactagcgtgtccaggccaggaaggggagaaccacgctttatagccgtgggatatgtcgacgatacccagttcgtgcgtttcgactccgatgcagcaagccagaaaatggaaccaagggctccatggattgaacaggaaggccccgagtattgggaccaagagacaaggaatatgaaagcccatagtcagacagatcgtgccaacctcggtaccctgcggggatactacaaccagagcgaggacggctcacacaccatacaaataatgtacggatgtgacgtgggtcccgacggacgcttcttacgaggataccggcaggatgcttatgatgggaaggattatatcgctctgaacgaggacttgaggtcctggacagccgccgatatggccgctcagattacaaagcgaaagtgggaggccgtacatgcagctgaacagagacgcgtataccttgaaggccggtgcgtcgatgggctgcgccgctacctggaaaacgggaaggaaactctgcagcggactgatcctccaaagacacatatgacacatcatcctatatccgatcacgaggccaccctcagatgctgggctctcggtttctatcccgcagaaataaccctgacatggcagagggatggagaggaccagactcaggataccgagctggtggagacgcggcccgcaggagacgggacatttcagaaatgggccgcagttgttgttccatccggcgaggagcagaggtatacctgccatgtgcaacacgaaggattacccaagcctctgacgctccgctgggtgtag

SEQ ID NO: 43247 - DNA, 1098 bp, Artificial Sequence
  Description of Artificial Sequence: Synthetic coding sequence
atggccgtgatggccccccggaccctgctgctgctgctgagcggcgctctggcacttactcagacatgggccggctctcattcgatgcgctacttctttacgtcagtgtcgcgccccggtagaggtgagcccagattcatcgctgtggggtatgtagatgatactcagttcgttcggtttgactccgacgccgcctcccaaaaaatggagccgcgtgcaccttggatcgaacaggaaggccccgaatactgggaccaagaaacacgaaacatgaaggctcacagccagaccgatcgagcaaacttaggtactctgaggggttactataaccaatctgaagatggctcccacactatacagatcatgtacgggtgtgacgtcggccccgatggccggtttctcaggggatataggcaggatgcttatgatgggaaggattacattgctctgaacgaagatctgaggtcatggactgctgctgatatggccgctcagatcactaagcgtaagtgggaggccgtgcacgctgcagaacagaggagagtgtatcttgagggtagatgtgtggatggtctgcggaggtatctcgagaatgggaaagagaccctacagcggaccgacccgcccaagacccacatgacacaccatccgatcagtgaccacgaagcaacattgaggtgttgggcgctgggtttttaccctgctgagataacactcacctggcagcgagacggagaagatcagacccaggatacggaattggtggagacacgacctgccggtgatggcacttttcaaaagtgggccgccgttgtggtcccctcaggggaggagcagaggtacacctgccacgtacaacacgaggggcttcctaagccactgaccctgaggtgggaattgtcctctcaacctactatacccatcgtcgggattatagctggactggtgcttctgggcgccgtcatcaccggggctgtggttgcagcggtcatgtggagacgcaaaagtagcgacaggaaaggggggtcctatactcaggctgcatcaagcgactctgctcaagggtcagacgtgagccttacggcctgcaaggtctag

SEQ ID NO: 43248 - DNA, 1116 bp, Artificial Sequence
  Description of Artificial Sequence: Synthetic coding sequence
atggccgtgatggccccccggaccctgctgctgctgctgagcggcgccctagcactgactcaaacatgggctgggagccacagcatgaggtatttctttacatcagtgtccagacctggacggggcgaaccacgatttattgcggtcggctatgttgatgatactcagttcgtgaggtttgactcagacgcggcctctcaaaaaatggagccacgagccccttggatcgaacaagagggacctgagtactgggaccaagaaacaagaaacatgaaggcccactctcagacagaccgcgccaaccttggcacacttcgaggttattacaaccagtctgaggatgggtcccacaccatccagattatgtatgggtgcgacgttgggcctgatgggagattcctgcgtggttacagacaggatgcatatgacggtaaagactacatagcgctcaatgaggatctccggtcctggacagccgccgacatggccgcacagatcaccaaacgtaaatgggaagccgttcatgctgcggaacagcgccgtgtttacttggagggcaggtgtgtggacggacttcgaagatacttggaaaatggaaaagagactctgcagcgaactgatccccccaaaacccatatgacgcaccatccgatatcggaccacgaagctacccttagatgctgggcactggggttctatcccgcagaaattaccttgacttggcagagagatggcgaagatcagacccaggacacagagcttgtggagaccagaccagccggggacgggacttttcagaagtgggcagcggttgtagtgccctctggggaagagcagcgttatacctgccacgtgcaacatgaaggtctgccaaaaccactcacgctgcggtgggaattatcctcccagcctaccattcccattgtcggcataatcgccggcctcgtgttgcttggcgctgtcatcactggtgctgtagtggctgcggtgatgtggcggaggaaatcttccggaggcgaaggggtgaaggaccgtaaaggggggtcctatactcaggctgctagctctgattccgcacaggggtcagacgtgagcctgactgcatgtaaggtgtag

SEQ ID NO: 43249 - DNA, 900 bp, Artificial Sequence
  Description of Artificial Sequence: Synthetic coding sequence
atggccgtgatggccccccggaccctgctgctgctgctgctgggcgcgctggcccttacccagacttgggcaggatctcacagcatgaggtatttcaccacgagtgtgtccaggcctggtagaggagaacctcgtttcattgctgtggggtacgttgatgacacccagtttgtgaggtttgactctgacgccgccagccagaggatggagccacgagcaccttggatcgagcaggaaggacccgaatactgggacttgcagacaaggaatgtcaaggcccagtcccagacagatcgcgccaacctcggaactctccgcggatattataaccagtccgaggccggctcacacactatacagatgatgtacggctgcgacgtgggctcagacgggcgctttttgcgtggctaccgacaggatgcgtacgatggcaaggactatattgcactgaacgaagatctgcgatcctggaccgccgccgatatggccgcccagatcacacagaggaagtgggaggcagcaagggtagcagagcagctgcgtgcatacctggagggtacctgtgtggagtggctgaggcgttatctggaaaacggcaaagagactttgcagaggacagacgcccctaaaactcacatgacccaccatgctgtatctgatcatgaggcgacgctaagatgctgggcactttctttctatccagccgagatcacccttacgtggcagcgggatggcgaagatcaaacccaggacaccgaactggtggagactcggcctgctggggatggcacctttcaaaagtgggccagcgtggtagtgccgagcgggcaagaacagcgttatacctgtcacgtgcagcacgagggactccctaaaccactgacgctaagatgggtgtag

SEQ ID NO: 43250 - DNA, 1098 bp, Artificial Sequence
  Description of Artificial Sequence: Synthetic coding sequence
tgagccgtgatggccccccggaccctggtgctgctgctgagcggcgcactggcgttgacacagacttgggctggctctcactccatgcgctatttttttacctctgtcagtagacctggcaggggagagcctcgattcatcgcggttggatacgtcgatgacacacaatttgtgcggtttgatagtgatgctgcgtcacagcgaatggaacctcgggctccctggattgaacaggagggtcccgagtactgggacggcgaaactagaaaggtaaaggcccactcacagacacaccgtgttgacctgggcactctgcgtggctattataaccagtcagaggcaggctctcacaccgtccaacggatgtatgggtgcgatgtcggctctgactggcgattcctcagaggttatcaccagtatgcatatgacggcaaggactacatcgctctgaaggaagaccttcgctcgtggacagccgcggacatggccgctcaaactaccaaacataagtgggaagcagctcacgttgcggagcagctcagggcctacctggaagggacttgtgtcgagtggttaagaagatatttagaaaatggaaaagagaccctgcagcgcactgatgcccccaaaacccacatgactcaccacgctgttagcgatcacgaggccactcttcggtgctgggccctcagtttttatcctgcagagatcactttgacttggcagagagatggggaggatcagacccaggataccgagctggtagagacccgccccgccggcgacggaacatttcagaagtgggccgccgtggtagttccgagcggccaggagcagcgatacacttgccacgtgcagcacgagggcctgcccaaaccgctaaccttgcgttgggaaccctctagtcagcctacaatcccaattgtaggcatcattgcgggccttgtactattcggcgccgtaattaccggggcggtcgttgccgcagtgatgtggcggcgcaagagtagtgaccgtaaaggtggtagttatagccaggctgcttccagcgactccgcccaaggatctgatgttagtctgactgcttgcaaagtgtag

SEQ ID NO: 43251 - DNA, 900 bp, Artificial Sequence
  Description of Artificial Sequence: Synthetic coding sequence
atggccgtgatggccccccggaccctggtgctgctgctgagcggcgcgctcgccctgacacaaacatgggcggggtctcatagcatgagatacttttttacttctgtgagccggccgggtaggggggagccccggttcattgctgttggctatgtagatgacactcagttcgtgagatttgacagtgatgctgctagccagagaatggaacctagagctccgtggatagagcaggagggtcccgagtattgggatggcgaaacccggaaggtcaaagcccacagccagacacacagagttgacttggggactctcagggggtactacaaccagagcgaagccggctcgcataccgtgcagaggatgtacggatgcgatgttggctcggattggcgttttctgagaggctatcatcaatatgcctacgacgggaaagactatatagcacttaaggaggatcttcgttcttggacggccgccgacatggcagcacagactaccaaacacaagtgggaggcggcccacgtagccgagcagctgagagcctacctagagggcacctgcgtagagtggttgcgaagatatttggagaatggtaaagaaaccctccagcgaacggacgcaccaaaaacccatatgactcaccacgcagtgtccgaccacgaggcgaccctgagatgttgggctctttccttctaccccgctgagatcacactcacatggcagcgagatggcgaggaccagacccaggataccgaactggtggaaacccggcctgcaggggacggtacattccagaaatgggccgcggtcgttgttccttccgggcaagaacaacgctatacctgtcatgttcagcatgagggtctccccaaacctctcaccctgcggtgggtatag

SEQ ID NO: 43252 - DNA, 1098 bp, Artificial Sequence
  Description of Artificial Sequence: Synthetic coding sequence
atggccgtgatggccccccggaccctgctgctgctgctgctgggcgccctggcactcacccagacttgggctgggtcccacagtatgaggtacttttttacttctgtgagccgacccgggcgcggcgagccaagatttatagccgtcggatatgtggacgacactcagttcgtcagattcgatagtgacgccgcgtctcagcggatggagccccgcgcaccatggatcgaacaggagggccctgaatattgggaccaagaaactcgtaacgtcaaggctcattcccagaccgatagggaatcgctgcgcatagccctcagatattacaatcagtctgaagcggggagtcacacgattcaaatgatgtatgggtgtgatgtggggcccgatggacggctactaagagggtatcaacaggatgcatacgacggtaaggactacatcgccctgaacgaggacctgcggagttggactgcagccgatatggcagcacagatcactcagagaaagtgggaagctgcccgagtggcagagcagttgagagcatacctggaagggacttgcgtagaatggttgagaagatatctggagaacgggaaggagacactacagcgtaccgatgctcccaagactcacatgacacatcacgcagtctccgatcatgaggccaccctgagatgttgggccctgtccttttaccccgcagagatcacacttacatggcagagggacggcgaggatcaaactcaagataccgagctcgtggagacacgccccgctggggacggcactttccagaaatgggcttcagtggtcgtcccgtctggacaggaacagcgctacacatgtcatgttcaacacgagggccttcctaaacctctgacccttaggtgggagccttccagccaacccactattccaatcgtgggaattattgcaggtttggtgttgttcggcgccatgttcgcaggggctgtcgtggcagctgtcagatggcggagaaaatccagcgaccgaaaaggcggatcatattcccaggccgcgtcctcggacagcgcccaaggatccgacatgagtctcaccgcatgtaaagtgtag

SEQ ID NO: 43253 - DNA, 1116 bp, Artificial Sequence
  Description of Artificial Sequence: Synthetic coding sequence
tgagccgtgatggccccccggaccctggtgctgctgctgagcggcgcgcttgcactcacccagacttgggcaggcagtcactccatgagatacttttttacttccgtaagtcggcctggcagaggggagccccggtttatcgctgtggggtacgttgatgacactcaattcgtgcgctttgattcagatgccgcttcgcagcggatggagccccgcgccccctggatcgaacaggaagggccagagtattgggacggtgagacccgaaaggtgaaagcccactcccaaactcacagggtggatctgggtactttgcggggatattacaatcagtccgaggcagggtctcataccgtccaaaggatgtatggatgtgacgttggtagcgattggcgtttcctgagaggataccatcagtatgcttatgacggcaaggattacattgctctgaaggaggatcttagaagctggactgctgctgacatggctgcacagactacaaaacacaaatgggaagcagcacatgtggcagagcagctcagagcatacctagagggaacatgcgttgaatggcttcggcgctatttggaaaacggtaaagaaacccttcaacgaacggacgcacccaaaacacacatgactcaccatgcggtcagtgatcatgaagctaccctccgctgctgggctctaagtttttatcccgccgaaataacactgacatggcagagggatggcgaagaccagacacaggacacagagctggttgagactcggccagccggggacggcacttttcagaagtgggccgccgtggtggtgccctcagggcaggagcagcgctatacctgtcatgtgcagcatgagggcttacctaaacctttaactctcagatgggagccaagtagccagccgaccatacctatcgtgggtattattgcaggcctcgtgttgttcggagccgtaattacgggagccgttgtggcagctgtgatgtggagaaggaagtcatcagggggggaaggtgtcaaggatcgaaaaggcgggtcctactctcaggccgcctcttcggatagcgcccagggtagcgacgtgtctcttacagcttgtaaagtttag

SEQ ID NO: 43254 - DNA, 1098 bp, Artificial Sequence
  Description of Artificial Sequence: Synthetic coding sequence
atggccgtgatggccccccggaccctgctgctgctgctgctgggcgccctggctctgacacagacctgggctggttctcactctatgaggtatttcacaaccagtgtctcaaggcctggacggggcgagcctcggtttatcgccgtaggctatgttgacgacacccagttcgtcaggtttgatagtgatgccgcaagccagcgcatggagcctcgagctccgtggatagagcaggaggggcccgagtattgggatctacagactcgaaacgtgaaggcccagagccaaaccgaccgcgccaacctggggacactaaggggctattacaaccagagcgaggcaggttctcataccatccagatgatgtatggatgcgacgtgggcagtgacggaagatttctcagagggtacaggcaagatgcttacgatgggaaagactacatagcattgaacgaggatcttaggtcctggaccgccgctgacatggccgctcagattacccaaaggaagtgggaggctgcccgggttgcggagcaactccgggcctacctcgagggaacttgtgttgagtggcttaggcggtatctagaaaacggtaaagagacgttgcaacgtacagatgcccccaaaacccacatgactcaccatgccgtatctgaccacgaggctacgctgagatgctgggccctgagtttctatcctgcagaaatcacgctgacgtggcaaagagatggcgaggaccaaacccaggacaccgagctggtggagacccggccagccggggacgggacattccagaagtgggcgtctgtcgtggttccttccggtcaggagcagcgatatacgtgtcatgtgcagcatgagggcctccccaaaccccttaccttgcgatgggagccgtcatcccaacctacgattcctatagtgggtataattgccggtctcgtcctatttggagccgtattcgctggcgccgttgtggccgccgtacggtggcgcagaaagtcatctgatcggaagggaggaagctatagccaggctgctagcagcgacagcgctcagggcagcgatatgtcccttaccgcttgcaaggtgtag

SEQ ID NO: 43255 - DNA, 1098 bp, Artificial Sequence
  Description of Artificial Sequence: Synthetic coding sequence
atggccgtgatggccccccggaccctggtgctgctgctgagcggcgcgttagcgctcacccagacatgggcgggctcccactccatgagatacttcttcacatccgtgagtcgtcccggacggggtgaaccaagattcattgctgtgggatacgtcgatgacactcaattcgtccgattcgactctgacgccgcctcccagcggatggaaccgcgggctccatggattgaacaggaggggccagagtactgggatggggagacaaggaaggttaaggcccactcacagacccatagggtggatttaggaacactgcgcggttattacaaccagagcgaggctggcagtcatacagtgcagcggatgtatggctgtgatgttggttccgactggagatttctgagggggtatcaccagtacgcctacgacggaaaggactacattgctttaaaggaggacctgcggtcctggacagcagccgacatggccgcccaaactaccaaacacaaatgggaagccgcccacgtcgcagagcagctgcgagcctatctggaaggcacctgcgttgagtggctgcgtcggtacctggagaacgggaaggagactcttcagcggaccgacgctcccaaaacccacatgacacatcacgccgtgtccgaccacgaggccacactgcgttgttgggccctgtctttctatcctgctgagattacattgacatggcagcgcgatggagaggatcaaacgcaggatacggaactggtagaaactcgacctgccggcgacgggaccttccaaaaatgggccgctgtggtggtgccttctggtcaggaacagcgatacacatgtcatgtccagcacgaggggttgccaaaacccctgacactgcggtgggagccttcctcccagcccacaatcccaattgttgggatcattgcaggcctagtgttattcggtgctgttatcaccggagctgtggtcgcagccgtaatgtggcggaggaagtcttcggatagaaaggggggatcctactcacaggcagcctccagcgactcggctcagggcagcgacgtcagcctcacggcttgtaaggtctag

SEQ ID NO: 43256 - DNA, 1029 bp, Artificial Sequence
  Description of Artificial Sequence: Synthetic coding sequence
atggccgtgatggccccccggaccctgctgctgctgctgctgggcgcactggccctgacacagacctgggcagggtcccatagtatgcggtacttcacaacctcagtgagcagaccggggagaggcgaaccaagattcattgccgttggatacgtagacgatacgcagtttgtgcggtttgatagcgatgcagcatcccagcggatggagcctcgggcaccttggatcgagcaggaaggacccgaatattgggatctgcaaactcggaacgtgaaggctcaatcacagaccgatcgagctaacttaggaactttacgtggctactacaaccaaagtgaagccggatcacatacgatacagatgatgtacggctgtgacgtcggcagcgacgggagattcctacgaggataccgccaagatgcttacgatggaaaggattacatcgctctcaatgaggatttgcgatcatggactgctgcagacatggccgcccagataacccagcggaaatgggaggctgcacgcgttgccgaacagctgcgtgcatatctagaggggacttgcgtggaatggttaaggaggtacttggaaaacgggaaggagacgttacagcggacagacgcaccaaaaacccacatgacacatcacgcagtgtctgaccacgaggcaacgcttagatgctgggcactctctttttatcctgctgagattaccttgacatggcaacgagacggtgaagaccaaactcaggacacagagctcgtagagacgcgcccggccggagatgggacttttcagaagtgggcctctgtggttgttccatcagggcaggagcagcggtacacctgtcacgtgcaacacgaggggttacctaagccattgaccctgcggtgggaaccgtcatcacaaccaaccatccctatcgtgggtatcatagcaggtcttgtgctgtttggggcagtgttcgcgggtgctgtcgtggccgctgtaagatggcgcaggaaaagttcgggaggagtaaagggatag

SEQ ID NO: 43257 - DNA, 345 bp, Artificial Sequence
  Description of Artificial Sequence: Synthetic coding sequence
atgacccaccaccccatcagcgaccacgaggccaccctgcggtgctgggcacttggattctacccagccgagattacccttacctggcagcgagatggggaggaccagactcaagacaccgagttggtggagacccgccctgccggagacggtacattccaaaagtgggccgcagtggtggtgcccagtggggaagagcagaggtacacctgccatgtgcagcacgaaggcctccctaagccactaacactacgatgggaccggaagggggggagctacacacaggcagcgagctctgacagcgcccagggctctgacgtatctctgacagcatgtaaggtgtag

SEQ ID NO: 43258 - DNA, 465 bp, Artificial Sequence
  Description of Artificial Sequence: Synthetic coding sequence
atggccgtgatggccccccggaccctgctgctgctgctgagcggcgccttggccctgacccaaacctgggctggatctcatagcatgcggtacttcttcacctctgtaagccgccccggcaggggtgaacctcgattcattgcggtgggttacgtggatgacacccagtttgtaaggtttgattctgatgcagcgagtcagaagatggagccacgcgcaccttggatcgaacaggaaggcccagagtattgggaccaggaaaccagaaatatgaaggcccacagtcaaacagatcgggctaatctaggaactctacgcggatactacaatcagagtgaggacggatcacatactattcagatcatgtatggatgtgatgtgggacctgacggccggtttctccggggttatcggctgcggtcacccagtgcttcaggcagaagaagtatgaggcggtctagctag

SEQ ID NO: 43259 - DNA, 1098 bp, Artificial Sequence
  Description of Artificial Sequence: Synthetic coding sequence
atggccgtgatggccccccggaccctggtgctgctgctgagcggcgcgctcgccctcacacagacctgggccgggtctcatagtatgcggtactttttcacatcagtatcaaggcctgggcgtggagagcctcggttcattgcagtgggttacgtcgatgatacgcagtttgtgaggttcgacagtgacgccgcttctcagcggatggaacctagagctccctggatcgaacaggagggtcctgagtactgggacggcgagacgcggaaagttaaagctcattctcagacccacagagtggacctaggaacccttcgcggttattataatcagtctgaagctggcagccacaccgtgcaacggatgtatgggtgtgacgtaggctccgactggcggttcttacgcggctatcatcaatatgcctatgatggcaaggactacatcgccttaaaggaagacctgcgatcatggacagctgcagacatggcagcgcagaccaccaaacataagtgggaggccgctcatgtggcggaacagttgcgagcataccttgagggcacatgtgtggagtggctgaggagatacctcgagaacggtaaggaaaccctgcaacggactgatgccccaaagacgcacatgacacatcacgcagtgagcgaccatgaagcaacgctgcggtgctgggccctgtctttctatccagctgaaatcactttgacatggcaacgcgatggcgaggatcaaacacaggataccgagctggtcgagactcgtcccgccggagatgggacctttcagaaatgggccgctgtggtcgtgccaagtgggcaggaacaaaggtacacatgccatgtgcagcatgaggggctgcctaagcctctgacactaagatgggagccatcctcccaacccactatccctattgtcggaatcattgcaggtctcgtgctgttcggtgccgtgattacaggagccgttgtagctgccgtgatgtggcgcaggaaatcttctgacagaaaaggtgggagttacagccaggccgcgtcatccgactctgcacagggctccgacgtgtccctgaccgcgtgtaaggtttag

SEQ ID NO: 43260 - DNA, 1089 bp, Artificial Sequence
  Description of Artificial Sequence: Synthetic coding sequence
atggccccccggaccctgctgctgctgctgagcggcgccctggccctgacccaaacctgggcaggctcccattcgatgagatatttttttacctctgtttcgcgccccgggcgaggagaaccacgcttcatcgccgtaggctacgtggacgacacccaattcgtcaggttcgatagtgacgctgcctctcagaggatggagcctagggctccctggattgaacaggagggaccagagtactgggatggggaaacacggaaggtgaaggcccatagccaaacccacagagtcgatcttggtacgctccgtggttactataaccaatccgaggccggtagtcacaccgttcagcgcatgtacggatgcgacgtgggcagtgactggcgcttcttgcgcggataccaccagtatgcttacgatggcaaagactacatcgccctgaaagaggaccttcgaagctggactgctgccgacatggccgcacaaacaacaaagcacaagtgggaggctgcccacgtagctgaacagcttagggcatatctcgaggggacctgcgtggaatggttgcgacggtacttggaaaatggaaaggagactctgcagagaaccgatgcaccaaagactcatatgacccatcatgctgtcagcgaccatgaagcaaccctgagatgctgggctctcagcttctatcccgccgagattactctcacatggcagagagatggagaggaccagacccaggataccgagctcgtcgagactcgcccggccggtgatggcacctttcaaaagtgggcagctgtcgtggtgccctccggacaggagcagcgatatacatgtcacgtccagcacgaaggtcttccaaaaccacttactttaaggtgggagccctcgagtcaaccaaccatccctatcgtaggcataattgcaggacttgtattgttcggagctgtaatcaccggcgccgtcgtggctgccgtcatgtggagaagaaaatcctctgaccgaaagggaggttcttacagtcaggccgccagctcagattctgcccaggggtccgatgtgagtttgaccgcctgcaaagtttag

SEQ ID NO: 43261 - DNA, 1098 bp, Artificial Sequence
  Description of Artificial Sequence: Synthetic coding sequence
atggccgtgatggccccccggaccctggtgctgctgctgagcggcgctcttgccctgactcagacgtgggccggcagccatagcatgagatacttttacacttccgttagccggcctgggcgcggtgagccgaggtttatcgctgttggctatgtggacgatacacaattcgtcagatttgatagcgacgcggcctcacaacggatggaacctagggccccttggatcgaacaggaaggccctgagtactgggatcggaacacacggaacgtaaaggcccactctcagacagaccgcgcaaacttgggcacgctgcggggttattacaaccagagcgaggacgggagtcatacgattcagcgcatgtacggctgcgacgtcggcccggatgggcggttcctgcgcgggtatcagcaggatgcgtacgacggaaaggactacatagctctgaacgaggacctgcgttcttggaccgcggcagacatggcggctcagatcacccagagaaagtgggaaactgcccacgaggccgagcagtggcgagcctacctcgaggggaggtgtgtggagtggctaaggcggtaccttgagaacggcaaggaaaccctgcagcgaacagacgctcctaagacacacatgacacaccatgctgttagcgatcacgaagctaccctgcgctgttgggccctgtctttctatcccgccgaaatcaccctgacttggcaacgtgacggtgaagatcagacccaggacacagagctggtggagacaagaccggccggtgatggcacgttccagaaatgggcctcagtcgtcgtgcccagtgggcaagagcagcggtatacctgtcatgtgcagcacgaaggcttaccaaagcctctgaccctgcgatgggagccatctagccagccaactataccaatagtggggatcatcgccgggctagtgctttttggtgctgtcatcgctggagcagtggtagcagccgtgatgtggcgtagaaagtccagcgaccggaagggcggcagttattcccaggctgcatcatcagattcagcccagggttctgatatgtccctgactgcgtgtaaagtatag

SEQ ID NO: 43262 - DNA, 888 bp, Artificial Sequence
  Description of Artificial Sequence: Synthetic coding sequence
atggccgtgatggccccccggaccctgctgctgctgctgctgggcgctctggcgttgacccaaacttgggcaggcagccacagtatgcggtactttacgacatcagtgagtaggcctgggcggggcgaaccgcgatttatcgcagttggctatgtggacgacactcagtttgttcggttcgactccgatgctgcatctcaaagaatggaacctcgggcgccctggattgagcaggaaggccccgagtactgggacctccagacccgcaacgtgaaagcccagtctcagactgaccgtgcataccttgaaaatggaaaggagaccctgcaaaggactgacgcccctaagactcacatgacgcaccacgcggtgtcagatcatgaagccactctgaggtgttgggctctgagcttctacccagcggaaatcaccctcacttggcagagggatggagaagaccaaacccaagatacagagctggtcgagacccgtcctgccggtgacggaaccttccagaagtgggcctcggtggtggtaccttcaggccaggaacagaggtacacttgccatgttcaacacgagggactgccgaaacccttgacgctgcgatgggaaccatctagccagccaacgattcctattgtggggataatcgccgggctcgtgctcttcggtgcagtgtttgccggggcagtagtcgccgctgtacggtggaggcgcaagtccagtggaggggagggcatgaagggaggctctgaaatttcttgcctaaccgagggatcgaagactcaggtggaagtctgcccagcgtcgttactgggaagcaccatccacaactacggacctactcaaccaggaccctgtgtgcccgcattgactttgttgtag

SEQ ID NO: 43263 - DNA, 1098 bp, Artificial Sequence
  Description of Artificial Sequence: Synthetic coding sequence
atggccgtgatggccccccggaccctgctgctgctgctgagcggcgcgctggctctcacgcagacttgggccggctctcactccatgcgctactttttcacctcagtgagccgccctggacgaggtgagcctcgtttcatcgcagtcggttatgtggacgacacgcagtttgtccggtttgactcggatgctgcctcacagaagatggaaccccgggccccttggatcgagcaggagggcccagagtactgggaccaggaaaccagaaatatgaaagcacacagtcagacggaccgtgccaatctcgggacgctccggggatattataaccagagtgaggatgggagtcataccattcagatcatgtacggatgcgatgtcggaccagacggtaggttcctacggggctacagacaggacgcgtacgacggtaaagattatattgcactcaacgaagatctgaggagctggaccgccgccgacatggccgctcaaatcactaagcggaagtgggaggcggtacatgctgcagagcaacggcgcgtgtatcttgaggggaggtgcgtggatggcctgaggcggtatcttgaaaatggaaaagaaaccttgcagagaaccgatcctcccaagacacacatgacccaccacccaatttccgatcacgaggctactttacgttgttgggccttagggttctacccggccgagattacgctgacttggcagagagacggcgaggatcaaacacaggatactgagctggtcgagacaagacccgcaggggacggcacgtttcagaagtgggcagcagtggtggtgcccagcggcgaagaacagcggtatacgtgtcacgtgcagcatgaaggcctgcccaagcctctgacactgaggtgggaactgtctagtcaaccaaccattccaatagttggcattattgccggcctcgtgctccttggtgcggttattacaggcgctgtggtggctgccgtcatgtggaggcgcaaatccagcgatagaaaaggcggatcttatacgcaagccgcttcctccgatagtgcccagggcagtgacgtgagcctgactgcttgcaaggtgtag

SEQ ID NO: 43264 - DNA, 888 bp, Artificial Sequence
  Description of Artificial Sequence: Synthetic coding sequence
atggccgtgatggccccccggaccctgctgctgctgctgctgggcgctctggccctgacacagacatgggccggtagccactcgatgaggtacttctttacaagtgtcagtaggccaggacgtggagagccgagattcatcgcggtcggatatgtggacgatacccaattcgtcagattcgactcagatgctgcgagccaacgcatggagcccagggcgccttggattgagcaggaggggccagagtattgggatcaggagactcgaaacgtgaaagcgcactctcagacagataggcgataccttgaaaatggcaaggagacactccagaggactgacgcccccaaaacccatatgactcaccatgctgtctccgatcacgaggccacccttagatgctgggctctgtccttttaccctgcggagattaccttaacttggcagagagatggagaggaccagacccaggataccgagctggtagaaactcgccccgcaggcgatgggacttttcaaaagtgggctagcgtcgtcgtaccatccgggcaggaacagcgttacacctgtcacgtacagcatgagggtctccctaagcccctgacgctgcgttgggaaccctcaagccaaccaaccattccgatcgttggcatcattgcgggcctggtgctattcggcgccatgttcgctggagctgtagtggccgccgtcaggtggaggcgcaagagcagcggtggcgaggggatgaagggaggttccgagatatcttgccttactgaagggagtaaaacgcaggtggaggtttgccctgcatccttactgggctccacgatccacaactacggcccgacacagcctggtccgtgcgtgccagctttaacactactgtag

SEQ ID NO: 43265 - DNA, 1098 bp, Artificial Sequence
  Description of Artificial Sequence: Synthetic coding sequence
atggccgtgatggccccccggaccctgctgctgctgctgctgggcgccttggctctgactcagacttgggcgggctcacattcgatgcggtacttcacaaccagcgtttctcggcccggtcggggcgagcccaggttcatcgcagtgggttacgttgatgatactcagtttgtcagattcgactctgatgccgcctctcaacggatggaacctagagctccttggatcgagcaagagggtccagaatattgggatttgcaaacccgcaacgtgaaggcccagagtcagacggatcgcgccaacctggggacccttagaggctactacaaccaaagcgaagctggtagccataccattcagatgatgtatgggtgtgacgtcggtagtgacggtcgttttcttaggggctacagacaggacgcttacgatggaaaagattatatcgcactgaatgaggatctgagatcttggaccgctgcagacatggccgcacagatcacacagcgaaaatgggaagctgcccgggtcgccgaacagctcagagcttacctcgaaggaacgtgtgtggagtggctgagacgctacctggaaaatggcaaggagactttacagaggacagacgctcctaagacccatatgactcaccacgctgtctctgaccatgaggctaccctaaggtgttgggccctgtcattctatcccgccgagattactctcacctggcagagagatggcgaggatcaaacccaggacaccgagttggtggaaacaaggcctgcaggcgacggcaccttccagaagtgggcctccgtcgttgtgccctcaggccaggaacagagatatacatgtcatgtgcagcacgagggtcttcctaaaccgctgaccctcaggtgggaaccatcaagccagccaacgattcctatcgtgggcatcatagctgggctggtcctttttggggcagtgttcgcgggcgcagttgtggcagctgtcagatggcgaaggaaatcgtcagatcggaagggagggagctactcccaagccgcttcatcagactctgcccaaggttccgatatgtcactgaccgcgtgcaaagtctag

SEQ ID NO: 43266 - DNA, 345 bp, Artificial Sequence
  Description of Artificial Sequence: Synthetic coding sequence
atgacccaccaccccatcagcgaccacgaggccaccctgcggtgctgggcattgggcttttatccagccgagattaccctgacatggcagcgcgacggagaggaccagacccaagataccgaactcgtggaaactagaccagctggggacgggacgtttcaaaagtgggccgccgtagtggtgccgtcgggagaggaacagcgctacacatgtcacgtacagcacgaagggctcccaaagccactgaccctgcggtgggacaggaaaggaggtagctatacacaggcagcctctagcgacagcgcccaaggctccgatgtgagcctcactgcttgtaaggtctag

SEQ ID NO: 43267 - DNA, 888 bp, Artificial Sequence
  Description of Artificial Sequence: Synthetic coding sequence
atggccgtgatggccccccggaccctggtgctgctgctgagcggcgcactagccttgactcagacctgggccggatctcactcgatgaggtacttctacacctccgttagccggccaggccgaggagaacctcgcttcatcgccgtggggtacgtcgacgacacccaatttgtgagattcgattcggacgccgcaagccaacggatggaacctagggctccttggattgagcaagaaggccccgagtattgggatagaaatacaaggaatgtaaaggcccattcccagacggatcgggcttacctcgagaacggaaaggaaacacttcagcgcacagacgccccaaagacccatatgacccatcacgccgtgagcgaccacgaggctacgctccgatgttgggctctgtcattttatccagctgagatcactcttacatggcagcgggacggggaagaccagactcaggacactgaactggtagagactcgtccagctggggatgggacatttcagaagtgggcttctgtggtcgtgccatccgggcaggagcagcgctacacttgccacgtgcagcacgagggtctgcccaaacctttgaccctccgttgggagccctcctcccagcctaccatacccatcgtggggataatcgccggactcgttcttttcggcgccgtcatagccggcgccgtggtcgccgcagtgatgtggcgtcgtaagagttccggtggagaaggaatgaagggcgggtccgagataagctgtctgacagagggaagcaaaactcaagtcgaggtctgtcctgcatcccttctgggcagcacaattcacaactacgagcctactcaaccaggcccctgcgtgcccgctctgactctactgtag

SEQ ID NO: 43268 - DNA, 465 bp, Artificial Sequence
  Description of Artificial Sequence: Synthetic coding sequence
atggccgtgatggccccccggaccctgctgctgctgctgagcggcgccttggccctcacccagacctgggccggcagccacagcatgcgttacttctttacatctgtctcccgtccaggccgcggagagccccgttttatcgctgtgggatatgtggatgacacccaatttgtgagattcgactctgatgcagcatcacaaaaaatggaacccagggccccttggattgaacaagaggggccggagtactgggatcaagagacccggaacatgaaggcccactcacagacggacagggcaaacctgggaaccctgcgcggatactacaatcagagtgaggacggctcccataccatccagatcatgtacgggtgcgatgtgggtcccgacggaagatttctgagaggatatcgtctccggagtccaagtgccagtgggcgcaggtctatgagacgctcatcctag

SEQ ID NO: 43269 - DNA, 1098 bp, Artificial Sequence
  Description of Artificial Sequence: Synthetic coding sequence
atggccgtgatggccccccggaccctgctgctgctgctgagcggcgctttagccctgacccaaacttgggccgggagccacagcatgcgatacttctttactagtgtgagcaggcccggtagaggagagcctcgctttattgccgtaggttacgttgacgatacgcagtttgtcaggtttgatagcgatgccgcctcgcaaaagatggaaccaagagcgccgtggattgagcaggagggcccagagtattgggaccaggaaaccagaaatatgaaggcacactcccagactgacagggctaacctggggactctgcgcgggtattataatcagtctgaagatggttcgcatacaatccagatcatgtacggatgcgatgtgggacccgacggaaggtttctgaggggataccgtcaggatgcatatgatggcaaagactacatcgccttgaatgaggatctgcggtcatggaccgcggccgacatggccgcacagattactaagcgtaagtgggaggcggtacacgctgccgaacagagacgtgtgtatctggaggggcgctgcgtggacggcctccgccgataccttgagaatggtaaagagaccctgcaaaggacagatccacctaagacccatatgacgcatcacccaatatcagaccacgaggccacccttcggtgctgggcgctgggattctacccagccgagatcaccctgacatggcagagggatggtgaggatcaaacacaagacactgagctcgtagaaactagaccagccggcgatggcactttccaaaagtgggccgccgttgtggttcccagcggcgaggagcagcgttatacctgccatgttcagcacgagggactacccaaaccccttacgttaaggtgggagttatccagccagcctaccattcctatcgtgggcataatcgccggattggtcctcctgggcgctgttataacaggcgctgttgtggccgccgtaatgtggcgccgaaaaagctccgaccggaagggcgggagctatactcaggccgccagtagcgactccgcccaaggaagcgacgtctctctaacagcctgcaaagtgtag

SEQ ID NO: 43270 - DNA, 1098 bp, Artificial Sequence
  Description of Artificial Sequence: Synthetic coding sequence
atggccgtgatggccccccggaccctgctgctgctgctgctgggcgcgttggcactaacgcagacctgggctgggagtcactccatgagatacttcttcaccagtgtctcacgcccaggacgcggagaaccacgcttcatcgcagttggatacgtggatgatacccaattcgtgcggttcgactcggatgcagcttctcagcgaatggaaccgcgagctccttggattgagcaggagggacctgagtactgggatcaggaaacccggaatgtcaaggcacactcccagactgatagggagtctctcaggatcgcactccgctactacaaccaaagcgaagcgggctcccatacaattcagatgatgtacgggtgcgacgtcggaccagatggaagactccttcgtggctatcaacaagacgcgtacgatggaaaggattacatcgccctcaacgaggatctgcgatcttggacagcagccgatatggccgcccagatcacccagagaaagtgggaggctgctcgtgtggcggagcagctgagagcgtacctggagggcacatgtgtggaatggcttcggagatatctggagaacgggaaagagaccctccagagaactgatgcccctaagacacacatgactcatcatgccgtctctgatcatgaggctactctgcgttgttgggcgcttagtttttaccctgcagagattactcttacctggcaacgcgacggggaagaccagacacaggacactgaactggttgagacccggcctgccggcgacggcacatttcagaagtgggcttccgtagtggtgccttcaggccaggagcagaggtatacctgtcatgtacaacatgagggtttacccaaaccacttaccctgcggtgggagccgagttctcagccaaccatccccatcgttggaatcattgccgggctggttttatttggtgcaatgttcgctggcgccgtcgttgctgccgtgcgttggagacggaagtcatccgaccggaagggcgggtcctatagccaggccgcgtctagcgattccgcgcaggggagcgatatgtcactcacagcgtgtaaagtgtag

SEQ ID NO: 43271 - DNA, 345 bp, Artificial Sequence
  Description of Artificial Sequence: Synthetic coding sequence
atgacccaccaccccatcagcgaccacgaggccaccctgcggtgctgggcactgggcttttatcctgccgagattacgctgacctggcagagagatggcgaagatcaaactcaggataccgaactggtcgagactaggcctgctggagacggtacctttcagaaatgggcggctgtcgtagtcccatcaggcgaggaacagcgatacacatgtcatgtccagcacgagggacttccaaagccactcaccctaagatgggacagaaagggcggttcttacacacaggctgccagttcagattcagcccagggaagtgatgtgtcgctgaccgcatgcaaggtctag

SEQ ID NO: 43272 - DNA, 1089 bp, Artificial Sequence
  Description of Artificial Sequence: Synthetic coding sequence
atgcgggtgaccgccccccggaccctgctgctgctgctgtggggcgctgtagccctgacggagacctgggccggctctcactctatgaggtatttccacacaagtgtgtcccgccctgggagaggggaacctagattcatctccgtaggttacgtggatggtactcagtttgtccggtttgattctgatgctgcttctccgagaacagagccacgagcaccatggatcgagcaagaaggacccgagtactgggatcgcaacacccagatcagtaagaccaatacccagacttaccgtgagtcactgcgcaatttaaggggatattacaaccagtctgaagccggatcccacactctgcagaggatgtatggctgcgacgtaggcccagacggaaggctcctgcgggggcatgaccagtctgcctacgacgggaaagattacatcgcccttaacgaggacctgtcttcatggaccgccgcggacacagccgcacagattacccaacgcaagtgggaggcagcccgggtagcggagcagctgagagcttacctagaaggaacgtgcgtcgagtggctgcgaagacacttggaaaatgggaaggaaacattgcagcgtgcagaccccccaaagacacacgtgacacatcatccgatcagcgatcacgaagccaccttaaggtgctgggcattgggattctacccagcagagatcacactgacctggcagcgagatggggaagaccagacgcaggatacagagttggtggagacccgccctgcaggcgacaggacattccaaaagtgggcagctgtggtcgtcccgtctggagaggagcagcggtatacctgtcatgtccagcacgaagggcttccgaaacctctgaccttacggtgggaaccgtcctcccagtcaacaattccaatcgtgggaattgttgctgggctggctgttctggccgtagtggtcatcggtgctgttgtagctaccgtgatgtgtcggaggaaaagcagcggcgggaaagggggttcttattcacaagccgccagctcagacagcgcccagggatcggacgtgtcgctcaccgcatag

SEQ ID NO: 43273 - DNA, 1089 bp, Artificial Sequence
  Description of Artificial Sequence: Synthetic coding sequence
atgctggtgatggccccccggaccgtgctgctgctgctgagcgccgccctcgccttgacagaaacttgggccgggagtcactccatgcgctacttttatacttccgtgagtagacccggcagaggcgaaccccggttcattagcgtcgggtatgtggacgatactcaatttgtgaggttcgattctgacgcagcgagcccgcgcgaggaaccacgggccccttggattgaacaggaaggaccagaatactgggatagaaatacccagatctacaaagcccaggcccagacggacagggaaagcctccggaatctcagaggctactacaaccagtcggaggccgggagtcatacactgcagagcatgtacggttgcgacgtgggtcccgatggcagactgctcagagggcatgaccagtacgcgtacgatggaaaggattatatcgctctcaacgaggatctgagatcctggacagccgcggatacagccgcccagattacccagcgaaagtgggaggcggcgcgggaagctgaacagcgacgggcctacttagagggcgagtgtgttgagtggttgcggaggtatcttgagaacgggaaagacaagctggagcgagccgatcccccaaagacccacgtgactcaccatcccatcagcgaccacgaggccactctaagatgttgggccctcggtttttaccctgccgaaatcacacttacctggcagcgggatggagaggatcagactcaagataccgaattggtggaaactcgtccagccggggaccgaacatttcagaaatgggctgcggtagtggttccttcgggtgaagagcagcgatatacatgccacgtgcagcatgaaggtctgcctaagccactgacactgcggtgggagcctagctctcagtccaccgtccctattgtgggcatcgtcgccggactagccgtgctagcagtcgtggtgataggggcagtggtcgccgccgtgatgtgccggcgcaagagcagtggcggaaaaggcggctcatactcgcaggctgcttgttccgatagcgcccaaggcagcgatgtgtctctaactgcctag

SEQ ID NO: 43274 - DNA, 726 bp, Artificial Sequence
  Description of Artificial Sequence: Synthetic coding sequence
tgacccgacggccggctgctgcggggccacaaccagtacgcctacgatgggaaagattacattgccttaaacgaagatttgcggtcgtggacagctgccgacactgctgcgcagatcacccagcgaaaatgggaggcggctagggtcgcagagcaggaccgggcgtacttagaagggacctgtgtggagtggttgagacggtatctcgagaacgggaaagacactctggagcgcgccgacccccctaagacgcatgttacacaccaccccatctccgatcacgaggccacattaaggtgctgggcactggggttctatcctgcagagataaccctgacatggcagcgagacggagaggaccagacccaagacactgaattagtggagactaggccagccggcgatcggacattccagaaatgggccgccgtcgtagtaccatccggggaggagcagcgctacacctgccatgttcagcacgagggactgcccaagcccctcacgctccgctgggaaccaagcagtcagagcactgttcctattgtcggcatagtagcagggttagccgtgttggcagtcgtggttataggagcagtcgtcgcggcagtcatgtgtcggcgcaagtctagcggtcacttcttaccaacaggcggcaagggcggctcctatagtcaggccgcatgttcagacagcgcccaggggagcgatgtgagtctgaccgcttag

SEQ ID NO: 43275 - DNA, 726 bp, Artificial Sequence
  Description of Artificial Sequence: Synthetic coding sequence
tgacccgacggccggctgctgcggggccacgaccagagcgcctacgatggcaaagattacattgccttgaacgaggatctgtctagttggaccgcagcagatactgccgcccaaataacgcagagaaagtgggaggcagctcgcgtcgcagagcaactgcgggcttaccttgagggaacctgtgtggaatggctgaggaggcatttggagaacggcaaggaaactctgcagcgggccgatccacctaaaacccacgtcacgcaccacccaatctctgaccatgaggcaaccctccgatgctgggccttgggcttctacccggccgagataactctgacctggcagcgcgacggggaggatcagacccaagacacggaactggtggagacccgaccagctggggacagaacatttcagaagtgggccgctgtggttgtcccatcaggtgaggagcaacgctacacatgccacgttcaacacgagggattgcctaaaccattgacgttacgctgggagcccagttcacagagcaccatccccatagttggcattgttgccggactcgcagtgttggccgtggtcgtgatcggagccgtcgtagcaaccgtgatgtgtcgcaggaagagttccggacattttctgcccacaggaggtaaaggggggagttacagccaagcagcatccagcgattcagctcaaggcagtgacgtatccctgaccgcatag

SEQ ID NO: 43276 - DNA, 1089 bp, Artificial Sequence
  Description of Artificial Sequence: Synthetic coding sequence
atgcgggtgaccgccccccggaccctgctgctgctgctgtggggcgccgtcgcattgacagagacttgggccggatcccactccatgagatacttttacactgctatgtcccgccccggcaggggggaacctcggttcatcacggtggggtacgttgatgatacacttttcgtgaggttcgattctgatgccaccagcccccgcaaggagcctcgggccccctggattgaacaggaaggacctgagtactgggatagagagactcaaatctctaagacaaacacgcagacttatcgggagaaccttagaacagccctgcgctattacaaccaatccgaagctgggtctcatattattcagcgcatgtacggatgtgatgttggaccagacggccgcctgctacgggggtatgaccaagacgcctacgacggcaaggactacatcgcactaaacgaagatcttagtagttggacagccgcggataccgcggcacaaataactcaaagaaagtgggaagccgcccgagttgctgaacaggatcgggcatatctcgagggtctctgcgtcgagtcactgcgccggtacctagagaacggcaaggagactctgcagagggcagaccctccaaaaactcacgttactcaccatcccatcagcgaccacgaggttactctgcggtgttgggccctgggattctacccagccgagattactctgacctggcagcgcgacggggaggaccagacacaagatactgagcttgtggaaaccaggccagcgggcgaccgaacctttcagaaatgggccgcggtggtcgttccatctggagaggaacagaggtatacctgtcatgttcagcacgagggtttaccaaagcctcttacactcagatgggaaccatctagccagagtacagtgcctatcgtgggaattgtggctgggctagctgtcctagccgtggtggtaattggcgccgtcgtggccgccgtgatgtgtcgtcgtaaaagctccggcggaaagggaggatcctattcccaggcggcatgtagcgacagcgcccagggttccgacgtttccctgactgcctag

SEQ ID NO: 43277 - DNA, 726 bp, Artificial Sequence
  Description of Artificial Sequence: Synthetic coding sequence
tgacccgacggccggctgctgcggggccacgaccagagcgcctacgatggaaaggactacattgccctgaatgaggacctgtctagctggactgctgccgacacagcagcccagattacacagcgcaagtgggaagcagcgcgtgaggccgagcagtggcgggcctacctggaggggctgtgtgttgagtggcttagacgttatctggaaaatggtaaggaaacactacagagggctgaccctccaaaaactcacgtcacacatcatccaattagtgaccatgaggcaaccttgcgctgttgggcgctgggtttttaccccgccgagattacacttacctggcagcgggacggtgaagaccagacccaggatacagaactggtcgaaactcggccagccggtgacagaacatttcagaagtgggccgccgtcgtggttccttccggggaggaacaaaggtacacctgccacgttcagcacgaaggacttccaaagccacttacattgcgttgggagccatcttcacagagcaccattcccatagtgggtatcgtagccggcctcgctgttttggcagtagttgtcattggagcagttgtagccacagtgatgtgtcgccggaagtctagtggccacttcctcccgacggggggcaaaggcggttcctattcccaggcagcaagcagcgacagtgcacagggtagcgatgttagcctgactgcttag

SEQ ID NO: 43278 - DNA, 1089 bp, Artificial Sequence
  Description of Artificial Sequence: Synthetic coding sequence
atgctggtgatggccccccggaccgtgctgctgctgctgagcgccgcactggcgctgacagaaacctgggctgggtcccattccatgaggtatttcgacaccgccatgtcccggcccgggcgtggagaacccagatttatttccgtagggtatgttgacgacacacaattcgtgaggttcgatagcgacgctgcatcaccacgggaggaacctcgcgctccttggattgaacaagagggaccagaatactgggaccgcaacacccagatcttcaagaccaatacccaaacggaccgcgaatcactgcgcaatctgcgaggttactacaaccagtccgaagccggcagccacacgctccagtccatgtacgggtgcgacgtcggtcctgatggccggcttctgaggggacacaaccagtacgcctatgatggcaaagactacatcgccttgaatgaggatctgcggtcatggacagcagcagacacagctgcacagatcactcagagaaaatgggaggctgccagggttgcggaacaggaccgcgcctatctggaaggaacatgcgtcgagtggttgagacgatacctggaaaacgggaaggacacattggagcgtgcagaccctcctaagacgcacgtgactcaccaccctatttccgatcacgaggccaccctgcgctgttgggccctgggtttttaccccgcggaaatcactctgacatggcagcgcgacggggaggaccaaacgcaggatactgaactggttgagacccgtcccgccggggaccgcacattccagaagtgggcggctgtggtcgtgcctagcggcgaggaacagagatacacgtgccatgtgcaacatgagggactcccaaagcccttgacccttcgttgggaaccctcatcccagagtacagttcctatagttggcatcgtggccggcttggctgtgctggcagtggtcgttattggcgccgttgtcgccgctgtcatgtgccgccgcaagtcttcaggcggaaagggaggctcctactctcaggctgcctgctcagatagcgcccagggtagcgacgtgtccctcaccgcttag

SEQ ID NO: 43279 - DNA, 678 bp, Artificial Sequence
  Description of Artificial Sequence: Synthetic coding sequence
tgaatgctggtgatggccccccggaccgtgctgctgctgctgagcgcggctttagccttgacagagacatgggctggaagccattccatgcgctacttctatacaagtgtatctagacctggccgcggggagccacggttcataagtgtgggctacgtggatgacacccagtttgtcagatttgactctgacgcagcgtcgcccagggaggagccgcgtgccccctggatcgaacaggagggaccggagtactgggaccgaaacactcagatttataaggcgcaagctcagacagaccgtgagtctctgcgcaatctgagaggctactacaaccaaagcgaggctggtagtcatacgctccagagcatgtatggttgcgatgtgggtcccgatggtagactacttagaggacatgaccaatatgcctatgacgggaaggattatattgcattaaacgaggacctaagatcatggacagcagcagacaccgctgctcagattacgcagcgcaagtgggaagctgcccgtgaagctgagcagcggagggcctatctcgagggcgagtgtgtggagtggctgcgcaggtatcttgagaacggcaaggataagctcgaacgagctgatcaagaacagaagtccttattccctgctcagagactcgagcttagtaacgaatag

SEQ ID NO: 43280 - DNA, 726 bp, Artificial Sequence
  Description of Artificial Sequence: Synthetic coding sequence
atgtacggctgcgacgtgggccccgacggccggctgctgcggggccatgatcagtacgcctatgacggcaaagactatatagccctgaacgaggatctccgaagctggactgctgccgacactgcggcccagataactcaaaggaaatgggaggctgctagagaagctgagcagcgaagagcatacctcgagggagagtgtgtagaatggttgcgcagatatctcgagaacggcaaagataagctcgagcgtgccgatccaccaaaaacccatgtgacccaccaccctattagcgaccatgaagctactctgcgttgttgggcgctaggcttttaccccgctgagattactctgacctggcagcgagatggtgaggaccaaacccaggatacggaacttgttgaaacccggcctgccggtgatcgcacctttcagaagtgggccgccgtggttgtgccatccggtgaggagcagcggtacacctgtcacgttcaacatgagggactgccaaagcccctaaccctgcgctgggaaccctcctcccaatccactgtaccaattgtcggcattgtcgccggcctggccgtgctagcagtagtggtgatcggagccgtcgtggccgccgtgatgtgccgccggaaatcttccggcggaaagggcgggtcttactctcaagccgcttgtagtgacagcgcacaagggagtgatgtttcactgaccgcctag

SEQ ID NO: 43281 - DNA, 741 bp, Artificial Sequence
  Description of Artificial Sequence: Synthetic coding sequence
atggccagcgtgggccggcgggagggcaccgccggcggcggcgccggcccaggagagcctagacgtgaagagggtagggcgggcctgagccctagtagtcctccggggtcacattcgatgagatatttttatactgcaatgtcacgacctggccgcggggagcccagattcatcacggtcggctatgtggatgataccttgttcgtgcggttcgacagcgacgccacctctccccgaaaggagcccagagccccgtggattgagcaggagggccccgagtactgggatcgggaaactcaaatttcgaagactaatactcagacctacagagagaatttaaggactgccctcaggtattataatcagtccgaagcgggctctcacattattcagaggatgtatgggtgcgacgtaggtcctgacgggaggctgttgagaggctacgaccaggatgcatacgacggcaaggactacatagccttaaatgaggatctgtcctcctggactgctgccgacaccgcagctcagatcacccagcgaaagtgggaggctgcaagagtggctgagcaattgagggcgtacctggagggactttgtgtcgagtccctgagaaggtatctggagaacggcaaggagactttgcagagggctgacccgccaaaaactcacgtcactcatcatccaatctccgaccacgaagtaacgctacgctgctgggctctaggattttatccagcctag

SEQ ID NO: 43282 - DNA, 741 bp, Artificial Sequence
  Description of Artificial Sequence: Synthetic coding sequence
atggccagcgccggccggagcgagggcaccgccggcggcggcgccggccctgaagaaccaaggcgcgaagagggccgggctggcctctccccgtctagccctcccggaagccatagtatgcgttatttttacacatctgtttctaggccagggagaggcgagccaaggttcatcagtgtgggctacgttgacgacactcagttcgtgaggtttgacagcgatgctgcttccccccgggaagagcctagggctccttggattgagcaagaaggtcccgaatactgggaccggaacacccagatatataaagctcaggcccaaaccgaccgtgagtcccttcgcaacctgagggggtactataatcaatccgaagccggttctcacacgctgcaatcgatgtatggatgtgatgtcgggccagatggtagactgttacgtggccatgatcaatacgcttatgacgggaaagactatattgcactcaacgaagacctgaggagctggactgcagccgacaccgcagcccagattacacagcgaaaatgggaagcagcccgcgaagccgaacagcggcgtgcatatctggagggtgagtgcgtggagtggcttcgccgctatttagagaacgggaaggacaagttggagcgcgctgacccaccaaaaactcatgtgacacaccaccccatctctgaccatgaagctactctaagatgctgggctctgggcttctatcccgcctag

SEQ ID NO: 43283 - DNA, 1089 bp, Artificial Sequence
  Description of Artificial Sequence: Synthetic coding sequence
atgcgggtgaccgccccccggaccctgctgctgctgctgtggggcgcagtagcattaacagaaacttgggcgggaagtcattctatgagatacttctacacagccatgagccgccccggaaggggcgagcctcggtttatcaccgttgggtatgtggatgatactctgtttgttcgcttcgattctgatgcgacatccccccgtaaagaacctcgcgccccctggatagagcaagaggggccagagtattgggaccgggagacgcagatttccaagacaaatacccagacgtatcgcgagaatttacggacagccctgcggtactacaatcagtctgaggccgggagtcatataatccagcggatgtacggatgtgacgttggacccgatgggcgcctgctacggggctacgaccaggacgcctacgacggaaaggactacatcgctctgaacgaagacctatccagctggaccgcagccgacaccgccgcacagatcacccagcgaaaatgggaagcagctagggtggcggaacagttgagggcctacttagagggcttatgcgtggagtcactgaggagatatctcgaaaatggcaaagagactttgcaacgagctgacccccctaaaactcacgtcactcatcacccaatcagcgatcacgaggtgacattgcgttgttgggccctaggattctaccctgcagaaatcactttgacttggcagcgggacggggaagatcagacccaggacacagaactggtagagacacgcccggctggggatcggacttttcagaagtgggccgcagtggtcgtgccttctggcgaagagcagagatacacatgccacgtgcagcatgagggattaccaaagccattgacacttcggtgggaaccatcttctcagagcaccgttcctatcgttggcatcgtcgctggcctcgccgttcttgcagtcgtggtgatcggggccgtggtggccgctgtaatgtgccgccgcaaaagtagtggaggcaaaggcgggtcctattcccaggctgcctgttccgattctgcacagggctcggatgtcagtctgacagcatag

SEQ ID NO: 43284 - DNA, 726 bp, Artificial Sequence
  Description of Artificial Sequence: Synthetic coding sequence
tgacccgacggccggctgctgcggggctacgaccaggacgcctacgacgggaaggactacattgcccttaacgaggatctttccagctggactgctgccgataccgcagcacagatcactcagagaaaatgggaagctgcccgcgttgcagagcagctgcgggcctacctggagggcttatgtgttgagtctctcagaaggtacctggaaaacggcaaggaaacactgcagcgcgcggatcctcctaaaacccacgtgacacatcaccctatcagtgatcatgaagtgaccctgcgttgttgggctttgggcttttatccggccgaaataaccctaacttggcagcgcgatggtgaggaccagactcaagacacagagctggttgagacccgaccagccggtgacaggaccttccagaaatgggcagcagtggtggtcccttcaggcgaggagcagcgctacacttgtcacgtccagcatgagggattgcccaagccactgacgctgcggtgggaaccttccagtcaaagcacagtcccaatagtgggcattgtggcaggcctggcagtgcttgccgttgttgtgatcggggcagtggtggccgcagtgatgtgccgacgaaagtctagtgggcatttcctaccaacaggcggcaaaggaggatcctactctcaagccgcgtgtagtgattccgcccagggcagcgatgtatccctgacagcctag

SEQ ID NO: 43285 - DNA, 726 bp, Artificial Sequence
  Description of Artificial Sequence: Synthetic coding sequence
tgacccgacggccggctgctgcggggctacgaccaggacgcctacgatggtaaagactacatagctttgaacgaggacctaagcagttggactgccgccgatactgcagcccagatcacccaacgcaagtgggaggcagctcgggtggccgagcaggaccgagcttacctcgagggcttatgtgtcgagagcttgaggcgatacctggaaaacggcaaagagaccttgcagcgcgccgacccacctaaaacccatgttactcaccaccccatttccgatcacgaggtaacacttcggtgctgggcactgggattctaccctgccgaaattaccctcacatggcaacgcgacggggaagaccagacacaggacacagaactggttgaaacccgtccagccggcgacaggacttttcagaaatgggccgccgtggtggtaccttccggtgaggagcagcgatatacttgccatgtccagcacgagggtcttcccaagcccctgactctgagatgggagcccagctctcagagcacagtgccaattgtggggattgtggctgggctggccgtccttgcagtggtagtgatcggcgcagttgtggcagcagtgatgtgcagacggaaatccagtggccacttcctgcctactggaggtaaaggaggcagttacagtcaggctgcctgttctgacagtgctcaggggtccgacgtgtctctaaccgcttag

SEQ ID NO: 43286 - DNA, 741 bp, Artificial Sequence
  Description of Artificial Sequence: Synthetic coding sequence
atggccagcgtgggccggagcgagggcaccgccggcggcggcgccggacccggcgaaccacgacgcgaggagggcagggccggcctgtccccttcatctccacctggctcccacagcatgagatacttctatactgcgatgtcgagacccggcagaggcgagcctagattcatagctgttgggtacgtggatgatacacagttcgtgaggttcgatagtgacgcagcctccccccgcatggccccacgtgccccttggatcgaacaggaagggccagaatactgggatcgcgagacacagatttctaaaaccaatacccagacctaccgcgaaagtttgaggaacctgcgcggctactacaaccagagcgaggccgggtcacacacactacagcggatgtatggctgcgatgtgggcccagacggacgcttattaaggggacacgatcaatcagcctatgacggtaaggactatattgcgcttaatgaggacttgagtagctggacagccgcagatacggccgcccaaatcactcagaggaagtgggaagcggcacgcgaagctgaacagtggagagcatacctcgaagggttatgtgtggagtggctgagacgctacctggagaacggcaaagagacactccaacgagcggatccacccaagactcatgttactcatcatcccatctccgatcatgaggctacactgagatgctgggcactagggttttatccagcatag

SEQ ID NO: 43287 - DNA, 741 bp, Artificial Sequence
  Description of Artificial Sequence: Synthetic coding sequence
atggccagcgccggccggagcgagggcaccgccggcggcggcgccggtcccgaggaacccaggagggaagagggtcgggccgggttgagccccagcagccctcctgggagccatagcatgagatattttgacacggccatgagcaggcctggacgcggtgaaccccggtttatctctgtggggtatgtcgatgacacccaattcgtcaggtttgacagtgatgcggcaagccccagagaggagcctcgggcgccttggattgagcaagaagggcccgagtattgggaccgaaatacgcagattttcaagacaaatactcagactgaccgcgagagcttgagaaacttgcgtggctactataaccagtctgaagcaggctcacataccttacagagcatgtatggatgcgacgtgggacctgacggcaggctgctaagaggacataaccagtacgcctatgatggaaaggactatattgctctgaatgaggacctgagatcatggactgccgcggatactgcagcccagatcacacagcggaagtgggaggccgcgcgggtggctgagcaggatagggcgtacctggagggcacatgtgtcgagtggctcagacggtacctggaaaatggtaaggacacactcgagagagccgatcctcccaaaacgcatgtgactcatcaccccatatccgaccatgaggctactctccggtgttgggctctggggttctatccagcctag

SEQ ID NO: 43288 - DNA, 741 bp, Artificial Sequence
  Description of Artificial Sequence: Synthetic coding sequence
atggccagcgtgggccggcgggagggcaccgccggcggcggcgccggccctggtgaaccgcgccgggaagagggaagagctggactaagcccctcctcaccgccgggtagtcactccatgagatacttctacacagcaatgtccaggccgggtaggggggagcctagatttatcacggtcggttacgtggacgacactctgtttgtacggtttgatagcgacgccaccagcccacgaaaagagcctagggccccttggatcgagcaggaaggtcctgagtattgggatagagagacacagatctcgaagaccaatactcagacctatcgcgagaacttgcgcaccgccctgcgctattataaccaatctgaagctggatcccatatcatacagaggatgtatggatgtgatgtggggcccgatgggcggctgctgcggggatatgaccaggatgcctacgatggtaaggattacattgcactgaatgaagaccttagttcctggacggccgccgacacagccgcacaaattacccaaagaaaatgggaagccgctagggtggccgagcaggacagagcttatctcgaaggactgtgcgtggaaagcctgagacggtaccttgaaaatggtaaggaaacgttgcaacgggcagaccctcctaaaacccatgtgacccaccatcccatttcagaccatgaggttactctacggtgttgggcactgggattttaccctgcctag

SEQ ID NO: 43289 - DNA, 1089 bp, Artificial Sequence
  Description of Artificial Sequence: Synthetic coding sequence
atgcgggtgaccgccccccggaccgtgctgctgctgctgagcggcgccctagctcttactgagacatgggccgggagccactctatgcggtatttttacaccgccatgtcccgccctggacgcggcgagccaaggttcattgcagtgggctacgtagacgacacccagtttgtgaggttcgactctgacgcggctagtcctcgtatggctccacgggctccttggattgagcaagagggacctgagtactgggaccgcgaaactcagatttcaaagacaaatacccaaacgtaccgcgaatctctgcgtaaccttaggggctactacaaccagagtgaggccggaagccataccctgcagcgtatgtacggctgcgacgtgggacccgacggtagactgctccggggtcatgatcagagtgcctatgatgggaaggattacatcgcattgaacgaggatctctcatcatggacagccgcagacacagccgcgcaaatcactcaacgtaagtgggaggctgcgcgcgaggccgaacagtggcgggcatatctcgaaggcctgtgcgttgagtggctgaggcgctaccttgaaaatggcaaagagaccttacagagagcagatccgccgaagacccatgttacacaccaccccatttctgaccatgaagctacattgcgctgctgggccctggggttctaccctgccgagattacactcacatggcagcgggatggtgaggatcaaacccaggatacggagctggtggagacaagacctgcaggagatcggacgtttcagaagtgggcagccgtggtggtgccttccggagaagagcagcgatacacttgtcatgtgcagcatgaaggattgccgaagccgctgaccctcaggtgggaaccctcttctcaaagtaccatccccatagtgggaatagttgctggactagccgtactcgctgtcgtggtgattggggcagtcgttgcaaccgtcatgtgccgccggaaatcctccggcggcaagggagggtcttattcccaggctgctagtagcgattctgcacagggttccgacgtaagcctcacggcctag

SEQ ID NO: 43290 - DNA, 609 bp, Artificial Sequence
  Description of Artificial Sequence: Synthetic coding sequence
atgtacggctgcgacgtgggccccgacggccggctgctgcggggccacgatcagtatgcctacgacgggaaggattacatagcattgaatgaggacctgcgatcctggacagctgctgatacagctgcccagatcacccagagaaaatgggaagcagccagagaggcagaacagcggcgagcctacctggaaggcgagtgcgttgaatggctcaggcgctatttagaaaacgggaaagataagctggagcgagcagacccacctaagactcacgttactcaccatccgatttcagatcacgaagcaacgctgcgatgctgggcgctcggattttaccccgcagagattactcttacatggcagagagacggggaggaccagacgcaagatactgagttagttgaaacccgccccgcaggcgatcggacctttcagaaatgggccgccgtcgttgtcccatcgggagaagaacagcggtatacttgccacgtgcagcacgagggtctgcctaaacccctgactctgagatggggcggcaagggcggcagctatagccaagcagcctgctcagatagtgcccaggggtccgatgtgtctctcactgcatag

SEQ ID NO: 43291 - DNA, 675 bp, Artificial Sequence
  Description of Artificial Sequence: Synthetic coding sequence
atgctggtgatggccccccggaccgtgctgctgctgctgagcgccgctttagccctgacggagacctgggcaggttctcatagcatgagatacttcgacaccgccatgagtaggccaggccgtggtgagccacgctttataagtgttggatatgttgatgacacacagtttgtccggtttgactcggacgccgcgtctcctcgcgaagagcctagagcgccctggattgagcaagagggacccgagtattgggatagaaacacacagatctttaagacaaatacacaaacagaccgggaaagcctgcggaacctcaggggttattacaaccagtcagaagccggtagccatacacttcagtctatgtacggctgtgacgtgggcccagacgggaggctgctcaggggccataatcagtatgcatacgacggaaaggactacatagctctcaacgaagacctccgctcttggaccgcagccgacaccgctgcacagataacccaaaggaagtgggaagctgcccgggtggctgagcaggatcgagcatatttggaggggacttgcgtggaatggcttaggagatatctggagaacggaaaagacactctggagcgcgcagaccaggagcagaagtccctcttccccgctcagcggttagagctgagtaacgagtag

SEQ ID NO: 43292 - DNA, 675 bp, Artificial Sequence
  Description of Artificial Sequence: Synthetic coding sequence
atgcgggtgaccgccccccggaccgtgctgctgctgctgagcggcgcgttagctctgacagaaacttgggccgggtcccacagcatgagatacttttacaccgccatgagtcgtcccggacggggcgaaccacgctttatcgccgttgggtacgtagatgacactcagtttgtgcgtttcgactcggatgcagcttcgcctaggatggcccctcgtgcaccctggatcgagcaggagggacctgagtattgggaccgcgaaacacagataagcaaaactaatacccagacgtaccgggagtccctgagaaacttgcggggctactacaatcagtctgaagctggaagccatactttgcaaaggatgtacgggtgcgacgtcgggccagacggtcgactgcttcggggccacgatcagtcggcctatgacgggaaggattacatcgccctcaacgaggaccttagcagctggaccgctgccgacacagcagcgcaaatcacacaaagaaagtgggaagccgcgcgcgaagccgagcagtggagagcctatttagagggactgtgcgttgaatggcttaggaggtatctagaaaacgggaaagaaacattgcagcgagctgatcaggaacagaagtcactgttcccagctcagcgcctcgagttatcaaacgagtag

SEQ ID NO: 43293 - DNA, 675 bp, Artificial Sequence
  Description of Artificial Sequence: Synthetic coding sequence
atgcgggtgaccgccccccggaccctgctgctgctgctgtggggcgctgtggccctaacggaaacctgggccggctcacacagtatgcgatactttcacacgtctgtgagtaggcccgggagaggcgaacctcggttcatctcggtgggttacgtggacggaacccagttcgtgaggttcgatagcgatgccgcctctccacggacagagcccagggcaccatggattgagcaggagggccctgaatattgggaccgtaacactcaaattagcaagacaaacactcagacttacagagaaagtctacgcaacctgcgggggtactataatcagagcgaagcaggttcccacacccttcaacgaatgtatggctgcgacgtcggtcccgatggcaggttacttcgggggcacgaccaatctgcttacgacggtaaagactatattgctctcaatgaggacttgtcgtcctggacagcagcagacaccgcggctcagatcacccaacgaaagtgggaagccgctagagtggcagaacaattgcgggcgtacctggaggggacctgcgtagagtggcttagaagacacctggaaaacggtaaggagaccttgcaacgcgcagatcaggagcagaaatctctgtttccagctcagaggttagagctctccaatgagtag

SEQ ID NO: 43294 - DNA, 675 bp, Artificial Sequence
  Description of Artificial Sequence: Synthetic coding sequence
atgcgggtgaccgccccccggaccctgctgctgctgctgtggggcgctgttgccctcactgaaacttgggcaggctctcacagcatgaggtacttctatactgcaatgtccaggccaggcagaggtgagcccagattcatcaccgtgggatacgtcgacgacaccttgttcgtgagattcgattcagatgccacatcaccacggaaggaaccacgagccccttggatcgaacaggagggccctgagtattgggaccgcgaaactcagatcagcaaaacgaatacccaaacgtatagagagaatctgcgtacagctctgcggtactataaccagtccgaggctgggagccacataattcagcgaatgtatggatgtgatgtgggacctgatgggcgactgctcagggggtacgatcaagacgcctatgatggtaaagattacattgctctcaacgaggatttgagctcttggacagctgcggatacggccgcacaaattacgcagagaaagtgggaggccgcacgcgtcgcagagcaacttagggcatatctcgaaggcttgtgcgtggagtcattgcggcggtatcttgaaaacggaaaagaaacactccagagagctgaccaggagcagaaaagtctctttcctgcacagcggctggaactgagtaatgagtag

SEQ ID NO: 43295 - DNA, 675 bp, Artificial Sequence
  Description of Artificial Sequence: Synthetic coding sequence
atgcgggtgaccgccccccggaccctgctgctgctgctgtggggcgccgtcgcgctcacagaaacgtgggctggaagtcattcaatgcgctacttttacaccgcaatgagccggccaggtaggggagagccacgcttcataactgtcgggtatgtggatgacactttgtttgtccggtttgacagcgatgcaacctctcctcgaaaagagccccgagccccatggattgagcaagagggacccgaatactgggacagggagacccagatcagcaagacaaatacgcagacctacagggagaacctacgaactgcactgcgttattataaccagtccgaggctgggtcccacatcatacaaagaatgtacggatgtgacgttgggcccgacggtcgtctcctgaggggctacgaccaggacgcctatgatggcaaggactacatcgccctcaacgaggacctctcctcctggacggccgccgatacagcagcccaaattactcagcgaaaatgggaggccgcccgtgtagcagagcaagatcgcgcatatctagagggtctctgcgtggaatctctaaggcgctatttggaaaatgggaaagagactttacaaagggccgatcaggagcagaaatcacttttcccagctcagcgactagagttgagtaatgaatag

SEQ ID NO: 43296 - DNA, 1302 bp, Artificial Sequence
  Description of Artificial Sequence: Synthetic coding sequence
atgcgggtgaccgccccccggaccctgctgctgctgctgtggggcgcggtcgccttaaccgagacatgggccgggtcacattccatgagatatttttataccgcaatgtctcggcctggacgaggagagccgagatttattactgtgggctacgttgacgacaccttgtttgtacgcttcgactcagacgctacgtcccctagaaaagagccacgggccccctggatagaacaagagggacccgagtactgggatcgtgagactcagatctcgaaaacgaatacccagacatatagggaaaatctgagaaccgcactgaggtactacaatcccggccgcagaagccgtctgccaatcccccatgtgcggccaggtagccccagggtgtccggcagtgaaataaggccaaggggtagaggcacccgacctgacccgaggcccgcccgcgcccccggtgctttcacgagatttcactttcaactgaggccgaagtcaccccgtgtaggtagagggggtgcaggcctcggcactgggctgactgctggacccggcccgggatcccacatcatccagcgcatgtacggttgtgacgtcggccctgacggccgcctcttgaggggctatgaccaggacgcctatgatggcaaagattatatcgctcttaatgaagacctgtcatcctggaccgccgctgataccgccgctcagattactcagcgaaaatgggaggctgcccgggtcgccgagcagcttagggcataccttgaagggttatgcgttgaatctctgagacgctatctggagaatggaaaagagacactccagcgcgccgacccccccaaaacgcatgtaacgcaccaccccatatcagatcacgaggtgactttaaggtgctgggcgctaggcttctaccccgcagaaataaccttgacatggcagcgcgacggcgaggaccagacgcaggatacggagttggtggaaacgcgccccgccggagataggacgtttcagaagtgggcggctgtcgttgtacccagcggcgaagagcaacgctacacatgccacgtgcagcatgaggggctgccaaaaccattgactcttcggtgggagccatccagccagtctacagtccccatagtcgggatcgtcgctggactggccgtgttggctgtagtagtcatcggggccgtagttgctgccgtcatgtgcaggcgcaagagctctggaggcaagggaggctcctattcacaggcagcctgttcagactctgcacagggatccgatgtcagcctgaccgcatag

SEQ ID NO: 43297 - DNA, 726 bp, Artificial Sequence
  Description of Artificial Sequence: Synthetic coding sequence
atgtacggctgcgacgtgggccccgacggccggctgctgcggggccacaaccagtacgcctatgacggtaaggactacattgctttaaatgaggatctgcgcagttggaccgccgcagatactgccgctcagattacccagcgaaagtgggaggccgcgagagtggccgagcaggacagagcttatctggaaggtacttgtgttgagtggctgaggagataccttgagaacggaaaggacacgctcgagagagctgatccgccaaagacccatgtcactcaccatccaatcagcgaccatgaggcaacactgcgctgctgggcattagggttttatccagccgagattacacttacttggcagagagacggcgaggaccagacccaggataccgaattggttgagactagacctgctggtgaccggacttttcagaaatgggcggctgtcgttgtgccctccggagaggagcagcgttacacatgccatgtgcagcatgaaggcctgcccaagcccttgaccctgagatgggaacccagctcccagtctaccgtacccatcgtgggcattgtcgcaggtctcgccgtgttagctgtagtagtcataggtgcagtggtagccgccgtcatgtgccgccgaaagtcttctgggggtaaaggcggatcctactctcaggccgcttgctctgacagcgcacagggctcagacgtgtccctgacagcttag

SEQ ID NO: 43298 - DNA, 1302 bp, Artificial Sequence
  Description of Artificial Sequence: Synthetic coding sequence
atgcgggtgaccgccccccggaccctgctgctgctgctgtggggcgcagtggctctgaccgaaacctgggccggctcgcatagcatgaggtacttctacactgccatgagtcggccagggcggggcgaacctcgctttataaccgtgggctacgtggacgacactctgttcgtgcgttttgacagcgatgctacatctccaagaaaagaaccacgggctccttggatcgagcaggaagggccggagtattgggatcgcgaaacccaaatatccaaaactaatacccagacttaccgggagaatctacgaactgctctccggtattacaatccgggcagacgaagtcgcctgcccattccacacgttaggccgggctcccctcgagtctctggctccgaaattcggccaagaggtaggggaacgagacccgatccccggcccgctcgtgcaccaggagcctttacacggtttcattttcagctaaggccgaaatcgcccagggttggccgcggaggtgcagggctaggcacaggattgaccgcaggcccagggccagggtcccacatcattcagcgcatgtatggctgtgatgtaggccccgacggacgactccttcgaggttacgatcaggacgcgtatgacggaaaagattacattgccctgaacgaggacctgtcttcgtggacagctgcagataccgcagctcagattacgcagcgcaaatgggaggcagctcgagttgccgaacaagacagagcgtatctcgaaggactatgcgttgaaagcctgcggcgctatcttgaaaacggcaaagaaacattacagagagccgatccgccaaagacccatgtgacacatcatcccatttcagaccacgaagtgacactaagatgttgggccctgggcttttacccagcagaaataaccttgacctggcaaagagacggagaggatcagacccaggacacggagttggttgagactaggccggctggcgatcggacgttccagaagtgggccgctgtggtggtgccatctggtgaggagcagaggtacacttgccacgtgcagcacgagggcttgcctaagcctctgacacttcggtgggaacctagctcccagagtaccgttcctatagttggtatcgttgccggcctggccgtcttagccgtggtggtgatcggggctgtggtggcggccgtgatgtgcaggagaaagtctagcggcggtaaaggtggatcctacagccaggctgcttgcagcgacagcgctcagggttctgatgtttcactcactgcatag

SEQ ID NO: 43299 - DNA, 1077 bp, Artificial Sequence
  Description of Artificial Sequence: Synthetic coding sequence
atggtggacggcaccctgctgctgctgctgagcgaggccctggccctgacccaaacatgggcaggcagccatagcctgaagtatttccatacatcagtgtcgcggccgggacgtggtgagcctcgttttatctcggtgggctatgtcgacgacacccaattcgtgagattcgataacgacgcggcgtctcccagaatggtccccagggcaccatggatggaacaggagggaagtgagtattgggaccgtgagaccaggtcagcaagagatactgcacagatctttcgtgtcaacctgcgcacattgagaggctattataatcaaagcgaagccggttcccacacgcttcaatggatgcacggatgcgaattggggcccgatggtaggtttctgagagggtatgaacaattcgcttatgacgggaaggattacctgactctcaacgaggaccttcggtcatggaccgccgtggataccgccgctcaaatctcagagcagaaatccaatgacgcatctgaggccgaacaccaacgagcttacttggaggacacttgtgtggagtggctgcataaatatctggagaagggcaaggaaactctcctgcacctggaaccacccaaaactcacgtgacccatcacccaataagtgaccacgaggccactctacgttgctgggcccttggcttttaccctgccgagatcacactcacttggcagcaggacggagaaggccatactcaagatacagaactcgtggagactagacctgctggcgatggaacttttcaaaagtgggctgctgtagtggttccatctggcgaggagcagagatacacatgccatgtacagcacgaaggcttgcctgagcccgttaccctaagatggaagcctgcgagtcaacccaccattcccattgtggggatcatcgccggtttggtcctgcttgggagcgtcgtatccggcgctgtcgtggcagccgttatctggcggaagaaatcatccgggggaaaggggggatcttatagcaaggctgagtggtctgattctgcccagggtagtgagagccatagcctctag

SEQ ID NO: 43300 - DNA, 1077 bp, Artificial Sequence
  Description of Artificial Sequence: Synthetic coding sequence
atggtggacggcaccctgctgctgctgctgagcgaggccctggccctgacccagacttgggccggaagtcactccctcaagtacttccacacctccgtgtctcggcctggtcgcggagagccacgatttatatctgtgggatacgtcgatgatacccagttcgtccgattcgacaacgatgcagcctcaccaagaatggtgccacgagccccctggatggagcaggagggatctgaatattgggacagggagactcgatccgcccgcgacaccgctcagatttttcgtgtgaacctccggactctaaggggctactacaatcagtcagaagccggatcgcacacactgcagtggatgcacggttgcgagctgggtcccgatcggagattcctgcggggctacgaacaatttgcttacgatggaaaagactacctaactttgaatgaagatctccggagttggaccgctgttgacaccgctgcacagatcagcgagcagaagagtaatgatgcctctgaagcggagcaccagcgggcttatctggaagacacctgcgtggaatggctccacaagtacctcgagaagggcaaagaaacactgttgcacttggagcctcccaaaacccacgtcacccaccacccaatttcggaccatgaagcaacactgcgctgctgggctctaggattttacccagcagaaatcacactgacgtggcagcaggacggcgaaggacacactcaggacaccgaactagttgaaacacgccccgcgggcgatggaacttttcagaagtgggctgctgtcgtggtgccctctggcgaggagcagcgttatacctgtcatgtgcagcacgaaggcttacccgaaccagtgaccctgcgttggaaacccgcttcgcagccaactattcctatcgtgggaattatcgccgggctcgttctgctcgggagtgtggtctctggcgcagttgtcgcggccgttatttggcgcaagaagtctagtggggggaaaggaggatcctatagtaaggcggagtggtctgattctgctcaggggtcagagagccattccctctag

SEQ ID NO: 43301 - DNA, 1077 bp, Artificial Sequence
  Description of Artificial Sequence: Synthetic coding sequence
atggtggacggcaccctgctgctgctgctgagcgaggccctggccctgactcagacctgggcaggctctcactctcttaagtatttccatacctctgtatctcggccgggccggggcgaaccccggtttatctcagttggctacgtcgacgacacacagtttgtgcgtttcgataacgacgctgcatcccccagaatggtgccccgtgcaccatggatggaacaagaggggagcgaatattgggaccgcgagacaaggtccgccagggatactgcgcagatcttcagagtaaacctacggacactgcgggggtattacaaccaatctgaagccgggagtcatactctccagtggatgcatggttgtgaactgggccccgaccggaggtttctgaggggatacgaacagttcgcctacgatggcaaggactatctcactcttaacgaggacctgcgcagttggacagcagtcgataccgcggcccaaatctccgaacaaaaatccaatgacgccagcgaggccgagcaccagcgagcatatttagaggacacgtgcgttgagtggctgcacaaatatctcgagaagggcaaagagacactactgcaccttgaacctcccaagacacacgtcacacaccaccctatcagcgatcacgaagctaccctcaggtgctgggccctcggcttttatcctgccgagatcaccttgacctggcaacaggatggtgaaggtcatacacaggacaccgagctggtcgaaacccgaccagcaggtgacggcaccttccagaagtgggctgccgttgtggttcctagcggagaagaacaacgttatacctgccacgtccagcatgagggcttgccggaacctgtgacactgaggtggaaacccgcaagtcagcccaccattccaatagtgggaattattgctggactggtgctgctcggcagcgtcgtcagtggcgccgtcgtagccgccgtgatctggcggaagaagagttccggcgggaagggcggaagttatagtaaggcagaatggtcagactctgctcaagggtcagaaagccactcactatag

SEQ ID NO: 43302 - DNA, 1077 bp, Artificial Sequence
  Description of Artificial Sequence: Synthetic coding sequence
atggtggacggcaccctgctgctgctgctgagcgaggccctggccttaacccagacttgggctggatcacactccctgaagtatttccatacgtcagttagcaggccaggacgcggtgaacctaggttcatttccgtgggctatgtggatgacactcagttcgtgcgctttgacaatgacgcagccagcccgcggatggtgccacgcgcgccctggatggaacaggagggctccgaatactgggatagagaaactagatctgcccgagacaccgcacagattttccgcgtaaacctaaggaccctgagagggtattataatcagtctgaggcaggttcccacaccttgcagtggatgcacgggtgtgaactgggacctgatcggcgatttctgcgagggtacgagcagtttgcatatgatggcaaggactacttaacactgaatgaggacctgagatcttggactgcagttgatactgctgcccagatatccgagcagaaaagcaacgacgcctccgaggcggagcaccagagggcctaccttgaggacacttgcgtggaatggctccataagtatttggagaaaggaaaggagacactcctgcacctggagccaccaaagacccacgtgacacaccaccccatctctgatcatgaggctaccctccggtgttgggccctcggcttttatcctgccgaaattactctcacttggcaacaagacggtgaggggcacacccaggacactgaactggtggagacccgacctgcgggtgatggaactttccaaaaatgggctgcagttgtagtcccttctggcgaggagcagagatacacttgccacgtgcagcatgaggggctaccagagccagtcactctccgctggaagcccgcgtcccagccgacaatccccatcgttggaataatcgccggcttggttcttttaggctccgttgtgtctggtgcagttgtagccgccgtgatctggagaaagaaatcaagcgggggcaaaggtgggtcctattctaaggccgaatggagcgatagcgctcagggcagcgagagtcactccttatag

SEQ ID NO: 43303 - DNA, 1077 bp, Artificial Sequence
  Description of Artificial Sequence: Synthetic coding sequence
atggtggacggcaccctgctgctgctgctgagcgaggccctggccctgacccagacatgggctggatcccattctctgaaatactttcataccagcgtcagcaggcccgggcgaggcgagccaagattcatttctgtgggttacgtagacgatacccaattcgtccgcttcgataacgacgcggcctctcctcgtatggtcccccgcgctccttggatggaacaggagggatccgaatattgggatcgcgagacacggtctgccagggacacagcccagatcttcagagtgaacctgcgtaccctccggggatactataaccagtcagaggccggctcccacactctgcaatggatgcacggctgcgagctgggccctgatggtcgcttccttcgaggctatgaacagttcgcatatgatggtaaagattacctgacacttaacgaggatttaagatcttggaccgcagtcgacactgcagcccaaatcagcgaacaaaagagcaacgatgcctcggaggcggagcaccagagggcatacctagaggacacttgtgtcgaatggctgcacaaatacctggagaagggtaaggaaactctccttcacctcgagccaccgaaaacccacgttactcaccatcctattagcgaccatgaggcaacactgcgctgttgggccttgggattctaccccgcagagataactttgacgtggcagcaggatggcgagggccacacgcaggatacggagttggtggagactaggcctgccggggacggaacgtttcaaaaatgggcagccgtagtcgtgccgtccggagaagaacaaaggtacacctgtcatgtgcagcacgaggggttgcctgagcccgtaacactgcgatggaagccggcttctcagcctactataccaattgtgggcatcatagctggcctcgtcctgctaggtagcgtcgtatctggtgccgtggtcgcagctgtgatttggagaaagaagtcatccggcgggaagggcggctcatactctaaagccgagtggagcgactccgcccagggcagtgagagccacagtctctag

SEQ ID NO: 43304 - DNA, 1077 bp, Artificial Sequence
  Description of Artificial Sequence: Synthetic coding sequence
atggtggacggcaccctgctgctgctgctgagcgaggccctggccctgacacagacttgggccggaagtcactcactgaaatacttccacacttctgtgtcgcgtcctggcaggggggaaccccgattcatcagtgtgggttacgtcgatgatacccagttcgtgcgttttgacaacgatgctgcttccccgagaatggtgcctcgtgcaccctggatggaacaggaaggtagcgagtactgggacagagaaacccgttccgcccgcgatactgcacaaatctttagagtgaatctgcggactctccgcggctactataaccagtctgaggccggcagccataccctccagtggatgcacggctgcgagctggggcccgaccgacggttcctgagggggtatgagcagtttgcatacgatggcaaagattacttaacattgaatgaagacctgcggagctggaccgcagtggataccgccgcccagatatcagaacaaaaatctaacgacgctagcgaagcagagcaccagcgagcttacctggaagacacatgcgtcgagtggctgcacaaatacctcgaaaaggggaaagagacactgcttcatttggaaccgcccaaaacgcacgtaacgcaccatccaatttctgaccacgaggctacgctccgatgctgggctctgggtttttatccagccgaaatcacactgacttggcagcaggatggagaggggcatacccaggataccgagctagtggaaacccggccagcgggggacggcacttttcagaaatgggcagcagtggtggtccctagtggagaagagcagagatatacatgccacgtccagcatgagggactcccagaacccgttacactgcgctggaagcctgcctcccaacctactatcccgatcgtaggcatcatagcgggcctggttctactcggcagtgtagtttccggcgccgtggtggccgctgtgatctggcggaagaagtcctcgggcggaaagggcggatcctactcgaaggccgaatggagtgattctgcacagggctccgaaagccacagcctgtag

SEQ ID NO: 43305 - DNA, 1077 bp, Artificial Sequence
  Description of Artificial Sequence: Synthetic coding sequence
atggtggacggcaccctgctgctgctgctgagcgaggccctggccctcacacagacatgggcagggagccatagtcttaaatatttccatacttcagtgtctcgcccgggccgcggcgaaccccgtttcataagcgtcggatacgtagacgatactcagtttgtcaggtttgacaacgacgcggccagcccccgcatggttcctagggctccgtggatggagcaggaaggctccgagtactgggaccgagagacccgctcagcccgcgacactgcccaaatatttagagtcaatctgagaacattgcgcggctattacaatcagagcgaggctggctcacacacattacagtggatgcatggctgcgaactcggcccagatggccggtttcttcgggggtacgagcagttcgcctatgatgggaaggattacctgacactcaacgaagatttgcgttcatggacagcagttgacactgccgcacagatctccgagcagaagagcaacgatgcaagcgaagctgagcaccaacgcgcctacttggaagatacatgcgtagagtggctccacaagtatctggaaaagggcaaagagaccctgttgcacctggaaccccctaaaacccacgtcacacaccaccccatcagtgatcacgaggccacccttcggtgctgggctctcggattttatccagccgagatcaccttgacatggcagcaggatggagagggccacacacaagacactgagttagtggagacccgcccagccggcgatggcactttccagaagtgggccgccgtggtggtcccatcaggcgaagagcagcgatatacttgccacgttcagcatgagggattgcccgaaccagtcaccctgcgatggaagcccgcctcccaacctactattccaattgtaggcatcatcgccggcctggtgcttttgggcagtgtggtgtcaggggctgtggtggctgctgtgatctggcgaaagaaatcatcaggcggaaagggcggcagttatagcaaggccgaatggtctgatagcgcccagggctcggagagccactccctgtag

SEQ ID NO: 43306 - DNA, 1200 bp, Artificial Sequence
  Description of Artificial Sequence: Synthetic coding sequence
atggagcccagcttctacagcagccggcggccctggcccctgccccgccccggccgagttagcgcaggttcaggctggaaacgtcctttgccaggagtcgagaggggacggccaggcggaggcgaggggctgggcgagccccgacgggaggaaggaagagctgacctgtcaccttcctccccacccggcagtcattccctaaagtactttcatacctctgtctccaggccaggcagaggggagccccggtttatctccgtgggatacgtggatgatactcagtttgtgaggtttgacaacgatgctgcatctccccggatggtcccccgcgctccgtggatggaacaggaggggagcgagtattgggaccgcgagacgcgcagcgcgagagacaccgcccaaatctttcgggtgaacttacggacacttagaggctattacaatcagtccgaggcagggtcacacacactccagtggatgcacggatgcgagttgggaccagaccggcgatttctacgcggatatgaacaattcgcatatgacgggaaagattacctcacactgaatgaagatctgagatcatggaccgccgtggatactgccgcccagatctctgaacagaagagcaatgacgcatccgaagctgagcatcagcgcgcatacctggaagatacctgtgtggagtggttgcacaaatacctcgagaaaggtaaggaaaccctgttgcacctggagcctccaaagacacatgttacgcatcatccgatttctgaccatgaggcgacccttcggtgttgggctctagggttctatcccgccgagatcactttgacatggcagcaggacggagaaggacatactcaagacaccgagctggtggagactcggccagctggcgacggcacttttcagaagtgggccgctgtcgttgtgcccagcggggaggagcagagatacacctgtcacgtgcagcatgaaggtcttcctgaacccgttaccctgcggtggaaacccgcgtcccagccgactattcccatagtggggattattgcagggttagtgttgcttggttcggttgtaagcggggccgtggttgccgctgtgatctggcggaaaaaatcatccgggggaaagggcggcagttatagcaaagccgagtggagcgattctgcacagggttccgaatcccattccttatag

SEQ ID NO: 43307 - DNA, 1329 bp, Artificial Sequence
  Description of Artificial Sequence: Synthetic coding sequence
atggccccccggagcctgctgctgctgctgagcggcgccctggccctaaccgatacatgggctggttcccactcactgcgctacttctcaactgccgttagccgaccaggcaggggtgaacctaggtacatcgcggtggagtatgtggacgatacacagtttctgcggtttgatagcgatgccgcaatccctaggatggaacctagggaaccctgggtggagcaggagggtccccagtactgggaatggaccaccggctacgccaaagccaatgctcagacagatagggtcgccctgaggaatctattacgacgttataatcagagcgaggccggctctcacacacttcagggcatgaacggatgcgacatgggccctgacggcagactgctccgggggtaccaccagcacgcctacgatgggaaagactatatcagtctaaatgaggacttaagaagctggactgctgcggacacagttgcacagattacccagcggttctacgaagccgaggagtacgcggaagaatttcggacctatctggaaggagagtgcctggagcttctgcggcggtacctcgaaaacggaaaagagaccctgcagagggcggatccccctaaagcccacgtggctcatcaccctatctcggatcacgaagcgactttaagatgttgggctctgggtttctaccctgcggagattaccctaacatggcagcgtgacggcgaggaacagacacaggataccgagctagtggagacaagacctgcgggggatggtactttccagaagtgggccgcggtggtagttccgccgggcgaagagcagaggtacacttgccacgtgcaacatgagggactgcctcagcctctcatcctacggtgggagcagagccctcagcccacaattccaattgtggggattgtggccggtctcgtagtgctgggtgccgttgtgaccggcgccgtggtagccgccgtcatgtggcgaaagaaaagcagtgacagaaatcgcggcagctatagccaggctgctgcttactctgtcgtctcagggaatcttatgataacgtggtggtcttctctatttctgctgggcgttctgttccaaggatacttggggtgcctcaggagccatagtgtcctggggcgtcgtaaggtcggcgacatgtggattttgttcttcttatggctttggacttccttcaacaccgcgtttttagctctgcaatcccttcgcttcggttttgggttccggcgcggacgctcttttctcctgcggagctggcaccatctcatgaagagggtgcaaattaaaattttcgactag

SEQ ID NO: 43308 - DNA, 1041 bp, Artificial Sequence
  Description of Artificial Sequence: Synthetic coding sequence
atggccccccggagcctgctgctgctgctgagcggcgccctggccctaacagacacctgggctgggtcacactcactgcgttacttctccactgctgtgagtcggcctggcaggggtgaaccccggtatattgccgtggagtacgtggatgacactcagttcctgcgctttgattcagatgctgctatcccaagaatggaacctagggagccttgggtggagcaggagggaccgcagtactgggaatggacaacgggctacgccaaagccaatgctcagacagacagggtcgccctgaggaacctattgcggcgatataaccagtctgaagccggctctcacacgcttcaagggatgaacggctgcgatatgggtcctgatgggcggttgctaaggggataccaccagcatgcttatgacgggaaagactatatcagcctgaacgaggatttgaggtcttggacagctgctgataccgtggcccagatcacacagcgcttttatgaagcagaggagtacgctgaagagttccgcacctatctcgagggagaatgtttagaactgcttaggcggtacctcgagaacggaaaggagactctccagcgggccgatccgcccaaggcacacgtggctcatcaccctatctcagatcacgaagcaacactgagatgttgggccctcgggttttaccccgccgaaataaccctgacctggcagagggacggtgaagagcagactcaggatacagagcttgtcgaaaccagaccggccggggacggcaccttccagaagtgggccgctgtggtggtaccgccaggcgaggagcagcgatacacatgccatgtacagcatgagggtttgccccaacccctcatcctgcggtgggaacagtctccccagcctacaatacccattgtcgggattgtggccgggctcgtcgtactgggagcggttgtcacaggcgccgttgttgcggctgtgatgtggaggaagaagtctagtgaccgcaataggggctcatatagtcaggctgcagtgtag

SEQ ID NO: 43309 - DNA, 1041 bp, Artificial Sequence
  Description of Artificial Sequence: Synthetic coding sequence
atggccccccggagcctgctgctgctgctgagcggcgccctggcccttaccgacacctgggccggtagccattctctgaggtacttctccactgccgtttctcgaccagggcgcggggagcctaggtatatagctgtggagtatgttgacgatacccagttcctgcggtttgactcagatgctgctatcccaagaatggagccaagagaaccttgggttgagcaggagggtccgcagtattgggagtggaccactgggtacgccaaggccaatgctcaaacggaccgtgtcgccctgcgcaacctcctacggcggtacaatcaatctgaggctggtagccacaccttacagggcatgaacggttgcgacatgggcccagatgggcggctcctacggggttaccaccagcatgcatacgacggcaaggactatatcagtctcaatgaagatctgaggtcctggactgctgctgacactgtggctcagatcacacagaggttctacgaagccgaggagtacgccgaggagtttcggacatatctcgaaggtgagtgtttagaactcttgcgcagatacctcgaaaatggcaaagagacgttacaaagggctgacccccctaaggcccatgtggcccaccatcccatcagcgaccatgaggccactcttcgatgctgggcgttgggattctacccagcagaaatcaccctgacatggcagcgtgatggcgaggagcagactcaggatacggaactcgtggaaaccagacccgccggtgatgggacctttcagaagtgggctgccgtggtcgtcccgtcaggggaagagcagcgctacacatgtcacgtccaacacgaagggctaccgcagccgcttatattgcgctgggagcagtcgccacaaccgactattcccatagtcggaatagtcgctggcctggtggtcctgggcgccgtcgtcaccggggctgtggtggcagccgtgatgtggaggaagaagtcctccgacagaaaccgcggatcatactcccaggccgctgtttag

SEQ ID NO: 43310 - DNA, 765 bp, Artificial Sequence
  Description of Artificial Sequence: Synthetic coding sequence
atggccccccggagcctgctgctgctgctgagcggcgccctggccctgacggacacctgggccggctcccacagtctgcggtatttctccactgctgtgtctcgccccggacgaggcgaaccccgatatatcgccgtggaatatgtggacgatacgcagtttctccgtttcgatagcgatgctgccataccacggatggagcccagagagccatgggtagagcaggaaggcccccaatactgggaatggactaccggttacgccaaagccaatgcacagaccgatagggtagccttgcgcaacctgctcagaagatataaccagtctgaggctggctcccacactctgcaagggatgaatggctgcgatatggggccagacggcagattgctccgcggataccaccaacacgcatacgatggcaaggactatatctcactcaacgaggacctccgcagctggacggctgctgatacagtggcccaaattactcagcgcttttacgaggccgaggaatacgcagaggagtttaggacgtacctggaaggtgaatgtctggagttactgagaagatatctcgagaatggcaaggaaacactccagagagcagagcagtccccgcagccaaccattccgatcgtgggcattgttgcaggccttgtagtcctgggcgcagtggtgaccggtgcagtggtggctgcagtgatgtggagaaaaaagtcctctgaccggaatcgcggatcgtacagccaggctgcggtgtag

SEQ ID NO: 43311 - DNA, 1005 bp, Artificial Sequence
  Description of Artificial Sequence: Synthetic coding sequence
atggccccccggagcctgctgctgctgctgagcggcgccctggccctcaccgacacctgggccggtagccactccctgcgctacttttcaaccgccgtctccaggccggggcgcggcgagccaagatacattgcggtggagtatgttgatgatacccaatttttgagattcgacagtgacgctgcaatcccccggatggaaccacgtgagccctgggtggagcaggaggggcctcagtactgggaatggacaacaggctatgctaaagccaatgcccagacggatcgcgtcgctttaagaaacctgctgcggcgatataaccagagcgaggccggttcacacaccctgcaaggcatgaatgggtgtgacatggggccggacggcaggctgttacggggctaccatcagcatgcttatgacggaaaagactacatcagcttaaacgaagatctgagatcttggacagcggcagataccgtggctcagataacacagcgtttttatgaggcagaggaatacgccgaggagtttcgtacatatttggaaggcgaatgtctggagctcctgcggaggtatctggaaaacggcaaggagactttgcaacgggccgatcctcccaaagcacacgtggctcatcatcctatctccgaccacgaagctaccctgcggtgctgggctttaggattttaccccgcagaaattactctcacctggcagagggacggtgaggagcagacacaggacaccgagctggtggagactcgcccggctggagatggaacttttcaaaagtgggccgcagttgtcgtgccatctggcgaggagcagcgctatacgtgccatgttcaacacgagggcctgccgcagcccttgatcctccgatgggaacagtcaccgcagcctacaatccccatcgtagggatcgtcgctggtctggttgtcctaggcgccgtagtaaccggggccgtcgtggcagccgttatgtggcggaagaaaagcagctag

SEQ ID NO: 43312 - DNA, 765 bp, Artificial Sequence
  Description of Artificial Sequence: Synthetic coding sequence
atggccccccggagcctgctgctgctgctgagcggcgccctggccctgactgacacatgggctggatcacatagtctgcggtactttagcactgccgtatccagaccaggtagaggtgagcctcgttacatcgccgttgagtacgtggacgatactcagtttctccggtttgatagcgatgctgccattccacgaatggagccgcgtgagccgtgggtagagcaggagggacctcagtactgggaatggaccaccggctacgctaaggccaatgcccagacagaccgcgttgctttaagaaatctcctgcgacgctacaaccagtctgaggctggaagccacactttacagggcatgaacggttgtgacatgggacctgacggcaggttgcttcgcggctaccatcagcacgcttatgacgggaaagactatatatctctgaacgaggatctccgatcatggactgcggctgacaccgtggcgcaaatcacccagagattttatgaggccgaggaatatgcagaagagttcagaacctacctggaaggtgaatgcctcgagctgctgcgcagatacctggagaacggaaaggagaccttgcaaagggccgagcagtcacctcagcctactattccaatagtgggtattgtagcgggcttggtagtgctcggagctgtagtgacaggcgccgtcgtggctgcagtgatgtggaggaaaaaaagtagcgaccgcaaccgaggttcatattcgcaggctgcagtgtag

SEQ ID NO: 43313 - DNA, 1041 bp, Artificial Sequence
  Description of Artificial Sequence: Synthetic coding sequence
atggccccccggagcctgctgctgctgctgagcggcgccctggccctgactgatacctgggcgggaagccattccttacggtacttctcaactgcagtatctagaccaggccgcggcgaaccccggtacatcgccgtggaatacgtagatgacacccagtttttgaggttcgactcagacgcggctatcccaagaatggagcctcgcgagccgtgggtcgagcaggagggaccgcagtactgggagtggacaaccggatacgcaaaagccaacgctcagaccgatcgggtcgcgcttcggaatctgttgcgtcggtacaaccaatctgaggctggtagccacactttgcagggcatgaacggatgcgacatggggcccgatgggaggctgctgcgcggataccaccaacatgcatacgacgggaaggattacatttctctgaacgaagacctgcgctcgtggacggccgccgacactgtggctcagattacccaacggttttatgaagccgaagagtacgcagaggagttcaggacatatttggaaggcgagtgcctggaacttctgcgaaggtacttagagaatgggaaagaaacgttacagagagcagatccccctaaggcacacgttgcccatcaccctatctccgatcatgaggccacgctgcgctgttgggctcttggcttctaccctgcagagataaccctcacctggcagagagatggggaagagcaaacccaggacactgagttggtggagactagacccgcaggagacgggacgtttcagaaatgggcagctgtcgtggtaccacctggagaggagcagagatacacttgccatgtccagcacgagggactgccccaaccactcatattgcggtgggagcagtctccccaacctacaatccccattgttggcatcgttgccggactggtggtgctgggggccgtggtgactggggccgtcgtagccgccgtcatgtggcgcaagaaaagctctgacaggaaccggggttcttattcccaggccgctgtgtag

SEQ ID NO: 43314 - DNA, 765 bp, Artificial Sequence
  Description of Artificial Sequence: Synthetic coding sequence
atggccccccggagcctgctgctgctgctgagcggcgccctggccctgaccgacacgtgggccggtagccacagtctaagatacttcagcaccgctgttagtcgtcccgggcgcggcgagccaaggtacattgctgtggagtatgtcgatgatacacagtttttgagatttgattctgatgctgctattccacgtatggagccccgggaaccctgggtggagcaagagggtccacagtattgggaatggaccaccggttatgccaaagccaatgcacagactgaccgggttgcactgcgaaatctgctacggagatacaatcagtctgaggctggtagtcacacgctacaggggatgaatggctgtgacatgggtccagacgggagattgcttcggggttatcatcagcacgcatacgatggaaaagactacatcagtctcaatgaagatctgcggtcatggaccgccgctgacaccgtcgcgcaaatcacgcagagattttacgaagctgaggagtatgccgaagaattccgcacgtatcttgaaggcgaatgcctggagctccttcggcgctatctggaaaatggaaaggagacactgcagagagctgaacagtctccacagccaaccattcccatcgtcggtatcgttgctggcctcgtggtgctaggagccgtagtgaccggggccgtggtcgctgccgttatgtggcgtaaaaagagctccgacaggaaccgtggctcttactctcaggccgccgtgtag

SEQ ID NO: 43315 - DNA, 1329 bp, Artificial Sequence
  Description of Artificial Sequence: Synthetic coding sequence
atggccccccggagcctgctgctgctgctgagcggcgccctggcccttaccgacacctgggccggaagccactcgttaagatatttctcgacagccgtgtcgagacctggtagaggagagccgcgctatatcgctgtggagtatgtggacgacacacagttcctccgtttcgattctgatgccgccataccccggatggaaccgagagagccttgggttgagcaggaggggccgcagtactgggagtggaccactgggtatgcaaaggccaatgcccaaacagaccgcgtggccctccgcaacctgttaaggcgttacaaccagtcagaggccggtagtcacacactgcaagggatgaacggctgtgacatgggccccgatggcaggttactgagggggtatcaccagcacgcatatgacggcaaggattacatctctctcaatgaggatctgaggtcatggacggcagccgacacagtcgcacaaattactcagcgtttttacgaggctgaggagtatgccgaagagttccggacgtacctggaaggtgaatgtctggagctcctgcgcaggtaccttgagaatggcaaggagactctccagcgtgcagacccacctaaggcccatgtcgctcaccacccgatctccgaccacgaggccacacttagatgctgggcactgggattttaccctgcggagatcacactcacgtggcagagggatggcgaggagcaaacacaggacaccgaacttgtcgagactcggcccgctggggatgggaccttccaaaaatgggccgccgtcgtggtgccaagtggggaagaacagcgctatacttgtcacgtgcagcacgagggcttaccccaacctttgatactgcgatgggagcaaagcccccagccgacgattcctatcgtgggcatcgtggctgggttagtcgtgctcggtgccgtggtgaccggggccgtagtcgcagccgtcatgtggcggaagaaatcatccgacaggaatcgagggtcctatagccaagccgctgcctattccgtcgtttcggggaacttaatgatcacgtggtggagctctctctttctgctgggtgtccttttccagggctacctcggctgtctgagaagccattcggttctgggaaggcggaaggtgggtgacatgtggatcttgttttttctttggctttggacgtcatttaacaccgcatttctggcattacagagtctgcggtttggatttgggtttcggcgcggcagatccttcctcctccgcagctggcatcacctgatgaaaagggttcagataaagatatttgattag

SEQ ID NO: 43316 - DNA, 1041 bp, Artificial Sequence
  Description of Artificial Sequence: Synthetic coding sequence
atggccccccggagcctgctgctgctgctgagcggcgccctggccctgaccgatacttgggcgggctctcatagcctgagatacttcagcacagcggtatcaaggcccgggagaggcgagcctaggtacatagccgtggaatatgtggacgacactcagtttctccgttttgactcagatgctgcgattccacgcatggagccaagggagccctgggtggagcaagagggccctcagtactgggagtggactaccggctacgccaaggcgaatgcccagactgaccgggtggccctgcggaatctattgagacgttacaaccagtccgaagccggtagccacacattgcagggtatgaatgggtgcgacatgggcccagacggacgattacttcgaggttaccaccagcatgcctacgacggcaaggattacatctcacttaacgaggaccttaggagttggacggcagccgatactgtggcccagattacccagaggttttacgaagcagaagaatatgccgaggaatttcggacctacctagagggtgagtgtctggagctcctgaggagatacctggagaacggcaaagagacactgcagagagccgatcctccaaaagcgcatgtcgcacatcacccaatctccgatcatgaagctactctacggtgttgggctcttggcttctatcctgcagaaattacattgacatggcagcgagacggcgaggaacaaacccaggacactgagctggtggaaactagacccgctggagacggcaccttccaaaagtgggccgcggtagtggtgccaagtggagaagaacagcgctatacatgccatgtccagcatgaaggcctgcctcagcctctgatccttaggtgggagcaaagcccacaacccaccatcccaatcgtaggaatcgtggcagggctagtagtcctgggagccgtcgtaactggcgccgttgtcgctgctgtcatgtggaggaaaaagtcaagtgaccggaatagaggtagctactcccaagcggcagtgtag

SEQ ID NO: 43317 - DNA, 1329 bp, Artificial Sequence
  Description of Artificial Sequence: Synthetic coding sequence
atggccccccggagcctgctgctgctgctgagcggcgccctggccctcaccgatacctgggctggctctcacagtctaaggtacttttccacagctgtgtccaggcccggacgtggtgaacccagatatattgctgtggagtacgtggacgatacacagttcttgcgcttcgatagcgatgctgccatccctaggatggagcctcgggagccctgggtagaacaagaggggccacagtactgggagtggaccaccggctatgctaaggccaacgcacagactgatagagtcgcgctgcggaacttactgcgacgctacaaccagagcgaggctggaagtcatactctgcaagggatgaatggttgtgatatggggccagatggcagattactacgagggtaccaccaacatgcctacgacggtaaagattatattagtctgaatgaagacctccgtagttggacagccgcagacacagttgctcagatcacgcagcgcttttacgaggcagaggaatacgccgaggagttccgtacgtacttggaaggagagtgtctggagttactaagacggtacctggagaacggcaaggaaactctccagcgcgcagacccaccaaaggcgcacgtggcccaccatccaatatccgaccatgaggccaccttgagatgctgggctctaggtttctaccccgcagaaattactctgacatggcagcgggacggtgaagagcagacccaggacaccgaactggttgagactcgcccagctggcgacggaacctttcagaagtgggctgctgtagtggtgcctagcggagaggagcagagatacacttgccacgtgcagcacgagggtctcccccagccccttattctccggtgggaacagtcccctcagcctacgattcccattgtgggtattgtggcaggactcgttgtactgggcgcagtggtcaccggcgccgtcgtggcggccgttatgtggcgtaaaaaatctagcgatcgaaatcgtgggagctacagtcaagccgcggcttacagcgttgtctccggcaaccttatgataacctggtggtcctcattgttcctgcttggagtgctgttccagggctacctgggatgtctgcgctctcattcagtgctggggcggagaaaagtaggcgacatgtggattcttttcttcctgtggttgtggacgtcttttaatactgcgttccttgccttgcaaagcctgcggttcggctttggttttagacgagggagaagttttctcctgcgcagttggcatcatctgatgaagagggtacaaatcaagattttcgattag

SEQ ID NO: 43318 - DNA, 1050 bp, Artificial Sequence
  Description of Artificial Sequence: Synthetic coding sequence
atggccccccggagcctgctgctgctgctgagcggcgccctggccttaaccgatacatgggccggctcacactccctccgatacttttctacggccgtgtctagaccagggaggggagaaccacggtacatcgccgtcgaatacgtcgatgacacacaattcttgagatttgactctgacgctgccataccaagaatggagccacgtgagccttgggtagagcaagaagggccccaatattgggagtggactacagggtacgccaaggcaaatgcccagaccgaccgcgttgccctgcgaaacttgcttaggcgatacctggaaaatggaaaagagacattacagagagctgacccccctaaagcccatgtagctcatcaccctatttcagatcacgaggctactctgcggtgctgggcacttggattttaccccgccgaaatcactctaacatggcaaagggatggcgaagagcagactcaggacaccgagctggtggagactcggcctgccggggacggaaccttccagaagtgggctgctgttgttgtcccgcccggggaagaacagagatatacatgtcacgtccaacacgaaggcctccctcagcccctgatactgcgctgggagcagtcaccacagcctactatccccattgttgggattgtggccggactcgttgtcctgggcgctgtggttaccggggcagtcgtcgccgccgtgatgtggagaaaaaaatcatccgatcgaaatagaggtagttacagccaagctgccgcctattccgtcgttagtggcaatttaatgatcacttggtggtcttcattgtttctgctgggtgttctgttccaaggatatctcggctgccttcgatcccattcagtactgggccgacggaaggcacagttgctgagcgtatccacatcccagacttctatcctcatccaggaacaattttcacatcagcggaccctggcgatgagtggaaagatgttttgctgccatgattggagcgaagaggaagtgcttcctgctagctgtggagagtag

SEQ ID NO: 43319 - DNA, 396 bp, Artificial Sequence
  Description of Artificial Sequence: Synthetic coding sequence
atggccccccggagcctgctgctgctgctgagcggcgccctggccctgactgatacgtgggctggtagtcattcccttcggtactttagcacagccgtgagcaggcctggtaggggtgaaccacgatacattgcagtggaatacgtcgatgatacccagtttctgagatttgactcagatgcggccatcccccgcatggagccaagagagccttgggtggagcaggaggggccccagtactgggaatggaccactgggtacgcaaaagcaaatgctcagaccgatcgtgttgctctacggaacttgcttcggagatacaaccagtccgaagcggggtcccatacactgcaagggatgaatggatgcgacatgggacctgatggcagactgctgtag

SEQ ID NO: 43320 - DNA, 396 bp, Artificial Sequence
  Description of Artificial Sequence: Synthetic coding sequence
atggccccccggagcctgctgctgctgctgagcggcgccctggccttaacagatacgtgggcgggctcccattcactcagatacttctcaacagcggtatccagacctggcaggggagagccacgctatatcgctgtggagtatgttgacgatacacagtttctgaggtttgattcggacgccgcaatcccgagaatggagccccgtgagccctgggtagagcaggagggtcctcagtactgggagtggacaactggatacgcaaaggccaatgcccaaacagacagagttgccctccgaaatctgctgcggaggtataatcagtccgaggcaggttctcatacattgcaaggaatgaacggttgcgacatgggtcccgacggcaggttgctttag

SEQ ID NO: 43321 - DNA, 396 bp, Artificial Sequence
  Description of Artificial Sequence: Synthetic coding sequence
atggccccccggagcctgctgctgctgctgagcggcgccctggccctaacagatacctgggcaggctcacatagcttgcgttattttagtacagccgtgagtcgcccaggccgcggggaacccaggtacatcgctgtggagtatgttgacgatacacagttcttaaggtttgacagtgatgctgctattcccaggatggagcctcgggaaccctgggtggaacaggagggcccccaatattgggagtggactacggggtacgccaaggctaacgcacagactgatcgggtggcattacgtaatctgctgcgcaggtataaccagtcagaagccggctcacacacactccaagggatgaacgggtgcgatatggggcctgatggccgactgctgtag

SEQ ID NO: 43322 - DNA, 642 bp, Artificial Sequence
  Description of Artificial Sequence: Synthetic coding sequence
tgacccgaccccccccccggccgggtgcccggcgccttcaccgagcacgcttacgatgggaaggattacatctcacttaatgaggacctccggagctggactgcggctgacactgtggcccagattacgcagagattttacgaggcagaggagtacgctgaagagttcagaacctatctggaaggcgagtgccttgaactcttgcgtcggtaccttgagaatgggaaagagactttgcaaagagcggacccacctaaggcgcacgtggcccaccaccctataagtgaccatgaggcaacgctccgatgttgggcgctgggattttatccggctgaaatcaccctgacttggcagcgggacggagaggagcagactcaagataccgagctggtagagacccgccccgctggggatgggactttccagaagtgggccgccgttgtcgtgccctcgggagaggaacagcggtacacctgccacgtccagcacgaagggctgccacagcctctaattttgcgatgggagcagtcaccccagccaacgattcccatcgtaggtattgtggctggcttggtagtgcttggcgcagtcgttactggagccgttgttgcagcagtgatgtggcgcaagaagagctcttag

SEQ ID NO: 43323 - DNA, 765 bp, Artificial Sequence
  Description of Artificial Sequence: Synthetic coding sequence
atggccccccggagcctgctgctgctgctgagcggcgccctggccttaacggacacttgggccgggagccactcgttgcgctacttttcgacggccgtgagcaggcccggccgaggcgagcctaggtatatcgctgttgagtacgttgatgacacacagttcctgaggtttgattcggacgccgctatccctcgcatggaaccccgggaaccttgggtcgaacaggaagggccgcagtactgggaatggaccaccggttacgccaaggccaatgctcagacagatcgcgtcgcattacgaaatctgctgaggaggtacaatcagtcagaagctggatcgcacactctgcagggcatgaacggatgcgatatgggtccagatggccgactattaagaggctatcatcagcacgcctatgatggaaaagactatattagtttaaatgaagacctaagaagctggacagcggctgacaccgtggctcagatcacccaaagattctatgaagccgaagagtatgcggaagagttccgcacatatcttgaaggggagtgtctcgaactgctccgccgatatcttgagaacgggaaagaaacgctacagcgggccgagcaatctccccagccaaccatcccaatagtgggaattgtggccggactggttgttctgggcgcagtggtgacgggtgccgtggtggccgctgtgatgtggagaaagaaaagctccgacaggaaccggggatcttactcccaagcagccgtgtag

SEQ ID NO: 43324 - DNA, 396 bp, Artificial Sequence
  Description of Artificial Sequence: Synthetic coding sequence
atggccccccggagcctgctgctgctgctgagcggcgccctggccctgacggacacatgggccggcagccattccctgaggtacttctcaacagctgtatcacggcccggccgcggagagccccggtatatagccgtggaatacgtggatgacacgcagtttctgaggttcgatagtgatgccgctatcccgcgcatggaaccccgagaaccctgggtagaacaagagggccctcagtactgggagtggaccaccggttatgccaaagctaatgctcagacagatcgggtggccttgagaaatcttctaaggcgctataatcagagcgaagccggctcacacacattgcaaggcatgaatgggtgtgacatggggcccgacgggagactgctatag

SEQ ID NO: 43325 - DNA, 678 bp, Artificial Sequence
  Description of Artificial Sequence: Synthetic coding sequence
tgacccgaccccccccccggccgggtgcccggcgccttcaccgagcatgcttacgacgggaaagattatattagtcttaacgaggatctccgaagctggaccgcagctgataccgttgcgcaaatcacacagcgtttttatgaggcagaggagtatgccgaagagttccgcacatatctagaaggcgaatgcttggagctgctccggagatacttggaaaatggtaaggagacactccagagggcagatcctcccaaggcgcacgtcgcacaccatcctattagcgatcatgaggctactcttcggtgttgggctctgggtttttatcccgcagagattaccctgacttggcagcgggatggggaagaacaaacccaggatactgagctggttgagacacgcccagcaggtgatgggacctttcagaagtgggccgctgtcgtggtgccatctggagaagagcaacgttacacctgtcacgtgcagcatgaggggttaccccagccgcttatcctccggtgggaacagtcccctcagcccacaatccccatcgtcggcatcgtggctggactggtggttttgggagccgtggtgacaggcgcagtcgtggcagctgtgatgtggcgtaaaaagagctccgacaggaataggggctcttatagccaggcggccgtctag

SEQ ID NO: 43326 - DNA, 1005 bp, Artificial Sequence
  Description of Artificial Sequence: Synthetic coding sequence
atggccccccggagcctgctgctgctgctgagcggcgccctggccctgaccgacacttgggccggttcacacagcctgaggtacttctctactgctgtctctcgacctgggcgcggagagcctcgatatatcgccgtggagtatgtcgatgatacacaattcctgcgctttgatagcgatgcagccattcctcgtatggaacctagggaaccctgggtagaacaagagggcccccagtactgggaatggactaccggatacgccaaggccaatgcacaaaccgacagagtggccctgagaaacctgctgcgtcgctacaaccagtccgaagccggcagccacactctgcagggcatgaacggatgcgatatgggaccagatggtagactgctgcggggatatcaccagcatgcctatgacggaaaggactacatcagcctcaacgaggacttgaggagttggacagctgcagacacagtggcccaaatcacacaacgtttctacgaggcggaagaatatgccgaagaattccggacatatttggagggagagtgcctagaactcctccgccggtatctcgagaatggaaaggagacactgcaacgggctgacccgccaaaggcccacgtcgcccatcacccaatctccgatcatgaggccactttgaggtgctgggcacttggcttttaccccgccgaaataacactgacttggcagcgagatggggaggagcaaacacaggacaccgagctggttgagacccggcccgccggggacggcactttccagaagtgggcggcagttgtggtcccctccggtgaggagcagaggtacacatgccacgtccagcacgagggcctgccacagccacttattctgcgatgggagcaaagtcctcagccaactatccccattgttggcattgtggcgggccttgttgtactgggcgccgtggtaaccggggcagttgtagcagcagtgatgtggagaaaaaaatcatcctag

SEQ ID NO: 43327 - DNA, 1041 bp, Artificial Sequence
  Description of Artificial Sequence: Synthetic coding sequence
atggccccccggagcctgctgctgctgctgagcggcgccctggccctcaccgacacctgggcaggcagccattctctgcgttattttagcaccgcagtgagccgcccggggaggggcgaaccccgctatatagctgtagaatatgtcgatgacacacagttcctgaggttcgatagtgacgcagcgattcctcgcatggagccacgggagccctgggtcgaacaggagggtccccagtactgggaatggaccaccgggtatgcgaaggcaaatgcacagactgaccgggtcgccctgcgaaacttactccggcggtacaaccaaagtgaagccgggagccatactctccagggcatgaatggctgcgatatgggccctgatggtaggctgctcaggggctatcaccagcatgcgtacgatgggaaggactatatttcactcaacgaggaccttcgttcttggaccgcagccgacaccgttgcacagattacccagcgattctacgaagctgaagaatacgccgaggagttccgcacatacctcgaaggcgagtgcctggagctccttcgtcggtacttggagaacgggaaagaaacccttcagcgagctgatccccccaaagctcacgtggctcaccaccccatatccgatcacgaagctactctcagatgctgggcgcttggtttctacccggccgagattacactgacctggcagcgtgatggagaagagcagactcaggacaccgaattggttgaaacccgtcccgcaggagatggtactttccaaaaatgggccgctgtggtagtaccatccggggaagagcagaggtacacctgtcacgttcagcatgaggggctcccccagcctctcatcctgaggtgggaacaaagtccacagccaaccatccctatcgtcggaatcgtggcaggcctggtggtgctgggagctgttgttacaggtgccgtagtcgctgcggtgatgtggaggaagaagagttccgatcggaatcgcggaagctactcccaggcagcggtgtag

SEQ ID NO: 43328 - DNA, 375 bp, Artificial Sequence
  Description of Artificial Sequence: Synthetic coding sequence
tgagccgtgatgtggcggaagaagagcagcggccacttcctgcccatagaccgtaatagaggctcctactctcaggccgcggcttatagtgtcgtgtcaggaaatctgatgatcacttggtggtcctcgcttttcctccttggggtactgtttcaggggtatcttggatgcctgcgttctcatagtgtcttggggaggcgaaaagtgggagatatgtggatactcttctttctgtggctgtggaccagcttcaacactgcctttcttgctctccagagtctgcgcttcggcttcggctttaggcgagggcgctcgtttctgttgcgatcttggcatcacctaatgaaacgagtccaaattaagatcttcgattag

SEQ ID NO: 43329 - DNA, 375 bp, Artificial Sequence
  Description of Artificial Sequence: Synthetic coding sequence
tgagccgtgatgtggcggaagaagagcagcggccacttcctgcccatcgatcgcaatcgcggctcctatagtcaggcggccgcatattcagtcgtctccggcaatctgatgatcacgtggtggtcctccctttttttgctgggagtgctgttccagggctacctgggttgcttgagatctcactccgtgctggggcgtcggaaagttggtgatatgtggatccttttctttctgtggttgtggacctcatttaataccgccttcctggcacttcaatcccttagattcggcttcggattcagacgcggcagatcttttctcctgcggtcatggcaccacctgatgaagagagtccagataaaaatcttcgattag

SEQ ID NO: 43330 - DNA, 678 bp, Artificial Sequence
  Description of Artificial Sequence: Synthetic coding sequence
tgacccgaccccccccccggccgggtgcccggcgccttcaccgagcacgcctatgacggcaaggactatatatccttgaatgaagatcttcggtcctggaccgcagcagataccgtggcccaaatcacccaacgcttctacgaggccgaagagtatgctgaggaatttcgcacctatcttgagggcgagtgccttgagctgctgagacggtaccttgaaaacgggaaggaaacactccagagagccgaccctcctaaggcgcacgtcgcccaccaccccattagcgaccatgaagctaccctgaggtgctgggcgctgggcttttatccagcagagattacactaacttggcaacgcgatggagaggagcagacacaggacacagagctcgtggagacaaggccggcaggcgacggtactttccagaagtgggctgcggtcgtagtcccctccggggaggaacaacgatacacatgccacgtgcagcacgaaggcctgccacagcctctgatcctgaggtgggagcagtcaccccagccaacgattcccatcgtgggaattgtagccggcctggtcgtgctgggagcagtggtgacaggcgcagtcgttgctgctgtcatgtggcgtaagaagtctagcgataggaaccgggggtcctactctcaggcagcagtttag

SEQ ID NO: 43331 - DNA, 1329 bp, Artificial Sequence
  Description of Artificial Sequence: Synthetic coding sequence
atggccccccggagcctgctgctgctgctgagcggcgccctggccctgacggatacctgggctggcagccatagcttacgctacttcagcacagctgtttcccgaccaggccggggcgaacctcgatacattgccgtggagtacgttgatgacacacaattcctgagatttgactcagacgccgccatcccgcgaatggagcctcgcgaaccgtgggtggaacaggaggggcctcagtactgggagtggactactggctatgctaaggcgaacgcccagaccgatcgggtggccctgagaaacctgctgcgacggtacaaccagtccgaggctggcagccacaccctgcaaggcatgaatggatgtgatatggggccggacgggcggttgctgcgcgggtaccatcagcatgcttatgatggcaaggactacatttcacttaatgaggacctgagatcttggacagccgccgacactgtggcacaaatcacccagcggttctacgaggccgaggagtatgccgaggagttccggacctatctagaaggcgagtgtctagagttgctacgccggtacctcgagaacggaaaggaaaccctgcagcgagctgaccctccaaaggctcacgtggctcatcacccgattagcgaccatgaggccactctcaggtgttgggcgctcggattttaccctgcagaaatcacactcacgtggcaacgggacggggaagagcagacacaggatacagagttagttgagacacggcctgcaggggatggcacgttccagaagtgggcagccgtggttgtacctagcggggaggaacagaggtacacctgccacgtccaacacgagggcctgccacagcccctgatcctgcgctgggaacagtctccccaacctactattccaatcgtcgggatcgttgcaggtttagtggttctgggcgccgtggtgacgggcgccgttgtcgccgcagtgatgtggcgaaaaaaatccagtgatagaaataggggctcctattcccaggccgcagcttatagtgtggtgtcaggtaacctgatgataacctggtggtccagtttgttcctattaggtgttctcttccagggatacctgggatgtctccgaagccattctgtgcttgggaggcgcaaagtgggcgatatgtggatcctgttctttctatggctctggacctcctttaataccgctttcctcgccctgcagtccttgaggttcggctttggctttcgtcgcggcagatcgtttctgttgaggtcttggcatcacctgatgaaaagggtacagattaagatttttgactag

SEQ ID NO: 43332 - DNA, 678 bp, Artificial Sequence
  Description of Artificial Sequence: Synthetic coding sequence
tgacccgaccccccccccggccgggtgcccggcgccttcacccagcacgcgtacgatggtaaagattatatcagtctgaatgaggaccttagaagctggacggcagctgatacggtggctcagatcacacaacgcttctacgaggccgaggagtacgccgaggaattcagaacttatctggagggggagtgcttggagctcctccgaagatacctggagaacggcaaggaaactctgcagagagcagatccccccaaagcccatgtggcacaccatcccatttccgaccacgaagctactctgcgctgctgggctctgggtttttacccggccgagattaccctcacctggcagagagatggcgaggagcagacccaagacactgaattggtagaaacacgacctgccggtgatggaacatttcagaaatgggccgccgtcgttgtgcctcctggggaggagcaacggtacacatgtcacgtccagcacgagggcctccctcagcctctcattcttagatgggagcagtctcctcaacccaccattcctatcgttggtatcgtagctggcctggtcgttttaggcgccgtggtgaccggcgcagtcgtcgctgccgtgatgtggcgtaagaagtcgtctgaccgcaataggggctcatactcccaggctgcagtgtag

SEQ ID NO: 43333 - DNA, 1329 bp, Artificial Sequence
  Description of Artificial Sequence: Synthetic coding sequence
atggccccccggagcctgctgctgctgctgagcggcgccctggccctgactgatacttgggccgggtcacacagcctgaggtacttctcgacagccgtgtcgcggcccgggaggggggaacctaggtacatcgctgtggaatatgtcgacgatacccaattcctcaggttcgacagcgatgctgctataccacgaatggaaccaagagaaccatgggtggagcaggagggaccacagtattgggaatggactaccgggtacgcaaaggcgaacgcccagaccgatagggtcgccctgcgcaatctcttaaggaggtataatcaaagcgaagccgggtcccacacgctccaaggcatgaacggttgtgacatgggtccagacggcagactgctgcgtggctatcaccagcacgcatatgatggcaaagactatatcagcctcaacgaagacctgagatcctggaccgcagccgacactgtggctcagatcacccaacggttttatgaggcggaggaatacgctgaagaattccggacttatcttgagggggagtgcctagaactgttaaggaggtacctggaaaatgggaaagagacactccagcgagctgaccccccaaaagctcacgtggcccaccatcctataagcgatcacgaagccactctcagatgttgggccctcgggttctaccctgccgaaataactttaacatggcagagggatggagaggaacaaacacaggacacagaactggttgaaactaggcccgcgggtgacggaacattccagaagtgggccgccgtcgtcgtaccttcgggggaggagcagcgttatacctgtcacgtgcagcatgaaggactgccccagcctctgatacttaggtgggagcagtctccccagcctaccatcccgatcgtcggcattgtggcagggcttgttgtgctgggagcagtggtgacaggtgccgttgtcgctgccgtgatgtggagaaagaaaagctcagaccgaaacagggggtcttactctcaagctgccgcctacagcgtcgtgtccggcctgttgatgatcacctggtggagtagcctattcctgttaggtgttctgtttcaagggtatctaggctgtttgcgctcacactccgttctgggccgtcgaaaggttggcgacatgtggatcctattctttctttggctctggacctccttcaataccgcatttctggctctacagtccctgcgtttcggctttggtttcaggaggggcagatcttttcttttgcgctcttggcatcatttgatgaagagggtgcagattaagatctttgactag

SEQ ID NO: 43334 - DNA, 678 bp, Artificial Sequence
  Description of Artificial Sequence: Synthetic coding sequence
tgacccgaccccccccccggccgggtgcccggcgccttcaccgagcacgcctatgacggcaaagattacatctccctcaatgaagacctacgctcgtggactgccgctgacactgtcgcacagataacgcagaggttttatgaagcagaggaatacgctgaagagttccgaacttacctggagggggagtgtctggagctgctaaggcggtatctggagaatggcaaggagactctgcagagggccgatcctcctaaagctcacgtggctcaccacccaatctccgatcatgaagcaaccctgcggtgttgggcccttggattttaccccgcggagattaccttgacatggcaaagggatggagaagaacagacgcaagacacggagctggtcgaaactcggccagccggcgatggaaccttccagaaatgggctgctgtcgtcgtgccttctggagaggagcaaaggtacacctgccacgtccaacatgaagggcttccacagccattgatcttgaggtgggagcagagtccccagcctacaatcccaatcgtggggattgtcgctggactggtggttctgggagctgtggtaaccggggcagtggtcgccgctgtgatgtggcggaagaaatcctctgatcggaatcgaggcagctacagccaggcagctgtgtag

SEQ ID NO: 43335 - DNA, 765 bp, Artificial Sequence
  Description of Artificial Sequence: Synthetic coding sequence
atggccccccggagcctgctgctgctgctgagcggcgccctggccctcactgacacctgggcaggttcacactccttgagatatttctctacggcggtgtcgcggccagggagaggcgagcctcggtatatcgccgtggaatacgttgatgacacccagttcttaagattcgatagcgatgccgccatccctcggatggaaccgagggagccctgggttgagcaggaaggccctcaatattgggaatggactactggatacgctaaggccaacgctcagaccgacagggtggctttacggaatctcctcaggaggtataatcaaagcgaggcaggcagccataccctgcagggaatgaacggctgcgacatgggaccagatggacggctacttaggggataccatcagcacgcttacgacgggaaagactatattagtcttaatgaagatctgcggtcttggacggcggctgatacggtggcacagatcactcagcggttttacgaagctgaagagtatgccgaggagtttcggacgtatctggaaggagagtgtctggaacttctgcggaggtacttagaaaacggcaaagagaccctccagagggcagagcaatcccctcagccaaccattccaattgtcgggattgtggccggcctcgtagtgcttggagctgtagtcacgggcgctgtagtcgccgccgtgatgtggcggaagaagtcttctgacagaaacaggggttcctacagtcaggctgcagtttag

SEQ ID NO: 43336 - DNA, 1041 bp, Artificial Sequence
  Description of Artificial Sequence: Synthetic coding sequence
atggccccccggagcctgctgctgctgctgagcggcgccctggccctcaccgatacttgggccggatctcactctcttcggtattttagcaccgccgtcagcaggcccggtcgcggagaaccccgctacatagctgtggagtacgtggacgacacgcagtttctccgtttcgatagtgacgcagctatcccaaggatggagcccagggaaccatgggtggagcaagaagggcctcaatactgggaatggacaaccggctacgcgaaagcaaatgcccaaactgaccgggtggcactgaggaacctgcttagacgttacaaccagtccgaagcagggagccacacgctccagggtatgaacgggtgtgacatgggccctgacggtcgcctgctgcgtggctatcatcagcacgcctatgatgggaaggattatatcagtctgaatgaagacctgcggagttggactgctgctgacaccgtcgcccaaattactcaaagattttacgaggccgaagagtacgccgaggagtttagaacctacctggagggagaatgtcttgagctgctccgaagatacctggagaatgggaaggagacactgcaacgggctgaccctccgaaagcccatgtcgcgcaccacccaatttcagatcacgaggctacactacgctgttgggctctgggcttctaccctgcagaaattacgctgacatggcaaagagatggagaagaacaaacccaagacacagagctggtcgaaaccagaccagctggagatggaaccttccagaaatgggcggccgtcgtggtcccatctggggaggaacagcgctatacctgccacgtgcagcacgaagggcttccacagcctctaatactgagatgggagcaatcgcctcaaccaacgattcccatagtgggtattgtggctggcctggtggtcctgggtgcagtggtaaccggcgctgtggtagcggccgttatgtggcggaagaaatcgtccgatcgcaaccgcggctcctattctcaagctgccgtgtag

SEQ ID NO: 43337 - DNA, 396 bp, Artificial Sequence
  Description of Artificial Sequence: Synthetic coding sequence
atggccccccggagcctgctgctgctgctgagcggcgccctggccctcaccgacacatgggccgggtctcattcgctgaggtacttttccaccgcagttagtagaccaggcagaggcgaaccccgttacatcgccgttgagtatgtggatgacacgcaatttctcagattcgattctgacgctgcgattcctaggatggaaccgagggagccttgggttgagcaagaaggtcctcagtattgggaatggacaactggttatgctaaggccaacgcccagacagacagagtggctcttcgcaatctactcagaagatataaccaatcggaagccggcagccacacactacaaggaatgaacggctgtgacatgggtcccgacgggagactcctgtag

SEQ ID NO: 43338 - DNA, 33 bp, Artificial Sequence
  Description of Artificial Sequence: Synthetic coding sequence
tgagccgtgatgtggcggaagaagagcagctag

SEQ ID NO: 43339 - DNA, 780 bp, Artificial Sequence
  Description of Artificial Sequence: Synthetic coding sequence
atgaacggctgcgacatgggccccgacggccggctgctgcggggctaccaccagcacgcttacgatgggaaggactacatcagtctcaacgaggaccttaggagttggaccgcggccgataccgtggcacagattacgcagaggttctacgaggctgaagagtatgccgaagaatttcggacctacctggagggcgaatgcctagaactgctgaggcgttatctggagaacggcaaagagacactacagcgagctgatccgcccaaggcccacgtagctcaccatccaatctccgaccacgaagcaaccttgcgctgctgggccttaggcttttaccccgcagagatcaccttaacatggcagcgagacggggaagagcagactcaagacactgagctcgtggagactaggcccgctggggatggcacattccaaaagtgggctgctgtggtcgttccacctggggaagaacagcgatacacatgccatgtgcagcacgaaggcctccctcagcctctcatactaagatgggagcaatctccccagcccacaatccccatagttggcatcgtggccggccttgtggttctgggcgccgtcgtaaccggggctgttgtggccgctgttatgtggcgcaagaagagcagtgcgtattctgttgtgtcagggaacctgatgatcacctggtggtcttcgttgtttctcttaggtgttttgttccagggctatctgggatgtctgagaagtcactcagtgctggggcgacggaagcatttctag

SEQ ID NO: 43340 - DNA, 765 bp, Artificial Sequence
  Description of Artificial Sequence: Synthetic coding sequence
atggccccccggagcctgctgctgctgctgagcggcgccctggccttaaccgatacctgggctggcagccattctctgcgctatttttcaactgctgtgagccggcctggtcgcggtgagcccaggtatattgctgtggagtacgtcgacgatactcagttcctcagattcgacagtgacgcagctattccgcggatggaaccccgagagccttgggtcgagcaggagggcccccaatattgggagtggacaactggatatgccaaggctaatgcgcaaacggatcgagtcgcactcagaaatcttctcaggaggtacaatcagtccgaggctggctctcacaccctgcaaggcatgaacggatgcgacatgggcccggacggaaggctgcttcggggttatcaccaacacgcctacgatgggaaagactacatcagccttaatgaagatctacgatcctggaccgcagccgatacggtcgcccagataactcagagattttatgaagcagaagaatatgctgaggaattccgcacctaccttgagggagagtgcttggagctccttaggcggtaccttgagaacgggaaggagacactgcaacgtgcggagcaatctccgcaacccaccatcccgatcgtgggaattgtggcagggctcgtcgtactgggtgccgtggtaactggggcagtggtagcggcagtcatgtggaggaaaaaatcctctgacaggaacaggggaagttatagtcaggctgcagtctag

SEQ ID NO: 43341 - DNA, 729 bp, Artificial Sequence
  Description of Artificial Sequence: Synthetic coding sequence
atggccccccggagcctgctgctgctgctgagcggcgccctggccctcactgacacttgggccggcagccactctctccggtacttctctaccgccgtgtcacggcctggcagaggggaacctcgctacatagcagttgaatatgtggatgacactcaattcttaaggttcgatagtgacgcagccattcccaggatggagccaagagagccctgggttgaacaagaaggtccacagtattgggaatggaccacaggatacgccaaagccaacgctcaaacggacagggtggcccttcgcaacctcctccgccgatacaaccagagtgaggcgggatctcacaccctgcaaggtatgaacggttgtgacatgggtcccgatggcaggctcctgagggggtatcaccagcacgcatacgacgggaaagattacatttctctgaacgaggatctgcgaagttggacggctgcagacaccgtcgcacagatcacccagagattttacgaagccgaggaatatgcagaagagtttagaacctacctggagggggaatgcttggaattgctcagacgataccttgagaacgggaaggagaccttgcaaagggccgagcagagtcctcagccaaccattccaattgtaggcatcgtcgctggcctagtggtacttggcgccgtagtcacaggggcagtcgtcgccgcggtaatgtggaggaagaaatcctcctag

SEQ ID NO: 43342 - DNA, 396 bp, Artificial Sequence
  Description of Artificial Sequence: Synthetic coding sequence
atggccccccggagcctgctgctgctgctgagcggcgccctggcccttacagacacttgggcaggctctcactctctgagatatttttcaacagcagtgagccgcccaggaagaggagagccccgctatattgccgttgaatacgttgacgacacacagttccttaggtttgattccgacgccgccatcccccggatggaaccaagagagccgtgggtagaacaggaaggcccacaatactgggagtggactaccggatatgcaaaagcgaacgctcagactgaccgggtggccctgcggaacctgttacgcaggtacaaccagagcgaggctggcagtcacactcttcagggtatgaacgggtgcgacatggggcccgacggccgactactgtag

SEQ ID NO: 43343 - DNA, 375 bp, Artificial Sequence
  Description of Artificial Sequence: Synthetic coding sequence
tgagccgtgatgtggcggaagaagagcagcggccacttcctgcccatcgatcgcaatcgtggctcatattcacaggcagcggcctactcggtagtgtctggtaaccttatgataacttggtggagcagtctgttcctcttaggtgtactctttcaggggtacttaggctgcttgcgaagccacagtgtgctcggacggcgtaaggtcggagacatgtggatcctgttttttttatggctatggacctctttcaacacagccttcctggctctccaatccctaaggtttggcttcggattccggcgaggacgaagcttcttgctgagatcctggcaccacctgatgaaacgggtgcaaattaagatcttcgattag

SEQ ID NO: 43344 - DNA, 1041 bp, Artificial Sequence
  Description of Artificial Sequence: Synthetic coding sequence
atggccccccggagcctgctgctgctgctgagcggcgccctggccctaaccgatacctgggcgggaagtcacagcttgcggtacttcagtacagctgtgtctcggcccgggcgtggagagcctcgatatatcgccgttgaatacgtcgacgacacccaatttctaaggttcgattcggatgctgccatcccccggatggagcctcgggaaccctgggtcgagcaggaaggcccgcagtactgggagtggactaccggctatgcaaaagctaacgctcagacagaccgggtagctttgagaaacctgctccggcggtacaaccagagcgaagcgggctcccatactctgcagggcatgaacggctgtgatatggggcctgacgggaggctccttcgcggttatcatcaacatgcctacgatggcaaggactatatatccctgaatgaggatcttcggagttggaccgctgccgacactgtcgcacaaatcactcagcggttttatgaggccgaagagtatgccgaggaatttagaacctatttggagggtgaatgcctggagttgcttcggaggtatctagagaacggcaaagaaaccctccagcgcgccgacccgcccaaggcacatgttgcccatcacccgatatccgaccacgaggccacactcagatgctgggccttgggattttacccagccgaaataactctcacgtggcagcgagatggtgaggagcaaacccaggatacggagctggtggaaacaagaccagccggtgacggcacgttccagaaatgggccgcagtagtagtgccatcaggagaagaacagcgatacacctgtcacgtccaacacgagggcctgcctcagcctctgattctgcggtgggaacagagtccccagcctaccattcccattgtcgggattgttgccggcctcgtggttctcggtgcggtggtgacaggcgccgtggtggccgctgttatgtggagaaaaaaaagctccgatagaaatagagggtcgtattcacaggctgctgtgtag

SEQ ID NO: 43345 - DNA, 1329 bp, Artificial Sequence
  Description of Artificial Sequence: Synthetic coding sequence
atggccccccggagcctgctgctgctgctgagcggcgccctggccctaaccgacacatgggccggtagtcattcactcaggtacttctcgactgctgtgtctcgacccgggagaggggagccaaggtatatcgctgttgagtacgtggatgacacccagtttcttcggttcgattcggatgccgccattccacgaatggagccgcgcgaaccttgggtcgagcaagaagggccccagtactgggagtggaccaccggatatgccaaggctaatgcacagactgatcgagtggccttaagaaatcttctgcgacggtacaatcagagtgaggccggctcgcataccctgcagggaatgaatggttgtgatatggggcccgacggccgtttgttacgaggctaccatcaacacgcctacgatgggaaagactacattagcctgaacgaggatcttagaagctggacagctgccgacaccgtagcacagatcacccagagattttacgaggcagaagagtatgccgaggaattccgaacttatttggagggtgagtgtctcgagcttctccgacggtatctcgagaatgggaaagagacgctgcagcgggctgatccgccgaaggctcacgtcgctcaccatcccatatccgaccacgaagcaactctgagatgctgggcccttggattctatcctgctgagatcacactcacctggcaacgcgacggcgaagagcaaacccaagacaccgaattggtcgagactaggccagctggcgatggaactttccagaaatgggccgccgtagtggttccatcaggggaggagcagcgatatacatgccacgtgcagcacgaaggactgccacagcccctgatcctgcgctgggagcaaagtccccagcctacgattcctatcgtggggatcgtcgctggcctggtggtcctgggggcggtcgtgacgggggccgtggtggctgccgtgatgtggagaaaaaaatcctctgaccggaatcggggttcttacagccaagcagcggcttatagcgtggtttcaggcaatctgatgattacttggtggagttcgcttttcctactaggtgtcctttttcagggctacctggggtgcctacgcagccatagtgtgcttggcagaagaaaagtgggggacatgtggattctgttcttcttgtggctgtggacctcgttcaacactgcatttttggcactgcaatctctgcggtttggtttcggttttaggaggggccgaagttttctgcttaggtcatggcaccacctcatgaagcgggttcagatcaagatctttgattag

SEQ ID NO: 43346 - DNA, 396 bp, Artificial Sequence
  Description of Artificial Sequence: Synthetic coding sequence
atggccccccggagcctgctgctgctgctgagcggcgccctggccctgactgacacgtgggccggttctcacagccttcggtacttcagcaccgccgtgtctcggccgggcagaggtgagccccggtatattgcagtagagtatgttgatgatacacagtttcttcgcttcgactctgatgcggctattcctaggatggaacctcgagagccctgggtggaacaagaaggcccccagtattgggagtggacgacgggatacgccaaagccaatgcccagaccgatcgggttgcgttgagaaatctcctgaggcgctataaccagagtgaggcagggagtcacaccctccaggggatgaatggctgtgacatggggccggacggtcgccttttgtag

SEQ ID NO: 43347 - DNA, 375 bp, Artificial Sequence
  Description of Artificial Sequence: Synthetic coding sequence
tgagccgtgatgtggcggaagaagagcagcggccacttcctgcccattgataggaaccgcggatcatacagccaggccgccgcatatagtgtggtcagcggactgctgatgatcacttggtggtcttccctgttcttgctgggggtcttattccagggatatctggggtgcctccgttctcactcagttctgggtaggagaaaagtgggggacatgtggatcctgttttttctgtggctttggaccagcttcaatacagcttttctggctctgcaatcgctcagattcggctttgggttccgccgcggcaggtcctttttactcagatcttggcaccatttaatgaaacgagtgcagattaagattttcgattag

SEQ ID NO: 43348 - DNA, 1260 bp, Artificial Sequence
  Description of Artificial Sequence: Synthetic coding sequence
atggccccccggagcctgctgctgctgctgagcggcgccctggccttgaccgacacttgggctggtagtcattcactgcgctattttagcaccgcagtaagtaggccaggccggggcgagccacgctatattgctgtggagccctgggtggaacaggagggaccacagtactgggaatggacaacagggtatgcaaaggctaatgctcagacagatcgcgtagccttgcggaatcttctcagacgatacaaccagtccgaagcaggatctcatacactccagggaatgaatggttgcgacatgggtccagatggcagactgttacggggctaccaccagcatgcctacgatggaaaggactatatatcccttaacgaagaccttcggagctggactgctgccgacacagtggcgcagatcacacagcggttctacgaggctgaggaatatgcagaggagtttcgcacctatctggagggcgaatgcctggagttactgcggcggtatctcgagaatggtaaagaaacactacagcgagctgatcctcctaaagctcatgttgcccatcacccgataagcgaccacgaagcaacattacggtgttgggccctgggcttttatcccgccgagatcacattgacctggcagagagatggtgaagagcaaacccaggacaccgagctggttgaaacccggccagctggcgatgggacctttcagaaatgggccgcagtcgtcgtgccccctggagaagagcaacggtacacctgtcacgtccagcatgaaggcctacctcagccactcatcctcaggtgggagcaaagcccccagcccacaattccaatcgtgggcatcgtcgctggactcgttgttctgggggctgtagtgactggggccgttgtggctgcagttatgtggagaaagaagtctagtgatcgtaacagagggtcgtatagtcaggctgcggcttatagtgttgttagtggaaacctcatgatcacctggtggtcctcgctgttcctgcttggtgttttgttccagggatatctgggctgcttacggagccattcagttctgggacgccgaaaggtcggggacatgtggatcctgtttttcctgtggctttggacctcatttaatacagccttcctagcgctccaatctctgaggttcggatttggttttaggaggggacggagcttcctgttgcgaagctggcatcaccttatgaagagggttcagataaagatctttgattag

SEQ ID NO: 43349 - DNA, 375 bp, Artificial Sequence
  Description of Artificial Sequence: Synthetic coding sequence
tgagccgtgatgtggcggaagaagagcagcggccacttcctgcccatcgataggaatcggggcagttactcccaggcagcagcgtacagcgttgtgtctggcaatctgatgattacttggtggagttctctgtttttgcttggcgtcctattccagggctacctcgggtgtttacgctctcactctgtcctgggcaggcgcaaggtgggagatatgtggatattgtttttcctatggctctggacatcttttaacaccgccttcctggccttgcagagcctccggttcggatttgggttccgtagaggccgatctttcttgctgcggagctggcaccacttaatgaaacgcgtgcaaattaaaatttttgactag

SEQ ID NO: 43350 - DNA, 678 bp, Artificial Sequence
  Description of Artificial Sequence: Synthetic coding sequence
tgacccgaccccccccccggccgggtgcccggcgccttcacccagcacgcctacgacggtaaagattatatcagcctcaacgaggatctgcggagctggacagccgctgatacagtggcccagattactcagcgcttctatgaagcagaggagtatgccgaggaattcagaacctatctggaaggcgagtgcttggaactcctgagaagatacctcgagaacgggaaggaaaccctgcaacgtgcagatccccccaaggcccacgtcgcccatcaccctattagtgaccatgaggctactttgcgatgttgggcgctcggattctatcccgccgagatcaccctgacttggcagagggatggggaagagcagactcaagacactgagctcgtggagacaaggcctgccggggacggcacattccagaagtgggccgcagtggtcgtgccatccggcgaagaacagcgatacacgtgccatgtacaacacgagggcctgccccaaccactgatcctgcgttgggagcagtcaccgcagccaaccatccccatcgtgggcattgttgccggtctggtggtgctgggcgcagttgttactggcgccgtggtggcagcagtaatgtggcgtaaaaaaagcagtgacagaaacaggggctcgtatagccaggccgcagtttag

SEQ ID NO: 43351 - DNA, 678 bp, Artificial Sequence
  Description of Artificial Sequence: Synthetic coding sequence
tgacccgaccccccccccggccgggtgcccggcgccttcacccagcacgcctatgatggaaaagactatatctccctaaacgaggatctgcggtcctggacagctgctgatactgtggcacaaattactcagaggttctatgaagccgaggaatatgccgaagagtttcgcacttacctcgagggtgagtgtctggagctcctgcggcggtacctggagaatggcaaggaaacgctgcaaagagctgatccacccaaggctcatgtggctcaccaccccatatcagatcatgaggccaccctcagatgttgggccctgggcttttatcccgccgagattacgctgacctggcagagggacggtgaggaacagacacaggacacagaattagttgaaacacggcccgcaggagatggcacttttcaaaaatgggcggctgtggttgtgccttcaggagaggagcagcgttatacatgccatgtccagcatgaggggctcccccagccccttatattgcggtgggagcagagcccacagccaacaattccgatagtcggtatcgtggctgggctcgtcgttctgggggccgtggtgaccggtgccgttgtggctgctgttatgtggaggaagaagtcttctgatagaaacaggggatcctactctcaggcagccgtatag

SEQ ID NO: 43352 - DNA, 375 bp, Artificial Sequence
  Description of Artificial Sequence: Synthetic coding sequence
tgagccgtgatgtggcggaagaagagcagcggccacttcctgcccattgataggaatcgtggctcctactcgcaggccgccgcttacagtgtggtgtccggaaatttgatgataacatggtggagttctctgttcctgcttggcgtgctattccagggctacctcggatgcctccggagccacagcgtattaggccgccgaaaggtaggagatatgtggatcctctttttcctctggttatggacctccttcaacactgccttcctggcgctacaatcactccggtttgggtttgggtttaggaggggacgttccttccttctgagaagctggcaccacctcatgaaacgggtgcagataaagatatttgactag

SEQ ID NO: 43353 - DNA, 780 bp, Artificial Sequence
  Description of Artificial Sequence: Synthetic coding sequence
atgaacggctgcgacatgggccccgacggccggctgctgcggggctaccatcagcatgcctatgacggcaaagactacatttcactaaacgaggatttgcggagctggaccgctgctgatacagtggcccagatcacccagaggttctatgaggcagaagaatacgccgaagagttccggacatacctagagggcgagtgcctcgagcttctgcgccggtatctcgagaatggaaaggagaccttgcaaagagctgaccctcctaaggcacacgtggctcaccacccgatctctgaccatgaggcaacacttagatgttgggcccttgggttctatccagccgagatcacactcacatggcagcgggacggcgaagaacagacacaggatactgagctggtagagacacgtcctgcaggggatggaacatttcagaaatgggcggccgtggtggtgccatctggagaggagcagagatatacgtgccacgtgcagcacgagggtctgccccagccactgattctcagatgggagcagtctccccagcccacaatcccaattgtcggaatcgtcgcgggcctggtcgtcctgggcgcggtcgttacgggggcggtggtcgccgccgttatgtggcggaagaaatcttccgcctacagtgtggtgtcaggcttgctgatgatcacgtggtggtcctcgcttttccttctcggggttctgtttcagggatacttagggtgcctgcgctcacacagcgtgctgggcagacgtaagcacttttag

SEQ ID NO: 43354 - DNA, 1050 bp, Artificial Sequence
  Description of Artificial Sequence: Synthetic coding sequence
atggccccccggagcctgctgctgctgctgagcggcgccctggccctgaccgatacgtgggctgggagccatagtctgcgctacttctctaccgctgtcagtcggccgggtaggggagaacctaggtatatcgcagtcgaatacgtggatgatacacaattcctgcggttcgacagcgacgctgctattccacgaatggagccccgggagccttgggttgagcaggaggggccccagtactgggagtggacaactggctacgcaaaggccaacgcgcagacggatcgagtagctttgagaaacctgctgcgcaggtacctggaaaacggcaaagagactctgcagcgggctgatccaccgaaggcccatgtagcccaccatcccataagtgatcatgaagccacattaaggtgttgggccctggggttctatccagccgaaatcacactgacatggcagcgagacggcgaggaacagacgcaagatactgaattggtggagactcggccagcaggggatggtactttccagaaatgggcagctgtggttgttccttctggggaagaacagaggtatacctgccatgttcagcatgagggtttgccacagcccttgatcttgagatgggagcagtcacctcagcctacaatccctatagttggtattgtcgctggcttggtggtgcttggtgcagtggtgactggcgccgtcgtggctgcggtcatgtggcggaagaagagcagcgatcgaaaccgaggttcttacagtcaggccgccgcctattccgtggtgtccggaaatctgatgattacatggtggagcagcctctttctgttgggggtgttgtttcaggggtatcttggttgtctgagaagtcactctgtgctcgggcgccgaaaggctcagttgttatccgtctctactagccagactagtatcttaattcaggaacagttttcccatcaacggacacttgccatgtctggtaagatgttctgttgtcatgactggagtgaagaaaaggttctgccagccagctgtggggagtag

SEQ ID NO: 43355 - DNA, 1260 bp, Artificial Sequence
  Description of Artificial Sequence: Synthetic coding sequence
atggccccccggagcctgctgctgctgctgagcggcgccctggccttgaccgacacctgggcagggtcacatagtttgcggtactttagcaccgctgtgagtcggcccgggcggggcgaaccgagatacattgccgtggagccctgggtcgagcaggagggtccacaatactgggaatggacgacaggctacgcaaaagcaaacgcacagacagacagggtcgctctacggaatctgctgcggcgctataaccaatctgaggccggttcacacaccttacagggcatgaacggatgtgatatggggcctgatggccgcctccttcggggataccaccagcatgcatacgatggaaaagattacatcagcctgaacgaagacctgcgaagctggactgccgctgatacagtagcgcagattacacagaggttctatgaggccgaggaatatgccgaagagtttagaacatatctagaaggggagtgtttagagctgttaaggcggtatctcgagaatggaaaggagaccctacagcgggctgatccgcccaaggcccacgtcgcacatcaccccatcagcgaccatgaagctacactaaggtgctgggctctcggcttttatcccgccgagattaccctcacgtggcagagggatggcgaggagcagactcaggatactgagctggtggaaacaaggccagcaggtgatgggactttccaaaaatgggctgccgtcgtggtgccatccggcgaggaacagcggtacacctgccatgtccagcatgagggtctgcctcagcctctgattctgcggtgggagcagtcaccacagccaacaatcccgattgtcggaattgtggctggactggttgtattgggggccgtcgtgacaggggctgtcgtggctgccgtgatgtggcgtaagaagtccagcgaccggaataggggctcatatagtcaggctgccgcctatagcgtggtgagtggaaatctgatgatcacttggtggtcttccctgtttctactcggggtgcttttccaaggatatctgggatgcttgaggagtcactccgtgcttggtcgccgcaaggttggcgacatgtggatcctcttctttctatggctgtggactagtttcaatacagcttttcttgccttacagtctctgagatttgggttcggctttagacgcggccggtcctttctcctccgctcatggcaccacctcatgaaaagagtgcagattaaaatttttgattag

SEQ ID NO: 43356 - DNA, 1050 bp, Artificial Sequence
  Description of Artificial Sequence: Synthetic coding sequence
atggccccccggagcctgctgctgctgctgagcggcgccctggccctcaccgacacttgggccgggtctcatagtcttcggtatttcagtacagccgttagccgacctggacgcggggaaccacgctacattgcagtggagtacgtcgatgatacacaatttctcaggtttgatagtgacgcagcaattcctaggatggagccccgcgaaccttgggttgagcaagagggtcctcagtactgggaatggaccacaggctacgcaaaggccaacgctcagacagatcgggttgctctccgaaatttactgcgaaggtacctggagaacgggaaggaaacccttcagcgggccgacccccctaaagcccatgtggctcatcaccctatttccgaccatgaagcgacactacgatgttgggccctcggattttatcctgccgagattaccctgacatggcagcgcgatggcgaggaacagacccaggacacggagctcgttgaaacgcggcccgctggagacggcaccttccagaagtgggccgccgtggtggttccgtccggcgaggagcagcgctacacctgccacgtgcaacatgagggacttccccagccgctgattttaaggtgggagcagagccctcagcccacaattccgattgttggcatagtggctggactagtggtgcttggcgctgtggttacgggggctgttgtcgccgcagtgatgtggcggaagaagtcaagcgacagaaatcgcggatcgtacagccaggcagctgcctacagtgtggtttcaggcaacctcatgataacatggtggtcatcattgtttctcctcggagtgctcttccaggggtatctcggatgtctgaggtcccatagtgttctaggccgcaggaaagctcaacttttgtccgttagtacaagccaaacttctattctcatccaggaacaatttagccatcagagaaccctggctatgtcgggaaagatgttctgttgccatgattggtccgaggagaaggtgctccccgccagctgtggagagtag

SEQ ID NO: 43357 - DNA, 780 bp, Artificial Sequence
  Description of Artificial Sequence: Synthetic coding sequence
atgaacggctgcgacatgggccccgacggccggctgctgcggggctaccatcagcacgcttacgacggaaaggactacatttcgctgaatgaggatcttcgaagctggaccgcagctgataccgtagcacagattacccagcgcttctacgaggcagaggaatacgctgaagaatttcggacctacctggagggggaatgcctggagctactgcggaggtatctggagaacggtaaagagacgctgcagcgggccgacccgcctaaggcacacgtggcgcaccaccctatctcagaccatgaagccacacttcggtgttgggccctcggcttctatcccgcagagataacgctgacgtggcagcgggacggagaagaacagacccaagacacagagctggtggagactcgccctgcgggcgacggaaccttccagaagtgggccgccgtggtggtgccgagcggcgaagagcagcgttatacgtgccacgtccagcacgaagggctgcctcagccactaatactccggtgggagcagtcgcctcagcccaccatccccattgtgggcattgtcgctggtctggtcgtgctcggcgcagtggtgacaggggcagtagtggccgctgtgatgtggaggaaaaagagctcagcctactcggtagtgtctggaaatctgatgataacatggtggtcttccctgtttttgttgggtgttctttttcaaggatacctgggatgcttgcggtcccatagcgtccttggcaggagaaagcacttttag

SEQ ID NO: 43358 - DNA, 780 bp, Artificial Sequence
  Description of Artificial Sequence: Synthetic coding sequence
atgaacggctgcgacatgggccccgacggccggctgctgcggggctaccatcaacatgcgtacgacggcaaggactatatctctttgaacgaggatctgaggtcttggaccgccgctgatacggtggcccagatcacacagcggttttacgaagctgaggagtatgccgaggaattccgcacataccttgagggtgaatgcttagagctgctccgaagatatctggagaatggcaaggagaccctgcagagagcagatccacctaaggctcatgtagcacatcaccccattagcgaccacgaagcaacactgaggtgttgggccctgggattttaccctgctgaaattacactgacatggcagcgagacggtgaagaacagactcaggatacggagctggtagagactcgtcctgcaggtgacggaacattccagaagtgggctgcggtcgtcgtgccatcaggagaggagcaacgatacacgtgccatgtccagcacgaggggctccctcagcctctcatactgaggtgggagcagtcaccccaacccacaataccaattgtgggtatcgtcgcaggactggtcgtgttgggggcggtggtgaccggcgcagtggtggcagcagtgatgtggcggaagaaatctagcgcatactctgtcgtgtccggtaatttaatgataacttggtggagctctctgtttctcttaggcgtccttttccaaggctacctcgggtgtctgcggagtcacagtgtgctgggcaggcgcaagcatttttag

SEQ ID NO: 43359 - DNA, 1260 bp, Artificial Sequence
  Description of Artificial Sequence: Synthetic coding sequence
atggccccccggagcctgctgctgctgctgagcggcgccctggcccttactgatacatgggctggaagccactctctgcgctatttcagcacggctgtgtccagaccgggtcggggcgagccaaggtacattgccgtcgaaccttgggtcgaacaggaaggtccccagtactgggaatggactacagggtatgctaaggcaaacgctcagacggaccgggttgccctacgcaatctgctgcggcgctacaaccaatcagaggcggggtctcacactctgcaaggaatgaatggttgtgatatggggcctgacggaaggctgctccgcggatatcaccagcatgcatatgatggaaaggactatatttcactgaacgaggatctgcgcagctggactgccgccgacacagtggctcaaattactcagcgcttctacgaggcagaagagtatgcagaagagttccggacctacctcgagggggagtgcctagagctcctgcggcgatatctggagaacggtaaggagactctacagcgggcagatccacccaaggcccacgtagcccaccacccaattagtgaccacgaggccacattgaggtgctgggccttggggttttatccagcagagattaccctgacctggcaaagagatggggaggaacaaactcaggacacagaactcgtcgagacccgtccagctggcgacggaacctttcagaagtgggctgccgttgtggtccctagtggagaggaacagcgctacacctgccacgtgcaacacgaaggtctgccacaacccttgatcctccggtgggaacaatcacctcagccgactatccccatcgtgggcattgtagcgggactggtagttctgggagccgtagtcacaggggcggtggtcgccgcagtcatgtggagaaagaagagctcagaccgtaatcgtggtagttacagccaggcagcggcctactctgtggtgtctgggaatttgatgatcacttggtggagttccttattccttctcggagtgttgtttcaggggtatctcggctgtctgcggtctcattccgtcctcgggcggaggaaggtgggcgacatgtggatattattcttcctatggttatggacctcttttaataccgcattcctcgcactacaatcactgaggttcgggttcggattcaggcgcggtagaagcttcctgttacggtcttggcaccacttgatgaaacgagtgcaaatcaagatttttgattag

SEQ ID NO: 43360 - DNA, 1050 bp, Artificial Sequence
  Description of Artificial Sequence: Synthetic coding sequence
atggccccccggagcctgctgctgctgctgagcggcgccctggccctgaccgatacctgggcaggatctcattctttgcgttattttagcacagcagtctcacgaccagggcggggagagccccgttatatcgccgtcgagtacgtggacgatactcagtttctgaggttcgactcggatgccgcaatccccaggatggaacccagagagccctgggtcgaacaggagggtccccaatattgggagtggactaccggctacgctaaggccaatgcccaaaccgaccgtgtggcacttagaaatctgctgcgtcgctatttggaaaatggcaaagaaaccctgcagcgtgccgatcccccgaaggcccatgtggcacatcacccaatttccgaccacgaggcaacattaaggtgctgggccctgggcttctaccccgccgagataaccttaacatggcagcgagatggcgaggaacagacgcaggatacggagttggtggagacacgaccagccggggacggcactttccaaaaatgggccgccgtggtcgtgccaagtggcgaggagcagcgctacacctgccatgtccagcacgaggggttgccacagcctctcatcctccgctgggagcagtctccacaacccaccataccgattgtggggatcgttgcaggactggtggtgctcggcgcagtggttactggtgccgtggtggcggcggtgatgtggagaaagaaatcctctgatagaaatcggggatcttatagccaggccgccgcctacagcgttgtgtctggcaacctgatgatcacatggtggagctcactgttcttgctgggcgtcctgttccaaggatatttgggctgtctgcgcagtcatagcgtcctgggccgaaggaaggcccaactgctcagtgtgtccacaagccaaacaagcatattaatacaggaacagttttcacaccagagaaccctggctatgtcaggcaaaatgttttgttgtcatgactggtctgaggagaaagtgctgcctgcttcttgcggcgaatag

SEQ ID NO: 43361 - DNA, 1308 bp, Artificial Sequence
  Description of Artificial Sequence: Synthetic coding sequence
atggccccccggagcctgctgctgctgctgagcggcgccctggccctgactgacacatgggcaggctctcatagccttcgctatttctcaactgccgtgagcagacctggtagaggagagccgcggtacattgcagtggagtatgtagatgatacacagttcctgcggtttgactctgacgccgccattccaagaatggagccgcgcgaaccttgggttgaacaggagggaccacagtactgggaatggaccacaggatatgccaaggccaatgcacaaacggatcgcgtcgctctacggaacctgctacgccgttacaatcagtcagaggctggatcgcataccttgcagggcatgaacggctgcgatatgggccctgatggcaggctactgcgcggttaccaccagcacgcctacgatggaaaggactacataagcctaaacgaggacttgcgcagttggaccgctgctgacacagtggcacagattactcagcggttctatgaggctgaggaatacgcagaagagttccgtacctacttggaaggtgagtgtttagagctgctgaggagatatttagagaatggaaaggagaccctgcagcgggccgatcctcccaaagcccacgtcgcccatcacccaattagtgaccatgaagcaactcttagatgttgggctctggggttttatcctgccgaaatcacactgacttggcagagagacggagaagaacagacacaggataccgaactcgtcgaaactcgccccgccggggatgggacgttccagaaatgggctgccgtggttgtgccctcaggcgaggagcagcgttacacatgtcatgtgcaacatgaagggctgccccaaccattaattctaagatgggagcagagtccccaacccaccattcctattgtgggcattgttgctgggcttgtggtgctaggggctgtggtcaccggcgcagtggtcgccgcggtgatgtggagaaagaagtccagtgaccgcaataggggcagctattcacaggcggcggcctactctgttgtgtcgggtctgttaatgatcacatggtggagcagcctctttttattgggagttctgtttcagggatacctagggtgtcttcgctcacactctgtcttagggcgcaggaaggcccagctgctcagcgtgagcacctcccagacctctatcctgattcaggaacaattcagtcatcaaagaaccctcgccatgtcaggtaaaatgttctgttgtcacgactggagcgaggaggaagtgctgccagcttcttgcggcgagtag

SEQ ID NO: 43362 - DNA, 1041 bp, Artificial Sequence
  Description of Artificial Sequence: Synthetic coding sequence
atggccccccggagcctgctgctgctgctgagcggcgccctggccctgacagatacctgggccggctcacatagcctcaggtacttcagcacagcagtgagccgacctgggcgaggagagcctcggtatatcgccgtggagtacgtggatgatactcaatttctgcgcttcgactcagatgctgctataccgcgcatggagcccagggagccttgggtggagcaagaaggaccacagtactgggaatggaccacgggatacgctaaagcaaatgctcagaccgatagggtggccttaaggaacctactgcgtcgctacaaccaatctgaagcaggctcccacacactccagggcatgaatggatgcgatatggggccagacgggcggctgctccggggctatcaccagcacgcttacgatggaaaggactatatctcgctgaacgaggacctgcgttcttggactgctgcggatacagtggcccaaattacacagcgtttttatgaggctgaggaatacgctgaggagtttcgcacttatttggagggcgagtgtctcgagctcctgcgacgttatttggagaacgggaaagaaacgcttcagcgtgccgaccccccaaaggctcacgtcgcacaccatcccatttcagatcatgaggccactttgaggtgctgggccttgggtttctacccagccgagattaccctgacctggcagagagatggtgaggaacaaacgcaggacacagaattggtggagactcgaccggcgggcgatggcacatttcagaagtgggccgccgtggtggttccatctggagaggaacagcgctatacttgtcacgttcaacacgagggcctgccacagccattgattctgcggtgggagcaaagccctcagccgaccattccaatcgtagggatcgtggcgggactcgtggtgctgggggcagtggtcaccggagccgtagtcgccgccgtgatgtggcgcaaaaagtcttcagatagaaatcggggcagctactctcaggctgccgtctag

SEQ ID NO: 43363 - DNA, 780 bp, Artificial Sequence
  Description of Artificial Sequence: Synthetic coding sequence
atgaacggctgcgacatgggccccgacggccggctgctgcggggctaccatcagcatgcctacgatggcaaggactatatctcgctgaacgaagacctgcggagttggactgccgctgacacggttgcacagatcacacagagattctacgaggccgaggagtacgcagaggaatttcgcacataccttgagggcgaatgccttgaacttctgcggcgctaccttgagaacggaaaagagacattgcagcgagcggatcctcccaaagctcatgtggcacatcacccgatcagcgaccacgaagccacgctaaggtgttgggccttgggattctatcccgcagaaatcacgctgacctggcagcgcgacggtgaggaacagactcaggataccgagcttgtggagacccggccagcaggggatgggaccttccagaaatgggcagccgtggttgtgccttcaggtgaggagcagcgctatacatgtcacgtgcagcatgaagggctgccgcagcccctcatactccggtgggaacagtccccacagccaacaatccccattgtaggaattgtcgctgggctggtcgttctgggcgcagtcgtgactggagccgtggtcgccgcagtcatgtggcggaagaaatcaagtgcatactcagttgttagtgggaacctgatgattacctggtggagcagtctctttctcttaggtgtcctgttccaaggatacctgggttgtctaaggagccatagcgtgctagggcggagaaaacatttttag

SEQ ID NO: 43364 - DNA, 1041 bp, Artificial Sequence
  Description of Artificial Sequence: Synthetic coding sequence
atggccccccggagcctgctgctgctgctgagcggcgccctggccttaactgacacctgggcagggtcacatagcctacgctatttctctaccgcagtgagtcgaccaggacgcggtgagccccgttacatagctgtggagtatgtcgatgatactcagttcctacgattcgactccgacgccgcaattccacgcatggagcctcgagaaccctgggttgagcaggagggtccacagtattgggagtggactacaggatacgctaaagccaatgcccagacagaccgcgtggccttgcgcaacctgctgcgtcggtataaccaatctgaggccggctcgcatacactgcagggtatgaatggttgcgatatggggcctgatgggcggttgttgcgggggtaccaccagcatgcatatgacggcaaggattacatctccctcaatgaggacctgcggtcttggactgcagcagacacagtggcacagattacgcagcgcttttatgaggctgaggaatatgctgaagagttcaggacctacttggagggcgaatgtctagaactgctgcgtcgatacctggagaatgggaaggagaccctccagcgggccgacccccctaaagcccatgtggcacaccaccccataagtgaccacgaggctactcttcgttgttgggccttgggtttctaccccgctgagattacactgacatggcagagagatggggaggagcagacccaggacacagagctggtcgagactcggccagctggcgatgggaccttccaaaaatgggctgcagttgtcgtaccttccggtgaggagcagcgctatacctgccacgtacagcatgaaggactgccccagccactgatcttaagatgggagcagtccccccagcccactattcccatcgtcggcatcgtcgctggccttgtcgtgctaggagccgtggtgactggagccgttgtagcagccgtcatgtggcgcaagaagtcctctgaccggaacagggggagttactctcaggctgctgtgtag

SEQ ID NO: 43365 - DNA, 1050 bp, Artificial Sequence
  Description of Artificial Sequence: Synthetic coding sequence
atggccccccggagcctgctgctgctgctgagcggcgccctggccctgacagatacatgggctggttcacactccctgaggtattttagcaccgctgtatctcgccccggcaggggcgaacctagatatatcgctgtcgagtacgtggacgatactcaattcctgaggttcgacagcgacgccgctatcccaagaatggaacctagagaaccatgggtggaacaagaaggcccccagtattgggagtggaccaccggttatgctaaggctaacgctcaaaccgatagagtagccctgcgcaacctccttaggagatatctggagaatggcaaagagactctgcagagggcagaccctcccaaagctcatgtcgcacaccacccaatcagcgaccacgaagccactctgcggtgttgggcactcggcttctaccctgccgagatcacactcacttggcagcgagatggcgaggaacagacccaggataccgagctcgtcgaaacaagaccggccggcgatgggacctttcagaaatgggccgcagtggtcgtcccttccggcgaggagcaacgatatacctgtcacgtccaacacgaaggtctgccacagccccttatcctgaggtgggagcaatccccacagcccaccattcccattgtgggaattgtggccggtctagtggtgctgggtgcagtggttacgggggccgtggtcgcggccgtgatgtggagaaaaaagagctccgatcgaaatcgtgggtcgtatagccaggccgccgcctattctgtagtgagcggaaatttgatgatcacctggtggtcttccctttttctgctgggcgtgctctttcaaggttacctagggtgcctcaggagtcacagtgtcctgggacggcggaaggctcaattgctttctgtaagcaccagccagactagcattctcattcaggaacagttctcgcatcagagaaccctggctatgagcgggaaaatgttttgctgccacgattggagcgaggaagaagtgctcccagcctcttgcggcgaatag

SEQ ID NO: 43366 - DNA, 1260 bp, Artificial Sequence
  Description of Artificial Sequence: Synthetic coding sequence
atggccccccggagcctgctgctgctgctgagcggcgccctggccttaacggacacatgggccggctcgcatagcctgagatacttctccacagcagtttcccgccccggccgtggcgagccaagatatatagccgtagaaccctgggtggagcaagaagggcctcagtattgggagtggactaccggatatgctaaagcgaatgcacaaactgatagagtagcactcagaaacctgctacgccggtacaatcaaagcgaggccgggtcccatacactgcagggcatgaacggttgtgatatgggccccgacgggcgccttctcagggggtatcaccaacacgcatatgacggaaaggattatatttctctgaacgaggacctcaggtcatggaccgccgccgatactgtagcccagattacgcaacgattttacgaggcagaggaatatgccgaagagtttcgtacgtacctggagggcgagtgccttgagctgctgcgtcgatatctagagaatgggaaagagaccctgcaaagggcagaccctcccaaggctcacgtggctcaccatccaataagcgaccacgaagcgactctcagatgctgggctctgggtttctaccctgctgaaatcacactaacatggcaacgcgatggggaggagcaaacccaagataccgagcttgtcgagacacggcccgctggtgatggtacctttcagaaatgggccgccgtcgtggtgccgtccggagaggagcagcgttatacctgccacgtgcagcacgaaggattaccgcagccgttaatcctgcgttgggagcagagcccccagcctaccataccgatcgtgggaattgtggccgggctggtggtgctgggggctgttgtcacgggggccgtggtggccgcggttatgtggcgcaagaaaagctcagatagaaaccgcggatcatactcacaggctgcagcttattcggtcgtgtccggaaatctcatgatcacatggtggtcaagccttttcctgctcggggtgcttttccaggggtacttaggctgtttgaggtctcattcggtcctgggtaggcgcaaggtaggtgacatgtggatactattctttctctggctgtggacatcctttaatacggctttccttgcactgcagtccctgcggttcggcttcggcttccgcagagggaggagttttttactcagatcatggcaccacctgatgaagcgggtccagataaaaattttcgactag

SEQ ID NO: 43367 - DNA, 780 bp, Artificial Sequence
  Description of Artificial Sequence: Synthetic coding sequence
atgaacggctgcgacatgggccccgacggccggctgctgcggggctaccatcagcacgcatacgacggcaaagactacatctctctgaatgaggatctcagatcttggacagccgctgacacagtagcccaaattacccagcggttttacgaagctgaagagtatgcagaagagtttcgaacatatctggagggcgagtgtctcgagctgctgcggcgctatctggaaaatggtaaggagactctccagcgcgccgatcctccaaaggctcacgtggcccatcatcccatcagtgaccatgaggcgacactgcggtgctgggccctgggtttctacccagcagaaatcacacttacatggcagcgggacggggaagagcagacccaagacaccgagttggtcgagacccggcccgcaggggacgggaccttccagaagtgggcagccgtggtcgtgccaagcggagaggagcagaggtatacttgtcacgttcagcatgagggacttccgcagcccctcattctgcgatgggaacagtcgccacagcccaccatacccatcgtggggatcgtggctggattggtggttctcggcgcagtggtcaccggggctgtggtcgccgccgtgatgtggaggaagaagagcagcgcatatagcgttgtatctgggaatctgatgattacatggtggtcctcgcttttcctgttaggggtgctgttccagggatacctcggctgtctacgctcccactctgttctagggagaaggaaacacttttag

SEQ ID NO: 43368 - DNA, 1260 bp, Artificial Sequence
  Description of Artificial Sequence: Synthetic coding sequence
atggccccccggagcctgctgctgctgctgagcggcgccctggccctgacggatacttgggccggaagccactctctgcggtacttctcaaccgcggtgagcagacccggccgaggcgaaccaagatacattgcagtggagccatgggtggagcaagagggtccacagtattgggaatggactaccggatatgctaaggcaaacgctcagactgacagggttgccctcaggaacttgcttcgacgctataaccaaagtgaggctgggagccacacattacagggaatgaacggctgtgacatggggcctgacggacgactgctgaggggctaccaccagcacgcttatgacggcaaggattatatcagcctaaacgaggacctcagaagctggactgccgcagatacggttgctcagattactcaaaggttctatgaggctgaagagtacgcggaagagtttagaacctatctggagggggaatgtttagaattgttacggagatatctggaaaatggcaaggagacgctgcagcgagccgaccctccgaaggcacatgtggcacaccaccccatcagcgatcatgaagctaccctcagatgttgggccctaggtttttacccagccgaaattaccctgacttggcagcgggatggggaggaacagacacaggatactgaactggttgagaccaggcctgcaggcgatggcacattccaaaaatgggcagcagtggtcgtccccagcggggaagaacagcgctacacttgccatgttcagcatgagggtcttcctcagccactcatcctgcgctgggagcaatctccccagcctacaattccgattgtgggcattgtagccgggctggtcgtgttgggagctgtggttaccggagctgtggtagctgcggtcatgtggagaaaaaagtcctccgatcggaatagaggatcctactcccaggcggcggcatattctgttgtatctggcaacctgatgattacctggtggagcagcctttttctcctgggggttctgttccaggggtatttaggatgtctcagaagccacagcgtgctgggccgtcggaaggtgggggatatgtggatcctgttttttttatggctgtggacttctttcaacacagctttcctagcacttcagtctctaaggtttggattcggatttaggagagggcgttctttcttgctgcggtcttggcatcaccttatgaaacgggtgcagattaagatctttgactag

SEQ ID NO: 43369 - DNA, 1041 bp, Artificial Sequence
  Description of Artificial Sequence: Synthetic coding sequence
atggccccccggagcctgctgctgctgctgagcggcgccctggcccttacggacacctgggccggaagccattctttgcggtacttcagcacagctgttagcagaccaggccggggtgagcctcgttacatcgccgtggaatatgtcgatgatactcagttccttagattcgattcagacgcggcgatccctcgcatggaaccacgagaaccttgggtggaacaggaggggccacaatactgggagtggaccactggctatgccaaggccaatgcgcagaccgatcgagttgccctgcgaaatctacttaggagatataatcagtcagaggcaggttcccatactctgcagggaatgaacgggtgcgacatgggccctgacggtagactcctgagagggtaccatcagcacgcctacgatggaaaggattacatctcgctgaatgaagatctgcgcagttggaccgctgctgatacagtggcccagattactcaacgcttctacgaggcagaggaatatgccgaggagttccggacttacctcgagggcgaatgtctagagctcctgcggcgttacttggaaaacggcaaagagactttacaacgcgccgaccctccaaaagcccacgtcgcccaccatcctatcagtgaccacgaggctactctcaggtgttgggctctcggcttttaccctgccgaaatcaccttaacctggcagagagatggagaagagcagacacaagataccgagctggtcgagacccgtcctgcaggtgatggcacctttcagaagtgggcagcagtggtggtcccatcaggagaggagcagcggtacacatgtcatgtccaacacgaagggctgccgcaacctttaattttgcggtgggaacagagtccgcagcccactattcccatcgtgggcatcgttgccggtctggtggtgctgggcgctgttgtgaccggagccgtcgtggccgcagtcatgtggcggaaaaagtcaagcgataggaaccgagggagctatagtcaagcggctgtttag

SEQ ID NO: 43370 - DNA, 1041 bp, Artificial Sequence
  Description of Artificial Sequence: Synthetic coding sequence
atggccccccggagcctgctgctgctgctgagcggcgccctggccctgacagacacctgggccggatcacactccttgcgctatttctcaactgctgtgtccagaccaggacgaggagagcctagatacattgcagtggaatacgtagatgacacccagttcctgcgctttgactccgatgctgccattccgaggatggagccccgcgagccatgggttgagcaggaaggacctcagtattgggaatggacaacaggctacgctaaggctaatgctcaaactgaccgcgtagccctcaggaacctgctgcgaagatataatcagagtgaggctggtagccacacactgcaaggaatgaacggctgtgatatgggccccgatgggaggcttctgaggggatatcaccagcacgcctacgacggcaaggactatatttcactgaacgaggatctgaggtcctggacggccgccgatacagtagctcagatcacacagagattctatgaagctgaagagtatgccgaagaattccgcacatacctcgagggtgagtgcttagagttactgcgcagatatctcgaaaatggcaaagaaacgctacagcgcgctgacccgcctaaggctcacgtggcccatcacccaatatccgatcatgaggccacactgcgttgctgggcactcgggttctaccctgccgaaatcactctgacgtggcagcgggacggcgaggagcagacccaggacaccgagctggtggagacaaggcccgcaggcgatggcactttccagaagtgggccgctgtggttgtccctagcggcgaagagcagagatacacctgtcacgtgcagcatgaagggctcccgcagcctctgatcttacggtgggagcagagtccccagccaactataccaatcgtgggcattgtggcaggcctagtagtgctaggagccgtcgtcacaggcgcagtagtcgcggccgttatgtggcggaagaagagcagtgataggaatagaggaagctatagccaagctgcggtctag

SEQ ID NO: 43371 - DNA, 1017 bp, Artificial Sequence
  Description of Artificial Sequence: Synthetic coding sequence
atggccccccggagcctgctgctgctgctgagcggcgccctggccctgaccgacacttgggccggttcacatagcctgcggtactttagcacagcggtatcccgccctggcaggggagagcctaggtacattgcagtcgaatatgtcgacgacactcagtttctgagatttgatagcgatgctgcaatccctcggatggaaccacgcgagccctgggtggaacaggaaggcccccagtactgggagtggaccaccggctacgcgaaagccaacgcccagacggatcgcgtcgccctgaggaatcttctgcgccgatacaaccaaagtgaagctgggtcgcatacgttacaggggatgaatggctgtgacatgggtcctgacggacggctgctgaggggataccaccaacatgcatatgatgggaaggactacatctctctcaacgaggacctaagaagctggacagcggccgacactgtcgcccagatcacacagagattctatgaagcagaggagtacgccgaagagttcagaacttacttggaaggcgagtgcttggagttgctgagacgttacctggagaacggcaaggagacattgcagcgggcggatcctccgaaggctcacgtggcgcaccatcccatctccgatcatgaggccacactccggtgctgggcgctagggttttatccggccgagataacgctgacatggcagagggatggcgaagagcagacacaagataccgagctagttgaaacccgacctgcaggtgatggcacattccagaaatgggctgccgttgtggtcccgtctggagaggagcaacgctatacttgtcacgtgcagcacgagggactcccacagcctctcatactgcggtgggaacaatcacctcagcctaccatcccaattgtcggcatagtggccgggctggtggtgctaggcgccgtggtcacgggagccgtggtagccgccgtaatgtggcggaagaaatcctcaggcagaaagggctag

SEQ ID NO: 43372 - DNA, 1260 bp, Artificial Sequence
  Description of Artificial Sequence: Synthetic coding sequence
atggccccccggagcctgctgctgctgctgagcggcgccctggcccttacagatacatgggccgggtcgcacagtttgcgatactttagtactgctgtatcaaggcctggtaggggcgagccgcgatacatcgccgtggaaccttgggtggaacaggaaggaccccagtactgggagtggaccacgggatatgccaaggctaacgcacagacagaccgcgtggccctgcggaacttactgaggcggtacaaccagagtgaggcgggctcccataccttacagggaatgaacggctgtgatatgggccccgacggtcgcctcttgcgtggatatcatcagcacgcatatgatggtaaagactatatcagcctcaatgaagacctgaggagctggaccgcggcggataccgttgcacaaattacacagaggttttacgaagccgaagagtacgccgaagagtttaggacctacttagaaggcgagtgtcttgagctcctccgcaggtatctggagaatgggaaagagacactacagcgggccgacccaccaaaagcccatgtggcccatcacccgattagtgaccatgaagccaccttgagatgctgggcacttgggttctacccagccgaaatcactctcacatggcagagagatggcgaggagcagacacaggacacggagctggttgaaacgagacccgccggcgatgggacatttcaaaaatgggcggctgtggtggttccaagcggtgaggagcaacgatacacctgtcatgtgcagcatgagggcctgccacaaccacttattctgcggtgggagcaaagtccccaacctactatccctatcgtgggcatcgtcgccgggttggtggtcctgggcgcggttgtgactggcgccgtggttgctgccgtaatgtggagaaagaagtcttccgatcgaaacaggggaagctattctcaggctgccgcatacagtgtggtctctggcctgctcatgatcacgtggtggtccagtcttttcctgctgggggtactcttccaaggatacttaggatgtctgaggagtcattctgtgctggggaggcggaaggtgggtgacatgtggattctgtttttcctttggctgtggacttcttttaacacagccttcctggctctccagtctctgcgcttcggttttggctttagaagggggcgctcatttttgctgcggagttggcatcacctaatgaaaagagtgcagattaagatttttgattag

SEQ ID NO: 43373 - DNA, 1017 bp, Artificial Sequence
  Description of Artificial Sequence: Synthetic coding sequence
atggtggtgatggccccccggaccctgttcctgctgctgagcggcgctctaacgctgacggagacatgggccgggtctcactccatgagatatttcagcgccgccgtgagtaggcctggaagaggcgaaccacgtttcattgcaatgggttatgtggacgacacccaatttgtgcgatttgacagcgacagcgcctgcccaaggatggagccccgggctccctgggtagaacaggaaggacctgagtattgggaagaggagaccagaaacacaaaagcccatgcccagaccgaccgtatgaatctgcaaacactgcggggttattacaaccaatcagaggcctccagtcacacactgcaatggatgatcggatgtgacctggggtctgatggacggttactgcggggttatgaacaatatgcttacgacggcaaggattaccttgcccttaacgaggacctgaggagctggactgctgcggacacagcagcccagatcagcaaaaggaaatgcgaagctgctaacgtcgctgagcagcgtcgcgcgtacctggagggcacttgcgttgagtggctccacagatacctggaaaacggcaaggagatgctacaacgggccgacccacccaaaactcatgttactcaccatcctgtcttcgattatgaggccacgctgcgctgctgggcactaggcttctatccagctgagattatactgacgtggcagagagatggcgaggatcagacacaggacgtagagcttgtggagacacgccccgctggcgacggcacattccagaagtgggcagctgttgtggttccctctggagaggaacaacgctacacctgccatgttcaacatgagggtcttccagaaccactcatgttgcggtggaaacagtccagcttgcccacaattcctatcatggggatcgttgctgggctggtggtgttggccgccgttgtgacaggggctgcggtagctgcagtgttgtggaggaagaaatcctccgattag

SEQ ID NO: 43374 - DNA, 465 bp, Artificial Sequence
  Description of Artificial Sequence: Synthetic coding sequence
atggtggtgatggccccccggaccctgttcctgctgctgagcggcgcactgactctgaccgaaacctgggccggtagtcacagtatgcgttatttctccgctgctgtatcccggccaggccgcggggaaccccggtttatcgctatggggtacgtcgacgacacacagtttgtgagattcgactcagattcagcttgccctcgtatggagcctcgtgcgccctgggtcgagcaggaaggacccgaatactgggaggaggagacaagaaatactaaagctcatgcacagaccgaccgcatgaacctgcaaacactgagaggatactataatcaaagcgaggctaaacaatccagcctgcctacaattcccattatggggattgtggcggggctggtagtgttggccgctgtggttacaggcgccgccgttgctgcggtgctgtggcggaaaaaaagcagcgattag

SEQ ID NO: 43375 - DNA, 741 bp, Artificial Sequence
  Description of Artificial Sequence: Synthetic coding sequence
atggtggtgatggccccccggaccctgttcctgctgctgagcggcgctcttacactgaccgaaacatgggcaggatcacattccatgaggtatttctcagcagctgtctctaggcctggacggggagaaccacgcttcatcgctatgggttacgtggatgacactcagttcgtgcgtttcgacagcgactccgcctgccccaggatggaacctcgggccccatgggtggagcaagaagggcctgaatattgggaggaggagacccggaacacaaaagcccacgcccagacggacaggatgaacttacagacccttcgagggtattataaccagtcagaggccaatcccccaaagacccacgttacccaccatcccgtctttgactacgaagccactctccgctgttgggccctcggattttacccagcagaaattattctgacctggcagcgcgacggcgaagatcagacccaggatgtggaactcgtagaaacacgccccgcaggcgatggtactttccaaaagtgggctgctgtggtcgttccctccggtgaggaacagcggtatacctgtcatgtgcagcacgaaggcctgcctgaacccctgatgctgcgatggaagcagtcttcattgccaaccatcccaatcatgggcatagtcgcggggttagtcgtcctggcagcagtggttacgggggcagcagtcgccgctgtgctgtggcgtaagaagtcttcagactag

SEQ ID NO: 43376 - DNA, 1032 bp, Artificial Sequence
  Description of Artificial Sequence: Synthetic coding sequence
atgaagaccccccggatggtggtgatggccccccggaccctgttcctattgctctctggggcactgactttaactgaaacctgggccggtagccactccatgcgttacttcagcgcggccgtgtctagaccaggccgtggcgaaccacggttcattgcaatgggatacgtggacgacacacagttcgttaggttcgactcagattctgcatgcccaagaatggagcctcgggcaccctgggtcgaacaagaggggcccgaatattgggaagaggagacccgcaacacaaaggctcacgcgcaaacggacagaatgaatctacaaacgctgagaggttactataaccagtccgaagcttcgtcccataccctccagtggatgataggatgtgacctcggaagtgacgggagacttctgaggggctatgaacagtacgcctatgatggaaaggactatctggccttgaatgaagacttgcgatcttggactgccgccgatacagcagctcagatttccaagcgcaaatgcgaagctgccaatgtcgctgagcaaaggcgggcctatctggaggggacgtgcgtggagtggcttcataggtatctcgagaatggaaaggagatgctacaacgggcagatccccccaaaacgcacgtgacacatcatcccgtgtttgactacgaggccacgcttaggtgttgggcactgggtttttatccagcagagattatactgacatggcagcgcgatggggaggaccagacacaggacgtggagttggtggagaccaggcccgcaggagatggcaccttccagaaatgggcagccgtagtcgtgccgtctggcgaagagcagcgatacacttgccacgttcagcacgagggtttgcccgaaccactaatgctgcggtggaaacaatccagcctgccaacaatacccattatgggcattgttgcggggctggtggtgttggccgccgtcgtgaccggagctgctgtagccgctgtcctgtggcgcaagaagtcaagcgactag

SEQ ID NO: 43377 - DNA, 1017 bp, Artificial Sequence
  Description of Artificial Sequence: Synthetic coding sequence
atggtggtgatggccccccggaccctgttcctgctgctgagcggcgcactgactctcactgagacttgggccggcagccactctatgagatattttagcgcagccgtgagcaggccagggaggggggagccacgctttatagccatgggatatgtagacgatacccaattcgtcaggttcgattctgactctgcttgtccaagaatggagcctagggccccatgggtggagcaggaaggacctgaatattgggaagaggaaactcgcaatactaaagctcacgctcagacggatcgtatgaaccttcagactctacgggggtactacaatcagtctgaggcctcttcacatactttacagtggatgatcggatgtgaccttggcagcgatggccggttgctgcggggttacgaacaatacgcctatgatggaaaagactaccttgcactgaatgaagatctgcggtcgtggactgccgcagataccgcagctcaaatatccaaaagaaagtgtgaggccgccaatgtcgctgaacagagacgcgcttatcttgaggggacttgcgtcgaatggttgcacaggtacctggagaacggtaaagagatgctacagcgtgcggacccccccaagacccatgtaacccaccacccggtctttgactacgaggcaaccctcaggtgttgggctctagggttttatccagccgaaattattctgacttggcagcgggatggcgaagatcaaacgcaagatgtggagctggttgagacaagaccagccggcgacgggacatttcagaaatgggccgcagttgttgtaccaagcggcgaggaacaacgatatacatgccatgttcagcacgagggattgcctgaacctctaatgctccgctggaagcagtcgagcctgcctaccattcccatcatgggcattgttgcagggctcgtcgtgctggccgccgtggtgacgggagctgccgtcgcagccgtgctgtggcgtaaaaaaagtagcgactag

SEQ ID NO: 43378 - DNA, 465 bp, Artificial Sequence
  Description of Artificial Sequence: Synthetic coding sequence
atggtggtgatggccccccggaccctgttcctgctgctgagcggcgccctgacccttaccgagacttgggcaggcagtcacagcatgagatacttttctgctgctgtgtcaagaccagggcgaggagagccccggtttatagcgatgggatacgtcgatgacacccagttcgtaagattcgactctgactccgcttgccctcgcatggagcctagagctccctgggtggagcaggaggggcccgaatattgggaagaggaaaccaggaatacaaaagcccatgcccaaactgacaggatgaacctccaaaccctgcgggggtactacaaccaaagcgaagcaaaacagtctagcctgcctacgattcctataatgggcatcgtggcgggcctcgttgttcttgcagccgtcgtaacaggggccgccgtcgctgccgtgctgtggaggaagaaatcctccgactag

SEQ ID NO: 43379 - DNA, 741 bp, Artificial Sequence
  Description of Artificial Sequence: Synthetic coding sequence
atggtggtgatggccccccggaccctgttcctgctgctgagcggcgccttgaccctaactgaaacatgggccggttctcactcaatgagatacttttccgccgccgtttctaggcctgggcgcggcgagccccgatttattgcaatggggtatgtggacgatactcagtttgtccgattcgacagcgactccgcctgtccaagaatggagccacgcgccccttgggtggaacaggaaggaccggagtactgggaggaggagacccgaaatacaaaagcccatgcacagaccgatcgcatgaatctccagacactgagaggctactacaatcagagcgaagccaacccccccaaaacccacgtgacacaccaccctgttttcgactatgaagcaacgctgcgctgctgggccttggggttttatcccgcggagatcattttaacttggcagcgcgacggagaggatcaaacacaggacgtagagctggttgagacccggcccgcaggagacggtactttccagaagtgggctgctgtcgtagttcccagcggtgaagagcagagatatacctgtcatgtgcagcacgagggtttacccgagcccctcatgctccgatggaagcagagttccctgcccaccatacctatcatgggtatcgtggctggccttgtggtgctcgctgccgtggtgaccggcgccgctgtggctgccgtgctctggcgcaagaaatctagcgattag

SEQ ID NO: 43380 - DNA, 1032 bp, Artificial Sequence
  Description of Artificial Sequence: Synthetic coding sequence
atgaagaccccccggatggtggtgatggccccccggaccctgttcctgctgctgtccggcgcattaacactgacagagacatgggctgggagccatagcatgcgttacttctccgctgccgtgtcacgcccagggaggggggaacctcgatttatcgcaatggggtacgtcgatgatacccagttcgttcgcttcgattcagatagcgcctgccctagaatggaacctagagccccttgggtggagcaggagggaccagagtactgggaggaggagacacgcaacaccaaagcccacgcacagaccgatcggatgaacctgcaaacgctgagggggtattacaatcaatcagaagcatcgtcacataccctgcagtggatgatcggctgtgatctgggttccgatggcagacttctgaggggctatgaacagtatgcatacgacggaaaagactatttagcgctcaacgaagacctccgctcgtggactgcagcagatactgccgcgcagataagtaaaagaaagtgcgaggcagcaaacgtggccgaacagaggagagcatatttagaagggacctgcgtcgagtggctgcatagatatctggagaatggaaaggaaatgctgcagcgtgccgatcccccaaagacacatgtcacacaccatccagtgttcgactacgaggctactctgaggtgctgggccctagggttttatccggccgagattatcctgacatggcagcgcgacggcgaagaccagacgcaagatgtggagctggtggaaacacgtcccgcaggcgatggcacatttcagaaatgggctgcagtagtcgtcccgtctggggaagaacaaagatatacgtgtcatgtacagcacgaggggttgccggaaccactcatgcttagatggaagcagagcagtctacctacgataccaatcatgggcatcgtggctggattggtagtactcgccgcggttgttacaggcgcagccgtggccgccgtcctgtggaggaaaaagtctagcgattag

SEQ ID NO: 43381 - DNA, 1032 bp, Artificial Sequence
  Description of Artificial Sequence: Synthetic coding sequence
atgaagaccccccggatggtggtgatggccccccggaccctgttccttctcttatccggtgcactaacactgacggagacctgggccggaagtcattctatgagatacttttctgctgctgtctcaagaccaggacggggagaaccccgcttcattgctatgggttacgtggacgatacccagtttgtcagattcgattccgattctgcctgtcccagaatggagccgagggctccttgggtggaacaggaaggcccagagtattgggaggaggaaaccaggaacaccaaagcacatgcacagaccgatcggatgaatctgcagacactgcgaggatattacaaccagtcggaagcctcatcgcatacgttacagtggatgattggctgcgaccttggatcagacggcaggcttcttcggggctatgaacaatatgcatacgacgggaaggactatctggctctgaatgaagatctgagatcgtggacagccgccgacaccgccgcccagatcagcaagcgtaaatgtgaggccgcgaatgtggctgagcagcggcgtgcttatttggagggaacgtgcgtagagtggctccatagatatctggagaacggtaaggagatgctgcagcgagcagatccacccaaaacccacgtgactcatcaccctgtgttcgactatgaagcaactctgaggtgctgggctcttggcttctaccctgccgagatcatcctgacttggcagagagacggagaggatcagactcaagacgtggaactcgtggaaacaaggcccgctggcgatggcacattccagaagtgggctgcagtggtagtgccttccggggaagagcaaaggtacacgtgtcatgtgcagcatgagggtctacccgaaccgctgatgctaaggtggaagcagtcgagcctccccactattcccataatgggcattgtggctggcctagtcgtcctggcagctgttgtcacaggcgccgccgtggcagcggtgctgtggaggaagaagtcttccgattag

SEQ ID NO: 43382 - DNA, 741 bp, Artificial Sequence
  Description of Artificial Sequence: Synthetic coding sequence
atggtggtgatggccccccggaccctgttcctgctgctgagcggcgccctaacgttaactgaaacatgggcaggctctcattctatgcgttacttcagcgcagccgtctccagacctggccgaggtgaacctcgttttattgccatgggctatgtagacgatacccagtttgtgaggttcgactccgacagtgcctgtcccaggatggaaccacgggcaccctgggttgagcaagagggtccggaatactgggaagaggagaccaggaataccaaagcccatgcgcagactgaccgtatgaacctgcagactttgcgcgggtattataatcagagcgaagccaaccccccaaagacacacgtcacgcaccaccccgtgtttgattatgaggctactctaaggtgctgggcactgggcttttatcctgcagagatcatcctgacatggcagcgggacggcgaagaccagacccaagacgtcgaactggtggaaacaaggcccgccggggacgggaccttccagaagtgggcagccgtggtggttccgtcgggggaagagcagaggtacacctgtcacgttcaacacgagggattgcccgaacctctaatgctgcgctggaaacagagtagtctgcccaccatccccataatgggcatcgtagctggactcgtggttcttgctgctgtggtcaccggagcagctgttgctgcggtactgtggcggaagaagagcagcgactag

SEQ ID NO: 43383 - DNA, 465 bp, Artificial Sequence
  Description of Artificial Sequence: Synthetic coding sequence
atggtggtgatggccccccggaccctgttcctgctgctgagcggcgcactcacactaacagagacctgggctggttcccattctatgagatacttttcagcagcggtatctcggccaggcaggggcgaaccaagattcatagccatggggtatgtcgatgacactcagtttgtgcgcttcgactccgacagcgcctgcccccgaatggagccccgagcaccgtgggtcgagcaggagggacccgagtactgggaggaggagacgcgcaacactaaggcacatgctcagacggacagaatgaatcttcagactctgagaggctactataaccaaagcgaggctaagcagtccagcctgccaaccatccctataatggggattgtggccggcctggtcgtcctggcagcagttgtcactggcgcagccgttgctgctgtgctgtggcggaaaaagagttctgattag

SEQ ID NO: 43384 - DNA, 1032 bp, Artificial Sequence
  Description of Artificial Sequence: Synthetic coding sequence
atgaagaccccccggatggtggtgatggccccccggaccctgttcctcctgctctcaggcgccctgactctcacggagacatgggccggatcccacagcatgcgatatttctccgccgccgtgagcaggccaggccgcggggagccacgtttcatcgccatggggtacgttgacgacacccaattcgtccgatttgatagcgacagcgcctgtccaaggatggagcctagagccccatgggtggagcaagagggccccgaatactgggaggaggagacacgcaacaccaaggcccacgcccagacagatcgcatgaatctgcagacactgcgtggatactacaaccaatctgaagccagttcacataccctccagtggatgatcggctgtgacctaggttcagatgggagactgctgcgcggatacgaacagtatgcatacgacggaaaggactacctggctttgaacgaggatttgaggagctggacagcggccgataccgctgcacagatcagtaaaagaaaatgcgaggccgcgaacgtggctgagcaaagaagggcatacctggaaggaacctgtgttgagtggctgcatagatacttagaaaacgggaaagagatgctccagcgggcggatccgccaaagacccacgtgacccaccacccagtgttcgactatgaggccaccctgcgctgttgggcacttggtttctaccctgcagaaattatccttacatggcagagggacggggaggatcagacgcaggacgtcgagttagtggagacccgtcctgcaggggacggcaccttccagaagtgggctgccgtcgtcgtgcctagcggtgaagagcaacgctacacctgccatgtacagcatgagggtctgccagaacctttgatgttgcggtggaaacagtccagcctacccacaattcccatcatgggcattgttgctggtctggttgtcctcgccgccgttgtgaccggcgccgctgtagctgccgtcttgtggcgcaaaaagtcctctgattag

SEQ ID NO: 43385 - DNA, 1032 bp, Artificial Sequence
  Description of Artificial Sequence: Synthetic coding sequence
atgaagaccccccggatggtggtgatggccccccggaccctgttcttgctgctgagcggggcacttaccctaactgaaacttgggctggatcacattctatgagatacttttcggccgctgtgagtcgacccggacggggcgagccaaggttcattgcaatggggtacgtggacgatacccagttcgtgagattcgactctgacagtgcctgtcctcggatggaacctagggccccttgggtggagcaggaaggcccagagtactgggaggaagagacgaggaacacgaaggcacacgctcagacggacagaatgaacctgcaaactcttagaggttattacaaccagtccgaagcttcgagccatacacttcagtggatgattggttgcgaccttggttcagatggccggcttctgagagggtatgagcagtatgcttacgacggcaaagactacttggctctcaacgaggacctgcggagctggactgccgcggacacggcagcacaaatctcaaaacggaagtgtgaagctgccaacgttgcagagcaaaggagggcttacctggaggggacttgtgttgaatggctgcataggtacctggagaatggaaaagaaatgctacagagagccgacccccctaagacccacgttacacaccaccccgtgttcgactatgaagccaccctgaggtgttgggccctcggcttctatcctgctgaaattattctgacatggcaacgcgatggtgaggaccaaactcaagatgttgaattagtggaaacgcgccccgccggagacgggaccttccagaaatgggcagcagtcgtggttccaagcggtgaagaacagcgctacacatgccatgtgcagcacgagggcctgccggagcctcttatgttgaggtggaagcagagttctctgccaactatacctatcatggggattgtagctggactagttgtgcttgcggctgtggtgacgggtgccgcagtggctgcagtgctttggcggaagaaatcctctgattag

SEQ ID NO: 43386 - DNA, 1017 bp, Artificial Sequence
  Description of Artificial Sequence: Synthetic coding sequence
atggtggtgatggccccccggaccctgttcctgctgctgagcggcgcccttaccctcacagagacctgggcaggatcacatagcatgaggtactttagcgcggctgtgagccggccaggtaggggagagccaagatttatcgccatggggtatgtggacgatacacagttcgtgaggtttgactccgatagtgcgtgccctaggatggagcctcgggccccctgggtggagcaggagggtcctgagtattgggaggaggagaccaggaatacgaaggcccacgctcagacagaccgaatgaatttacagaccctgagagggtattataaccagtctgaggcttcgagtcataccctgcagtggatgataggatgcgacctgggctcagacggtaggttattacgcggatatgaacagtacgcatacgacggcaaagattacctggcgttgaatgaggatctgagaagttggaccgcagctgacaccgctgcccagatcagtaaacgcaagtgtgaggcggcgaacgtggccgaacagcggcgagcgtacttagagggtacatgtgtggagtggctgcatcgctacctggagaacgggaaggaaatgttgcagcgggccgaccctcctaagacgcacgtgactcatcaccccgtctttgactatgaggccacattgcgttgttgggcccttggattctaccccgccgagattattctgacatggcaaagagacggagaggaccaaacgcaggatgtcgaactagtggagacacggcccgcaggcgacggaacatttcagaaatgggctgctgtggtggttcccagcggcgaagagcagcggtatacatgccacgtgcagcacgaagggctacctgagccattaatgctgcggtggaagcagagctcactgccgacaatcccgattatgggtatcgtcgcaggcctggtggttctggcggctgtggtgactggcgctgccgtcgctgccgtactgtggaggaagaaaagttctgattag

SEQ ID NO: 43387 - DNA, 1017 bp, Artificial Sequence
  Description of Artificial Sequence: Synthetic coding sequence
atggtggtgatggccccccggaccctgttcctgctgctgagcggcgctctcacactgacagagacctgggctggatcccactcgatgcggtatttttccgcagccgtgagtaggcctggacgaggtgagccccgctttatcgccatgggttacgtggatgacacccagtttgttcgatttgacagcgactccgcttgtccccggatggagcctcgtgccccgtgggtggaacaggagggtcccgagtattgggaggaggagacacgtaacaccaaggcccacgcccaaacggaccgcatgaatctgcagactctccggggctactataatcagtcggaagcaagctctcacacactgcaatggatgattggatgtgaccttggctctgacggacggctgctccgtggctatgagcagtacgcttatgatggcaaagactatctggcactcaacgaggacctgaggtcttggaccgccgctgatacagcggctcagatatccaaacgcaagtgcgaggccgctaatgtcgcagaacagcgcagggcatatttggaggggacctgcgtggaatggctgcacagatatctggaaaacggtaaagaaatgctgcaacgcgcagacccaccgaaaacccacgtgacccaccacccagttttcgactacgaggccaccctgaggtgttgggcccttggcttctaccccgctgaaatcattttgacttggcaacgtgatggtgaggaccaaacccaagacgtcgaactggtcgaaacaagacctgccggggatggtacttttcagaaatgggctgcggtcgtagtaccatctggggaggagcagagatacacctgccatgttcagcacgaaggcctgcccgagccccttatgctgaggtggaagcagtcctcactgccgactatccccatcatgggaattgtcgctggccttgtcgtgttggcggcagtcgtcacaggggcagcagtggcggcagttctgtggcgtaaaaagtcatcggactag

SEQ ID NO: 43388 - DNA, 741 bp, Artificial Sequence
  Description of Artificial Sequence: Synthetic coding sequence
atggtggtgatggccccccggaccctgttcctgctgctgagcggcgcacttacactgactgagacatgggcaggttcacacagcatgaggtacttttccgccgcagtctcccggcccgggaggggagaaccaaggttcattgctatggggtacgtggatgacacgcagttcgttagatttgactccgattcagcatgcccacgcatggagccgagagccccttgggtggagcaggaagggcccgagtactgggaggaagagacaagaaatacaaaagcgcatgcacagaccgaccgcatgaacctgcaaactttacgcggttattataatcagagcgaagccaatccaccgaagacccatgtgacacatcacccggtttttgattacgaagcaacgctgagatgttgggctctgggcttctaccctgctgagattatcttgacatggcaacgcgatggtgaagaccagacccaagatgtagaactggtggaaacgaggcccgcaggtgacgggacctttcaaaagtgggccgcggtggttgtaccatcaggagaggagcagagatatacatgtcatgtccagcacgagggccttccggaacccctgatgctcagatggaagcagagctcacttcccacgatacccattatggggatcgttgccggcctcgttgtcctggccgccgtagtaaccggagcggcagtggcagctgtgctctggagaaagaaatcatctgactag

SEQ ID NO: 43389 - DNA, 1017 bp, Artificial Sequence
  Description of Artificial Sequence: Synthetic coding sequence
atggtggtgatggccccccggaccctgttcctgctgctgagcggcgctttgactctcacagaaacctgggcaggcagccatagtatgaggtacttctcggcagcagtatcaagaccggggcgaggcgagcccaggttcatagcaatggggtatgtggacgacacacagttcgtgcggttcgactcagattcagcctgccctcgaatggagccaagggctccctgggttgagcaagagggtcccgagtactgggaagaggaaacccggaacacaaaagcccacgcccagacagaccggatgaacctccagacgctccggggctactacaaccagagcgaggcgagttcccacacactccagtggatgattggttgcgacttaggatctgatggccgactgttgaggggctacgaacagtacgcatacgatggcaaagattatctggcgctgaatgaagatcttcggagctggacggccgcagatacagccgcccaaatcagcaaacgaaagtgcgaagcggccaatgtcgctgagcagcgccgcgcatatctagaggggacctgcgtcgaatggcttcaccggtatttagaaaacggaaaggagatgcttcagcgagccgaccccccgaaaacacacgtcacccatcaccccgtgttcgactatgaagccactctgaggtgctgggccctgggtttctatccagcagagattatccttacgtggcagcgggacggagaggatcagacacaggacgtggagctcgtagagacccggcccgccggcgacggcacgtttcagaagtgggctgcagtagttgtgccatctggagaggagcagcgatacacatgtcacgttcagcatgagggattgccggagccactgatgctaagatggaagcaatcttccctacccactatcccgattatgggcattgtcgccggtctggttgtgctggctgctgtagtaaccggcgccgcggttgcagcagtgctttggaggaagaaaagctccgattag

SEQ ID NO: 43390 - DNA, 1017 bp, Artificial Sequence
  Description of Artificial Sequence: Synthetic coding sequence
atggtggtgatggccccccggaccctgttcctgctgctgagcggcgccctgactcttaccgagacctgggctgggagccattctatgcgatatttttcagcggcggtctcacgcccaggacggggtgagccgcgatttatcgcaatgggttatgtagatgatactcagtttgtgcgtttcgacagtgactcagcctgtcccaggatggagccacgggccccctgggtcgagcaggaggggcccgaatactgggaagaggagacccgtaacaccaaggcacatgctcaaaccgataggatgaaccttcagactctgagggggtattacaaccaatcagaggctagtagccatactttgcaatggatgattggctgcgacttaggatcagacggtcgtttgcttcggggctatgagcagtacgcctacgatggcaaggattacctcgcgctgaatgaggacctaaggtcatggactgccgcagacaccgcggctcagatcagcaaaagaaaatgtgaggccgcaaatgtagcagagcagcggcgcgcctatctggaaggaacatgcgttgagtggctacaccgctacctggagaacgggaaggaaatgctgcaacgggctgacccgcctaagacccacgtgacgcaccatcccgttttcgactacgaagccaccttgagatgctgggctctgggattttatcctgcggagattatcctcacctggcagcgagacggagaagaccagacacaggatgtggaactggtcgagacgcgaccggccggagacggaaccttccagaagtgggctgcggtagtcgtcccatcaggcgaagagcagaggtacacttgtcacgtccagcacgaagggcttccagaaccactgatgcttcggtggaagcaatcttctctaccaaccatcccaatcatggggatcgttgcaggactggtggtgctcgccgcagtcgtaactggagccgccgtggccgctgtgctgtggaggaagaagtcaagtgattag

SEQ ID NO: 43391 - DNA, 465 bp, Artificial Sequence
  Description of Artificial Sequence: Synthetic coding sequence
atggtggtgatggccccccggaccctgttcctgctgctgagcggcgctctgaccctgaccgaaacctgggcagggagccacagtatgagatacttctccgcagctgtgtcgaggcctggcagaggggaacctcggttcatcgcgatgggatacgtcgatgatacacaatttgtgagatttgactctgattctgcctgccccagaatggagcccagagcaccatgggttgaacaggagggaccagagtactgggaagaagagactcgcaacaccaaagcccatgcgcagacggaccgtatgaatctgcagaccttacgcggttactacaaccagtccgaagccaagcagtccagcctacctacaatcccaatcatgggcatcgtggcaggactcgtggtgctggccgcggtcgttactggcgcagctgtcgccgccgtgctttggaggaaaaaatcctccgattag

SEQ ID NO: 43392 - DNA, 741 bp, Artificial Sequence
  Description of Artificial Sequence: Synthetic coding sequence
atggtggtgatggccccccggaccctgttcctgctgctgagcggcgctctcacattgacagaaacatgggccggttcacacagcatgaggtactttagcgctgcagtgtcaaggcccggcagaggcgagcctaggttcattgctatggggtatgtcgacgacacccagtttgttagattcgacagcgatagtgcgtgcccacgcatggagcctcgggccccatgggtggagcaggaagggcctgaatactgggaggaagaaacaagaaacaccaaggcacatgctcagacggatcgtatgaatctgcaaaccctcaggggatactacaaccagtcagaggccaacccccccaagacacacgtgactcaccaccccgtttttgactatgaggctacgttacgatgttgggctctgggcttctatcccgctgagataattctgacctggcagagggatggcgaagatcagacacaagacgtggaactcgtggagacacggcctgctggcgacggcacatttcagaaatgggccgccgttgtggtacccagcggcgaggaacagcgatatacgtgccatgtccagcacgaaggactgcccgagcccttaatgctgaggtggaagcagagttctctgcccaccatacccataatgggaatagtggccggtcttgtcgttctggcggccgtggtgaccggcgccgcagtagcggcagtgctgtggagaaagaagtcgtcagactag

SEQ ID NO: 43393 - DNA, 1032 bp, Artificial Sequence
  Description of Artificial Sequence: Synthetic coding sequence
atgaagaccccccggatggtggtgatggccccccggaccctgttcttgttgttgtccggggccctcacactaacagagacatgggcgggatcacattctatgcgctatttctccgccgccgtgtccagaccaggtagaggcgagcctcgattcatcgccatggggtacgtggacgatactcagttcgtgcgcttcgattccgactccgcctgtccgcgaatggagcccagagctccctgggttgagcaagaaggaccggagtattgggaggaggagactaggaataccaaggcgcacgcacagactgatcggatgaacttacagaccctccgcggctactacaatcaaagtgaggcatcttcacacactctgcagtggatgatcggctgcgacttgggaagtgatggccgactgctacgcgggtacgagcaatacgcgtatgacggcaaagattaccttgcccttaacgaagatctcagaagttggacggcagccgacaccgccgcacagatatctaaacgcaagtgcgaagctgccaatgtcgccgagcagcgccgcgcatacttggaggggacttgcgtggagtggctgcaccgatacctcgaaaatggtaaagaaatgctgcaaagagctgaccccccaaaaactcatgtgacacatcatccagtgtttgattatgaagccacactacggtgctgggccctgggcttctaccccgcggagattattctgacatggcagagggacggggaagatcagacccaagatgtggagctcgtggagacgcggcccgccggcgacggcacattccagaagtgggctgctgtggtcgtgccgtccggagaagaacagcggtatacatgtcacgtgcagcacgaaggcctgcctgaacctctcatgctgcgttggaagcagagtagtctcccaactattccaatcatgggtatcgtggcaggcctggtggttctggccgctgtggtgaccggcgccgctgtggccgcagtgctctggaggaagaaatcatcggattag

SEQ ID NO: 43394 - DNA, 741 bp, Artificial Sequence
  Description of Artificial Sequence: Synthetic coding sequence
atggtggtgatggccccccggaccctgttcctgctgctgagcggcgctctgactctaactgaaacgtgggccgggtctcactcaatgaggtacttcagtgcggctgtatctcgaccgggtcgaggcgagcctagatttatcgcaatgggatacgtggatgacacccaattcgtgcggtttgattcggactctgcatgcccaagaatggagccacgagctccatgggtcgagcaggaagggccggaatactgggaggaggaaacaaggaacaccaaggctcatgctcagacggatagaatgaacctgcagaccctgcgagggtactacaaccagtccgaagctaatcccccgaagacccacgtgacacaccaccctgtgtttgattatgaggctaccttacgctgttgggccctcggcttttaccctgccgaaatcatcctgacatggcagcgggacggcgaggatcagacccaggacgtggagctcgtggagaccagacctgctggagatgggacctttcagaagtgggcagccgtggttgtgccttccggcgaggaacaacgctacacctgtcacgtccaacacgagggcctccccgagcctctaatgctgaggtggaagcagagttccctgccaactattcccataatgggaattgtggccgggttagtggtgcttgcagctgtggtaacaggggccgccgtagccgccgtgttatggaggaaaaagagttctgattag

SEQ ID NO: 43395 - DNA, 1017 bp, Artificial Sequence
  Description of Artificial Sequence: Synthetic coding sequence
atggtggtgatggccccccggaccctgttcctgctgctgagcggcgccctgacgctgacggagacatgggccggtagccactccatgaggtacttttctgccgctgtgtcccggcctgggagaggcgagcctcgctttatcgcaatgggatacgtggatgatactcagttcgtcagatttgatagcgattccgcctgtcctagaatggaaccgcgggctccatgggtggagcaggaaggacctgagtattgggaggaagagactaggaacaccaaggcacacgcccaaactgatcgcatgaatctgcagacactgcggggttactacaatcagagtgaggctagcagtcacacactgcagtggatgatcggttgcgatctgggcagcgatggtcggctgctgcgaggttacgaacagtacgcttacgatggaaaggactatttagccctgaatgaggaccttaggtcctggacagccgccgataccgctgcacagatttccaagcggaagtgcgaagcagcaaacgtcgcagagcagaggcgcgcgtatctagaaggtacttgtgtggaatggttgcacaggtacctggagaacggcaaagagatgctacagagggccgacccccccaagacccacgtaacccatcacccagtctttgactatgaagccacgttgcggtgctgggcgctggggttctacccagccgaaatcattctcacctggcagagagacggcgaagatcagactcaggacgtcgaactggtagagacccgtccggccggagacggtacttttcagaaatgggctgcggttgtggtgccgagcggggaggaacagcgctatacatgtcacgtgcagcacgaaggactgccagaacctttgatgttgcgttggaagcagtcttccctgcccaccattcccattatgggcatcgtggccggcctggttgttctggcagctgtcgtcaccggggccgctgtggctgcagtgctatggagaaagaagagcagcgattag

SEQ ID NO: 43396 - DNA, 465 bp, Artificial Sequence
  Description of Artificial Sequence: Synthetic coding sequence
atggtggtgatggccccccggaccctgttcctgctgctgagcggcgctctaacacttactgagacatgggcaggcagtcattccatgcgatacttcagtgcagccgtcagccgtcctgggcggggcgagcccagattcatcgctatgggctatgtggatgacacccagttcgtgcgctttgactcagattccgcatgtcctcgaatggagcctcgggcaccatgggtggagcaggaaggcccagaatattgggaagaggaaacacgaaacactaaagcacatgcccagaccgaccgcatgaatttgcaaactctcaggggatattataatcaaagcgaggcgaagcagtcctccctgcccacaattcctattatgggtatcgtagccggacttgtagtcttggcagcggtggtgaccggagccgctgtggccgccgtgctctggcgaaaaaaatcctctgactag

SEQ ID NO: 43397 - DNA, 465 bp, Artificial Sequence
  Description of Artificial Sequence: Synthetic coding sequence
atggtggtgatggccccccggaccctgttcctgctgctgagcggcgcactgacgctgactgaaacgtgggcaggaagccatagcatgcgttacttcagcgctgcagttagccgcccaggacggggcgagcccaggttcatcgcaatggggtatgtggatgatactcaattcgtcagattcgactccgattctgcctgtccacggatggagccacgggctccttgggtagaacaggaaggaccagagtattgggaggaagaaactagaaataccaaagcgcacgcccagaccgaccggatgaacttgcagacgttgcgagggtattataaccagtcagaggccaaacaatcgtcactgcctactatcccgataatgggcatcgttgcaggactcgtggtgctcgcagctgtcgttacaggcgccgctgttgccgcagtgctctggcggaaaaagtcttcggattag

SEQ ID NO: 43398 - DNA, 1017 bp, Artificial Sequence
  Description of Artificial Sequence: Synthetic coding sequence
atggtggtgatggccccccggaccctgttcctgctgctgagcggcgcacttacgctcactgaaacttgggcaggcagtcactctatgagatattttagcgcagccgtctcccgcccaggcagaggcgaacccagattcattgccatggggtatgtggacgacacacagttcgtcagattcgactccgacagtgcctgccctaggatggaacccagagcaccctgggtggaacaggagggcccagagtactgggaggaagaaactcgtaatactaaggcacatgcccaaactgacaggatgaacctgcagaccctccggggttactacaaccagagtgaagcttcttctcataccttgcagtggatgatcgggtgtgacctcggcagcgatggtaggttactgagaggttatgagcagtacgcgtacgacgggaaggattatttggctctgaacgaagatctaagaagctggacggcggccgacactgccgctcagatctccaaaagaaaatgcgaagcggccaatgtggcggagcagcggagggcctacctggaaggaacctgcgtagaatggctccatcgatacctggaaaacggaaaagaaatgctacaacgcgccgacccccctaaaacacacgtgacacaccatcccgttttcgactatgaggcaaccctgcggtgctgggccttggggttttatccagcagagatcattctgacttggcaaagggatggtgaagatcagacacaggacgttgagcttgtggagacacgacctgctggcgacggcaccttccagaaatgggctgcagtggttgtcccatctggtgaagagcagcgttatacctgccatgtccagcacgagggactcccggaaccactgatgctgcgatggaaacaaagctccttacctaccatccccatcatggggatagtggcaggtctcgtcgtgctcgccgctgttgtcacaggcgccgcagtggcagccgtactctggaggaagaaatcttcagactag

SEQ ID NO: 43399 - DNA, 1032 bp, Artificial Sequence
  Description of Artificial Sequence: Synthetic coding sequence
atgaagaccccccggatggtggtgatggccccccggaccctgttcctgctgctgtcaggagcgttgaccttgacagagacttgggctggctctcattccatgagatatttctctgccgctgtgagcaggcctggacgaggagagcctaggttcatcgctatgggctatgtggatgatacacagttcgtgaggtttgacagtgactccgcttgtccgcgcatggaaccccgcgccccctgggtggaacaagagggccctgagtactgggaagaggagacaaggaatacgaaggctcatgcacaaaccgatcgcatgaatctgcagactttgcgaggctactataaccagtcagaggcttcttcccacactctgcagtggatgattggttgtgacctgggctctgacggccgcctgctacgcggatatgaacagtatgcctatgatggcaaagactacctggctcttaacgaggatttgcgttcttggaccgccgccgacaccgccgcccagatctccaaacgaaaatgcgaggctgctaatgtggcagaacaacgaagagcctacctggagggtacttgtgtggagtggctgcaccgatatttggagaatggaaaggagatgctgcagagagctgacccgcctaagacccacgttacccaccaccccgtatttgattatgaagccacccttagatgctgggccctaggattctaccccgctgagatcattctaacctggcagagagacggcgaagatcagacacaggatgtggaactcgtggaaacaaggccagcaggcgacggaacgtttcaaaagtgggctgccgttgtcgtaccaagcggtgaagagcaacgctacacctgccacgtgcagcatgaaggactgcccgaaccactgatgcttcgttggaagcagagcagcttacccaccattccaattatgggcatagtcgcgggcctggttgtcctggccgccgtcgtgaccggcgccgcagtggctgccgtgctgtggcgcaaaaaaagttccgactag

SEQ ID NO: 43400 - DNA, 741 bp, Artificial Sequence
  Description of Artificial Sequence: Synthetic coding sequence
atggtggtgatggccccccggaccctgttcctgctgctgagcggcgccttgacccttaccgagacctgggccggttcgcactctatgcgttatttctccgcagccgtctctcgccccgggagaggcgagccaagattcatagcaatgggatatgttgacgacacccaatttgtgcggtttgactccgacagcgcatgcccaaggatggaaccccgcgctccctgggtggagcaggaagggccagaatattgggaggaagaaacacgaaacacaaaggcacacgcccaaaccgatcgcatgaacctccagactctgcgcggatattataatcagagcgaagccaacccccccaaaactcacgtgacgcatcaccccgtgtttgactatgaggccacccttcggtgttgggccttaggattctaccctgcagagattatactgacttggcaacgcgacggggaagatcagacacaggacgtagagctggtggaaacacgccccgctggcgatggcacttttcagaaatgggcggcggtcgtggtaccctcgggagaggaacagaggtacacttgtcatgtgcagcacgagggtttgcccgaacctcttatgctgcggtggaagcagagcagccttccgacaattcccataatggggatcgtggccggtttagtcgttctggctgccgtggttaccggtgccgctgtagcagcagttctctggcgcaagaaatcgtccgattag

SEQ ID NO: 43401 - DNA, 741 bp, Artificial Sequence
  Description of Artificial Sequence: Synthetic coding sequence
atggtggtgatggccccccggaccctgttcctgctgctgagcggcgctctgacactgaccgagacatgggcgggcagccatagcatgcgatacttcagcgcggctgtgagtaggcctggcaggggggagcccagattcatcgccatgggttatgttgacgatactcagtttgtacgttttgactccgacagcgcgtgcccgagaatggaacctcgagccccatgggtggagcaggagggccctgaatattgggaggaggagaccaggaatacaaaagctcacgcacagactgaccgcatgaacctgcagactctacgcggttattacaatcagtctgaggcaaacccacctaaaacccatgttacccatcatccagttttcgactacgaggccaccctgcgatgctgggcactcggcttttacccagcagaaatcatcctgacgtggcagcgagacggcgaagaccagacccaggatgttgagttggtggagacccgccccgccggggacggcacgtttcagaagtgggcggctgtagtggtgccctcaggagaagagcaacgctacacatgccatgtgcaacatgagggcctgcccgaaccactcatgctgcgatggaaacagtccagtctacccaccattcctatcatgggcattgtagccgggctggtggtgctggcggccgtcgtcactggagcagccgtagccgcagtgctttggcggaaaaaatcctcagactag

SEQ ID NO: 43402 - DNA, 465 bp, Artificial Sequence
  Description of Artificial Sequence: Synthetic coding sequence
atggtggtgatggccccccggaccctgttcctgctgctgagcggcgccctcaccttaactgaaacctgggcaggatcacattccatgcgctatttcagcgctgccgtttctcggccggggagaggcgagccacgatttatcgccatgggatatgtggacgacacacagttcgtccgcttcgactctgactcggcttgccctcgaatggagccaagggcaccatgggtggagcaggagggacccgagtactgggaagaagagacaagaaataccaaggcacacgctcagaccgacagaatgaacttgcaaactttaagaggttactataatcagtcagaggcaaagcaaagttctctacctaccatcccaatcatgggcatagtagccggtctcgtagtgttggccgccgtcgtgactggagccgcagtggccgccgtcctctggcggaagaaatcgagcgactag

SEQ ID NO: 43403 - DNA, 741 bp, Artificial Sequence
  Description of Artificial Sequence: Synthetic coding sequence
atggtggtgatggccccccggaccctgttcctgctgctgagcggcgctctgaccttaactgagacctgggctggctcccacagtatgagatacttctccgcagcagtctccagaccagggagaggcgagcctcggttcatcgccatgggatacgtggatgatacccagttcgtcaggtttgactcagactctgcttgcccaagaatggagcctcgggctccctgggtggaacaggaaggaccggagtattgggaagaagagacccggaacacaaaggcccatgcccagaccgatcgcatgaacttgcaaaccttacggggctattacaaccagtctgaggccaatccacctaaaacacacgtcacgcaccacccggtttttgattacgaggccactctgaggtgttgggcgctcggcttttatcccgctgagataattttgacgtggcagagggacggagaggatcaaactcaggacgtggagctggtcgagacaaggcccgccggtgatggaacatttcagaagtgggcagctgtcgtggtgccatccggtgaggaacaacgatatacctgtcatgttcaacacgagggcttacccgagccccttatgcttagatggaagcagtcttccctgccgacaatcccaataatggggattgtcgccgggttggtggttttggccgcagtcgtaacgggcgcagccgtggctgccgtcttgtggagaaagaagtcatcagactag

SEQ ID NO: 43404 - DNA, 741 bp, Artificial Sequence
  Description of Artificial Sequence: Synthetic coding sequence
atggtggtgatggccccccggaccctgttcctgctgctgagcggcgcgctcactctaaccgagacatgggctgggagtcacagtatgcgttacttttctgcggcagtctcacggccaggaaggggagaaccccgcttcatcgccatggggtatgtggatgacactcagttcgtgcgctttgacagtgacagtgcatgcccccgcatggagccccgagccccctgggtagagcaggaggggccagagtactgggaggaggagacccgcaataccaaggcccacgctcagaccgatcggatgaatttacagaccctgaggggctactacaaccaatcagaagcaaatcctccaaaaacgcatgttacccatcatcctgtgtttgactatgaagcaacactgagatgttgggccctgggtttttatcctgcagaaattattcttacctggcagcgggatggagaggaccagacccaggatgtcgaactggtagagacgaggcccgccggagatgggactttccagaagtgggccgccgtggtggtgcccagtggtgaggagcagagatacacgtgtcatgtgcagcacgagggactgccagagccactgatgctgcggtggaagcagtccagcttgcctactattcccataatgggtatagttgcaggactcgtggtacttgccgccgtcgtgaccggcgccgcggtagcggcagtcttatggcggaaaaaatctagtgactag

SEQ ID NO: 43405 - DNA, 741 bp, Artificial Sequence
  Description of Artificial Sequence: Synthetic coding sequence
atggtggtgatggccccccggaccctgttcctgctgctgagcggcgccctgacgctcacggagacttgggccggctcccactccatgcgttacttctcagcggccgtgagcaggcctggccgaggagagcctaggttcattgcaatggggtatgtggacgacacccaatttgtacggtttgattccgattccgcttgtccaaggatggagcctcgcgccccatgggtggagcaggaaggtcccgagtattgggaggaagagacccgcaataccaaggcgcatgcccagacagatcgcatgaatctgcagacgctaaggggttattacaaccagtctgaggccaacccacctaagacccatgttacacaccacccagtattcgactacgaagcaaccttgcggtgctgggcattaggtttttaccctgctgagatcattttaacctggcagagggacggtgaagaccagactcaagatgtggaactggtggagacaagacccgccggtgatggaaccttccagaaatgggctgcagtggtggtgccctctggagaagagcagaggtatacctgccatgtccaacacgaaggactgcccgagcctctgatgttgaggtggaagcagagctccttgcccaccattccaatcatggggatcgtcgctggcctagttgtcctcgccgctgtggtcaccggagcagcagtggccgccgtactgtggcggaaaaagagttcagactag

SEQ ID NO: 43406 - DNA, 741 bp, Artificial Sequence
  Description of Artificial Sequence: Synthetic coding sequence
atggtggtgatggccccccggaccctgttcctgctgctgagcggcgcattgactctgaccgaaacttgggccggttcccattccatgcggtatttttccgcagctgtgtctcggcctggacgcggggagcctcgcttcatcgccatggggtacgtcgacgatacccagtttgtccgcttcgattccgactcggcctgcccccgcatggaaccgagggccccgtgggtagagcaggagggtcccgagtattgggaggaggagactcgaaatacaaaagcccatgcacagactgaccgcatgaacttgcagactcttagaggctactacaaccaatccgaggcaaacccaccaaagacccacgttacacaccatcctgtcttcgattatgaagcaacccttagatgctgggctttaggattctaccccgccgaaatcatactgacatggcagagggacggcgaggaccaaacccaagacgtggagctggtggaaacaaggcccgctggagacggtacgtttcagaagtgggccgccgttgtggtcccatccggagaggaacagaggtacacttgccatgtgcagcacgaaggtctccctgagcctctgatgctccggtggaagcagtcgtctctcccaactattcctattatgggcattgtcgccggcctggtcgtgctcgcggccgttgttaccggtgcagctgtcgcagcagttctgtggcggaagaagagttccgattag

SEQ ID NO: 43407 - DNA, 741 bp, Artificial Sequence
  Description of Artificial Sequence: Synthetic coding sequence
atggtggtgatggccccccggaccctgttcctgctgctgagcggcgcactgacgctcacagagacttgggccggcagccactcaatgcggtacttctccgccgccgtgagtcgccccggccggggagaaccgcgattcatcgcgatggggtatgttgacgatacccagttcgtgaggttcgattccgattcggcatgcccccggatggaaccaagagccccatgggtagaacaggaaggccctgagtactgggaggaagagacaagaaataccaaggcccacgcgcagacagaccgaatgaacctacagactctgcgcggctattataatcagagcgaggccaatcctcctaagacccatgtgacccatcatcctgtgttcgattatgaggccacattacggtgctgggccttggggttttacccagccgagattattctgacttggcagcgcgatggagaagaccagacgcaggacgtggagctggttgaaacaaggcctgcaggcgacggaacgtttcagaagtgggctgccgttgtcgtccccagcggtgaggaacaaagatatacctgtcacgttcagcacgaggggctaccagagcccttaatgctccgctggaaacagtctagcctaccaaccatccccattatgggcatcgtcgctggacttgtggtgttggcagcagtcgtgacaggtgccgctgtcgccgctgtactctggcggaagaaatctagtgactag

SEQ ID NO: 43408 - DNA, 741 bp, Artificial Sequence
  Description of Artificial Sequence: Synthetic coding sequence
atggtggtgatggccccccggaccctgttcctgctgctgagcggcgccctaacactgacagagacttgggctggcagtcacagcatgcggtattttagcgccgccgtgagccggcctgggagaggagaacccagatttatcgcaatgggatatgtcgatgatacccagttcgtgaggttcgattcggactctgcctgtcccaggatggaaccacgagcaccctgggtggagcaggagggccctgagtactgggaagaagaaactcgcaacaccaaagctcatgctcagacagatcggatgaacctccagactcttcgcggttactacaaccagagtgaagccaatccgcctaagacccatgtgactcatcaccctgtgttcgattatgaggcaactctgcggtgttgggctctgggcttctatcccgcagagatcatcctgacctggcagagagatggtgaagaccagactcaggacgtagaactggtcgaaactagaccagcgggcgacggcaccttccagaagtgggccgccgtagtggtaccgagcggagaagagcagcggtacacctgtcacgtgcagcatgaggggttgcctgagcctttgatgcttcggtggaaacagagttccctgccaaccatccctataatgggaattgtggccggactggtggtcctcgccgccgttgttactggtgctgcagtcgcagcagtgctgtggcgaaagaaaagctccgactag

SEQ ID NO: 43409 - DNA, 1017 bp, Artificial Sequence
  Description of Artificial Sequence: Synthetic coding sequence
atggtggtgatggccccccggaccctgttcctgctgctgagcggcgccctgacactgaccgaaacatgggctggctctcactccatgcggtattttagtgccgccgttagccgtccaggacggggcgagccacgatttattgccatgggatacgttgacgacacccagttcgtgaggtttgactcagactctgcatgcccgaggatggaacctcgggccccttgggtcgaacaagaaggtccagaatactgggaggaggaaactcgcaacacgaaagcacacgcacagacagaccggatgaatctgcaaaccctccggggctattataaccagtccgaggcatctagccacactctccaatggatgataggctgtgacctggggtctgatggccggcttctgcgcgggtacgagcagtacgcgtacgacggtaaagattatctggcgctgaatgaggatttgagaagttggactgccgcagacaccgctgcacagatatccaaaaggaaatgcgaagccgccaacgtagccgagcagaggagagcctaccttgagggaacatgtgtcgaatggctgcatcggtatctagaaaacggaaaagaaatgctccagcgggccgatccaccaaagacccacgtgacacatcaccctgtgtttgattacgaggccacactacggtgctgggctctaggcttttatccagctgaaattatcctgacctggcagagggacggggaggatcagactcaagacgtggagttagtcgagacccggccagcaggcgatggcacattccagaaatgggccgctgtcgtcgttccttctggcgaggaacagcggtatacctgtcacgttcagcatgaaggactgccagagcccctgatgctgagatggaagcagagttccctacccacaattcccataatggggattgttgctgggctggtggtccttgccgcggtggtgacgggcgcagccgttgcggccgtcctgtggaggaaaaagtccagcgattag

SEQ ID NO: 43410 - DNA, 1017 bp, Artificial Sequence
  Description of Artificial Sequence: Synthetic coding sequence
atggtggtgatggccccccggaccctgttcctgctgctgagcggcgccctcacactgacagagacttgggccggctcacactccatgaggtatttcagcgccgcggtgtctagacctggccgcggggagccaagatttatcgcaatggggtatgtcgatgatacgcaatttgtccgtttcgactctgattcagcttgtccgcggatggaacctcgggctccctgggtggagcaggaagggcctgaatactgggaggaggagacaaggaacaccaaagcacacgcccagaccgacagaatgaatctgcagaccctccggggatattacaaccagtccgaagctagttctcataccctgcaatggatgataggctgtgatctgggtagcgacggaagactgctgaggggatacgagcagtacgcctacgatggcaaggattaccttgctctgaatgaggacctgcgctcatggacagcagccgatacggctgcccagatcagcaaaaggaagtgcgaggctgcgaacgttgctgaacagcgtcgcgcttacctggaggggacctgcgtggagtggctgcaccgatatctggagaacggaaaagaaatgcttcagagggctgacccgcctaaaacccatgttacgcaccacccagtcttcgattacgaagccacactgcgctgctgggcactgggattctaccccgccgagattatcctcacttggcaaagggatggagaagaccagacacaggacgtggaactcgtcgagaccagaccagcgggggatggtacctttcaaaaatgggcagctgtggtggtgcccagtggggaagaacaacgatatacctgtcacgtccagcatgaagggcttccagagcctctgatgctaaggtggaaacaaagctccctacctaccataccgatcatgggcattgttgcagggctggtggtgctggccgccgtggtgactggggccgcagttgccgcagtgctgtggaggaaaaagagttccgattag

SEQ ID NO: 43411 - DNA, 1017 bp, Artificial Sequence
  Description of Artificial Sequence: Synthetic coding sequence
atggtggtgatggccccccggaccctgttcctgctgctgagcggcgccctgactctgaccgaaacctgggccgggtcccactccatgcgctacttctcagccgcagtctccagacccgggaggggtgaacctagattcatagcaatgggttacgtcgatgacacccagtttgtccgttttgatagcgacagcgcttgcccccgcatggagccccgtgccccgtgggttgagcaagaaggaccagagtactgggaggaagagacaagaaacacaaaggcccatgcccagactgaccgaatgaacctgcagacgctacgggggtattacaaccaaagcgaagcctcaagtcatactctgcagtggatgatcggatgtgatttgggaagcgacggcagactcctgcgcggctatgaacaatatgcttacgatggcaaagattatctggcactgaatgaggatttaagaagttggacagccgccgatactgctgctcagatctccaaaagaaaatgcgaggcggcaaacgtggccgagcagcgcagggcttatctagagggcacctgtgttgagtggctgcacaggtatttggagaacggaaaggaaatgctgcagcgggccgaccctcctaaaacccatgtaacgcaccatccagtgtttgattacgaggctaccttaagatgttgggcccttggattttatcccgcggagataatcctgacgtggcagcgagacggtgaggaccaaacccaggacgtcgagctggtagagaccaggccagccggcgacggtaccttccagaagtgggcagctgtggtggtaccttctggcgaagaacagaggtacacgtgccatgtgcagcacgaggggctgccagagccgctcatgttgcgatggaagcagtccagcctgcccaccatccccatcatgggtattgtcgcaggtctagtagtgcttgccgcagtggtgaccggcgcagctgtggcagccgtcctttggcgtaagaagtcaagcgattag

SEQ ID NO: 43412 - DNA, 1017 bp, Artificial Sequence
  Description of Artificial Sequence: Synthetic coding sequence
atggtggtgatggccccccggaccctgttcctgctgctgagcggcgcacttactctgacggaaacctgggcagggtctcattcaatgcggtattttagcgcggccgtctcacggcctgggaggggcgagcccaggttcattgccatggggtatgtcgacgacacacagtttgtgcgtttcgacagtgactcggcgtgtcctaggatggagcctagggcaccctgggtagaacaagaggggcctgaatactgggaagaggaaacgaggaacactaaagctcacgctcagactgacaggatgaacctgcagaccctgaggggctactacaatcagtcagaggccagctctcatacactacaatggatgattggttgtgacctgggcagcgacggccggttgctgcggggctacgaacaatacgcctacgacggcaaagattatttagccttgaatgaagacctgcgatcatggaccgccgcagacactgctgcacagatcagcaagcgaaaatgtgaggctgcaaatgtggcagagcaacggcgagcctatctggaagggacgtgcgtcgagtggctccacagatacctcgaaaatggaaaggagatgctccaacgcgccgacccgcctaagacccacgtgacccatcaccccgtattcgattatgaggcaaccctaaggtgctgggccctggggttttaccctgcggaaataattctcacctggcagcgcgacggagaggaccagacccaggacgtcgaattagtcgagaccaggccggccggagacgggacattccagaaatgggcggccgttgtagtgcccagcggagaggaacaacggtacacatgccacgtccagcatgagggtctcccagagccactgatgttacgctggaagcagagctccctgcccaccatccccattatgggtattgtggcaggcttagtggttctggctgccgttgtcactggtgctgccgtggctgccgtgctctggagaaaaaaatcgagtgattag

SEQ ID NO: 43413 - DNA, 1017 bp, Artificial Sequence
  Description of Artificial Sequence: Synthetic coding sequence
atggtggtgatggccccccggaccctgttcctgctgctgagcggcgcccttaccttaactgaaacctgggctgggagccactccatgcgttattttagcgcagctgtatctagaccaggccgtggcgaaccccggttcattgcaatgggttatgtcgatgacactcaattcgtgcgttttgacagtgactctgcatgcccacgcatggagccgcgtgctccctgggtggagcaggaggggcccgagtattgggaggaagagacccgtaacaccaaggcgcatgcgcagacagaccgcatgaaccttcagaccttgcgaggatactataatcagagtgaagcctcaagtcacaccctgcagtggatgatcggatgcgacctcggatcagatggtcgcctgttgcgtgggtacgaacagtatgcatacgacgggaaagattacttggcccttaacgaagacctcagatcttggactgctgcggacactgcagcccaaatatcgaagcgaaagtgtgaagccgcaaacgtggccgagcaaaggagagcttatctggagggaacttgcgttgagtggttacacaggtacctcgagaatggcaaagagatgctacaaagagcagatcccccgaagacccatgtcacccaccatccagtctttgactatgaggccactctgaggtgttgggccctggggttttatccggccgaaataattctgacctggcagagagacggtgaggaccaaacccaggatgtcgaactagtcgaaacacgtcccgccggcgatggcacgttccagaaatgggcagctgtggtcgttccctccggggaagagcaaagatacacatgccatgtgcagcacgaagggctgcctgaacccctcatgctccgatggaagcagtcaagcctgcctacgataccaattatgggaatcgtggccgggttggttgtcctggcagcagtagtcaccggcgccgcagtggccgctgtactgtggagaaagaagagctccgattag

SEQ ID NO: 43414 - DNA, 1017 bp, Artificial Sequence
  Description of Artificial Sequence: Synthetic coding sequence
atggtggtgatggccccccggaccctgttcctgctgctgagcggcgctctgacactgaccgaaacctgggcaggcagtcattctatgcgctacttttctgccgctgttagcaggccagggcgaggcgagcccagattcatcgccatggggtacgttgatgatactcagttcgttcggtttgactccgatagcgcatgtccccgaatggagccccgggcaccctgggtggaacaggagggacccgaatactgggaggaggaaacgagaaacacaaaggcccacgcccaaactgatcggatgaatcttcagaccctccggggctactataatcagtcagaagcttctagtcacacactgcagtggatgattgggtgcgatttgggaagtgatggacggctcctgagaggatatgaacagtacgcctatgatggcaaagactaccttgctctgaatgaggatctgcgctcatggactgcagcagatacagccgctcagatcagcaaacgcaaatgcgaggccgcgaatgtcgctgaacaaagacgagcctacctggagggaacttgtgtagagtggctgcatcgatacctggagaatggtaaggaaatgctccagcgggccgatcctccaaaaacacatgtcacacaccatccagtgtttgattatgaggccacactgcgctgctgggctctgggcttttatccagccgaaattattctcacttggcagagggatggtgaagaccaaacgcaggatgttgagctggtggaaacgcggcccgctggtgatggtacattccagaaatgggctgctgtcgtcgtgccaagcggtgaggagcaacgctatacctgtcatgtccaacacgagggcctccctgagccgctgatgttgcgctggaaacagtcctccctgccaactatcccgattatggggatcgtggctggtttggtggtgctggctgcggtcgtaacgggcgccgctgtcgctgccgtactgtggcgtaagaaaagtagcgattag

SEQ ID NO: 43415 - DNA, 372 bp, Artificial Sequence
  Description of Artificial Sequence: Synthetic coding sequence
atgggccacgagcagatgctgcccctgctgtggctgctgccccacagttgggccgtgcccgaggctccgaccccaatgtggcctgacgacttgcagaaccacacattcttgcacaccgtctactgccaggacggctctccgtctgtcggtctcagtgaggcctacgacgaagatcagttattcttttttgatttttcccagaacacccgggttccacggctgcccgagtttgccgattgggctcaggagcagggggatgcaccggctatcctgttcgataaagaattctgcgagtggatgatccagcaaattgggccaaaattggacggcaagattcccgtgtcaagaggtcaggaattctctggagaatag

SEQ ID NO: 43416 - DNA, 786 bp, Artificial Sequence
  Description of Artificial Sequence: Synthetic coding sequence
atgggccacgagcagaaccagggcgccgccctgctgcagatgctgcccctgctttggttgctgcctcatagttgggccgtcccagaagcgccaacccccatgtggcccgacgacttgcagaatcacacattcctgcacacagtatactgccaagatgggagcccttctgtgggcctctcggaggcatacgatgaagaccaactgttcttcttcgatttcagccagaatacaagagtgcccaggctgcccgaattcgctgattgggctcaggaacaaggagatgcaccagcaatcttgttcgataaggagttttgcgaatggatgatccagcagatcggacccaagctggacggaaagataccagtttcccggggtttcccaatcgcagaggtgttcaccctgaaaccacttgagttcgggaagccaaacaccctcgtgtgcttcgtgtctaacctgttccctcccatgctcaccgttaactggcaacatcacagtgtgcctgtggagggctttggtcctacttttgtgtcagctgtggatggactgagctttcaggctttttcttatcttaacttcacccccgagcctagcgacattttttcctgtatagtcacccacgagatcgatcggtatacggctattgcctattgggtaccccggaatgctctgccatccgacttgcttgaaaatgtgctgtgtggagtcgcctttggtctgggggttttgggtattatcgtcggaatagtgcttattatttacttccggaaaccctgctcgggggattag

SEQ ID NO: 43417 - DNA, 684 bp, Artificial Sequence
  Description of Artificial Sequence: Synthetic coding sequence
atgggccacgagcagaaccagggcgccgccctgctgcagatgctgccactgctttggcttctcccccactcctgggccgtgcccgaggcccccacccccatgtggcctgacgacctccagaaccatacctttttgcatactgtgtattgccaagacggatccccctcagttggccttagtgaggcgtatgatgaagaccaactgttctttttcgatttctctcagaacacccgcgttcctcgactcccagaatttgccgactgggctcaggagcagggtgacgcgcccgctatattgtttgataaagaattttgcgaatggatgatacaacaaattggcccaaagctggatggcaaaatacctgtatccagggtcaattggcaacaccattctgtccccgtggaagggtttgggcccacatttgtgtcagccgtcgacggtctgtcgtttcaggccttctcctatctcaatttcacccctgaaccctccgatatattctcctgcattgttacacacgagattgacaggtatactgccatcgcttattgggtcccaagaaatgctttgcccagcgatttgttggaaaacgttctgtgcggcgtggcgttcggactgggggtattaggcattatcgtcgggattgtcctgatcatctactttcggaagccctgcagcggggattag

SEQ ID NO: 43418 - DNA, 501 bp, Artificial Sequence
  Description of Artificial Sequence: Synthetic coding sequence
atgggccacgagcagaaccagggcgccgccctgctgcagatgctgcctcttctgtggctgctgcctcacagttgggccgtccccgagggctttcctattgcggaagtgttcactctcaaaccacttgaattcgggaaaccaaacactctcgtgtgtttcgtgtcaaatctctttccgcccatgctgacagtcaattggcagcaccatagtgttcctgtcgaagggttcggccccacttttgtgagcgctgttgacggcctgagcttccaagcattctcctatctgaacttcactccggaaccttccgacatcttcagctgcattgtgacacacgaaattgacagatatactgcgattgcctactgggttccgcgcaacgccctccctagtgacctcctggaaaacgttctgtgcggtgttgcattcggcttaggcgtgctcgggatcattgtcggtattgtgctgattatttactttcggaagccgtgcagcggtgactag

SEQ ID NO: 43419 - DNA, 786 bp, Artificial Sequence
  Description of Artificial Sequence: Synthetic coding sequence
atgggccacgagcagaaccagggcgccgccctgctgcagatgctgcccctcctgtggctcctaccccacagctgggctgttccagaggcccccacccctatgtggcccgacgacctccagaatcatacatttctccacactgtgtactgtcaggatgggagtccctccgtgggcctttccgaagcttacgacgaagatcagttgttctttttcgattttagccagaacactcgagtgcctcgattacctgaattcgcagactgggctcaggaacagggcgacgcaccagcaatcctttttgacaaagaattttgcgagtggatgatccagcagattggtcctaaactcgatggaaagattcccgtgagtcgagggttccctattgcggaggtgtttacgctcaaacccttagagttcggcaagcccaataccctggtgtgttttgtgtcaaatttgtttccacccatgcttaccgttaattggcagcaccattctgtacccgtagagggcttcggaccgacgtttgtgtctgctgtagatggactgtcttttcaggctttttcctatctgaactttacccctgagccttccgatatttttagctgtatcgttacgcatgagatcgaccgttacaccgccatagcatattgggtccctcgcaatgcattgcccagcgatctgctggagaacgtgctctgtggtgttgcatttgggctcggggttctgggtattatcgttgggatagtgctcattatttactttcgaaaaccctgctccggcgattag

SEQ ID NO: 43420 - DNA, 684 bp, Artificial Sequence
  Description of Artificial Sequence: Synthetic coding sequence
atgggccacgagcagaaccagggcgccgccctgctgcagatgctgccccttctctggctccttccacacagttgggccgtccctgaagcacccactcccatgtggccagacgatctacagaaccacactttcctgcatactgtgtattgccaggatggatcccccagcgtggggctgtcggaggcatatgacgaagatcaactctttttcttcgacttttcacagaatactagagtgccaagactccctgagttcgctgactgggcccaggagcagggagacgcgcccgccatcctctttgacaaggagttttgcgagtggatgatccagcaaatcgggcctaaactcgacggaaagatcccagtcagcagggtgaattggcagcatcactctgttccagtcgagggatttgggccaaccttcgtgagtgccgtcgacggtttaagcttccaggcattctcttacctgaacttcactcctgagccctccgacattttcagctgcatcgtgacccatgaaatcgaccgttacactgccatcgcatactgggtgcccaggaatgccctccctagtgacttgctggagaatgtgctgtgtggcgtcgctttcgggctgggggtgctgggcatcatcgtgggaatcgtgctgataatctactttcgcaagccatgttccggcgactag

SEQ ID NO: 43421 - DNA, 501 bp, Artificial Sequence
  Description of Artificial Sequence: Synthetic coding sequence
atgggccacgagcagaaccagggcgccgccctgctgcagatgctgcctcttctgtggttgctccctcacagctgggccgtgcccgaaggcttcccaatcgcagaagtattcaccttaaagccgttagagtttggcaaacctaatactttggtctgcttcgtgagcaatctgttcccccccatgttgacagttaactggcagcatcattccgtccctgtggaggggttcggcccgaccttcgtctctgctgtcgacggtctgtcctttcaggcctttagttatttgaacttcacgcccgagcctagcgacatcttctcctgtattgtgacccatgagatcgataggtatacagcaattgcttactgggtacctcgcaacgcccttccctctgacctccttgagaacgtgctttgcggagtagcttttggattgggagttctcggtatcatcgtgggaatcgtccttatcatctattttcgcaaaccttgctctggcgactag

SEQ ID NO: 43422 - DNA, 726 bp, Artificial Sequence
  Description of Artificial Sequence: Synthetic coding sequence
atgaagtggctgaagaagtgcctggacaccgcccccacccccatgtggcctgacgacctgcagaatcacacttttctgcacactgtgtactgtcaagatgggagccccagtgttgggttgtctgaagcttatgacgaagatcagctgtttttctttgacttctcccagaacactagggtgccacgtctgccagaattcgcagactgggcgcaggaacagggcgatgctccagctattctgttcgataaagagttttgtgaatggatgattcaacagattggccctaaactcgatgggaaaattcctgtgagtagaggctttcccatagcagaagtgttcaccctgaagcccctagagtttgggaagcccaacacgctagtgtgttttgtgtccaacttgtttcccccaatgctcacagtgaattggcaacaccacagtgttccagtagagggattcggccctacttttgtctctgcagtcgatggactatccttccaggcattcagctacctaaattttacccctgagccatctgacatcttctcttgcatcgtcacccacgaaatcgatcgttacaccgcaatcgcctactgggtgccacgcaacgccttgccttcagacctgctggagaatgtgctctgcggcgttgcgtttggcctgggagtgctgggaattatcgtcggcatcgtcctcatcatctactttagaaaaccatgtagcggctag

SEQ ID NO: 43423 - DNA, 510 bp, Artificial Sequence
  Description of Artificial Sequence: Synthetic coding sequence
atgtggcccgacgacctgcagaaccacaccttcctgcacaccgtgtactgtcaggacggcagtcccagtgtaggtttgagtgaggcttacgatgaggatcagctgtttttttttgacttctctcagaatacgcgggtgcctcgcctgcctgagtttgccgattgggcccaggaacaaggagacgcaccagctatattattcgacaaggagttctgcgagtggatgatacagcagattggccccaagcttgatggaaaaatacctgtgagcaggggattccccatagcagaggtattcaccctgaaaccccttgagttcggcaagccaaatacactcgtatgttttgtgagtaatctgttccctccaatgctcactgtaaattggcagcaccattctgtgccagtcgagggtttcggccctacatttgtctcggcagttgacggcctctcctttcaggccttctcgtacctgaactttacacccgaacccagcgacattttttcatgctag

SEQ ID NO: 43424 - DNA, 873 bp, Artificial Sequence
  Description of Artificial Sequence: Synthetic coding sequence
gtgagctgctggctgagcgacagctgccaggagctgcagcggcgggggataatcctttgtagctacggggtcacaagccccatcgccgtattcggacgccccggccgcctgaggaatcgtagacactttgagcgccgactggtccccatgaagtggctgaagaagtgtctggacactgcacctacgcccatgtggccagacgatctgcagaatcacacctttctgcataccgtgtattgtcaggacgggagtccgtcagtgggcctgagtgaggcttacgatgaggaccagttgtttttttttgatttctcccagaacacacgggtcccccggttaccagaattcgcagattgggcccaggagcaaggcgacgccccggccatcctgtttgataaagaattttgcgagtggatgatccaacagatcggtcctaaactcgatgggaaaatccctgtcagtagaggtttccctatcgccgaagtcttcacgctgaaacccctggaatttggtaaaccaaatacacttgtgtgttttgtgtctaacttgttcccccctatgttaactgttaactggcagcatcactctgtgcccgtcgagggattcggaccgacctttgtttcagcggtggacggccttagcttccaagccttcagttatttgaattttactcccgaaccttctgacatcttctcctgtatcgtcacacacgaaattgacaggtacacagccattgcctactgggtgccacggaacgcgctcccaagcgacctgctcgaaaacgtattgtgtggagtggcttttggactcggagttttaggtataattgtgggaatcgtattgatcatatacttccgtaagccctgctccggctag

SEQ ID NO: 43425 - DNA, 510 bp, Artificial Sequence
  Description of Artificial Sequence: Synthetic coding sequence
atgtggcccgacgacctgcagaaccacaccttcctgcacaccgtgtactgtcaggacggcagccccagcgtgggtttaagcgaggcatacgatgaagatcagctctttttctttgatttcagccagaatacccgggttccaagacttcccgagtttgcagactgggctcaggaacagggcgacgccccagccatcttattcgataaagaattttgcgagtggatgatccagcagataggcccaaagttagacggtaaaatcccagtgtcccggggttttccaatcgcagaggttttcacactgaaacctctcgagtttggtaagcccaatacactcgtgtgctttgtgtctaacctgttcccccctatgctgacggtgaactggcagcaccatagcgtgcccgtggagggcttcggaccaacgtttgtgagtgctgtggatggcctgtcatttcaggccttctcatacctgaattttacaccagagccatccgacattttctcttgctag

SEQ ID NO: 43426 - DNA, 684 bp, Artificial Sequence
  Description of Artificial Sequence: Synthetic coding sequence
atgggccacgagcagaaccagggcgccgccctgctgcagatgctgcccctcctctggcttctcccccactcttgggccgttcccgaagcccccactccaatgtggcccgacgatctgcagaatcacacctttctccatactgtctactgccaagatggttcgccatcagtggggctgtcggaagcttatgacgaagaccagctcttcttctttgacttctcgcagaacacaagagtaccgcgcctgccagagttcgcggactgggcccaggagcagggagacgctccggctatactgttcgacaaggagttttgtgagtggatgattcagcaaatcggccccaagctggatggtaaaatacccgtcagccgggttaattggcagcaccactcagtgcccgtggaaggttttggccccactttcgtctccgcagtcgacggcctgtcttttcaggcattctcctatttaaatttcacccccgaaccttccgacatcttttcatgcatcgtgacgcacgagattgatcgttacacggctattgcatactgggtgccacggaacgctttacctagcgacttactggagaatgtgctttgtggcgtcgcctttgggttgggggtgctcggaatcatcgtcggaatagtgcttataatttactttaggaaaccttgctcgggcgactag

SEQ ID NO: 43427 - DNA, 510 bp, Artificial Sequence
  Description of Artificial Sequence: Synthetic coding sequence
atgtggcccgacgacctgcagaaccacaccttcctgcacaccgtgtactgccaggacggatccccatcagttggcctcagcgaagcatatgacgaagatcagttgttcttttttgatttttcccagaacaccagggtccccagactccccgagtttgcagattgggctcaggagcagggcgacgctcccgctatcctgttcgataaagagttttgcgagtggatgatccaacagattggccctaagctggatggtaaaattcccgtcagcaggggctttcctattgccgaagtgtttacattaaaacccttggagttcggcaagcccaacaccctggtctgttttgtgagtaacctctttcctcccatgttaactgtgaactggcaacaccacagtgtccctgtggaggggtttggaccgacattcgtttcagccgtggatggactatcctttcaggccttttcctacctgaatttcacccctgagccctccgacatcttctcctgttag

SEQ ID NO: 43428 - DNA, 501 bp, Artificial Sequence
  Description of Artificial Sequence: Synthetic coding sequence
atgggccacgagcagaaccagggcgccgccctgctgcagatgctgccattgctgtggttgttacctcattcatgggccgtgccggagggattccctattgcagaggtatttaccctaaagcctctggaattcggaaagccaaataccctggtgtgttttgtatctaatctttttccacctatgctaacggtcaactggcagcatcatagtgtgccggtagagggctttgggcctacatttgtctctgctgttgatggcctgtcctttcaggcattttcatacctgaatttcacacccgaaccatctgatatcttcagttgtatcgtgactcatgagatcgaccgatacacagctatcgcttactgggttcctcgaaatgccctaccctcagatctgctcgaaaacgtgttgtgcggtgtggctttcggactcggagtgctaggcattatcgtcggcatcgtgcttattatctattttcgcaaaccgtgcagcggagattag

SEQ ID NO: 43429 - DNA, 684 bp, Artificial Sequence
  Description of Artificial Sequence: Synthetic coding sequence
atgggccacgagcagaaccagggcgccgccctgctgcagatgctgcccctcctctggttgttgccacattcatgggcagtgcctgaggcgccaacaccaatgtggcctgacgacttgcaaaaccatacttttctgcatacagtgtactgtcaggacggatcaccaagcgtggggctctcagaagcttatgatgaggatcagctcttcttcttcgatttcagccagaatacgcgggtgcctaggcttccagaatttgccgattgggcccaagagcaaggggacgcacccgcgatcttgtttgacaaagaattttgtgaatggatgatccagcagatcggccccaaactggatggtaaaattcccgtgtcccgggttaattggcaacaccacagcatccccgtcgaggggtttggccccacatttgttagtgccgttgacggcctctccttccaggcctttagctatctgaactttacccccgaacccagtgatatcttctcgtgcattgtcacacacgaaatcgacagatacaccgccatcgcctactgggtccctcgaaatgccctgccgtctgatctcctcgaaaatgtcctgtgtggcgtggctttcggactcggcgtgctaggcatcatcgtaggcattgtgctgatcatatactttagaaagccatgctctggtgactag

SEQ ID NO: 43430 - DNA, 873 bp, Artificial Sequence
  Description of Artificial Sequence: Synthetic coding sequence
gtgagctgctggctgagcgacagctgccaggagctgcagcggcggggcatcattttgtgctcgtatggcgtgacctccccgattgcagtgtttggtcgaccaggccgtcttcgcaataggcgacacttcgagagacggctggttccgatgaagtggttgaagaaatgcttggacacagctcctactcctatgtggccggacgacctgcaaaatcacactttcttacacaccgtgtattgtcaggacggcagtccgagtgtaggcctgtcggaagcctatgatgaggaccaactgttcttctttgatttctcgcagaatacacgagtgccccgcctgcctgagtttgctgactgggcacaggaacaaggcgacgctccagccatcctgtttgacaaggagttttgcgaatggatgattcagcaaattggaccaaagctggacggcaaaatccccgttagccgagggtttccaatagccgaggtgtttacgctcaaaccgttagagttcggcaaacccaacacactcgtgtgctttgtttctaatctgttccctccgatgctgacggtcaattggcagcatcactccgttcccgtggagggcttcgggcccactttcgttagtgccgtggatggtctgtctttccaggccttcagctatttaaactttacacccgaacctagtgatatttttagttgtatcgtgacccacgaaatcgacaggtataccgccatagcgtactgggtgcctcgcaacgccttgccctctgatttactcgagaacgtcctgtgcggcgtggcattcgggttgggcgtgcttgggatcatagtcggcatcgtgctgatcatctatttccggaagccctgttccggttag

SEQ ID NO: 43431 - DNA, 510 bp, Artificial Sequence
  Description of Artificial Sequence: Synthetic coding sequence
atgtggcccgacgacctgcagaaccacaccttcctgcacaccgtgtattgccaggacggatcaccatcagtcggcctgagcgaagcctatgatgaggatcaactttttttcttcgacttctcacagaacactcgggtcccaagattacccgagttcgctgattgggcacaagagcaaggcgacgctcccgctatccttttcgataaggagttctgcgaatggatgattcaacagatcggccctaagctcgacgggaaaattcctgtttctcgaggcttccctatcgccgaggtgtttacccttaagcctcttgaatttgggaagcctaacaccctggtttgttttgtgtctaatcttttccctcctatgcttacagttaattggcagcaccacagtgtgcctgtggaaggattcgggcctacctttgtgagcgctgtggacggtttgtctttccaggccttctcctacctgaactttaccccagagccaagcgatatcttctcctgttag

SEQ ID NO: 43432 - DNA, 510 bp, Artificial Sequence
  Description of Artificial Sequence: Synthetic coding sequence
atgtggcccgacgacctgcagaaccacaccttcctgcacaccgtgtattgccaggatgggtccccttccgttgggctcagcgaggcctacgacgaagatcagctgttctttttcgatttcagccagaacactagggtacctaggctcccggagtttgccgattgggctcaggagcagggggatgcaccggccatcctgtttgacaaggagttttgtgagtggatgattcagcagatcggcccgaagctagatggtaagatacctgtgtcacgcggttttccgatagccgaagtcttcaccttaaagccacttgaattcgggaagcctaatacactggtctgttttgtgagcaatctgtttcctccgatgctgaccgtcaattggcagcaccattccgtccccgtggaaggattcggtccaacttttgtgtccgctgtggacgggctcagttttcaggcgttctcctatcttaacttcacccccgaaccttctgatatattctcttgttag

SEQ ID NO: 43433 - DNA, 684 bp, Artificial Sequence
  Description of Artificial Sequence: Synthetic coding sequence
atgggccacgagcagaaccagggcgccgccctgctgcagatgctgcccctgctgtggctgctgccacatagctgggctgtcccagaggcaccaacaccaatgtggccagacgatctacagaatcataccttcttgcacacagtgtactgccaggatgggagcccctctgtcgggctgtctgaagcctatgatgaggaccagctgttttttttcgacttttcacagaataccagggtgccacggttgccagagtttgcagactgggctcaggaacagggggacgctcccgctattctttttgacaaggagttttgcgagtggatgatccagcagataggaccaaagttagatgggaagattccagttagccgcgttaattggcaacaccattcagtgcccgtcgagggattcggtccgaccttcgtctcagctgtggacggtctctcctttcaagccttttcttacttgaacttcactccagaaccatccgacattttttcttgcatagtgactcacgaaatcgaccgctacactgcaatcgcatactgggtccctcgaaacgcactgccctcggatttgctggagaatgttctgtgcggcgttgcgttcggccttggcgtgcttggcattatagtcggcattgtgctcatcatttatttcagaaagccgtgcagcggcgattag

SEQ ID NO: 43434 - DNA, 873 bp, Artificial Sequence
  Description of Artificial Sequence: Synthetic coding sequence
gtgagctgctggctgagcgacagctgccaggagctgcagcggcgggggatcatactgtgctcttatggtgtgacgtcacccatagctgttttcgggcgacctgggaggttgcgtaacaggcgtcattttgaacgccgactggtaccaatgaaatggctgaagaaatgcctggacaccgcccccacccctatgtggcccgatgacttacagaaccatacctttctacataccgtttactgtcaagatggatccccctctgtgggactgtctgaggcatatgacgaggaccagctgttcttcttcgatttcagtcagaatacccgtgtgcctcgactcccagagtttgccgactgggctcaagagcagggagatgctccggcaatcctgttcgacaaagagttctgcgagtggatgatccagcagatcggccccaaactggacggcaagatcccagtgtccagggggttcccgattgctgaagtgtttacactgaaaccccttgagtttggcaaacctaacacgctcgtctgtttcgtgtcgaacctgttcccccctatgctgaccgttaattggcagcatcactctgtccctgtggagggctttggcccaactttcgtcagcgctgtggacggacttagttttcaggcgtttagctacctgaacttcacaccagagccttcagatatctttagttgtatcgttacccatgaaattgaccgttatacggcgattgcatactgggtaccaagaaacgccctgcccagtgatttgctcgagaacgtactgtgcggcgtggccttcggactgggggtccttgggatcattgtcggaatagtgctcataatctattttagaaaaccttgctcgggatag

SEQ ID NO: 43435 - DNA, 786 bp, Artificial Sequence
  Description of Artificial Sequence: Synthetic coding sequence
atgggccacgagcagaaccagggcgccgccctgctgcagatgctgccgcttttatggctccttccacactcctgggcagtgccggaggccccaacacccatgtggcccgatgacctgcaaaatcacacatttctgcacacagtctactgtcaagatgggtcccctagcgtcggcctgtccgaagcatacgatgaagaccagctctttttcttcgacttttcacagaacactagggtgccccggcttcccgaattcgctgactgggcacaggagcaaggtgatgctccagcaatcctgtttgataaggaattttgcgaatggatgattcagcagatcggtcctaagctggatgggaagattcccgtgtctagaggttttccaattgcagaggtgttcactctcaaacccttggagtttggaaaacccaatacccttgtgtgtttcgtgtccaacctattcccacccatgttgaccgtcaactggcagcaccattcggtgcccgttgagggattcgggccaaccttcgtgagcgccgtggacggtttgtcattccaagcattctcatatctgaattttactccagagccttcagacatcttttcctgcatcgtgacccacgagattgatcgatacacggccattgcctactgggtgccccggaatgccttgccgtcagacctcttagagaacgtgttatgcggtgtcgcctttggcctcggcgtattagggattatcgtcggaatcgtgctgattatctacttcaggaaaccatgcagcggagattag

SEQ ID NO: 43436 - DNA, 501 bp, Artificial Sequence
  Description of Artificial Sequence: Synthetic coding sequence
atgggccacgagcagaaccagggcgccgccctgctgcagatgctgcctctgttatggttgcttccgcacagctgggctgttcccgaaggattccctattgccgaggtcttcacactgaaacccctggagttcgggaagcctaacacgctcgtttgcttcgtttccaatcttttccctcccatgctaaccgtcaactggcagcaccattccgttccagttgagggattcgggccgacattcgtctccgccgtcgacggattgtcttttcaggccttctcatacctgaactttacacccgagccttccgatatattcagttgcatcgtaactcatgagatcgacagatatactgcaattgcgtactgggtgcctaggaatgctctgcccagcgaccttctggagaacgtcctgtgcggcgtggcctttggattaggcgtgcttggtataatagtggggatagtactcatcatctattttaggaaaccttgctccggggactag

SEQ ID NO: 43437 - DNA, 510 bp, Artificial Sequence
  Description of Artificial Sequence: Synthetic coding sequence
atgtggcccgacgacctgcagaaccacaccttcctgcacaccgtgtactgtcaggatggatccccttccgttggtctgagcgaagcctatgatgaggaccagctgttcttctttgacttctcacagaacacgcgcgtgccgcggctgccagagttcgcagactgggcccaggaacagggggacgctccagccatcttgtttgataaagagttttgtgaatggatgattcaacagattgggcctaagctggatggcaagatcccagtgtctaggggattccccatcgctgaggtgttcactctcaaaccgctagaattcggtaagccaaataccctcgtatgtttcgttagcaatttgttcccacccatgctgactgtaaattggcaacatcattccgttccagtggaggggtttggccccacattcgtgtccgcggtggatgggctttccttccaagctttctcatacctgaactttacccctgagcccagtgacattttttcctgttag

SEQ ID NO: 43438 - DNA, 786 bp, Artificial Sequence
  Description of Artificial Sequence: Synthetic coding sequence
atgggccacgagcagaaccagggcgccgccctgctgcagatgctgccacttctgtggctcctgcctcacagctgggccgtgccagaggcccccactccaatgtggcctgacgatcttcagaaccataccttcctacacacggtttactgtcaggatggaagtcccagcgtgggattgtcagaggcgtacgacgaggatcaactattcttttttgatttttcacagaatacccgtgtgcctagattgcccgaattcgctgactgggctcaggagcagggcgatgcacccgcaattctgtttgacaaggaattttgcgaatggatgatccagcaaatcggccccaaacttgacgggaagattccagtgtccagaggttttcctatagctgaagttttcactctgaagcccctggagtttggaaaaccaaacacactcgtgtgctttgtttcaaacctcttccctccaatgctaacagttaattggcaacatcactcaatccctgttgagggatttggcccgaccttcgtctccgcagtcgacggactgagttttcaggcgttctcctacctgaacttcactccagagccaagcgacatatttagttgcattgtgacacatgagatcgaccgttacacagccatcgcctactgggtgccgcggaacgcgctgccatctgatctcctggaaaatgtcctgtgtggcgtcgcctttgggctcggcgtgttgggaattatcgtgggaatcgttctgattatatattttagaaaaccttgttcaggggattag

SEQ ID NO: 43439 - DNA, 873 bp, Artificial Sequence
  Description of Artificial Sequence: Synthetic coding sequence
gtgagctgctggctgagcgacagctgccaggagctgcagcggcgggggattatcctctgttcttatggggtcacgtctccaattgccgtgttcgggcgtcctggacggttgcggaacaggcgacatttcgagcgccgactcgtgccgatgaaatggctgaagaaatgcctggacaccgctccaactccaatgtggccagatgacttgcagaaccatacgttcctccatactgtgtattgccaggatgggagtcctagcgtcgggctgtccgaggcttatgatgaggatcagctgtttttcttcgatttttctcagaacacacgggtgcccaggctgccagagttcgccgattgggcgcaggagcagggggacgccccggccatcctttttgacaaagaattctgcgaatggatgatccagcagattgggccaaaactggacggaaagatacccgtgtcccgtggtttcccaatcgccgaagtgtttacgctgaagccattagagtttggcaaacccaatacactcgtttgctttgtgtcaaatttgtttcccccgatgctgaccgtcaactggcagcaccattcagtcccagttgaggggtttggccccacatttgtctccgctgtagacgggttaagctttcaggcctttagctatttaaatttcactcctgagcccagtgatatcttcagctgtatcgttacccatgagatagaccggtatactgccattgcatactgggtccctcgcaatgcactccccagcgatctgctcgaaaacgttctgtgcggggtggctttcgggctcggagtcttaggaatcattgtcggaattgtactgatcatatactttcggaagccatgcagtggctag

SEQ ID NO: 43440 - DNA, 510 bp, Artificial Sequence
  Description of Artificial Sequence: Synthetic coding sequence
atgtggcccgacgacctgcagaaccacaccttcctgcacaccgtgtactgccaggatggatcccccagtgtcggtctgagcgaggcgtacgatgaagaccagctgtttttcttcgacttcagtcaaaacacacgcgtgccgcggctgccagagtttgcagactgggcacaggaacagggcgatgcacccgcaatactgtttgacaaagaattctgcgagtggatgatacagcagattgggcccaaactggacggcaagatccctgtgtctagggggtttcctattgccgaagtgttcaccttgaagccactggaattcggcaaacctaataccctggtttgcttcgtcagcaacctgttcccacctatgctgacagtcaactggcagcaccatagcataccagtcgagggctttgggcctacatttgtgtcggccgtggacggcctttccttccaggctttttcctacctgaactttacaccagagccatccgatattttcagctgttag

SEQ ID NO: 43441 - DNA, 786 bp, Artificial Sequence
  Description of Artificial Sequence: Synthetic coding sequence
atgggccacgagcagaaccagggcgccgccctgctgcagatgctgcccctgctctggctcctcccccattcttgggccgtccccgaagcaccgactcctatgtggcctgacgacctccaaaaccacactttcctgcacaccgtgtattgtcaggacggctcaccttcagtgggcctgtctgaggcttacgacgaggatcagttgttttttttcgatttctctcaaaacactcgggtccctaggcttccagagttcgcggactgggcccaagagcaaggcgacgccccagcgattctcttcgacaaggagttttgcgaatggatgatacaacagatcggccccaaactggacgggaagattccagtgtctcggggtttcccgatcgcagaagtttttacactgaagcctctcgagttcgggaaaccgaacaccctagtgtgctttgtgagcaacctgttcccgcccatgttgacagtgaactggcaacaccacagtgtgccggtcgagggattcgggcccactttcgtgagcgcggtagatggactgagttttcaggccttcagctaccttaacttcacacccgagcctagcgatatcttctcttgtattgtgactcacgagatagatcggtacacagccatcgcttattgggttccaaggaatgctctcccaagtgatctgctagaaaatgtgctgtgtggggtggcttttggacttggagtcctgggcattattgtcggcattgtgctgattatatattttcgcaaaccctgctccggggactag

SEQ ID NO: 43442 - DNA, 501 bp, Artificial Sequence
  Description of Artificial Sequence: Synthetic coding sequence
atgggccacgagcagaaccagggcgccgccctgctgcagatgctgccactattatggcttcttccccatagttgggcagtccccgagggctttcccattgcagaagtttttactctgaagccgctcgagtttgggaagcccaatactctcgtgtgcttcgtcagcaacctgtttccaccgatgcttacagtgaactggcagcaccacagtatccctgtcgaaggcttcggacccaccttcgtgtccgcggtcgacgggttgagctttcaggccttttcttatctgaacttcacgcccgagcctagtgatatcttctcctgtattgtgacacacgaaatcgatagatataccgccatcgcttactgggtaccacggaacgccctccccagcgatcttctcgagaacgttctttgcggagtggcttttggattaggtgtgcttggtattatagtgggaatagtgctcatcatttatttccgcaagccctgtagcggggactag

SEQ ID NO: 43443 - DNA, 786 bp, Artificial Sequence
  Description of Artificial Sequence: Synthetic coding sequence
atgggccacgagcagaaccagggcgccgccctgctgcagatgctgccgttgctctggttgctcccccactcatgggctgtccctgaggccccaacccccatgtggcccgacgacctgcagaatcacaccttcctgcacacagtgtattgtcaggatggttcgccctccgttggactttccgaagcctatgatgaggatcaactctttttcttcgacttcagtcagaatacccgggtaccacgcctgcccgaattcgcggattgggctcaagagcagggcgacgctcccgctattctgtttgacaaagaattctgtgagtggatgattcagcaaatcggaccaaagctggacggtaaaatccccgtttctagaggcttcccaatcgcagaggtgtttaccttgaagcctctggaatttggaaaacccaatactctcgtgtgcttcgtaagcaacctttttccaccgatgttaactgtgaactggcagcaccactcggttcccgtggagggatttggccccactttcgtgtccgcagtggacggactgtcttttcaggctttttcgtacctgaattttaccccagagccctcggacatcttttcttgcatcgtgacccacgagattgaccgctatacagccatcgcatattgggtgccccggaacgccttgccttcggacctattggaaaatgttctatgcggcgtggcattcggcttgggtgtcctgggtattatcgtgggaatcgtgctcatcatttactttcgtaaaccgtgttcgggagattag

SEQ ID NO: 43444 - DNA, 684 bp, Artificial Sequence
  Description of Artificial Sequence: Synthetic coding sequence
atgggccacgagcagaaccagggcgccgccctgctgcagatgctgccattgctatggctcttgccacactcttgggctgtccctgaggcccccaccccaatgtggcccgacgatctacagaatcacaccttccttcacacggtgtactgccaagacgggagtccatctgtcgggctgtcagaggcttatgatgaggatcagttattcttcttcgatttctctcaaaacactcgcgttcctaggctaccggaatttgccgactgggctcaagaacagggggacgcaccagctatactgtttgacaaggagttttgcgagtggatgatccaacaaattggacctaagttagatgggaagatccctgtgagtcgtgtgaactggcaacaccattcagtgcccgtcgagggtttcggacctactttcgtgagtgctgttgatggactgtcttttcaagctttctcgtacctcaattttacgcctgagccctctgacatcttttcgtgcatagtaacccatgaaattgataggtacacggccatagcatattgggtgcccagaaacgctctcccctcggacctcctggaaaacgtactgtgtggagtggccttcgggcttggggtgcttgggattatcgtcgggattgtgctgatcatttacttcagaaaaccctgttctggagattag

SEQ ID NO: 43445 - DNA, 501 bp, Artificial Sequence
  Description of Artificial Sequence: Synthetic coding sequence
atgggccacgagcagaaccagggcgccgccctgctgcagatgctgcctcttttgtggctcctccctcactcttgggcagttccagaaggcttccctatcgctgaggtttttacactaaagcccctggaatttggtaagcccaataccttggtctgttttgtgagcaacctattcccccccatgctgacggtcaactggcaacaccactctgtgccagttgagggattcggcccgacgttcgttagcgccgtcgatggattatcctttcaagctttcagttatttgaactttactcctgaaccaagcgatatcttctcatgcattgtgactcacgaaattgatcgctacactgctatagcttattgggtgcctcgcaatgctcttccgtccgatttactggagaacgtgctttgtggcgtggcctttgggctgggcgtactggggataattgtcgggatcgtgctgatcatctacttccgaaaaccttgttctggcgattag

SEQ ID NO: 43446 - DNA, 684 bp, Artificial Sequence
  Description of Artificial Sequence: Synthetic coding sequence
atgggccacgagcagaaccagggcgccgccctgctgcagatgctgccacttctgtggcttttgccacacagctgggctgttcccgaggccccgacacccatgtggcctgatgacctgcagaaccacacatttctgcatactgtatactgtcaagatggatcccccagcgtggggctgagcgaggcctacgacgaagaccagttgttcttcttcgactttagccagaacacaagggtgccccgcctgcccgaatttgcagattgggcgcaggagcagggagacgcccctgccatactattcgacaaggagttttgcgagtggatgatccagcagattggcccaaagcttgacggcaagatacccgtatcgagagtgaattggcaacaccatagcgtccctgttgaaggcttcggcccgacttttgtgtctgcggtggacgggctgagcttccaggcattctcctatctcaactttactcctgaaccctctgacatattctcatgtatcgtgacccacgagatcgaccggtacaccgcaatcgcttactgggtgccccgcaatgctctgccttcagatctgctggagaacgtcctgtgcggtgtagcgtttggcctcggtgtactaggcatcatcgttggtatcgtgcttattatttattttcgcaaaccttgtagcggagactag

SEQ ID NO: 43447 - DNA, 684 bp, Artificial Sequence
  Description of Artificial Sequence: Synthetic coding sequence
atgggccacgagcagaaccagggcgccgccctgctgcagatgctgccgcttttgtggctgctcccacattcctgggcagtgcccgaggccccgactcccatgtggccagacgacctgcagaaccataccttcctacacaccgtctactgtcaggatgggagcccatcagtcggcctctcagaggcatatgacgaggaccaactttttttcttcgatttctcacaaaacacacgtgtaccacggctgcctgagttcgctgactgggcacaggagcagggagacgctccagccatactgtttgacaaggagttttgtgaatggatgattcagcaaatcggacctaagctggatggtaaaattccggtatcgcgcgtgaactggcagcaccactctgtacctgtcgaggggtttggtcctacctttgtgtccgctgtggatgggctctcgttccaggcattctcatacctgaacttcactccagagccatctgatatctttagctgtatcgtgacgcatgagatagatcgctacactgctattgcctattgggtccctcgcaacgcgctgccatccgatctgctggagaatgttctctgcggagtcgcctttggcctgggcgtgctgggcataatcgtcggtattgtgttaattatctactttagaaaaccatgttcaggagactag

SEQ ID NO: 43448 - DNA, 786 bp, Artificial Sequence
  Description of Artificial Sequence: Synthetic coding sequence
atgggccacgagcagaaccagggcgccgccctgctgcagatgctgcctctgttgtggctcctgccacattcatgggctgtacctgaggcccccacaccaatgtggcctgatgacctgcagaatcatacgttcctgcataccgtgtattgtcaggatggaagcccttctgtgggcctgtctgaggcttatgatgaggatcagctgttctttttcgatttctcgcagaacacacgggtgccacgcctgccggagttcgccgactgggcacaggaacagggcgacgcgcccgctatactttttgataaggaattttgtgaatggatgatacagcaaatcggccctaaactcgacggcaagattcccgtcagtcggggttttcccattgccgaggttttcacattgaagcctctggagttcggtaagcctaacactctggtgtgtttcgtgagcaatttatttccaccaatgctgacggttaattggcagcaccactccgttcctgttgagggcttcggcccaacgttcgtctcagccgttgatgggctatccttccaggccttctcctatctaaacttcacaccagaaccctcggacatattctcctgtatagttacgcacgagattgaccgttataccgccatcgcctattgggtaccccggaacgctctgcccagcgacctgctcgaaaacgtgctgtgtggcgtcgccttcggtctgggggtgctgggtatcatcgtgggaatcgtactgattatttactttcgcaagccttgcagtggcgattag

SEQ ID NO: 43449 - DNA, 501 bp, Artificial Sequence
  Description of Artificial Sequence: Synthetic coding sequence
atgggccacgagcagaaccagggcgccgccctgctgcagatgctgccactcctctggcttctgccacacagttgggcagtaccggaaggcttccccatcgcagaggtcttcacactgaagcccttggagtttgggaagccgaacaccctggtgtgtttcgtcagcaacctcttccctccaatgttaacagtgaactggcaacatcactcggttccagtagagggattcggtcccacattcgtgagcgcagtcgacggcctttcttttcaggcctttagctacttaaacttcacacccgaaccatccgacatcttctcatgcatagtaacacacgagatagacagatacacggcgattgcatattgggttccccggaacgccctgcccagtgatttgttggagaatgtgctgtgcggggtagctttcgggctgggcgtccttgggattatcgttggaatagtcctcattatttatttccgcaagccatgtagcggtgactag

SEQ ID NO: 43450 - DNA, 786 bp, Artificial Sequence
  Description of Artificial Sequence: Synthetic coding sequence
atgggccacgagcagaaccagggcgccgccctgctgcagatgctgccactgctgtggctacttccgcattcttgggccgtgccggaagcgccgactccaatgtggcccgacgacctgcagaaccacacgttcctgcatacagtgtactgccaggatggctctccatcagtcggactgagcgaggcctacgatgaggaccagcttttttttttcgactttagtcagaataccagagtgcctcggcttcctgagtttgctgactgggcacaggagcagggagatgccccggctatcctttttgacaaagaattctgtgaatggatgatccaacagatcggaccaaaactggacggcaaaattccagtgagtcgcggattcccaatcgctgaggtctttactcttaagcctctggagtttggcaagccgaataccctggtgtgctttgtgagtaatttgtttcctcccatgttgacggtaaattggcagcatcacagcgtacccgtggaaggctttggacctacttttgtttccgccgttgatggtctatctttccaggcattcagctacctgaacttcacccctgagccatctgacatattctcttgtatcgtgacccacgagatcgatcgatataccgcaatagcttattgggtgcctcgtaacgccctccccagcgatctgctggagaacgttttatgcggagttgccttcgggctgggcgtactagggatcatcgtcggaatcgtcctcatcatctacttccgcaagccgtgctccggggattag

SEQ ID NO: 43451 - DNA, 873 bp, Artificial Sequence
  Description of Artificial Sequence: Synthetic coding sequence
gtgagctgctggctgagcgacagctgccaggagctgcagcggcggggcattattctctgttcctatggagtcacctctccaattgctgtattcggtagacccggccgcctgaggaatcgcagacacttcgagcggcgcctggtccctatgaaatggttgaagaaatgcctggatactgctcccacaccaatgtggcccgatgatctccagaaccacactttcctccacaccgtttattgtcaggatggaagcccttcagtgggcctaagcgaggcatacgacgaagaccagctctttttcttcgattttagtcagaacacccgcgtgcccaggctgccagagtttgccgattgggctcaggaacagggagacgcccccgccatactgtttgacaaagaattttgcgagtggatgattcagcagattggccctaagcttgatggtaagatccccgtctctcggggtttcccaatcgcggaagtttttactctcaagcccttagaattcggaaagccaaacacacttgtctgtttcgtttctaatctgtttcctccaatgctgaccgtgaactggcagcatcattccgtccccgtcgagggttttggtccaaccttcgtaagcgccgtcgatggactgtctttccaggcgttttcttacctcaactttaccccagaaccttccgatatattcagttgcatagtgacacatgaaattgaccgctatacggccatagcttactgggtgccccgcaatgctctgccctcagaccttctggagaacgtactctgtggagtggctttcggcctcggcgtccttgggatcatcgtgggcattgtgctaattatttattttcggaaaccttgttccggatag

SEQ ID NO: 43452 - DNA, 873 bp, Artificial Sequence
  Description of Artificial Sequence: Synthetic coding sequence
gtgagctgctggctgagcgacagctgccaggagctgcagcggcggggtattattttgtgctcctacggcgtcaccagcccaatcgcggtatttggcagaccaggtagactcaggaacaggcgacattttgaaagacggttagtaccaatgaagtggctcaagaaatgcttggatacagctccaacacccatgtggcccgatgatctgcagaatcacaccttcctgcacaccgtgtattgtcaggacggttcaccatccgtggggttatcggaagcatacgatgaagaccagttgtttttctttgactttagccagaacactcgcgtcccgagattacctgagttcgctgactgggcccaagagcagggtgatgctcccgcaatactgttcgacaaggagttctgtgagtggatgatccagcagataggcccaaaattggacggaaaaatccccgtctcaaggggattccctatcgcggaagtgtttaccttgaagcccctcgaattcgggaaacccaacaccttggtttgttttgttagcaacctgttcccacccatgctgaccgtgaactggcagcatcatagcatcccagtcgagggcttcggacctacgttcgttagcgccgtagatggcctttccttccaggccttcagctacctaaactttacacctgagcctagtgacatcttttcctgcatcgtgactcatgaaatagacaggtacactgcaatcgcctattgggtgccccgcaatgcccttccttccgatttacttgagaacgtgttgtgcggggtggctttcggactgggagtcttaggcattattgtgggaattgtgctgattatctatttccgaaagccatgcagcggctag

SEQ ID NO: 43453 - DNA, 873 bp, Artificial Sequence
  Description of Artificial Sequence: Synthetic coding sequence
gtgagctgctggctgagcgacagctgccaggagctgcagcggcgggggattatcctctgttcctatggtgtcacaagtcctattgctgtgttcggaaggccggggagattgagaaacagacgtcacttcgagagaagactcgtgccaatgaagtggctcaaaaaatgtctcgacacagctccgacacccatgtggccggacgatttgcagaaccacacgttcctgcacactgtttattgccaggacggttcaccctccgttggtctcagcgaggcctacgatgaagaccagctcttcttctttgacttcagtcaaaacactcgcgtgcctaggttacccgaatttgccgactgggcacaagaacagggtgacgctcccgctattcttttcgataaggagttttgtgagtggatgatccagcagattgggccgaaactggatggcaagatccctgtcagcagggggttccccatcgccgaagtgttcaccctgaagccactggagttcggtaagccaaacaccttggtctgctttgtgtcaaatctgtttccccctatgctcactgtaaactggcaacatcattccgtgccggttgagggatttggccctactttcgttagcgcagtcgatggcctcagttttcaagcattctcatacctgaattttaccccggagcctagcgacatattctcctgtattgttacccacgaaatcgatagatataccgcgattgcatactgggtccctaggaatgccctgcctagtgaccttctagagaacgttctgtgcggagtcgccttcggactgggcgtgctgggaatcattgtcggcatcgtattgatcatatatttcagaaaaccctgcagtgggtag

SEQ ID NO: 43454 - DNA, 501 bp, Artificial Sequence
  Description of Artificial Sequence: Synthetic coding sequence
atgggccacgagcagaaccagggcgccgccctgctgcagatgctgcccttgctgtggctgctgccacattcctgggccgttcctgaggggtttcccatcgcagaagtctttacacttaaacccctggagttcggaaaacctaacactctggtgtgtttcgtgtcaaacctatttccgcctatgctaacagtgaactggcagcaccactcggttcctgttgagggctttgggcctacgttcgtatcggccgttgacggtctttcgttccaggcgttttcctacctgaatttcacccccgaaccttcagacatcttttcctgcatagtcacgcatgagatcgaccgctacacagctattgcgtactgggtgccaagaaacgcattaccttccgacctgctggagaatgtattgtgcggggtggcttttggactaggggtgctgggcataattgtgggtatcgtgttgatcatctattttcgtaagccctgtagcggggattag

SEQ ID NO: 43455 - DNA, 510 bp, Artificial Sequence
  Description of Artificial Sequence: Synthetic coding sequence
atgtggcccgacgacctgcagaaccacaccttcctgcacaccgtgtactgccaagacggttccccatctgtcggcctgagtgaggcgtacgacgaagaccaattattctttttcgacttctcgcagaacactagggttccaaggctaccagagttcgccgattgggcacaggaacagggcgacgctccagcaatactgttcgataaagagttttgtgagtggatgatccagcaaattggaccaaagctggacggcaagatcccggtctcacgaggctttcctatagctgaagtatttaccctaaagcctctggaatttggtaagcccaacaccttagtgtgctttgtgtcgaatctctttcctcctatgttaaccgtgaactggcagcaccatagtgttcccgtggaaggcttcggccccacctttgtgtccgccgtcgacgggctttcctttcaggctttttcttacctgaatttcactcccgagccttcagacattttctcttgctag

SEQ ID NO: 43456 - DNA, 792 bp, Artificial Sequence
  Description of Artificial Sequence: Synthetic coding sequence
atgatcaccttcctgcccctgctgctgggcctgagcctgggctgcacaggggccggtggcttcgtggctcacgttgagagcacatgcctgctcgatgatgccgggacacccaaagactttacatactgtatcagcttcaataaggatcttctgacgtgttgggaccccgaagagaataagatggccccatgcgagttcggagtactcaattcacttgcaaacgttctgagccaacacctcaaccagaaagatactctgatgcagcgccttagaaacggactccaaaactgcgcaactcacactcagcctttttggggatctcttacgaacagaacccgtccaccaagcgtacaagtggcgaaaaccacacctttcaatacacgagaaccagtgatgctcgcctgctacgtgtggggattttatcccgccgaggttacaatcacctggcgcaagaacggtaagctggtgatgccacactcctccgcacacaagacagcccagcccaatggggattggacataccagactctgagccacctggctttgacccccagctatggcgacacttacacctgcgtagtagagcacattggggctcctgagcccatactgagggactggaccccgggactgtccccaatgcagaccctgaaggtatccgtgtctgccgttactctgggactgggactgatcatcttctcccttggcgtcatctcctggcgcagggccggacatagcagctacactcccctgcctggtagtaattattccgaggggtggcacataagctag

SEQ ID NO: 43457 - DNA, 792 bp, Artificial Sequence
  Description of Artificial Sequence: Synthetic coding sequence
atgatcaccttcctgcccctgctgctgggcctgagcctgggctgcaccggtgccggtggctttgtggcacatgtggaatcgacctgccttctagacgatgcagggacacctaaagacttcacttattgcattagcttcaacaaagatcttctgacatgttgggaccctgaggagaataagatggccccctgcgagttcggcgtgttgaacagcttagccaatgtgctaagccagcatctgaaccagaaggatacattaatgcagcgcctgcggaatgggctgcagaactgcgccacacacacgcagccattctggggctccctgactaaccgcactcgccccccctcagtgcaggttgcaaagacaactccattcaatacaagggagcccgttatgctggcctgttacgtgtgggggttttacccagctgaagtaacaattacctggagaaagaatggaaaattggtgatgcctcacagcagtgcccataagaccgcacaacctaatggcgattggacctatcaaaccctcagtcatctggccctcactccgagttacggagatacctacacctgcgtcgtggaacacataggggccccagaacctattcttcgggattggacacctggcctatcacccatgcagacgttaaaagtctccgtaagcgcagtaactctgggtctgggtctcatcatcttttcactgggggtgatttcctggcgaagagcagggcacagcagctatacccccctgccaggttccaattactccgaaggctggcacatctcgtag

SEQ ID NO: 43458 - DNA, 792 bp, Artificial Sequence
  Description of Artificial Sequence: Synthetic coding sequence
atgatcaccttcctgcccctgctgctgggcctgagcctgggctgcacaggggccggggggttcgtagcccacgtcgaatcaacctgtctactcgatgacgctggcactcctaaggattttacatactgcatcagcttcaacaaagacctcctcacttgctgggacccagaagaaaataagatggctccctgcgaatttggcgtgctcaattctctcgccaacgtgcttagccaacatctgaaccagaaggatacattaatgcagcgactgcggaacggtctccagaactgtgctacacatacacagcctttctggggctccctgaccaataggacccggcccccttcagtgcaagtcgcgaagactactccttttaacactagagaacccgtgatgctagcctgctatgtgtggggattctatcccgcagaggtcaccataacctggcgcaagaacggcaagctggtgatgccccatagctccgcccataagaccgctcagcctaacggggattggacatatcagactctgagccatctagcccttactcctagctacggcgacacttatacttgtgtagtggaacacaccggagctcccgaacctatcttgagagattggactcctgggctgtcgcccatgcagactttgaaagtgtccgtctctgccgtgacgctgggtctcggactcattattttctctctcggtgtcatctcgtggaggagagccggtcactcctcatacacacccctgccgggatcaaactacagtgaaggatggcacatttcatag

SEQ ID NO: 43459 - DNA, 426 bp, Artificial Sequence
  Description of Artificial Sequence: Synthetic coding sequence
tgaacccggccccccagcgtgcaggtggccaagaccacccccttcaacactcgtgaacctgttatgctcgcctgctacgtgtgggggttctaccccgccgaggtgaccatcacctggcgcaaaaacggtaaacttgtgatgcctcattcttctgctcacaagaccgcccagcctaacggtgactggacttaccagacactgagccacctggcacttacaccaagctacggggatacatacacatgtgttgtggaacacatcggagcccctgaacctatcctacgagattggacgcccggtctgagccccatgcagaccctgaaagtatctgtgtccgcggtgaccctaggcttagggttgatcatcttctctctcggagtgatttcatggcggcgtgcaggacatagccggtggcacatttcatag

SEQ ID NO: 43460 - DNA, 774 bp, Artificial Sequence
  Description of Artificial Sequence: Synthetic coding sequence
atgatcaccttcctgcccctgctgctgggcctgagcctgggctgcaccggcgccggcggatttgtggcacatgtcgagtccacgtgcctgctcgacgatgcagggactcccaaggattttacctattgtatcagtttcaacaaggatttgctcacatgttgggacccagaggaaaacaaaatggctccgtgcgagttcggggtcctgaactccctcgctaacgtcctgagccagcacctcaaccagaaggatacgctcatgcagcgcctccgcaatgggctgcagaattgcgcgactcacacacagccattctggggctctctcactaataggacacggccgccttcagtccaggtggccaagaccacaccattcaatacgcgagaacccgtgatgcttgcttgttatgtctggggtttttaccctgccgaagtgaccataacgtggagaaagaatgggaagttggtcatgccacatagtagcgcccacaagactgcgcaaccaaacggggactggacataccagaccctgtcgcatctggcccttacaccatcgtacggcgatacctacacctgtgtggtagaacatatcggcgcgcccgagcctatcctgagggactggacgccaggactgagtcccatgcagaccctgaaggttagcgtgtccgccgtgacccttggcctcggcctgatcatctttagtctgggcgtgatttcttggcgacgtgcaggacattcctcagatcttattatatctctgctgtttatcctttag

SEQ ID NO: 43461 - DNA, 321 bp, Artificial Sequence
  Description of Artificial Sequence: Synthetic coding sequence
gtggccaagaccacccccttcaacacccgggagcccgtgatgctggcgtgctatgtgtggggattttatcctgctgaggttacaattacctggcggaaaaatggaaagctggtcatgccccacagcagtgcccacaagactgctcagccgaatggtgactggacgtaccaaacattgtctcatctggccctcaccccaagttatggagatacatatacatgcgttgtggagcacacaggtgctccggagcctatactgagggactggtcttacacccctttacctgggtccaactactcagagggatggcatatctcttag

SEQ ID NO: 43462 - DNA, 426 bp, Artificial Sequence
  Description of Artificial Sequence: Synthetic coding sequence
tgaacccggccccccagcgtgcaggtggccaagaccacccccttcaacactagagagccagtgatgctggcttgctacgtgtgggggttttaccctgcagaagtaacaatcacttggcgtaagaacgggaaactcgtgatgccacatagcagtgctcacaaaacagcacagcctaacggagactggacttaccagactctgtcccatctggccttaaccccaagctatggagacacttacacatgtgtcgtagagcataccggcgcccctgagcctatcttgagagattggactcctgggttgtcacccatgcagaccttgaaagtgagtgtgtctgccgttacactgggattaggccttatcatcttttcactgggagttatcagttggaggcgcgctggacactcccgctggcatatctcatag

SEQ ID NO: 43463 - DNA, 528 bp, Artificial Sequence
  Description of Artificial Sequence: Synthetic coding sequence
atgggccacgagcagaaccagggcgccgccctgctgcagatgctgccgcttttgtggttattgccacacagctgggcagtgccagaggaacagtccatgatcacttttcttccattgctgctcgggctgtccctgggctgcaccggtgcggggggcttcgtggcacatgtggagtccacctgtctactagatgacgccggcacgcccaaggatttcacgtactgcatttcctttaataaggacctactgacatgctgggacccagaggaaaacaaaatggccccctgcgagtttggtgtgcttaacagtttggccaatgttctgtcacaacacctcaaccaaaaggacaccttaatgcaaaggctccggaacggcctccagaattgcgcgacgcacacccagccgttttggggatctctgaccaaccggactagacccccaagtgtccaggtggctaaaactacaccatttaacacaagggaaccagtaatgttggcctgctatgtgtggggcttctaccccgcttag

SEQ ID NO: 43464 - DNA, 528 bp, Artificial Sequence
  Description of Artificial Sequence: Synthetic coding sequence
atgggccacgagcagaaccagggcgccgccctgctgcagatgctgccccttttgtggttactcccccacagttgggcagtccccgaggagcagagcatgatcacatttctgccactgttgctcggactctctctcggctgtacaggggcgggggggttcgtcgcacatgtggaaagcacctgtttactcgacgacgcagggacacccaaggactttacctattgtattagttttaataaggatcttttgacctgttgggatcctgaagaaaacaagatggccccttgtgaattcggggttctcaattcgctagcaaatgtgctcagccagcacctcaatcagaaggacacacttatgcaacggttgcggaacgggctacagaactgtgcaacccacacgcagccgttctggggatcactgacaaacaggacaagaccgccctcggtgcaagtcgcaaagactactccctttaatacacgggagcctgtgatgctggcctgctatgtatgggggttttatcctgcctag

SEQ ID NO: 43465 - DNA, 651 bp, Artificial Sequence
  Description of Artificial Sequence: Synthetic coding sequence
atgatcaccttcctgcccctgctgctgggcctgagcctgggctgcactggagctggcgggttcgtagcacacgtcgagagcacctgcctcctggatgacgcaggcactccaaaagattttacctattgtatctcttttaacaaggacctgctcacctgttgggacccagaagagaataagatggccccttgtgaattcggagtgttaaactcattggcaaatgtcctatcccagcaccttaaccaaaaagatacccttatgcagaggctgcgcaatggcctccagaattgcgccactcacacccagcctttctgggggagcctgactaaccgaactcgcccacctagtgtacaggtcgccaagacgacgccctttaataccagagaaccggtcatgctggcttgttatgtctggggcttctatccggctgaggttacgatcacttggcgaaaaaatggtaaactcgtcatgccacattcatccgctcataagactgcacagccgaatggagattggacttaccagaccctcagccacctcgctctcacaccttcctacggtgacacttacacatgcgtggttgaacatacaggcgcacctgaaccgatcttgcgcgattggtctaagtgtatggccgatggttggaattag

SEQ ID NO: 43466 - DNA, 792 bp, Artificial Sequence
  Description of Artificial Sequence: Synthetic coding sequence
atgatcaccttcctgcccctgctgctgggcctgagcctgggctgcacaggtgccggcggttttgtcgcacacgtggagtctacttgtctgctcgatgacgctggcactcctaaggattttacgtactgtatcagcttcaacaaggacctgctgacatgctgggatccagaggaaaataagatggcaccctgcgaatttggggtattaaacagcttggccaatgtccttagccagcacctgaatcagaaagacactctgatgcagcgccttaggaatggcttgcagaattgcgctacgcacactcagccattttggggctccttaaccaaccgaacccgtccaccctcagtgcaggtggcaaagactacaccctttaacacccgcgaaccagtgatgttggcttgttatgtgtgggggttttaccccgcggaagtgactattacatggcggaagaacggaaagctcgtcatgcctcatagtagcgctcacaagacggcccaacctaacggtgattggacctaccaaaccctatcacacttagctcttacaccatcttatggagacacttatacatgcgtagtagagcacactggcgccccagagcctatcctgcgagactggaccccagggctgtcccctatgcagactctgaaggtgtccgtgagcgcagtcaccctggggcttgggctcatcatcttttctctcggggtgattagttggcgaagagctggccactcttcttacacccccctcccaggcagtaactattctgagggctggcatatttcgtag

SEQ ID NO: 43467 - DNA, 774 bp, Artificial Sequence
  Description of Artificial Sequence: Synthetic coding sequence
atgatcaccttcctgcccctgctgctgggcctgagcctgggctgcacaggagctggaggatttgtggcacacgtggaaagcacttgcctgctggacgacgcaggcactccaaaggacttcacatactgtatttcctttaataaagaccttctgacatgctgggaccctgaggaaaataagatggctccctgcgagttcggagtcttgaactcactagcgaacgtgctctctcaacacttgaatcagaaggacacactgatgcagcgcctcaggaacggcctgcaaaactgtgcgacgcacacacagcccttctggggttctctaacaaaccgcacaagaccacctagcgttcaagtggccaaaacaacacccttcaatacacgggaaccagtgatgttagcctgctacgtttggggcttttatcctgctgaagtcacaattacctggcggaagaatgggaagcttgtaatgccgcacagttctgctcacaaaacagcccagccaaacggagactggacatatcagactttatcacacttagcactcactccctcgtacggggacacctatacatgcgtggtcgagcatacaggagcacctgaaccgattcttcgagactggacgccaggactgagcccaatgcagactttaaaagttagtgtgagcgcagtgactcttgggcttggattgataatcttttctctgggagtaatctcatggcggagagcgggccactcctcagatctgatcattagcttgttattcatcctttag

SEQ ID NO: 43468 - DNA, 321 bp, Artificial Sequence
  Description of Artificial Sequence: Synthetic coding sequence
gtggccaagaccacccccttcaacacccgggagcccgtgatgctggcctgttacgtgtggggcttctatcctgctgaggtaacgattacctggagaaaaaacggcaaacttgttatgccccattctagtgcccacaaaaccgcccagcccaacggcgactggacgtatcagactctttcccacctggcccttaccccgagctacggtgacacgtatacttgtgtagtggaacacattggcgcacctgaaccaatcttacgggactggagttataccccgctgcctggcagtaactactctgagggatggcacatctcttag

SEQ ID NO: 43469 - DNA, 792 bp, Artificial Sequence
  Description of Artificial Sequence: Synthetic coding sequence
atgatcaccttcctgcccctgctgctgggcctgagcctgggctgcaccggggctggtggcttcgtagcccacgtggaaagcacttgcctgctagatgacgctggaacacccaaagactttacatactgcattagctttaacaaagacctgctcacctgttgggatccggaggaaaacaaaatggccccgtgcgaatttggcgtattgaacagcctggccaacgtgctgagtcagcatcttaaccagaaggacactctcatgcagcgtctgagaaacgggctccagaactgcgcgacacatacccagcccttctgggggtccttaaccaaccgcacccgtccacccagcgttcaagttgccaaaaccacgccttttaacacacgcgaacctgtgatgctcgcctgctatgtgtgggggttttatcctgcggaggtgacaataacctggcggaaaaatgggaaactggtgatgccgcactcaagtgcccacaagaccgctcagcctaatggcgactggacgtaccagaccctcagtcaccttgcgctgacaccatcgtatggagatacctatacgtgcgtggtcgagcatacgggcgcccctgagcccatcctgcgcgactggacccccggactgtcaccaatgcaaactctcaaggtgagtgtgagcgccgtcaccctggggttaggattaatcattttcagcttgggcgttataagttggcggcgggctggccacagttcttataccccccttccaggctctaattattcagagggatggcatatcagctag

SEQ ID NO: 43470 - DNA, 426 bp, Artificial Sequence
  Description of Artificial Sequence: Synthetic coding sequence
tgaacccggccccccagcgtgcaggtggccaagaccacccccttcaacactcgcgaaccagtgatgctggcctgctacgtgtgggggttctatcccgccgaggttacaatcacctggaggaaaaatggaaagctggtcatgccccactcctccgcccacaaaaccgcacagcctaatggcgactggacataccagaccctgagtcatcttgctctgaccccatcctatggggacacgtacacctgcgtcgtggagcacacgggtgccccagagcctatattgcgcgattggacaccaggcctttctccgatgcaaaccctgaaggtgagcgtgtcagcagtgacactcgggctgggcttgatcatcttctccctgggagtaatctcttggcgccgcgctggacacagtcgttggcatatctcttag

SEQ ID NO: 43471 - DNA, 792 bp, Artificial Sequence
  Description of Artificial Sequence: Synthetic coding sequence
atgatcaccttcctgcccctgctgctgggcctgagcctgggctgcaccggagcaggcggctttgtggctcacgttgaatcgacatgcttgctggacgacgcaggaaccccaaaggattttacttactgtattagctttaacaaagacctgctcacctgctgggacccagaggagaataagatggctccctgcgagtttggtgtgcttaactcactggccaatgtgttatcccagcacctgaaccagaaggatactctcatgcaaaggcttcggaacggtctccagaattgcgcaactcacacacagcctttctggggctccctcaccaatcggactcggccacctagcgtacaggtagcgaaaacgacgccattcaacactcgcgaacccgtcatgttggcctgttacgtgtggggcttctatcccgccgaggtgacaatcacctggcgaaaaaatggtaagctggtgatgccacattcatctgcccacaagacagcccaacccaatggtgactggacctatcagaccctcagccatcttgccctcactcctagttacggcgacacctacacgtgtgtggtggaacacatcggggcacctgaaccaatcctgagagattggacccctggcctgtcacccatgcaaacactcaaagtcagcgtcagtgccgtgacattgggcctcggtttgataattttcagtttgggcgtgatctcttggcgtcgggctggtcactcatcctatacacctcttcccggctcaaattactccgaaggctggcacatcagttag

SEQ ID NO: 43472 - DNA, 774 bp, Artificial Sequence
  Description of Artificial Sequence: Synthetic coding sequence
atgatcaccttcctgcccctgctgctgggcctgagcctgggctgcacaggagcaggcggatttgtggctcacgtggaatcaacgtgtcttcttgatgatgctggtactccaaaggacttcacgtactgtattagctttaataaagatttgcttacatgttgggatccagaagaaaataagatggcaccttgtgagttcggagttctgaacagtctggccaacgtcctgtcacaacacttgaaccagaaagataccttgatgcagcggctcagaaacggacttcagaattgcgcgacccatacacaaccgttttggggatcactgaccaaccggacacggcccccaagcgtacaagtggccaagacaactccatttaacacccgcgagcctgtgatgctggcgtgctacgtgtggggtttttacccagctgaggtcaccatcacctggcgaaagaacgggaaactggtgatgcctcactcttcagctcacaaaacagcgcagccaaatggcgactggacttaccagacgctgtctcacctagctctgacaccaagctatggagatacatatacatgtgttgttgagcacatcggggcacccgagcccatacttcgggattggacccccggtctttcgcccatgcagaccctgaaggtcagcgtctcagccgtgaccctggggctgggcctgatcatattttccctgggagtgatctcctggcgacgggccggacacagttcggacttgatcatcagccttctgtttatattatag

SEQ ID NO: 43473 - DNA, 528 bp, Artificial Sequence
  Description of Artificial Sequence: Synthetic coding sequence
atgggccacgagcagaaccagggcgccgccctgctgcagatgctgcctctgctttggctgctgccacactcatgggccgtgcccgaggagcaaagcatgattacattcctgcccctgcttcttgggttatccctcggatgtaccggtgcaggaggtttcgtcgcccatgttgagagcacttgtcttttagatgacgcaggaacccccaaggattttacatactgtatcagtttcaacaaagatctgttaacttgttgggaccctgaggagaacaaaatggcgccatgcgaatttggagtgctgaatagcctggccaatgtcctatcacagcacctaaaccagaaggacacacttatgcagcggctccggaacggtctacagaattgcgctacccatacacaaccattctgggggagcctcacaaaccgtactcggcccccaagtgtgcaggttgccaagacaaccccctttaataccagagagccagtgatgctggcatgctatgtgtggggcttttatcccgcctag

SEQ ID NO: 43474 - DNA, 528 bp, Artificial Sequence
  Description of Artificial Sequence: Synthetic coding sequence
atgggccacgagcagaaccagggcgccgccctgctgcagatgctgccactcctctggctcctgccacattcatgggcagttccggaagagcagtccatgatcacattcttgcccctgctgctggggctgtcactcggatgtactggcgcgggcggttttgtagcacacgtagaatctacctgccttctggatgacgccggtacacccaaagactttacctactgtatcagtttcaataaagatcttcttacatgttgggaccccgaggagaataaaatggccccctgtgagtttggcgtcctcaactcattagcaaacgttctgagccagcacttgaatcagaaggatacacttatgcagcgcttgcgaaatggccttcagaattgcgccacccacacccagccattttggggctcgttaaccaataggacccggcccccctcagtccaggtcgctaagaccactccatttaatacgcgcgaacccgtaatgctggcctgctatgtgtggggattttatcccgcatag

SEQ ID NO: 43475 - DNA, 321 bp, Artificial Sequence
  Description of Artificial Sequence: Synthetic coding sequence
gtggccaagaccacccccttcaacacccgggagcccgtgatgctggcatgctacgtatggggattttatcctgccgaagtgacgatcacctggcgaaaaaatggcaaactggtgatgcctcactcatcagctcacaaaacggcacagccgaacggtgactggacttatcagaccttgtcccatctcgcactgacccctagttacggagacacgtatacatgtgtggtagagcatattggggccccagagccaattttacgcgactggagctacacccctctgcccggaagcaattactcagaaggctggcacatatcctag

SEQ ID NO: 43476 - DNA, 426 bp, Artificial Sequence
  Description of Artificial Sequence: Synthetic coding sequence
tgaacccggccccccagcgtgcaggtggccaagaccacccccttcaacacaagagaacctgtgatgctggcctgttacgtgtgggggttctacccagccgaggtaaccatcacctggcgaaaaaatggcaagttggtcatgccccatagtagcgcacacaaaacagctcagccgaacggcgattggacataccaaaccctctcacatttagcattgactccgagctatggtgatacctacacctgcgttgtcgaacacaccggcgctcctgaacccattttgcgggattggacccctggcctgtctccgatgcagactcttaaggtttccgtctccgccgtcacacttggtttagggctcataattttctctcttggggtaatttcctggcggcgtgctgggcattccaggtggcatatctcatag

SEQ ID NO: 43477 - DNA, 528 bp, Artificial Sequence
  Description of Artificial Sequence: Synthetic coding sequence
atgggccacgagcagaaccagggcgccgccctgctgcagatgctgccactgctttggctgctgccccactcgtgggctgtaccagaggagcagagcatgatcacattcctgcccctcctacttggcctttccctgggttgcaccggcgcaggtggcttcgtggcacatgtggaatcgacctgtcttctggacgatgctgggacacccaaggactttacctactgtatcagctttaacaaggacctcctgacctgttgggacccggaggagaacaagatggccccttgcgaatttggtgtcctgaattccttggccaacgtgctgagccaacacctgaaccagaaagacacactcatgcagaggcttagaaacgggctccagaactgtgccactcacacacagccgttctggggatcgctgacaaacagaactcgccctccctctgtgcaggtggcaaaaacaactccatttaataccagggaaccagttatgttggcctgttacgtctggggcttctatcccgcctag

SEQ ID NO: 43478 - DNA, 321 bp, Artificial Sequence
  Description of Artificial Sequence: Synthetic coding sequence
gtggccaagaccacccccttcaacacccgggagcccgtgatgctggcgtgttatgtctgggggttttaccccgccgaggtgacaatcacctggcgaaagaacggtaagctggttatgccgcactcatccgcacacaaaaccgcacagcctaacggggactggacataccaaaccctgagtcacctcgcactgaccccctcctacggcgacacctacacatgcgtcgtcgaacacacgggcgctccggagcctatcttacgggactggagttacactcctttacctggttcaaactacagcgagggctggcacattagttag

SEQ ID NO: 43479 - DNA, 321 bp, Artificial Sequence
  Description of Artificial Sequence: Synthetic coding sequence
gtggccaagaccacccccttcaacacccgggagcccgtgatgctggcttgctacgtttggggcttctacccagcagaggtcaccatcacttggcgcaagaacggcaagttggtgatgccacatagttccgcccataaaactgcccagcctaatggtgattggacctaccagactctgtcacatttagctttgacacctagttatggtgatacgtatacgtgcgtcgtggaacacatcggtgcacccgagcccatcctccgggactggtcttatacacccctccccgggtcaaactatagcgagggctggcacataagctag

SEQ ID NO: 43480 - DNA, 321 bp, Artificial Sequence
  Description of Artificial Sequence: Synthetic coding sequence
gtggccaagaccacccccttcaacacccgggagcccgtgatgctggcctgctatgtgtggggattttaccccgcggaggtcacaatcacttggcggaagaacggaaaactggtgatgccgcactcatctgctcacaagacagcccaaccgaacggcgattggacctatcagacactgtcacacctggcactgacccccagctatggcgacacttatacctgtgtagtggagcacatcggcgcacccgaacccatcctccgcgactggtcctacacgcctctgcccggatctaactattccgagggctggcatattagttag

SEQ ID NO: 43481 - DNA, 426 bp, Artificial Sequence
  Description of Artificial Sequence: Synthetic coding sequence
tgaacccggccccccagcgtgcaggtggccaagaccacccccttcaatacaagggagccagtcatgctcgcctgttacgtgtgggggttttatccagccgaggtgactatcacctggagaaaaaacggaaagctggttatgccgcacagcagcgcccataagaccgcccagccgaatggcgactggacatatcagacactttcacatctggccttaactccctcttatggggacacctacacttgcgtcgtggagcacattggcgctcccgagcctattctaagagattggacaccaggcctgagtcccatgcaaactctgaaagtaagcgtttccgcggtgacactgggtctaggcctgatcatctttagcctgggagtcattagttggcggcgcgcgggtcatagccggtggcacatctcgtag

SEQ ID NO: 43482 - DNA, 321 bp, Artificial Sequence
  Description of Artificial Sequence: Synthetic coding sequence
gtggccaagaccacccccttcaacacccgggagcccgtgatgctggcgtgttacgtttggggtttctacccggccgaagttaccattacatggaggaaaaatggaaaactagtgatgccccacagtagtgcccacaaaactgcacagcctaacggggactggacataccagacactgagccacctggctcttacgcccagctatggagatacctacacctgcgttgtggagcataccggtgcaccagagcccatactgcgcgattggtcctacactcctctgccgggttctaactactccgaaggctggcatatctcgtag

SEQ ID NO: 43483 - DNA, 774 bp, Artificial Sequence
  Description of Artificial Sequence: Synthetic coding sequence
atgatcaccttcctgcccctgctgctgggcctgagcctgggctgcaccggtgcaggcggattcgtcgcgcatgttgaatccacctgtttgctcgacgacgccggaactcccaaggacttcacttactgcatttccttcaacaaagacctgcttacatgctgggaccctgaggaaaacaaaatggccccctgcgagtttggggtccttaattcactggcgaacgtgctaagccagcacttgaaccagaaggatactctcatgcagcgcctccggaatggtctccagaactgtgccactcatacccagcccttttggggatcacttactaacagaactagacctccaagcgtgcaggttgctaagacgacaccatttaatacccgagaaccagtcatgctggcgtgctatgtctgggggttctatcctgccgaagtcaccatcacgtggcgcaaaaacggaaaactggtcatgccacatagtagcgctcacaaaactgctcaacccaatggggattggacatatcagaccctttcccacctcgcattaacccccagctacggcgacacctacacctgtgtggttgaacacactggcgcccccgaacctatcctccgcgattggaccccaggcttgtccccaatgcagactcttaaagtatccgtcagcgccgtgactttgggactggggctgatcatattctctttgggggtaatttcctggcgccgcgccggacactcctctgacttgatcatctcactcctgttcatcttgtag

SEQ ID NO: 43484 - DNA, 792 bp, Artificial Sequence
  Description of Artificial Sequence: Synthetic coding sequence
atgatcaccttcctgcccctgctgctgggcctgagcctgggctgcacaggcgcagggggattcgttgcccacgtggagtctacatgcctgctggacgacgccgggactcctaaagattttacttactgtatctccttcaataaggacctgctaacctgctgggatcccgaggagaataaaatggcgccctgtgagtttggtgtgctcaactctttagctaatgtactgagtcagcatctcaaccagaaggacacccttatgcagcgtctgcgcaatggcctccaaaactgtgccacgcacacacagccgttttggggctctctgacaaatcgaactcgtcccccctctgttcaagtcgcgaaaactaccccgttcaatacccgtgagccagtgatgctcgcctgttatgtatggggcttctaccctgccgaagtgacaatcacgtggagaaagaatggcaagttggttatgccacatagcagtgcacacaaaacggcccagccaaacggggattggacgtaccaaacgctatctcacctggccttgactccttcctatggggacacctacacttgcgtcgtagagcacatcggcgctcccgagcccatccttcgcgactggaccccaggtctcagtccaatgcagaccctgaaagtttcagttagcgccgtaaccctgggactgggtttgatcatcttctccctgggtgtgatcagctggcgccgcgccgggcattcttcttacacacctttaccaggctcaaattactccgagggttggcatataagctag

SEQ ID NO: 43485 - DNA, 321 bp, Artificial Sequence
  Description of Artificial Sequence: Synthetic coding sequence
gtggccaagaccacccccttcaacacccgggagcccgtgatgctggcttgctacgtttgggggttctacccagccgaggttaccataacttggaggaagaacggtaagttagttatgccccatagctctgctcacaagacagcccagccaaacggcgattggacctaccaaactctgagccacttagccctgacaccctcctacggggacacatatacatgtgtggtcgaacacaccggcgctcccgaacctattcttcgcgactggagttatacccctctgcccggcagtaattacagtgaaggctggcacatctcttag

SEQ ID NO: 43486 - DNA, 426 bp, Artificial Sequence
  Description of Artificial Sequence: Synthetic coding sequence
tgaacccggccccccagcgtgcaggtggccaagaccacccccttcaatacccgtgagccggtaatgctggcctgctatgtctgggggttctatccagctgaggtaaccattacatggaggaagaatggaaaacttgtaatgccacacagcagcgcccacaagaccgcgcagccaaatggcgactggacctaccagacgctgagccatctcgcgctgacaccatcctatggggatacatacacctgtgtggtggaacataccggggcccctgagcccatcttgagggattggacccctggtctatcaccaatgcagacacttaaggtcagtgtcagcgccgtcacactggggctgggtctgatcatcttctccctgggagttatttcatggaggcgcgccggccacagcaggtggcatatctcttag

SEQ ID NO: 43487 - DNA, 774 bp, Artificial Sequence
  Description of Artificial Sequence: Synthetic coding sequence
atgatcaccttcctgcccctgctgctgggcctgagcctgggctgcacaggtgccggtggattcgtggctcacgtggagtccacttgcctcctggatgacgctggaacaccaaaggattttacatattgtatctcgtttaataaagacctgttaacgtgctgggatcccgaggagaacaaaatggctccgtgcgagtttggcgttttgaactcacttgctaacgtgctgtcccagcacctcaaccagaaggacaccttaatgcaacggcttcggaacggcctgcagaactgtgccacccacactcagcccttctgggggtccctgaccaatagaacccgaccgccgtccgtgcaagttgccaaaaccaccccctttaacacgagagagcctgtgatgctagcgtgttatgtatggggattctatccagctgaagtcaccatcacctggcgtaaaaatggaaaattggttatgccccacagctcagcccacaagaccgcacagcctaatggcgactggacctatcaaacattgtcccacctcgcactgaccccaagctacggcgacacatatacctgtgtggtcgagcacacaggggcgcccgagcccatcctaagagattggacccccggcttgagcccaatgcagacgctcaaggtttctgtgtccgccgtgaccctgggtctagggctgatcatcttttccctcggcgtcatcagttggcggcgggctggccatagctccgatcttataatttccctgctgttcattctctag

SEQ ID NO: 43488 - DNA, 774 bp, Artificial Sequence
  Description of Artificial Sequence: Synthetic coding sequence
atgatcaccttcctgcccctgctgctgggcctgagcctgggctgcaccggggctgggggcttcgtagcccatgtggagtccacgtgcctactcgacgatgccggaactcccaaggatttcacgtattgtatcagcttcaataaagatctactcacatgctgggatccagaggaaaacaaaatggccccgtgtgagtttggagtactcaatagtctggccaatgtcttatctcagcacttgaatcagaaggacacactgatgcagagattacgcaatgggctgcaaaattgtgctacccacacccagcctttctggggctccctgacgaatcgtacgaggcctcccagtgtgcaggtggctaaaacaacaccatttaacacaagggaaccagtgatgctggcctgctatgtttggggcttctaccccgcagaggtgactataacctggagaaagaacggtaagttggtgatgccccacagctccgctcataagaccgcccagcctaacggagattggacttatcagacattgtctcatctcgccttaacgccttcgtacggagatacttatacttgcgtggtggagcacatcggcgctcctgagcctatactacgcgactggacccctggactttcccctatgcagactctgaaagtgagcgtgtcggctgttaccctaggactggggctgattatcttttcccttggggtcataagctggcggagagccggccattccagtgatttaattatttcactcttatttatactttag

SEQ ID NO: 43489 - DNA, 528 bp, Artificial Sequence
  Description of Artificial Sequence: Synthetic coding sequence
atgggccacgagcagaaccagggcgccgccctgctgcagatgctgccactgctttggcttctgccccacagctgggctgtgcctgaagaacagtccatgattacgtttttgcctcttctcctggggctcagtctgggatgtaccggcgctggcggtttcgtagcccacgtggagagtacctgcctgttagatgatgctggcactccaaaagacttcacttattgcatctccttcaataaagatctcctcacgtgttgggacccagaggagaacaagatggccccttgcgagtttggggtgttgaattcccttgccaatgttctatcccagcacctcaaccagaaggacacgctgatgcagcggctgcgaaacggcctgcagaactgcgcaacacacactcagccgttctggggttcgcttacaaatcgtactcgccctcccagcgtccaggtggccaaaactactcctttcaacactcgggagccagtgatgctggcatgttacgtgtggggcttctatcctgcttag

SEQ ID NO: 43490 - DNA, 426 bp, Artificial Sequence
  Description of Artificial Sequence: Synthetic coding sequence
tgaacccggccccccagcgtgcaggtggccaagaccacccccttcaatacgcgcgaacccgtaatgctggcgtgctatgtatggggcttttatccagccgaggtcaccataacctggaggaagaacggcaaactggtgatgccccacagctctgcccacaagacagcacagccaaacggcgactggacctatcagaccctgtcacatcttgcactcaccccttcttatggcgacacctacacatgcgtggtcgaacatattggtgctccagaaccaattttgcgtgattggacccccgggctctcccccatgcagactctgaaggtgtctgtgtccgcagtaaccttaggactgggattaattatttttagtcttggggttatttcctggaggcgtgcaggtcactctcggtggcatataagctag

SEQ ID NO: 43491 - DNA, 528 bp, Artificial Sequence
  Description of Artificial Sequence: Synthetic coding sequence
atgggccacgagcagaaccagggcgccgccctgctgcagatgctgcccctcctctggctcctcccgcactcatgggcagtgcctgaagagcaaagcatgataacattcctacccttactgctgggcctgagcctcggttgcaccggggccggcggattcgtagcgcacgtggagagcacttgtttgctggatgatgccggaacaccgaaagacttcacgtactgcataagctttaacaaggatttgcttacatgttgggacccagaagagaacaagatggccccctgtgagtttggggtcctaaacagtcttgcgaatgtgctttctcagcaccttaaccagaaggatacgttgatgcagcggctccggaacggtttgcagaattgcgctacccacacacagccattttggggtagcctaaccaaccggacgaggccccccagcgtccaggtcgcaaagaccaccccatttaacacaagggaacctgtaatgctcgcttgctacgtgtggggattttatccagcctag

SEQ ID NO: 43492 - DNA, 528 bp, Artificial Sequence
  Description of Artificial Sequence: Synthetic coding sequence
atgggccacgagcagaaccagggcgccgccctgctgcagatgctgcctctgttgtggcttctgccacactcatgggccgtcccggaggaacaatcaatgataacgtttctccctttactgcttgggctctctctgggttgtaccggcgctggcgggttcgtggctcacgttgagagcacatgcttgctggacgacgcaggaacccccaaggatttcacctattgcatctcattcaataaggatctcctgacttgttgggacccggaggagaataaaatggctccatgcgaattcggagtgctgaactcactggcaaacgtcctgagccagcaccttaaccagaaagataccttaatgcagagattgcgaaacggcctgcaaaattgtgcaacgcatacccagcccttttggggatctctgacaaatcggacgagaccaccaagtgtgcaggttgccaagactacacccttcaacaccagggaacctgtgatgctggcctgttacgtctggggtttctatccggcctag

SEQ ID NO: 43493 - DNA, 792 bp, Artificial Sequence
  Description of Artificial Sequence: Synthetic coding sequence
atgatcaccttcctgcccctgctgctgggcctgagcctgggctgcacgggggccggcggttttgtggcccatgtggagtcaacatgcttactagatgatgccggaacacctaaggacttcacctattgtatctccttcaacaaggaccttctgacatgctgggacccagaggaaaacaagatggcaccatgtgaattcggagttcttaatagcctggccaacgttctgagtcagcacttgaaccagaaggacaccctgatgcagagattgcgcaatggactgcagaactgcgcaacccacactcagccgttctggggctccctgaccaaccgcactagacccccaagcgtacaggtggcaaagacgaccccattcaatacccgagagccagtcatgttggcctgctatgtttggggcttttaccctgctgaagtaactatcacttggcggaagaacgggaagcttgtgatgcctcatagtagcgctcataaaactgctcagccaaacggggattggacctatcagacactgtctcaccttgcgttgaccccatcctatggagatacctacacatgcgtcgtggagcatactggcgctcctgagcctatcttacgcgactggaccccgggcctgtcaccaatgcagacgttgaaggtaagcgtgagtgctgtgactcttgggctggggctcattatcttttctcttggcgtcattagctggagaagggccggccacagttcatatacccccctgcctggcagtaactatagcgagggctggcatatctcttag

SEQ ID NO: 43494 - DNA, 426 bp, Artificial Sequence
  Description of Artificial Sequence: Synthetic coding sequence
tgaacccggccccccagcgtgcaggtggccaagaccacccccttcaacactcgagagcctgtgatgctggcctgttatgtgtggggtttttaccccgccgaggtgaccatcacatggcggaaaaatggcaagcttgttatgcctcactcttcggcccataagaccgctcaaccgaatggagattggacataccagaccttgagtcatttggccttaactcccagctatggcgacacatatacgtgcgtggtggaacatattggtgctccggagcctattctccgggattggacaccagggttgtctcccatgcagaccctcaaagtgagcgtgtctgctgtgacccttgggctaggactgattattttcagcctgggcgtcatatcttggcggcgggccgggcattctcggtggcacattagttag

SEQ ID NO: 43495 - DNA, 774 bp, Artificial Sequence
  Description of Artificial Sequence: Synthetic coding sequence
atgatcaccttcctgcccctgctgctgggcctgagcctgggctgcacaggtgcagggggctttgtcgctcacgtagagagtacctgtctgttagatgacgcaggaactccgaaagattttacatactgtatatcttttaacaaggatctactgacatgctgggacccggaagaaaataaaatggctccctgtgagtttggggtcttgaattcactggcgaacgtgcttagtcaacatctgaaccaaaaggacacgctgatgcagcggctgaggaacgggctgcagaactgcgccacccacacacagcctttttggggctccttaaccaacagaacacgccctcctagcgtgcaggttgccaagacaacaccgttcaacacacgggagcccgttatgttggcgtgctacgtctggggcttttaccccgctgaggtcacgataacgtggaggaaaaatggaaagctcgtgatgccccatagtagtgcgcacaagactgcgcagccaaatggggattggacataccagaccctgtcgcacttggctttgacaccaagctacggcgacacctatacatgcgtcgtggaacacattggcgctccagagcccatactcagagactggacacctggcctgagcccgatgcagacattgaaggtgtccgtgagtgctgtaactctgggattggggctcattatcttctccctgggagttattagctggcgcagggcaggccactcctctgacctgattatctctctacttttcattttgtag

SEQ ID NO: 43496 - DNA, 774 bp, Artificial Sequence
  Description of Artificial Sequence: Synthetic coding sequence
atgatcaccttcctgcccctgctgctgggcctgagcctgggctgcacgggtgcagggggattcgtggcccacgtggagagtacatgtctacttgacgatgcagggacacctaaggatttcacctactgcataagctttaataaggatctgctcacctgttgggatcccgaagagaacaaaatggcaccttgcgaattcggcgttcttaacagtcttgccaacgtgctgagccaacaccttaatcaaaaagatacccttatgcaaagattgaggaacggcctccagaattgcgcgactcacacacaaccgttttgggggagtttgaccaaccgcacgagaccaccatcggtgcaggttgccaaaactacccctttcaacacacgggagcccgtgatgctggcctgttacgtatggggattttatccagccgaagtgacaattacctggaggaagaatggcaagctggtgatgccacactcctcagcacacaagaccgctcagcccaatggcgactggacttaccagacattgtctcatctggcactcacaccttcctacggagatacttatacgtgcgtggtggagcatactggtgcccccgaacccatactacgggactggaccccaggcctcagccccatgcagaccctgaaagtctcagtcagtgccgttaccctggggctggggctgattatcttctcccttggagtgatttcttggcggcgggccggccactcctctgacctcatcattagcctcttgttcatactgtag

SEQ ID NO: 43497 - DNA, 651 bp, Artificial Sequence
  Description of Artificial Sequence: Synthetic coding sequence
atgatcaccttcctgcccctgctgctgggcctgagcctgggctgcacgggagctggcggatttgtagctcacgtcgagagcacgtgcttgttagatgatgctgggacacctaaggatttcacctactgcatctctttcaataaggacctgctcacctgttgggatccagaggagaataaaatggcaccctgtgaattcggcgtactcaattccttagctaacgttctgtcacagcatttgaaccagaaggacactctgatgcagcggctccggaatggattacagaactgtgcgacccatactcagcccttctgggggagcctgactaatagaacgcgccccccatctgtacaagttgcaaagaccacaccgtttaacaccagggagcctgtgatgctcgcttgttacgtttgggggttttatccagctgaagtgactataacatggcgcaagaacggcaagctggtcatgccccactcgagcgcacataaaactgcccagcctaacggcgattggacctaccagaccctgtcccaccttgccctgactccctcatacggcgatacttacacatgcgtggttgaacacatcggcgccccagagccaattttgagagactggagcaaatgtatggccgatggctggaactag

SEQ ID NO: 43498 - DNA, 171 bp, Artificial Sequence
  Description of Artificial Sequence: Synthetic coding sequence
atgccccacagcagcgcccacaagaccgcccagcccaacggcgactggacctatcaaactttatctcatcttgccctcacaccatcctatggagacacctacacatgtgtcgtggagcacataggtgcccctgaacccatcctgcgagactggaggtggcatatttcttag

SEQ ID NO: 43499 - DNA, 171 bp, Artificial Sequence
  Description of Artificial Sequence: Synthetic coding sequence
atgccccacagcagcgcccacaagaccgcccagcccaacggcgactggacataccagactctaagtcatttggcactcactccatcctatggggatacatacacatgtgtcgtggagcacataggcgcccctgaacccatcttgcgggactggcggtggcatatcagctag

SEQ ID NO: 43500 - DNA, 651 bp, Artificial Sequence
  Description of Artificial Sequence: Synthetic coding sequence
atgatcaccttcctgcccctgctgctgggcctgagcctgggctgcacgggggccggcggctttgtagcccatgtggagtccacctgtttgcttgacgacgcaggcacccctaaggacttcacgtactgcattagctttaacaaggacttgcttacttgctgggatccggaagagaacaagatggctccttgcgagttcggcgtactcaacagcctagccaatgtgctgagccagcatcttaaccagaaagataccttgatgcagaggcttcggaatggactgcagaactgtgccactcacacccaacccttttggggttctctcacaaatcggacccgtcccccctcagtgcaagtggctaagaccaccccattcaatacgagggagcctgttatgctcgcttgctacgtttgggggttttatcccgccgaggtgactatcacatggcgtaaaaacggcaagttagtcatgcctcactcatctgcacacaagactgcacagccgaatggggactggacttatcagacactctcacatttggccctcacaccttcctacggcgacacctacacttgcgtggttgagcacactggtgccccggaacccatcctgagagactggtctaagtgtatggctgacggatggaactag

SEQ ID NO: 43501 - DNA, 207 bp, Artificial Sequence
  Description of Artificial Sequence: Synthetic coding sequence
atgccccacagcagcgcccacaagaccgcccagcccaacggcgactggacataccagaccttgagtcacttagcactcaccccgtcatatggcgacacctatacttgtgtagtggaacacattggcgccccagagcctatattgcgcgattggtcatacacccccttacctggcagtaactactctgaggggtggcacatctcttag

SEQ ID NO: 43502 - DNA, 171 bp, Artificial Sequence
  Description of Artificial Sequence: Synthetic coding sequence
atgccccacagcagcgcccacaagaccgcccagcccaacggcgactggacatatcagaccctgtcccacctggctctaactccctcttacggcgatacttacacttgcgtggtggagcacattggggcccctgaacccattctccgggactggcgctggcatatttcctag

SEQ ID NO: 43503 - DNA, 288 bp, Artificial Sequence
  Description of Artificial Sequence: Synthetic coding sequence
atgccccacagcagcgcccacaagaccgcccagcccaacggcgactggacttaccagacactgagccacttggctcttactcctagttacggagatacttatacctgtgttgtggaacacattggcgcaccggagccaattctccgcgactggacccccggactgtcgccaatgcaaacactcaaagtgtcagtctccgccgtgacactgggcttgggtctgattatattttccctgggtgtgatctcttggagaagagcgggccactccaggtggcatatcagttag

SEQ ID NO: 43504 - DNA, 207 bp, Artificial Sequence
  Description of Artificial Sequence: Synthetic coding sequence
atgccccacagcagcgcccacaagaccgcccagcccaacggcgactggacatatcagacactgtcgcatttggccttgacaccgtcttacggagatacttatacttgcgtggtagagcacattggagcacccgagccgatcctaagagactggtcatacaccccactgcctggctcaaactattcagagggctggcatatatcatag

SEQ ID NO: 43505 - DNA, 207 bp, Artificial Sequence
  Description of Artificial Sequence: Synthetic coding sequence
atgccccacagcagcgcccacaagaccgcccagcccaacggcgactggacataccagactctctctcatcttgcacttacacctagctatggggacacttatacatgcgtcgtcgaacacattggagcaccagagccaatccttagagactggtcttataccccgttgcccggctcaaattatagcgagggatggcacatcagctag

SEQ ID NO: 43506 - DNA, 288 bp, Artificial Sequence
  Description of Artificial Sequence: Synthetic coding sequence
atgccccacagcagcgcccacaagaccgcccagcccaacggcgactggacataccagaccctttctcacttagccctgacaccttcctatggggatacatatacttgcgtcgttgaacacataggcgcccccgaacctatactgcgcgattggacaccaggcctgagccccatgcagacactaaaggtctccgtttctgcggtgaccctgggcctcgggctaatcatcttctctttgggagtcatctcatggaggagagctggccacagtcgatggcacatatcttag

SEQ ID NO: 43507 - DNA, 651 bp, Artificial Sequence
  Description of Artificial Sequence: Synthetic coding sequence
atgatcaccttcctgcccctgctgctgggcctgagcctgggctgcaccggagcggggggatttgttgcccatgtcgaatctacttgcttgcttgacgacgctggtactcctaaggacttcacctactgcattagcttcaataaggacctcctcacctgctgggatcctgaggagaacaagatggctccctgtgagttcggggtactcaatagcttggcgaatgtactttcccagcatctgaatcagaaagacactctgatgcagcgactacggaacggccttcagaactgcgcaacccatacccagcctttctggggcagtttgacaaaccggacccgcccaccctccgtgcaagtggcaaaaaccactcccttcaataccagagagcccgtcatgctggcctgctacgtgtggggcttttatcctgcagaggtgacaataacctggcggaagaatggcaagcttgtgatgccccacagctccgcccataaaaccgcccagcctaacggggattggacctatcagaccctgtcccatttagccctgacccccagttacggggacacatatacttgcgtggtggagcacataggggcccctgaaccaatactgagagattggtctaagtgtatggcggacggctggaactag

SEQ ID NO: 43508 - DNA, 207 bp, Artificial Sequence
  Description of Artificial Sequence: Synthetic coding sequence
atgccccacagcagcgcccacaagaccgcccagcccaacggcgactggacctatcagaccctctctcacctggcgctcaccccgtcatatggcgatacatatacctgcgttgtggagcacatcggtgctcctgagcctattctcagagactggtcttatacccccctccccggttccaattacagcgaaggctggcacataagttag

SEQ ID NO: 43509 - DNA, 651 bp, Artificial Sequence
  Description of Artificial Sequence: Synthetic coding sequence
atgatcaccttcctgcccctgctgctgggcctgagcctgggctgcacaggtgccggtgggttcgttgctcatgtggagtccacttgtctgcttgatgatgccggaacacccaaggactttacatattgtatctcctttaataaagacctactcacttgctgggatccagaagagaacaaaatggccccctgcgaattcggggtgctcaatagcttagctaacgtgctcagccagcacctgaaccagaaggacacactcatgcaaagactgaggaacggactgcaaaactgtgccactcatactcaacccttttggggcagcctgacaaaccgcacacgcccaccttcagtccaggtcgccaaaaccacaccctttaatacccgtgagcctgtgatgctagcctgttatgtgtggggcttctatccagctgaagtcacaatcacttggagaaagaatggaaaattagttatgccacacagcagtgcccacaagacagctcagcccaacggcgactggacttaccagactctctctcacctggcactgacaccatcttatggagatacatacacctgcgtcgtcgaacacactggcgccccagagcctattctgagagactggtcaaaatgcatggctgatggctggaactag

SEQ ID NO: 43510 - DNA, 651 bp, Artificial Sequence
  Description of Artificial Sequence: Synthetic coding sequence
atgatcaccttcctgcccctgctgctgggcctgagcctgggctgcaccggcgccggcggatttgttgctcatgtggaaagtacctgcttgcttgatgatgccggcactccaaaggattttacatactgcatctcgttcaacaaggatttgttgacctgttgggatccagaggagaataaaatggccccctgcgagttcggtgtgttgaactcgctcgccaatgtgctgtcccagcatcttaatcaaaaggacaccctcatgcagagactgcgcaacggcttgcaaaactgtgccacccatactcaaccgttttggggcagcctcactaacaggacacgacctcccagtgtacaagttgccaagactaccccttttaatacccgggaaccagtgatgctcgcctgctatgtgtggggtttctatcccgcagaggtcacgataacctggcgaaagaatgggaagttggtgatgccacacagtagtgcccacaagacagcacagcccaacggggattggacctaccagacccttagccacctagccctcacaccttcatatggggacacttatacatgtgtcgttgagcacacaggagccccagagcctatcctgagagactggagcaagtgtatggcagacggctggaactag

SEQ ID NO: 43511 - DNA, 171 bp, Artificial Sequence
  Description of Artificial Sequence: Synthetic coding sequence
atgccccacagcagcgcccacaagaccgcccagcccaacggcgactggacttatcagactctgagccacctggcacttaccccctcttacggagacacttatacctgcgtagtggaacacattggggctccggaaccaatcctaagggactggcgatggcatatttcgtag

SEQ ID NO: 43512 - DNA, 651 bp, Artificial Sequence
  Description of Artificial Sequence: Synthetic coding sequence
atgatcaccttcctgcccctgctgctgggcctgagcctgggctgcaccggtgctgggggattcgtcgcacacgttgaatctacgtgcttgctggatgatgcgggcactccaaaggatttcacctattgcatatccttcaataaagacctcctcacttgttgggatcccgaagagaataagatggctccctgcgagttcggcgtcctgaactctttagccaatgtgttatctcaacatctgaatcagaaggacaccctaatgcagaggctgcgcaatggccttcagaactgtgcgactcatacacagccgttttggggcagcctgactaatcgtacccggcccccttctgttcaagtggcgaaaacaacaccctttaatactagggagccggttatgctagcatgctacgtctggggcttttaccctgctgaagtcaccataacatggaggaagaacggaaagctcgtgatgccacacagctccgcacacaagaccgcccagccaaatggagattggacatatcagaccctttctcacttggcgcttactcctagctatggggacacctatacctgtgttgttgaacatattggtgctcccgaacccattttacgcgactggtccaaatgcatggctgacggctggaactag

SEQ ID NO: 43513 - DNA, 288 bp, Artificial Sequence
  Description of Artificial Sequence: Synthetic coding sequence
atgccccacagcagcgcccacaagaccgcccagcccaacggcgactggacatatcagacattgtcccacctcgctctcacccccagctacggcgatacttatacctgtgttgttgagcacattggagctccggagcctatcttgcgggattggacccccggcttgagcccaatgcagacgctgaaagtgtccgtgagtgccgtgaccctggggctgggccttatcatcttctcactgggagtaatcagttggcgccgagctggccattcacgttggcacatatcatag

SEQ ID NO: 43514 - DNA, 288 bp, Artificial Sequence
  Description of Artificial Sequence: Synthetic coding sequence
atgccccacagcagcgcccacaagaccgcccagcccaacggcgactggacctatcagactttgtcccatctggctcttaccccctcttacggcgatacatacacatgtgtcgtggaacacattggcgctcccgagcccattctgagagactggacacctggcctctctcccatgcagacactgaaagtgtcagtttccgctgtcaccctcggtttagggctcattatatttagcctcggagtcattagctggagaagagcaggacacagcaggtggcatattagctag

SEQ ID NO: 43515 - DNA, 651 bp, Artificial Sequence
  Description of Artificial Sequence: Synthetic coding sequence
atgatcaccttcctgcccctgctgctgggcctgagcctgggctgcacgggcgctggggggtttgtggcccacgtggagtccacctgcttgttggatgacgcagggactcctaaggactttacttactgcatcagctttaataaagatctgttaacatgctgggatcctgaagagaacaagatggccccctgcgaatttggtgtgttgaacagcctggcgaacgtgctgtctcagcatctaaaccagaaagacaccctaatgcagcggctgcgtaacgggctccagaattgtgcaactcacacccaacccttttgggggtcccttaccaatcgtacacggcctccgtcagttcaggtcgccaaaacaacaccattcaacacacgggagccagttatgctcgcctgttacgtgtggggtttctaccctgctgaggtgaccatcacctggcgaaagaacggcaagttggtcatgccccattcatccgctcataagactgcacaaccaaacggggattggacatatcaaaccctatcccacctggcgttgaccccgagctacggagacacctatacctgcgtggtggaacacataggagcccccgagccaattttgagagattggagcaaatgtatggcagacggctggaattag

SEQ ID NO: 43516 - DNA, 465 bp, Artificial Sequence
  Description of Artificial Sequence: Synthetic coding sequence
atggccggcggcggcccccaggccaaccccgactacctgttccacgtaatttttctgggagactctaatgtcggcaagacttcctttctccacctcctacaccagaacagtttcgccaccggactgaccgccaccgtgctgcaccccagtctctgcgtcctgggagtagactttcgggtcaagaccctgctggtggacaacaagtgttttgtcttacagctctgggatacagccggtcaggaaaggtaccacagcatgactcgccaattgctgcgtaaggcagacggcgtggttttgatgtacgacattacctctcaggaatccttcgctcatgtaagatactggcttgattgcctccaagacgcgggcagtgatggtgtggttattctgctactggggaataagatggactgtgaagaagagcgccaagtgagcgtagaagcaggacagcagttggcccaatag

SEQ ID NO: 43517 - DNA, 261 bp, Artificial Sequence
  Description of Artificial Sequence: Synthetic coding sequence
atggccctgcgggccggcctggtgctgggcttccacaccctgatgacacttctctctccgcaggaggctggggctaccaaggggagggccggtcgacatcggaggaaccaatcaccctcaggccaccctgggggcgctttacagccacagcagtcccaccagagggcttcaacgggggaccgggccccccaggtgtctgggggtgccggacccgcccagcatccccatctacaccggggtcagcacctgcctccgtgctag

SEQ ID NO: 43518 - DNA, 261 bp, Artificial Sequence
  Description of Artificial Sequence: Synthetic coding sequence
atggccctgcgggccggcctggtgctgggcttccacaccctgatgacactcctgtctccacaggaggccggagccaccaaggggagagcggggcgtcacaggcgcaatcaaagcccatctggccaccccgggggggccctccagccccagcagtcccaccaaagggctagcactggcgaccgggccccccaagtgtccggtggcgcagggcccgcccagcacccccacctgcatcgggggcaacatctccctccctgttag

SEQ ID NO: 43519 - DNA, 753 bp, Artificial Sequence
  Description of Artificial Sequence: Synthetic coding sequence
atggccctgcgggccggcctggtgctgggcttccacaccctgatgacattgctcagccctcaggaagcaggagccactaaggcggaccatatggggtcctacgggcctgccttctatcagtcttacggcgccagtggacagttcactcacgaatttgacgaggagcagctgttctcagtggatttaaagaagtcagaagccgtctggcgcttgcctgaatttggggactttgcccgcttcgacccacagggtggactcgcagggattgccgccattaaggctcacctggacattctcgtggagaggtctaatcgcagccgcgctattaatgtgccgccgcgggttaccgtgttaccgaaaagccgggtggagttggggcagccaaacatcttgatatgtattgtcgataacatctttcctccagtgataaacattacatggctcagaaatgggcagacggtgacagaaggagtcgctcagactagcttttatagccagcctgaccatttgttccgaaagttccattacctacctttcgtgccatccgccgaagatgtttacgattgccaggttgaacattgggggttggacgcgcccctcctgagacactgggaacttcaggttccaatcccgccccctgatgcaatggagaccctggtctgtgccttggggcttgctattggattggtcggctttctggttggaacagtccttattatcatgggcacttacgtcagtagcgtcccaaggtag

SEQ ID NO: 43520 - DNA, 261 bp, Artificial Sequence
  Description of Artificial Sequence: Synthetic coding sequence
atggccctgcgggccggcctggtgctgggcttccacaccctgatgacactgttaagtccacaggaggccggcgccacaaaaggctgggccggaagacaccgtaggaaccagtcacccagcggccatccagggggagccttgcagccgcagcagtcccatcagagagcatccactggcgatagggcccctcaggtgagtgggggtgctggccctgcccaacatccccatctgcatcggggccagcatctgcccccctgctag

SEQ ID NO: 43521 - DNA, 261 bp, Artificial Sequence
  Description of Artificial Sequence: Synthetic coding sequence
atggccctgcgggccggcctggtgctgggcttccacaccctgatgactttactcagccctcaggaggccggggccactaaaggcagagccggacggcatcgccgcaatcagtcacccagtgggcacccaggtggggcgctccagccccagcagtcacatcagcgcgcctcaactggggacagggccccgcaggtgagcgggggcgccggacctgctcagcacccacatctccataggggacagcatctgccaccttgctag

SEQ ID NO: 43522 - DNA, 753 bp, Artificial Sequence
  Description of Artificial Sequence: Synthetic coding sequence
atggccctgcgggccggcctggtgctgggcttccacaccctgatgacacttctgtcaccccaggaggccggcgccaccaaggcagatcatatgggatcttatggaccagcattctaccaaagttatggtgctagtggtcagtttacacacgagttcgacgaagagcagctgttcagtgtggacctgaaaaaatccgaagccgtatggcgcctgcccgaattcggggacttcgcacgttttgatcctcagggagggctggctggcattgcagccatcaaggcccacctggatatcctggtcgaaagatccaaccgctcacgggctattaacgtgcctcctagagtgaccgtgcttcccaagtctcgcgtggagttgggacaacccaatatactgatttgtatcgttgacaacatcttcccaccggttatcaatatcacatggctgaggaacggtcaaacagtgacagagggcgtggctcagactagtttttattctcagcccgaccacttgttcagaaagttccattacttgcccttcgttccgtctgccgaagacgtgtacgactgtcaggtagaacattgggggctggatgccccactgctgagacactgggagttgcaggttcctatccctccacctgatgcaatggagacacttgtttgtgctctgggattagctatcggactggtgggcttcttagttggtactgtgcttatcattatgggcacatacgttagctcagtacccaggtag

SEQ ID NO: 43523 - DNA, 753 bp, Artificial Sequence
  Description of Artificial Sequence: Synthetic coding sequence
atggccctgcgggccggcctggtgctgggcttccacaccctgatgaccctattgagcccgcaggaggccggcgcgacgaaagccgaccacatgggctcttatggccctgcattttatcaatcctatggcgcctcgggacagtttacccacgagtttgatgaggagcaactcttttccgttgatctgaagaagagcgaggccgtgtggcgactacctgagttcggggacttcgcccggttcgacccacaggggggattggcaggaattgccgccattaaagcgcatctggatatcctggttgagcgatccaacagaagccgcgccatcaacgttccacctcgtgtgacagttctgcccaagagtagagtggagctgggacagccaaatatccttatatgtatcgtcgacaatatcttccctcctgtgattaatataacttggttaagaaatggacagactgtaaccgagggagtggcgcaaacctctttttactcacagccggatcatctgtttcggaagtttcattacctgcctttcgttccgagcgccgaggacgtatatgattgccaagtagaacattggggtctggacgccccgttactgcggcactgggaattgcaggtacccatacccccacccgacgccatggaaacgctagtgtgcgcacttgggcttgcgatagggctggttggctttttagtgggaactgtgctgatcattatgggcacgtatgtgagcagtgtgcctaggtag

SEQ ID NO: 43524 - DNA, 186 bp, Artificial Sequence
  Description of Artificial Sequence: Synthetic coding sequence
atggccctgcgggccggcctggtgctgggcttccacaccctgatgacactactgagtccgcaggaagccggtgccacaaaagcagatcacatgggctcttacgggcctccctctacttccttgaccgccccaagagcttcaagccccatgaacttaatgagaaattcctgttctctatggacatag

SEQ ID NO: 43525 - DNA, 753 bp, Artificial Sequence
  Description of Artificial Sequence: Synthetic coding sequence
atggccctgcgggccggcctggtgctgggcttccacaccctgatgaccctactctcaccccaagaggctggcgccaccaaggcagatcacatgggctcatatggaccagccttttaccagagctacggggctagcgggcagtttacccacgagtttgacgaagaacagctttttagtgtggacctcaaaaagagtgaggccgtttggagactccccgaatttggagacttcgcaagatttgatccgcagggcggcctggccgggatcgccgcaataaaggctcatttggatatcttggttgaacgctctaaccgctccagggctattaacgtgccccccagggtcactgtgctccccaagtccagagtggagctgggccagccgaatatcctcatatgcatcgtagataacatttttcccccagtaatcaacatcacctggctgcgcaacggtcaaacagtgaccgaaggagtggcccagacctcattctactcgcagccggaccatctcttcaggaagttccactatctgccatttgtaccttccgctgaggatgtttatgattgccaggttgaacactggggactggacgcccctctcttgcgccactgggagctgcaggtccccataccccctcctgatgccatggagacactggtgtgcgcactcggtctggccattggtctggtcggtttcctggtgggaacagttctcatcatcatgggaacatacgtgtcctctgtcccccggtag

SEQ ID NO: 43526 - DNA, 753 bp, Artificial Sequence
  Description of Artificial Sequence: Synthetic coding sequence
atggccctgcgggccggcctggtgctgggcttccacaccctgatgacgctattgagcccccaggaagcaggggccaccaaggctgaccatatgggctcatatggaccggccttttaccagagctacggtgcatctggtcagtttacccacgagtttgatgaagaacagttgttctctgtggatttgaaaaaatcagaggccgtgtggcgcctgcccgagtttggagattttgcccgatttgaccctcagggcggactggccggcattgccgcaataaaggcacatcttgatatactggtcgagcggtctaaccgtagcagggctattaatgtgccaccacgagtcacggtgctccctaagagcagggtcgaattagggcaacccaacattttgatctgcatcgtggacaatatcttccctccggtgattaatataacatggttaaggaacggccagaccgttaccgagggcgtcgctcagaccagcttttattctcagccggatcacctgtttcgcaagtttcactatctaccgttcgtgccttccgcggaggatgtgtacgactgccaggtggaacattgggggctggatgctccccttctgcggcactgggagctgcaagttcccattcccccacctgatgccatggaaacactggtgtgtgcactaggcctggctattgggctagtgggtttcctggtgggaactgtcctaattatcatgggaacctacgtatcctcagttccaagatag

SEQ ID NO: 43527 - DNA, 261 bp, Artificial Sequence
  Description of Artificial Sequence: Synthetic coding sequence
atggccctgcgggccggcctggtgctgggcttccacaccctgatgactctgctctcaccacaagaagccggcgccaccaagggacgggccggacgacacagacggaatcagtcccccagcgggcaccctgggggcgcactgcagccccagcagtcacatcaaagagctagcaccggggaccgagcaccacaggtttctggaggcgcagggcctgcccagcacccacatctccatagggggcagcacctgcccccctgctag

SEQ ID NO: 43528 - DNA, 615 bp, Artificial Sequence
  Description of Artificial Sequence: Synthetic coding sequence
atgggcagctacggccccgccttctaccagagctacggcgccagcgggcagtttacccacgaattcgatgaggagcaactgttcagcgtcgatttaaaaaaaagcgaggccgtttggcgacttccagagttcggcgactttgctcgttttgaccctcagggggggctcgcagggatcgcagcgattaaggctcatctggatatcttggttgagaggtccaatcgctcccgcgctattaacgtaccccccagggtgactgtgcttccaaaaagcagggtcgagctagggcagcctaacattctgatatgcatcgtcgataacatatttccccccgtgattaatatcacctggctgaggaatggtcagaccgtcacagaaggcgtggcccaaacttctttctatagtcagcccgatcacttgtttaggaagtttcactacctccctttcgtgccctccgcggaggatgtctacgactgccaggtcgaacattggggcctggatgcgcccttgctgcgccactggggaaacgacccttcagaaagaaacgatctgtgggaaaccccgtgccgttcctcctgggtctgcgactccccctgtgtcctttctgctctgtag

SEQ ID NO: 43529 - DNA, 753 bp, Artificial Sequence
  Description of Artificial Sequence: Synthetic coding sequence
atggccctgcgggccggcctggtgctgggcttccacaccctgatgactctcttgagtccccaggaggccggcgccacaaaggccgaccacatgggatcctacggtccagctttttaccagagctatggagccagcggtcaatttactcatgaattcgatgaagaacaactgttttctgtggacttgaagaagtctgaggcagtctggcggctgcccgagtttggggatttcgctagatttgacccccagggtggcctggcagggattgcagcgatcaaggcccatctcgacatacttgtcgagcgctcaaataggtccagggccatcaatgtgccccctcgggtgacagtgctgccaaagtctagggtagaactaggacagccaaatattcttatatgtatagtcgacaacatcttcccaccagtgatcaacatcacatggttgcggaacggtcagaccgtcacagagggcgttgcccaaacgtctttttatagtcagcccgaccacttgttcagaaaatttcactacttgcccttcgtgccctctgctgaggacgtctatgattgccaagtggagcactggggccttgacgcccccctcctgaggcattgggagttgcaagttccaatcccccctccagatgccatggaaacgctggtgtgtgccctcggtctggcaatagggctagtgggcttcttagtcggaaccgtcctgattataatgggaacctatgtgtccagtgtccctaggtag

SEQ ID NO: 43530 - DNA, 261 bp, Artificial Sequence
  Description of Artificial Sequence: Synthetic coding sequence
atggccctgcgggccggcctggtgctgggcttccacaccctgatgacactactgagcccacaggaggccggtgccacaaagggctgggcagggcgtcatcgtcgtaaccagtctcccagcggtcatccaggtggcgccctacaacctcaacagtcacaccaacgggctagcacgggggaccgtgctccccaagtcagcggaggtgccggcccggcccagcacccacatctgcacagggggcagcacttgccgccatgctag

SEQ ID NO: 43531 - DNA, 261 bp, Artificial Sequence
  Description of Artificial Sequence: Synthetic coding sequence
atggccctgcgggccggcctggtgctgggcttccacaccctgatgaccttactgagtccgcaggaagccggtgctactaaaggccgggcagggaggcacaggaggaaccagagcccgagcggccaccccgggggcgccttgcaaccccagcagtcgcaccagcgtgcaagcacgggtgaccgggccccacaggtgagcggcggagccggtccagctcaacaccctcaccttcatcggggtcagcatctgccaccctgttag

SEQ ID NO: 43532 - DNA, 186 bp, Artificial Sequence
  Description of Artificial Sequence: Synthetic coding sequence
atggccctgcgggccggcctggtgctgggcttccacaccctgatgacactcctatcaccacaggaggccggggctaccaaagccgaccacatgggtagttatgggcctccgtcaacatccctgaccgccccaagagcaagtagcccaatgaatttgatgcgcaatagctgctccctgtggacatag

SEQ ID NO: 43533 - DNA, 186 bp, Artificial Sequence
  Description of Artificial Sequence: Synthetic coding sequence
atggccctgcgggccggcctggtgctgggcttccacaccctgatgacactgctctcaccacaggaggccggagcgaccaaagctgatcacatgggttcatatgggcccccctcaacatccctgacagccccccgtgccagctctccgatgaatctgatgcgcaactcttgctccctctggacctag

SEQ ID NO: 43534 - DNA, 615 bp, Artificial Sequence
  Description of Artificial Sequence: Synthetic coding sequence
atgggcagctacggccccgccttctaccagagctacggcgccagcggacaattcacacacgagtttgacgaggaacagttgttttctgtagacctgaagaaatccgaagctgtatggaggctacctgagttcggtgactttgctagatttgatccacaaggtggattagccggaatagccgctattaaggcgcatctggacattttggttgaacggagcaacaggagcagagctatcaatgttccccccagagtgacagtgcttccaaagtccagagtggagctggggcagccgaatattctcatctgcatcgtagacaacatattcccacctgttatcaatattacttggttgaggaacggacagacagtgaccgagggggttgctcagaccagcttttattcccagccggatcaccttttcaggaagttccattatttaccattcgtccctagcgccgaggacgtgtatgactgccaggttgaacattggggtctcgatgcgccattacttcgccattggggaaacgacccttccgaacgcaacgatttatgggagaccccgtgccggtctagttgggtatgcgacagcccatgcgtgttgagtgccctttag

SEQ ID NO: 43535 - DNA, 615 bp, Artificial Sequence
  Description of Artificial Sequence: Synthetic coding sequence
atgggcagctacggccccgccttctaccagagctacggcgccagcggccaattcacccacgaattcgacgaagagcagctgtttagcgtggaccttaaaaaaagtgaggctgtgtggcggctgcccgaattcggcgactttgcccgctttgacccccaaggaggacttgcaggaatcgctgccattaaagcccatctggacatcctggtagagcgtagcaatcgctctagagccattaatgtgcctccccgtgttaccgttctgcccaaatccagggtggaactgggccagcccaatatcctgatctgcatagtagacaacatttttcctcctgttattaatatcacatggttgcgcaacggccagacagtcacagaaggtgtggctcagacttccttctatagtcagccggaccatttgtttaggaagtttcattatctgccctttgtgccatctgctgaggacgtttatgactgtcaggtcgagcactggggcctcgatgccccgcttctgcgccactggggaaacgaccccagcgagaggaatgacctgtgggagactccttgccgctccagttgggtgtgtgacagcccctgcgtcctgtccgctctatag

SEQ ID NO: 43536 - DNA, 615 bp, Artificial Sequence
  Description of Artificial Sequence: Synthetic coding sequence
atgggcagctacggccccgccttctaccagagctacggcgccagcggccagttcacccatgagttcgacgaggagcagctgttctccgtcgacttgaaaaagtcagaggccgtctggcgcctgccagagttcggggactttgcccgcttcgacccccaaggtggtctagccggaattgcagcgatcaaggcacacctggacattttagtggagcgctctaaccggtccagagccattaacgtcccaccgagagtcacagtgttgcctaaaagtcgggtagaactggggcaacctaacatcctgatctgtattgtggacaacatctttcctccggtgatcaatataacttggttgaggaatggccaaactgtgacagagggggtggctcaaacctcattctactcccagcccgatcacctgtttaggaaatttcactacctgcccttcgtgccgtcagctgaagatgtctatgactgccaagtggagcactggggcctagacgcccctctcctccgacactgggggaacgatcctagcgaaagaaatgacctctgggagacaccgtgccgtagcagctgggtatgtgattctccttgcgtgttgtcagccctgtag

SEQ ID NO: 43537 - DNA, 186 bp, Artificial Sequence
  Description of Artificial Sequence: Synthetic coding sequence
atggccctgcgggccggcctggtgctgggcttccacaccctgatgacactgctgagtcctcaggaagcaggcgccacgaaagctgatcacatgggaagttatgggcccccttcaacctccctgactgctccgcgcgccagctcacctatgaatctcatgagaaatagctgctcattgtggacttag

SEQ ID NO: 43538 - DNA, 615 bp, Artificial Sequence
  Description of Artificial Sequence: Synthetic coding sequence
atgggcagctacggccccgccttctaccagagctacggcgccagcggccagttcacacacgagttcgacgaagagcaactattttctgtggacctgaaaaaatccgaggcagtgtggaggctgcctgagttcggcgatttcgcccgatttgacccccaggggggtctagctggtattgcagcaatcaaggcccatctggatattctggttgaacgcagcaaccggtccagagctataaatgtgccacctagagtaaccgtcttgcccaagtcccgggtggaactaggccagccaaacatcctcatctgtattgtggataatatctttccacccgtgatcaatattacctggctgcggaatggacaaactgttacggaaggagttgcacagacttccttttactcccagccagatcacctttttcgcaagttccactacctgccctttgtaccttccgctgaggacgtgtatgactgccaggtggagcactggggcctggacgcacctttacttagacactggggtaacgacccttctgaacggaatgacctctgggaaactccctgtagaagctcatgggtttgtgattccccgtgcgtcttgtccgctttatag

SEQ ID NO: 43539 - DNA, 615 bp, Artificial Sequence
  Description of Artificial Sequence: Synthetic coding sequence
atgggcagctacggccccgccttctaccagagctacggcgccagcggccagttcacccacgaattcgatgaagagcaactgttcagcgtcgatctgaaaaaatccgaagctgtgtggaggctgcctgaatttggagactttgccaggttcgacccacagggtggactcgccggaatagccgctatcaaggcacaccttgacattctggtagaacggagtaaccgatctcgagctattaatgtccccccgagggtgacagtgttacctaaaagtcgagtggagctaggacagccaaacatactcatttgtatagtagacaatatcttccctccagtaatcaatattacatggcttcgaaacggccagaccgtgacggagggtgtggctcaaacctcattttattcgcagccagaccacctgttcagaaaattccactatcttccttttgttccctctgccgaggacgtgtacgactgccaggtggaacactgggggcttgatgcccctctgctgaggcattggggcaatgatcccagcgagagaaatgacctatgggagactccgtgtaggagttcttgggtgtgtgattccccttgcgtgctctcagccctatag

SEQ ID NO: 43540 - DNA, 186 bp, Artificial Sequence
  Description of Artificial Sequence: Synthetic coding sequence
atggccctgcgggccggcctggtgctgggcttccacaccctgatgacgctgctgagcccccaggaggccggagctacaaaagctgatcacatgggctcatacggacctccctcgactagccttacggctccacgagccagctctcccatgaacttgatgcgtaacagctgttcactctggacttag

SEQ ID NO: 43541 - DNA, 186 bp, Artificial Sequence
  Description of Artificial Sequence: Synthetic coding sequence
atggccctgcgggccggcctggtgctgggcttccacaccctgatgaccctgctttcaccacaggaagccggggccacaaaggcagatcacatgggctcatatggacccccatcgacctcactgacagcacccagggcctctagtcccatgaacctcatgcggaattcttgctctctctggacctag

SEQ ID NO: 43542 - DNA, 186 bp, Artificial Sequence
  Description of Artificial Sequence: Synthetic coding sequence
atggccctgcgggccggcctggtgctgggcttccacaccctgatgacgctgttgtccccacaggaggctggcgcgacaaaagcagaccacatgggatcatatggcccccctagcacctcgctgacagcacccagagcctcctcccccatgaatctgatgcggaattcttgttcactgtggacctag

SEQ ID NO: 43543 - DNA, 615 bp, Artificial Sequence
  Description of Artificial Sequence: Synthetic coding sequence
atgggcagctacggccccgccttctaccagagctacggcgccagcggtcaattcacccatgagttcgacgaggagcagctcttttcagtcgacttgaagaagtccgaagctgtctggcgactgcctgaatttggggactttgccaggttcgacccacaaggaggcttggcggggatcgcggcgatcaaggcccatctcgacatacttgtcgaaaggtccaatagatccagagcaatcaatgtccctcccagggtgaccgtcctacccaaaagtagggttgagctggggcagcccaatatccttatctgcatcgttgacaacatcttccctccggttattaatatcacttggctgcgtaacggccagactgtgacagaaggcgtggcccagacatctttttactcacaaccggaccatctttttcgcaagtttcattaccttcctttcgtgccttcggcagaggatgtctacgattgtcaggtagaacattggggccttgacgctccactgttgaggcattgggggaacgaccctagcgagcggaacgacttgtgggagacaccatgtagatctagttgggtatgtgattccccttgcgtgctgtccgccttgtag

SEQ ID NO: 43544 - DNA, 549 bp, Artificial Sequence
  Description of Artificial Sequence: Synthetic coding sequence
tgaaacctgacccggctggacagcagcatgacccagggcaccgactctcccgaagacttcgtgatacaggccaaggctgactgttatttcacaaacgggaccgaaaaagtccagtttgttgtgcgctttatcttcaacctggaggagtacgttcggtttgactcagacgtcggcatgttcgtcgctctaactaaactcggacagccggacgccgagcaatggaattccaggctggatttgctcgagaggtcaagacaggccgtggacggggtctgtaggcacaactaccggctgggagctccattcacagtaggacgaaaggaggtgacagtgtatccagaacgaacccctctgcttcaccagcacaatcttctgcactgctccgtgaccgggttctatcctggcgacatcaagatcaaatggtttttgaatgggcaggaggagagagcgggcgtgatgtctacgggccctatacgcaatggtgattggacttttcaaaccgttgtcatgctggaaatgactcctgaactgggtcacgtgtatacctag

SEQ ID NO: 43545 - DNA, 822 bp, Artificial Sequence
  Description of Artificial Sequence: Synthetic coding sequence
atgggcagcggctgggtgccctgggtggtggccctgctggtgaacctgacgaggctggactcctctatgacacagggaaccgactcaccagaagatttcgtaatccaggctaaagccgactgctatttcacaaacggaaccgaaaaagttcaatttgtagtgcgattcatctttaatctggaggaatacgtgagattcgacagtgacgtgggaatgttcgttgccctaaccaagctgggacagccggacgcagaacagtggaattctcgtcttgatctcctcgagaggtctcggcaagccgtggatggtgtgtgccggcacaattacaggttaggcgcccctttcacagtcggtaggaaggtgcagcctgaggtgacagtctatccagagcgaactcctctgctccatcaacacaacctgctgcattgctcagtgaccgggttctatcctggtgacattaaaattaagtggttcctgaatggacaggaggaaagagccggcgtgatgagcacaggccccataagaaacggcgattggacctttcagacagtcgtgatgttggagatgaccccagaactcggtcacgtctatacatgcctcgttgatcattccagcttactgtccccagtgagcgtcgaatggcgggctcagtcagaatacagctggcggaagatgctgtccggaatcgccgctttcttactcggcctgatttttctcctggtcggtattgtcatccagctgagggcacagaaggggtatgtcagaacccagatgtcgggcaatgaagtttctcgggccgtccttctgccccagtcatgctag

SEQ ID NO: 43546 - DNA, 822 bp, Artificial Sequence
  Description of Artificial Sequence: Synthetic coding sequence
atgggcagcggctgggtgccctgggtggtggccctgctggtgaacctgactagactcgattccagtatgacacaagggaccgacagtcccgaagactttgtgatccaagctaaagccgactgctacttcactaacgggacagaaaaagtacagtttgtggtgcggttcatctttaatctggaagagtacgtgagatttgacagcgacgtgggcatgttcgttgctctcacgaaacttggccaaccggacgcagaacagtggaactcccggctggatttgcttgaaaggagccggcaggcagtagatggagtctgccgccataactaccgtttaggagctccttttaccgtgggaagaaaagtgcagccggaagtgacagtctacccagaacggacacctctgctacatcagcacaatctgttacactgctccgtgaccggattctatcccggggacataaagataaaatggttcttgaacggtcaagaggagcgggccggagtgatgtcaacagggcccatcagaaacggtgactggacattccagaccgtggtgatgctcgaaatgacccccgaactggggcacgtgtacacctgtctggttgatcactcctcccttctgtcccctgtttctgtggagtggagggcacaaagtgagtatagctggagaaagatgctcagcggcatcgccgcattcctgctgggactgatcttcctactagtgggtatagtgatccagctcagagcacagaagggctatgtcaggacccagatgagcggaaacgaagtttccagggcagtgctgctacctcagtcttgctag

SEQ ID NO: 43547 - DNA, 549 bp, Artificial Sequence
  Description of Artificial Sequence: Synthetic coding sequence
tgaaacctgacccggctggacagcagcatgacccagggcaccgacagtcccgaggacttcgtaatacaggctaaggccgattgttatttcacaaacgggaccgagaaggtgcaattcgtagtcaggtttatttttaatctcgaggagtatgttagattcgattcagatgtcggaatgtttgtagccctcactaagctggggcaacctgacgccgagcaatggaatagccgacttgacctgctcgagaggagccgtcaggccgtggacggagtttgtagacataactacagactcggggcacctttcactgtggggcggaaggaggtgacagtttaccctgagagaacacccctgctacaccagcacaacctactgcattgctctgtcacaggattttatccaggcgatatcaagattaagtggtttttaaatggtcaggaggagagggccggtgtaatgtccactggtcctatccgtaatggagactggacattccaaacagtcgtaatgctggagatgaccccagagctaggccatgtatacacatag

SEQ ID NO: 43548 - DNA, 822 bp, Artificial Sequence
  Description of Artificial Sequence: Synthetic coding sequence
atgggcagcggctgggtgccctgggtggtggccctgctggtgaacctgaccagattagactctagcatgacccagggtacagacagtccagaggatttcgttatacaagccaaggccgattgctacttcactaacggcaccgaaaaagtacagttcgtggtgagattcatcttcaacttagaggaatacgtccgcttcgacagcgatgtgggtatgtttgtcgctcttacaaaactaggacagccggatgccgaacagtggaactctcgattggacttgctggaacggtcaagacaggcagtagatggagtgtgcaggcataattaccgtctgggcgcccccttcaccgtcggcaggaaagtgcagccagaggtgacagtgtatccagagaggactcctctgctgcatcagcacaatctcttgcattgttcggtgactggtttctacccaggagacataaaaatcaaatggttcctcaatggccaggaggagagggccggagttatgagtactggccctatccgcaacggcgactggaccttccagaccgtagtgatgcttgaaatgacgcctgaactagggcacgtgtacacttgtcttgtggatcatagttctctgttgagtccagtgagcgtggagtggagagctcaaagcgagtacagctggcgcaagatgctttcaggtatcgccgcgtttctcctggggctaatcttcctgcttgtaggcatcgtcatccaactgcgagctcagaagggttatgtgagaacgcagatgtctgggaacgaagtttccagggccgtcttactgccccagagctgctag

SEQ ID NO: 43549 - DNA, 549 bp, Artificial Sequence
  Description of Artificial Sequence: Synthetic coding sequence
tgaaacctgacccggctggacagcagcatgacccagggcaccgactccccggaggactttgttattcaggcaaaggccgactgctactttacaaatggtactgagaaggtgcagtttgtggtgagattcatttttaatttggaagagtatgttcgattcgatagcgacgttggcatgtttgttgcactgaccaaactgggccagccagatgccgaacagtggaactcgaggcttgacttgctggagcgcagtcgtcaggccgtggatggagtttgccgccacaactacagattgggcgcaccttttacagtagggcggaaggaggtgacggtttaccccgagagaactcccttgctgcaccagcataatcttcttcactgctccgttacgggcttttacccaggggatatcaagatcaaatggtttcttaatgggcaagaggagcgggctggcgtgatgagcactggcccaattcgtaacggcgattggacctttcagaccgtcgtgatgctcgagatgactccggaacttggacatgtgtacacttag

SEQ ID NO: 43550 - DNA, 549 bp, Artificial Sequence
  Description of Artificial Sequence: Synthetic coding sequence
tgaaacctgacccggctggacagcagcatgacccagggcaccgacagtccagaagactttgtgatacaggctaaagcggattgctattttactaatggcacagagaaagtgcaatttgtagtgagattcatttttaatttggaggaatatgttcggtttgatagcgacgttggaatgttcgtggctctaacaaaactcgggcagccagacgctgaacaatggaatagtagactagatctgttagaacggtcaaggcaggcggtagatggcgtgtgcaggcacaactaccgcctgggagctccatttactgtgggaaggaaggaggtgacagtataccccgagagaacgcctcttctacatcaacacaacctgctgcattgttcagtgactgggttttatcctggagacatcaagatcaaatggttcctcaatggtcaggaggagcgggctggcgtgatgagcaccggccctattcgcaatggggattggaccttccaaacagtggtaatgctcgagatgacacccgaactggggcacgtctacacctag

SEQ ID NO: 43551 - DNA, 549 bp, Artificial Sequence
  Description of Artificial Sequence: Synthetic coding sequence
tgaaacctgacccggctggacagcagcatgacccagggcaccgactcccctgaggacttcgtgatccaagcaaaggcggactgctacttcactaatggaaccgagaaggttcagttcgtggttaggtttattttcaacctggaggagtacgtccgcttcgatagtgatgttgggatgtttgttgctctaacaaagctgggacagccagacgcagagcagtggaatagcaggctcgacctgctggaaagatccagacaggctgtggacggtgtctgcaggcataactacagacttggagcccctttcacggtaggtagaaaggaagtgactgtataccccgaaaggactcccctgctgcaccagcataatctgctgcattgcagcgtcacgggcttttaccctggagatattaagatcaaatggttcctaaatggccaagaggagagagccggggtaatgagcacgggccccatcaggaacggagattggactttccagacagttgtaatgttggaaatgacaccagaactggggcatgtgtacacctag

SEQ ID NO: 43552 - DNA, 822 bp, Artificial Sequence
  Description of Artificial Sequence: Synthetic coding sequence
atgggcagcggctgggtgccctgggtggtggccctgctggtgaacctgactcgtttagattcaagtatgacacagggcacagattcccccgaggacttcgtgatacaggcaaaggccgactgctattttacaaacggaactgaaaaagtccagttcgtggtcaggtttatttttaatttggaggagtatgtcagatttgattcagacgttgggatgttcgtggcactcaccaaattgggccaacctgacgccgaacagtggaatagccgcctggacctgcttgaacgcagcagacaggccgtggatggagtttgcagacacaactataggctgggcgctccctttacagtaggaagaaaagtgcaaccagaggtaacggtttaccccgagaggactcctttgctccatcagcacaatctgctccattgcagtgtgaccggattctatccaggagatataaagattaaatggttcctaaatggacaggaggagcgagccggcgtcatgagcacaggtcctataagaaacggcgactggaccttccaaaccgtagtgatgctggaaatgacccctgagctgggacacgtgtacacctgccttgtggatcattcgagcctactctctcccatttcagttgagtggagagcccagtcggagtactcatggagaaaaatgctatctgggatcgccgccttcctgctgggactgattttcctgctcgtgggaattgtgatccaactccgggcccagaaagggtatgtgaggacccagatgtctggcaacgaggtgagccgggccgttcttctcccacagagttgctag

SEQ ID NO: 43553 - DNA, 822 bp, Artificial Sequence
  Description of Artificial Sequence: Synthetic coding sequence
atgggcagcggctgggtgccctgggtggtggccctgctggtgaacctgacaaggctcgattcttcaatgacacaaggcaccgatagccctgaggactttgtgatccaggccaaagctgattgttatttcacaaatggaactgaaaaagtgcaattcgtcgtcaggtttattttcaacctagaagaatatgttcgctttgattcggatgtagggatgttcgtagcgctgaccaaactcggacagccagatgcagagcagtggaacagcaggctggacctgctggagcggagtcgacaggcggtggacggcgtctgtagacacaactacagactgggcgccccattcaccgtcggtcgaaaagtgcagcccgaagtgaccgtctacccggagagaacaccccttctccaccaacataatctgctgcactgctctgttaccggattttatccaggagatatcaaaattaagtggtttcttaacggtcaggaggagcgcgccggggtgatgtccacaggtcctataagaaatggcgactggacatttcaaacagtggtaatgctggagatgacgcccgaactgggacacgtttacacgtgcctggtggaccacagctcacttctgtccccagtctctgtggagtggagagcccagtcagaatactcttggagaaagatgcttagcggcatcgcagcattcttgctggggctgatattccttctggtcgggattgtgatccaattgagggcacaaaaaggctatgtacgcactcaaatgtcaggcaacgaagttagcagagccgtgttactgccccagtcctgctag

SEQ ID NO: 43554 - DNA, 549 bp, Artificial Sequence
  Description of Artificial Sequence: Synthetic coding sequence
tgaaacctgacccggctggacagcagcatgacccagggcaccgacagtccagaggacttcgttattcaagccaaagctgattgttattttaccaacgggactgagaaggtccagttcgtggttaggttcatatttaacttggaggagtacgtaaggtttgacagcgacgtgggaatgtttgtggcgttgacaaagctcgggcagccggatgccgagcagtggaactcccggctggacttgctcgagaggtcccggcaggccgtggacggcgtttgtaggcataattataggctgggcgccccgttcaccgtaggccggaaagaggttacggtatatccggaaaggacgccattactgcatcagcataatctgctgcactgtagtgtgacaggattctaccccggcgacataaagatcaaatggttcttgaatgggcaggaggaaagggcaggcgtgatgagcacaggtcctattagaaacggcgactggactttccagaccgttgtgatgttggagatgacacccgagctcggacacgtctacacctag

SEQ ID NO: 43555 - DNA, 822 bp, Artificial Sequence
  Description of Artificial Sequence: Synthetic coding sequence
atgggcagcggctgggtgccctgggtggtggccctgctggtgaacttgacacgcctcgactctagcatgactcaggggactgatagtccggaagatttcgtgattcaggccaaagcggattgctacttcacgaatggtaccgagaaggtacaatttgtcgttcgcttcattttcaatcttgaggaatacgtgagatttgattccgacgtcggcatgtttgttgccctcacaaaactgggacaaccggatgcagagcagtggaatagtcgtctggacctccttgagaggagccggcaagccgtagatggggtatgcagacataattatagactgggtgcgcctttcactgtgggccgcaaggtgcaacccgaggttaccgtgtatccggagcggacccccctgctacaccagcacaatctgttacactgcagtgtcacaggtttctatcccggagacatcaagatcaaatggttcctgaacggccaggaagaacgggccggcgtgatgtccaccgggcccattaggaatggcgactggaccttccagaccgttgtgatgcttgaaatgacgcctgagttgggacacgtctacacgtgcctggtggaccactcctccctgttatcaccggtgagcgtcgaatggcgcgcccagagtgaatattcctggcgcaagatgcttagcggaattgccgctttcctcctggggctaatttttctcctagtcgggatcgtgatccaattgagagctcagaaaggctatgtgcgcacacagatgagtggaaacgaagtgtcccgcgccgtcctattgcctcagtcttgctag

SEQ ID NO: 43556 - DNA, 411 bp, Artificial Sequence
  Description of Artificial Sequence: Synthetic coding sequence
atgagctggaagaaggccctgcggatccccggcggcctgcgggtggctaccgtgacactcatgttggccatgttgtctacaccagtagctgagggccgggactccccagaggattttgtgtaccagtttaaaggaatgtgttactttacgaacgggacagagagagtgagattagtgacacgttatatctataatcgcgaagagtacgcccggtttgacagcgatgtcggagtttatcgggcagtgacccctcttggtcctcccgacgccgaatactggaatagccagaaggaagttttggagcggactagggctgagctcgacacagtatgccggcataactaccaactggaactgaggacaaccctgcaaaggaggggtaccgtgacggggccatctcgctcgtggtag

SEQ ID NO: 43557 - DNA, 840 bp, Artificial Sequence
  Description of Artificial Sequence: Synthetic coding sequence
atgagctggaagatggccctgcagatccccggcggcttctgggccgccgccgtgacggtgatgcttgtgatgctgtccactcctgtggccgaagcccgagacttccctaaggacttccttgttcagttcaagggaatgtgctatttcaccaacggtacagaaagggtgagaggggtagctcgatacatttacaatcgggaagaatatggcagatttgattctgacgtgggggagttccaggctgtgactgaactgggccggagcatcgaggactggaacaactataaggacttcctggagcaggaacgagccgcggtggataaggtctgcaggcacaactacgaagccgaattaagaaccacacttcagcgccaggtcgaaccaactgtcactatatcccctagcagaacagaggcacttaatcatcataatctgctcgtgtgcagcgtcactgacttttacccagcacagatcaaggtgcaatggtttaggaacgaccaggaagagacagctggggtagtttcaacgagcttgattagaaacggggattggacgttccagatcttggttatgctcgaaataactccccagcgaggcgacatatacacgtgccaggtggagcaccccagcttgcagtcaccgatcacagtcgaatggagagcccagagtgaatctgctcagtcaaagatgcttggtggagtgggtggctttgtgctcgggttgatctttcttggcttaggacttataattaggcatagaggccaaaaaggtccccgcggtccaccacctgctggaaacatatctgccatgattcagtctggggaacgagctcaagcatag

SEQ ID NO: 43558 - DNA, 696 bp, Artificial Sequence
  Description of Artificial Sequence: Synthetic coding sequence
atgagctggaagatggccctgcagatccccggcggcttctgggccgccgctgtaaccgttatgctggtaatgctgtctacccctgtggcagaggccagggatttcccaaaagatttccttgtgcagttcaagggcatgtgctactttacaaatggcaccgagagggttcgtggggttgcccgctacatttacaatagagaagaatacggccggtttgactccgatgtaggagagttccaggcagtcaccgaactgggacgctcaatcgaagattggaacaactacaaggattttctagaacaagagcgggctgcagttgataaagtgtgtagacacaattacgaggctgagctgcgaacaacactgcagcgccaggtggaacctaccgtgaccatctcccccagtcgtacagaggccctgaaccaccacaatctactggtttgctcagtcaccgatttctatccggcccaaattaaggttcagtggtttcggaacgaccaggaggagactgccggggttgtgagcaccagcctgatacgcaacggcgattggacattccaaattctcgtgatgctggagattacaccacagaggggggatatctatacatgccaagttgaacaccccagcctccagagcccaataactgtcgagtggaggccgaggggacccccccctgcggggcttttgcattag

SEQ ID NO: 43559 - DNA, 807 bp, Artificial Sequence
  Description of Artificial Sequence: Synthetic coding sequence
atgagctggaagatggccctgcagatccccggcggcttctgggccgccgccgtgaccgtgatgcttgtaatgttgtcaacaccggtcgccgaggcacgagattttcctaaagattttctggtgcagttcaaaggaatgtgctacttcactaatggcaccgagagggtgcggggcgtggctaggtacatctacaaccgagaggagtatggtcgcttcgactccgacgtgggagaattccaggccgtcactgaactcggccgatccatcgaggactggaacaactataaagactttctggagcaagagcgagcagcggtcgataaggtgtgcagacacaactacgaagctgaactgagaaccacgctgcagagacaagtggaaccaaccgtgacgatcagcccaagtagaacagaagctctcaatcatcataatctcttggtttgttctgtgacagacttctaccccgcgcagattaaagttcagtggtttcggaatgatcaggaggaaaccgcgggagtggtctctacctccctgatacgcaatggagattggacctttcagatactggtgatgttggaaattactcctcaacgtggtgacatatatacatgccaggtggagcatccttccttgcagtcccctattaccgtggagtggagggcccagtcagagtccgcccagagcaagatgctcgggggggtcggtgggtttgtccttggccttatctttctgggcctgggcctgatcatccgccaccgggggcagaaaggacctcgcggcccccccccagcagggctgctgcattag

SEQ ID NO: 43560 - DNA, 684 bp, Artificial Sequence
  Description of Artificial Sequence: Synthetic coding sequence
atggccctgcagatccccggcggcttctgggccgccgccgtgaccgtcatgctggtgatgttatctaccccagtggctgaggcaagggacttcccaaaggacttcctggtccaattcaaaggtatgtgctatttcaccaacggaacagagcgcgtccggggcgtggcacgctatatatataatagagaagaatacggtcgcttcgattcagacgtaggcgaattccaggccgttacggaattgggcagatccattgaggactggaataattataaggattttctcgaacaggaacgtgcagccgtagataaggtctgcaggcacaactacgaggccgagctgcgcacgacactccagcggcaagtcgaacctacggtcactataagccccagtagaactgaggcgctgaaccatcacaatctgttagtatgctccgtgacagatttttatccagcccagatcaaagtgcgctggtttcgtaacgatcaggaagagactgcaggagttgtctccaccagtcttatccgcaacggggactggactttccagatacttgtcatgcttgagatcacaccgcaacgtggcgacatttatacctgtcaagtggagcacccctctttgcaatctccaatcacagtggagtggagaccgaggggccccccccctgcaggcctgctgcactag

SEQ ID NO: 43561 - DNA, 828 bp, Artificial Sequence
  Description of Artificial Sequence: Synthetic coding sequence
atggccctgcagatccccggcggcttctgggccgccgccgtgaccgttatgttagttatgctgtccacacctgttgcagaagccagggacttcccgaaagacttcctcgttcagttcaaaggcatgtgctacttcaccaatggcaccgagcgagtccgaggagtagcgcgatacatctacaatcgtgaggagtatggccggtttgattccgatgtgggggagtttcaggcagtgaccgagttggggcgatcaatcgaagactggaataactacaaggactttctggagcaggaacgggctgccgtggacaaggtgtgtcgacacaactatgaggcggagctgagaacaaccctgcagaggcaagtggaaccaacagttacgattagcccatcaagaactgaagcgctgaatcatcataatctgctcgtctgctccgtgacagatttttatcccgctcagataaaagttcggtggttccgaaacgaccaggaggagacagccggtgtggttagcacaagtctaatcaggaatggagactggactttccagatactcgtcatgttagaaattaccccccagcggggcgatatctacacgtgccaggttgagcatccctcgctgcagtctccgattacggtcgaatggagggcacaatccgaatccgcccagagcaagatgctgagtggaatcggtggcttcgtgctgggcttgatattcctgggactcggtctgattattagacatagaggtcagaagggtccgcgagggcccccaccagcagggaacattagcgcgatgattcagtctggagaaagggctcaagcctag

SEQ ID NO: 43562 - DNA, 657 bp, Artificial Sequence
  Description of Artificial Sequence: Synthetic coding sequence
tgactgcagatccccggcggcttctgggccgccgccgtgaccgtgatgctggtcatgttgtcaactccagtggccgaagcccgcgacttccccaaggacttcctcgtacagtttaaaggaatgtgttacttcaccaacggtactgaacgagtccgcggcgtcgctcgctatatatacaaccgagaagaatacggccgctttgatagcgatgtcggcgaattccaggccgttacagagctgggcagaagcattgaggattggaataattataaggattttctcgaacaggagcgcgctgctgttgacaaagtgtgccgccacaactacgaggcggaacttagaacgacccttcaacgtcaggtggagcccactgtgacgataagcccttccaggactgaagccctgaaccaccacaacctcctggtgtgcagtgtcacggatttctaccctgctcagatcaaagtgcagtggtttcgaaacgatcaggaggaaactgctggggtggtcagtacatctctgattcgcaacggcgattggaccttccaaattctggttatgttggagatcaccccgcagagaggggatatatacacatgtcaagtggaacacccatcactacagtctcccattacagtcgaatggcgactgctgcactag

SEQ ID NO: 43563 - DNA, 696 bp, Artificial Sequence
  Description of Artificial Sequence: Synthetic coding sequence
atgagctggaagatggccctgcagatccccggcggcttctgggccgctgctgtaacagtgatgctggtaatgctctcaactcctgtggccgaggcacgcgattttccgaaggacttcctggtgcaattcaaggggatgtgctacttcactaacggtaccgagcgtgtccgcggtgtggcacggtatatctataacagagaggaatacggacggtttgactctgacgtgggtgaattccaagccgtcacggagctcggccgctccatcgaagactggaataactacaaggacttcctggaacaggagcgagccgctgtcgacaaggtgtgcagacataactatgaagctgagctgcggacaactcttcagcggcaggttgagcctaccgtgaccatctccccgagtaggaccgaggccctgaaccaccacaatctgctcgtctgtagtgtcacagacttttacccagcccagatcaaggtgcaatggtttcgcaatgaccaagaggagacggctggcgtagtttcaacaagtctcatccgcaatggtgactggacctttcaaattctagtgatgctggagatcactccccagcgcggggatatttacacctgccaggtggagcaccctagcctgcagtcccctatcacggtggagtggaggccccgaggacctcctcctgcaggccttttacactag

SEQ ID NO: 43564 - DNA, 657 bp, Artificial Sequence
  Description of Artificial Sequence: Synthetic coding sequence
tgactgcagatccccggcggcttctgggccgccgccgtgaccgtgatgcttgtaatgctgtccacgcctgtggctgaggccagggatttcccgaaggacttcttggtacagtttaaggggatgtgttacttcacaaacggtaccgagagagtgagaggggtggccaggtatatctataaccgcgaagaatacggtcgctttgattccgacgtgggcgaatttcaggcggttaccgaattgggcaggtccatcgaggactggaataactataaggactttttggagcaggagagggccgcagtcgataaggtgtgtagacataattatgaggctgagctgcgaaccaccttgcaacgccaagtagagccaacagtgacaatatcaccaagcagaacagaggccttgaaccaccacaacttgttggtgtgctctgtgacggacttctaccccgcacagatcaaggtgcggtggtttagaaatgaccaggaggaaactgcaggagtcgttagtacatctctcattcgaaacggcgactggaccttccagatcctggtgatgctggagatcactccacagcgcggagatatttatacttgccaggtggaacatcccagcttgcagtctcctatcacggtagagtggaggttgctacattag

SEQ ID NO: 43565 - DNA, 657 bp, Artificial Sequence
  Description of Artificial Sequence: Synthetic coding sequence
tgactgcagatccccggcggcttctgggccgccgccgtgaccgtgatgttggtgatgttgtcgacacccgtggctgaggctagggactttcctaaggacttcttggtccagtttaaaggcatgtgctattttaccaatggaacagaaagggtaagaggagtcgctcggtatatttacaacagagaagagtacgggcgcttcgacagcgacgtaggagagttccaggctgtgactgagctgggtagaagcattgaagattggaacaactataaggatttcctcgagcaggaacgagccgccgttgataaggtgtgccggcacaactatgaagcagagctaaggacgacattacagcggcaggttgagcctaccgtgacgatttctccgagtaggaccgaagcattgaatcatcataatctactcgtgtgtagtgtcactgatttttacccagcacagataaaagtgcagtggtttaggaatgatcaagaggaaactgccggcgtggtaagtaccagtctcattagaaacggagattggacctttcaaattctggttatgcttgagatcacgccccagcggggagacatttacacctgccaggttgaacatccgagtctccagagtcccattactgtggaatggaggctgctgcactag

SEQ ID NO: 43566 - DNA, 840 bp, Artificial Sequence
  Description of Artificial Sequence: Synthetic coding sequence
atgagctggaagatggccctgcagatccccggcggcttctgggccgctgccgttaccgtcatgctggtcatgttaagcactcctgtggctgaggccagggatttcccgaaggatttccttgtccagttcaaggggatgtgctatttcaccaatggaacggaaagggtcagaggagtggccaggtacatttataatcgagaagagtatggccgatttgatagcgacgtcggtgaatttcaggctgtcaccgaattggggagaagcatagaggattggaacaattacaaggatttcttggagcaggaacgggccgccgtggacaaagtgtgtcgccacaattacgaagcagaacttcggacaactttacagagacaggtggagcccaccgtgactattagcccgagcagaacggaggccctcaatcaccacaatctgctcgtgtgtagtgttaccgatttctatccagctcagattaaggtgcagtggtttaggaacgaccaggaggagacagccggagtggtgagtacatctctcattagaaatggtgattggacatttcaaatactggtcatgctggaaatcaccccccagcgcggcgacatatatacatgtcaagtcgaacatcccagtctgcagagcccgatcaccgtagaatggagagcccagtctgagagcgcccagagcaaaatgttaggtggcgttgggggtttcgtacttgggctgatatttctgggcctgggccttataattcgccaccgcgggcagaaaggaccacgcggtccccctccagcgggtaatatctcagcgatgattcagtcaggggagcgtgcgcaggcctag

SEQ ID NO: 43567 - DNA, 795 bp, Artificial Sequence
  Description of Artificial Sequence: Synthetic coding sequence
atggccctgcagatccccggcggcttctgggccgccgccgtgaccgtcatgctggtgatgttatcaaccccagtcgccgaagcaagggacttccccaaagatttcttggtgcagttcaaagggatgtgttactttacaaacgggaccgagagggtgaggggcgtggcccgatatatctataacagagaggaatatgggcggtttgatagcgacgtcggcgagtttcaggccgttacggaactgggtcgctcaatcgaggactggaataattataaagacttccttgagcaggagagagccgccgtggataaagtttgccggcacaattatgaagctgagttacggacgaccctgcagcggcaagtcgagccgactgtgactatctctccgagcaggaccgaggctctcaaccatcacaatctccttgtttgttccgtcactgacttttatcctgcccagatcaaagtgcgttggtttagaaatgaccaggaagagaccgccggagttgtgagcacttcgttaatccggaatggtgactggacatttcagatcctggtgatgctggaaatcactccccagcggggcgacatttacacttgccaagtagagcacccttcccttcagtcccccatcacagtcgagtggcgtgcacagagtgagtccgcacagtcgaagatgctttccggaattggggggttcgtgctgggattgatcttcttgggattaggacttataatcagacatcgtggacagaaaggtcctagggggcctccacctgccgggctgttgcactag

SEQ ID NO: 43568 - DNA, 657 bp, Artificial Sequence
  Description of Artificial Sequence: Synthetic coding sequence
tgactgcagatccccggcggcttctgggccgccgccgtgaccgtgatgctggttatgctgagcaccccagtggccgaggcccgagactttccaaaggatttccttgtccagtttaagggtatgtgctacttcaccaatggcaccgagcgagtgcgaggcgtcgcccgatacatttataaccgggaggagtatggacgttttgatagcgacgtgggagaatttcaggccgttaccgaactagggaggagcattgaagactggaacaactacaaagacttcctagagcaggaacgggcagctgttgataaagtctgtcgtcacaattatgaggccgaactaagaacaactttgcagagacaggtggaacctacagtcaccatatctccttccaggaccgaagctctaaaccaccacaatctgcttgtctgctccgtgacggacttttacccagcccaaatcaaggtgcggtggttccgcaacgatcaagaggaaactgcaggagtggtgagcacgagtctcatccgaaacggggactggacgttccaaattcttgtaatgctggagattacaccacagaggggagatatctacacgtgccaggtggagcatcctagcctgcagtcccccataactgtggaatggcggcttttgcactag

SEQ ID NO: 43569 - DNA, 657 bp, Artificial Sequence
  Description of Artificial Sequence: Synthetic coding sequence
tgactgcagatccccggcggcttctgggccgccgccgtgaccgtgatgctagtgatgttatcaacgccagtggctgaggcaagggactttccaaaggatttcctcgtgcaatttaagggtatgtgctactttactaatgggacggagcgggtgagaggtgtggcaagatacatctacaacagggaggaatatggacggtttgattctgacgttggagaatttcaggcagtgactgagctgggccggagtatcgaggactggaataattacaaagatttcctagaacaagaaagggccgcagtggacaaggtctgcagacataactatgaggctgaattgcgaaccacattgcaacgccaggtggaacctacagtgacaataagcccctctagaaccgaagctcttaatcaccacaacctgctcgtgtgcagtgttactgatttctaccccgcccaaatcaaagtccagtggttccgaaacgatcaggaggagaccgctggagtggtgtccacctccctaattagaaacggtgactggacgttccagatactagtgatgctcgagatcactccccaaaggggggatatttatacatgccaggtggaacacccatctctgcaatcacccataacggtggaatggcgattacttcactag

SEQ ID NO: 43570 - DNA, 684 bp, Artificial Sequence
  Description of Artificial Sequence: Synthetic coding sequence
atggccctgcagatccccggcggcttctgggccgccgccgtgaccgtgatgttggtgatgctgtctacaccagtggccgaagcccgagatttccctaaggacttcctcgtgcagttcaagggaatgtgttatttcactaacggcacagagcgagtgcggggcgtggcccgttacatatacaatagggaagagtacgggcgatttgattccgacgtgggcgaattccaggctgttaccgaactgggaaggagcatagaagattggaacaattataaggactttttagaacaagagagggccgctgtggataaagtgtgccgtcacaactatgaggccgaactgcggactactttgcagcgacaagtggagcctacagtcacaatctctcccagccggactgaggctctgaaccaccataacctcttggtctgctcggtgacagacttctatcccgcacaaatcaaagtgaggtggtttagaaatgaccaagaagagaccgctggcgtggttagcacaagcctcattaggaatggcgattggacctttcagatcctcgtcatgctggagataacaccccagagaggcgatatctacacatgccaggtcgaacatccctccctccagtctcctatcacggtggaatggagaccaagggggcccccaccagctggacttctccactag

SEQ ID NO: 43571 - DNA, 657 bp, Artificial Sequence
  Description of Artificial Sequence: Synthetic coding sequence
tgactgcagatccccggcggcttctgggccgccgccgtgaccgtgatgctcgtgatgctctcaacccccgttgccgaggccagagactttcccaaggattttctggtccagtttaaaggcatgtgttatttcaccaacggtaccgaacgcgtacgaggggttgctagatatatctataatcgagaagaatacgggcggttcgatagcgacgtaggggagtttcaggctgtcactgaactgggtagatcgatcgaagactggaacaattacaaggacttcctggaacaggagagggcagcagtggataaagtgtgcaggcacaattatgaagccgaacttaggacaactctgcagagacaagtggagccaactgtgactatcagcccgagccggactgaggccctgaaccaccacaatcttctggtctgtagcgtaactgatttctaccccgctcagatcaaggtgcgatggttccgaaacgatcaagaggaaacggccggcgtggtttccacctccctgatccgaaacggagactggacattccagatcttagtgatgctcgagatcacgccccagcggggtgacatatacacttgtcaggtggagcatcccagccttcagtcaccgatcacagtggagtggcggttgttgcactag

SEQ ID NO: 43572 - DNA, 696 bp, Artificial Sequence
  Description of Artificial Sequence: Synthetic coding sequence
atgagctggaagatggccctgcagatccccggcggcttctgggccgctgctgttactgttatgttagtcatgttgtccaccccggtagcggaagcccgtgacttccccaaggattttttagtgcagttcaagggaatgtgttactttaccaatgggacagagcgcgttcgaggcgtggctagatatatatacaatagagaagagtacggcagatttgatagtgacgtgggcgaattccaggctgttacagagctgggtaggtctattgaggactggaataactacaaagattttctggaacaagagagggccgccgttgataaagtttgtcgccataattatgaagccgagctgcgtaccactctgcaacggcaggtggagcccacggtgaccatctccccatctcggacggaagctctgaaccaccataatttgctcgtatgcagtgtcacagacttttaccccgcacaaatcaaggtgcagtggttcaggaacgaccaggaggaaacagcaggcgtggtatccacttccctgattcgcaatggagactggacttttcagatactggtcatgctggagatcaccccacagagaggtgacatttacacgtgccaagtggaacatcccagtttacaatcccccatcaccgtcgaatggcgtccgagggggcctccgcccgctgggctccttcactag

SEQ ID NO: 43573 - DNA, 795 bp, Artificial Sequence
  Description of Artificial Sequence: Synthetic coding sequence
atggccctgcagatccccggcggcttctgggccgccgccgtgaccgtcatgttggtaatgctgtcaaccccagtcgcggaggcgcgcgactttcccaaggattttctggttcagtttaagggtatgtgctattttactaacgggactgaacgggtgaggggggtggcccggtatatctacaacagagaagagtatgggagattcgacagtgatgtgggcgaatttcaggccgtgaccgagttgggcaggagtatcgaggactggaacaattacaaggatttcctcgagcaggagcgcgcggctgtcgataaagtgtgtcggcacaactatgaggccgagctgaggaccacactccagaggcaggttgagccaacagtgacaatttcccctagcagaaccgaagcgctcaatcaccacaacctgctggtgtgctctgttactgatttttatccggctcagattaaagttagatggttccgcaacgatcaggaggaaaccgcaggggtggtaagcactagcctcatccgaaatggtgactggactttccagatcctcgtgatgttggaaatcacgccccaacgtggggatatttacacatgccaggtggagcacccctctttacaaagccccattactgtcgagtggagagcccagagtgagtctgcccagtctaagatgctgtctggaattggaggttttgtgctggggctgattttcttgggtctgggccttattattcggcatagggggcagaagggaccccgggggcccccaccagcgggcctcctgcattag

SEQ ID NO: 43574 - DNA, 795 bp, Artificial Sequence
  Description of Artificial Sequence: Synthetic coding sequence
atggccctgcagatccccggcggcttctgggccgccgccgtgaccgtgatgctggttatgctatcaacccccgtggcagaagccagagacttcccgaaggacttcctagtgcagtttaagggaatgtgctactttactaatggcactgaaagggtgcgaggggtcgcgcgttatatttacaaccgcgaggaatacggacgtttcgacagtgacgtaggcgagtttcaggctgtaaccgagctcggacgctccatcgaagattggaataattataaggatttcctggagcaggagagggcagccgtggacaaggtgtgccgccacaattatgaagctgagctccggactaccctacagaggcaggtggagccaactgtgaccatttccccaagtaggacagaggctctgaaccaccataatctattggtgtgctccgtaaccgacttttaccccgctcagataaaagtaaggtggtttaggaacgaccaggaggaaacagccggagtggtgtccacttcacttataagaaacggcgattggacttttcagattctggtcatgctagagattaccccccagcgcggcgacatatacacctgccaggtcgagcacccaagtctgcagtcccctataaccgtggagtggcgggctcaatcggaaagcgcccagtccaaaatgctgtcaggtattggtggtttcgtccttggtctgatcttcctgggattgggtctcataattaggcaccggggacagaagggcccccgcgggccgccgccggctggtctgctccattag

SEQ ID NO: 43575 - DNA, 807 bp, Artificial Sequence
  Description of Artificial Sequence: Synthetic coding sequence
atgagctggaagatggccctgcagatccccggcggcttctgggccgccgccgtgaccgtcatgctggttatgctttctacgcctgtggcagaagcccgcgatttcccgaaagacttcttagtccagtttaaggggatgtgttattttaccaacggcaccgagcgggttaggggggtggcacgatacatctacaatcgggaagagtacgggaggtttgattcggacgtcggcgagtttcaggcggtcactgagctgggtcggtctatagaggactggaataactacaaggattttcttgagcaagagcgtgctgccgtggataaagtgtgccgccataattacgaggcggagctccgtacaactctgcaacgtcaggtcgagccaacggtgaccattagcccctccaggactgaggccctcaaccaccacaacttactggtctgcagcgtgaccgatttctatcccgcacagatcaaggtgcagtggttcagaaatgaccaagaggaaacggccggtgtagtgagcaccagtctgatccgaaacggcgactggaccttccaaatactggttatgctggagataacccctcaaagaggcgatatttacacttgccaggtcgaacacccttctcttcagagtcctattactgtagagtggcgcgcccaatccgagtccgcacagagtaaaatgctgggcggagttggcgggttcgttctggggctcatcttcctgggcctaggcctcattataagacaccgaggtcaaaagggaccccgagggccgccccccgccggccttttacactag

SEQ ID NO: 43576 - DNA, 807 bp, Artificial Sequence
  Description of Artificial Sequence: Synthetic coding sequence
atgagctggaagatggccctgcagatccccggcggcttctgggccgccgctgtaaccgtcatgctggtgatgctgtccacacccgtcgccgaagcccgcgacttccccaaggactttctcgttcagtttaaaggtatgtgttacttcaccaacggaacggaacgggtgcggggagtcgcaaggtatatctataatcgtgaagaatacgggcgtttcgatagcgacgtaggtgagtttcaggccgtgacagagttgggccgcagcattgaggactggaataactacaaggatttcctggagcaggaacgggctgccgtcgataaggtctgccgacacaactacgaagccgagctaagaacaaccctgcagagacaggtggagcccaccgtgactatctccccttcacgtactgaagcccttaaccatcataaccttctcgtttgcagcgtgaccgatttttatccagcacagataaaagtgcagtggtttagaaacgatcaggaagagacagctggcgtggttagcacatccctgatccgtaatggcgattggacatttcagattctcgtgatgcttgaaatcactccacagcgaggagatatctacacgtgtcaggttgagcacccctctttgcagagccctatcacagtcgagtggcgcgcacagagcgagtctgcccagagcaaaatgctaggcggtgtaggagggttcgtcctgggtctgatattcctgggtctcgggctgattatcagacatcgaggacagaaaggacctcgcggtccacctcctgccggccttctgcattag

SEQ ID NO: 43577 - DNA, 696 bp, Artificial Sequence
  Description of Artificial Sequence: Synthetic coding sequence
atgagctggaagatggccctgcagatccccggcggcttctgggccgctgccgtcaccgtcatgctcgtcatgttatcaacaccagttgctgaagcaagagattttcccaaggacttcctggtccagtttaagggcatgtgttacttcacaaatgggaccgaaagagtgcggggcgtggctagatacatctataaccgggaagagtatggccgttttgatagcgacgtgggggagtttcaggcagtgactgagctgggcagatccatcgaggattggaataactacaaggacttcctcgaacaggagagagctgccgttgacaaggtgtgtaggcataactatgaagcggagctccgcaccactttacaacggcaggtggaaccaaccgtgactatctctcccagtagaaccgaggcgctgaaccaccacaaccttctggtctgttctgtgacggacttctaccctgcccaaatcaaggttcagtggtttaggaatgaccaggaggagaccgccggcgtggtctccacgtccctgatccggaacggggattggacttttcaaattctggtcatgctggaaatcacgccccagagaggcgatatctatacttgtcaagtggagcatcctagcttgcagtcaccgattacagtggagtggcgtcctcgcggaccaccccccgccggcctgttgcactag

SEQ ID NO: 43578 - DNA, 840 bp, Artificial Sequence
  Description of Artificial Sequence: Synthetic coding sequence
atgagctggaagatggccctgcagatccccggcggcttctgggccgctgccgtgaccgtaatgctggtgatgctctccacccctgtggccgaggcgcgggactttccaaaggattttcttgtgcaatttaagggaatgtgttatttcactaacggaactgaacgtgttaggggggtcgcccgttacatctacaaccgcgaggaatatggaagattcgactcagatgtcggggagttccaagccgtgaccgagctcggacggtccattgaagactggaacaactataaggattttctcgaacaagaacgagccgctgtcgacaaggtatgcagacacaattacgaggcggagctgaggaccacactgcagaggcaggtcgagcccactgtgaccatctctcccagtcggacggaggccctgaaccatcataacctcctggtgtgcagcgtgaccgatttctatcctgcacagattaaggtccagtggtttcggaacgatcaagaggagacagctggggtggtcagtacctcgctcatccggaatggtgattggacttttcagattctggttatgctggagattacccctcagagaggcgatatttacacatgtcaggttgagcacccctctctgcagtctccgattacggtggaatggcgggctcagtctgagtcagcacaaagcaagatgctcgggggcgttggagggtttgtactcggtctaatctttctgggattgggtctcatcattagacaccgcggccagaagggaccccgtggccccccgccagctggaaatataagtgcaatgattcagagtggagagcgagcccaggcttag

SEQ ID NO: 43579 - DNA, 657 bp, Artificial Sequence
  Description of Artificial Sequence: Synthetic coding sequence
tgactgcagatccccggcggcttctgggccgccgccgtgaccgtgatgctagtaatgctgtctaccccagtggccgaggcgagggacttcccaaaggacttcctggtgcaattcaaggggatgtgctatttcaccaacggcactgagcgcgtgcggggggtggcacgttacatctataatcgtgaggagtacgggaggttcgacagtgatgtgggcgagtttcaggcagtcacggaacttggaagatctatagaagattggaataactataaagattttctggagcaagagagagccgctgtggataaggtttgccgacataactacgaggcggagttgcggacaacccttcagagacaggtagagcctacagtcaccatttctccctcaagaaccgaggctttgaaccatcacaatctcttagtgtgttccgtgaccgacttttaccctgctcaaattaaggtgcggtggtttcgaaatgaccaggaggaaacagcaggtgtggtgtctacaagtttaatcagaaacggcgattggacatttcagatccttgtgatgttggagattaccccccagcgcggagatatctatacttgtcaggtggagcatcctagcttgcaaagtcctatcactgtagagtggagactactgcattag

SEQ ID NO: 43580 - DNA, 828 bp, Artificial Sequence
  Description of Artificial Sequence: Synthetic coding sequence
atggccctgcagatccccggcggcttctgggccgccgccgtgaccgtcatgttggtaatgctttcaacccccgtggccgaggcaagagacttcccgaaggactttctggtgcagtttaagggcatgtgttactttaccaacggcaccgagcgcgtgcggggcgtagcaaggtacatttacaatcgcgaagagtatgggcggttcgattccgatgttggagaattccaagccgtcacagagctgggccgtagcatagaagactggaacaactataaggactttcttgagcaagaacgagccgcggtggataaggtgtgtcgacataattacgaagctgaacttaggacaaccttgcagagacaggttgagcctaccgtgaccatcagtcctagcaggacagaggccctaaatcatcacaatttattagtgtgctccgttacagatttctatccggctcagatcaaggtcaggtggttccgcaatgaccaggaagagacagcaggcgtggtgtccacaagtctgatcaggaacggggactggaccttccagatcctcgtgatgctagaaatcacccctcagcgcggtgatatatatacatgccaggtggagcacccaagtttacagtctcccattactgtcgaatggagggcacagagtgaaagcgctcagtccaagatgcttagtggtattggggggttcgtcttaggcctcatttttttaggcctcggcctgatcataaggcaccgcgggcaaaaaggccctagagggcccccccctgcgggcaacatttccgcaatgattcagtctggagaacgcgctcaggcttag

SEQ ID NO: 43581 - DNA, 795 bp, Artificial Sequence
  Description of Artificial Sequence: Synthetic coding sequence
atggccctgcagatccccggcggcttctgggccgccgccgtgaccgtgatgttggtcatgctgtctacgcctgtggccgaggcaagagatttcccaaaagactttttggtccagttcaaggggatgtgctactttaccaatggaacagaacgtgtacggggtgttgctagatatatttataaccgggaggaatacggacgtttcgatagtgacgtgggggagtttcaggcggtgacagagctaggtcgctccatcgaagactggaacaattacaaagatttcctggagcaagagcgagcggccgtggataaagtctgtaggcataattatgaggcagagcttaggaccacgcttcagcgtcaggtcgaacccaccgtgaccatcagcccatcccgcaccgaagctctcaatcaccataatctgctggtctgtagtgtaacggacttttatcccgctcaaataaaggtcaggtggttcagaaatgatcaagaggaaactgcaggagttgtgtcaacaagcttgatcaggaatggcgactggaccttccaaattctagtgatgctggagatcacaccccagagaggggacatttacacatgtcaggtggaacacccatccctgcaatcccccataactgttgagtggagagctcagagtgaatctgcgcagagtaagatgctctccggcatcggcggattcgtactgggcctcatctttctgggtctggggctgattatccgacaccgcgggcagaaagggccccgaggaccccccccggctgggctactgcattag

SEQ ID NO: 43582 - DNA, 684 bp, Artificial Sequence
  Description of Artificial Sequence: Synthetic coding sequence
atggccctgcagatccccggcggcttctgggccgccgccgtgaccgtgatgcttgttatgctttcaacaccagtggcagaggccagagactttcccaaggatttcctagttcaatttaaaggaatgtgctacttcaccaacggaacagaacgggtgaggggtgttgctaggtatatatacaatcgcgaagaatacggtcggtttgacagcgacgtcggagaatttcaggcggtgacagaacttggacgctctatagaggattggaataattacaaagacttcctggagcaggagagggcagcggtagataaggtctgtagacataattacgaggccgagctaaggaccactcttcagaggcaggtggagccaacagtgactatctcaccctcacgcacggaggcacttaaccatcacaatctgcttgtgtgtagtgtgactgacttctacccagctcaaataaaagtaagatggttccgtaacgaccaggaagaaaccgccggcgtggtgtccacaagtttgatcagaaatggagattggactttccagattctggtgatgctggagatcaccccacagagaggcgacatttatacttgccaggtggagcaccctagcctccagtctccgattactgtagagtggaggcctcgcggaccccccccagctggtctactgcactag

SEQ ID NO: 43583 - DNA, 840 bp, Artificial Sequence
  Description of Artificial Sequence: Synthetic coding sequence
atgagctggaagatggccctgcagatccccggcggcttctgggccgccgccgtgacagttatgttggttatgctgagcactcccgttgccgaggcccgagatttccccaaggattttttggttcagtttaaaggcatgtgttattttacaaacggcacagaacgcgtgcgtggcgtggcccggtacatctataatagggaagagtacggtagatttgactccgatgtgggcgagttccaagctgtcaccgaactgggaaggagtatcgaggactggaataattacaaggactttttggagcaagagagagctgctgtggacaaggtctgtaggcacaactacgaggctgagctgcgcaccactctgcagcgccaggttgaaccaacggttacaatttccccatccagaacggaggccctgaatcaccacaacttgctggtctgcagtgttaccgacttttaccctgcccagatcaaagtccaatggttccgcaacgaccaagaggagactgctggagtcgtaagcacctcacttattaggaacggagattggactttccagattcttgtgatgctggagataacacctcagcgcggagatatttacacttgtcaggtggagcacccctctctgcagagtcccattaccgttgaatggcgtgcccagtctgagtccgcccagtccaaaatgcttggaggcgttggaggttttgtgttggggctcatcttcctagggcttgggctgatcatccgccacaggggacagaaggggccacgcggacccccgcccgctggtaacattagtgctatgattcaatccggtgagagggctcaggcctag

SEQ ID NO: 43584 - DNA, 828 bp, Artificial Sequence
  Description of Artificial Sequence: Synthetic coding sequence
atggccctgcagatccccggcggcttctgggccgccgccgtgaccgtgatgctggtgatgctgagcacgcctgtagccgaggccagggattttccgaaagactttcttgtgcagtttaagggaatgtgctattttaccaacgggacagagcgggttagaggagtggcgcgctatatttacaaccgcgaagaatacggcaggttcgattctgatgtgggagagtttcaggccgtgactgagctaggccggtcgatcgaagactggaataattataaagatttcctcgaacaggaacgggctgccgtggacaaagtatgcagacacaactacgaggccgagctcagaaccaccttacagagacaggtggaacccacggttacgattagtccatccagaactgaggctctcaaccaccataatctgttagtatgtagcgtgaccgatttctatcctgcccagatcaaagtgagatggttcaggaatgatcaagaggaaactgccggcgttgtgtcaacatcattgattaggaatggagactggactttccagatactcgtgatgctcgagatcaccccccagcgcggcgatatttacacttgccaggtagagcaccctagcctgcagagcccgattactgtggaatggagggcccaaagcgagagcgcccagtccaagatgttgtcaggtattggcggatttgtgctgggcttgatctttctgggattgggcttaatcattcgccacaggggacaaaaaggtcctcgcgggccacccccagctggcaatattagcgccatgatccaaagcggagagcgggctcaggcatag

SEQ ID NO: 43585 - DNA, 657 bp, Artificial Sequence
  Description of Artificial Sequence: Synthetic coding sequence
tgactgcagatccccggcggcttctgggccgccgccgtgaccgtgatgcttgtcatgttatcaactccggttgcagaggcgagagattttcccaaggacttcttggtccagttcaagggaatgtgctactttaccaacgggaccgagagggtccggggtgttgcccgctacatatacaatcgtgaagaatatggacgtttcgacagcgacgtcggcgagttccaggccgtaaccgagctgggcagatccattgaagattggaacaattataaagatttcctcgaacaggagcgagccgcagtagataaagtgtgcaggcacaattatgaagctgagcttaggacaacacttcaacggcaggtggagccaactgtgactatctctccgtctcgcaccgaggcattaaatcaccataacctgcttgtatgcagtgtgacagatttttatcccgcccagatcaaggtccagtggttccgcaacgaccaggaagagaccgcaggagtggttagtacctcactgatacgcaacggtgactggacgtttcaaattctcgttatgcttgaaattaccccgcagcggggcgacatatatacgtgtcaggtagagcatcctagtctgcaaagccccatcaccgtagaatggcggttgctgcattag

SEQ ID NO: 43586 - DNA, 828 bp, Artificial Sequence
  Description of Artificial Sequence: Synthetic coding sequence
atggccctgcagatccccggcggcttctgggccgccgccgtgaccgtgatgctggtcatgcttagcacccctgtggccgaagccagggattttcctaaagactttctagttcaatttaagggcatgtgttactttacgaacgggacagaacgagtgagaggcgtcgctagatatatctataaccgcgaggagtacggtcgttttgacagcgacgtaggcgagttccaggcagttacagaactcgggcgcagtatcgaagactggaataactataaggattttctggaacaagaaagggccgctgtggataaggtgtgccgccataattacgaagccgaattacgcacaaccctccaacggcaagtcgagcccacagtcaccatcagcccctctcgaaccgaggccctaaatcatcataacctgttggtgtgctccgtgactgatttctatcctgcacagattaaggttagatggttccgtaacgaccaagaagaaacagccggcgtggtctccacttctttaatccgcaatggtgactggacattccagattttagtaatgctagaaatcacccctcagcgcggagacatctatacatgccaggtggagcacccaagccttcagagccccattacagttgagtggagagcccagtcagaatccgcccagtctaaaatgctttccgggatcggcggatttgtactcggcctaatctttttgggccttgggctgatcatcagacacaggggacaaaaaggcccacgaggcccaccccccgctggcaacatcagtgcgatgatacagtctggtgagcgggcacaggcatag

SEQ ID NO: 43587 - DNA, 684 bp, Artificial Sequence
  Description of Artificial Sequence: Synthetic coding sequence
atggccctgcagatccccggcggcttctgggccgccgccgtgaccgtgatgcttgtaatgctttctactccagtcgctgaagctcgcgatttccccaaagactttctggttcaatttaaaggcatgtgttatttcaccaacggcacagaacgggtgaggggcgtggcccgatacatctacaaccgcgaagaatacggccgattcgactccgatgtgggggagttccaggcggtgactgagctcggccgctcgatagaggactggaataactacaaggatttcttggaacaggagagagccgccgttgacaaggtgtgtagacacaactacgaggcggagctgaggacgactctgcagcgtcaggtggagccaaccgttacgatttccccaagccgcaccgaggctctcaaccatcataacctgctggtgtgttccgtcacagatttctaccctgcccaaatcaaggtgcgctggttccgaaatgaccaggaggagactgccggcgtcgtgtctacttctctcattaggaatggagactggacctttcagatcctcgtaatgctggaaatcacacctcaaaggggagatatctacacctgtcaggtggaacaccctagtctccagagtccgattacagttgagtggcgcccacgcggaccaccgcccgccgggctgctgcactag

SEQ ID NO: 43588 - DNA, 807 bp, Artificial Sequence
  Description of Artificial Sequence: Synthetic coding sequence
atgagctggaagatggccctgcagatccccggcggcttctgggccgccgctgtcaccgtgatgctcgtgatgctttccactcccgtggccgaagctagagattttccgaaggactttctggtccagttcaaggggatgtgctatttcacaaacggaacagagcgtgtgcggggggtcgcaagatatatctacaatagggaagaatacggaagattcgactccgatgtgggcgaattccaagctgtcacagaactgggacgttctattgaagattggaacaattacaaggatttcttagaacaggagcgggcagctgtcgacaaggtgtgccgccataactacgaagcggaactcaggaccacactgcagcggcaggtcgagccgactgtaactatcagtccttcgaggaccgaggccctcaaccatcacaacttactggtgtgctccgtgacagatttctatcccgcccagataaaggtacagtggttccgcaatgatcaggaggaaacggccggtgtagtttccacaagcctgattcgaaacggcgattggacattccagatacttgtcatgttggagatcaccccccagaggggggacatctatacctgtcaggtggagcaccccagtttgcagagtcctatcactgtagaatggcgtgctcagtccgaatccgcacaatctaagatgctgggcggcgtgggcggcttcgttctgggactgatttttctgggcctaggactgataatccgccatcgtggacaaaaagggccgcggggtcctccaccggctgggctgctgcattag

SEQ ID NO: 43589 - DNA, 627 bp, Artificial Sequence
  Description of Artificial Sequence: Synthetic coding sequence
atgctgagcacccccgtggccgaggcccgggacttccccaaggacttcctggtgcagtttaagggcatgtgttactttaccaacggtaccgagagagtaaggggggtcgcacgatacatctacaacagggaggagtatggacgattcgactccgatgtgggagagttccaggctgtgacagaactggggaggtctatagaagattggaacaattacaaggattttctggagcaggaaagagccgccgtcgacaaagtgtgtcgacacaactacgaggcagagctgagaacaacactccagagacaggtggagcccacagtcaccatcagcccctcacggaccgaggctctcaaccaccacaacctgcttgtctgttcagtaaccgatttttaccccgcccagatcaaagtgcagtggtttcgcaatgaccaagaagaaacggccggcgtagtgagtacatctctcatacgtaacggggattggacatttcagatccttgtgatgctcgaaatcacacctcagcgaggcgacatttatacgtgccaggtcgaacatccctctttgcaaagccctatcacagtggagtggcgacctaggggaccacctccagcaggactgctccactag

SEQ ID NO: 43590 - DNA, 828 bp, Artificial Sequence
  Description of Artificial Sequence: Synthetic coding sequence
atggccctgcagatccccggcggcttctgggccgccgccgtgaccgtgatgcttgtcatgttgagcacccccgtcgccgaggcgcgggactttcctaaggattttctggtgcaattcaaaggaatgtgttacttcacaaatggcaccgaacgagtcaggggtgtggccaggtacatttataatcgggaggagtacggaagatttgattccgacgtgggagagtttcaggctgtgacagaactcggacgctctatcgaagactggaacaactacaaagacttcctggaacaggaacgggccgccgtggataaggtatgcaggcacaattacgaggcggagctgcgcacgacgctgcaacgccaggttgaacctaccgtgaccatcagcccctcaagaacagaggcccttaaccaccataacctcctcgtctgtagcgtgaccgacttttatccagcccagataaaagtgcaatggtttcggaacgatcaggaggaaacggctggggtggtcagtacgagcctgatcaggaatggcgactggacgttccaaatcttggtgatgcttgaaatcactcctcagcggggtgacatctacacctgccaggtggagcatccatcattgcagagccccattacagtggagtggcgcgcccagtctgagtcggctcaatcaaaaatgctcggtggagtcggaggatttgtgctcggtctcattttcctgggacttgggctgatcataaggcaccgcgggcagaagggcccccgcggtcctccaccagctggaaatatctctgcgatgatccaatccggagagcgcgcccaagcctag

SEQ ID NO: 43591 - DNA, 627 bp, Artificial Sequence
  Description of Artificial Sequence: Synthetic coding sequence
atgctgagcacccccgtggccgaggcccgggacttccccaaggacttcctcgtccaatttaaggggatgtgctattttacaaacggcacggaacgcgtccggggggtggccaggtacatatataaccgggaagagtatggtcggttcgattccgatgttggggaatttcaggcagtgactgagctgggccggtcaatcgaggattggaacaattataaggactttctagagcaggagcgggccgcagtggataaggtctgccgtcacaactatgaggccgagctgagaaccacacttcagaggcaggtggagcctactgttactatctccccgagccgcactgaggctttaaaccaccataatctgctcgtgtgttctgtcactgacttttaccctgctcagattaaggtccgttggttccgcaacgaccaggaggagaccgctggagtcgtttccacctcgctgataagaaacggagattggacttttcaaattctcgtcatgctcgaaatcacccctcaacggggcgatatatatacttgtcaagtcgaacaccctagtcttcagtcgcccattacagtggagtggaggcccagaggccccccacccgccggcctgcttcactag

SEQ ID NO: 43592 - DNA, 627 bp, Artificial Sequence
  Description of Artificial Sequence: Synthetic coding sequence
atgctgagcacccccgtggccgaggcccgggacttccccaaggactttctcgtgcagttcaaagggatgtgctatttcacaaacggcaccgagcgggtgcgcggtgtcgctcgctacatttacaaccgcgaggaatacggtagatttgactcggatgtcggagaatttcaagccgtgaccgagcttgggcgaagcatcgaagattggaataactataaagactttttagaacaggagcgcgcggcagtggataaggtttgcagacacaattatgaggctgagcttagaaccactctacagcgacaggtcgagccaacagttactattagtccaagtcggacagaagccttaaatcaccacaacctgctggtgtgtagtgtgacagatttttaccctgctcagattaaggtacagtggtttaggaacgaccaagaagagaccgccggggttgtctccacctcactaattcggaatggagattggacgtttcagatcctggtgatgctcgagattactccccaacgcggagacatctacacctgccaagtggaacacccaagccttcagagcccgattacagtggaatggaggcctcgcggtccacctcccgcggggctactgcattag

SEQ ID NO: 43593 - DNA, 627 bp, Artificial Sequence
  Description of Artificial Sequence: Synthetic coding sequence
atgctgagcacccccgtggccgaggcccgggacttccccaaggactttctcgtacagtttaagggcatgtgttatttcacgaacggtacagaaagagtgcgtggcgtagctcgatatatatacaatcgagaagagtatggacgctttgattccgacgtcggggagtttcaggccgtcacggaactgggacggtccatcgaggattggaacaactataaggacttcctggagcaagaaagagcggcagtggataaagtttgtcggcacaactatgaggccgaattgagaactacccttcagaggcaggtggagcctacagtgacaatttcaccttcccgcactgaggcactgaaccaccataatcttctggtttgctccgtgaccgatttctatcctgctcaaatcaaagtccagtggttccggaacgatcaggaagaaaccgctggggtggtgtctacctcactgatacgcaatggagactggacatttcagatcctcgtgatgctggaaatcaccccccagaggggcgatatctatacgtgtcaggtcgaacatccaagcctccagtcgccaataacagtcgagtggcggcctcgcggacctccgccagcgggccttcttcattag

SEQ ID NO: 43594 - DNA, 627 bp, Artificial Sequence
  Description of Artificial Sequence: Synthetic coding sequence
atgctgagcacccccgtggccgaggcccgggacttccccaaggactttctggtacagttcaaaggaatgtgctatttcacaaacggaacggagagggtgcgtggggtggctaggtacatctacaatcgtgaagagtacgggcggtttgacagcgacgtcggcgagtttcaggcagtgacggagcttggtcgctccattgaagactggaacaattacaaggacttccttgaacaggagagagctgccgtggataaggtctgtcgtcacaattatgaggctgagttgcgcaccaccctccagcgccaagtcgaacctaccgtgactataagcccgtccaggaccgaggccctgaatcatcacaacttgctggtctgcagtgtgactgatttttatccggctcagattaaggtcaggtggttcagaaatgaccaggaagaaacagcaggggtggttagcaccagtctgattcggaacggggattggacatttcaaattctcgtgatgttagagattaccccccaacgcggcgacatatatacatgccaggtcgaacacccaagcctacagtctcctattacagtggagtggaggcctaggggacctccccctgctgggctccttcactag

SEQ ID NO: 43595 - DNA, 627 bp, Artificial Sequence
  Description of Artificial Sequence: Synthetic coding sequence
atgctgagcacccccgtggccgaggcccgggacttccccaaggacttcctcgtccagttcaagggcatgtgttatttcacgaacggcactgagcgagttagaggggttgccaggtatatatacaatcgagaggaatatggcagattcgattcagacgtcggcgaattccaggcagtgaccgaactgggaagaagcatcgaggattggaataattataaagactttctggagcaagagcgtgcagccgtggacaaggtttgtagacacaattacgaagccgaactgagaaccacacttcagaggcaggttgagcccacagtcacaatctcacccagtaggacagaagccctgaatcatcacaacctgttagtgtgctctgtgaccgatttctatccagcacagatcaaggtccagtggttccgtaatgatcaagaggagactgccggggtggtgtctacctcccttattagaaatggggactggacttttcagattctggttatgctcgaaatcaccccccagcgcggagacatatatacatgccaagtcgagcacccctcactccagagccctattactgttgagtggcggccccgagggcctcctcctgcaggactccttcattag

SEQ ID NO: 43596 - DNA, 828 bp, Artificial Sequence
  Description of Artificial Sequence: Synthetic coding sequence
atggccctgcagatccccggcggcttctgggccgccgccgtgaccgtgatgctcgttatgctgtcaaccccagtcgcagaagccagagatttccctaaggatttcctagttcagttcaaggggatgtgctactttacaaacggcactgagagagtgagaggtgtagctaggtatatctataaccgggaagagtatggtcgatttgattcggacgtcggggaatttcaggcggtgaccgagttaggccgaagcatcgaggactggaataactacaaagacttcctggagcaagaaagagctgccgttgacaaggtctgtaggcacaactacgaagcagagctccgaacaacactgcagcggcaagtcgaaccaactgtgacaattagtccctcgcgcaccgaggctcttaatcaccataatctactggtatgttccgtaactgacttttatccagcccagattaaggtccagtggtttcgaaatgatcaggaagaaaccgccggggtggtgtcgacttcacttatacgtaatggcgactggacgtttcagattctggtcatgctagaaatcactccccaacgaggcgacatttacacttgtcaggtggagcacccgtctctgcagtcccccatcactgttgagtggcgggctcagagcgagagcgctcaatctaaaatgctgggcggcgtgggaggcttcgtgctgggcttgattttcttaggacttggccttatcattcggcatcgtgggcagaaaggacccagaggacctccccctgcgggaaacatttccgcaatgatacagtccggagaacgcgctcaggcctag

SEQ ID NO: 43597 - DNA, 627 bp, Artificial Sequence
  Description of Artificial Sequence: Synthetic coding sequence
atgctgagcacccccgtggccgaggcccgggacttccccaaggactttctggtgcaattcaagggtatgtgttatttcaccaatgggacagagcgagttcgaggagtggcaagatacatctacaatagggaggagtatggccggttcgattccgatgtaggagaattccaggcggttacagaacttggaaggtccatcgaggattggaataactacaaagatttcctggaacaagagcgtgcagcagtcgacaaggtgtgccggcataactacgaggctgaattgcgaactacccttcagaggcaggtggaaccgacggttacaatttcccccagtcggacggaggccctcaatcatcataacctgctggtgtgctccgtaactgacttttatcccgctcaaattaaggtaagatggtttcgaaatgaccaggaagaaacggcaggcgtggtctcgaccagcctgatcagaaatggagactggacattccagatcctcgtgatgttagagatcaccccccagcgcggagatatctatacatgtcaagtggaacatccttcattgcagagcccaattacagtggagtggaggccgcggggtccccctcctgcagggttgctccactag

SEQ ID NO: 43598 - DNA, 828 bp, Artificial Sequence
  Description of Artificial Sequence: Synthetic coding sequence
atggccctgcagatccccggcggcttctgggccgccgccgtgaccgttatgttggttatgctgtcgacaccagtggcggaagcacgcgactttccaaaagattttttagtacagttcaagggtatgtgctattttaccaatgggacagaaagagtccggggagtagcgaggtacatttataatcgggaagaatacggacggttcgacagtgatgtcggagaattccaagcagtgaccgagctcggacggagtatcgaggattggaacaactataaggacttcttggagcaggagcgggcggccgtcgataaggtctgccggcacaattacgaggcagaattacgcactacgctgcagcgtcaggtggagcccacagttacgatatccccctcgagaactgaggccctgaatcatcataatctactcgtgtgctcagtgaccgatttttaccccgcacaaataaaagtacagtggtttaggaatgaccaagaggagaccgctggagtcgtgtctactagtctgatcaggaacggtgattggaccttccagatcttagtaatgctggagattactccccaacgtggggacatatacacgtgtcaagtcgaacacccctccctgcagtctcctattaccgtagagtggagagcccaaagtgaatctgctcagagtaaaatgctgggaggcgtgggaggttttgtgctcggcctgatattcctgggcctgggcctgatcatacgtcataggggacagaaaggtccccgcggcccgcccccggccgggaacatctcggcgatgattcagtccggggagagggctcaggcctag

SEQ ID NO: 43599 - DNA, 828 bp, Artificial Sequence
  Description of Artificial Sequence: Synthetic coding sequence
atggccctgcagatccccggcggcttctgggccgccgccgtgaccgtcatgttggtgatgctctcaaccccagtggccgaggcaagggattttccgaaggacttcctggtgcagttcaagggcatgtgttacttcacaaacggaacagaacgcgtgaggggcgtggcgcggtacatttacaaccgggaggagtatgggagattcgactctgacgtgggcgaatttcaagccgtgacggaattagggcgatccattgaagattggaacaattataaagacttccttgagcaggagcgcgccgctgtagacaaggtgtgtaggcataactacgaggctgagctccgcactacattacaaaggcaggtggaacccactgtgaccatttcccccagccgaacagaggccctaaaccaccacaacttgttagtttgttcagttaccgatttctatccggcccagatcaaggtccagtggtttaggaacgaccaggaggaaacagctggagtcgtcagcaccagcctgatccgcaatggggactggacgttccaaattctggtgatgctggagattactccgcagcgaggcgatatatacacttgtcaagttgaacatccttctctgcagagccccattacagtagaatggagggcacagtctgagagtgctcaaagtaagatgttgggcggggtgggcggtttcgtgctcggcctgatcttcctcggcctgggccttattatcagacaccgagggcagaaagggccccggggcccgcctcccgcaggaaacatctcagctatgattcaatctggggagcgagcacaggcatag

SEQ ID NO: 43600 - DNA, 690 bp, Artificial Sequence
  Description of Artificial Sequence: Synthetic coding sequence
atggccatcagcggcgtgcccgtgctgggcttcttcatcatcgccgttcttatgtcagcccaggaatcttgggccataaaagaagaacatgtgattattcaggccgagttctacctgaatcctgaccagtcaggagagttcatgtttgacttcgacggcgacgaaatttttcatgtggatatggccaagaaagagaccgtgtggaggctggaggagtttggcaggtttgcctcttttgaggcccagggtgcattggccaacatcgccgtggacaaggcaaatctagaaattatgaccaagagatcaaactataccccgatcactaatgacaaatttacacctccagttgtaaatgttacctggctgcgcaatggcaagccggtcacaaccggagtctcggaaacagtcttcctcccccgcgaggaccaccttttccgcaagtttcactatctcccctttctgcctagcactgaggacgtttatgattgcagagtggagcattggggccttgacgagccactgctaaagcactgggagttcgacgctcctagccctcttcccgaaaccacagagaatgtggtgtgtgctctgggtctcacagtggggctggtcggcatcattataggcactattttcattatcaaagggctgaggaaaagtaatgccgctgaacgccggggtcccctttag

SEQ ID NO: 43601 - DNA, 765 bp, Artificial Sequence
  Description of Artificial Sequence: Synthetic coding sequence
atggccatcagcggcgtgcccgtgctgggcttcttcatcatcgccgtactgatgtctgcccaggagtcgtgggcaatcaaagaagagcacgtcattatccaggctgagttttacttaaaccctgatcagtcaggcgaattcatgttcgatttcgatggtgacgagatcttccacgtggatatggccaagaaggaaaccgtgtggcggcttgaagagttcggaagattcgcatccttcgaagcgcaaggtgcgttggctaatattgcagttgacaaggctaacctggagatcatgacgaaaaggtcgaactatactcccatcacgaacgtgccacccgaagtgacagtgctgactaatagcccggtcgaattacgggagccgaatgtgttgatctgcttcatcgataagttcacaccaccagtggtgaatgtcacatggctgcgcaatgggaagccagtgaccaccggcgtatcggagacggtgttcctgcctcgcgaggatcatctgttccggaagttccattacctgccattcctgccctctaccgaagacgtttatgactgtcgggtcgaacactggggtttggatgagcccctgctgaagcactgggaatttgacgctccttctccccttcccgaaaccacagaaaatgtggtctgcgctcttggcttgaccgttgggcttgtgggtattattatcggaaccattttcatcatcaagggcctgcggaagagtaatgccgccgaacggcgaggaccgttatag

SEQ ID NO: 43602 - DNA, 690 bp, Artificial Sequence
  Description of Artificial Sequence: Synthetic coding sequence
atggccatcagcggcgtgcccgtgctgggcttcttcatcatcgccgttctgatgtcggctcaggaatcctgggcaattaaggaagagcacgttattatccaagcagagttttacctgaaccctgatcagagcggggagtttatgtttgacttcgacggtgacgagatttttcatgtggatatggcaaaaaaggagactgtgtggaggttggaagagttcggtcggtttgcgagcttcgaggcacaaggagccctggccaatatagctgttgacaaagccaacctggagattatgaccaaacgctccaattacacaccaatcacaaacgataaatttactccacccgtggtgaacgtgacttggctcagaaacggaaagccggtgactaccggagtatcagaaaccgtatttctcccaagagaagatcacctgttcagaaaatttcattatctaccctttttgcccagcacagaggacgtatatgactgtagagttgagcattggggcttggacgaacctttgctgaaacactgggagttcgacgcaccctcgccgttgccagaaactacagaaaacgtcgtctgcgcacttggactgactgtgggactcgtgggtattatcatcggcaccatctttatcatcaagggggtacgcaagagcaacgcagctgaacggagaggccccttgtag

SEQ ID NO: 43603 - DNA, 765 bp, Artificial Sequence
  Description of Artificial Sequence: Synthetic coding sequence
atggccatcagcggcgtgcccgtgctgggcttcttcatcatcgccgtgctcatgtctgcacaagaatcctgggccataaaagaggagcacgtcattatacaagccgagttttatctgaaccccgatcaatcgggagagtttatgtttgactttgatggagatgaaattttccatgtggacatggcaaagaaggaaactgtgtggcggctggaggagtttgggagatttgcgagtttcgaggcacaaggtgcactggccaacattgcagttgataaggcaaatctagagattatgacaaagcgaagcaactatacccctatcactaatgtgcctcccgaggttactgttctgacaaactcccccgtagaactccgtgagcctaatgttttaatctgtttcatcgacaagttcactccacctgtagtaaatgtgacatggctccgcaatgggaaacctgtgacgactggggtttcggaaacagttttcctaccccgcgaggaccacctgttccgaaaattccattacctgccattcctgccctccactgaagacgtgtacgactgtagagtggagcattggggccttgatgaaccattattgaaacactgggagttcgacgccccatcacctctccccgagaccactgagaacgtcgtctgcgccctcgggcttaccgtaggcttggtggggatcattataggcacaattttcatcattaaaggggtgcgcaagtccaacgctgctgagagacgagggcctttgtag

SEQ ID NO: 43604 - DNA, 765 bp, Artificial Sequence
  Description of Artificial Sequence: Synthetic coding sequence
atggccatcagcggcgtgcccgtgctgggcttcttcatcatcgccgtcctgatgagcgcgcaagagtcttgggcgattaaagaggaacacgtgatcatccaggccgaattctacctgaatccggatcaaagcggagagttcatgttcgactttgatggagacgagatctttcacgtcgacatggctaaaaaggagacagtctggcgccttgaagagttcggaaggttcgccagttttgaggcacagggagccctagccaacatagccgtggataaggcaaacctggaaatcatgacgaagagatcaaattatacaccaatcaccaatgtgcccccggaggtgactgtgctgacaaacagtccggtggagttgcgagagccaaatgtcctgatttgtttcatagacaagttcactccgcctgtcgtgaacgtgacatggctacgtaacggcaagcccgtgactacaggggtcagcgagaccgtctttttacccagggaagaccatctgtttaggaaatttcactacctgccgttcctgccatcgacagaagacgtctatgattgtcgagtggagcattggggcctggatgaaccactgctgaaacactgggaatttgatgcccccagcccactcccagagactaccgagaacgtggtatgcgccctggggttgactgtgggtctggtgggcatcattatcggcacaatctttatcatcaaaggattaagaaaatccaacgctgccgagagaaggggacctttgtag

SEQ ID NO: 43605 - DNA, 690 bp, Artificial Sequence
  Description of Artificial Sequence: Synthetic coding sequence
atggccatcagcggcgtgcccgtgctgggcttcttcatcatcgccgtgctgatgagtgctcaggaatcctgggccatcaaagaggaacatgtaattatacaggccgaattttacttgaaccctgaccaatcaggagaatttatgttcgacttcgatggggacgaaatctttcacgtcgacatggccaagaaagagaccgtgtggcggctcgaagagttcggacgcttcgcatccttcgaggcccagggggcattggcaaatattgccgtggacaaggctaatctcgagatcatgaccaagaggtcaaactacactcccattacgaacgataaattcacgcccccagtggtgaacgtaacttggcttagaaacggcaaaccggttaccaccggcgtcagcgagacagtgtttctgccaagggaagaccatcttttccgcaagtttcactatctgccctttctcccctcaaccgaggacgtctatgactgcagagtggaacattggggactcgacgagccactcctgaagcactgggaatttgatgctccctctccactccctgaaaccacggagaatgttgtgtgtgctttaggcctcaccgttggactggtgggaattattataggaacaatttttattattaagggagtccgcaagagtaacgctgcagagaggcgtggccctctttag

SEQ ID NO: 43606 - DNA, 765 bp, Artificial Sequence
  Description of Artificial Sequence: Synthetic coding sequence
atggccatcagcggcgtgcccgtgctgggcttcttcatcatcgccgttttgatgagcgcccaggagagctgggcgattaaggaggagcatgtgattatccaggctgagttctatctgaaccccgaccagtccggcgaattcatgtttgacttcgatggagacgagatattccatgtagacatggcaaagaaggagaccgtgtggcgtctcgaagagtttggcagattcgctagctttgaggcccagggtgccctggccaatatcgccgtcgacaaggcgaacctggaaataatgaccaagaggagtaactatactccaatcaccaatgtccctcctgaggtgacagttctcacgaactcacctgtggagctacgagagcctaacgtcttaatctgttttattgataagtttacaccacctgtggtcaacgtcacctggctccggaacggaaagccggtgacaactggcgtgtccgaaactgtcttcctcccacgggaagaccatctgtttcgaaagttccattacttgccgttccttccaagtactgaagatgtctacgactgcagggtagagcactggggcctcgatgaacctctgctgaagcactgggagttcgatgcaccgagccctctgcctgagaccactgagaacgtagtctgcgccctcggacttacagtgggtctcgtcggcatcatcatcgggaccatcttcatcattaagggcgtacgcaagtcaaatgctgccgaacgacgggggccactctag

SEQ ID NO: 43607 - DNA, 765 bp, Artificial Sequence
  Description of Artificial Sequence: Synthetic coding sequence
atggccatcagcggcgtgcccgtgctgggcttcttcatcatcgccgttttaatgtcagcacaggagtcctgggcaatcaaggaggaacatgtcatcatacaagctgagttctatcttaaccctgatcagagcggcgaattcatgttcgattttgatggggatgaaatttttcacgtggacatggccaaaaaagagactgtctggagactggaggaatttggcaggttcgcttccttcgaagcacagggcgccctggccaatatcgcggtcgataaggctaacctggaaatcatgaccaagaggagtaattatacccctatcaccaacgtccctcctgaagtgactgtcctgacaaactcacctgtggagttgcgagagccaaacgttctcatttgcttcatagataagtttacccctcctgtcgttaatgtcacctggttgcgaaatggtaagcctgtcaccacgggcgtctcagaaacagttttcctgccccgggaggatcacctgtttcggaagtttcattacctgccgtttctgcctagtaccgaggacgtctacgattgcagggtggagcattgggggttagacgaacccctgctgaaacactgggagtttgacgcaccgtcccccctccctgagaccaccgagaacgtggtgtgcgctcttgggctcacagtgggactcgtcggtattataatcggcactattttcattattaaaggggtgcgcaaatcaaatgctgccgagagacggggccctttgtag

SEQ ID NO: 43608 - DNA, 690 bp, Artificial Sequence
  Description of Artificial Sequence: Synthetic coding sequence
atggccatcagcggcgtgcccgtgctgggcttcttcatcatcgccgtccttatgtcagcacaggaatcctgggccatcaaagaggagcacgtgattatccaggccgaattttatctgaatccagaccagagcggagaatttatgtttgatttcgatggtgatgagatcttccatgtggacatggctaagaaagagaccgtctggagactggaagaatttggccgctttgcctcgttcgaagctcagggtgccttagccaatattgcggtcgataaagcgaatctggaaataatgactaaaaggagcaactatacccctataaccaacgataaatttaccccacctgttgtgaatgtcacttggctgcgcaacggtaaacccgtgacgacaggagtgtctgaaaccgtttttctccctcgtgaagaccatttattccggaaatttcactatctcccttttttaccttctaccgaagacgtatacgattgtagagttgagcattggggcttggacgaacctctgctgaagcactgggagttcgatgccccaagtcccctgccagagaccaccgagaatgtggtttgcgccctggggctgactgtgggattggtcggtatcatcatcgggacaatcttcataataaagggagttcggaagtccaacgccgcagagcgaagaggtccgttgtag

SEQ ID NO: 43609 - DNA, 765 bp, Artificial Sequence
  Description of Artificial Sequence: Synthetic coding sequence
atggccatcagcggcgtgcccgtgctgggcttcttcatcatcgccgtacttatgagtgctcaggagagctgggccatcaaagaagagcatgttattatacaggctgaattttacctcaacccagatcagagcggtgagttcatgttcgattttgacggagatgagatttttcatgttgatatggcaaaaaaggaaacagtgtggaggctggaagaatttgggcgctttgccagcttcgaggcacagggtgcgctggctaacatagccgtggataaggcgaacttggaaatcatgacaaaacggtcaaactatacgcccattaccaatgtaccccccgaggtgacagtacttaccaattcgccggtggaacttcgggaacccaacgtgctgatctgctttatcgataaattcactcctccagtggtgaacgttacctggctgcgaaatgggaagccagttaccacaggggtgtccgagacggtgtttcttccccgagaagatcacctgtttagaaaattccactatctgccctttctgccatccaccgaggatgtctatgactgcagagtggaacactgggggctcgacgaacctctgctcaagcactgggaattcgatgctccctctcctctaccagaaactactgaaaacgttgtgtgcgcccttggccttacagttggactggtgggcataatcattggaactatcttcatcatcaagggagtgagaaagtccaacgccgctgagagacgcggccccctgtag

SEQ ID NO: 43610 - DNA, 690 bp, Artificial Sequence
  Description of Artificial Sequence: Synthetic coding sequence
atggccatcagcggcgtgcccgtgctgggcttcttcatcatcgccgtactcatgagtgctcaggaatcctgggccattaaggaggaacacgtcataatccaggctgagttctaccttaatcccgaccagagtggcgaattcatgtttgattttgatggcgatgaaatttttcatgtggatatggctaaaaaggaaaccgtttggcgactcgaggagtttggtagattcgcatccttcgaggcgcaaggtgcgttagcaaacatcgccgtggataaggcgaatcttgaaattatgactaagcgttcaaattacacaccaattaccaatgacaagtttaccccccccgtggtgaacgtgacttggcttaggaatggcaaacccgtgaccacaggcgtttcagaaacagtgttcctcccccgggaggaccatctgtttagaaaatttcactatttaccattcctcccatctaccgaggatgtgtacgactgccgtgtcgagcactggggtcttgatgaaccacttctcaagcattgggaattcgatgccccctcaccactgcctgagacaactgagaacgtagtgtgtgccctaggacttaccgtaggtttggtgggtattattatcggaactattttcatcattaaaggggtacgcaagtctaacgccgcagagcgtagaggtccactgtag

SEQ ID NO: 43611 - DNA, 690 bp, Artificial Sequence
  Description of Artificial Sequence: Synthetic coding sequence
atggccatcagcggcgtgcccgtgctgggcttcttcatcatcgccgtcctgatgagcgcccaagaatcttgggctataaaagaagagcacgtgattatccaggccgaattttacctgaatcccgatcagagcggtgaatttatgtttgacttcgatggagacgagatattccatgtggacatggccaaaaaagagacagtgtggcgcctcgaagagtttgggcggtttgctagcttcgaagcccagggggcgctggccaatattgccgttgacaaggctaacctggaaatcatgacgaagcgctcaaattacacgcccattaccaatgacaaattcacaccccccgttgtaaacgtgacttggctaagaaatggcaaacctgtcacaacgggagttagcgagactgtgtttttgccacgcgaggatcacctgttccggaagttccactacctccccttcttacccagcacagaggatgtgtatgattgccgggtggagcattggggcttagatgaacctcttttaaaacattgggagttcgatgctccttcaccactccctgaaactaccgagaacgtcgtctgtgcactcgggctcaccgtgggactggtcggcatcatcatcggcacaatctttatcattaagggcgtgaggaagtcaaatgccgcagaaagaagaggaccactttag

SEQ ID NO: 43612 - DNA, 690 bp, Artificial Sequence
  Description of Artificial Sequence: Synthetic coding sequence
atggccatcagcggcgtgcccgtgctgggcttcttcatcatcgccgtattgatgagtgcacaagagtcatgggccataaaggaggagcacgtgatcattcaggctgaattttacctgaaccctgaccagtctggtgagtttatgttcgatttcgacggtgacgagatttttcacgtggatatggccaagaaagagacagtctggagactcgaagaatttggccgattcgccagctttgaggctcagggagctcttgctaacattgccgtggataaggcgaatctggagatcatgactaagagatccaactatacgcctataacaaacgacaagtttacaccacctgtcgtgaatgtcacttggctgaggaatgggaagcccgtcaccacaggcgttagtgagacagtgtttcttcccagggaagaccacctgttccgaaagttccattacctgccttttctgccaagtactgaagacgtatatgattgcagagtcgaacactgggggctcgatgaacccttgctgaagcactgggagtttgatgccccaagcccgctacccgagacaactgagaatgtggtctgcgctctgggcctgaccgttggactcgtgggaatcattattggcacgattttcatcattaagggtcttaggaagtccaatgccgctgagagacggggcccgctttag

SEQ ID NO: 43613 - DNA, 765 bp, Artificial Sequence
  Description of Artificial Sequence: Synthetic coding sequence
atggccatcagcggcgtgcccgtgctgggcttcttcatcatcgccgtgttgatgtctgctcaggagagttgggccattaaagaggagcacgttatcatacaggcagagttctacttaaaccccgatcaaagcggggagtttatgtttgactttgacggggatgagattttccatgtggatatggccaagaaagagactgtgtggagactggaggaatttggccggtttgcctcattcgaagcccagggtgccctggccaacatagcagtcgataaagctaatctcgagattatgaccaagagaagcaattatacccccatcactaatgttccccccgaggtgacagtgctcaccaactcccccgtggagttaagggagccaaatgtcctgatctgttttattgacaaatttacaccacccgtcgtaaacgttacatggctgagaaatggcaagccagttacgacgggcgtatccgaaactgtctttctgcctagggaggatcatctgtttcggaagtttcattacctaccattcctcccttccaccgaagacgtctatgattgccgcgtggaacactggggacttgacgagcctctcttgaaacattgggaatttgacgcgccttcaccactccctgagaccaccgagaacgtggtctgcgctttggggctaaccgtaggcctcgtcggaatcattatcggaactatatttattataaaaggcgtacggaagagcaacgctgccgagagacgaggccctctgtag

SEQ ID NO: 43614 - DNA, 543 bp, Artificial Sequence
  Description of Artificial Sequence: Synthetic coding sequence
atggccatcagcggcgtgcccgtgctgggcttcttcatcatcgccgtactgatgtctgctcaggagtcatgggcaataaaggaagaacacgtgatcattcaggccgagttttacctgaaccctgaccagtcaggcgagttcatgtttgattttgatggcgacgaaatattccacgttgacatggctaagaaagagactgtttggcggttggaagaattcggaaggttcgcttcatttgaagctcaaggcgccctggccaacatcgcagtagataaggccaacctagaaataatgactaagcgctccaagcctagtccacgggattaccgcgaacggggcgtgtgcccagggccagactgcgggagcggcgggcaccattattgggatcacctacaccatcaaggtatcgctcagaaacagtgttcacggacccagggcgcgagtgtgaggcatatggaagtcatggtgttcctgagagagaagattacggaggaaacaagcgctttaatggctctgcaaagctggcagtactacaatccatag

SEQ ID NO: 43615 - DNA, 714 bp, Artificial Sequence
  Description of Artificial Sequence: Synthetic coding sequence
atgagcgcccaggagagctgggccatcaaggaggagcacgtgatcatccaagcggaattctaccttaaccctgatcagtcaggagagttcatgtttgactttgacggcgatgagatcttccatgtggacatggcaaaaaaggagaccgtctggagactggaagagtttgggcggtttgctagctttgaagcacagggcgcactggctaacattgcggtcgacaaggccaatctggagattatgacaaagcgcagtaattacacgccaattactaatgtgccaccagaagtgaccgtgttgaccaattcacctgttgagcttcgcgagccgaacgtactgatctgctttattgataaattcaccccgcccgtggtgaacgtaacgtggctgagaaacggaaagcctgtgacaacaggcgtgtcggagactgtctttctcccacgggaagatcacctgtttcggaaatttcactatctgccctttctgccttccactgaagatgtgtatgactgcagggtggagcactggggtctcgacgagcctctgctcaaacattgggagtttgacgcaccttcccctctgcccgagacgacagagaacgttgtgtgtgccctagggctgactgttggccttgtcggcattatcatagggaccattttcatcattaagggtgttcggaagtccaacgctgctgaaaggcgaggcccactttag

SEQ ID NO: 43616 - DNA, 498 bp, Artificial Sequence
  Description of Artificial Sequence: Synthetic coding sequence
atggccaagaaggagaccgtgtggcggctggaggagttcggccggttcgcttcgttcgaggcccagggcgccctcgctaacattgccgtcgacaaggcaaacctggagattatgacgaagcggagcaactatacacccatcacaaatgtgcctcctgaggttactgttctgaccaatagcccagtagaactgcgggaaccaaatgttctcatttgtttcatagacaaatttactcccccagttgtgaatgtgacgtggttacggaatggaaaaccagtcaccaccggagtttcggagactgtttttctctcgatcgcctttagctgtatctactttccattattccccattatccttctgtcaccatgcaatgcctcggggatcaaacacacaggcgtctgtctctgctacggaatgcctcacggcgcgagtctggtgtacctgctattcaaagtgtcatcaaactgcgactttagcgagcataataaactgttttag

SEQ ID NO: 43617 - DNA, 453 bp, Artificial Sequence
  Description of Artificial Sequence: Synthetic coding sequence
atggccatcagcggcgtgcccgtgctgggcttcttcatcatcgccgtgctaatgtccgcacaggaatcatgggccattaaagaagagcatgtgatcattcaggctgagttctacttgaacccagatcagtccggagagttcatgtttgactttgacggggacgagatcttccacgtggatatggcaaaaaaggaaactgtctggcgtctggaggaattcggtagattcgctagcttcgaagctcagggggccctggctaacattgccgtcgacaaggccaatctcgagattatgaccaagcgatcaaattatacacccattaccaatgtgcctcccgaagtcaccgtcctcaccaattcccccgtggagcttagagagcctaacgtgttgatttgctttatcatcaagggggtgaggaagagcaacgccgccgagcgaagagggccactgtag

SEQ ID NO: 43618 - DNA, 543 bp, Artificial Sequence
  Description of Artificial Sequence: Synthetic coding sequence
atggccatcagcggcgtgcccgtgctgggcttcttcatcatcgccgtgctgatgagcgcgcaggagagttgggccataaaggaggaacatgtgattatccaggccgagttctacctgaatccagaccagtccggagaatttatgttcgattttgacggagatgaaatctttcatgttgacatggccaaaaaagagacggtttggcgcctggaggagttcgggaggtttgcaagctttgaggcccaaggagccttagccaatatagctgtagataaagctaacttagagataatgaccaagcggagtaagcccagccctagagactatcgggaaagaggggtctgtccgggcccggattgcggaagtgggggccaccactactgggaccacctgcatcatcagggatcagcccagaaacagtgttccaggacacagggggcctccgtccggcatatggaggtgatggtgttcctccgtgagaagataacagaagagacctctgccctcatgactttgcagtcctggcaatactacaacccttag

SEQ ID NO: 43619 - DNA, 543 bp, Artificial Sequence
  Description of Artificial Sequence: Synthetic coding sequence
atggccatcagcggcgtgcccgtgctgggcttcttcatcatcgccgttctcatgagcgcccaggagtcctgggccattaaagaggaacatgtgataatccaggccgagttttacctgaacccggatcagtcgggggagttcatgttcgatttcgatggtgacgagatttttcatgttgacatggcaaagaaagaaacggtctggcgtctagaagaattcggcaggttcgcctctttcgaagcccagggggcactggctaatatcgccgttgacaaggccaacctcgaaattatgactaagcgcagtaagccgtcccctagagactaccgcgaaaggggcgtctgccctggccccgactgcgggagtggcggccaccattattgggatcacctccaccatcaaggttcggcccagaaacagtgctctcgtacccagggtgctagcgtgagacatatggaggtgatggtattcctgagagagaagatcacagaggagacaagcgctttgatgaccctccagagctggcagtattataatccgtag

SEQ ID NO: 43620 - DNA, 498 bp, Artificial Sequence
  Description of Artificial Sequence: Synthetic coding sequence
atggccaagaaggagaccgtgtggcggctggaggagttcggccggtttgcttcattcgaggcccagggggccctggctaatattgcagtcgacaaagccaatttggaaataatgacaaagagaagcaactatacgcccatcaccaatgtaccaccagaggtgacagttctaaccaatagtcctgttgagcttagggagccaaacgtgctgatatgttttatcgacaagtttaccccccccgttgtgaacgttacttggctgaggaacggaaaacctgttaccaccggggtctcagagacagtttttctgtccatcgcattttcatgcatctattttccattgttccccatcatcctgttaagcccttgtaacgcttcgggtatcaagcataccggggtgtgtctgtgctacggtatgccgcacggtgctagtctagtgtatctgctgtttaaggtgtcgagtaattgcgacttctctgaacacaacaaattgttttag

SEQ ID NO: 43621 - DNA, 543 bp, Artificial Sequence
  Description of Artificial Sequence: Synthetic coding sequence
atggccatcagcggcgtgcccgtgctgggcttcttcatcatcgccgtacttatgagcgcgcaggagtcctgggccattaaagaggagcatgtcattatccaggcagaattctaccttaaccctgaccaatcaggcgagtttatgtttgatttcgatggcgacgagatctttcacgtggatatggccaaaaaggaaaccgtgtggagactcgaagaatttggacgcttcgcgagtttcgaagcgcagggagccctggcgaacattgccgtggataaggctaacctcgagataatgactaagcggtctaaaccttcgcccagggactaccgcgagagaggagtttgccctggtcccgactgcggaagtggcggacatcactactgggaccatctgcaccatcagggatcagcgcagaaacagtgctcccgcactcagggggccagcgtgcgccatatggaggtgatggtgtttttgcgtgaaaagataactgaggagacatcagccctgatgacgctgcagtcctggcagtactacaacccttag

SEQ ID NO: 43622 - DNA, 498 bp, Artificial Sequence
  Description of Artificial Sequence: Synthetic coding sequence
atggccaagaaggagaccgtgtggcggctggaggagttcggccggttcgcttcattcgaggcgcagggtgctctggccaatattgccgtggataaggccaacttggaaattatgaccaaacgaagtaattatacaccaattacaaatgtgcctcctgaggtgaccgtccttactaatagcccagtggaattgagggagcccaacgtgctaatttgtttcattgacaaatttactcctccagttgtgaatgtgacatggctgcgcaacggcaaacccgtgactacaggggttagcgaaaccgtgtttctgagcattgcttttagttgcatttactttcccctattccctattatcctgctgtcgccttgcaacgcctctggtattaagcatacaggggtatgtctctgctacgggatgccccatggagccagcctggtatacttactgtttaaagtatcctctaactgcgattttagcgaacacaataaactgttctag

SEQ ID NO: 43623 - DNA, 714 bp, Artificial Sequence
  Description of Artificial Sequence: Synthetic coding sequence
atgagcgcccaggagagctgggccatcaaggaggagcacgtgatcatccaggccgagttctacctgaaccccgatcagagcggtgagtttatgttcgattttgacggagatgaaattttccacgtggatatggctaaaaaggaaacggtatggcggctggaagaattcgggaggttcgcttcgttcgaggcacagggagcgctcgcaaacatcgctgtagacaaagctaatcttgagatcatgactaaacgctccaactacacccccatcacaaacgttccaccagaggtcacagtcctcactaatagtccagtggagctgagagaacctaacgtgctgatctgctttattgacaagtttacacctccggtggttaatgtaacttggctccggaatggtaagcctgtcactactggcgtctccgagaccgtttttttaccacgcgaggatcatctgtttcgaaagtttcattatctcccattcctgcccagcaccgaggacgtgtatgactgccgggtggaacattgggggctggacgagcctctgttaaagcattgggaatttgatgccccttcccccttacccgagacaacagagaacgtcgtgtgcgctctcggacttacagtcggactagttggcataattatcggcactatcttcataattaagggggtgcggaagtctaatgccgcagagagacgagggcccctgtag

SEQ ID NO: 43624 - DNA, 543 bp, Artificial Sequence
  Description of Artificial Sequence: Synthetic coding sequence
atggccatcagcggcgtgcccgtgctgggcttcttcatcatcgccgtgctaatgagcgcacaggaatcctgggcaattaaggaggagcatgtgattatccaggccgagttttacctgaacccagaccagtccggtgagttcatgtttgattttgacggtgatgagatttttcatgtagatatggccaaaaaggaaacagtctggaggctcgaagagttcggccgctttgcttccttcgaggcgcagggcgcccttgccaatattgccgtagacaaggcgaacctcgaaatcatgacgaaacggtctaaaccaagcccaagagattaccgcgagagaggcgtgtgtcctgggcccgattgtggctctggggggcatcactattgggatcatctgcaccaccaagggagtgcccaaaagcagtgttcccggacccagggagcaagcgtgcgccacatggaggtgatggtgttccttcgggaaaagattaccgaggagacaagcgccctgatgacactgcagtcctggcagtattataacccttag

SEQ ID NO: 43625 - DNA, 498 bp, Artificial Sequence
  Description of Artificial Sequence: Synthetic coding sequence
atggccaagaaggagaccgtgtggcggctggaggagttcggccggtttgccagcttcgaggcgcagggggctctggccaatattgccgtagataaagccaatcttgaaatcatgactaaaaggagtaattacacgcctatcactaatgtcccgccggaggtcacagttctcaccaattctcccgtcgaattacgcgagcctaacgttcttatatgctttatcgataaattcactccaccagtcgttaatgtgacctggctgcggaatgggaaaccggttaccactggggttagtgaaacagtgtttttgagcatcgccttttcatgtatctacttccctttatttccaataatactgttgtccccctgcaacgcatctggaatcaaacatacaggggtttgtctgtgttacggtatgccgcacggagcttcactcgtctatttgttattcaaggtttcctcaaactgcgacttctctgagcacaacaagctgttttag

SEQ ID NO: 43626 - DNA, 498 bp, Artificial Sequence
  Description of Artificial Sequence: Synthetic coding sequence
atggccaagaaggagaccgtgtggcggctggaggagttcggccggtttgcctccttcgaggcacagggagccctggctaacatcgctgtcgataaggctaacctagaaatcatgactaaacgtagcaattatacacccattactaacgttccacccgaagtgacagtgttgactaatagccccgtcgagctccgcgaaccaaacgtcctgatatgctttattgacaagtttaccccaccagtggtgaatgtaacctggctgagaaatggcaagcccgtgaccacaggagtgagcgaaactgtgtttctctccatcgcctttagctgcatatactttcctttatttcccattattctgctttcaccatgtaacgcctcagggattaaacacacaggggtgtgcctgtgctacggaatgcctcatggggctagtctggtgtacctgttgttcaaggtgtcatcgaactgcgacttcagcgagcataataaattgttctag

SEQ ID NO: 43627 - DNA, 714 bp, Artificial Sequence
  Description of Artificial Sequence: Synthetic coding sequence
atgagcgcccaggagagctgggccatcaaggaggagcacgtgatcattcaggctgagttttacctgaaccctgaccagtccggagaatttatgtttgatttcgatggcgacgagatttttcacgtagacatggcgaaaaaggagaccgtgtggagacttgaggagtttggccgtttcgcaagctttgaagcgcagggagctcttgcaaacattgccgtggacaaagcaaacctggaaataatgacaaagcgcagtaactacacccccatcactaacgtgcctcccgaggtaacggtccttactaatagccccgttgagcttcgggaacccaatgttctgatttgcttcatcgacaaattcactcctccggtcgtgaatgtcacctggctgcgtaatggcaaaccagtcactacaggggtcagcgaaaccgtgtttttaccacgcgaggatcatttgttcaggaaatttcattacctcccttttttgccttccacagaagacgtatatgattgtcgggtggagcactgggggcttgatgagcccctcttgaagcattgggaatttgatgccccctctcccctgcctgagaccacagagaatgtggtgtgtgcactaggactgactgtggggctcgtgggcatcataatcgggaccatcttcatcatcaaaggcgtaaggaaatctaatgcagcggagcgccgggggcccctatag

SEQ ID NO: 43628 - DNA, 543 bp, Artificial Sequence
  Description of Artificial Sequence: Synthetic coding sequence
atggccatcagcggcgtgcccgtgctgggcttcttcatcatcgccgtcttaatgtctgcccaagagagctgggccatcaaggaggaacacgtgatcattcaggcggagttttacctgaaccctgaccaatccggagaattcatgttcgattttgatggtgacgaaatcttccacgtggatatggcaaagaaggagacagtttggagactggaagaattcggcaggtttgcctcctttgaagcacagggtgctctggcgaatatagcagttgataaagccaacctggagatcatgacaaaaagaagcaaacctagcccccgtgactaccgggaatgtggtgtctgccccggccccgattgcggttccggaggacaccattattgggatcacctccaccatcaggggtcggctcaaaaacagtgttcacgtacccagggagcttctgttcggcacatggaggtaatgatgttcctccgggaaaaaattacagaggagacgtctgctcttatgacactacagagttggcagtactacaacccttag

SEQ ID NO: 43629 - DNA, 498 bp, Artificial Sequence
  Description of Artificial Sequence: Synthetic coding sequence
atggccaagaaggagaccgtgtggcggctggaggagttcggccggttcgcatcattcgaggctcagggggcactcgccaacattgctgtagacaaggctaatctggagatcatgaccaagcgctctaattatacacccattacaaacgtgccacctgaggtcaccgtgcttacaaactcacccgtcgagctgcgagagcctaacgtgctcatttgcttcattgataagtttacaccgcctgtagttaacgtcacctggttgaggaatggtaagccagtgactactggtgtcagcgaaaccgtcttcctgagtattgcatttagctgcatctactttcccctgttcccgatcatacttctcagcccctgcaatgcttcaggcattaagcatactggcgtgtgcctctgctacggtatgccccacggagccagcctggtgtaccttcttttcaaagtgagctctaattgcgacttctcagaacataataagctgttctag

SEQ ID NO: 43630 - DNA, 714 bp, Artificial Sequence
  Description of Artificial Sequence: Synthetic coding sequence
atgagcgcccaggagagctgggccatcaaggaggagcacgtgatcatacaagctgaattctatctgaatccggaccagagtggtgaatttatgttcgactttgacggggacgaaatttttcacgtggacatggctaagaaggagacagtttggcgcctggaagagtttggaagatttgcatccttcgaggctcagggtgcactggcaaacattgccgttgacaaggcaaatctggagatcatgactaagcgctcaaattatacccctattacaaacgtcccaccagaggtcacagttcttactaattcaccagtggaattgcgagagccaaatgtgctgatctgttttattgataaattcaccccacctgtggtgaacgtcacatggttgagaaacggtaagcccgtaacgactggggtatctgagaccgttttcctcccacgcgaagatcacctttttcggaagttccactacctgcctttcctaccaagtacggaggatgtttacgactgtcgggtggaacattgggggttggacgaaccgctgctcaaacattgggagtttgatgcgccgagcccgctgcctgaaactaccgagaatgtcgtttgtgccctaggtctgacggtggggctcgtggggattattattgggaccattttcattatcaaaggtgtgcgcaagagcaatgcagcggaacgtcgcggccccttatag

SEQ ID NO: 43631 - DNA, 801 bp, Artificial Sequence
  Description of Artificial Sequence: Synthetic coding sequence
atggtgtgcctgaagctgcccggcggcagctgcatggccgccctgactgtgactctgaccgtactaagctcaccgctggcactggcgggcgacacgcagcctcggttcctggagcaggccaagtgcgaatgtcacttcctgaacggaacagagcgggtgtggaacctgatccgctatatatacaaccaggaggagtacgcccgttataattcagatctcggggaataccaagctgtcactgagctgggccggccagacgccgaatactggaactcccagaaagatttgctcgaacgcagacgggcggaggtggacacgtactgccgctataactacggcgtcgttgagtcctttaccgtccagaggagagtgcagcccaaggtaacagtttacccaagtaagactcagccactccagcatcataacttgctggtctgcagcgtcaacgggttttatccagggtcaattgaagttcggtggttccggaacggccaggaggaaaaagccggtgttgtatcaacagggctgattcaaaatggtgattggacgttccagaccttggtcatgttagagaccgtcccccgatcaggtgaggtttacacctgccaggtcgagcacccatccatgatgagtcccctcaccgttcagtggtctgctagatctgagtctgcccagtcaaaaatgcttagcggagtggggggcttcgtactgggattgttgttcctcggcaccggtctctttatctatttccgcaaccagaagggacacagcgggctccagcccacaggccttctcagttag

SEQ ID NO: 43632 - DNA, 801 bp, Artificial Sequence
  Description of Artificial Sequence: Synthetic coding sequence
atggtgtgcctgaagctgcccggcggcagctgcatggccgccctgactgtgacgctcactgtcctgagctccccacttgccctcgctggagatacacagccccgcttcctggaacaggcaaagtgcgagtgccatttcctgaacggcactgaacgagtgtggaaccttatccgctacatttacaaccaagaagagtatgcccgctataactccgacttgggcgagtaccaagctgtaaccgagttgggccggccagacgctgagtactggaactcccaaaaagacctgttagagagacggagggcagaggtagacacctattgcagatataattatggggttgtggagagcttcaccgttcagcgcagggttcagccaaaagtaacagtgtacccttctaagacccagcctctgcagcaccataacctattggtttgttctgtaaacggcttctatccagggagcattgaagtacgatggtttaggaacagtcaggaagaaaaagccggcgtggtgagcactggactcatccagaacggggactggacatttcagacgctggtgatgctcgagaccgttcctaggagtggtgaagtgtatacgtgtcaggttgagcaccccagcatgatgagtccattgactgttcagtggtcggcgaggtcagagagtgcccagagtaagatgctgtcaggagtcggaggcttcgtcctggggctgctctttctgggcacgggcttgttcatttactttcgcaatcagaaaggccattctggtcttcagccgacgggactgctgtcttag

SEQ ID NO: 43633 - DNA, 801 bp, Artificial Sequence
  Description of Artificial Sequence: Synthetic coding sequence
atggtgtgcctgaagctgcccggcggcagctgcatggccgccctgacggtgacactcacagtgctgagttccccactggctcttgccggggacactcaaccacgatttctggaacaggctaagtgtgagtgccacttcctgaacggcaccgagcgtgtgtggaacctgatacgctacatttacaaccaagaggaatacgccaggtataacagcgatctaggagagtatcaggcggtaaccgaactcggcagaccagatgcagagtactggaatagccagaaggacttgcttgagcgacgccgggcagaggtcgacacatattgtaggtacaattacggtgtggtggaatcattcaccgtgcaacggcgcgttcagcctaaggtgactgtgtacccctctaagacacagccacttcagcaccacaacctcctggtgtgctcagttaatggtttttaccccggctcaatcgaggtacggtggtttaggaacgggcaggaggagaaagcaggggtggtgagcacgggactgatccaaaatggggattggacatttcaaacactcgtcatgcttgagacggtcccccggagcggtgaagtatacacctgtcaggtagaacatcctagtatgatgtcccccctgacggtgcagtggagcgcccggagcgaaagcgctcaatctaagatgctcagtggtgtgggtggattcgtcctgggactgctgttccttggaaccggcttatttatttactttcgaaaccaaaaaggccatagtggccttcagcccacaggtctattgtcttag

SEQ ID NO: 43634 - DNA, 1173 bp, Artificial Sequence
  Description of Artificial Sequence: Synthetic coding sequence
atgagcgtgcgggtggcccgggtggcctgggtgcggggcctgggcgcctcctacagacggggcgcaagtagcttcccagttccgcctccaggggcacagggggtggccgagctcctacgcgatgcaaccggtgccgaagaagaagcgccttgggccgccaccgagcgccgtatgccaggccagtgttccgtccttctattccctggacagggcagccaggtagttggcatgggaaggggcttactgaattaccccagagttcgcgaactatacgccgcggcccgaagggtgctggggtatgatctgctggagctcagccttcatgggccccaggaaacactcgacaggactgttcactgccagccggctatctttgtggccagcctcgcagccgtggaaaaattacaccacctccagccatccgttattgaaaattgcgtcgctgctgccgggttctcagtaggggaattcgctgcgctcgtcttcgctggcgctatggagtttgccgaagggttgtacgccgtaaaaatccgcgcggaagcaatgcaagaggctagcgaagccgtaccttccggcatgctgtcagtgctggggcagcctcagtcaaagttcaattttgcctgtttggaagcccgagagcactgcaagtctctgggtattgaaaatccagtgtgcgaggtgtcaaattacctctttccagactgtcgggtgatctccggccaccaggaagcgctgagattccttcagaaaaacagttccaagttccacttcaggcgtaccagaatgcttccagtcagcggcgcctttcacacccgcctcatggaacctgcggtcgaaccattgacccaggccttgaaggctgttgatatcaaaaaaccattggttagcgtgtacagtaatgtgcatgctcaccgttacagacaccctggacacattcataagctcctggcccagcaattagtgtcccctgtgaaatgggaacagaccatgcatgctatctacgaacgcaaaaaaggccggggcttccctcaaacatttgaggtggggcccggcaggcaacttggtgcaatcctgaagagctgcaatatgcaggcctggaagtcctactcagctgtggatgttctccagactctggaacacgtagatcttgatccccaggaaccaccccgatag

SEQ ID NO: 43635 - DNA, 543 bp, Artificial Sequence
  Description of Artificial Sequence: Synthetic coding sequence
atgagcgtgcgggtggcccgggtggcctgggtgcggggcctgggcgcctcctatcggagaggagctagtagctttccagtgcctccacccggtgcacagggagttgccgagcttctacgggacgccaccggcgccgaagaggaggcaccctgggccgccactgaaaggagaatgccgggtcagtgttctgtcctcctgtttccgggccagggcagtcaggtcgtaggaatgggccgagggctgctgaactatccacgtgtcagggagctttacgccgctgccaggagagtcctcggctacgacctcctcgaactgtcccttcacgggccacaggaaacccttgaccgcactgtccactgccagccagcaatcttcgtggcctccttggccgccgttgagaagcttcatcacttgcagccctccgtgatcgagaactgtgtcgcagctgcaggcttttccgtgggagaattcgctgccctggtgttcgccggcgctatggagtttgccgaaggctctaccgtctcacccgaggagtttctgtag

SEQ ID NO: 43636 - DNA, 3414 bp, Artificial Sequence
  Description of Artificial Sequence: Synthetic coding sequence
atgcccctgagcagccacctgctgcccgccctggtgctgttcctggctggatcctctggctgggcctgggtgcctaaccactgtcgctctccaggacaggcagtgtgcaatttcgtctgtgactgtcgcgactgttctgacgaggctcaatgcggataccatggcgcttcaccgactctgggggcacctttcgcttgtgatttcgagcaggatccctgtggatggagagacatcagtacaagcggatacagttggctccgggaccgcgctggagccgcattagagggccctgggccacattcggatcacacactgggaacggacctaggctggtatatggccgttggtacccatcgtggcaaggaggcctcaactgccgccctgaggtcccctacgctgcgtgaagctgcctcaagctgcaagctcaggttgtggtaccacgcagcatctggcgacgttgctgagctaagggtcgaattgactcatggggccgaaaccctaaccttgtggcagtctacgggcccctgggggcccggctggcaggagctggctgtgactacgggcagaatcagaggtgactttcgcgttacctttagcgctacgaggaatgctacccatcgcggagctgtggctctggacgatctggagttctgggactgcggcctaccaacaccacaggctaattgccccccaggacaccaccattgccaaaacaaagtgtgtgtggagccccaacagttatgcgatggggaagacaattgcggagacttgagcgatgaaaacccactgacttgtggcaggcacatcgccacagacttcgaaacaggcctcggcccatggaaccggtctgaaggttggtccagaaaccatcgagccggtggaccagagagaccaagttggccccggagagatcatagtagaaattccgcgcaggggagctttttggtatctgttgcagagcctggaacgcccgccatactgtccagtccagagttccaggccagtggcaccagtaactgctccctagtcttttaccagtatctgagcgggagtgaagcagggtgcctgcagctctttctgcagactctcggcccaggcgctccacgagctcctgtccttttgcgcaggagaaggggggaactggggactgcgtgggtgcgagacagagtcgatattcagtcggcttacccatttcagattctgctggccggtcagaccggccctgggggtgtggtgggactggacgacctcatactctcagatcactgtcggcccgttagtgaggtatctaccctgcaacccttgccccctggtcccagagcgcctgcaccccagccactgccaccttcatctagactccaggattcatgcaagcaagggcatctggcctgcggagatttatgcgttccaccagagcagctgtgcgacttcgaggaacagtgcgctggcggggaagatgaacaggcttgcggcaccactgacttcgagagtcccgaagccggcgggtgggaagatgcctccgtgggccggctgcagtggagaagagtgtccgcccaggagtcccagggttcctctgccgcagcggcaggccatttcctatctcttcagagggcttggggacagctcggcgcagaagccagagtcctgacccccctcctgggaccttcaggaccaagctgtgagttgcacttggcatattatctccagtcccagccgagagaggtctcctgcaacttcgagcgggacacatgctcgtggtatcccggacatctgagcgatacccactggcgctgggtggagagtaggggtccagatcatgaccacactactggacagggacatttcgtgctgctcgaccctaccgatcccctggcctgggggcactctgctcacctgctgagtagacctcaggtgcccgctgcccccaccgagtgccttagcttctggtaccacttacatggtcctcagattgggacacttcgtctggctatgcgccgcgagggcgaggagacccacctttggagtaggtcagggacacagggtaatagatggcatgaagcttgggctaccctcagccatcaacctgggtcacacgcccagtatcaacttttgttcgaaggtctcagagatgggtaccacgggacaatggcactggatgatgttgccgtgcggcccggtccttgctgggctcccaactattgctcgttcgaggactcagattgtgggttctctcctggaggccagggtctgtggcggcgccaagctaacgcctctggccatgcagcttggggaccaccaaccgaccacaccacggaaacagctcagggccactatatggtggttgatacgtccccggacgcactgcctcggggtcagaccgcctctcttacatccaaggaacacagaccgttggcccagccagcatgcttaaccttctggtatcatggatcccttcgaagtccgggaacactcagggtgtacctggaggaaagagggaggcatcaggttctgagcctctccgcccacggcggattagcctggcgcctgggatcaatggatgtgcaggctgaacgagcttggcgagtggtatttgaagctgtggccgccggggtggctcactcctacgtggcgctcgatgatctgttgctgcaggacggaccatgcccacagccaggctcatgcgattttgaaagcggcctgtgcggttggtcacatcttgcatggccggggctaggaggctatagttgggactggggaggaggtgctactccatccaggtatccccagcctccagtcgaccatactctgggcaccgaggcagggcattttgccttcttcgagacgggggttctggggccgggcggtagagcagcctggctacgctctgagccactgccagctactccggcttcttgcttgcggttttggtaccacatggggttccctgagcacttctataaaggcgaattaaaggtcctgctccacagtgcgcagggacaacttgccgtctggggcgcaggcggtcacagaaggcaccagtggttagaggctcaggtggaagtagcgtcggctaaggaatttcaaatagtgttcgaggccactctgggaggccaacctgctcttggccctatagccctagatgacgttgaatatctggcgggtcaacactgccagcagcccgctccaagcccaggcaacacagctgccccagggtccgtgcctgcagtggtggggagcgccctcctactcttgatgctgctcgtgttgcttgggctgggcggtcgaaggtggctgcagaagaaggggagttgcccctttcagtctaacacggaggcaactgccccaggctttgataatatcctcttcaatgccgacggggtgaccctgcctgccagcgtaacatccgacccttag

SEQ ID NO: 43637 - DNA, 3609 bp, Artificial Sequence
  Description of Artificial Sequence: Synthetic coding sequence
tgaggctgggcctgggtgcccaaccactgccggagccccggccaggcagtgtgtaactttgtctgcgactgtcgagattgttctgacgaggctcagtgcggttatcatggagcatctccgaccctcggcgctccatttgcatgtgactttgaacaggatccttgcggatggagggacatctccacctctggatattcctggttaagggatcgtgcaggcgcggctctggagggtcccggcccccatagcgaccatacacttggaactgatctggggtggtatatggctgtcggcactcataggggcaaggaagcgtctactgctgccctgcgatcccccaccctaagagaggccgccagcagctgtaaactccgactgtggtaccatgctgcatcaggcgatgtcgcggagcttcgcgtggaacttacacacggggctgagacgctgaccctttggcagagcactggaccttggggtccaggttggcaggagcttgcagtgaccactggtcggataaggggggacttccgagttacgttctccgctacacggaatgcaacccatcggggcgccgtggcgctcgacgatctcgaattttgggactgcggcttgcctacgccacaggccaattgtcctccgggacaccaccattgccagaacaaggtctgcgtggagccacaacaactctgcgacggcgaggacaactgtggagatctttctgatgagaacccactgacttgtgggcgccacatcgctactgactttgaaaccgggctgggaccttggaatagatcagagggctggagcaggaatcatcgagcagggggtcctgaaagaccttcctggccaaggcgcgaccacagtcggaatagtgcccagggttccttcctggtgagtgttgctgagcccggcactccggccatactgagcagtcccgagttccaggcatctgggacttccaattgtagcctagtcttctaccagtacctaagtgggagtgaggccgggtgtctgcagttatttctgcagactctggggcccggtgcaccacgggccccagttctgttaaggcgccgaaggggcgaactgggaactgcttgggtccgggatagggtggatatccaaagtgcctaccctttccaaatcctgctggccggccaaaccggcccgggcggagtggttggtcttgatgatttaattctgtctgatcactgccgtccggtcagcgaagtctccaccctccagccactgccccctggcccgcgcgcgccagctccccagccgcttcctcccagtagccggctgcaggacagctgtaagcaggggcatttagcttgtggcgacctatgtgttcccccagagcaactgtgtgacttcgaagaacaatgcgcaggcggtgaggatgagcaggcctgcggaacaaccgacttcgaatcccctgaagccggtgggtgggaggatgcttccgttggaagattgcagtggcgacgagtgtctgctcaagagtcccagggctcttccgctgccgccgcgggtgaggctcaggggcacttcctgtccttgcagcgggcgtgggggcaactgggcgccgaagcgcgggtgttgacacccctcttgggccccagcgggccttcgtgtgagctccacctggcttactacctgcagtcacagcccagagggttcctggcacttgtagtggttgataacggctctcgtgagctggcctggcaggcccttagctctagcgcagggatctggaaggtcgataaagtcttgctgggtgcccgccggaggccttttagattagagttcgtgggcctcgtggacctcgatggccctgaccagcagggggcaggagtcgacaatgttactcttagggattgttctccgacagtcaccacagagcgcgaccgggaagtctcctgtaatttcgagagagatacttgcagctggtatcccggacacttatctgacacccactggcgctgggtagaatctcgcggtcctgatcacgaccacactactgggcagggccactttgtcctgctcgacccgacagaccccctggcttggggtcattcggcccatttgctctcccgaccgcaggtcccagctgcccccactgaatgtctctcattttggtaccatttgcacggaccccagatcgggaccctacgattagccatgaggagagagggcgaggagacccacctgtggagccgctctggcacacagggcaatcgttggcatgaagcttgggccacgctgtcacaccagcccggcagccacgcccagtaccagctcttgtttgaaggactgcgcgatggctatcacggaacaatggcattagatgacgtggccgttcggccaggcccatgctgggctcccaactactgcagcttcgaggatagcgattgcggttttagtccgggagggcagggactctggcggaggcaggcaaatgccagcggccacgcggcgtgggggccccccactgaccatacaactgaaaccgcccagggacactacatggtggtggacactagcccagatgccctgccccgcggtcagacagcttccctgacctcgaaggagcaccggccgcttgctcagccggcgtgtctgacattttggtaccatggatccctgcggagtcccggaaccttacgagtatacttggaggagcggggaagacaccaggtgcttagcctgtcagcccacggcggcctggcctggagactggggtctatggatgttcaagcggagagagcttggcgagttgtttttgaagcagtggcagccggcgtggctcattcttatgtagctttggatgacctacttctgcaggatggaccttgtccccagcctggatcttgtgacttcgagtctggtctctgcgggtggagtcatctggcctggcctggcctgggaggatattcgtgggattggggaggtggagccacccctagccgatatccccaaccacccgttgatcatactctcggaacggaagctggtcattttgctttcttcgagactggtgtgctaggcccaggaggcagggcagcatggcttaggtccgagccactgcccgctactcctgcttcctgcttgcggttttggtaccacatgggcttccctgaacatttctataaaggggagctgaaagtcctgttgcatagcgctcaaggacaactcgctgtgtggggagccggaggccaccgccggcatcagtggctcgaggcacaggtggaagtggcctcagctaaggagtttcagatcgtctttgaggctactcttggaggacagcccgcattggggccgatagctttggatgacgtcgaatacctagctggccagcactgccaacagccggctccaagcccaggcaatactgctgccccggggtcagtgccagctgtggtaggttccgcattgctcctactcatgcttcttgtactcttaggccttggtggtcgtagatggttacagaaaaaaggctcgtgtccgtttcagagtaacactgaggccaccgctcccggctttgataacattctatttaacgctgacggcgtgactctgccggcttccgtgacaagcgacccgtag

SEQ ID NO: 43638 - DNA, 3651 bp, Artificial Sequence
  Description of Artificial Sequence: Synthetic coding sequence
atgcccctgagcagccacctgctgcccgccctggtgctgttcctggcggggagttcaggatgggcgtgggtgcccaaccactgtaggtcacccggacaggcggtttgcaactttgtctgcgactgccgcgattgctcagatgaggcccaatgtggatatcacggagcctctcctacattaggagctccattcgcctgtgacttcgagcaggacccttgcgggtggcgcgatatttcaacctccggctactcttggctgcgagatcgagcgggggcagctctggaaggccccggcccacattcagaccataccctcggaacagacttgggctggtacatggccgtgggcacccatcgagggaaggaggcctccaccgccgctctgcgctctccaacccttagggaagccgcatctagttgtaaactaagactttggtaccatgccgcgagtggcgacgttgctgagctgcgggtagagttgacccatggtgcagagaccctcacactttggcagagtaccggcccttgggggccggggtggcaagaactggccgttaccacgggacgaataagaggcgactttcgtgtgacattcagtgctacgagaaacgctacccatcggggggcggtggctttggacgacctggagttttgggactgcggcttgcccacacctcaggcgaactgtcctccaggccaccaccactgccagaataaggtatgtgtcgaacctcagcagctgtgtgatggagaggataactgcggagacctgtccgatgaaaaccccctcacatgcggaagacacatcgccaccgatttcgagactggactagggccctggaaccgttcagaggggtggtcacgaaaccatagagccggtggaccagaaagaccgagttggccccgtcgggaccactccagaaattcagcacagggctcgtttctggtgagtgtggctgaaccaggtactcccgcaattttgtcctctccagagttccaggcctccggcacatcgaactgctctttagtgttctatcagtatctgagcgggtcagaggctggctgcctgcaattattccttcagacactgggtccaggcgcgccccgcgctcccgttctcctgagacgccggagaggagaactcgggaccgcgtgggttcgggacagggtggatattcagtctgcatatcctttccaaattctccttgctgggcaaacaggcccaggtggcgttgtggggctggacgatttgattctctcggaccattgtcggcctgttagcgaggttagcacactacagcccctgcctccaggaccacgagctcctgcacctcaacccttgcccccatcttctagattacaggacagctgtaaacaaggacacctggcctgcggagacttgtgcgtgccccccgagcaactttgtgatttcgaagaacagtgtgcaggaggcgaggatgaacaagcctgtgggaccaccgattttgagagtcccgaggcaggtggttgggaggacgctagtgtgggtcggctgcagtggcgacgggtgtcagcacaagaaagtcaaggtagctcagctgccgccgcaggtcatttcctctctctgcagagagcttggggccagctgggtgcagaggctagagtactgactccattactggggccttccgggccctcttgcgagttgcatcttgcgtattatcttcagtctcagccaaggggctttcttgcacttgtggtggtggacaatggctctcgggagctcgcctggcaggcgttgtcaagctcggccggcatctggaaggtcgacaaggtcttactaggagcccgtaggaggccctttaggctggaatttgtgggcctcgtggacctggacggtcccgaccagcagggggccggagtggataacgtaacgctgcgggattgctcacccacagtgaccaccgaacgtgacagggaggtgagttgtaactttgagagagatacgtgcagctggtatccgggacacctatccgatacgcattggcgctgggtcgaatctcgcggcccggatcacgaccatactaccgggcaagggcatttcgtgctgctggatcctactgatcccctcgcctggggtcatagcgcacacctcctcagtcgcccccaggtccctgccgcccccacagagtgcttatcattctggtaccatttgcacggcccacagataggcactctgcgcctggctatgcgacgcgaaggtgaagaaacccatctgtggagtagaagcgggactcagggaaacaggtggcatgaggcttgggccaccctctcccatcagcctggtagccacgcccagtaccagctgctctttgagggtttgagggacggctaccacggaacaatggccctggacgacgttgctgtccgacctggaccctgttgggccccaaattattgttccttcgaagatagcgactgtggcttctctcctggcggacaaggactttggaggagacaggctaacgctagcggtcatgccgcatggggcccgcccacggaccacaccaccgagaccgctcaggggcactatatggtggtggacacatccccagatgctctcccacgtggccaaacagcatctcttacgtcgaaggaacatagacctctggctcaacccgcgtgcctaaccttctggtaccacggcagcctgagaagccccggcaccctcagagtttacctcgaagagcgcggaagacaccaggttctctccctttccgctcacggtgggctcgcttggcggctgggaagtatggatgtacaggctgagagggcttggcgagtggtgttcgaggccgttgcagcaggcgtggctcattcctacgtagctctggatgatctgctactgcaggacgggccgtgtcctcagcccggaagttgcgattttgagagcgggctgtgtggttggagccacctcgcctggcctggactcggcggctattcatgggactggggcggcggcgcaaccccttctcgatatcctcagccccctgttgaccatacactcggcacagaggccggtcacttcgccttttttgagacaggcgtgctggggcccggcggccgggccgcatggctccggtctgagccactccctgccacaccggcaagctgtctgcggttttggtatcatatgggttttcccgaacacttctacaagggcgagttgaaggtccttctccactcagcacaagggcaattagctgtttggggagccggtggccatcgcagacaccagtggctggaggcacaggtggaagtggcttccgccaaggagtttcaaatcgtcttcgaggccaccctgggcgggcaacccgcattgggtcccattgctcttgacgacgtggagtacctcgcaggccagcattgccagcagccggccccgagccccggaaacactgccgcccccggcagtgtgccggccgtagtcggcagcgcccttctcctgctcatgctacttgtgctccttggactcggagggaggcgatggttacaaaagaagggctcatgcccattccagtcaaataccgaagcgaccgcacctgggtttgacaacattctttttaacgccgacggcgtgacccttccggcctctgtaacttctgacccctag

SEQ ID NO: 43639 - DNA, 1353 bp, Artificial Sequence
  Description of Artificial Sequence: Synthetic coding sequence
atgatgcagttcgcctggcagagctacaagcggtacgccatgggcaagaacgagctgagaccgctgactaaggatggctatgaaggaaacatgtttggcggtcttagcggagccactgttatcgactccctggatacactgtatcttatggagcttaaggaggaatttcaggaggcaaaggcttgggtaggcgagtccttccatttgaacgtctcaggagaggcatccctgtttgaggtgaatatccgctatatcgggggactcctgtctgctttctatctgacaggggaagaagtattcaggataaaggccatccgcctgggtgaaaagctcttgccagcttttaatacaccaaccggtatccccaaaggggtcgtttcattcaaaagcggcaattgggggtgggctaccgctggatctagctctatactggccgagtttgggtcactgcacttggaattcctccatttgaccgaactgtctggcaaccaggtgtttgcagaaaaggtccgaaacatccgtaaagtgctgcgcaagatagagaagccatttggcctgtaccccaatttcctctccccagtgtctggtaactgggtgcaacaccatgtgtccgtcggtggactgggtgactctttttacgagtatctgatcaaatcctggctaatgagcggtaaaacggatatggaagccaagaacatgtactatgaggctctggaggccatagagacttatctgttaaatgtctccccaggcggcttgacttatattgcagaatggagaggcggcattctagaccacaaaatgggacatttagcctgcttctccggcggcatgattgctctcggggcagaggacgcgaaagaggagaagcgcgctcactatagggaactcgccgctcagatcaccaagacatgtcatgagagttacgcccggagcgacacgaaactcggcccagaggctttctggttcaacagcggcagagaggcagtcgctacacagctttctgagtcatattatattctgagaccggaagttgtggaatcctatatgtatctctggcgtcagacacataatccaatatacagggagtgggggtgggaagtggtattggcccttgaaaaatactgccggactgaggctggattctccggcattcaagacgtgtactcatctactcccaaccacgacaataagcagcagtctttttttctggccgagacattgaagtacttgtatctcctgttttccgaagacgatcttttgagtctggaagactgggtcttcaacacagaagctcaccctttgcctgtcaaccatagcgacagctctggcagagcttggggtcggcattag

SEQ ID NO: 43640 - DNA, 1206 bp, Artificial Sequence
  Description of Artificial Sequence: Synthetic coding sequence
atggagctgaaggaggagttccaggaggccaaggcctgggtgggcgagagctttcacttaaatgtctccggcgaggccagcctgtttgaggtgaacattaggtacatcgggggtctgctatccgcgttttaccttactggggaagaagtgttcagaatcaaggcgatccgactgggagagaagcttttacccgccttcaacactccaacggggatcccgaaaggcgtggtttcattcaaaagtggaaactggggatgggccacggctggcagttcctcgatcctggccgaattcgggtcgctgcacctcgagtttctgcacctgacggagctctctggtaatcaagttttcgcagaaaaggtgcgcaacatcagaaaggtattgcggaaaattgaaaagccattcggcctttatcccaactttctctctcccgtctctggaaattgggtgcaacaccatgtgagcgtggggggccttggcgactccttttacgagtacctgatcaaatcatggctgatgtcaggaaagacagatatggaggcaaagaacatgtattacgaagccttggaggccatcgagacttatctgcttaacgtcagtccaggcggactgacctacattgcagagtggagaggcgggatcctggaccacaaaatgggccacctcgcttgtttctcgggcggaatgattgctctgggggcggaagacgccaaagaggagaaacgtgcacactacagggaattggcagcgcagattacgaagacctgtcacgagtcttatgctagatccgacactaaacttggccctgaagccttttggttcaacagcgggcgggaggccgtagccacacagttatccgaatcttattatattctcagacctgaggtggtggaatcctatatgtatctctggcgacagacacataatcctatctacagagagtggggatgggaggttgtcctggctttggaaaaatactgccgaacagaggcggggttttcaggcatccaggatgtctatagcagtactccaaaccacgacaacaaacagcagagcttcttcctagctgaaacactgaaatacttgtacttgctgttcagcgaagacgacctgctgtcattggaagactgggtgtttaataccgaggctcacccactgccagtcaatcacagcgattcatctggccgggcctgggggcgccattag

SEQ ID NO: 43641 - DNA, 1170 bp, Artificial Sequence
  Description of Artificial Sequence: Synthetic coding sequence
atgatgcagttcgcctggcagagctacaagcggtacgccatgggcaagaatgaactgcggcctctgacgaaagacgggtatgagggcaacatgtttggcggattaagtggcgcaactgtgatcgattcacttgacaccctgtatctgatggagctgaaggaggagtttcaggaggctaaagcatgggtgggggaatccttccacttaaacgtctctggagaggcctcactctttgaggtgaacatcaggtacattggcgggttactgtctgcgttttacctgactggtgaagaggtgttccgcatcaaggcgatcaggctgggagagaagctgctccccgcatttaataccccaacgggcattcctaaaggtgtggtaagcttcaagtctggaaactggggatgggcaaccgcaggctcttcatcaatccttgcagagtttggcagcttacatctggaattcctccacctgaccgagctgagtggcaatcaggtgttcgccgagaaagtgagaaacatccgaaaagtattaagaaaaatcgaaaagcctttcgggctctatcccaactttctgagtccagttagcggcaattgggtgcagcaccacgtgtctgtgggggggctgggggacagcttctacgaatatctaatcaaaagttggctaatgagtggaaagactgatatggaggcgaagaacatgtattatgaggctctcgaagcgattgagacatacctgttgaatgtttccccaggaggtctgacctacatcgcagagtggagggggggcatcctggatcacaagatggggcatcttgcatgtttcagcggcgggatgatcgccctgggcgccgaggatgctaaagaggagaagagggcccactaccgcgagctggcagcacagatcactaagacatgccatgaatcttacgctaggagtgacacaaagctggggcccgaagccttctggttcaattccgggagggaagccgttgccacccagctgtcagagagttactacatactgagacctgaggtcgtcgagtcttatatgtacctttggagacagactcataaccctatttatagggagtggggctgggagggcgcgggactgggtgagatcctgtccgacagaagtcggtttctgtgggatccccgccgggtccagtag

SEQ ID NO: 43642 - DNA, 1893 bp, Artificial Sequence
  Description of Artificial Sequence: Synthetic coding sequence
atgctgatgcggaaggtgcccggcttcgtgcccgccagcccctggggactcagactgccacagaagtttttgttccttttgttcctatcaggcctggtgaccctgtgtttcggcgccctcttcctgttgccgcattcatcccgcctgaaacgcctatttctggcaccaaggacacagcaacctggcctcgaggttgtggctgagattgccggccacgcacctgcacgcgaacaggagccaccccctaatcccgcgcccgccgctcccgctccgggcgaagacgatccatcgtcatgggcctctcctcgacggagaaaggggggactgcgacggacccggcccaccggaccaagggaggaggcgactgctgcccggggaaacagtatcccagccagtagacctggtgacgagggcgtcccattccggtttgattttaacgcattcagaagtaggctgcgccaccccgttctgggcacgcgcgcagacgaatctcaggaaccacagagtcaagtcagggctcagcgagagaagatcaaagagatgatgcagttcgcctggcagtcctacaagcgctacgccatggggaaaaacgagctccggccacttacaaaggatggttatgagggaaatatgttcggaggtctatccggtgccaccgtgatcgattccctggacaccctttatttaatggagctgaaggaggagttccaagaggctaaagcctgggtcggtgaatcttttcacttgaacgtttctggcgaggcgtctctctttgaggttaacatccgctatatcgggggcctgctgagcgcgttctacctgaccggcgaagaagtgtttcgtatcaaggcaatacgcctgggcgagaaacttctgcccgctttcaacaccccaacagggattccaaagggcgttgtgagtttcaagtcagggaactggggctgggctaccgctggtagctcgagcattctcgctgaattcggctcactccatctggaattcctgcatctcacggaactgagcggaaaccaggtgtttgcagagaaggtaaggaacataaggaaagtgctgagaaagattgagaaacccttcgggctctacccgaatttccttagccccgtgtccggcaattgggttcagcatcatgtcagcgttggggggctcggcgatagtttctatgagtatctgatcaagtcatggctcatgagcggaaagaccgatatggaagccaaaaacatgtattatgaggcactcgaggctattgagacataccttcttaacgttagtccgggtggactgacttacatcgccgaatggcggggcggcatcttagaccacaagatgggacatctcgcctgcttttctgggggtatgatcgctctgggagccgaggatgccaaggaggaaaaaagagcccactaccgggagctcgcagcacagattacaaagacttgccacgaaagctatgcccgcagcgacactaagctgggtcctgaggctttctggttcaacagtggacgggaggcagtggccacacagttgtctgaatcctattatatcctgaggcctgaggtggtggagtcttacatgtatctctggagacagacgcataaccctatttatagagagtggggttgggaggtggtgctggcacttgagaaatactgtcggacggaagccggatttagcgggatccaagatgtgtatagttccacccctaaccacgacaacaaacagcaatctttcttcctcgccgagactctcaaatatttgtatctcctattttccgaagacgacctgctgagcctggaggattgggttttcaacacggaggcacacccactgccagtaaaccacagtgactcctctggacgggcatggggacgccactag

SEQ ID NO: 43643 - DNA, 258 bp, Artificial Sequence
  Description of Artificial Sequence: Synthetic coding sequence
atggccagcgacctggacttcagcccccccgaggtgcccgagcccactttcctggaaaatttgctgcggtatggactattcctaggggcaatcttccaactgatttgcgtgttagctatcatcgtgccaatccccaagtcccacgaggctgaggccgaacccagcgaaccccgtagcgcggaagtcactcgcaaaccaaaggctgccgtccctagcgtgaataaacggccaaagaaggagactaagaaaaagcggtag

SEQ ID NO: 43644 - DNA, 258 bp, Artificial Sequence
  Description of Artificial Sequence: Synthetic coding sequence
atggccagcgacctggacttcagcccccccgaggtgcccgagcccactttcctagagaatctcttgagatatgggctttttctgggcgcgatcttccaactaatttgtgtcctggcaattattgtgcctattcctaaaagtcatgaggccgaggctgaacctagcgagccccgctccgctgaggtgaccaggaaacctaaagccgctgtgcctagtgtgaacaagcgacccaaaaaggaaactaagaaaaagaggtag

SEQ ID NO: 43645 - DNA, 171 bp, Artificial Sequence
  Description of Artificial Sequence: Synthetic coding sequence
atggccagcgacctggacttcagcccccccgaggtgcccgagcccacatttcttgagaatctgttaagatacggcctcttcctgggagcaattttccagctcatttgcgtcttagcgatcattgtgcctatccctaagagccatgaggccgagttccacgtagaggcttag

SEQ ID NO: 43646 - DNA, 258 bp, Artificial Sequence
  Description of Artificial Sequence: Synthetic coding sequence
atggccagcgacctggacttcagcccccccgaggtgcccgagcccacttttctggagaacttgctgcgctatggccttttcctgggagcaatattccagctgatctgcgtgctagccatcatcgtcccaatcccaaaaagccacgaagcagaggctgagccaagtgaacccagaagcgccgaggtgacccggaagcccaaagctgctgtccccagtgttaacaagagacctaaaaaggagaccaaaaaaaaacgctag

SEQ ID NO: 43647 - DNA, 258 bp, Artificial Sequence
  Description of Artificial Sequence: Synthetic coding sequence
atggccagcgacctggacttcagcccccccgaggtgcccgagcccacatttctggaaaatctgctacggtacgggctattcctgggcgcaatctttcagcttatctgcgtgctcgcaataatagttccaatcccaaaaagtcatgaggcggaagccgaaccctctgagcccagatcggcagaggtcacccgtaagccaaaggctgccgttccttcagttaacaagcggcctaagaaggagactaaaaaaaagagatag

SEQ ID NO: 43648 - DNA, 258 bp, Artificial Sequence
  Description of Artificial Sequence: Synthetic coding sequence
atggccagcgacctggacttcagcccccccgaggtgcccgagcccacctttctggaaaacctactgagatacggcttattcttgggcgccatttttcagttaatctgtgtgttagccattattgtgcccatccctaaatcacatgaggcagaggccgaaccctcagagcctcgctcagctgaggtgactcgtaagcctaaggcggcggtcccttccgtgaacaaacgaccaaaaaaggagaccaagaagaagaggtag

SEQ ID NO: 43649 - DNA, 708 bp, Artificial Sequence
  Description of Artificial Sequence: Synthetic coding sequence
atgatcaccggcagcccccagatgacctggtgcccccccttctggactcctccaatatcaacagcttccaggtatggatctcatggtgccttttatcgctataagaacagtatggggaagagcctacccctgttttacatctacgactcctatctcacatcaccagaggcatgggctcatctcctgactcctaacggccctcacagtattcggaacacaccatacgatggtgtgttcatcgccctgttagtcgaggagggacatacccatgatattctggctgccggtttcgacggcatgtatacctactttgcctccaatggcttctcctttggcagttcacaccagaattggaaggctgtgaaaaacttctgcgatgctaacaacctgatgtttatacccagcgtcgggcctggatacatagataccagtatccggccgtggaacaaccacaacacccggaatcgagtcaacggaaaatattatgaaaccgcactgcaagcggccctgactgtgagacccgaaatcgtcagtattaccagcttcaatgagtggcacgaaggtactcagattgaaaaagcaataccaaaaaaaacaccgacccggttatatctggattacctcccacatcagccaagcttatacctcgaactgacgcgcaggtgggcagagcattttattaaggagaaagagcaatggctcatgtag

SEQ ID NO: 43650 - DNA, 1374 bp, Artificial Sequence
  Description of Artificial Sequence: Synthetic coding sequence
atggcccggcggcggcggcgggcctgcatcgccctgttcctggtgctgctcttcgctttcggcacccttatggggctgagaactctgaaggccccggatggattgcccgcactgggccctgggttggagcttgcacctttcgagcggagacctgagggggcgcctgctccagctgctcgcgcccccgcagccccagctgctcccccacctccaccgcccccacccaggacggccgatcccggcggctcacccggtccagcaccagccgaggccgagcctgcacctgttcaaagtctgagagtgtattcagacctgcacgcattttattattcctggtacggctcccctcggagagaaggccattatatccattgggatcacgtgatggtgcctcactgggatccgaaaatctctgccagttatccccgcgggaggcatagtccacctgacgatcttgggagcagtttctaccctgaattaggaccctatagcagcagagaccctgaggtcctaagggagcacatgactcagctcaaggaggcagctattggagtgctggtgctgagctggtaccccccagggatggcagacgataacggtgagccgtcagacgacctcgtgcccgcaatattagacaccgcgcaccagtatagtatacaggtggcattccacattcagccctacaaagggagggacgacattaccgtgcatgacaacatcaaatacataatcgacacctacggaagtcacggcgccttttatagatacaaaaacagcatgggcaagtctctacccctcttttacatctacgactcatacttgacttcaccagaggcctgggcccacctgttaacgccgaatggcccccattctattcggaacacaccatatgacggggttttcatagccctgttggttgaggagggtcacacgcacgatatcttggcagcgggcttcgatggcatgtatacctacttcgcatcaaacggattttcgtttgggagctcacatcagaactggaaagccgtcaaaaacttttgtgacgctaacaacctgatgtttattccaagcgtgggtcctggctacatcgataccagcatacggccttggaacaaccacaatacccgaaatcgggtgaacgggaaatattatgagacagcactccaggcagcacttacagtgcgcccagaaatagtatctatcacatctttcaatgaatggcacgaaggcactcaaattgaaaaggcgatccccaagaaaactccgacccgcctttacctggattatctcccccaccagccatccctgtacctggagctgaccagacggtgggcagagcacttcatcaaggagaaagaacaatggctcatgtag

SEQ ID NO: 43651 - DNA, 753 bp, Artificial Sequence
  Description of Artificial Sequence: Synthetic coding sequence
atggcccggcggcggcggcgggcctgcatcgccctgttcctggtgctgctgtttgcctttggtacgttgatgggcctgagaacacttaaagcccccgacggcctgcccgctctgggccctggtcttgagttggctcccttcgaacggagaccggaaggcgcccctgctcccgcagcacgagctcctgccgcacccgctgcaccgccaccaccacctccgcctccccgcacagctgacccagggggatccccaggtcctgcccctgctgaggcagaacccgcccctgttcaaagtcttagggtgtacagcgacttgcacgccttctattattcttggtatggttccccaaggagggaaggccactacatacattgggatcatgtcatggtgcctcactgggaccctaagattagcgcatcttacccccgcggcagacatagcccaccagacgatctgggttcaagcttttaccccgagctgggaccttactcatcccgtgatcccgaggtactgcgagagcacatgactcagctgaaagaagccgcaatcggcgtgttagtgctgtcctggtaccctcccggtatggcagacgacaatggagagccaagtgacgacttggtgcctgcgatcctagacacggctcatcagtacagcatacaggtggctttccacatccagccttataagggtcgcgatgacatcacagtccatgataacattaaatacataatcgacaccactggaaagctctag

SEQ ID NO: 43652 - DNA, 1437 bp, Artificial Sequence
  Description of Artificial Sequence: Synthetic coding sequence
atgttcaagttccaccagatgaagcacatcttcgagatcctggacaaaatgcggtgtctgcgcaagcgaagcacagtatcattcttgggcgttctggtgattttcctcctgttcatgaacctttatattgaggactcatatgtgctcgagggagacaaacaattgatccgcgagacctcaactcatcagctcaactccgaacgctatgtgcacacgtttaaggatctttcgaacttcagcggcgctataaatgtgacctaccgttacctggcagctacgcccctacagagaaaaaggtatctgacaatcggcctcagtagcgtgaagagaaagaagggcaactacctccttgaaacaattaaatcaatttttgagcaaagctcctacgaagagctgaaggaaatttctgtcgtggtgcacctggcagattttaactcaagctggagagatgccatggtgcaggacatcacacagaagttcgcccaccacatcatcgcaggtagactaatggtcatacacgccccagaagaatactacccgatcttagacggactgaagcgcaattacaatgatcccgaggatcgggtgaaattcagatctaaacagaatgttgactacgccttccttctgaatttttgcgccaataccagcgactattacgtgatgctggaggacgatgttagatgttccaaaaacttcctgactgcaattaaaaaagtaatcgcatccttggaagggacatattgggttacattagaatttagtaagctaggttacattggaaagctgtaccactcacacgacctcccccggctggcccacttccttctaatgttctaccaagagatgccgtgtgattggttattaacacacttcaggggactgctcgcccagaaaaacgtgatcaggtttaaaccgagtctgttccagcacatgggatactatagctcctacaagggaacagaaaacaagctgaaagatgacgactttgaagaagagtccttcgacatcccagataatccaccagcatctctatataccaacatgaatgtttttgaaaattatgaggccagcaaggcctatagctcagttgatgaatacttctggggcaagcccccgtcaaccggggacgtgttcgttatcgttttcgagaacccaatcattatcaagaagattaaggtaaatactggaacggaggaccgccagaatgatatcctgcatcacggagcactggacgtgggggaaaatgttatgccgtctaagcaacgacgacagtgctccacgtaccttcggctcggggaattcaagaacgggaactttgaaatgagcggagttaatcaaaagattccctttgatattcactgcatgcgaatttatgttactaagactcagaaggaatggttgatcatccgctctatcagtatctggacaagttag

SEQ ID NO: 43653 - DNA, 1524 bp, Artificial Sequence
  Description of Artificial Sequence: Synthetic coding sequence
atgctgggcaaggacatggtgcggttcgtggtgcggaagaccgtgcagcgcagtgtggctaagggctctcgtcgctgtaaaaagcggatgttcaagttccatcagatgaagcacatctttgagatactggataaaatgcgatgtttgcgaaagcggtccacagttagttttctgggggttcttgtgatattcctgcttttcatgaacctttacattgaggacagctatgtcctggagggagacaagcagctgatcagagaaacatcaacccatcagttaaactccgaacgatacgtgcacacatttaaagatctctcaaatttcagcggtgcaattaatgtgacctataggtatttggccgcgacccctctccagcgaaaaagatatttaacaattggcctgtcctctgtgaagaggaagaaggggaattacctgctggagactattaagagtatttttgaacagagttcatatgaagaactgaaggagattagtgtcgttgtccatctggcagatttcaattcttcctggagggacgcgatggttcaggatatcacacaaaaatttgcccaccacattatcgctggacggctgatggtcatccatgcacccgaagagtattacccaatcctggacggtctgaagcggaactacaatgaccccgaggatcgggtcaagtttaggtcaaagcagaacgtcgactacgctttcctgttgaacttctgtgccaatacctccgattactatgttatgctggaagacgatgtgagatgtagcaaaaattttctcacggctattaagaaagtgattgccagtctggaaggcacctattgggttacactcgaattctccaagttaggctacatcggcaaattgtaccatagccatgacctgccacggctcgctcactttcttttgatgttttatcaggagatgccctgtgattggcttttaacgcatttcaggggacttctggcacaaaagaacgtcattcgatttaagccttctttattccagcacatgggatactattcttcctacaaagggactgaaaacaagctgaaggatgacgactttgaagaagagtcgtttgacattccagataatcctcccgcgtctctatacaccaatatgaacgtgttcgagaattacgaggccagtaaagcctacagctccgtggatgagtatttttgggggaagccaccctcgacgggagacgtgttcgtgatagtattcgaaaacccaattatcattaaaaaaatcaaggtgaatactgggacagaggatcgccagaacgatatcctgcaccacggagcccttgacgtgggggaaaacgtgatgccatctaaacagcgtaggcaatgttcaacataccttaggttaggcgagttcaagaatggaaactttgagatgtctggagtcaatcagaagattccatttgatatccattgtatgagaatctacgtcacgaaaacccagaaggaatggctgatcatccgcagcatctccatatggacatcttag

SEQ ID NO: 43654 - DNA, 1197 bp, Artificial Sequence
  Description of Artificial Sequence: Synthetic coding sequence
atgttcaagttccaccagatgaagcacatcttcgagatcctggacaagatgcgatgtctgagaaagcggtctacagtgtctttccttggggtgctggtcattttcttactttttatgaatctctacatcgaagactcatacgtgctagagggagataagcagctgatacgtgaaaccagcacccaccaacttaactcagagagatacgttcacacctttaaggacctgagcaacttcagcggagctattaatgtgacataccggtatctcgcggcgactccactgcagcgaaagaggtacctgacaatcggcttgtcctctgtgaagcggaaaaagggcaattatctgcttgagaccatcaagtcgatattcgaacagagcagctacgaggagttgaaagagatatccgtggtggtgcatctcgccgattttaactccagctggagagatgcaatggtgcaggatatcacacaaaaattcgcccatcacataattgccgggcggctgatggttattcacgccccagaagagtattacccaatcctcgatggactaaagagaaactacaacgaccctgaggacagagttaagttccgaagcaagcagaacgttgactatgcctttttactgaacttctgcgcaaataccagcgactactatgtcatgctggaggacgacgttcggtgttctaaaaactttctgaccgccattaaaaaagttattgccagtctggagggcacgtattgggtcacccttgaatttagcaagctcggctacatcggaaagctctaccactctcatgatttaccacgactcgcccatttcctgctcatgttctaccaggaaatgccctgtgactggctcctcacacattttcgggggctattggcccaaaagaacgttatccgatttaagccatcactgttccagcacatggggtattattcatcttataaagggactgaaaataagctgaaggatgacgacttcgaggaggaaagtttcgatattcccgataatccccctgcctcactctacaccaacatgaatgtgttcgaaaattacgaagcttcaaaggcctactcatccgtcgacgaatacttctggggcaaacccccttcaacaggtgacgtctttgttatagtgttcgaaaatcccattatcattaaaaagatcaaagtcaacactggaacatag

SEQ ID NO: 43655 - DNA, 1437 bp, Artificial Sequence
  Description of Artificial Sequence: Synthetic coding sequence
atgttcaagttccaccagatgaagcacatcttcgagatcctggacaaaatgaggtgcttgagaaagcgctccacagtgtcatttctgggggtgctggtgatcttcctgctgtttatgaacctctacattgaagacagttacgtgttagaaggagacaaacaacttataagagaaacttcgacccaccaactcaacagtgaaaggtatgtgcataccttcaaggacctttctaatttctcaggagctatcaacgtaacatatcgctacttagccgcgactccgctccaaaggaagcggtacctgactatagggctgtcctctgttaagcgcaagaaggggaactaccttttggagaccatcaagtccattttcgagcaatcgagttatgaagagttgaaagagatctctgtggtggtccatctcgcggatttcaattcctcttggagggacgctatggtccaggatatcactcagaagttcgctcaccacattatcgccggccgcttgatggtcattcatgcccctgaggagtactaccctattctcgacggccttaagcgaaattataacgatcccgaggaccgcgttaaattcagatctaaacagaacgttgactatgccttcctgctgaatttttgcgccaacactagtgactactacgtgatgctagaagacgacgtgcgatgctccaagaatttcctcaccgctataaaaaaggttatcgcctcgctagagggaacctattgggtaacactggaattctcaaaactgggatacataggcaaactttatcacagccatgatctaccaaggttagctcacttcttacttatgttctaccaggaaatgccgtgtgattggcttctcacacactttagaggactactggcccagaaaaatgttattagatttaaacctagtctttttcagcacatgggttactactccagctacaaggggactgaaaacaagctgaaggatgatgacttcgaagaagagtctttcgacataccagacaacccgcctgcatccctttatacaaatatgaatgtgttcgaaaactatgaagcgtccaaggcctatagttccgtggacgaatacttctgggggaagcccccctctacgggggacgtgttcgtcattgtcttcgaaaaccccattataattaagaaaattaaagtgaatacaggcactgaagacagacagaacgacatcctgcatcatggggcactcgacgttggcgagaatgtgatgcctagtaagcaaaggaggcagtgcagtacctacctgcgcctgggcgagttcaaaaatggaaatttcgagatgtctggggtgaaccagaagatcccctttgatattcattgcatgcgtatctacgttacgaagacccagaaggagtggctgatcattcggagcatctccatctggacttcgtag

SEQ ID NO: 43656 - DNA, 1437 bp, Artificial Sequence
  Description of Artificial Sequence: Synthetic coding sequence
atgttcaagttccaccagatgaagcacatcttcgagatcctggacaaaatgcggtgcctgcgcaagcgatccaccgtgtcgttccttggagtactagtgatttttctcctttttatgaacctgtatatcgaggactcctacgtgctagaaggagacaaacaactaattcgcgagacgagcacacatcagctgaatagcgaaaggtacgtccacaccttcaaagatctgtcaaatttctccggggctataaacgtgacctataggtatcttgctgctacccctcttcagcgcaagaggtacctcactattggcctcagttcagtcaaacgtaagaagggcaattatcttttggagaccatcaaatccatcttcgaacaaagttcttacgaagaacttaaggaaatcagtgttgtggtgcacctggcagactttaattcctcttggcgggatgccatggtgcaggacatcacccagaaatttgctcaccacatcattgctggccgcctaatggttattcacgcgcccgaggaatattatccaatcttagacggattgaaacggaactataacgatcctgaggaccgggtgaaattccgatcgaaacagaatgtggactacgctttcttactcaacttttgtgccaacacgagtgattactacgtaatgctcgaagatgacgtgcgctgctccaaaaacttcctgacagcaatcaaaaaagttattgctagcctggaaggtacatactgggttactttggaatttagcaaactgggctatataggcaagctttatcattctcacgatctccctagattagctcactttcttttgatgttctatcaggagatgccttgcgattggctcctgacgcatttccggggcttgctggctcaaaagaacgtcatccggtttaaaccttctctcttccagcatatgggatattattcctcttacaaggggaccgagaataagttgaaggacgatgattttgaggaggagtcgtttgatatcccagacaacccccccgcctctttgtataccaacatgaacgtgttcgagaactatgaggccagtaaggcttatagttccgtggacgaatacttctggggtaaaccccccagcactggggacgtatttgtcatcgtctttgaaaatccgattattatcaagaaaataaaagtcaacacgggcactgaggaccgccagaacgatatcttacatcacggagctttggatgtgggagaaaacgtgatgcccagcaaacaaagaagacagtgtagcacttacctgcgcctaggggagtttaaaaatggaaacttcgaaatgagcggtgttaaccaaaaaattccgtttgatatccactgtatgcggatttatgtaacgaagacacagaaagaatggctcataatcaggtccattagcatctggactagctag

SEQ ID NO: 43657 - DNA, 1437 bp, Artificial Sequence
  Description of Artificial Sequence: Synthetic coding sequence
atgttcaagttccaccagatgaagcacatcttcgagatcctggacaaaatgcgctgccttcgcaaaaggagcacagtgagtttccttggggtactggtgatctttctactctttatgaacctctatattgaagactcttacgtgcttgaaggagataaacagctgattcgggaaacatctactcaccagctgaactctgagcgctatgtccacaccttcaaggacctgagcaacttttcaggcgcaatcaatgtgacctatcggtaccttgctgccacaccactgcaaaggaagcgatatttgacaattggactgtcaagcgtgaaaagaaaaaaagggaactacctgctggagactatcaaatcgatctttgagcagtcgagctacgaagagttgaaggagatctccgtcgttgtacacctcgcggattttaatagtagttggcgagatgccatggtgcaagatattacccagaagttcgcccaccatatcattgccggtcgtctgatggttattcacgcacctgaagaatattatccaattctagacgggctgaagaggaattacaatgacccagaggaccgcgtcaaattccggtccaagcaaaacgtggattacgcattcttgttaaatttctgcgccaatacgagcgactattacgtcatgttggaggatgacgtgagatgtagtaagaacttcctgacagccattaaaaaagtgatcgctagcctcgagggcacttattgggtgacactggaatttagtaagttggggtatattggaaagctgtaccatagccatgacctcccacgcctcgcccattttctgctgatgttctatcaagaaatgccctgcgattggttgctcacacattttagaggcctgcttgcacagaaaaatgtgatcaggttcaagcctagcctgtttcaacatatggggtattactcaagctataaaggcacggaaaataagctaaaggacgatgatttcgaagaggaaagctttgatattcccgacaaccccccagcgagtctgtacacaaacatgaacgtttttgagaactacgaagcctccaaagcatattcttccgtggatgaatatttttggggcaagccacctagtacgggcgatgtgttcgtcatagtgtttgagaaccctattattattaagaagatcaaggttaatacaggcactgaagacaggcagaatgacattcttcaccacggggcactggatgttggagagaacgtcatgcccagcaaacagaggcggcagtgcagtacctatttgcggttgggcgaattcaaaaacggcaattttgagatgtcaggcgtcaatcagaagatccccttcgacattcactgcatgagaatctacgtaaccaaaacgcagaaggagtggctgatcatcagaagcattagcatctggacatcatag

SEQ ID NO: 43658 - DNA, 1437 bp, Artificial Sequence
  Description of Artificial Sequence: Synthetic coding sequence
atgttcaagttccaccagatgaagcacatcttcgagatcctggacaaaatgcgatgtctcagaaagagaagcacagtcagtttcctaggggtgcttgtaatttttttgttgttcatgaacctatacattgaggactcttacgtgttggagggggataagcagttgattagggagacatccactcaccagctgaatagtgagagatacgtgcacaccttcaaagacttgagcaacttcagcggagctattaacgtcacatacaggtacctcgccgccacccctctccagcgcaaacgttatctgactattggcttatcttcagttaaaagaaagaaaggtaactacctactggagacgattaagtctatcttcgagcagagcagctatgaagaactgaaagaaatctctgtggtggtccacctcgccgactttaactccagttggcgtgatgcaatggtacaggacattacccagaaatttgcccatcacatcatagcaggaagacttatggtcatccacgcgccagaggaatactatcccatcttggatggtttgaagaggaattataacgatccagaagaccgcgtgaaatttcgcagcaaacagaacgtcgattacgcatttctgttaaacttctgtgctaacacaagcgactactacgtgatgctagaggacgatgtcaggtgctcaaagaactttctgaccgcgattaagaaagtgatcgcctccctagagggcacctactgggtgacactggagttcagcaaactcggctatattgggaagctgtatcactcccatgacttgcccagacttgcccacttcttgttgatgttttatcaagagatgccatgcgattggctgttaacacatttccgagggcttctggcccagaaaaacgtcattcgtttcaaaccttccctctttcagcacatgggatactactcgagctacaaaggcacagaaaacaaactcaaggatgatgacttcgaggaagaatcgttcgatatacctgataaccctcctgcctcgctgtatactaacatgaatgtattcgaaaactacgaggcaagcaaggcctactctagtgtggacgaatatttttgggggaagccccctagtacaggagatgtctttgtgattgtctttgagaatcccattatcattaaaaaaatcaaggtgaatacaggaacagaggatagacagaacgacattcttcaccatggcgccctagacgtcggagagaacgtcatgccttctaaacaaagacggcagtgctcgacttatcttaggcttggcgagttcaagaatggaaactttgagatgtccggggtgaaccagaaaattcccttcgatattcactgcatgaggatttacgtgaccaagacccagaaagagtggctgatcatccggtcaattagcatctggacatcatag

SEQ ID NO: 43659 - DNA, 810 bp, Artificial Sequence
  Description of Artificial Sequence: Synthetic coding sequence
atggcccgggccagcagcggcaacggcagcgaggaggcctggggcgccctgagggcgccccaacagcagctcagagaattatgtccaggggtcaataatcagccttacctctgcgaatccggtcattgttgtggtgaaaccgggtgttgcacgtattattacgaattatggtggttctggttgctttggactgtactgatcctgtttagttgctgttgtgcatttcggcaccggagggccaagctccgtctgcagcaacaacagcggcagcgcgaaatcaatttactggcatatcacggtgcctgtcacggagcaggcccatttccgaccgggtccctcctcgacctgagatttctgtccacctttaaacccccagcttatgaagatgtggttcacagaccaggcacacccccaccaccttataccgtcgctccaggccggccactcaccgcaagcagcgagcaaacctgttgcagcagcagcagcagttgcccagcacactttgagggcaccaatgtggaaggagtcagttctcaccagtccgcccctccccaccaggagggagagcccggcgccggtgtgacacctgccagtaccccaccctcttgtagatatagaagattgactggcgactccggcatagagctgtgcccttgccctgccagtggcgagggggagcccgtgaaggaagtgcgagtttcagcaacactgcctgaccttgaagactactccccatgcgcgctgcctcctgaatctgtgcctcagatatttcccatgggcctaagttcctccgagggagatatcccatag

SEQ ID NO: 43660 - DNA, 2196 bp, Artificial Sequence
  Description of Artificial Sequence: Synthetic coding sequence
atgaagacccggagccccaagcccctgctgaccggcctgatgtgggcgcagcagggtacaacccccggaacaccgaagctgagacacacctgcgagcagggagatggggtgggcccatatggctgggagttccacgatggattgtcttttgggcgccaacatatccaggatggtgctctgagactgactactgagttcgtcaagcggcctggagggcagcacggtggcgattggagctggcgggtgactgtcgagccccaggactctggcaccagcgctcttcctctggtaagcctcttcttttacgtggttactgacgggaaagaagtcttgctcccagaagtcggcgctaagggacagctgaagtttataagtggccacacttctgagctcggagactttcgcttcaccctgttaccaccgacttcccctggagatactgcacccaagtacgggagctataacgtgttttggacaagtaatcccggtctcccacttttgacagagatggtcaagtcacgcctgaattcctggtttcaacataggccacctggagccccacctgagaggtacctaggcctgcctggctctctgaaatgggaggaccgcggaccaagcgggcagggccaagggcagttcttgattcagcaagtcaccctcaagattcctataagcatcgaattcgtttttgagtccgggtccgcgcaggccggcggaaaccaagcgttaccaagacttgctggaagcctgctgacccaagcccttgagtctcatgccgagggctttcgggagagatttgagaagacattccagctcaaagaaaagggcctaagtagcggtgaacaggtcctgggacaggccgccctttctggcctccttgggggtatcggttacttttatggccagggcctggtgctgcccgacatcggcgtagaggggtctgagcagaaggtggaccctgctttatttcctcccgtgcccctgttcactgctgttcccagtcgctctttcttcccacgcggtttcttgtgggatgagggctttcatcagctggtcgtacagcgatgggatccttccctgacccgagaggcactcggacattggctgggactgctaaatgccgacggctggattgggagggagcagattttgggggacgaagccagggcccgcgtgccacccgagtttttggtgcagagggcagtgcacgctaacccaccaaccctcctactccccgtagcccatatgctggaggttggtgaccctgatgatcttgcttttttgaggaaggctctgccccgcctccacgcctggttcagttggttgcatcagagtcaagctggcccgttgcctctttcttatcgatggagaggaagagaccctgctttgcccacactgctgaatccaaagactctcccgagtggattggatgattatccacgcgcctcccaccccagcgtaacagagaggcacctagatctccgctgttgggttgccctcggagcccgggttctcacacggcttgcggaacatctcggagaagcagaagtcgccgcggaactaggccctctggccgcgtctttggaggcggccgagtctctggacgaactgcattgggcacctgagcttggggttttcgcagacttcggcaaccacaccaaagctgttcagttaaagccacgtccacctcagggattggtcagagtagttgggcggccacagccacagctgcagtatgtggatgctttgggatatgtctcattgtttcctctgctgttgagactcctagatccgacaagcagcaggttaggtccccttttggatatccttgccgacagtcgtcacttatggtcaccatttggactgcgaagcctggcagcctcaagctctttctatggccagcgcaacagcgaacacgatccaccatactggaggggtgccgtttggttgaacgtgaactacctggcgctgggggcactccaccattacgggcatctcgaggggccacaccaggccagagctgcaaagctgcacggggaacttagagctaacgtggtgggcaatgtgtggcggcagtatcaggcaacaggcttcttgtgggaacaatattccgatagggacggcaggggaatgggatgtcgaccttttcacggatggacctcccttgtccttctggcaatggctgaagactactag

SEQ ID NO: 43661 - DNA, 480 bp, Artificial Sequence
  Description of Artificial Sequence: Synthetic coding sequence
atggcccggggcgagcggcggcggcgggccgtgcccgccgagggcgtgagaaccgccgaacgcgccgcccgtggaggaccgggcaggcgggatggtcgaggggggggacctcggagtacagctggcggtgtcgctctggcagtcgtggtgctgagcctcgcgctcggcatgagcggacgttgggtcctggcctggtacagagcccgaagagctgtgacactgcatagcgccccgccagtactacctgccgatagttcatctccagccgtggcaccggacctgttttgggggacttacagacctcacgtctacttcggcatgaagactaggtccccaaagccactcctgacaggcctccgttacttctgtccacctttcgggctgcccgtgctgctttgtggagacaggtggcaggggtcccccactacccgtggctgggggcaaggcgctgttgaagtttatcaatgggctcaccagtag

SEQ ID NO: 43662 - DNA, 1296 bp, Artificial Sequence
  Description of Artificial Sequence: Synthetic coding sequence
atgttcttcggcggcgagggcagcctgacctacaccctggtgatcatctgcttcttgaccctgaggctgagtgcatctcagaactgcctgaaaaaaagtctggaggatgtggttatcgacattcaatcctctctgtcaaagggcattcgggggaacgagccagtgtatactagcacgcaggaggattgcatcaactcatgctgttcaaccaagaacatcagtggggataaggcctgtaatttgatgatcttcgatacacgcaagactgctcgccagcccaactgttacctgttcttttgtccaaacgaggaggcgtgcccccttaaacccgcaaaaggactgatgtcctatcgaatcataaccgatttcccaagcctgacccggaatctgccatctcaggaattacctcaagaggacagtctgttgcacggccagttttcccaggccgtgacccctctggctcaccatcacaccgattactccaagcccactgacatctcttggcgcgacactctgtcccagaaatttggtagttccgaccatttggagaaactcttcaagatggatgaagcttccgcccagctcttagcttataaggaaaagggccacagtcagtcttcccagtttagctccgaccaggagatcgcacatctgcttcccgagaatgtttctgcactccctgctacagtggccgttgcttcgccgcacaccacgtcagcaacacctaaacccgccacgctactccctaccaacgccagcgtgaccccctccggcactagtcagccacagcttgctacaaccgcacccccggtgacaaccgtcacgtcccagccccccaccactctcatttctaccgtttttacgagggccgccgccactttgcaggcaatggctaccacagctgttctcacgaccacctttcaagcccctacagacagcaagggatctttggaaaccattccgtttacagaaatttccaatctgacattgaacactggaaatgtttacaacccaaccgccctgagtatgtctaatgtcgagtccagcactatgaataaaaccgcttcatgggaggggcgtgaagcaagtcctgggtcctcttcacagggctcagtacctgaaaatcagtatggcctgccttttgagaagtggctgctgatcggcagcttgctgttcggcgtcttatttcttgtcatcgggctggtgctgcttggtagaatactgagcgagtccctccggcgcaagcggtactccaggctggattacctgatcaacggaatttatgtcgacatctag

SEQ ID NO: 43663 - DNA, 174 bp, Artificial Sequence
  Description of Artificial Sequence: Synthetic coding sequence
atgttcttcggcggcgagggcagcctgacctacaccctggtgatcatatgcttcctgacgctgcggctgtctgcttcacagaactgcctgaagaagtccctcgaggatgtagtcattgacatacagtcctcactcagtaagggtataaggggaaatgaacccgtctacacatag

SEQ ID NO: 43664 - DNA, 615 bp, Artificial Sequence
  Description of Artificial Sequence: Synthetic coding sequence
atggaggcccccgccgagctgctggccgccctgcccgccctggccactgccctggcactgctgctggcatggcttctggtgcgtaggggagccgccgcatcacccgagccggcaagagcccctcctgaaccggcacctcccgcggaagcaacaggcgctccggccccatcccgaccatgcgctccagagccagccgcttcccccgctggccctgaggagcccggagaacccgcaggcctgggggagcttggggagcccgccggaccgggtgaaccagaaggaccgggtgatcctgcagcagcccctgcagaggccgaagaacaagcagtggaggccaggcaagaggaagagcaggatctcgacggcgaaaaaggtccgagttccgagggaccagaagaggaagatggcgaggggttttccttcaagtacagcccaggcaagctgaggggaaaccagtacaaaaagatgatgacaaaggaggagctagaggaagagcagagggttcagaaggagcagttggctgctatcttcaagctgatgaaagataataaggagactttcggggagatgtcagacggggatgttcaggagcagctgagactgtatgacatgtag

SEQ ID NO: 43665 - DNA, 534 bp, Artificial Sequence
  Description of Artificial Sequence: Synthetic coding sequence
atggaggcccccgccgagctgctggccgccctgcccgccctggccacagctttagccctgctacttgcttggttgctggttcgccggggggccgccgcttcgcctgagccagcaagagctccacccgagcccgctcctcccgctgaagctaccggagcccccgcccccagcaggccatgcgcccctgaacccgcggctagtcctgccggacccgaggaaccgggcgagcccgccgggttgggcgagctcggggagcccgctggaccaggagaaccagagggcccaggcgacccggcagcggcccccgcagaggctgaggaacaggccgtcgaggcgaggcaagaggaagagcaagaccttgatggcgagaaagggccttcttccgagggacccgaagaggaagatggcgaaggctttagctttaagtacagcccaggtaagctccgcggcaaccagtataagaaaatgatgaccaaagaagagttggaagaggaacagagaatcgagctgacttccgacctgacatccctttag

SEQ ID NO: 43666 - DNA, 513 bp, Artificial Sequence
  Description of Artificial Sequence: Synthetic coding sequence
atggaggcccccgccgagctgctggccgccctgcccgccctggccacagctttggccctcctgctggcctggctcttggtcaggagaggcgctgcagccagccccgaacctgcccgagcacctcccgagcccgcacctcccgcagaggctactggggcccctgccccatccagaccctgcgcccccgaacccgctgccagccctgcaggcccggaggagcctggggaaccagcaggactcggggagctgggagagcctgccgggcctggcgagccagaaggccctggcgaccccgcagccgcgccagctgaggccgaagaacaggcagtcgaggcaagacaggaggaagaacaggacctggacggcgagaaaggaccttcttccgaggggcctgaagaggaggacggggaaggattctcgttcaagtactcccccgggaaattaaggggaaatcagtataagaaaatgatgacaaaggaagagctggaagaagaacagcggacccagcggtag

SEQ ID NO: 43667 - DNA, 513 bp, Artificial Sequence
  Description of Artificial Sequence: Synthetic coding sequence
atggaggcccccgccgagctgctggccgccctgcccgccctggccacagccctggccttactgctcgcctggctgctcgttagaagaggcgccgctgcttctcccgagcctgctcgggcaccccctgaacctgcacctccggcagaggccacaggggcgcctgctcctagcaggccatgtgcgcctgaacccgcagcctctccggcaggcccagaggagccaggggaacctgcgggactcggcgagttgggcgaacccgcaggccccggggaacctgagggtcctggagatcctgcagccgcccccgccgaagccgaggagcaggccgtcgaagctagacaagaggaggaacaggatttagatggtgagaaaggtccctcctcagagggcccggaagaagaggacggagagggcttttcctttaagtattccccgggtaaactgcgtggcaatcaatataagaagatgatgaccaaagaggaactggaagaggaacagaggaccgaggagtag

SEQ ID NO: 43668 - DNA, 1329 bp, Artificial Sequence
  Description of Artificial Sequence: Synthetic coding sequence
atggccctgcccagccggatcctgctgtggaagctggtgctgctgcaatcctcagcagtgttacttcactccggcagcagtgtccccgcagccgctggctcttctgtagtctctgagagtgccgtgtcttgggaggcgggcgccagagccgtgctgcgctgccagtcacctagaatggtgtggacgcaggataggttgcacgaccgacagagggtacttcactgggacttgaggggacctggggggggtccagctagacggctgttggacctatattctgctggtgagcagcgagtttatgaggctcgtgatagaggccgcctggagctgagtgcatccgcgttcgacgacggcaacttctctctgctaatacgggctgttgaagaaaccgacgcagggctgtacacttgtaatctccatcaccactactgccatctctacgaatccttggccgtcagactcgaagtgacggacggcccccccgccaccccagcttattgggatggcgagaaagaagttcttgctgtcgcaaggggagcacctgcccttcttacgtgtgttaatcggggacacgtctggactgaccgccacgtagaggaggctcagcaggtcgtccattgggataggcagcccccgggtgtacctcatgatcgtgccgaccgcttactggacctctatgccagtggagagcgcagggcatatggccctctgttccttagggaccgcgtcgcagtaggggccgacgcctttgagaggggggacttctcactgaggatcgagccacttgaagtggctgatgagggaacttacagctgccaccttcatcaccactattgcgggctgcacgagcgcagagtgtttcaccttaccgtggccgaaccccacgccgaacctcctccgcggggttcaccaggtaacgggtcctcccactctggagcccctggaccggaccccactctcgctcggggccataatgtcatcaacgtgatcgttcctgaatccagggcgcatttcttccagcagcttggatacgtgctggctacactgcttctgttcatactgctgttggtcaccgtgctcttagccgctcgccggcgcagaggtggatatgagtattctgatcagaagtcgggaaaaagtaagggtaaagacgtaaatctggccgaatttgctgtggcagccggggaccagatgctgtatagaagcgaggacatccagctggactacaagaataatatattgaaggagagggccgaactggcgcactcccctctgcccgctaagtatatcgatctggacaagggcttccgaaaagagaactgcaagtag

SEQ ID NO: 43669 - DNA, 1026 bp, Artificial Sequence
  Description of Artificial Sequence: Synthetic coding sequence
atggccctgcccagccggatcctgctgtggaagctggtgctgctgcagagcagtgccgtgttgctgcactcagccgtggaagaaactgacgctggactgtatacctgtaacttgcaccaccactattgccatctttacgagtctctggccgttcgcctagaggtgactgacggcccccctgcaacacctgcctactgggatggggagaaggaagtgttggccgtcgcacggggcgctcccgcactgctgacttgcgtaaatcgggggcacgtttggacagaccggcacgtggaggaggctcagcaagtggtgcattgggacaggcagcctcctggcgtccctcacgacagggcagaccggctattagacctctatgccagcggagagcgccgggcctatggacctctatttctgcgagacagggtcgccgtgggtgccgatgcgttcgagagaggcgatttttcgctaagaatcgagccactggaagtggctgatgagggaacttactcgtgtcaccttcatcatcactactgcggcctgcacgaaagaagagtgtttcacctgaccgttgctgaacctcacgcggaaccgccaccgcggggctcacccggcaacggcagttcacactccggagcacccggcccagatcctacccttgcacgaggtcacaatgtgattaacgtcatcgtgccagagtctcgggcccactttttccaacaactgggctatgtgcttgctacacttttattgtttatactgctactggtcactgtattattagcagcgcgaaggcgtagggggggatatgagtactctgatcagaaatctggtaaatcaaaagggaaagatgtgaatttggcagagttcgccgttgccgccggcgaccaaatgctttaccggagcgaagacatccaacttgactacaagaataacatacttaaagaaagagcagaactggcccattctccgctgcccgccaagtacattgacctggataaggggttcagaaaggaaaactgcaagtag

SEQ ID NO: 43670 - DNA, 1302 bp, Artificial Sequence
  Description of Artificial Sequence: Synthetic coding sequence
atgatccggtgcgccgccaccggcagcgccgtgctgctgcacagcggtagtagtgtccccgctgctgcagggtcttctgtggtctcagagagcgcagtgagttgggaagcaggagcccgggctgttctgaggtgccagtctcccaggatggtgtggacacaggataggttacatgaccgccagcgggtccttcattgggacctgcggggacctggcggtggccctgctcggcggttgctggacctgtatagtgccggagagcaaagagtctatgaggcccgagacaggggccgcctggaattaagtgcatctgctttcgacgatgggaacttttcattgctcatccgtgcagtagaggaaactgatgcaggcctctacacctgtaacctgcaccaccactactgccacttatacgagagtctggcggttagattggaagtgaccgatgggccacccgcaacgcctgcctattgggacggcgaaaaggaagtcctggccgtggcacgaggtgcccctgcactgctcacgtgcgtcaatcggggccacgtttggacagatcgccacgttgaagaggcccaacaggtggtgcattgggaccgccagccaccaggagtgccacatgatcgcgccgacagactgctcgatttgtatgcctcaggggaacgtcgggcatacggccccctgtttctcagagacagggtcgctgttggtgcagacgcttttgagaggggagacttttctctccgcatagaacctctggaagtggctgacgaagggacctattcttgccacctccatcaccactactgtggactgcacgagcggagagtcttccacctgactgtagccgagccacatgcagagccccccccacggggctctccagggaacggttcttcacactctggtgctcctgggcctgacccaacattggcacgcggccacaacgtaataaacgttatcgtccctgaatcacgcgctcatttttttcaacagcttggttatgtcctcgctacactcttgctatttatcctgttgctggtgaccgtccttcttgctgcccgcagacgccggggaggctatgagtactcagatcagaagtctggaaagtccaagggcaaggacgtgaacctcgctgagtttgccgtagccgcgggcgaccagatgctgtacagaagcgaggacatccagcttgattataagaataacattcttaaggaacgcgctgagttggcccactcacccttacccgctaaatacatcgacttggataaaggcttccgcaaggaaaactgtaagtag

SEQ ID NO: 43671 - DNA, 1353 bp, Artificial Sequence
  Description of Artificial Sequence: Synthetic coding sequence
atggccctgcccagccggatcctgctgtggaagctggtgctgctgcagagcagtgccgttcttctgcactccgggagctctgtacccgctgccgctggttcctccgtggtcagcgaaagcgcagtgagctgggaggcaggtgcccgcgctgtgctgagatgtcagagtccccggatggtctggacacaggatcgattacatgaccgacagagagttctacactgggatctgcgggggcctggaggcggccctgcccggcgcctgcttgatctgtattcagctggggagcagcgtgtgtatgaagctcgagacagaggcagattagagctcagcgcatcagccttcgacgatgggaactttagcttgctcatacgagccgtggaggaaactgacgctggcctgtatacctgtaatctgcaccaccactattgccatctatacgaatcacttgcagttaggctggaagtcaccgatggcccccccgcaacacctgcgtattgggatggcgaaaaggaagtgctggctgttgccagaggagctccagccctattgacctgcgtcaatcgaggacacgtgtggacagaccggcacgtcgaggaggcacaacaggtcgtccactgggaccgccagccccctggagtcccccacgatcgagccgatcgcctgctggatctgtatgcatccggcgagagacgggcttacggcccattgttcctcagagatcgtgtggcggtgggtgctgatgcctttgagcgtggcgacttttcactccggatcgaacctctggaggtcgctgatgaggggacctactcctgtcaccttcatcaccattactgcgggctccacgaaagaagagtgtttcatctgacggtcgctgagccccacgccgagccaccacccaggggctccccagggaatggtagcagtcacagcggagctccggggccggatcccacattagcacgagggcacaacgtgattaacgttatagtcccagaaagcagggcacactttttccagcagctgggttatgtcctcgccactctcctgctgtttatcctgctcctcgtgaccgttctgctggcagctaggcgtcgtagaggggggtatgaatacagcgaccagaagtccgggaaaagcaaggggaaggatgtgaacctcgccgagttcgccgtcgcagctggtgaccaaatgctgtaccggtccgaggatattcagttggcttcctctccccccaccgactataagaataacatcttaaaggaaagagccgaactggctcactcacccttacctgcaaaatacatcgatctcgacaaggatcctagcggcctgtgcccacttggagcttag

SEQ ID NO: 43672 - DNA, 207 bp, Artificial Sequence
  Description of Artificial Sequence: Synthetic coding sequence
atgccccagaaggacccctgccagaagcaggcctgcgagatccagaagtgcctgcaagcaaacagctatatggaatcaaagtgtcaggctgtcattcaagaattacgcaagtgctgtgcacagtatcccaaaggccggtctgtggtgtgttccgggttcgagaaggaggaggaagaaaatctcacaaggaagtccgcctcaaaatag

SEQ ID NO: 43673 - DNA, 207 bp, Artificial Sequence
  Description of Artificial Sequence: Synthetic coding sequence
atgccccagaaggacccctgccagaagcaggcctgcgagatccagaagtgccttcaggccaactcatacatggagagtaagtgtcaggctgtgatccaggaactcagaaagtgctgtgcgcaatatcccaaggggcgatcagtcgtctgttccggtttcgaaaaagaggaagaggagaatttgacgcgtaagagtgcgtcaaagtag

SEQ ID NO: 43674 - DNA, 618 bp, Artificial Sequence
  Description of Artificial Sequence: Synthetic coding sequence
atgagcgcccagcggctgatcagcaaccggaccagccagcagagcgcctccaatagtgactacacgtgggagtatgaatattatgagatcgggccagtgtccttcgaggggctgaaagcccataagtattccatcgttattggcttctgggttggccttgcggtattcgtaatttttatgttctttgtcctgacactgctgacaaagaccggcgcacctcaccaagacaacgcggagtcgtcagagaaacggttccgcatgaactccttcgtctcggacttcggccgtcccttggagcccgataaagtctttagccgacaaggcaatgaagagtcccgctcactgttccactgttacattaatgaggtggaaaggttagatagagccaaagcatgtcatcagacaaccgccttggatagcgacgtgcagctccaggaagctatccgatcttctggccaaccggaggaggagctgaatagactaatgaagtttgatatcccaaacttcgtcaatacggaccagaactattttggggaggatgacttacttatctctgagccacctatcgtgctcgaaaccaaacccctctcgcagacaagccataaagacctcgactag

SEQ ID NO: 43675 - DNA, 930 bp, Artificial Sequence
  Description of Artificial Sequence: Synthetic coding sequence
atgagcctggagcagcggagcctgcactgcaagcccgaggaggccctagaagcccagcaggaagccctgggactggtctgcgttcaggccgctacgagctcctcgtcccccctggtcctggggacgctcgaagaagttcccacggcagggagcacagacccacctcaatctccacagggcgcttcagcgtttcccacaacaatcaattttaccagacaacggcagccctccgaggggtcatcttctcgtgaggaggagggaccctcaacctcctgtattctggagagcctgtttcgcgccgtgatcaccaaaaaggtggccgacttggtaggctttctgctcttaaagtaccgcgcaagagagcctgttactaaagccgagatgctggaatcagtaatcaagaactacaagcattgcttccctgagatcttcggtaaggcatccgagagtcttcagctggtatttggcatcgatgtcaaggaagctgaccctacgggccattcttatgtactggtcacgtgtctggggctctcttacgatggactgctcggagataatcagattatgccaaaaacaggcttcctgatcattgttctggtgatgattgctatggagggcggccacgccccggaagaagaaatctgggaagagttaagcgtgatggaggtttatgatggcagggagcacagcgcctatggtgaacctcgaaagctcttgacacaggaccttgtgcaagagaagtacctggaatatcggcaggtcccagactccgacccggcgcggtatgagtttctgtggggcccgcgtgccctggctgagacaagctacgtgaaagtgctggagtacgtcatcaaagtttcagctcgagttaggttcttctttccttcactacgggaggcagctttgcgcgaagaggaggaaggcgtgtag

SEQ ID NO: 43676 - DNA, 4368 bp, Artificial Sequence
  Description of Artificial Sequence: Synthetic coding sequence
atgagcaagagcctgaagaagaagagccactggaccagcaaggtgcatgaatccgttattggaaggaatcctgaggggcaacttgggtttgaattgaaaggaggagcagagaacggccagttcccttatctgggtgaggtcaaacccgggaaggtcgcttacgagtccggttcaaagctggtgtctgaagagttgttactggaggtgaatgagacacctgtggccggcttaacaattcgagacgtattagctgtaattaaacactgcaaagacccactgaggctgaagtgcgtcaaacaggggggaatagttgacaaggatttgcgtcactatctgaacttacgtttccagaagggctccgtggatcatgagctgcaacagataatcagggataatctctatcttcgcaccgtaccatgtaccactcgcccccataaagagggagaggttcctggtgtggactacatcttcataacagtagaggacttcatggaattggagaaatccggagctctgctggaaagtggaacttatgaagacaattactatggcacgccaaagcctcctgccgagcccgctccattactgttaaatgtaacggatcaaatcctgcccggcgcaactccctctgcagaggggaaacgtaaaagaaataaaagtgtatcaaacatggaaaaggcctcaatagagccacctgaagaggaggaggaagagcgccccgtcgtgaacgggaacggtgtcgtggtgactcctgaatcttctgagcatgaagacaaatcggcaggcgctagtggcgaaatgccatcgcagccttaccctgccccagtgtattctcagcctgaggaactgaaggagcagatggacgataccaagccgaccaagccagaggacaatgaagagcccgacccactgcctgacaattgggaaatggcgtacactgagaagggagaggtatacttcatcgaccataataccaagacgaccagctggctggatccaagattagctaagaaagccaagccgcctgaagagtgcaaggaaaacgaactgccttacggctgggagaaaatagatgatcccatttatggcacatactatgtggaccatattaatcggcgaacccagttcgagaacccggtgctcgaggcaaagcgcaaactgcagcagcacaacatgccccacacggagctaggaactaaacctctgcaggctccaggatttagggagaaaccactattcacaagagatgcttcacaactcaaggggacctttctctctaccacactgaaaaagtctaatatgggcttcggctttactataatcggcggtgacgagccagacgagtttctgcaggtcaagagcgtgattcctgatggaccagcggcccaggatggtaagatggagaccggagacgtaatcgtctacattaacgaggtttgtgtcctcggacatacacacgctgatgttgtaaagctctttcagtccgtcccaatcggtcaaagtgtgaacctggtgctctgcaggggatatcccctgccgtttgacccggaagatccagcgaacagtatggttcccccgctcgcaatcatggagcgtcccccacccgtgatggtgaacggcaggcacaattatgaaacctatctggagtatattagccggacctctcagagtgttcccgacatcactgatagaccaccacactctttacactctatgccaaccgacggccagctcgatgggacttacccacccccagtccacgacgacaatgtgagcatggcctcatcaggagcgactcaagccgagctgatgaccctgacaatcgtaaaaggggcccagggtttcgggtttacaatcgccgacagccctaccgggcaaagagtgaaacagatcctggatattcaggggtgtccagggctgtgcgagggggacctgattgtcgaaataaaccagcagaacgtgcagaaccttagccatactgaggtcgtcgacattcttaaggattgtcccattggctctgagacttccctcattatccaccgtgggggcttcttcagcccttggaagacgccaaaacctataatggatcgctgggagaaccagggctctccgcagacgagcctgagcgctcctgccattccacagaacttaccctttcctcctgcgctgcataggtcatccttcccagacagtaccgaggctttcgatccacgtaagcccgacccttatgagctatatgagaagagtagggccatctacgagtccagacagcaggtgccaccccggacttccttccgaatggattctagtgggcccgattataaagagttggacgtacaccttaggcgaatggagtccggctttggcttcaggattttaggtggtgacgagcctggtcagcccattttgattggggcagtgatcgccatgggttctgcagatagagatggccggttgcatcctggcgatgaactggtgtatgtggatggtattccagtggccgggaaaacacaccggtacgtgatcgaccttatgcatcacgccgcgcgcaatggacaagtgaatctgaccgtgagacggaaggttctctgcggcggtgagccctgtccggaaaatggacggagtcccgggtccgtgtccacacatcacagctctccgagaagcgactatgctacctataccaactctaatcacgcagccccaagctccaatgcgtctccccctgagggatttgcctcacatagtctgcagacctctgatgtagtgatccacagaaaggaaaatgagggatttggtttcgtaattatttccagcttgaaccggcctgagagtggtagcaccatcaccgtgcctcacaagattggtcgtataattgatgggagtcccgccgacagatgcgccaagttgaaagtcggagatcggatcctagcagtgaatggccaatctataattaatatgcctcacgcagacatcgtaaagttgattaaagatgcaggcctatccgtcactctgcgaatcataccacaggaggaactaaatagtccaacaagtgctccctcgtctgagaaacagtcgcctatggctcaacagagccccctggcccagcaaagccccctggctcagcccagtcctgcaacccccaactctccaatcgcacaacccgcaccccctcagccgctgcagcttcaggggcatgagaacagctacagatcagaagtgaaggcccggcaagatgttaagccagacatcagacaaccccctttcaccgattacaggcagcccccattagactataggcaaccccccggcggtgattatcagcagccccctcctctggattacagacagcctccattactggattaccgacaacactcacccgacaccagacagtatcctctctccgactacagacagccgcaggattttgactacttcactgttgatatggagaaaggggccaagggctttggctttagtatacgcggcggccgcgagtataagatggacttgtatgtcctgagactggccgaggacggaccggcgataagaaatggaaggatgagggtgggagatcaaataatcgagatcaacggtgagagcacacgggatatgactcatgctcgcgctatcgaattgattaagtccggagggcgtcgggtgcggctattgttgaaaagaggtaccggccaggtccccgaatacgatgagccagccccatggtctagccccgcggctgccgctccaggcctgcccgaagtgggcgtttccctcgatgatgggctggctccattttctccttcccacccagccccccccagtgacccatctcatcagatctcgccagggcccacatgggacattaaacgcgagcacgatgtcaggaagccaaaagagttgtccgcttgtggccagaaaaaacagagactgggagaacagcgcgaaaggtctgcaagcccccagagggccgcaagacccaggcttgaagaggcgccagggggtcaggggagacccgaagccggtaggccagcaagtgaggcaagggccccaggactggctgctgctgacgcagctgacgccgcaagggctggaggcaaagaggctccccgcgctgccgcaggatccgagctgtgccgacgcgaaggcccaggcgcagccccagccttcgcaggccccgggggcggtggttcaggggccctggaggctgagggacgcgccggagctcgggctggtcctcggcctgggccccgacctcccggtggtgctcccgcccgtaaggccgcagtggcccctggaccctggaaggttcctgggtccgacaagctgcccagtgtactgaagccaggagcctctgccgcgtcaaggtag

SEQ ID NO: 43677 - DNA, 4326 bp, Artificial Sequence
  Description of Artificial Sequence: Synthetic coding sequence
atgagcaagagcctgaagaagaagagccactggaccagcaaggtgcatgagagtgtgatagggcgcaaccctgaaggccaactgggctttgagctcaaaggtggggcagaaaacggacagttcccgtatctgggcgaagtcaagccaggcaaggtagcttacgagagtggaagcaaacttgtgtctgaggaattgttgttagaagtcaatgagacaccagtggcaggcctcaccatcagggatgtactcgccgtgatcaagcattgcaaagacccattgcggttgaaatgtgtgaagcagggtggaatcgtggacaaggacctacgccactatcttaaccttagatttcaaaaggggtccgtagatcacgaactacagcagattattagagacaacttgtatctacggaccgtcccgtgtacaacccgccctcataaagagggagaagtgccgggcgtggactatatctttattacagttgaggattttatggaactcgagaagagcggcgcactcctggagtccggaacttacgaagacaattattacggcacacccaaacccccggccgaacccgctcctctgcttctgaatgtgacggatcagattttgccgggagcaacccctagcgccgagggcaagcgaaaaagaaacaaaagcgtgagcaacatggagaaggcttcaatcgagcctcctgaagaggaagaggaagagcggccggtcgtcaatggaaatggagtagtagttacaccagaatcgagcgagcacgaggataagtctgcgggagcctctggtgagatgccttcccaaccttatcccgctcccgtgtactcacagcccgaagagctcaaagagcagatggacgatactaagcctactaaacctgaggataatgaggaacccgatccgctgccagataactgggagatggcatatactgaaaagggcgaagtctacttcatcgaccataataccaagactacgtcttggctggatcccaggttggcaaagaaggctaaacccccagaagagtgcaaggaaaacgaactgccatatggctgggaaaaaattgacgaccccatatacggcacctattatgtcgatcacatcaacagacggacccagtttgaaaatcccgtgctggaggctaagaggaaactccagcagcataatatgcctcacaccgagctgggtactaaacccctgcaggcacccgggttccgagagaagcccttgttcaccagggatgcatctcaactcaagggcacatttctgagtaccacactgaagaagagcaacatgggcttcggcttcacaatcataggcggagacgaacctgatgagttcctccaggtgaaaagcgtgattccggacgggccggccgcacaggatggcaaaatggagacaggcgacgtgatcgtttacattaatgaggtatgcgttctggggcacacccacgcagacgtggtcaaattgttccaaagcgtgcctattggacaatctgtgaacctcgtgctatgcagggggtatcccctgccctttgaccctgaggacccagcaaatagcatggtccccccccttgccatcatggagcgcccacctccagtaatggttaatggacggcacaactacgagacttatctggagtacatttcccgtacatctcagtctgtgcccgacataactgaccggccaccacatagcctgcattccatgcccaccgacgggcaactggatggcacctatccgccccccgttcatgatgacaatgtgtctatggcatcttctggtgcaacacaggccgaattgatgaccctgactattgtgaaaggagctcaaggcttcggatttacaatcgccgactccccgaccgggcagcgagtgaaacagattcttgatattcagggatgcccgggtctgtgtgagggcgatctgatcgtggaaatcaaccagcagaatgttcagaatctgagccatacagaagtggtggacatcctgaaagattgtcccatcggatctgaaacttctttgattatccatcggggaggtttcttcagcccttggaaaacgcccaaaccaatcatggatcgctgggagaaccagggatcccctcagacttctttatctgccccagctatcccacagaatctgcctttccctcctgccctgcatcgatcctcatttcctgactctaccgaggcttttgatcctcgcaagcccgatccctacgaattgtacgaaaagtcaagggctatctacgagtcacgcagaccagattacaaggaattggatgtacacttacgaaggatggagtccggattcggcttccgaatattaggcggggacgaaccggggcaacctatcttaatcggtgcagtgatcgctatggggtccgcagatagagacggcagactccacccaggagatgagctcgtctatgtggatggcatacccgtagctggaaaaacgcaccgttacgttatagatttaatgcaccacgcagcccgcaatggtcaagtgaatctgactgtgcggagaaaagtattatgcggcggtgagccgtgtccggagaatggtcgtagccctggaagcgtttccactcaccactctagccccagatcagattatgcaacctacaccaattccaaccacgcagctccttctagtaatgcaagtcccccggagggctttgccagtcactcactgcagacaagcgacgtagtgatccatcggaaggagaacgagggatttggcttcgtcattataagctccttgaataggcccgagtccggaagcaccattactgtcccccataagatcgggagaataatcgacggcagtcccgctgacaggtgtgctaaacttaaggtgggtgaccgtatactggccgtgaatggacagtctattataaatatgccccacgctgatatcgtcaagttgattaaagatgctgggttaagcgtgacactccgcatcatccctcaagaggagctaaactcacccacaagcgcaccaagctcagagaaacaaagtccgatggcacagcaatctccgctcgctcagcagtccccactagcccagccttccccagctacacccaattcccccatagcgcagccagcacctccacagccccttcagctccaggggcacgagaacagctatagaagcgaggtgaaagccagacaggacgttaagcctgacattcgccagcctccattcaccgattaccgccaaccgcctctggactaccggcagccccccggtggagactatcagcagccacctcctctggactaccgccagccccctttactcgattatcggcaacactctccagatactcgacaataccccctctccgattataggcaaccccaggactttgattacttcactgtcgatatggagaaaggggccaagggttttggattttcaattagaggcggacgcgagtacaaaatggacctctacgtgctacgcctcgctgaggacggacccgctatccggaacggcaggatgcgggttggagatcaaattatcgaaatcaacggggagagtacgagggacatgacccacgcccgggcaatcgaattgatcaaatcaggcggccgtcgagtgaggctcctgctcaaacggggaactggtcaagtccccgaatatgatgaacctgccccctggtcctctccagccgcagcagctcccgggctgcccgaggtgggggtatctctggatgatgggctggcaccttttagcccaagccatcccgcaccaccttccgatccctcccaccagatttccccaggccccacttgggatatcaaaagagagcacgacgttaggaagcctaaggaactgtctgcttgtggtcagaagaagcaacgcctgggagaacaacgggaacgctcagcctctcctcagagagcagctcggccaaggctcgaagaagcccccggtggacaaggacgcccggaggctggcagaccagcctctgaggcgcgtgcccccggcttagctgctgcagacgccgcggatgccgctagggcaggagggaaagaagcaccccgggctgcagccggaagtgaactgtgccggcgggaagggccaggcgccgcacccgcctttgccggccccggcgggggcggctccggggctcttgaggcagagggcagagctggcgctcgggctggacctcgccctggcccacgtcccccgggtggagcaccagcgcggaaggcagcggtggccccagggccatggaaggtccctgggtctgacaagctccccagcgttttaaagccaggtgcatcagcagcctcacgttag

SEQ ID NO: 43678 - DNA, 1668 bp, Artificial Sequence
  Description of Artificial Sequence: Synthetic coding sequence
atggagctggagaagagcggcgccctgctggagagcggcacctacgaagataattattatgggacaccaaagccccccgcagaaccagcccccctcctgcttaacgtaacagatcagatcttgccaggcgcaaccccttccgcagaaggcaaacggaagcggaacaaaagcgtgagtaatatggagaaagcctctatcgagcctccggaggaggaagaagaggagaggccggtcgtgaacggaaacggggtggtggttacccctgagtcctctgagcatgaggataagtccgccggtgcaagcggcgagatgccttcccagccctaccccgccccagtgtacagccaaccagaagagttgaaggagcagatggacgacacaaagcccaccaaaccggaggacaatgaagagcctgaccccctccccgacaactgggagatggcttacaccgagaagggtgaagtttacttcatcgaccacaacaccaaaaccacttcttggcttgacccccgcctggctaaaaaagcaaagccaccagaagaatgcaaggagaacgaacttccctatggctgggaaaagatcgacgacccaatctacggaacttattacgttgatcacattaacagaaggacacagtttgagaaccctgtgctggaagctaagaggaagctgcagcaacataatatgccacacacagagttgggaactaagccattgcaagctccgggctttagggaaaaacccctgtttaccagagacgccagtcagctcaagggcacatttctcagcaccacacttaagaagtctaatatggggttcgggttcacaatcataggcggcgacgagccagacgagtttctgcaggtaaaatcagtaatcccagatggtccagccgcacaggacggcaagatggagaccggcgatgtgattgtgtacattaacgaagtgtgtgttctcggtcacacccacgctgacgtcgtcaagttattccagtcggtgcctattggtcagagtgtgaacttagtcctttgcaggggctacccattaccatttgaccccgaagaccccgctaactccatggtacctcccctcgctataatggaacgccccccacctgtgatggtgaacgggagacacaattacgaaacatatctggagtacatttcacggaccagtcagtctgtcccagacataactgatagacccccccatagcctccacagcatgcctactgatggccagctggacggtacttatcccccccccgtacacgatgacaatgtgtccatggcatcttccggggccacccaggctgaactcatgaccctcaccattgtgaagggcgcccaggggtttgggttcaccatagccgactcccctactggtcagagggtaaagcagatattggatatccagggttgcccaggactgtgtgaaggggacctcatcgtagagatcaaccagcagaatgtgcagaatctgtcccataccgaagttgtggatattcttaaggactgtcctattggttcagagaccagtctgatcatccatcgggggggtaaaactaacacgggttccgccattaaatatgtggggaaaatcgtaggttcttttaacaatatcgtgaagatgcagatttcccttgagctgaacgaaataatactgtag

SEQ ID NO: 43679 - DNA, 3762 bp, Artificial Sequence
  Description of Artificial Sequence: Synthetic coding sequence
atgagcaagagcctgaagaagaagagccactggaccagcaaggtgcacgagagcgtcattgggaggaatccagagggccaactgggatttgagctcaagggaggcgcggagaatggtcaatttccctacttgggcgaggtgaagcccgggaaagtcgcctacgagtcaggatctaagctggtttccgaggagctgcttcttgaggtgaacgagacacctgtggctggactgacgataagggatgtgctggccgtgattaagcattgtaaagatccattacgccttaaatgtgtcaagcaaggtggcattgttgacaaggaccttcgccattacctcaacctcaggttccaaaagggcagcgtagatcatgaacttcaacagattattcgtgacaacctgtatctgcgtaccgtcccctgtacaactcggccacacaaggaaggggaagtcccaggagttgactatattttcattaccgtcgaagatttcatggaattagagaaaagcggagccttactggagtccggcacctatgaagataactactatggaacacctaagcctcccgcagagcccgctcctctcttgctcaatgtgacggatcagattttacctggcgcaaccccttctgcagaaggcaaacggaaacggaacaagagtgtgtcaaatatggaaaaagcaagtatcgagccaccagaagaagaggaagaggagcggcctgtcgtaaatgggaacggagtggtggttactccagagagcagtgagcacgaagacaaaagtgccggcgcttctggtgaaatgccaagccaaccataccctgcacctgtgtacagccaaccagaagaattaaaagaacagatggacgatacgaaacctactaaacccgaagacaatgaggagcctgacccgttacccgataattgggaaatggcatatacagaaaaaggggaagtatactttatagaccacaacacaaaaaccacttcctggctggaccctagactcgcaaagaaggccaagccaccagaagagtgcaaggagaatgagctgccctacggttgggagaaaattgatgatcctatctatgggacatactacgtagatcatatcaacaggcgaacacagtttgaaaacccagtgcttgaagcaaaaagaaagctgcagcagcacaacatgccccacaccgaactgggtacaaagccactgcaagccccagggttccgtgagaaacccttgtttacacgagacgcttcccagcttaaaggaacctttctcagcacaacactgaagaagagtaatatggggttcggatttaccattattgggggggacgaaccagatgaattcttacaggtcaaaagtgttatcccagatgggccagccgcgcaagacggaaaaatggagacaggggacgtcattgtgtatattaacgaggtctgcgtgctgggacacacccacgcggacgtggtgaaactattccagtctgttccaataggacagagcgttaacctggtgctgtgtcgcggctatcctctcccatttgatccggaagatccagctaactccatggtcccacccctggccatcatggaaagaccacccccggtgatggtgaatggcaggcacaattatgaaacatatctggaatatatctcgagaacaagtcaatccgtgccagatataacagaccggcctcctcacagcttgcacagcatgccaacagacggccaactggatgggacttaccctcctcccgtgcatgacgacaacgtgtctatggcttctagcggggctacccaggctgagctcatgacactcacaatcgtcaagggagcccagggcttcggcttcacgattgctgattcacctaccgggcagcgtgtgaagcagattctggacattcagggctgtcctggcctatgcgagggggatctgattgtcgaaattaatcaacagaatgtgcagaacttatcacacacagaggtcgttgatatcctgaaagattgccccatcggaagtgagacgagcctgattatccaccgtggaggcttcttctctccgtggaagacgcccaagcctataatggatcgctgggagaaccagggtagtccacaaacttcacttagtgcccccgctattccccaaaatctgccttttccgcccgctcttcatcgatctagcttcccggactccactgaagctttcgacccacggaaaccagacccgtatgagttgtacgagaagagcagagccatttatgagtcccgacagcaggttccccctcgcactagttttcggatggacagcagcggaccagactacaaagagctggatgtgcacctgagacggatggagtcaggcttcggctttcgtattttgggaggggatgagcccggccagccaatcttaataggtgccgtcatcgctatgggatccgccgatagagacggccgactccatccaggggacgagctggtatatgtggacggaattcccgtggctggcaaaacacatcgttacgtgatagaccttatgcatcacgccgcgagaaacgggcaggtaaacctgacggttaggcggaaagtgctctgcggtggcgaaccttgccccgagaacggccggtctcccggctcggtttctacccatcattcaagcccccgctcagactacgcgacgtacactaacagtaaccatgccgccccatcctcaaatgcctcacctcccgaaggtttcgcctcccatagcctgcagacaagcgatgtggtgatacaccgtaaggagaacgaaggcttcggatttgtgattatctcgtcccttaatcggcctgagagcggcagcacaatcactgtcccacataagatcggtagaatcattgacggatctccggccgaccgatgcgcaaaactgaaggtaggcgacagaattctggccgtcaacgggcaaagtataatcaatatgcctcatgcagacattgttaagctgattaaggacgctggcctctcggtgactctgagaatcatccctcaagaagagttgaacagtcctacttcagccccatcaagcgaaaagcagagccctatggctcaacagagtccactcgcacagcagtcaccgctggctcagccgtcaccagcaactcccaactcaccaatcgcgcagcctgcacccccgcaacctctgcaactccagggacacgagaactcttacagatcagaggtaaaggcgaggcaggatgttaagccagatatccgacagcccccctttacagactatcgacagcccccgctggattatcgacaaccaccgggaggcgactatcaacagccacccccattggactacagacagccacctctactggactacagacaacactctcccgacactcgtcagtatcctttgagtgattaccgccagccccaggattttgattatttcaccgtggatatggagaagggggctaaaggatttgggtttagtattcgcggtgggcgcgagtataaaatggatctctatgtcctccgtcttgctgaagatggaccggccattaggaatggacgcatgagggtcggcgatcagattattgaaattaatggtgaaagcaccagggacatgacgcacgctagggcgatcgaattgattaaatccggaggtaggagggtgagactgttgctgaagcgtgggacaggacaagtgccagaatatgatccaccagcaccagcccaggccgttttgctgcgcttccgcctcactgcattctag

SEQ ID NO: 43680 - DNA, 1653 bp, Artificial Sequence
  Description of Artificial Sequence: Synthetic coding sequence
atgatcagcgcccaccggaacctgtgcctgcccgacaactactacgggacacccaaaccccccgcagagccagctccccttcttctgaacgtaaccgaccagattcttccaggcgcaacacctagcgcggagggaaagaggaaacggaacaaatccgtatctaacatggagaaggcatccatagaacctccagaggaagaagaggaggagcgccctgtcgttaatgggaatggagtagtggtcacacctgagtccagcgagcacgaggacaagagcgccggcgcatcaggggagatgccatctcagccatacccagccccagtgtatagtcaaccagaagaactgaaagaacaaatggatgataccaaacccacaaagcccgaagataacgaggagcctgatcccctgcctgataactgggaaatggcttacaccgagaagggagaagtgtacttcattgaccacaatacaaaaaccactagctggctcgaccccaggcttgccaagaaggccaagcctcctgaagagtgtaaggagaacgagcttccctatggatgggagaagatcgatgacccgatttacggtacatattatgtggaccatataaacagacgcacccaattcgaaaacccagtgttggaggcgaaaaggaaacttcagcagcacaacatgccccacacagagctcggaaccaagcccttacaagcccccggattccgggaaaaaccactttttaccagggacgcctctcagctgaaaggcactttcctatccaccactctgaagaagtctaatatgggctttggatttacaattattgggggcgacgagcctgacgagtttcttcaagtgaagtccgttatccctgacggcccggctgcccaagacgggaaaatggagactggagatgtgattgtttatatcaacgaggtgtgtgtgctgggtcatacccacgcagacgttgtgaagttgttccagagcgtcccaattggccagtccgtgaatctggtgctctgtcgaggctaccctctcccctttgaccctgaggaccccgctaacagcatggtgccacctctggctattatggagagaccgccccccgttatggtgaatggccgacataattacgaaacttatttggagtatattagtagaacctcccaatccgtgccggatatcaccgaccgtcctccacactctctccatagtatgccaactgacggacagctggacggtacctatccgccacccgtacatgatgataatgtcagtatggcatcctcaggagcaacgcaagcagaactcatgacccttaccatagtcaaaggagcccagggtttcggattcaccatagcagattcacctaccggtcagagagtgaaacagatcctggacatccaggggtgcccggggttgtgcgagggcgacctaatcgtcgaaattaatcagcaaaacgtacagaatctgtcccataccgaagttgtggatattctgaaagactgtccaataggctcagagacaagtttaatcatacatcgaggcggcaagacaaataccggctctgctatcaaatacgtggggaagatcgtgggctctttcaacaacatcgtgaagatgcagatttccctggagttaaacgagattattctgtag

SEQ ID NO: 43681 - DNA, 1419 bp, Artificial Sequence
  Description of Artificial Sequence: Synthetic coding sequence
atgagccccgaggagtggacctacctggtggtgctgctgatcagcatcccaatcggttttctgttcaagaaagcaggtcccggccttaagaggtggggagcagctgcagtaggacttggactgaccctatttacctgtggcccccacacactccacagcttggtgacgatcctgggaacttgggcactcatccaggcccaaccatgttcatgccatgcactagcactggcgtggacattcagctatctgctttttttccgcgctctcagcctcctgggtcttcccaccccaacaccttttactaacgccgtgcagctgctgctcacactgaaactcgtatccctcgccagcgaggtccaagatctgcacttagcccagaggaaggaaatggcatccggcttctcaaagggtcccaccctaggactgcttcctgatgtgccgagcctgatggaaaccttgagttatagctactgttatgtggggatcatgaccggtccgttttttcggtaccgtacctacctggattggctcgagcaaccattccccggggcggttccttcgttacgcccccttctccgcagagcttggcccgcaccactcttcggtcttctcttcctgctttcttcgcatttgttccctctcgaggcagttcgggaagatgccttttatgcacgcccgctcccggcaaggctgttctacatgatacccgtctttttcgcctttaggatgcgattctatgtcgcatggatcgccgctgagtgtggctgtatcgctgctgggtttggggcttaccctgttgcagccaaggcccgtgccggagggggccccactctgcagtgtccacccccgtctagtcccgaaaaagccgcaagcctcgagtatgactacgagacaatccggaacatagattgctacagcacagacttttgcgtcagggtgagggatggcatgcgatactggaatatgaccgttcaatggtggcttgctcagtatatctacaagagcgcacccgcccggagctacgtcctcaggagtgcttggacaatgttactgagcgcctactggcacgggctgcatccaggctattacctctcgtttcttactatccctctgtgtctggccgccgaaggccgcctcgaatccgctctacggggtcgtctgagcccgggcgggcagaaagcttgggactgggttcattggttcctgaaaatgcgtgcatacgactacatgtgtatgggcttcgttctgctaagtctggctgacaccctaaggtattgggcgagtatttacttttgcatccactttctcgccctcgcggccttaggtctgggactcgcccttgggggcggcagtccatccagacgcaaagccgcatcccagcccacaagtctggctccggagaagcttagagaagagtag

SEQ ID NO: 43682 - DNA, 1200 bp, Artificial Sequence
  Description of Artificial Sequence: Synthetic coding sequence
atgggcagcagccggtgcggccccggcgcccaccccgtgcacctgtggccacctcatttcgcatttagcggccaccacccccgcgatctcggaccccatagtggaccagcactgctggtgtcgcttgcctctgaggtgcaggacttacacttggcacagcgtaaagagatggcttccggctttagcaaaggcccgactctaggactgctgccagatgttccctccctaatggaaacgctgtcttattcatattgttatgtaggcatcatgactggacccttctttcggtaccgtacatatctcgattggctcgagcagcccttcccaggggcagttccgtcactgcgccctcttctcagacgggcctggcctgccccactgttcggactgcttttcttgcttagctcccatctgtttcctttggaggccgtgcgcgaagacgccttttatgccagacctttaccagcccgcctgttctacatgatccccgtgttcttcgctttcagaatgaggttctatgtggcatggattgctgccgaatgcggatgtatagcggccggatttggcgcttatcccgttgccgccaaagcccgggccggaggagggcccacacttcagtgtcccccaccatcctctcccgagaaggccgcctctctcgagtatgattatgagactatacgcaacatcgactgttactccacggacttttgtgtgcgcgtgcgggacgggatgcgctattggaatatgaccgtacagtggtggcttgcgcaatatatttataagagcgcacccgcgcgctcatacgtgctgcgcagcgcttggacaatgctgttatcagcctactggcatggacttcaccccggctactacctgtcattcctaacaattcccttatgtctcgctgccgagggaagattggaaagcgccctcaggggtcgactgagcccaggcggccaaaaggcctgggactgggtgcactggttcctgaaaatgcgtgcctacgattacatgtgtatgggattcgttctgctgagccttgccgacaccctcaggtattgggcaagcatatatttttgtatacacttcttagcacttgctgctttaggactgggtctcgccctgggcggaggtagtcctagtcgcaggaaggccgcaagccaacccacttctcttgcccccgaaaaattgcgggaggagtag

SEQ ID NO: 43683 - DNA, 1035 bp, Artificial Sequence
  Description of Artificial Sequence: Synthetic coding sequence
atgagccccgaggagtggacctacctggtggtgctgctgatcagcattcccattggatttctctttaaaaaagctggaccaggtctcaaacgctggggggcagccgcggttgggttgggactgaccttgttcacctgcgggcctcatacactccacagtcttgtgacaatcttagggacctgggccctgattcaggcgcaaccctgttcttgccacgccctggctctcgcttggacattcagctatctcctgttttttagagccttgtctctgctgggcctgccaacacccaccccattcaccaatgcagtccagctgcttctgacattaaagttagtttcattagccagcgaagtacaggacttgcatctagctcaaagaaaagagatggcatcgggattcagcaagggccctacactcggactgttaccggatgtaccatctctgatggagactctgtcttacagttattgttatgtggggattatgaccgggcctttcttccggtacaggacttacttggattggctagagcagcctttccccggcgcagtccccagtctcagaccgctgcttcgccgggcatggccagctccgctatttggtttactcttcttgctgtctagtcacctttttcccctagaggcagttcgagaagacgccttctatgctcgacctctgcccgctcgactgttttatatgattcctgtgttttttgcgttccgcatgagattctatgtcgcttggattgccgcggagtgtgggtgtatcgccgccggcttcggcgcttaccctgtggccgccaaggcccgggccgggggagggccaacgctgcagtgtcctccaccatccagtccagagaaggctgccagcttagagtacgattatgagacaatccggaatattgactgctacagcacagatttctgcgtgagagtgagggatgggatgcggtactggaacatgacagtacagtggtggctcgcacagtatatctacaaaagcgcccccgctaggagctacgtactgcgatag

SEQ ID NO: 43684 - DNA, 771 bp, Artificial Sequence
  Description of Artificial Sequence: Synthetic coding sequence
atgagccccgaggagtggacctacctggtggtgctgctgatcagcattccaattggattcctgttcaagaaagctggtcccggcctgaaaaggtggggggcagcggcagtcggattgggtctgacactattcacatgcggtcctcataccctacattcactggttacgattcttggcacttgggccctgatacaagcccagccctgtagttgccatgcactcgccctggcatggacattctcttacttattattttttcgggctctgtcacttctaggattgcctacgccgactcccttcaccaacgccgtgcagctccttttgactttaaagctggtctcactggctagcgaggtccaggacctgcacctggcccagcgcaaagagatggcatccggtttttctaaggggcccaccctgggcttgcttccggacgtaccctctctgatggaaactcttagttactcttactgctacgtggggatcatgacaggcccattctttcgttataggacttatctggactggctggaacaaccctttccaggagccgtgcccagcctcagaccattgctccgaagagcctggcccgcccccttgttcggcctgctgttcctactgtcgagtcatctatttccccttgaggccgtccgtgaggacgcattttacgctagaccactgcctgcccgacttttttacatgatacctgtgttttttgctttccgtatgcggttttacgtcgcttggattgccgctgagtgcggatgttag

SEQ ID NO: 43685 - DNA, 1200 bp, Artificial Sequence
  Description of Artificial Sequence: Synthetic coding sequence
atgggcagcagccggtgcggccccggcgcccaccccgtgcacctgtggcctccacattttgcatttagcggccaccacccgagggacctgggccctcactccggtcccgcccttctggtatcactcgccagcgaggtccaagatctccacttggcccagaggaaagagatggcaagcggattctccaagggacctacattgggcctccttcctgatgtgcctagcctcatggaaacattatcctactcatactgctatgtgggcatcatgacaggtccattcttcaggtacaggacgtacctggactggctcgagcagcctttcccaggagctgtgccctcactgaggccactccttcggagggcgtggccagctccactctttggtctcctgttcctgctcagcagccatctgtttcccctcgaggcagtgagggaagatgccttttacgctcggccgctgcccgcgcgactattctatatgattccagtgtttttcgccttccggatgcgcttctacgtggcctggatcgccgcagagtgcggttgcatagctgccggctttggcgcataccccgtggccgctaaagcaagagccggaggtgggccaacattgcagtgtcccccgccaagctcaccggagaaagccgccagtctggaatatgattatgagacaattcgtaacattgactgctacagtactgatttttgtgtccgtgtgagggacggaatgcgctactggaatatgaccgtccaatggtggctggctcagtatatttacaagtccgcacctgccaggagttacgtactgcgatctgcttggacgatgctgcttagcgcttattggcatggtctgcatcctgggtactacctgagctttcttaccattcccctgtgcctggcggctgaaggacggttggagtccgccctacgaggacgcctgtcgccgggtggacagaaagcctgggattgggtgcactggttcttgaagatgcgagcctacgattacatgtgcatgggcttcgtgctcttatcgctcgcagataccttgagatactgggcaagcatctatttttgtatacatttcctggctctggcggccctggggcttggactagctcttggaggtgggtctccaagcagacgaaaggccgcctcccagcctactagcctggcccccgagaaactcagagaagagtag

SEQ ID NO: 43686 - DNA, 513 bp, Artificial Sequence
  Description of Artificial Sequence: Synthetic coding sequence
atgagccccgaggagtggacctacctggtggtgctgctgatcagcattcccattggctttctgtttaaaaaagctggccccggattgaagaggtggggcgccgctgccgtgggtcttgggttaaccctgttcacctgcgggcctcacactctgcattccctggtaacaatcctgggtacgtgggccctcattcaggcccagccatgctcttgccatgctctagcccttgcttggacattctcatacttgctgttctttcgcgccctgtctttactgggacttcctacgcccaccccttttacaaatgccgttcagctactattgaccctgaagctggtgtcactcgcctccgaagtgcaggacttgcatctagcacagcggaaggaaatggcatccggattctctaagggcccaaccctcggactcctgcccgacgtgccaagcttgatggaaacactgagctattcctactgctatgttggcattatgacgggtccgtttttcagatattag

SEQ ID NO: 43687 - DNA, 1740 bp, Artificial Sequence
  Description of Artificial Sequence: Synthetic coding sequence
atgaaggacttcagcgacgtgatcctgtgcatggaggccaccgagagtagtaaaacagagttttgtaatccggcattcgaacccgaatcaggtcccccatgccctccccccgtgttccctgaagacgcatcatactctgtgcctgccccttggcacggcagacgcccaagaggactccggccggactgccgcttttcttggttgtgtgtcctcctgttgtcctcccttctgctgttgttgctgggattattagtcgctattatcttggctcaacttcaggcagcccctcctagtggcgcctctcacagtccccttcccgcgggaggcctgacgactacaaccaccactccaacaatcacaactagtcaagctgcgggtactcctaaaggccaacaggaatctggggtttctccaagcccgcagtcaacatgcggcggattgctcagtggtccaaggggattcttctcgtcgcctaactaccccgacccgtacccaccgaatactcactgtgtctggcacatacaggtcgctaccgaccacgcgatccaattgaaaattgaagcactgtctatcgagtcagtcgcatcctgcctctttgaccgtcttgaactgtctcctgagcctgaaggaccattgctccgtgtgtgtggccgcgtccctccccccactctcaataccaacgcatcccatctcttggtggtgtttgtgagcgatagcagcgtcgaggggtttgggttccacgcctggtaccaggcgatggctcctggacgcggcagttgcgcacacgatgagttccggtgcgatcagctgatatgtctcctgccagacagcgtatgtgacgggttcgcaaactgtgctgacggatcagacgaaacaaattgctctgcaaagttttcaggatgcggcggaaatctgaccggactgcaagggaccttctctactccctcttatcttcagcaatatccccatcagctgttgtgcacgtggcacatttctgtgcccgccggccattcaatcgagctgcagttccacaacttcagtctggaagcgcaggacgaatgtaagttcgattacgttgaggtttacgagacaagctctagcggcgcgttcagcttgcttgggcgcttttgcggagccgaaccacctccacatctggtgagcagccatcacgagctcgctgtgctgtttaggactgatcatgggattagctccggagggttttccgctacgtacctcgccttcaacgcaacggaaaacccctgcggtcccagcgagctatcttgtcaggcaggtgggtgtaaaggcgtacaatggatgtgtgatatgtggcgcgactgcacggatggaagtgacgacaactgtagcggtcccctctttccacctccagaactcgcctgcgaacccgtgcaggtggaaatgtgtttaggactgtcctacaataccactgctttcccaaacatctgggtcggcatgatcacacaagaggaggtggtggaggtgttgagcggctacaagagtctcacttcgcttccctgttatcagcactttaggaggttgctctgcggcctgttagtgcctcgctgcacccctctgggatctgtgctacctccctgcagatctgtgtgtcaggaggcagaacatcagtgccagagtggtctggctttgttgggaaccccttggccctttaattgtaacagactgcctgaggccgccgacctggaagcctgcgcccagccctag

SEQ ID NO: 43688 - DNA, 1740 bp, Artificial Sequence
  Description of Artificial Sequence: Synthetic coding sequence
atgaaggacttcagcgacgtgatcctgtgcatggaggccaccgagtcctccaagacggaattctgcaatcccgcattcgagcccgagtcgggtcccccgtgtccaccccccgtctttccagaagacgcttcgtatagcgttccagctccctggcacggccggcgccctcgcggcctgagaccagattgtcgcttctcctggctgtgcgtgttactcctgtcgagcctgctccttctgttgcttggcctgctggtggctataattctcgcacaattgcaagctgccccacctagtggggcctctcacagccccctaccagccggcgggctaactactactacgacaacccctaccattacaacctcacaggctgctggcaccccgaaggggcaacaggaaagtggcgtgagccctagtccgcagtccacctgcggtgggctcttaagtgggcccagaggcttcttcagttctcctaattatccagacccttatcctccaaacacgcattgcgtgtggcacatacaggtggctaccgatcacgctattcaactgaagatagaggccttgtcgatcgagagcgtggcatcttgtctctttgaccgcttagagctttcccccgaaccagaaggacctctcttgcgggtttgcggcagagtccctcctcctactctgaatacaaatgcaagccatttgttggttgtgttcgtgtctgatagctcagtagagggcttcgggtttcacgcctggtaccaggccatggcgcccgggcgtggttcctgtgcccacgacgaattccgctgtgaccagctgatctgtctgctgccagactctgtgtgcgatggctttgccaactgtgctgatgggtccgacgaaaccaactgctctgctaaattcagcgggtgtgggggaaatcttaccggtcttcagggcacatttagcaccccttcctacctgcagcaatacccacatcagctgctctgtacttggcacatttccgtgcctgccggccactccatcgaattacagtttcataatttttccctggaggcccaggatgaatgtaaattcgattatgtagaggtgtacgagaccagcagcagcggagcattctcactgcttgggcgattttgcggcgcagagccacccccacatctggtgagtagtcaccatgagctagcggtgctgttcagaacggaccacggcatctcatctggcggcttctccgccacttacctcgccttcaacgcaaccgaaaacccctgcggtccatccgaactgtcctgccaggccggaggctgcaaaggagtgcagtggatgtgtgatatgtggcgggattgtaccgacggctctgatgacaactgttcaggccctctgttccctcctcccgaactcgcttgcgaaccagtgcaggtggagatgtgtctgggcctgagctacaacactaccgcctttccaaacatctgggtgggcatgatcacccaggaggaggtagtggaagtactgagcgggtacaagagcttgacttcactgccctgttatcagcacttccgccgattgctatgtgggctgctagtaccccgttgcacacccctgggcagcgtgcttcctccctgtagatctgtctgccaggaggctgaacatcaatgccagagcggtctcgccctcctcggcactccgtggccgtttaattgtaatcggctgcccgaagccgccgacttggaagcttgcgcacagccctag

SEQ ID NO: 43689 - DNA, 396 bp, Artificial Sequence
  Description of Artificial Sequence: Synthetic coding sequence
atggcccccagcctgtggaagggcctggtgggcatcggcctgttcgcgttagcccatgccgcattctctgccgcacagcacagatcctacatgaggctgactgaaaaggaggacgaaagcctgcccattgacattgtgctgcagaccctgctggcgttcgcggtcacttgttacgggattgtgcacatcgctggcgaatttaaagatatggacgcaactagcgagctcaagaataaaactttcgacactctgaggaaccacccatccttttacgtttttaatcatcgcggacgggtgctcttccggccctccgacacagccaacagctctaaccaagacgccttgtcctccaatacgtccctgaaattgagaaagctagagtctctgcggcgatag

SEQ ID NO: 43690 - DNA, 591 bp, Artificial Sequence
  Description of Artificial Sequence: Synthetic coding sequence
atgacccccctgggcagcggccccccccgggaggccagcatcgcccagccatccggtttttccaccacggagactttatgtgctcaggacttttccgacgttattttcctgagacgagcagacactagacgctggaaaaaaaaacagcttcggcgccccagtcttctcctactcgggtgctgcagctttggtatcatggccccatcactctggaagggcctggtgggaattggcttattcgctctggcgcatgctgccttctctgcggcacaacacaggtcttacatgaggctgacagagaaggaagacgagagccttcctatcgatattgtcctccaaaccctgctggcttttgccgtaacttgttacggaatcgtgcatattgcaggtgagtttaaagatatggatgcgacgtccgagctgaagaacaaaacttttgacacgctgcgaaaccacccaagtttctatgtttttaatcataggggccgggtcttgttccgccccagcgatacagctaacagctctaaccaggatgccctttcatccaacaccagtttaaagctccgcaagttggagtcgcttagacgctag

SEQ ID NO: 43691 - DNA, 2139 bp, Artificial Sequence
  Description of Artificial Sequence: Synthetic coding sequence
atggagagcaccagccaggaccggcgggccacccacgtgatcaccattaaacctaacgagactgttcttaccgccttcccctaccgcccgcatagttctctcctcgactttttgaaaggcgaaccaagggtccttggcgccacccaaattctgctcgcgctgatcattgtcgggttcgggacgattttcgccctaaattatatcgggtttagccagcgcctccctctggtggtgttgactggatatcccttttggggagcacttatcttcatactcacagggtacttgaccgtgactgataaaaaatctaagttattggggcagggagtgaccggcatgaatgtgatctcatccttggttgccatcactggaattaccttcactatcttgagctacagacaccaagataagtattgccagatgccaagctttgaggagatctgcgtgttctcacggaccctgttcatcgggatattgttgattctgctgattataagtatcgctgaactatccatcagcgtgaccattgcttcgtttcggagcaaatgctggacacaatctgacgaggtcctgttttttctgccctctgatgtgacacaaaattcagagcaaccggctcctgaggagaacgaccagcttcagtttgtgctgcaagaagaatttagcagcgatgactctaccacaaatgcgcagagcgtgatctttggtggctacgcctttttcaagttgacactgtctcgatcccctctcgtgagtcagcccggaaacaagggccgcgaattcgtgcctgatgaacaaaagcagtcgatactccccagtcccaagttttccgaggaggagatcgaacctctgcctcccacccttgaaaagaagccgagtgaaaacatgtctatccagctggattccacatttaagcagatgaaagacgaagacctccagtcagctatagtacagccaagtcagatgcagactaagctcctccaggaccaggcagcaagcctccaggtgtttccatcccacagtgccctgaagctggaagatatcagccctgaggacctcccatcccaggcgctgcctgtggagggactttctgaacagacaatgcctagcaagagcacatcttcccatgtgaagcagtcctccaatctcaccgccaacgacctgcctccgcagggaatcctctcccaggacacaagttctcaggatatgctgttccatgatatgacctctcaggacatgcagtccttagacatgctgtcccaagatacaccttcacacgccatgccaccgcaagacattccaagccaagacatgctctcccaggcgctttcagcccacgctatcctacccgaggcctctacctcacacatcgttcaattcccagaaatccagcatttactacagcagcctcccgacctgcaacctgagaataccgaaccccagaaccaacagattttacaaatgagttatcaggacatcagatctgaggtgatggaggagacaaaggagtggaaatcagaagaggagttgcatagaagaaaatcatcccgacggcattccttaaaccagcaaacgaaggctcttcaatatcttcggcgtcactccctcgatgtgcaggccaagggccagaaaagcagtaagcgccacagcttggaccaacaatcaaaaggatggcagtcacctaagcaaaaaagcctagaccagcaaatcaaggactggctctcccctaaacggcatagcgtggacaagcaggcccagctgaatcagaccaaagagcaactccctgaccagcaggccgaggatcagcaagccaagggggagcaatatccagagggtcaaagcaaagacgggcaggtcaaggaccagcagacagataaagaacaaaactcaaaaaaacaaacccaggaccagcagactgaggatcagcctgcacaggagaaaaagtcgcctaagggccagttccagaatgtccaagccgaaggccagcaggctcaagtagagaaagtaccaaagcttctctgtcaggacagtgagtctcagatacaacaataccagttttggcagtttcacaagggaaacttgcaggccggtcaaccacgcaccgttaacctccttgcaaagaatcctctgaccggatag

SEQ ID NO: 43692 - DNA, 339 bp, Artificial Sequence
  Description of Artificial Sequence: Synthetic coding sequence
atgatcggcatcttccacatcttcatgtggtacttcctgctggtgttatatatgggacagatcaaaggcgccttcggcacttacgagccagtgacctacaagactggctgtacactatggggtatcttttttataatagctggggtgtttctaattcgcgtcactaagtaccccactcgttcggggaagctgggacgtgaggtttcccggattttactcttcttttacgggctcgagttttccattgccttgactcattccatctattcatgctccaatctgtttagacgacaaaacgatctaacgtctgtaaccgaggaggccgagagcacgccgtag

SEQ ID NO: 43693 - DNA, 459 bp, Artificial Sequence
  Description of Artificial Sequence: Synthetic coding sequence
atgatcggcatcttccacatcttcatgtggtacttcctgctggtgctgtatatgggacagattaaaggggcgtttggcacctacgaaccagtgacatacaaaaccggatgcacgctgtggggcattttttttattatagccggagtcttccttattagagtgactaagtatcccacacggtctggcattatctccacgctcatcataaacatcatctgtattatcaccactatcacagcggtgacactgactataatagaactttctcactttaattctgtgagttaccgcaattacggccaggcaaaactagggcgggaagtctcccgcatcctattatttttttacggcttggagttctccattgctctcacgcactcaatttattcttgtagcaatcttttccggagacagaatgacctgacgtctgtcacagaggaagccgagagtacaccttag

SEQ ID NO: 43694 - DNA, 282 bp, Artificial Sequence
  Description of Artificial Sequence: Synthetic coding sequence
atgatcggcatcttccacatcttcatgtggtacttcctgctggtgttgtacatggggcaaattaaaggtgcttttggcacttacgagccagtcacgtacaagacgggctgcaccctgtggggcattttcaagctaggtagagaggtcagccggatactacttttcttctacggcctggagttttctattgctctcacccatagcatctactcatgcagtaatctcttccgacgccagaacgacctcacatccgttaccgaagaagctgagtccacgccttag

SEQ ID NO: 43695 - DNA, 2040 bp, Artificial Sequence
  Description of Artificial Sequence: Synthetic coding sequence
atggagagcaccagccaggaccggcgggccacccacgtgatcaccattaagcctaacgaaaccgtgttgaccgcattcccgtaccggcctcacagttcactgctggacttcctcaaaggggagccacgggtactgggcgcaacacaaattctcctcgcccttattatcgtcgggtttggtactatcttcgccttgaactatattggctttagtcagcgactgcccttagttgttctcaccggttatcccttctggggcgccctaatctttatcctgaccggctatctcacagtcactgacaagaaatccaagctgctgggacaaggcgtcaccggaatgaatgtgatttccagcctggtggccattaccggaatcacgttcacaatattaagctaccgccatcaagacaaatattgccaaatgccaagttttgaagaaatctgtgtctttagccggactctgttcatagtgttgttctttttgccgagcgatgtaacccagaattcagaacaaccggcacctgaggagaacgatcagctacagtttgttctgcaggaggagttctcttccgacgacagcaccaccaatgctcagtccgtgatctttggtggctacgctttctttaagctgactttgtcccggtcgcctctcgtctcgcagccaggaaacaaagggcgggagtttgtgcccgacgagcaaaagcagtcaatcctccctagccctaaattttctgaagaggagattgagcctctgccccccacgttagaaaagaaaccttctgaaaatatgagcattcagctagactcgaccttcaagcagatgaaggacgaggacctgcaaagcgccattgtacagccctcccaaatgcagaccaaattactacaggatcaggcagccagccttcaagtttttccaagccattccgcccttaagctcgaggatatttctccagaagacctcccaagtcaagcattgcctgttgaaggcttgtccgagcagacgatgccctccaagtccacttcttcccacgtgaaacaatcttcaaatctgaccgctaacgaccttcctcctcagggaattctttctcaagacacttcgtcccaagacatgctgttccacgatatgactagccaggatatgcaaagccttgacatgctgtcccaggacaccccctctcacgctatgcctccccaggatattcctagtcaagacatgcttagccaggcactgtccgcacatgcaatattacccgaagcctcgactagtcacattgtgcagtttcccgagatccagcacttacttcagcagccacccgacttacagccagagaacactgagcctcaaaatcagcaaatccttcagatgtcatatcaggacatacgttccgaggtcatggaggagaccaaggaatggaaatctgaggaagagctgcatcgcaggaagtcttctcggcgccactcccttaatcaacagacaaaagccctgcagtacctgaggcggcattctctcgacgtccaggccaagggccaaaagagtagcaaaagacactcactggatcagcagtcgaagggctggcagtcacccaagcagaagagtttggaccaacagattaaggactggctcagccccaagcgacattccgtcgacaagcaagctcaattgaaccagaccaaggaacagttgcccgatcagcaggccgaagaccaacaagcaaaaggcgaacaatacccagaaggccaatcaaaagacgggcaggtgaaggatcagcagaccgataaggaacagaactccaaaaaacagacacaggaccagcagaccgaggatcaacctgcccaggagaagaagtctcctaaagggcagttccaaaacgtgcaagctgagggtcagcaagcccaggtggagaaagtgcctaaactcctttgccaggattctgagtcccaaatccaacagtaccaattctggcaattccataaggggaatctgcaagccggtcagcctcgaaccgtgaaccttctggccaaaaatcccctgactggctag

SEQ ID NO: 43696 - DNA, 177 bp, Artificial Sequence
  Description of Artificial Sequence: Synthetic coding sequence
atgaacgtgatcagcagcctggtggccatcaccggcatcaccttcacaatcctgtcctaccgccaccaggataaatactgccagatgccttccttcgaagaaatctgtgtattctcacgcacactgtttatcgacttcatcttgctgacaccaccgcactctagccattttctatag

SEQ ID NO: 43697 - DNA, 1989 bp, Artificial Sequence
  Description of Artificial Sequence: Synthetic coding sequence
atggagagcaccagccaggaccggcgggccacccacgtgatcaccattaagcccaacgagactgtgctgactgccttcccctaccgccctcatagcagtctgctggatttcctgaagggagagcccagggtcctgggggcaactcaaatcctgctcgcactaattattgtgggattcggaacaatctttgccctcaattatattggcttttcccagagactcccgttggtggtccttaccggctacccattttggggagccctgatcggtcagggagttaccggcatgaatgtcatcagttctctggtggccattacgggaattacgtttacgattctgagttaccggcatcaggacaagtattgtcagatgccctccttcgaagagatctgcgtcttctcgagaacgttattcatcgttctctttttcctcccgagcgacgtgacccagaattctgagcagcccgctcctgaggaaaatgaccaactacaatttgtgcttcaggaagagttttccagtgacgacagcacaaccaacgcccagtctgtcatcttcggaggctatgcattctttaagctgacactctcaaggtcacccctagtatctcagcccgggaacaaggggcgtgagtttgtacctgacgagcagaagcagtctatccttccctcgccgaaattcagtgaagaagagattgagccccttccacccaccttggaaaaaaagccgagtgaaaatatgtccattcaactagacagcaccttcaagcagatgaaggacgaggaccttcaaagcgcaattgtccaaccatcacaaatgcagactaagctgctgcaagaccaggccgccagcctgcaggtgttcccatcccactccgctttgaaattggaagatatctccccggaggatctgccctctcaagctttgccagttgagggcctaagtgaacagacaatgccatccaagtcaacatccagccacgttaagcagtcatccaatctgactgccaatgacctccccccccaggggatactgagtcaggatacatcttcacaggacatgttatttcacgacatgacctctcaggatatgcagagcttagacatgctatcccaggatacaccctcccacgccatgcccccgcaagatatcccaagtcaagacatgctgtcacaggccctgagtgcccacgccattttgcccgaggcgagcacatcccatattgtacagtttcctgaaatacagcatctcctgcagcagccacccgacctccagcccgagaacactgaaccacagaaccaacaaatccttcagatgtcttatcaagatattcgctccgaagtgatggaggagacgaaggagtggaagagtgaggaagagctacataggagaaagtccagcaggaggcacagcctcaaccagcagacaaaggctctgcagtatctgcggcgccactccctggatgtccaggcaaaaggacaaaaatcctcaaaacgacattcactggaccaacagtccaaaggatggcagagtccgaaacagaagagcctggaccaacagattaaggattggctgtcacctaaacggcattctgtggacaaacaggcacagctcaatcagactaaagagcagctgccggatcagcaggctgaggaccagcaagccaagggagaacagtaccctgaggggcagagcaaagacggtcaagtgaaggatcagcagacagacaaagaacagaactccaagaaacaaacgcaggaccagcagactgaggatcaacctgcccaggagaagaagtctcccaagggacagttccaaaatgttcaggctgaaggccagcaggcgcaggtagagaaggtgccaaagttgctatgtcaggacagtgagtcgcaaattcagcagtaccagttctggcagttccataaagggaacctgcaagccggacagcccaggacagttaacttactggcaaagaatcctctgacaggatag

SEQ ID NO: 43698 - DNA, 1704 bp, Artificial Sequence
  Description of Artificial Sequence: Synthetic coding sequence
atgaacgtgatcagcagcctggtggccatcaccggcatcaccttcacaatcctatcataccgccaccaggataagtattgtcagatgccctcttttgaagaaatctgtgttttttctcgaacactcttcatcgtgctcttcttcctgccaagtgatgtgacccaaaatagcgagcagccggcccccgaggagaatgaccaactgcaattcgtgctgcaggaagagttttcttctgacgattctacaacgaatgcccaatcagtgatctttggcggttacgcttttttcaaactgaccctgtcccgctccccgctagtgagccagccaggcaacaagggcagggagttcgtccctgatgagcagaaacaatccatacttccaagccctaagttcagcgaggaggaaattgagcctctgccccctactctcgaaaagaaacccagcgaaaacatgtctattcagctcgatagcacttttaagcagatgaaggacgaggatctgcagagtgccatcgtgcagcctagtcagatgcagactaagttgctccaggaccaggccgcaagtctgcaggttttcccttcacactccgcactgaagctcgaggatatcagtcccgaggatctgccgtcacaggcgctgcccgtggaaggcctgtcagagcagacaatgcccagtaaatctacctcatcacacgtcaaacagagctccaacctgaccgccaatgacctgccaccacaggggatcctgagccaagatactagctcacaggacatgctgtttcacgatatgactagtcaggatatgcagagtctggacatgctctcccaggatactccctcacacgccatgcctccgcaggatatccctagccaagacatgctttcgcaggccctgagtgcccatgcgattttaccagaagcctcgacctcccacattgtacaattcccagaaattcaacacctcctccagcaacctcctgatttgcagcctgagaatacagaaccgcaaaatcagcagatcttacaaatgagctatcaggacatcagatctgaggtgatggaggaaactaaagagtggaagtctgaggaggaactgcatcgccggaagtcttcccggcgccatagtctgaatcagcagactaaggctctgcagtacctgcggcgtcactcactcgacgtccaggccaagggccagaagagcagcaagaggcattcactcgaccagcaatccaagggatggcagtcccccaaacagaagagcctcgaccagcagatcaaagactggttgagcccaaaacggcattccgtcgacaaacaggcgcagttgaatcagacaaaggagcagttgcccgatcagcaggcagaggaccagcaggccaagggcgagcagtatcctgaagggcagtcaaaggacggccaggtgaaggaccagcaaacagataaagagcagaactccaagaagcagacacaggaccagcagactgaggatcaaccagcccaagaaaagaagtcacctaaggggcagtttcagaatgtgcaggcagagggacagcaagctcaggtggagaaggtgccgaaattgctctgccaggatagtgaatcccagatacaacaataccagttctggcaatttcacaaaggcaacttacaggctgggcagccacgcaccgtgaacctgcttgcaaagaacccattaacaggctag

SEQ ID NO: 43699 - DNA, 444 bp, Artificial Sequence
  Description of Artificial Sequence: Synthetic coding sequence
atggtgcggcggggccacgtgggcatcttcttcatcgagggcggcgtgccattctggggcggcgcatgtttcatcatctccgggtccctttcagtcgcggctgagaaaaaccacacatcctgcctggtgcggagttctctgggaaccaatatcctctcagtcatggccgcattcgctggcacagctatcttgctgatggactttggtgtcacaaaccgtgatgtggaccgcggataccttgctgttctgaccatctttacggttctcgagtttttcacagcagtgatcgctatgcacttcggctgtcaggccattcatgcacaggcgtctgccccagtgatttttctccctaatgcattttctgccgactttaacataccatccccagctgccagcgccccccccgcctacgacaatgtggcttatgcgcagggggtggtttag

SEQ ID NO: 43700 - DNA, 723 bp, Artificial Sequence
  Description of Artificial Sequence: Synthetic coding sequence
atgagcgccgcccccgccagcaacggcgtgttcgtggtgatcccccctaacaacgcttctggcctgtgtccccccccagctattctgccgacttccatgtgtcagccaccaggaattatgcaattcgaggaacctcctcttggagctcagaccccgagggcaacccagcccccggatctgaggcccgtcgagacattcctcacaggcgagcccaaagtgctgggcacagtgcagatcttgattggcctcatacacttgggcttcgggtccgtgctgctgatggtgagacgcgggcacgttggcatatttttcattgagggaggagtgccattttggggaggtgcttgctttattatttcaggaagcctgagtgtggccgccgagaaaaaccatacctcctgtttggttaggagtagcctcggaacaaacatcttgtctgttatggccgcatttgccggcacagctatattgctgatggactttggagtcacgaatagagacgttgacagggggtacctggcagtgctcacaatcttcacagtccttgaattcttcaccgcagtgatagccatgcacttcggatgtcaggccatccacgcacaggcatccgctcccgtcatatttttacctaatgcttttagcgctgattttaacatcccttcgcccgcagctagcgctccacccgcctacgacaacgtggcttacgctcagggtgtagtgtag

SEQ ID NO: 43701 - DNA, 3162 bp, Artificial Sequence
  Description of Artificial Sequence: Synthetic coding sequence
atggaggtgagcggcgaccccggcatccccgccctgcaccggctgtgcacgcgagccctctctgcatcacctggtcctaccgccctagggcccagcacttttcttccatgggacgtctccgctaggatgacgtctgcaagaagacgcaccgacgtggggccgcgagtggccttcacttacccatgtacccaactaagccctaccagagcccaccggcatcttcccgtgcacacagtgacttatccatgcacacaactgtcacctacacgggctcactcatgccatttaccaatgcacacagtcacatacccctgtacgccctcaccaactagagcccatagttgccacctccctgtgcataccgtgacctatacttgcaccctaagtcccacccacgcgtgcctccatgcctctaccgtgtcctgtctgtgttgtatacccgtccataccgtaacatatccctgtaccctttcgcccacctgtgctcactgccacctccacatgcgggccaggacgcatccacagccacacgcctgcgccgtttacctttgtatcctgtcaccaacccgagcacattgccacttgcacgtgcatactgtgacttacatgtgtgtgcccgcatgtacacacagcattacccctgtccatgcacctcctgacactagctgtgcatgggcccaggccgtgcatcgctggccggtgctttggggtagtcgcagcagtagcatgagctccggcctgaagcagaccccgatggtcggcgtgacaggtcctccttgggatcccgacgcccctgctccggctccggctgggaccttgacagcccatctgatcccaggggccttgcagagcagcggcctcacgttgctcctatcacttgccgcacattgcagtggcccacaggccaaggttctatctcccggcggtctcgacgcgtcgggggccaatctttgggcaagtgccaattgctctcttttacagggtttctggtgccagccagcatcacagctgccccgcgatcagctgtctgctctgatccagcgactggctctcctgcaggtcccactgcaggcatggcaggtgagcggaaaagaatgtcggggcgccggtacaggagggcgaggagacgatccaacttgtggaaaacggggccgcgaggtggggggtgactgggggctgcgcccaccacagaggggccgggcaccgacaggttgccacggggagagcagggtcacaagagaaagacgatccgcccagctgtcatgtctggcgaatttggcgtctagatgtggattgcaagatgattttaccctccatcctccgaatctcttgctgttctataatctcagtcaggttcgggaagccgactgcagggcatttatccgacgtgctgcccaaggtgatgttgagttgctgagtcaccttcccgaccagcgggtggccttgtggcgcgcagctgtcgcgtgcctcgtgggggcaggctggggctgggcccgatgcatcggtggctctttgcccttgggggcagatttgttggccctccagggcgtcgcacgtctcaggctgagcgcttctgaccagcagctgcttggcgccctggtctgcgatatggacgctagcagcatcggagcagccgacccacatatgctggagaacctcagacggtgtccccggctgacagctgcccagcgtattgcccttaattccctgctcgccggggggaagacaagtttgggtcccccaggttcatggacacttgaggggcttcaagccttaggaccactggcaacttacatctctccacacctgtgggcacaggtgcaggaagcagtggggcttggctttttccgtagtgtcgtggcgagctgccaggtgggtcgactggggcagagggaggcccgctgttttgtgacctctttcctggagagtaagacaaagccagtgagctcccgccccaggctgagcacaggaaacataacagccgccacccttcgcgacgacctctttctggtccattacgattgtgccgagctcgagagctgtctcgacggatgtattcttcgtaccaatctagacaccctcctgcagcatcttctccctacagaatgccagcacgtggttaaggccaaattagcgcagatttacccacaaggtttgcctgaagatcaattaaggttaatcacttcactggtctacctttactcaagaactgagatcggccagtggtctataacatctcaggacactgtgatggcacttctggcttcagacgtggccctggaaaaccagacggaggcagttttacagaagtttctggagcacaatggcaccgtgtccggtgcccttcttttggccattggcggcacccgcctctgttggatgagcccgcatcagatccagacaatacaccctcaggaactaagattagctggtgcactcgacttgagttcctgcccccagtcacgcaaggacgtgctctacacaaaggctcacgaaaccttcgggtcctccggcaccttggccgcctattacagactgatgcgtccctacttgggaggttctcccggtggcgcgcagccacccagccctgttcctccagggggagcacctgtggaagagcttagacatttggcacacgccaacatatccatggacatcgacacgtttacaagcctcaatccattggaattgcagagcctggatgtgggtaatgtgacggctctcctgggccataacgtgggggatcttcagaaagccagatcacaccccacagtgcgggcgtggctacgttctttgaattccagcactctggggcagctaggcttggacgcttccccaacttcgcccacgggtccggctcatggtacgcgcggtccgccatccacaacacaccaggttctccacctcgtgcacacttcagggctccccacaaatgatgcccaggcctcgacaagcggctcattatgggctccactggggtatctccctctagccatggcccttccttgcagcctactgtgtcttctgcattggggcacttgcattttggtttccgtagattctgtagcaagcggttggctcgggtcccaggggtcaggggcgggtaagacagaggtgctggatagcgccggaaggcccttggggctcacaggacagctgtag

SEQ ID NO: 43702 - DNA, 2109 bp, Artificial Sequence
  Description of Artificial Sequence: Synthetic coding sequence
atggccgccgccgtgaccatccccggcccccggatcggcgccctgcagtcgagcgggctgaccctcctattgagcttggccgcccactgtagcggtccacaggctaaagtactgagtccgggaggtcttgacgcttccggcgctaatctgtgggcgagcgcaaattgcagtctgctgcaaggcttctggtgccaaccagcctcgcagctgcccagagatcagctgagtgccctgattcagaggttggccctcctccaggtccctctccaagcgtggcagctatcgtgtctggcgaaccttgctagtcgttgtggtctgcaggacgacttcaccctgcacccaccaaatctgcttcttttttacaacctctcccaggtaagggaagccgactgccgggcctttattaggagggctgcccagggcgatgtggagttactcagccatcttcccgaccagagagttgccctgtggagagcagcagtcgcttgcctggttggggctggattgaggctgtcggcctctgatcagcagctgctaggcgctttagtgtgtgacatggatgcttcctccattggtgctgctgatccccacatgcttgaaaaccttaggagatgcccacgccttaccgctgcacaacggatagccttaaattcccttctggctggcgggaagacgagccttgggcccccgggctcctggaccctagaagggctccaggccttggggccactcgccacctacatttcaccccatctgtgggcccaagtgcaggaagctgtggggctcggtttcttccgaagtgtggtagctagctgtcaagtgggaagactcggccaacgtgaggcccgttgcttcgtgaccagtttccttgaaagtaagaccaagccggtcagctctcggccgagattaagtactggtaacattaccgccgccacccttcgggacgatctgttcctcgtacactatgactgcgcagaacttgaatcctgtctcgatggctgcattcttagaacaaatctggacacactgctccagcaccttctccctacagagtgtcagcatgttgtgaaagccaagctggcccagatctatccacaaggcttgcctgaggatcaacttcggctgattactagccttgtttacctgtacagtcgcacagagattggtcaatggtcaatcacatcgcaggataccgtaatggctctgttggcgagtgatgtggctttggaaaaccagacagaggcagtattacagaagtttctggagcataatggcaccgtcagtggcgccctcctgttggccattggtgggacccgcttatgctggatgtcaccccatcagatccagaccatacatccccaggagctgcgacttgcgggagcattggatctttcatcgtgcccacagagccgcaaagatgttctgtacactaaggcgcacgagacattcggtagctccggaaccttagccgcctactaccgcctaatgagaccatatttaggagggagccctggcggcgcgcagcctccctcgcctgtgccccccggaggtgcaccagttgaagagctaaggcatttggcccatgctaacattagcatggacatcgatactttcaccagtcttaatccgctcgagctgcagtctctggatgtggggaacgtgaccgccctgctggggcacaatgttggggacctgcagaaagccaggtcgcacccgaccgtgagagcctggctgcggtctctgaactcaagcacgttgggccagcttggactcgacgcgtcgcctacctctccgacagggcccgcccatggcacaaggggaccgcccagtaccacacaccaggtcttgcatctggtgcacacatctgggcttccaacaaatgatgcccaggcttccacaagcgggagtctttgggcccctttgggctatttgcctctcgctatggctctcccttgctctctgctctgcctgctgcactggggcacgtgcatcctggtgtctgttgattccgtcgctagtggatggctgggcagccaaggatctggtgcgggcaagactgaggtgctcgactctgctggccgcccccttggtctgactgggcagttgtag

SEQ ID NO: 43703 - DNA, 792 bp, Artificial Sequence
  Description of Artificial Sequence: Synthetic coding sequence
atgagcctggtggccgaggccttcgtgagccagatcgccgccgccgagccttggccggaaaacgctacactgtaccagcaactcaagggagagcaaatcttgctgagtgacaacgcagcaagccttgccgttcaggcctttcttcaaatgtgcaacctgccaattaaagtggtttgccgagccaacgccgagtacatgtcccccagcggcaaggttccttttatccacgtgggcaatcaagtcgtgtctgagctgggaccgatcgtacaatttgtgaaagccaaaggtcatagtctgtcggatgggctcgaagaggtccagaaagccgagatgaaagcctatatggagctggttaacaatatgctgctgactgcagaactatatctccagtggtgtgacgaggccactgtcggcgagattactcacgctcggtacggcagcccctacccttggcctctcaaccatatcttggcctaccagaagcagtgggaagtcaaaaggaaaatgaaggcgatcgggtggggtaagaaaacactcgaccaagtcctagaagacgtcgatcagtgttgtcaggcgctgagccagcgcctgggcacccagccttacttctttaataagcagcccaccgagctagatgcgttggtgttcggacacctgtataccatactgaccacacagttaaccaacgatgaactgtccgagaaggtaaagaactactctaacctgctggctttctgtaggaggattgagcaacattacttcgaggatcgcggcaaaggtcggctttcttag

SEQ ID NO: 43704 - DNA, 762 bp, Artificial Sequence
  Description of Artificial Sequence: Synthetic coding sequence
atgtacatcgccgccgagccctggcccgagaacgccaccctgtaccagcagttgaagggagagcagattctcttgtcagataatgcagcttcactggccgttcaagcctttctccaaatgtgcaatctgccaatcaaggttgtttgccgggcaaacgcagagtacatgtcccctagcgggaaggtaccttttatccatgtcggcaaccaggttgtgagcgaactgggccctatcgtgcagttcgtgaaagccaaaggccactccctcagcgacggactggaggaggtgcaaaaggcagagatgaaggcctatatggagttagtaaacaatatgctactcacagctgagctgtatctgcagtggtgcgatgaggctacagtcggcgaaattactcatgcgagatacgggtccccatatccttggccattgaaccatatcctggcataccagaaacagtgggaggtgaagcggaagatgaaagctatcgggtggggcaagaagactttagaccaggtactggaggacgtggaccagtgctgccaggcactgtcacagcgactcggaactcagccttattttttcaataaacagccgacagagctcgacgccctggtgttcggacacctgtacacgatcctgactactcagctgacaaacgacgagttaagcgaaaaagttaaaaactacagcaacctgttagccttctgtagacgcatcgaacagcactatttcgaagacagaggtaaggggcgactgtcttag

SEQ ID NO: 43705 - DNA, 477 bp, Artificial Sequence
  Description of Artificial Sequence: Synthetic coding sequence
atggccgcccccctggagctgagctgctggggcggcggctggggcctaccaagcgtgcactcagaatctctggtggtgatggcatacgccaagttttctggcgccccactgaaggtgaacgtgatcgataacacgtggagagggagccggggcgacgtccctattctgacaacagaagacgatatggtgagccagcctgctaaaatcctgaacttccttagaaaacaaaagtacaacgcggattatgagctaagcgccaaacagggagctgacacactggcatatatcgcactcctggaggagaagctgttaccagccgtgttacataccttctgggttgagtccgacaactactttacggttaccaagccatggttcgcaagtcaaattccatttcccctatccctgattttgccaggtcgcatgtccaagcaaatattgagctctagggctggcactcacatgcttagaaaatag

SEQ ID NO: 43706 - DNA, 747 bp, Artificial Sequence
  Description of Artificial Sequence: Synthetic coding sequence
atggccgcccccctggagctgagctgctggggcggcggctggggccttcccagcgtccactcagaaagccttgtggtgatggcttacgctaaattttccggagcaccactgaaggtgaatgttatcgacaacacctggagaggcagccgcggagatgttcctatccttaccaccgaagacgacatggtgtcgcagcccgccaagattctgaattttctgagaaagcaaaagtataacgctgactatgagctaagtgctaagcagggtgccgataccctcgcatatatcgcactcctcgaggagaaactgctgcccgccgttctccataccttttgggttgaaagtgacaactattttaccgttaccaaaccatggtttgctagtcagataccttttcctttatcccttatcctccccggacgcatgtccaaaggcgccctgaaccggatcttgttaactcgcggccagccccccctgtatcacctgagagaggtcgaggcccagatatacagggatgctaaggaatgcctcaacctgctgagcaatcgcttgggaacaagtcaattcttttttggggatactccttctaccctggacgcctatgtctttgggtttctggcccccttatacaaagtccgatttcccaaggtgcagttgcaggagcaccttaaacagctgagcaacctgtgccgattttgcgacgacatcctgtcttcgtattttaggctgagcctgggggaaggttag

SEQ ID NO: 43707 - DNA, 747 bp, Artificial Sequence
  Description of Artificial Sequence: Synthetic coding sequence
atggccgcccccctggagctgagctgctggggcggcggctggggcctgccatcggtccactccgaaagcctcgtggtcatggcctacgctaagtttagcggtgcccccctgaaggtcaatgtaattgacaacacctggcgtggctcccgcggagacgtccccatcttgacgactgaggatgacatggttagtcagcctgcaaaaattttaaattttctgagaaaacagaaatacaacgccgactacgagctttctgctaaacagggcgccgacactttggcctatattgccctgctggaggaaaaactgttgcctgccgtgctgcacactttctgggttgagtctgacaactattttacagtcacaaagccctggtttgcctcacagatcccattccctctgagtttgatcctaccaggccgcatgagtaagggcgcccttaacagaattctgctaaccagaggacaaccgcccctctaccacctgcgggaggtagaggcacagatctatcgagacgccaaggaatgcttgaatctgttgtcaaatcgccttggcacgagccaattctttttcggtgacactccctccacacttgacgcttacgtgtttggttttctggctccgctgtacaaggtccggttcccaaaggtgcagctgcaggagcacctcaagcagttaagtaatctgtgtcggttctgtgacgacatcctgtcctcttacttcaggttatcacttggtgatgggtag

SEQ ID NO: 43708 - DNA, 939 bp, Artificial Sequence
  Description of Artificial Sequence: Synthetic coding sequence
atggccgcccccctggagctgagctgctggggcggcggctggggcttgccatcagtgcatagcgaatctctggtggtgatggcctatgccaagttttccggtgcaccattaaaagtgaacgttatcgataacacttggcgcggctcacgaggagacgttccaatcttaacaaccgaagatgatatggtgagccagcccgccaaaatccttaattttctccgaaaacagaaatataacgccgattacgaactgtcagccaaacaaggcgccgatacattagcatatatcgcactcctggaggagaagctgctgcccgcggtgctgcacacgttctgggtggaatcggacaactactttaccgtgacaaaaccctggtttgcttcccaaatccctttcccactgagcctcatcctcccagggcggatgtcaaagggggcgctcaatcgtatactcctgacccggggccagccacccttgtatcatctgcgagaggtggaagcacagatctacagagatgcaaaagaatgtctcaacttattgagtaatcggctgggaacatcccagtttttctttggagacactccaagtaccctggacgcctacgtgttcgggttcttagctccattgtataaggtccgatttccgaaggtgcagctgcaggagcatcttaaacaactttctaacctatgtcggttttgcgacgacatattgtcaagctactttagattgtctttgggcggcattagccccgccgggcaggaaacagtagatgcaaacttacaaaagctgacgcaactggtgaacaaggaaagcaacctgatcgaaaaaatggatgacaatctgcggcagtccccacaattgcccccaagaaagctcccaacccttaagcttacacctgctgaggaagagaacaacagttttcagcgtctgagcccttag

SEQ ID NO: 43709 - DNA, 756 bp, Artificial Sequence
  Description of Artificial Sequence: Synthetic coding sequence
atggtgagccagcccgccaagatcctgaacttcctgcggaagcagaagtataatgctgattacgaactgtcagccaaacagggcgcagacacactcgcttacatcgccttgcttgaagagaagcttctccccgccgttcttcacacattctgggtcgagtcagataattacttcaccgtgacaaagccatggttcgcgtcccagatccctttcccactgtccttaatcctacccggacggatgagcaaaggggctctgaatcgcattttgcttacgcgcggccagcctcctctttaccatctgagggaggtggaggctcagatctacagagatgctaaggagtgcctgaatctgctgtctaaccgccttggcacttcccaatttttcttcggagacaccccttccacgctggacgcctacgtgttcggcttccttgcacccctctataaggttaggtttcctaaggtgcagctacaggagcacttgaaacagttaagcaatctgtgccgcttctgtgatgatattctttccagttactttagactgagcctcggcggaatcagtccagccggacaggaaaccgtggacgcaaatcttcagaagctcacccagctggtgaataaggagtctaatttgatcgaaaaaatggatgacaatctgagacagagtccccaactccctccccgcaagctgccaactctgaagctgaccccagctgaggaggaaaacaactcctttcagcggctgagtccatag

SEQ ID NO: 43710 - DNA, 1008 bp, Artificial Sequence
  Description of Artificial Sequence: Synthetic coding sequence
atggccgcccccagcggcgtgcacctgctggtgcggcggggcagccaccggatcttttcatcccccctcaaccatatttacctacataagcaaagcagttctcagcaaaggcgaaacttttttttcagacgacagagggacattagccactcgatcgttctgcctgccgccgtctcttccgcgcatccagtgccaaaacacatcaagaagccagactacgtgaccaccggcattgtcccagattggggcgactctatcgaggtgaaaaacgaagaccagatccagggccttcaccaggcatgtcagttggcccggcatgtcctcttgctggccggaaaatctctgaaggtggatatgaccacggaggagattgacgctctggtccatcgggagatcatctcccacaacgcctatcctagccctttagggtacggcggatttccaaagtcggtatgtacatcggtgaacaacgtgctctgccacggcattcctgatagtcgaccgcttcaggacggtgatatcatcaatatcgatgttacagtttattataatggctatcatggggacacgtctgaaaccttcctagtcgggaatgtggacgagtgcggtaaaaagcttgtggaagttgccaggcggtgcagggacgaggcgatcgcagcatgccgggcaggggccccattttccgtgattggtaatactattagtcacatcacccaccaaaacggattccaggtgtgcccgcacttcgtgggtcacgggatcggatcgtactttcacggacacccagaaatctggcaccacgcaaacgattcggatctccccatggaggaagggatggcctttactatcgaaccaattatcacagagggttctccagagttcaaggtgctggaagatgcctggacggtcgtgtctttggataatcagagatccgcacagttcgaacatacagtgctcattaccagtcgcggcgctcagattctgaccaaacttcctcatgaggcctag

SEQ ID NO: 43711 - DNA, 747 bp, Artificial Sequence
  Description of Artificial Sequence: Synthetic coding sequence
atgaagcccgccagcatcagcgaggaggagctgctgaacctgatcaataagctgaacaacgacgataacgtggacgggcttttggtgcagctccccctgcctgaacacatcgatgagcggaggatatgtaacgcagtttcgccagacaaagacgttgatggattccatgttatcaatgtgggtagaatgtgcctggaccagtacagtatgttgccagccacaccatggggggtgtgggaaattatcaagagaacggggatccctacactggggaagaatgttgttgtggccgggagaagcaagaacgtcgggatgcctattgctatgctcctgcataccgatggggctcatgaaaggcctggcggagatgcaacagtgacgattagccacaggtatactcctaaggagcagctcaaaaagcatacaattttggcagatatcgtcattagtgctgccggcatccccaatctgatcactgccgacatgataaaagagggggccgccgtaatcgatgtgggaatcaaccgagtgcacgaccccgtaaccgccaaaccaaagctggtcggggacgtcgattttgagggcgtcaggcagaaggctggctacattacaccagttcccggcggggttggccccatgacagtggccatgctgatgaagaataccatcatcgctgcaaagaaagtgttgagattagaggagagggaggtgctaaagagcaaggagcttggcgtggcgacaaattag

SEQ ID NO: 43712 - DNA, 561 bp, Artificial Sequence
  Description of Artificial Sequence: Synthetic coding sequence
atgtgcctggaccagtacagcatgctgcccgccaccccctggggcgtgtgggagattataaagagaaccggcataccgaccttaggtaagaacgtagtggtcgccggcaggtctaagaacgttggtatgcctatcgccatgctcctccataccgatggagcacacgaacggcccggcggtgatgcaactgtaaccatctcacaccggtataccccaaaagagcagctcaagaagcacacaattctcgccgacattgtgatatccgccgccggcatccctaatcttatcacagccgatatgatcaaggagggcgcagcagttatagatgtggggatcaaccgcgtccacgacccagtgaccgctaagcccaaactcgtgggcgatgttgacttcgagggtgtgcggcagaaagccgggtatattacacccgttccagggggtgttgggcctatgaccgttgctatgctcatgaaaaacaccatcatagccgcaaagaaggtcctcaggctggaggaaagagaagtcctgaagagcaaagagcttggggtggccacaaattag

SEQ ID NO: 43713 - DNA, 1053 bp, Artificial Sequence
  Description of Artificial Sequence: Synthetic coding sequence
atggccgccaccagcctgatgagcgccctggccgcccggctgctgcagcctgcgcactcctgcagccttaggttgcgaccattccacttggccgccgtgcgaaacgaggcagtggtgattagcggtagaaagctggcccagcaaataaaacaggaggttcgccaagaagtcgaggagtgggttgcatcgggcaacaagcgacctcacttgagtgtgatcctggttggggagaaccccgcaagccattcctacgtactcaacaaaacacgggcggctgctgtggtaggaatcaattctgaaaccataatgaaacccgcatctattagcgaagaggaactgctgaacttgattaataaacttaataacgacgacaatgttgatgggctgctggtgcagctacccctccctgagcatatcgacgagcgcaggatctgtaatgcggttagtcccgataaggatgtggatgggttccacgtcatcaacgtgggtaggatgtgcctcgaccaatatagcatgctgccagccacgccatggggagtgtgggaaatcatcaagcgcacaggcataccaaccctgggcaaaaatgtagttgtggcaggacgttctaagaacgtgggaatgccaatcgcgatgctactgcatacagatggtgcccacgagcgccccggcggtgacgcgaccgtgaccataagccatcgatataccccgaaggaacagctcaagaaacacacaattctggctgacattgtgatcagtgctgctggaatccctaatctgattacagcagacatgatcaaggaaggggccgccgtcatcgatgtcggaatcaacagggtccacgacccggtcaccgctaaacctaagctggtgggggacgtggacttcgagggcgtgcggcagaaggctggctacatcaccccggtgccgggaggtgtcggtcctatgacagtagccatgttaatgaagaacacaattatagccgcgaagaaagttcttaggctcgaggagagggaggttctaaaatcaaaagaactcggcgtggccactaactag

SEQ ID NO: 43714 - DNA, 882 bp, Artificial Sequence
  Description of Artificial Sequence: Synthetic coding sequence
atggccaccaacgagagcgtgagcatcttcagcagcgccagcctggcagtagagtatgtggattcacttctgcccgaaaacccactccaggagcctttcaaaaatgcttggaattacatgctgaataactataccaaattccagatcgctacttggggctcgctgattgtccatgaagccctgtactttctgttttgccttcccggtttcttgttccagtttattccttatatgaaaaagtacaaaattcagaaggataagcctgagacttgggaaaatcagtggaaatgtttcaaggtgcttctgttcaatcacttctgcattcagttacctctcatttgtgggacgtactattttaccgaatatttcaatattccttacgactgggagcgcatgccaaggtggtattttctgttggctcgctgcttcgggtgtgccgtcattgaggacacatggcactactttcttcatcgcttgctacaccataagagaatctacaagtacattcataaggttcatcacgagtttcaggccccgttcggaatggaagccgagtacgctcaccctctggaaactctgatccttgggaccgggttttttatcgggatcgttctactctgtgatcacgtcatcttgctttgggcctgggttactattcgcctgctggagaccattgacgtccattccggctacgacatccctctgaatcctctgaatttaattcccttctacgccggaagccggcaccatgacttccaccacatgaactttatcggaaattacgcgtcaaccttcacctggtgggatcgaatttttggaacagactcccagtacaatgcttacaatgagaagcgaaagaagttcgagaaaaagactgagtag

SEQ ID NO: 43715 - DNA, 489 bp, Artificial Sequence
  Description of Artificial Sequence: Synthetic coding sequence
atgccccggtggtacttcctgctggcccggtgcttcggctgcgccgtgatcgaggacacttggcattactttctgcatagactgcttcaccataagagaatttataaatatatccataaggtgcaccatgagttccaagcaccattcggtatggaagctgagtacgcccaccccctagaaactctgatcctgggaactggcttttttattggtattgtgctgctttgtgaccatgtcatattattgtgggcttgggtgaccattcgactgctggagaccatcgacgtgcatagcgggtatgacataccgctcaatccgctgaatctgataccgttttacgcgggctccagacaccacgattttcatcacatgaactttattgggaattacgctagtacctttacttggtgggaccggatattcggaacagactcacagtacaatgcttacaatgagaaacggaagaaattcgagaaaaaaacggaatag

SEQ ID NO: 43716 - DNA, 258 bp, Artificial Sequence
  Description of Artificial Sequence: Synthetic coding sequence
atggccaccaacgagagcgtgagcatcttcagcagcgccagcctggccgtagagtacgtcgactcccttcttccggagaatcctctgcaggaaccattcaagaatgcctggaattacatgctcaataactacaccaaattccaaatcgcgacctggggcagcctcatcgtgcacgaggccttatatttcctgttttgccttcccggctttctctttcagtttatcccatacatgaagaagtataaaatccaaaaatag

SEQ ID NO: 43717 - DNA, 663 bp, Artificial Sequence
  Description of Artificial Sequence: Synthetic coding sequence
atggccaccaacgagagcgtgagcatcttcagcagcgccagcctggcagttgaatacgttgatagcttgctgcccgaaaatcctttgcaggagccattcaagaacgcctggaattatatgctaaataactacaccaagtttcaaatcgctacctgggggagcctgattgtgcatgaagctctgtatttccttttctgtctgcctgggttccttttccagttcattccatatatgaagaagtacaaaatacagaaagacaagccagagacttgggagaatcagtggaagtgtttcaaagtcttgttgttcaatcacttttgtatccagcttccgctgatctgcggcacttactacttcaccgaatattttaacatcccctacgattgggagcggatgcctaggtggtatttccttcttgccagatgtttcgggtgtgctgtcatagaggacacctggcattattttctccataggctcttgcaccacaaacgtatctataagtacatccacaaggtacatcacgaattccaggccccatttggcatggaagcagaatatgcgcacccgctagagacactcattctgggaaccgggttttttataggtattgtgctgctctgtgatcacgtcatacttctttgggcatgggttaccatccgctag

SEQ ID NO: 43718 - DNA, 723 bp, Artificial Sequence
  Description of Artificial Sequence: Synthetic coding sequence
atggccgccctgcggcggatgctgcacctgcccagcctgatgatggggacttgtaggccattcgccggatcgttggccgattcctgtcttgccgaccgttgtttgtgggaccgacttcacgctcagcctaggcttggaaccgtccctacttttgactggttcttcggatatgatgaggtgcagggactgctgcttccactactgcaagaggcacaggcggcatctccgttgcgagtgttggacgtgggctgtgggacctccagcctgtgtaccggactatacacaaaaagtccacatcctgttgacgtccttggagtggacttttcccctgtcgctgtggctcatatgaacagtctcctggagggtggcccagggcaaacccccctctgccctgggcacccagcctcctcactccacttcatgcatgcggacgcacagaatttgggagcagtggccagcagcggaagcttccagctccttttggataaggggacgtgggacgccgtggcaaggggaggattgcccagggcctaccaactacttagcgaatgtcttagggtgttaaacccccagggtactctgattcaattcagcgatgaggaccctgatgtgcgactgccttgcctcgaacaggggtcttacggctggaccgtcactgttcaggagctgggacccttccggggcataacatacttcgcatacctcatacagggcagtcactag

SEQ ID NO: 43719 - DNA, 657 bp, Artificial Sequence
  Description of Artificial Sequence: Synthetic coding sequence
atggccctggtgccctacgaggagaccaccgagttcggcctgcagaagttccacaaacctctggcaacctttagttttgcaaaccataccattcaaatccgacaggattggcgccacctgggcgtcgccgccgtcgtgtgggacgccgccattgttctgagcacctacctggagatgggagccgtggaacttagggggcgttcagcagtcgagttgggggccggcaccgggctggtgggcatcgtcgcagcccttttgggggcccatgtcacaatcacagataggaaggtggctctggagttcctgaagtctaacgttcaagccaacctcccgccacatatccagaccaagacggtggtcaaagagctgacgtgggggcagaacttggggagtttttcgcctggagagttcgacctgatcctgggagccgacattatctacctagaggagacatttactgacctgcttcagacattagagcacctttgttccaaccacagcgtcatcctccttgcgtgcaggataagatatgaaagagacaataacttcctggctatgctggagcgtcaatttaccgttaggaaagtccactacgatcctgagaaggatgtgcatatctacgaagcccagaagcgcaaccagaaggaagacctctag

SEQ ID NO: 43720 - DNA, 657 bp, Artificial Sequence
  Description of Artificial Sequence: Synthetic coding sequence
atggccctggtgccctacgaggagaccaccgagttcggcctgcagaagtttcataaacctttagctacctttagttttgccaatcacacgatccaaatccggcaagactggaggcatctgggtgtggcagctgtcgtgtgggacgccgccattgtgctgtccacctacttagaaatgggcgcggttgagttgcgcgggcggtcagccgtagagctgggagctggcaccggccttgttggcatcgtggcggccctgctcggcgcacatgtaacaatcaccgatcgcaaggtcgcgctcgagtttctgaagtcaaatgtgcaggcaaatctcccaccacacattcagaccaagacggtggtgaaggaacttacatggggccagaatctgggctcattttctcctggagaattcgacttgatcctgggggcagacatcatctacctggaagaaacttttactgacctgttacaaactctggagcatctgtgctccaatcacagtgtaatccttctggcctgtagaattagatatgagcgagacaataattttctcgctatgctagaacgtcaatttacggttcgtaaggtacattatgatccagagaaagacgtacacatatacgaggcccagaagcgtaaccagaaggaggatctctag

SEQ ID NO: 43721 - DNA, 273 bp, Artificial Sequence
  Description of Artificial Sequence: Synthetic coding sequence
atggccctggtgccctacgaggagaccaccgagttcggcctgcagaagtttcataaacccttagcgacattctccttcgctaaccacaccattcaaatacgtcaggattggcgccatctcggggttgccgccgttgtgtgggacgcggccatcgtgctgagcacatacctggagatgggcgcagtggaactccgcggaagatcggcagtggaactcggcgccggaactggcttggtgggtattgtggcagcccttctgggcggcggaatttag

SEQ ID NO: 43722 - DNA, 657 bp, Artificial Sequence
  Description of Artificial Sequence: Synthetic coding sequence
atggccctggtgccctacgaggagaccaccgagttcggcctgcagaaattccataaaccattggcaacattctcattcgccaaccacacaattcagattagacaggattggcgccacctcggagtggctgccgtcgtttgggatgcggctatagtgctctccacatacctagaaatgggtgccgtcgagctgagagggcggtcagcggtcgagttgggtgctggcactgggctggtgggcattgttgctgcactgctgggggcacacgtgaccattaccgatagaaaagtggccctggaatttcttaagagcaatgtacaagcaaatcttcccccccacattcaaacgaaaacagtcgtaaaggagctgacgtgggggcagaacctgggctcattctctcctggggagttcgacctcattctcggagctgatataatctatctggaagagaccttcaccgacctgcttcagaccttggagcatctatgctccaaccattccgtgatcctgctggcctgtaggattaggtacgagagggataataacttcctagctatgttagagagacagttcaccgtacgcaaggtgcattacgacccggagaaggacgtacatatatatgaggcccagaagagaaatcagaaggaagatttgtag

SEQ ID NO: 43723 - DNA, 657 bp, Artificial Sequence
  Description of Artificial Sequence: Synthetic coding sequence
atggccctggtgccctacgaggagaccaccgagttcggcctgcagaagtttcacaagcctctggccaccttttcattcgcaaaccacactatccagatccggcaagattggcggcacctgggtgttgcagccgtagtgtgggacgctgccattgttctgagcacttatctggagatgggggctgtcgagcttcgggggcggtccgctgtcgagctaggggctggaaccggcttggttggcatcgtggccgcgcttttgggtgctcacgtgaccattactgacaggaaagtagctctggagttcttgaagagcaacgttcaggcgaatctgcctccccacattcaaacaaagaccgttgttaaagagctcacctggggacagaacctcggtagctttagccctggtgagtttgatttgatcttgggagctgacatcatctatctggaagagactttcaccgacctgctgcagacactggagcatctttgctctaaccacagtgtgatccttctcgcctgtaggattcgatatgagagggacaacaattttcttgccatgcttgagcgtcagttcacagtgcggaaagtccattatgatccagaaaaggacgtacacatctacgaggcgcagaagcggaaccagaaagaagatctatag

SEQ ID NO: 43724 - DNA, 657 bp, Artificial Sequence
  Description of Artificial Sequence: Synthetic coding sequence
atggccctggtgccctacgaggagaccaccgagttcggcctgcagaagttccacaagccattagcaaccttctcgttcgctaaccacactattcagattcgccaggactggcgacatctgggagtcgccgcagtcgtttgggacgccgctattgtgctttccacgtacctggagatgggcgctgtcgaactgcgcggcagaagtgcagtggagctcggggccggaaccggcctggtgggcattgtagctgcactactcggcgcccacgtcacaattactgatcgcaaggtagccttagagttcttaaagagcaacgtacaagccaacctgcctcctcatatccaaaccaagactgtggttaaagaactcacatgggggcagaatcttggtagcttttcaccgggggagttcgacctcattctgggagccgatattatatatctcgaggagacctttacagacctcctgcagacactcgagcacctttgtagtaatcattccgtgatcttgctggcttgcaggataaggtacgagagagataacaactttcttgccatgctggagcggcagtttactgtccgcaaagtccactacgatccagagaaagacgtccatatctatgaggctcagaagcgaaaccagaaggaagatctgtag

SEQ ID NO: 43725 - DNA, 273 bp, Artificial Sequence
  Description of Artificial Sequence: Synthetic coding sequence
atggccctggtgccctacgaggagaccaccgagttcggcctgcagaaatttcataagcccttagccacattctcatttgcaaaccacacaattcagattaggcaggactggcgtcatctgggagtggccgccgtcgtgtgggacgcagccatagttctctccacttatctggagatgggggctgttgagctacggggccgcagtgcggtcgaattgggagccgggaccggactggtaggaattgtggcggccctgctgggaggaggcatttag

SEQ ID NO: 43726 - DNA, 681 bp, Artificial Sequence
  Description of Artificial Sequence: Synthetic coding sequence
atggccgaccccggccccgaccccgagagcgagagcgagagcgtgtttccccgcgaagttgggctgttcgcagactcctattccgaaaagtctcaattttgtttctgtggacacgtactgaccattacccagaattttggaagtcgactgggagtcgcagcacgggtgtgggacgccgctcttagtctatgtaattattttgagtctcagaacgttgatttcaggggcaaaaaagtcatcgaacttggcgccgggacaggaatcgtcgggatcctggccgcgctgcagggaggcgacgtgacaattaccgatctaccactggcgcttgaacaaattcagggcaatgtgcaggcgaacgtgcccgctggcggccaggcgcaggtgcgcgccctgtcctggggaattgaccaccacgtgttccctgcgaattacgatcttgttctgggtgcagatattgtatatctggaacccacattcccactgcttctcggcactctgcagcacctttgtaggccccatggcaccatttatctggcaagcaagatgcgcaaagaacatggaacagagtctttcttccagcacctgctgccacagcatttccagctggagctggcacaaagggatgaggatgaaaacgtgaatatctacagagcgaggcacagggagcccaggccagcatag

SEQ ID NO: 43727 - DNA, 450 bp, Artificial Sequence
  Description of Artificial Sequence: Synthetic coding sequence
atggccgaccccggccccgaccccgagagcgagagcgagagcgtgtttcctcgggaggtggggttgttcgcagatagctacagcgaaaaaagccaattctgcttctgtgggcatgtcctgacaattacacagaactttggttcccgtttgggcgttgccgctcgagtatgggacgctgctctgtcgctctgcaactattttgagagccaaaacgtagactttcgcggaaagaaggtaatcgagctgggagccggcactggtattgtgggcatcctcgcggcgctgcagggggcttatggcctggttcgcgagacagaggatgatgtgatcgaacaggaactgtggcgcggaatgcgaggagcatgtggacacgcactgtccatgtccaccatgactccttgggagtccattaaaggtagctccgtccgcggtggatgttatcaccactag

SEQ ID NO: 43728 - DNA, 810 bp, Artificial Sequence
  Description of Artificial Sequence: Synthetic coding sequence
gcccggtgccagttctgcgcctgcgagagcctgagcccctgcagcggactgagcagcctggcagcacggcagggctaccaccagatctgggctttcccatttctccccagcggtgccacagcgacctggccagcggcgagccgttctcgctctctggcagccagatccctacctcggtctccggctcgccctgggccaaatgacgccctgctcggggaacacgattttagaggccagggagtgcgtgcacagcgcttccggttcagcgaagaacctggaccaggggccgacggggccgttctggaagtgcatgtcccacagattggagctggtgtttcgctccctggcattctggccgccaagtgcggagccgaagtgattctctccgacagtagcgaattgccacattgcctggaagtctgcagacagtcctgtcaaatgaataacttgccccatctgcaggtcgtggggctgacttggggtcatatatcgtgggacctgctcgcactgcctccgcaggatatcatcctggcgtctgacgtgttcttcgaacccgaggacttcgaagacatcctggccaccatttacttccttatgcacaaaaacccgaaagtgcagctgtggtcgacatatcaagtaaggagcgcggactggtcacttgaggcattgctgtacaagtgggacatgaaatgcgttcacatccccctggaatcattcgatgcggacaaagaggatatcgctgagagcaccttacccggacggcacaccgtggagatgcttgtgattagctttgccaaggactctttatag

SEQ ID NO: 43729 - DNA, 573 bp, Artificial Sequence
  Description of Artificial Sequence: Synthetic coding sequence
atgtacgtgtggccctgcgccgtggtgctggcccagtacctgtggttccatcggcggtcactacccggcaaagccatcctcgaaattggtgcaggagtgtctctgccaggcatcctggctgcaaaatgcggtgctgaagtgattttatcagactcaagtgagctcccccactgcctcgaggtatgtagacagtcatgccagatgaataatctgccccacctgcaggtggtcggcctgacatgggggcatattagctgggatctactggccctgcctccacaggacatcatcttggcttccgatgtctttttcgaaccagaggactttgaagacattctggctaccatctactttctgatgcataaaaaccccaaagtacagctttggtctacgtatcaggtgcggtcagccgactggagcttagaagccctgctgtataagtgggacatgaagtgcgtgcatatccccttagaatcgtttgacgccgacaaagaggatatcgccgagtcaacattacccggcagacataccgtcgaaatgctcgtgatcagtttcgccaaggattccctctag

SEQ ID NO: 43730 - DNA, 372 bp, Artificial Sequence
  Description of Artificial Sequence: Synthetic coding sequence
atgaacaacctgccccacctgcaggtggtgggcctgacctggggccacatcagctgggacctgctggctctcccccctcaggatattattctggcatccgacgtgtttttcgagccagaagatttcgaggacattcttgctacgatttattttttgatgcataagaaccccaaggtccagctctggtccacttatcaggtaagatcggccgactggagcctggaagccctgctatacaagtgggatatgaaatgtgtgcacattcctcttgagagttttgatgccgacaaggaagatatagccgagtccacattgcctggcagacacaccgtggagatgctggtgatctctttcgctaaggattctctgtag

SEQ ID NO: 43731 - DNA, 372 bp, Artificial Sequence
  Description of Artificial Sequence: Synthetic coding sequence
atgaacaacctgccccacctgcaggtggtgggcctgacctggggccacatctcctgggatttgttggcactgcccccccaggatattattctggctagtgacgtgtttttcgaacctgaggactttgaagacatccttgccacaatctatttcttgatgcacaagaaccctaaggtccaactgtggagcacttatcaggtgaggtcagccgattggagcctggaggctcttctgtataagtgggacatgaaatgcgtccacatccccctcgaaagctttgacgcagacaaagaagacatcgccgagagcactctgccggggagacatactgttgagatgcttgtgatctcattcgccaaagattccctatag

SEQ ID NO: 43732 - DNA, 372 bp, Artificial Sequence
  Description of Artificial Sequence: Synthetic coding sequence
atgaacaacctgccccacctgcaggtggtgggcctgacctggggccatatctcttgggacttgctggcactgccaccgcaggatattattctagccagtgatgtattttttgaaccagaagactttgaagatatcctcgccacaatctactttttgatgcacaaaaatcccaaagtgcagctttggtcaacctaccaagtgaggtcagccgactggtctctagaggccctgctgtataaatgggatatgaagtgtgtccacattcccctggaaagcttcgacgccgacaaggaagatattgcggaatcaaccttaccggggcgtcatacagtagagatgttagttatttcttttgctaaggattccctgtag

SEQ ID NO: 43733 - DNA, 2715 bp, Artificial Sequence
  Description of Artificial Sequence: Synthetic coding sequence
atggccgccatccgggccctgcagcagtggtgccggcagcagtgcgaagggtacagggacgtcaatatctgcaatatgactacctcgtttcgcgacggactagccttttgtgctatcttgcaccggcatcggcctgatctgataaatttctctgcactcaaaaaagagaatatttacgagaataacaagctggcttttcgagtggccgaggagcacctcgggattcctgcattactggacgccgaggatatggtagctctcaaagtccccgaccgtctttctattctcacctacgtgagtcaatactacaactactttcatggccgcagtcctattgggggtatggccggggtcaaacgagctagtgaggactctgaagaggaacctagcggaaagaaagcgccagtacaggcagccaaactgcctagtcctgctccggctcgaaagccccctttgtctcccgcccagacaaaccccgttgtgcagagacgaaacgagggcgctggcgggccccctccaaagacagatcaggcactggccggaagtctcgtgtccagcacctgcggtgtgtgtggaaagcacgtccaccttgtgcagaggcatctcgccgacggccgtctctaccaccgtagctgtttccgctgcaaacagtgcagctgcacgctacatagtggggcctataaagccaccggtgaaccaggtacctttgtctgtacttctcacctgcccgctgcagcaagtgcttcccccaagctcactggattagtgccccggcaaccaggtgctatgggcgtcgattctcgaacatcgtgctcgccacaaaaggcccaggaggcgaataaagctcgccccagcgcatgggaacctgccgccgggaacagtcctgccagggcatccgtcccagcagctccgaatcccgcagcgaccagcgcgacaagcgtgcacgttagaagcccagcccggcccagtgagtcgaggctggcgccgaccccaaccgagggaaaagtccggcccagggtgaccaattcgtctcctatgggctggtcaagtgccgccccgtgtaccgctgccgccgcctcacacccagctgtgccaccatccgcccctgacccccgacccgccacccctcagggcggcggtgccccgcgggtagctgcaccccagaccaccctctcaagtagcagtacaagtgccgctaccgtggacccaccagcatggacacccagtgcaagccgcacccaacaagcccggaataagttcttccaaaccagcgcggtacctcccggtacctccctgtctggacgcgggcctacaccttctctggtgctgtccaaggatagtagtaaagagcaggcaaggaatttcctcaaacaggcgctcagcgcactggaagaagccggagcgcctgctcctgggcgccccagtccagccaccgccgccgtgccctcttcccagcctaagactgaggcaccacaggccagtcctctcgccaagcctcttcaatcatcctctccacgtgtattaggcttgcctagcaggatggagccccccgcaccactgtccacatcctctacctctcaggccagtgcacttcctccggccggcaggcgtaacttggctgagtcaagtggagtagggcgggtcggcgctggatccaggcctaagcccgaagccccaatggccaaggggaagagtactactctaacacaggacatgagcacctctttgcaggaaggtcaggaagatgggccggccggatggagagccaatctcaagcctgtcgacaggagatccccagctgaacggacactgaagcctaaagagcctcgggctctcgcggagccccgggccggggaggccccgagaaaggtgtcgggcagttttgcagggtcagtccacattacactgacacccgtaaggcccgatcgcactcctcgccctgctagcccgggcccctccctgcctgcgaggagcccttctccgccaagaaggcgccggctggcggtgcctgcgtccttagacgtgtgcgacaactggctgcgtccagagcctccaggacaggaggccagggtgcagagctggaaggaagaagaaaaaaaaccacaccttcaggggaagccaggccggcctctgtctcctgccaacgtcccggctctgccgggcgagactgttacctcccctgtgaggctccatccagactatctatctccggaagaaatccagcgccagctgcaagacattgagaggcggctggacgctctcgaactgcgcggcgtggaactggaaaagcggctccgtgcagccgagggtgatgatgcagaagattctctgatggttgattggttctggctcatccatgagaaacagttgctcctccgccaggagagcgaactgatgtacaagtctaaggcccagcggctggaggagcagcaactagacattgaaggagaactgagaagacttatggcgaagccagaagccctcaagagcctgcaagaaaggcgaagggaacaggagcttctggagcaatacgttagtacggttaatgaccgctctgacatcgtagacagcctcgacgaggaccgcttgcgggaacaggaggaggatcagatgctgcgggacatgatagaaaagcttggactccagcgcaagaagtccaagtttcggctgagtaaaatttggagccctaagtccaaatcatcgcccagccagtag

SEQ ID NO: 43734 - DNA, 2079 bp, Artificial Sequence
  Description of Artificial Sequence: Synthetic coding sequence
atggccgccatccgggccctgcagcagtggtgccggcagcagtgcgaaggatacagggacgtcaatatatgcaacatgacaacccatttacctgcagccgctagcgcttcaccgaaattgactggactggtgccacggcaacctggggccatgggcgttgacagtcggacatcctgcagtcctcaaaaagcacaagaggcaaataaggccaggcccagtgcctgggaacctgccgcaggcaattcccccgccagggcaagcgtaccggcagcgcctaatccagctgctacctccgcaacatcagttcatgtcagaagcccagcccgtccttccgagtctagactggcccccacacctactgagggtaaggtgcgaccaagagtgacgaactcctcaccaatgggatggtcctctgctgctccatgcactgccgctgctgctagccaccccgcggtgccacccagcgctcccgacccaagacccgcaactccccagggtggaggagccccacgcgtggctgccccccagacaacgctgtcatcatcatctacctctgctgcgacagtggatcctcccgcttggacacccagtgcctctcgcacacagcaggcccgcaacaaattcttccaaacttccgcagtcccccccggcacatcgctctccgggcgcgggccgactccgtcgcttgtgttaagcaaagacagttcgaaggaacaagccagaaacttcctaaagcaggccctgtcagccctcgaggaggccggcgcacccgcccccggtaggcccagcccagccactgctgccgtaccgtcgtctcagcctaaaactgaagcccctcaggctagcccattagccaagcctctccagtcctccagtccgagggtactgggcttgccttcccgaatggagcctcctgcgcctctgagcacttcttccacttctcaagcgtctgctttgccacccgctggccgccggaaccttgctgaatcctcgggagttggtcgcgtgggcgcaggaagccgtccaaaacctgaggccccgatggctaagggtaagagcacgacactgactcaggatatgtctacatccttgcaggaaggccaggaggacggcccggctggttggcgtgccaatctgaagccggtcgatcggcgttccccagctgaacgcaccctcaagccaaaagaaccgagagccttagccgaaccccgggctggagaggcaccccggaaagttagcggcagcttcgctgggagtgtgcacatcactttgacgcctgtgcgacctgatcgaactccacgcccagccagtcccggcccatctctgccggctcgaagcccgagccccccccgccgtcggagactagccgttccagcttcactcgacgtgtgtgataactggctgagaccagaacccccaggacaggaggcaagagttcagtcctggaaagaggaggaaaagaagccacacttacagggcaaaccagggcggcctttatcaccggccaacgtgcccgctctccccggcgagacagtgacaagtccagtgagactccaccccgattacttgagccccgaagaaatccagcgtcagctacaggacatcgagcgccgtctggatgctcttgaactgagaggtgtggaactggagaaaaggctgcgggccgcagagggggacgatgccgaagactctctgatggttgactggttctggctgattcacgaaaagcagctactgctgagacaagaatcagagctgatgtacaaaagtaaagcccaacgcctggaggagcaacaactggacattgaaggagagttgagaaggctgatggctaagccggaagccctgaagtcacttcaggagcggagaagagagcaggaactgctagagcagtatgtgtccaccgttaacgataggagcgacattgtggattccctggacgaggacaggctgcgggagcaggaggaagatcagatgctgagggacatgatagaaaaactaggattgcagcgaaagaaaagcaagtttcgcctgtccaagatatggtcccctaaatcgaagagctcccctagccagtag

SEQ ID NO: 43735 - DNA, 1230 bp, Artificial Sequence
  Description of Artificial Sequence: Synthetic coding sequence
atggaccggctgaagagccacctgaccgtgtgcttcctgcccagcgtgccttttctaatccttgtatctaccttggccacggccaagtccgttacaaactcaaccttgaatggcacaaatgtggttttgggcagtgtgcccgtcataatcgcaaggactgatcacatcattgttaaggagggtaatagcgcacttatcaattgcagcgtgtatggcattcccgatccccagtttaaatggtataacagtatcgggaaactcctgaaggaggaggaagatgaaaaggagcggggcgggggcaagtggcagatgcatgacagcggcctgctgaatatcactaaagtttccttctcagacaggggtaagtacacctgcgtggcatcgaacatctacggaactgtgaacaacaccgtgactctgcgggttatctttacttccggcgacatgggcgtttactacatggtggtgtgcttggtggcttttacaattgtaatggttcttaacataacacggctgtgtatgatgtcaagccacctcaaaaagactgaaaaagctattaacgaattctttcggacagagggagccgaaaaattgcagaaagcattcgagatcgcgaagagaattcccatcatcacttctgcaaagacactcgagctcgccaaggtgacccaattcaaaacaatggagttcgctcggtacatagaggaactggcaaggtccgttcctctcccaccattgattatgaactgccgtacaataatggaagagattatggaggtcgtgggcctcgaggaacaagggcaaaactttgtcaggcacacccctgaagggcaggaggcggccgatcgggatgaggtctatacaattcccaacagtctgaagagaagtgactctccagcggctgactccgacgcgtcatctctccatgaacagccacaacagatcgccataaaagtgtctgtgcaccctcagtctaaaaaagagcatgcagacgaccaagagggtggccagtttgaggtgaaagatgtagaggaaacagagctgtctgctgaacattcacctgaaaccgcagagccaagcaccgatgttacctcaaccgagttgacaagtgaagaaccaactccagtggaagtccctgacaaagtactccccccagcgtatctcgaagccacagagcccgccgtaacccatgacaaaaacacgtgcattatatacgagtcacacgtgtag

SEQ ID NO: 43736 - DNA, 921 bp, Artificial Sequence
  Description of Artificial Sequence: Synthetic coding sequence
atgcacgacagcggcctgctgaacatcaccaaggtgagcttcagcgaccgcggtaaatacacttgcgttgcctccaacatctatggcaccgtgaataataccgtgaccctgcgcgtcatcttcacttccggagatatgggggtgtactatatggtcgtttgtctagtcgcattcacgatcgtaatggttctgaacatcacacggctgtgcatgatgagctctcacttgaaaaagaccgagaaagccattaatgaattcttccggaccgagggtgccgagaaactacagaaggcatttgagatagctaagaggatcccgatcatcacatccgctaagaccctggaactggcgaaggtcacacagttcaagaccatggagttcgcacggtacatcgaagagctcgcccgctccgtccctctgcctccacttatcatgaattgcaggacaatcatggaagaaattatggaagtcgtggggctcgaggagcaaggacagaacttcgtaaggcatactccagaaggccaggaagccgccgatcgtgacgaggtgtacacaatcccaaacagcctgaagagaagtgatagtccagccgccgatagcgatgcgtcgagtctgcacgagcaaccccaacaaattgctatcaaagtgtccgtgcacccacagagcaaaaaggagcacgctgacgatcaggagggaggacagttcgaggtcaaggacgttgaagagacagagctgtccgctgaacactcacccgaaaccgcggaaccctctaccgatgtgacttctactgaacttaccagcgaggagcctacgccggtcgaggttccggacaaagtgttacccccagcgtatttagaagctactgagcccgcagtcacacacgataaaaatacttgtattatatatgaaagtcacgtttag

SEQ ID NO: 43737 - DNA, 195 bp, Artificial Sequence
  Description of Artificial Sequence: Synthetic coding sequence
atgcacgacagcggcctgctgaacatcaccaaggtgagcttcagcgatcgagggaagtatacctgtgtggcatctaatatatatggcactgtgaataatacagtcacgctccgagtgatcttcactagcggagatatgggagtgtattacatggtggtctgtctagtcgcatttacaattgtcatggtgctgtag

SEQ ID NO: 43738 - DNA, 297 bp, Artificial Sequence
  Description of Artificial Sequence: Synthetic coding sequence
atggaccggctgaagagccacctgaccgtgtgcttcctgcccagcgtgccttttttgatattagtcagcacactggccaccgctaagtcagtaacaaacagcaccctgaacggcaccaatgtggtcctgggaagcgttcccgtgatcatcgctcggaccgatcacataatcgtaaaggaaggtaattcagccctgattaattgctcagtgtacggcatcccagacccacaattcaagtggtataattccattggaaaactcctcaaggaagaagaagatgaaaaggagcggggatag

SEQ ID NO: 43739 - DNA, 273 bp, Artificial Sequence
  Description of Artificial Sequence: Synthetic coding sequence
atggaccggctgaagagccacctgaccgtgtgcttcctgcccagcgtgccattcctgatcctcgtgtctacgctagccactgctaaaagcgttacgaacagcacattgaatggaaccaatgtggtccttggctccgttccagtgattatagcacggaccgatcacattatcgtgaaagagggcaactccgctcttattaactgtagtgtatacgggatcccggatcctcagttcaaatggtataacagtatcgggaaactcctgaaagaatag

SEQ ID NO: 43740 - DNA, 222 bp, Artificial Sequence
  Description of Artificial Sequence: Synthetic coding sequence
atggaccggctgaagagccacctgaccgtgtgcttcctgcccagcgtcccctttctcattcttgtgtctaccctggccaccgctaagagcgtgactaacagcacactgaacggtaccaatgtcgtgcttggctctgtccctgtaattattgcgaggacagaccacataatcgtgaaggaagggaactccgcattaattaattgctctgtatacggaatctag

SEQ ID NO: 43741 - DNA, 474 bp, Artificial Sequence
  Description of Artificial Sequence: Synthetic coding sequence
atgcacgacagcggcctgctgaacatcaccaaggtgagcttcagcgaccggggaaagtacacctgcgtcgcatccaacatctacgggactgttaataacacagtgaccctgcgtgtgatcttcacgtccggcgacatgggggtgtattatatggtggtgtgtcttgtagcttttaccatcgtcatggtcctaaatatcaccagactttgtatgatgagctcgcacctgaagaagacagagaaagctatcaatgagtttttccgaaccgagggagctgagaagctccagaaggcatttgaaatagccaagcggattccaattattacaagtgcaaaaacactggaactggccaaggtgacgcagtttaagacaatggaatttgcccggtacattgaggagctagcaagaagcgtgccactgcctcccctgatcatgaactgtcgaacaataatggaagagatcatggaagtgtag

SEQ ID NO: 43742 - DNA, 366 bp, Artificial Sequence
  Description of Artificial Sequence: Synthetic coding sequence
atgcccagcgaccggcccttcaagcagcggcggagcttcgccgacagatgtaaggaagtccaacagattagagatcagcatcccagcaagatcccggtaattatcgagcgatataaaggagaaaaacagctacctgtactggacaagactaaattcctggtccctgaccatgttaacatgagtgaactggttaaaataatccgcaggcggctgcagctaaaccctactcaggcattctttctcctggttaaccagcattctatggtctcggtgagcacccccatcgccgatatatatgaacaggaaaaggacgaagatggctttctgtatatggtatacgcatctcaggagaccttcggattctag

SEQ ID NO: 43743 - DNA, 366 bp, Artificial Sequence
  Description of Artificial Sequence: Synthetic coding sequence
atgcccagcgaccggcccttcaagcagcggcggagcttcgccgacaggtgcaaagaggtgcagcagataagagaccagcaccccagcaagatccctgttattatcgagaggtataaaggggaaaaacaactgcccgttttggataaaactaaatttctggtaccagatcatgtgaatatgtctgaacttgtgaagatcatcagaagacggctccagctgaatcctactcaggcattcttcctgctggtcaaccaacactctatggtgagtgtgagcacccccatcgctgacatctacgagcaggaaaaggatgaagacgggtttctctacatggtctatgctagtcaagaaacctttggattttag

SEQ ID NO: 43744 - DNA, 378 bp, Artificial Sequence
  Description of Artificial Sequence: Synthetic coding sequence
atgaagatgcggttcttcagcagcccctgcggcaaggccgccgtggaccccgctgaccgctgtaaagaagtccagcagattagagatcaacatcctagcaagatccccgtgatcatcgagaggtacaagggggaaaagcagctgcctgtgttggacaaaaccaaattcttggtccctgaccatgtgaacatgagcgagctggttaagataattaggagacgtctgcagctgaatcccacacaagctttcttcctgctcgtgaaccagcactcgatggtcagcgtcagcactcccatcgctgatatctacgagcaggaaaaggacgaggacgggtttctttatatggtctatgcatcccaggagacctttggcttttag

SEQ ID NO: 43745 - DNA, 378 bp, Artificial Sequence
  Description of Artificial Sequence: Synthetic coding sequence
atgcccagcgagaagaccttcaagcagcggcggaccttcgagcagcgggtggaagatgtgagactgattcgtgaacagcatccaactaaaataccggtgattatcgagcgctacaagggggagaagcagctgcccgtgttggataagaccaaatttttggtcccagaccatgtgaacatgtccgagctcatcaaaataatcaggaggcgactccagctgaatgccaaccaggccttttttctgctggtaaatggccactccatggtcagcgttagcacacccatcagcgaagtgtacgaatcagaaaaggatgaagacgggttcctgtatatggtttacgcctctcaggaaacctttggtatgaaattaagtgtatag

SEQ ID NO: 43746 - DNA, 201 bp, Artificial Sequence
  Description of Artificial Sequence: Synthetic coding sequence
atgagcgagctgatcaagatcatccggcggcggctgcagctgaacgcgaatcaagcattcttcttgctggtcaatggacactccatggtttcagttagcactccaatatctgaagtgtatgagtccgaaaaggacgaggacggatttttatacatggtttacgcgtcgcaggaaaccttcgggatgaaactgagcgtgtag

SEQ ID NO: 43747 - DNA, 444 bp, Artificial Sequence
  Description of Artificial Sequence: Synthetic coding sequence
atgccccccccccagaagatccccagcgtgcggcccttcaagcagaggaaaagtttagctatacgccaagaggaagtggccggtattcgcgcgaaatttcccaataagatacccgtcgtcgtcgagagatatccccgggaaactttcctgcctcctctggataagacaaagtttcttgtgcctcaggaactaactatgacgcagttcttaagtatcatcagatccagaatggttctcagagcaaccgaggccttctacttattggtcaataataaatcattggtgagtatgagcgcaacaatggcggagatatatagggattataaggacgaggacgggttcgtctacatgacgtatgcttcccaagagacattcggctgtcttgagagtgcagcaccacgggatggcagttctcttgaggacaggccatgcaatccgctttag

SEQ ID NO: 43748 - DNA, 1968 bp, Artificial Sequence
  Description of Artificial Sequence: Synthetic coding sequence
atggccgagctgggcgccggcggcgacggccaccggggcggcgacggcgccgtccggagtgaaaccgcacccgatagctacaaagtgcaggacaagaagaacgcttcatcccggccagcgtctgccatttccggacagaacaataaccatagcgggaataaaccagatccccctccagtacttagagtagatgatcgacagcgacttgcacgggaaagaagggaggagcgggagaaacaattggatcccgaccgacgctcagttagtactatgaatctgagtaagtacgttgacccagtgatctctaagcgcttaagtagctcttctgccacactgttgaacagccctgaccgagcccgcaggttgcaactatccccgtgggaaagttccgtagtgaatagacttttgaccccgactcactcttttctggccaggtcaaaatctacggccgctctctctggtgaggcagcctcttgctcccctattatcatgccctataaggctgctcattcccgcaactcgatggatagacccaaactgttcgtaacacctccagaaggtagcagcaggcggcggatcattcacggaactgctagctacaagaaggagcgggagagagaaaatgtcctgtttcttactagcggcactcgacgggctgtgtccccgagcaacccaaaagcccgacagcccgctcgaagcaggctgtggctgccgagtaagagtctgccacaccttccggggactcctagacccacgtcatcactgcccccaggttccgtcaaggcggctccagctcaagtcaggccaccctcacctggaaacatccgtccggtgaagcgggaggtcaaagtcgagcccgagaaaaaagatccagaaaaggagccccagaaggtcgccaatgagccatcactcaaggggagagccccgctagtcaaggtggaagaggccaccgttgaagagaggacacctgcagagcctgaggtgggacccgccgctccagccatggcacctgcacctgcctcagctccagctcccgcttctgctcctgctccggctccagtgcccacacctgccatggtcagcgccccaagcagcacagtcaacgcctcagcctccgtgaagactagcgcaggcacaaccgatcccgaggaggctaccaggctgctggccgaaaagcgcaggctcgctcgcgaacagagggagaaggaggaaagagagagacgtgaacaggaggagctggagcgccagaagcgagaggagctggcccagcgcgtggccgaggagcgcaccaccaggagagaggaagaaagtaggagactggaggccgagcaagcccgggagaaggaggagcagttgcaacgacaagccgaggagcgcgcgcttcgggagagggaggaagctgagcgagcccagagacagaaagaggaagaggccagagtccgcgaggaggccgaaagagtgaggcaggagcgcgagaagcactttcaaagggaagagcaagagcgcctcgagcgtaagaagcgattagaagagatcatgaagcggactcggaggacagaggcgaccgacaagaaaacttctgatcagcggaatggggatatcgctaaaggggcgctcactggaggaaccgaggtttccgctttgccatgtaccaccaacgccccaggtaacggcaaaccagtcggatcaccacatgtggtcacatcacatcaatctaaggtgacagtagagtctactcccgacttggaaaaacagccaaatgagaacggtgtgtctgtccagaacgagaatttcgaggaaattatcaatctgcccataggctccaaaccctcacggctggacgtcacaaatagcgaatcccccgagattccacttaatccaattttagcgttcgatgacgaaggcacattaggccccctgccacaagtcgacggcgtccagacccaacagacggccgtggtgatctag

SEQ ID NO: 43749 - DNA, 2250 bp, Artificial Sequence
  Description of Artificial Sequence: Synthetic coding sequence
atggccgagctgggcgccggcggcgacggccaccggggcggcgacggagccgtcaggagtgaaacggctcccgactcctataaagtgcaggataagaagaacgcatcaagtcggccagcctctgctattagtggacagaacaataaccactcaggaaacaaacccgaccctcctccagttctgcgcgtcgatgaccgacaaagactggccagagagcgacgggaagagcgggagaagcagctggcggcccgagagatcgtgtggctggaacgggaggagcgtgccagacagcactacgagaagcatctggaggagcgaaaaaaaaggctggaggagcagcggcagaaggaagagaggcggcgcgccgcagtggaggagaaacggcgccagcgcctggaggaagacaaagagcgccacgaagcagtcgtgcgccgaactatggagcgatcacagaaacctaagcaaaaacacaataggtggtcttggggaggcagcttgcacgggtctccaagtatccattccgccgatcctgaccgcaggtccgtgtccaccatgaacctgtccaagtatgtcgatccagtgatttccaaacggctcagcagctcctcagccaccctgctgaactcacctgaccgcgccagaaggctccagctgagcccttgggagtctagcgtggtgaaccgtctcctgactccgactcacagcttcctggctcgctccaagagcaccgccgcactgtctggggaagcagcctcatgtagccctattattatgccttataaggctgcacactcacgcaacagtatggacaggcctaagctcttcgtgacgcccccagaggggtcatcacgccgcagaatcatccacggcacagcaagctataagaaagaaagggagcgagaaaacgtcctctttctcacatctgggacaagaagggccgtttccccctcgaatccgaaggcccgtcagccagcccggtcacggctgtggctgccctcaaaatcattgccccatctgccaggcacgccgcgcccaacgagcagcctgccacccggctctgtgaaagccgcgcccgcacaggtgcggcccccctcacccgggaatattcgcccagtaaagagggaggtgaaggtggagcccgaaaaaaaagaccctgagaaggaaccccaaaaggtggccaatgagccctccctgaagggccgcgccccgctggtcaaagtggaggaggcaacagtcgaggagaggactcctgctgagcccgaagtcgggccagccgctcctgccatggcccccgcccctgctagcgcacccgcaccggccagcgcccctgccccagcccccgtccctacccccgccatggtgtccgcgccctcgtccacagtgaacgctagtgcatccgtgaagacctcagcagggacaactgatccagaagaggctaccagactgttggccgagaaacgcaggctcgctcgggaacagcgcgagaaagaagaaagagaaaggcgcgaacaggaggaactcgaacgacagaaacgcgaggagcttgcccagagggtcgccgaagagcggactacgagacgggaggaagaaagccggcgtctcgaagctgaacaagctcgcgaaaaagaggaacagctccagcgccaggccgaggagcgggctttaagggagcgcgaggaagcagaacgcgcacagcgccagaaagaagaggaagcgcgcgttagagaagaggccgagagagtgcggcaggagcgggagaagcatttccaacgtgaggaacaggagcgcttggagaggaaaaagagactggaagaaatcatgaagcgtaccaggcggactgaagcaactgataagaagacttcagaccaaaggaatggcgatatcgctaagggggcacttacggggggcaccgaagtatccgcgctgccttgtacaacaaacgctccaggcaacggcaaacctgtaggttctccacacgtggtcacttcccaccagagcaaggtaaccgtggagagcaccccagatctggaaaagcagcctaatgaaaacggagtttctgtacagaacgaaaatttcgaagagattataaatctgccgattggctcaaaaccctcccgtctggacgtgacaaactctgaatcccccgagatacccctcaatcctatcctggcgttcgacgacgaaggaacccttggcccgctgcctcaagtcgacggagtccaaactcagcaaaccgccgaagtaatatag

SEQ ID NO: 43750 - DNA, 1812 bp, Artificial Sequence
  Description of Artificial Sequence: Synthetic coding sequence
atggagcggagccagaagcccaagcagaagcacaaccggtggagctgggggggctccctccacgggtctccctctatccattcagccgacccagatcggcgctcagtctccactatgaatttaagtaagtacgtcgatcctgttatctctaaaagacttagctccagttcagccaccctcctgaatagccctgatcgggcccgaagattacaactgagcccgtgggaatcaagcgtcgtcaacagacttctgaccccaactcactcgttccttgcacggtccaagtctacagccgcactctccggcgaggccgcgagctgtagccctatcatcatgccttataaagcagcccactcccggaattccatggaccggcccaagctctttgtaacccctccagaggggtcatctcgccgcagaataattcatgggaccgccagttataaaaaggaacgcgagcgcgagaatgtcctgtttttgacttctggcactagaagagccgtctccccttccaaccctaaggcaaggcagcccgcccgctcccgcctatggcttccgtccaaatcactccctcatcttcccggaacccctagacccacaagttctctgcctcctggcagcgtgaaggctgccccggcacaggttagacccccctctcccggaaacatcagacctgtgaaacgcgaggtgaaggtcgaacccgagaaaaaggatcccgagaaagagccccagaaggtggccaacgagccctctctcaagggccgggcaccgctcgttaaagtcgaggaggccaccgttgaggagcgcacacctgcagaacccgaagtgggacccgcagccccggccatggcaccagcacccgcctctgcgcctgcacctgctagcgcccccgcccccgcaccagttcctactcccgctatggtgtccgctccgagcagtactgtgaatgccagcgcaagcgtcaagaccagtgcaggaacgactgaccccgaagaagccacccgcctacttgccgagaagcgtaggctggcacgagaacagcgcgaaaaagaagaacgcgaacggcgagagcaggaggagttggagagacaaaaaagggaggagcttgcgcagcgagtagcagaagagcgtaccacaaggcgggaagaagaaagccggaggctagaagcagaacaggccagggagaaagaagaacagttgcaacgacaggccgaagaaagggccttgcgcgagagagaagaagccgagcgcgctcagcgacaaaaggaagaagaggcaagggttcgggaggaagccgaaagagtcagacaggagagggagaagcattttcaacgtgaggagcaagagcgcctcgagaggaagaagaggctggaggagatcatgaaacgaaccagaaggaccgaggctaccgacaagaagacctccgatcaaaggaatggggacatcgcaaagggtgctttgactggcggcacagaagtgagcgccctgccttgcactacaaacgccccaggaaatggtaagccggtaggtagtccccacgttgtgaccagtcaccagtcaaaagtgaccgtggaaagcaccccagacctggagaagcagcctaacgaaaacggagtgtctgtccaaaacgagaattttgaggaaatcatcaacctgcccattggaagcaaaccgtcccgcctcgacgtaacaaatagcgagtctcccgagattcccctgaaccctattcttgcgttcgacgacgaaggaacactcggaccccttccacaggtggatggtgttcagacccaacagacagccgaggtcatctag

SEQ ID NO: 43751 - DNA, 2205 bp, Artificial Sequence
  Description of Artificial Sequence: Synthetic coding sequence
atgcccggcagcgccaccgccctgcggcacgagcggctgaagaagactaatgctcgccctataccactgggcctgtttacaatcaacgaagaggacgaacagcagaaaaacggtaactcacgaaggccgaaggcacccgatagctacaaggtccaggacaaaaaaaacgcaagtagtcgacctgcatccgcaatctcaggccaaaataataaccactctggcaataaacccgatccgccacctgttctccgggtggacgatcgccaaagactcgcaagagagcggcgtgaagagcgggaaaaacagctggctgcgcgcgaaatagtgtggctggagagagaagaacgggccagacagcactacgagaagcacctcgaggagcgcaagaagaggctagaggaacagcggcaaaaggaggagcgtcgccgtgctgcagttgaggaaaagagaagacagcgactggaagaggacaaggaacgccacgaggccgtcgtgaggcgaactatggagcgatctcaaaagcccaaacagaagcacaatagatggtcctggggcggaagtcttcatggcagccccagcatacattcagctgcgcgtcgcttgcagctgagcccctgggaaagctccgtggttaatagactgctgactccaacccacagcttcctagccagatccaaatctaccgccgcccttagcggggaggcagcctcgtgttcccccatcatcatgccgtacaaagctgcacactcccgcaattctatggataggcccaaactctttgtgacaccccccgagggaagctcaagaagacggatcattcatggaactgcatcgtacaagaaggagcgggaacgtgaaaatgttctatttctgaccagtggcactcggcgagcggtgtctccatcaaatcccaaagccaggcagccagcccgtagtagactctggctaccgtcgaagtccctgccccatctgcctgggactccccggcctacctcatcactgccacccgggtccgtgaaagccgcccctgcccaagtgcgccccccttcacctggtaatatccggccagtcaagcgggaggtgaaggtggagcctgaaaagaaagatcctgagaaggagccccagaaagttgcaaatgagcccagcctcaaggggcgcgcccctctcgttaaggtcgaagaagccaccgtagaggagcgcaccccagccgaacctgaggtcggccctgctgctcccgccatggcacccgccccagccagcgcacccgccccagctagcgccccagcaccggcccctgtacccaccccggccatggtttctgccccaagcagcactgtgaacgcttcggccagcgtaaaaacgagcgccggcactactgatccagaggaggctacacgcctccttgccgagaagcgacgtttggctcgagaacagagggagaaggaagagcgagaaagaagagagcaagaagagctggagcggcaaaagcgggaagagctggcgcaacgtgtcgctgaggagaggacaacccgccgggaagaggagtccagaagactggaggccgaacaggcccgggaaaaagaggaacagctccagcggcaggcggaagaaagagcattgcgcgagcgagaggaggcggagcgcgcacagaggcagaaggaggaggaggccagggtgcgagaagaagctgagcgggtgcgacaggagcgtgaaaagcactttcaacgggaagaacaggaacgactggagagaaagaagcggctggaggagatcatgaaaaggacacgcagaaccgaggcaacagataagaagacatccgatcagcgcaacggagacatcgccaagggcgcattgactggaggcaccgaagtttctgccctgccttgcacgaccaatgctcccggaaatggtaagcccgtgggctcaccccacgtggttactagccatcaaagcaaggtgacagtggaatcaacgccggatctggaaaaacagccgaatgagaatggcgtgtcggttcagaacgagaatttcgaggaaatcattaacctgccgattggttctaaaccatccagactagatgttaccaattcggagagcccggaaattccgctgaatccaattctcgcgttcgatgatgaaggaaccctgggcccacttcctcaggtcgatggagttcagacccagcagactgcggaagtcatctag

SEQ ID NO: 43752 - DNA, 2316 bp, Artificial Sequence
  Description of Artificial Sequence: Synthetic coding sequence
atgcccggcagcgccaccgccctgcggcacgagcggctgaagaagacgaatgcaagaccgatccccctgggcctgtttaccatcaatgaggaggatgagcaacagaaaaatgggaacagccggcgccccaaggcccccgatagctacaaggtgcaagataagaaaaatgcttcttcccgacccgcaagtgcaattagtggtcagaacaacaatcatagcgggaacaagcccgatcctccaccggtactgagggtagatgacaggcagcgattagcgagagaaagaagggaggaacgggaaaaacagttggccgcacgcgagattgtatggctggagagagaggagcgagcaaggcagcattacgagaaacaccttgaagagcgcaaaaagcgattagaagagcagcgtcagaaagaggagcgccgacgggccgctgtggaagaaaaacggcgccagcgtctcgaggaagataaggaaaggcacgaggccgtggtgcgacgcaccatggagcggtcccagaagcctaagcagaaacataatagatggtcatgggggggctctctccacggtagcccttccattcactctgcagatccagatcgcagatctgtgtctaccatgaacctgtccaagtacgtggatccagtgatctctaaaagattaagctcttccagtgcgaccctactcaactccccagaccgggctcggaggctgcaactttccccctgggaatctagtgttgtcaacaggctgctaaccccaacccactctttcctcgcccggtcgaagtccacagcagccctgtccggggaggccgcatcttgttcacccattattatgccctacaaggccgctcactcaagaaactccatggaccggcctaaattgtttgtgacaccacctgaggggtcgtcacgtagacggataattcacggaacggcatcctacaaaaaagaacgagagcgggaaaacgtcctgttcttgacgtctggaactcggcgggccgtcagcccgagcaatccaaaggctcgccaacccgcccggagtcgcctttggctcccttctaagtctctgccccacctgcccggaacccctcgacctactagcagtctgccacctggatccgtgaaggccgcccccgcccaggtgagacccccctccccaggcaacatcaggcctgtgaaaagggaagtcaaggttgaacccgaaaagaaagatcccgagaaagagccccagaaggtggcaaacgagccaagcctaaaggggcgggctccattggtgaaagttgaggaagccacagtggaggagcgtactcccgctgaaccagaagtcggcccggctgcccctgctatggccccggctcccgcttcagcccctgcaccagcctcagcccccgcacccgcccctgtgcctaccccagcgatggtctctgctccctcctccaccgtaaacgcatctgcgtctgtcaaaacatctgccggtacaaccgatcctgaggaggcgacacggctgctggcagaaaaaaggaggctagcccgagagcagagagaaaaggaagagagggagcgacgcgagcaggaggagttggagcggcaaaagcgcgaggagctggctcagcgggtcgctgaagagcgtactacaaggcgggaagaggagagcaggcgactggaggccgaacaggcaagagagaaggaagagcaattgcagagacaggccgaagagcgcgctttgagagaaagggaggaggcagagagagcccagcggcaaaaggaggaagaagcgagagtacgcgaggaggccgaacgtgtgcgccaggaaagagagaagcacttccaacgagaggagcaggagagactggagagaaagaaaaggcttgaggagataatgaagaggactcggcgaactgaagccacagataagaaaacatcagatcagaggaatggcgacatcgcaaaaggtgccctcaccggaggtacagaggtatccgcacttccttgcactacaaacgcaccgggcaatggcaaacccgtgggatcaccacacgtggtcacatcacatcagagcaaggtgaccgttgagagcacccccgacctggaaaagcaaccaaacgaaaatggagtgtccgtgcaaaatgaaaatttcgaggagattatcaatctgcccatcggcagcaagccttcaagactggacgttactaattcagagagccctgagatccctctgaatcccatactcgcattcgacgatgaaggcacactcggtccactccctcaagtggatggagtgcagacgcagcagacggcagaggttatctag

SEQ ID NO: 43753 - DNA, 2205 bp, Artificial Sequence
  Description of Artificial Sequence: Synthetic coding sequence
atggaggacaccaagctgtacagccccgacagctacaaggtgcaggataaaaaaaatgcatcatctcgccccgcttctgccatcagtggccagaacaataatcactccggtaacaagcccgatcccccccccgtgttgcgggtagatgatcgccagaggctggcacgtgaaaggcgcgaagagcgggaaaaacagcttgcagctcgcgagatagtttggctagaacgtgaggagcgggcacgccaacactacgagaagcatctggaggaacgcaagaagaggctcgaggagcagagacaaaaggaagagaggaggcgagccgctgtcgaagaaaagcgtcgtcaaaggctcgaggaagataaagagaggcacgaggcagtggtgcgccggacgatggaaagatcgcagaaaccgaagcagaaacacaaccgatggtcctggggaggaagtctgcatggatccccctcaatccacagcgccgacccggacaggcgctccgtgtccacaatgaatctgtccaaatacgtggaccccgtaatttccaagaggctctcatcgtcaagcgcaactttgctgaacagcccagaccgcgctcgcaggctgcagctaagcccatgggagagtagtgtagtaaatcgccttctgacaccaacccatagtttcctcgcccggtccaaaagtacagctgcgcttagcggcgaagccgcgtcctgctcccctatcatcatgccttataaagccgcacatagtcgtaactccatggatcgtccaaaactcttcgtgacacccccagagggcagctctcggcggcggatcatccacgggactgccagttacaagaaagaacgagagcgggagaatgtcctgttcttgacatctggcaccaggcgcgccgtctcaccaagcaatcccaaggccaggcagcccgctcgaagtcgactttggcttccttccaaaagcctacctcatctgcctgggactcctaggccaacaagctcactccctcctggatccgtcaaagccgctccagcccaagtgcggccgcccagtcctggaaacatccgaccagtgaagcgggaggttaaggtcgaacccgagaagaaggaccctgaaaaagagcctcaaaaggtggcaaacgagccgtctctgaagggtcgagctcctctagtgaaggttgaagaagcaacagtggaggaacgtacaccagctgaacccgaggtggggcctgctgcccctgcgatggctcctgcccccgcatccgcccccgccccagcttctgccccagcgcctgcacccgtacctactcccgcaatggtttccgcaccaagttcaaccgtgaatgctagcgcctccgtcaaaacctctgcaggcaccacggacccagaagaagccacacgcttgctcgcagaaaagcggaggcttgcgagagaacagcgtgaaaaagaagagagggaacgccgcgagcaggaggagttggagcgtcagaagagagaagagcttgcacagcgggtcgcagaagaacggactacacggcgggaagaagaaagccgccggcttgaggcggaacaggcccgcgagaaagaagagcagcttcaacgtcaagcggaggaaagggccctcagggagcgcgaggaagccgagagagcccagcgtcagaaagaagaagaagcgagagtgcgcgaggaagccgagagggtccgacaggaaagggaaaagcattttcaaagggaagagcaggagagattggagaggaagaaaaggttggaggaaattatgaagcggacgagacgcactgaagccacagataaaaagacatccgaccagcggaacggcgacattgccaaaggagcccttaccggcggaactgaagtgagtgcattaccttgtacgacaaacgctcctggtaatgggaaacccgtggggagcccacacgtcgtgacctcccaccaaagcaaggtgaccgtagagtctacccctgatctggaaaagcagcctaatgagaacggggtgagcgtacaaaatgagaactttgaagaaatcataaacctcccgattggatcaaaaccatcacgcctcgacgtaactaattccgagagccccgaaattcctttgaacccaattctggcatttgatgatgaagggacgttgggaccattgcctcaggtggatggggtgcagacacaacagacggctgaagtaatctag

SEQ ID NO: 43754 - DNA, 3021 bp, Artificial Sequence
  Description of Artificial Sequence: Synthetic coding sequence
atgagcaacagccggaacaaccgggtgatggtggagggcgtgggcgcccgggtcgtgaggggaccggattggaaatgggggaaacaggacggcggcgaaggacatgtcggaactgtcaggagcttcgaaagtcccgaagaggtagtcgtggtgtgggataatgggaccgccgccaactaccgatgttcaggggcctacgacctgcgcatcctggactccgcaccaacaggcattaagcacgatggtaccatgtgcgatacttgcaggcaacaacccatcattggcatccgttggaagtgcgccgaatgtaccaattatgatctctgcaccgtctgctaccatggggacaagcatcacctccgacatcgcttttatcggattacaacacccggctctgagcgcgttctgctggaatcccggagaaagtcaaaaaagataacggcccgcgggatcttcgctggagcccgagtggtgcggggcgtagactggcagtgggaggatcaagacggggggaacggccgacgcggcaaagttaccgaaatccaggattggagtgcatcttcaccacacagtgccgcctatgtgctgtgggataacggcgccaagaatctctacagagtcgggttcgaaggtatgtctgatctgaagtgcgttcaggatgcaaagggtggcagcttttacagagaccattgtcccgtgctcggagagcagaacggcaacaggaatccagggggactccagatcggcgatctggtgaacatcgatcttgatttggaaattgtgcaatctctgcaacacggccacggcggctggactgacggaatgttcgaaactctgacaaccacaggaacggtctgtggaatcgatgaggaccacgacatcgtggtgcagtatccttccggcaatcgatggacatttaaccccgccgttttaaccaaggccaatattgtccgaagcggtgacgcagcgcagggcgccgaaggcgggacaagccagtttcaggttggcgaccttgtccaggtatgttatgaccttgagcggatcaaattactccagcgcggccacggcgaatgggccgaagccatgcttccaactctcggcaaagtaggtcgggtgcagcaaatctatagcgattccgatcttaaagtggaggtctgcggcactagctggacttataaccccgctgccgtgtccaaggttgcgtccgccggtagcgccataagcaacgctagcggcgagcgccttagccagctgttgaagaaactttttgagacacaggaatctggcgacttgaatgaggagctggtgaaggccgctgcaaatggcgatgtggcaaaggttgaggacctgcttaagagaccagatgtggatgtgaacggacaatgcgccggccacacggcgatgcaggccgcttcacagaatgggcacgttgacatcttgaaactgttgctgaagcagaacgtcgatgtcgaagctgaggataaagacggggaccgggcagtgcatcatgctgcttttggcgatgagggtgccgtgatagaagtcctgcacagaggctctgcggacctgaacgcccgaaacaaaaggcgccagacacccctacacatcgcagtcaacaaagggcatctccaggttgtgaaaacccttttggatttcggatgccatccctccctgcaagatagcgagggagacaccccgttgcacgacgcaatctccaaaaagcgagacgacattttggcagtcctgttagaggccggggcagatgtgacaatcaccaacaacaacggcttcaacgccttgcaccacgcagctctccgcggaaatccatcagccatgcgagtactgctttccaaactaccgcgaccttggatcgttgatgagaagaaagatgacggctatacagccttacatctggctgcactgaataaccacgtggaagtggctgaacttttagtgcaccaggggaatgccaatctggacattcagaacgtaaaccaacaaacagccttgcacctcgcagttgagagacagcacacccaaattgtacgccttctagtgagggccggcgcaaagctcgacatacaggataaagatggggatacaccactgcatgaggctctcaggcatcatactttatcgcagctgcgccaactccaagatatgcaagatgtagggaaggttgacgccgcctgggagccttccaagaatacactgatcatgggtctgggaacacagggtgctgaaaagaagtctgctgcaagtatcgcctgctttctcgcagctaatggagccgatttgtcaattcggaacaaaaagggccaaagtcccctggatctgtgtcccgatccgaacctctgtaaagctctcgctaaatgtcacaaagaaaaagtctcggggcaggtgggcagccgatccccctccatgatttcaaacgacagcgaaacccttgaggagtgcatggtgtgcagtgatatgaagcgcgataccctatttgggccatgcggacacattgctacttgttccctgtgtagcccaagagtgaaaaaatgccttatatgcaaagagcaagtacaaagccgaaccaagatcgaggaatgtgttgtgtgcagtgataagaaggccgcagtgcttttccagccctgcggtcatatgtgtgcatgcgaaaactgcgctaacctgatgaaaaagtgtgtgcagtgccgggcagtagtagagcggagagtccccttcatcatgtgttgcggagggaaatcatcagaagacgccaccgacgacatctcttctggaaacatacccgtccttcagaaggataaagataatacaaacgtcaacgcggatgtgcaaaagttgcagcagcagctgcaggatattaaggagcaaacaatgtgccccgtttgtctggacaggcttaaaaacatgatcttcctctgtggccacgggacctgccagctgtgcggagatcgcatgtccgagtgccccatttgcagaaaggcaatagagagacggatcctcctgtactag

SEQ ID NO: 43755 - DNA, 750 bp, Artificial Sequence
  Description of Artificial Sequence: Synthetic coding sequence
atggccaagagcggcctgcggcaggacccccagagcaccgccgccgccaccgtcctcaaacgcgctgtcgagttggactctgaatccaggtaccctcaagcattagtgtgttaccaggaaggaatcgacctgctgctgcaggtcttgaagggcaccaaagacaataccaagcgttgcaaccttagggagaaaatcagtaaatatatggatcgggctgaaaacataaaaaagtatcttgatcaagaaaaggaggatgggaaataccacaagcaaataaaaatcgaggagaatgccacgggcttctcctacgagagcctttttagggagtatttgaacgagaccgtcactgaggtttggattgaggacccttacatccgacatacccatcagctctataatttccttaggttctgcgagatgctgatcaaacgtccctgcaaagtaaagactatacatctgctgactagcttagacgagggcatcgaacaggtgcagcagtcaagagggttgcaggagatagaggaatctctccgatcccatggcgtgcttctagaagtgcaatattctagtagcatccatgatagagagattcgcttcaacaatggctggatgattaaaatcggtcggggcttagattatttcaaaaagccacaatcaaggttctcgctgggttactgtgacttcgacctcaggccgtgccacgagacaaccgtggatatctttcacaaaaaacacaccaagaacatatag

SEQ ID NO: 43756 - DNA, 696 bp, Artificial Sequence
  Description of Artificial Sequence: Synthetic coding sequence
ctgaagcgggccgtggagctggacagcgagagccggtacccccaggccctcgtctgttatcaggaaggtattgatttgctgttgcaagtgctcaaggggactaaagacaacactaagagatgtaatctcagagaaaagatcagcaagtacatggacagggccgagaacatcaaaaagtatctggaccaggagaaggaggatgggaaatatcacaagcagatcaaaattgaggaaaacgccactgggttctcatatgagtccttatttagagaataccttaacgaaacggtgacagaggtgtggatcgaggatccctatatacggcacacacaccagctttataatttcctgcggttttgtgaaatgctgattaagagaccctgtaaagtgaagactattcacttgctaacgagcctggatgaaggaatcgagcaagtacagcagagcagaggattgcaggaaatcgaggaatccctgcggagccacggcgtcctcctcgaggtgcaatactcctcatcaatccatgacagggaaatccgctttaacaatgggtggatgataaagatcgggcgggggcttgattatttcaagaagccacaaagtcggtttagtctcggctattgcgattttgacctgaggccatgccatgaaaccacagttgacatttttcacaagaagcacaccaagaacatatag

SEQ ID NO: 43757 - DNA, 1431 bp, Artificial Sequence
  Description of Artificial Sequence: Synthetic coding sequence
atgttccggctgaacagcctgagcgccctggccgagctggccgtgggaagccgctggtatcacgggggttcccaacccattcagatacgtcggcgcctgatgatggtggcctttctcggggcctcagcggtcaccgcaagtactggattgctctggaagagggcccacgcagagtccccgccatgtgtggataacttgaagagcgacataggagacaagggaaagaataaagatgagggcgacgtgtgtaatcatgagaagaaaaccgcggacctcgcaccccatcccgaggaaaagaagaaaaagagatccgggtttagggataggaaagtgatggagtacgagaacaggatccgggcctactccactcccgacaaaatttttaggtacttcgctacactcaaggtgatcagtgaaccaggcgaggccgaagtctttatgaccccagaagactttgtcaggagtatcacacctaacgagaagcaacccgagcacctcgggctggaccaatatattatcaagcgctttgatggcaagaaaattagccaggagcgggagaaatttgcagacgagggatccatcttctatacactgggggagtgcggtctcatttccttttccgattacatcttcttaaccacagtgttgtccacgccacaaagaaatttcgagatagcattcaaaatgttcgacctgaacggagacggtgaggtcgatatggaagaattcgaacaggtgcagtcaataatacgcagtcaaacctctatgggcatgagacacagagaccggccgactactggcaataccctcaaatccgggctctgttccgccttaacaacgtacttcttcggcgccgacctgaagggaaagcttactattaaaaacttcctagaatttcagcgaaagttacaacatgacgttctgaaattggagtttgaacgccatgatcctgtggacggtcgaattacggagcgccaattcggcgggatgctgctggcgtactctggagtgcaaagtaagaagctgactgccatgcagcgacagctgaaaaagcacttcaaagagggtaaggggctaacctttcaggaggtggaaaatttttttacgtttctgaagaacatcaatgatgttgacacggccctgagtttttaccacatggctggtgcgtccctggacaaggtgacaatgcagcaggtggccagaacagtggcaaaggtcgaactcagtgatcatgtgtgtgacgtggtctttgccctatttgattgtgatgggaatggagagctctcaaacaaggaatttgtgtccataatgaagcagaggctcatgagagggctggaaaagcctaaggatatgggcttcacccgactgatgcaggccatgtggaagtgcgctcaagagacggcatgggacttcgcccttcctaagcagtag

SEQ ID NO: 43758 - DNA, 1437 bp, Artificial Sequence
  Description of Artificial Sequence: Synthetic coding sequence
atgttccggctgaacagcctgagcgccctggccgagctggccgtgggcagcagatggtatcatggtggttcacagcctatccagatccgaagacgcctgatgatggtggctttcctcggcgcttctgccgtgaccgccagcaccggactgctgtggaagcgcgcccacgcagaaagtcccccatgtgtggacaatttaaaaagcgacataggggataaggggaaaaacaaggacgagggcgatgtttgcaatcacgagaaaaaaacggctgatctcgcccctcatcctgaagaaaaaaaaaaaaaaagatctgggttcagagacaggaaggtgatggagtacgaaaatagaatccgagcttactctaccccagacaaaattttcagatacttcgccaccttaaaagttatctccgaacccggggaggctgaggtttttatgactcccgaagatttcgtgcgaagcataaccccgaatgagaagcagccagaacatctgggactggaccagtacataataaagaggttcgacggcaaaaataagaagatttcacaggagagagagaagttcgccgatgaagggtcaatcttctacacccttggcgaatgtgggctcatcagttttagtgactacattttcttaaccacagtgctgagcactccacagcgcaatttcgaaatagcgttcaaaatgtttgacctgaacggcgacggcgaggtggacatggaagagtttgagcaggctatctcgattatcaggtcacaaacatccatgggcatgcggcatagggacaggccaacaaccggtaatactctgaagtctggactatgctccgctcttaccacctacttcttcggagctgatcttaagggaaaactgactattaaaaattttctggaattccagaggaagctacaacatgatgtgctgaaattggagtttgagcgccatgatccagttgacggacgcattaccgagagacagttcggggggatgctgcttgcttactccggagtgcagagcaagaaacttaccgcaatgcaaagacagctgaaaaagcacttcaaggaaggcaaagggctgaccttccaggaggtggagaatttcttcacattccttaagaacattaacgacgtcgacacggccttaagcttctatcatatggcaggtgcttctctcgataaggtgactatgcaacaggtcgcccgcaccgtggccaaagtggagctgagcgatcacgtctgcgacgtggtcttcgccctgttcgactgcgacggaaacggcgaattgagtaacaaggagttcgtcagtattatgaaacagaggctaatgcgggggttagaaaagcccaaagacatggggtttactaggctgatgcaggcgatgtggaaatgtgcccaggaaacagcttgggacttcgctttgcctaagcagtag

SEQ ID NO: 43759 - DNA, 837 bp, Artificial Sequence
  Description of Artificial Sequence: Synthetic coding sequence
atggtgagcctgaaggccaagctgaaccacctgcggcagagcatgctgaaacaaaaagctccccagcgtaacttcgagatagctttcaaaatgttcgatcttaacggcgatggggaggtggatatggaagaatttgagcaggtgcagtcaattatacggtcacagacatctatggggatgagacaccgcgaccgccccaccactggaaacacactcaaaagtgggctgtgtagcgccttgactacgtattttttcggagcagatttaaaaggaaaattgacaatcaagaactttctggagtttcagcgaaagctgcagcatgatgttttaaaactggagttcgagcgccacgaccccgtggacggacggattacagaacgccagttcgggggaatgctactagcctactctggggttcagtctaagaagttaacagcaatgcagcggcagctgaaaaaacatttcaaggaagggaaaggtttgacattccaagaagtcgagaacttttttacatttctgaagaatatcaatgatgtggatactgctctttctttctatcatatggccggtgcgtctcttgataaggtcactatgcagcaggtggcaagaacagtcgccaaagtcgagctgtccgaccatgtgtgcgatgtagtctttgctctgttcgattgtgatggcaacggggagctatcaaacaaggagtttgtgagcatcatgaaacagaggctgatgcggggattagagaagcccaaagacatggggttcaccaggttgatgcaagctatgtggaagtgtgcccaggagacggcttgggactttgctcttcctaaacagtag

SEQ ID NO: 43760 - DNA, 1431 bp, Artificial Sequence
  Description of Artificial Sequence: Synthetic coding sequence
atgttccggctgaacagcctgagcgccctggccgagctggccgtgggatctcggtggtatcacggggggagtcagccaatccagattcgcaggcgacttatgatggtcgcattcctgggagccagtgccgtaaccgccagcactggactcctctggaagcgcgctcacgcagagagcccaccttgcgtcgacaatttgaagtcagatattggagacaaaggaaaaaataaggatgagggcgacgtgtgcaatcacgagaaaaaaactgctgatctggcccctcacccggaagagaaaaagaaaaaacgcagcggctttcgggacaggaaggtcatggagtatgagaatcgtattcgcgcctacagcacccctgataagatctttcggtatttcgctactctcaaggtgataagtgagccaggcgaggccgaggtgttcatgaccccagaagacttcgtgaggagtatcactccaaacgagaagcagcccgaacaccttggacttgatcagtacattattaagcgcttcgatgggaaaaaaatttcgcaggagcgcgagaagttcgcagacgaaggctctatcttttatacccttggtgagtgcgggctgatctcctttagcgattatatatttctgaccaccgttctgagcacaccacagcggaattttgaaatcgcattcaagatgttcgatctgaacggagatggcgaagtagacatggaagagttcgaacaggccattagtatcatcagatcacagacctctatgggcatgaggcacagggaccgaccaactactggcaacacactcaaaagtgggctttgctccgcccttacaacttacttctttggcgcagacctgaagggcaagttgacaatcaagaactttcttgagttccaaagaaagctccagcacgatgttctgaaactggagttcgagaggcacgatcctgtggacggacgcatcacggaacggcagttcgggggtatgctgctcgcatactcaggcgtgcaaagtaagaagcttacagccatgcagaggcagctcaagaaacactttaaagagggaaaaggccttacattccaggaagttgagaacttctttactttccttaagaatattaatgacgtagacaccgccctgtcattttaccatatggcaggtgctagtctcgataaagtgactatgcaacaggttgccagaacagtcgccaaggtggaactgtccgaccacgtgtgcgatgtcgtgttcgctctgtttgactgcgacggcaatggagagttatccaataaggaattcgtgtcgattatgaagcagcgcctgatgcgcgggctcgaaaaacccaaggacatgggattcacacgactgatgcaagccatgtggaaatgtgcccaagagaccgcctgggacttcgccctccccaaacagtag

SEQ ID NO: 43761 - DNA, 837 bp, Artificial Sequence
  Description of Artificial Sequence: Synthetic coding sequence
atgaagcggatctacacctaccggcgggccaaggagatcttcaaggacacccctaaggccccgcagaggaattttgaaatcgcctttaaaatgttcgatctgaatggggacggagaggtagatatggaggagtttgaacaagtacagtccattattaggagccagacatcgatgggcatgagacaccgcgaccgtcccactactgggaatactttgaaatcaggcctttgctcggctttaactacctacttcttcggtgcagacctgaaaggaaagctgactattaaaaactttttggaatttcaaaggaaactacagcacgatgttctcaagctcgaattcgagagacacgaccctgtcgacggaagaataacagagagacagtttggtggtatgctcctggcgtactctggagtacaaagcaagaaactcacagccatgcagcgccagttaaagaagcactttaaagaagggaaggggctcacttttcaagaagtggaaaacttttttacatttctcaagaacattaatgatgttgacacagctttaagtttctatcatatggccggagccagcctcgacaaagtgaccatgcagcaggtggccagaaccgtcgcgaaagtagagctgagcgatcatgtgtgcgatgtggtgttcgccctattcgactgtgatggtaacggagaactctctaacaaggagttcgtttccatcatgaagcagaggttgatgcgtggtctggaaaagccgaaagatatgggatttactaggctcatgcaggccatgtggaagtgcgcacaggaaaccgcctgggatttcgcactgccaaaacagtag

SEQ ID NO: 43762 - DNA, 1092 bp, Artificial Sequence
  Description of Artificial Sequence: Synthetic coding sequence
atggacggcggcagcggcggcctgggcagcggcgacaacgcccccacgaccgaggcgctattcgtggcactgggcgctggcgtgacagccctcagtcaccctctgctgtacgtaaagttactgattcaagtgggccatgaacccatgcctccaacattgggcacaaacgttcttgggcggaaagtcctgtacctgccctcatttttcacgtacgctaagtatatcgtccaggtggatggcaagatcggcctgtttcgtggcctgtctccaaggctgatgtcgaatgcactttcaactgtgacaagaggttctatgaaaaaggtcttcccacccgatgaaatcgagcaagtatctaataaagatgatatgaagaccagcctcaaaaaggtggtcaaagaaacctcctatgaaatgatgatgcagtgcgtttctagaatgcttgctcatccgctccacgttatctcaatgcgctgcatggtgcagttcgttggccgggaggcgaaatatagcggagtgttgagttccatcggcaaaatatttaaagaagaggggctgctcggcttctttgtgggtctgatccctcacctgttgggcgacgtggtgttcttgtgggggtgcaacctcttagcacacttcatcaacgcctatctggttgatgattctttttcccaggcactagcaatccggagttatactaagttcgttatgggtatagctgtcagcatgctaacttaccccttcctgttggtgggagacctaatggcagtgaacaactgcgggttacaagccggcctgccgccctactcaccagtgtttaaatcatggatccactgctggaaatatctgtctgtgcagggacagctgtttcgcggaagtagttgcttcagcgccggatgccaccaagatcacgctctgccttggagtaatcttaaccatcttaaaaatacagtctctacatggccaccttgggtgcgccctgaccacctaggtacaccagctcggagactgcaacctaacaataatcagatgtgttctagtcccgccggcctccagtttcacatctgccacgtgtctgtccaaatgtggggttag

SEQ ID NO: 43763 - DNA, 1074 bp, Artificial Sequence
  Description of Artificial Sequence: Synthetic coding sequence
atggacggcggcagcggcggcctgggcagcggcgacaacgcccccaccacagaagctctcttcgtggctttgggagccggcgtcactgccctatctcatccgttgctgtacgtcaaattgttgatccaggtggggcacgaaccgatgccccccacgttaggcacgaacgttcttggtaggaaagtgctgtaccttcccagcttctttacctacgcaaagtatatcgtgcaggttgatggcaaaatagggttgttccggggcctgtctccacgcctgatgtctaatgcactgagcactgttactcgagggagcatgaagaaagtctttcctccagatgagatcgaacaagtctccaacaaggacgatatgaagacgtctcttaagaaggttgtgaaagaaacatcgtatgagatgatgatgcagtgtgtgagcagaatgctggcccaccccctgcacgtgatctctatgcgctgtatggtgcagttcgttgggagggaggcaaagtactccggtgtcctgagctctatcgggaagatcttcaaggaagaagggcttttaggatttttcgtgggcctaatcccacacttgctgggcgacgtggtatttctatggggctgcaatctgctggcccatttcatcaatgcctatctcgtggatgatagcgttatccaaccaggccccggacaccctgaactctatcaggtgcgcgatggtgattgttctgagcacgcagatctgcctttacctgcaagttggcggcctcatggttgcgaacaactgcgcgccgcgtcctgggctcctcccctgctgccttcagtacagatcttagactccctgctcgaggtacccgaatgcgccgcctgcttttccgccggctgccatcaggatcacgctctgccatggagtaatcttaatcacttgaagaacacagtgtccacgtggcccccatgggttcgaccggaccatctcggtactccagcacgacgactgcagcctaataacaaccagatgtgctcatctcctgccggactccagttccatatctgtcacgtgtctgtccagatgtggggttag

SEQ ID NO: 43764 - DNA, 561 bp, Artificial Sequence
  Description of Artificial Sequence: Synthetic coding sequence
gccgtgtgcgtgccccacgtgggccccccccccgcctgccacctgaacgccctgcatggtcccgtgtgtggcaccggcggccaggtacagctgtcctgcggggccacaatccccggcagctcagcagccatggtccctcatttcggcgtgatcaatggcaagctggcgcatagtccaagactgataatgagtggtgtgctgagcagtattggcaagatcttcaaggaagagggactgctgggtttcttcgttggcctgattccgcatttgttgggggacgtcgtgttcctgtggggctgcaacctgctcgcccattttattaatgcgtatttggtggatgactcgtttagccaggccttagcaatacggtcatacacaaagttcgtgatggggatcgccgtgagcatgttgacctacccttttcttttggttggggatctcatggccgtaaacaactgtggattgcaggccggtctccccccttactccccagtggctagttcatccgaagcgcccgcctgctttagcgctggctgccaccaggatcatgcgctaccatag

SEQ ID NO: 43765 - DNA, 1119 bp, Artificial Sequence
  Description of Artificial Sequence: Synthetic coding sequence
atgggcgccagcgaccccgaggtggccccctgggcccggggcggcgccgcaggaatggccggagcaggggcgggcgctggcgcgagagggggagccgctgcaggggttgaggcacgcgcgagggatccacctcccgcccatagggctcaccctcgacatcccagacccgctgcacaacccagcgccaggaggatggacggcggctccgggggactgggttcgggagacaatgctcccacaacagaggcactgttcgtcgctctgggcgcgggagtgaccgccctgagccatccgctgctgtacgtgaagttactcatacaagtgggccacgaacctatgcctcctacactcggaactaacgtgctggggcggaaagtcctttatctaccaagctttttcacctatgctaagtacatcgtgcaagtggacggcaaaataggtctgttccgcggactcagcccccggctcatgtcgaacgccctcagcactgtaaccagaggaagcatgaaaaaagtcttcccacctgacgagatcgaacaggtgtccaataaagatgatatgaaaacctcactcaagaaggtcgtgaaggagactagttacgagatgatgatgcagtgtgtgagcaggatgctggctcacccactccacgttatcagcatgaggtgcatggtgcagtttgttgggagggaagcaaagtacagcggggttctgtcgtccatcggcaagatctttaaggaggaaggattattgggttttttcgtaggtctcattccccacttactgggggacgtcgtctttctttggggatgcaacttgctcgctcatttcatcaatgcttatctggtggacgattcattcagtcaggccctggccatacgatcttacaccaagttcgtgatgggaatcgctgtgtccatgctcacctatccattcctgttagtcggggatctgatggccgtgaataattgcgggctgcaagctggccttcccccgtactcccccgtatttaagagctggatccactgctggaagtacctgtcagtgcagggccagctcttcaggggctccagtctcctcttcaggagagtgtctagcggctcctgtttcgccctcgagtag

SEQ ID NO: 43766 - DNA, 1170 bp, Artificial Sequence
  Description of Artificial Sequence: Synthetic coding sequence
atgggcgccagcgaccccgaggtggccccctgggcccggggcggcgccgcagggatggctggagcaggtgccggcgctggggctcggggcggcgcagctgccggggtagaggcccgtgcacgggatccgccacctgctcaccgcgcgcatcctcggcacccgcggcctgccgcacaacctagtgccagacgtatggacggtggctccggcggcttgggttctggcgataatgctccaaccactgaagcactattcgtcgcactcggcgccggggtgacagccctgagtcatccgctgctttacgtcaaacttctcattcaggtcggacatgagccaatgccccctactcttggcaccaatgtccttggaagaaaagtgctgtacctgcccagtttcttcacttatgctaagtacattgtgcaagtcgatgggaaaattggcctcttcaggggcctgagcccgcgcctgatgtccaacgccttatccactgtcacgcgtggatcaatgaagaaggttttccctccagacgaaatcgagcaggtgagtaataaggatgatatgaaaacttcactcaaaaaggtggtgaaggaaacttcgtatgagatgatgatgcagtgtgtgagccgcatgcttgcccatcccttgcacgtgatcagtatgcggtgtatggtccagtttgtggggagagaggcaaaatactcaggcgtgttaagttccattggcaagatattcaaagaagagggcctgcttggcttcttcgtcggacttattccgcatctactgggagacgtcgttttcctgtggggatgcaatctgctagcccatttcatcaacgcctacttggtggacgactcagtgagtgatacccccgggggtctgggaaacgaccaaaacccggggtcacagttttctcaggccctcgcaattagatcttacactaaatttgtgatgggaatagcggtgtccatgctgacctacccattccttctggtcggcgatctgatggccgtaaacaactgtggtctgcaagccggccttcctccttatagtcctgtgttcaaatcctggattcattgctggaaatatctgtccgtgcagggtcagctgttccgaggctcatcacttctgttccgtagggtaagctccgggtcctgctttgccttggagtag

SEQ ID NO: 43767 - DNA, 606 bp, Artificial Sequence
  Description of Artificial Sequence: Synthetic coding sequence
tgagccgtgtgcgtgccccacgtgggccccccccccgcctgccacttaaatgccctccacggacctgtgtgcggcacaggagggcaggtgcagctgagttgtggagctaccatccctgggagctccgctgctatggttccgcacttcggggttatcaacggcaaactggcacacagcccccgtctgattatgagtggggttttaagtagcattgggaaaatttttaaagaggaaggcctgctcggttttttcgtgggcctgatcccgcatctgctgggggatgtggtgtttttatggggctgcaatctgttggcccactttatcaatgcgtacctggtggacgactctttctcccaggccttggctatccgtagctataccaagttcgtaatgggtatagcagtgagtatgctgacgtacccctttctgttggtgggtgacctcatggctgtcaataactgtgggctgcaggcaggactccctccttactcacccgtcttcaaatcatggatacactgttggaagtatctcagcgtacaggggcagttgttccggggctcatccctgctatttcggcgtgtttccagcggatcttgttttgcttag

SEQ ID NO: 43768 - DNA, 1185 bp, Artificial Sequence
  Description of Artificial Sequence: Synthetic coding sequence
gccggcatggccggcgccggcgccggcgccggcgcccggggcggcgccgctgctggagtggaagctcgggccagagatccaccaccagctcacagggctcatcctaggcacccgcgtcctgcagcacaaccttccgctcgcagaatggatgggggctccggcgggctggggtctggtgataacgcgcccaccaccgaagcactgttcgtggctctgggggctggcgtcacggctcttagccacccgcttctgtacgtcaaactgctgatccaggtaggccatgaacctatgcccccgacccttggcaccaacgtgctcggcagaaaggtgctgtacttacccagcttcttcacttacgcaaagtacattgtgcaagtggacggaaaaattggcctgttcagaggactctccccacgtctgatgtctaacgcgctttcgactgttacaaggggtagcatgaagaaagtgttccctcctgatgagattgaacaggtcagcaacaaggacgacatgaaaacttccttgaaaaaggttgtcaaggagactagttacgagatgatgatgcagtgcgtttctcgcatgctagcccaccctctacatgttattagtatgagatgtatggtgcaatttgtaggcagggaggccaagtactccggggttttaagctctattggcaagatctttaaggaggaaggtcttttaggcttctttgtgggcctgatcccccacttactcggagatgtagtgtttctgtggggatgtaatctgctagcacacttcatcaacgcttacctagtggatgactcgttctcccaggccctggcaatcaggtcttacacaaagtttgtgatggggatcgccgttagcatgctgacttaccctttccttttagtgggagacttaatggcagtgaataattgtggccttcaggcgggactccctccatacagcccagtgttcaagtcctggatccactgctggaagtatttaagcgttcaggtatccaagcactggacagcagaggccttccctgtgttgtgttacatcttacaactcaagtggttttgtggttgttttatcgcctgtaaggataagtggttccatgggatccagtactgtgaggaaattctgggcatttataaggcatttaaattttcgtcctacattatcagtgaacgtatttag

SEQ ID NO: 43769 - DNA, 765 bp, Artificial Sequence
  Description of Artificial Sequence: Synthetic coding sequence
atgagcaacgccctgagcaccgtgacccggggcagcatgaagaaggtgttccctcccgacgagatcgagcaggttagtaacaaggatgatatgaaaacttccttgaaaaaggtggttaaggagacaagttacgaaatgatgatgcagtgcgttagccggatgcttgctcaccccctgcacgtgataagcatgcgatgcatggtgcagtttgtgggaagagaagctaagtacagcggtgtccttagcagtattgggaaaatcttcaaggaggaaggcctcctggggttcttcgtaggccttatacctcacctacttggagatgtggtgttcttatggggatgcaatctgctcgctcatttcattaatgcatatttagtggacgactccttttctcaggcactcgccattcgctcttataccaaatttgtgatggggattgccgtcagcatgctgacatacccgtttttgcttgtgggggacctgatggctgtgaacaactgcggtctgcaggctggcttgcctccatatagcccagtgttcaagagctggattcattgctggaaatacctcagcgtgcaggtgtccaagcattggaccgccgaggcttttccagtgttgtgctatatcctccagctgaaatggttctgtggctgttttatcgcctgcaaggataaatggttccacggtattcagtactgcgaggagattctcggcatctacaaggccttcaaatttagtagttacatcatttctgagagaatctag

SEQ ID NO: 43770 - DNA, 894 bp, Artificial Sequence
  Description of Artificial Sequence: Synthetic coding sequence
atgatggacagcgaggcccacgagaagcggccccccatcctgaccagttctaagcaagatatttcaccacatattaccaatgtcggtgaaatgaaacattacctctgtggctgctgtgctgccttcaataacgtagctatcacgtttccaatccaaaaggtgctctttagacaacagctgtatgggataaagactagggatgcaatcctgcagcttagaagagatgggtttcgcaatctgtatcgcggcatccttcccccactgatgcagaagactaccaccttggcgctcatgttcggcttatacgaagacttaagctgcctcctgcacaagcatgttagcgcaccagagttcgcaacaagtggcgttgcagccgtccttgctggcaccactgaggcgatattcacacctctggagagagtacaaactctgctacaggaccataagcaccacgataagttcaccaacacttatcaggcatttaaagccttaaagtgccacggcatcggcgagtattatagaggactggtcccgattctgtttaggaacggcctatctaacgtgctgttcttcgggctaagaggccccataaaggaacatctccctaccgccacaacacattccgctcaccttgtgaacgactttatctgtggcggcctgcttggagctatgcttggattcctgttctttccaatcaacgttgtcaagacccggatacagtctcagatcggcggagagtttcagtcattccccaaagtattccaaaagatatggctggaaagggataggaagctgataaacctcttcagaggtgctcacctcaactatcacaggagtctaatctcctggggcattataaatgctacctacgagttcctcctcaaagttatttag

SEQ ID NO: 43771 - DNA, 894 bp, Artificial Sequence
  Description of Artificial Sequence: Synthetic coding sequence
atgatggacagcgaggcccacgagaagcggccccccatcctgacctcctccaaacaagacatatcaccccatattacaaacgtcggcgagatgaagcattatctctgcggttgctgtgctgctttcaataatgttgcaattacatttccgattcaaaaggtgctgtttcggcagcagctgtatggtattaaaacgagggacgcaattctgcaacttaggagagacgggtttaggaacctgtatcgggggattctaccacccctgatgcagaagacaaccacccttgcgttgatgttcgggctttacgaggacctgtcatgtctcctgcataagcatgtttctgcgcctgaatttgccacttctggggtggctgcggttctggctggcacaactgaagccatttttacaccattagagagggtccagactctgctacaggatcataaacaccacgataagttcactaacacgtatcaagccttcaaggctctgaaatgccatggcatcggggagtactatcggggtttagtccccatactgtttcgtaacgggttgtcgaatgtgctcttttttggacttcgtggccccattaaagagcatctacctaccgcgaccactcactccgcacacctggtcaacgatttcatttgcggtggattgcttggagccatgttgggatttttgttcttccctatcaacgtcgtcaaaacccgaattcaaagtcagatcgggggggagtttcagtcttttccaaaagtcttccagaagatttggctcgaaagagacaggaaacttattaacctcttcaggggcgcccatctgaactaccaccggtctctcatctcatggggcatcattaacgccacatacgagttccttctgaaagtcatttag

SEQ ID NO: 43772 - DNA, 894 bp, Artificial Sequence
  Description of Artificial Sequence: Synthetic coding sequence
atgatggacagcgaggcccacgagaagcggccccccatcctgacctccagcaagcaggatatcagtcctcatatcacaaatgtgggtgaaatgaagcactacctttgtgggtgttgtgccgcattcaacaacgtggctataacattccctatccagaaggtgcttttccgccagcagctgtacggaatcaagacccgcgatgctattttgcaactccgccgggacggcttccgaaatctctatcgcggaatcctccctcccctgatgcagaagaccacaacacttgctttaatgttcggcttgtatgaagatctgagctgcctgctccataagcacgtctcagctcctgagttcgctacaagtggagtggcagcagtgctggcaggcaccactgaggctatctttactcctttagaacgcgtgcagacactgctgcaggatcataaacatcatgacaaatttactaacacctaccaggcattcaaggccctgaaatgtcacgggataggggagtactaccgcggcctcgtgccgatactcttcaggaatggactaagtaatgtcctcttctttggcctacgaggacccattaaggagcacctccccaccgcaaccacccactcagctcatctagtcaacgacttcatctgcggagggttacttggcgccatgctagggtttctttttttccccatcaacgttgttaagacgcgaattcagtcgcagattggcggggaattccaaagcttccctaaggtgttccagaagatctggctggagcgggaccggaaactcatcaatctctttcgaggcgcccacttgaactatcacaggagcctcatttcttgggggatcatcaatgcgacctatgagttccttctgaaggtgatctag

SEQ ID NO: 43773 - DNA, 924 bp, Artificial Sequence
  Description of Artificial Sequence: Synthetic coding sequence
atgcccttcatgcggaagatcctgagcaacatgatcgacagcgaggcacacgaaaagaggccgccaatcctgacatcctccaaacaggatataagcccccacatcacgaatgttggtgagatgaaacactatctttgcggctgctgtgcagccttcaataacgttgccattacgtatcctattcaaaaggttctgtttcgccagcagttatacggtatcaagacacgtgacgccgttctgcagttaaggcgcgacggctttaggaatctttacagggggatactgccacccctcatgcaaaagactaccacactcgcgctcatgtttggactgtatgaggatctgtcctgtcttttgaggaaacatgtcagggcaccagaatttgcaacacatggcgtagccgcggtgttggctggcaccgcggaagctatttttaccccactagaacgagtccagacattgctgcagaatcataaacaccacgataaatttactaacacctaccaggcctttaaggccctcaaatgtcacggaattggagaatactatcgaggacttgtacccattctcttccggaacggcttgtccaatgtgctcttttttggacttagaggaccaattaaggagcacctgcccaccgcaaccacccatagcgctcatctcgtgaatgatttcatcggtggtggactgctgggcgctatgttaggctttctgtgtttcccgatcaacgttgtcaagacacgcctgcagtctcagatcggtggagaattccagtccttcccaaaagtttttcaaaaaatctggctcgaacgcgaccgaaagcttatcaacctgttccggggggcacacctgaactaccatcgcagtctgatctcgtggggaataattaacgccacatatgaattcctgcttaagttcatttag

SEQ ID NO: 43774 - DNA, 894 bp, Artificial Sequence
  Description of Artificial Sequence: Synthetic coding sequence
atgatcgacagcgaggcccacgagaagcggccccccatcctgacctcctccaaacaagacatctccccccacatcaccaacgtgggcgaaatgaaacactacctgtgcgggtgctgtgctgctttcaataacgtggcaattacttatcccatacagaaagtactgttccgccagcagttatatggcattaagactagagacgctgtacttcagttgcgccgcgacggctttagaaacttgtatcgcgggatcctccctcctctcatgcagaagactacaactcttgccctcatgtttggcctgtacgaggacctgtcatgtctgttacgcaaacatgtcagagctcctgaattcgccacacacggcgtcgcagcagtactggcagggaccgccgaggccatcttcacccctcttgaaagagttcagaccctgctgcaaaatcacaagcaccatgataagttcaccaacacataccaagccttcaaagctctgaaatgccacgggattggcgaatactataggggtctggttccaatcctgttccgtaacgggctgtccaacgtgctattttttggtctgcgggggccaatcaaagagcacctgccgacggctaccactcatagcgcccacctggtcaacgatttcattgggggagggttactgggtgctatgttgggttttttgtgtttccctataaacgtagttaagacccgcttacagtcacagatcgggggtgaatttcagtcatttccaaaggttttccagaagatatggcttgaaagagaccggaagttaatcaaccttttcaggggagcacatctcaactatcaccggagcctcatcagttggggaattattaacgcaacttacgaattcctcttaaagttcatttag

SEQ ID NO: 43775 - DNA, 924 bp, Artificial Sequence
  Description of Artificial Sequence: Synthetic coding sequence
atgggcgagcagaaccacagccccggcaaggagctgcagcaccggactcgggccgaagcgcctggcaaaaaatcctggcatagtcaagcttacgcactgggggccgtctctaactttatgtcgacctttctgacttttcctatatacaaggtggtttttaggcagcagatacatgccatggctgtgtcagaagcggtcaggcagctatggcacgagggtccacaatatttctatagaggaatttaccctcccttactgagtaagacacttcaaggcacacttctcttcggaacttacgactctctactttgctttctttctccagtaggcccacatacgctcgggcatcggtgggccgccggtttgatgtcaggcgtggtcgaggcagtcgccctgagccccttcgagagggtccaaaacgttctgcaggacgggcgaaagcaggcaaggttcccctccaccttttccatcctcaaggaatttaacagttacggcttgtgggggagactgtctcttggctactatagaggattctggcctgtcctagctcggaatagtctcggctctgctctgtatttctccttcaaagaccccatccaggacggcctagctgagcaaggcctgccccattgggtgcccgcccttgtgagtggctctgtgaacggaaccatcacatgtttagtgttgtacccactgatcgtgttggtcgccaatatgcaaagccatatcggttggcagaatatgccctcattgtgggcctccgcgcaagacgtctggaatactcgcggccgaaaacttctgctaatctatcggggaggcagtttagtgatactccgcagctccgtcacatggggactgacaaccgccattcacgactttctccaacgtaagagccactctcggaaggagctgaagactgactag

SEQ ID NO: 43776 - DNA, 876 bp, Artificial Sequence
  Description of Artificial Sequence: Synthetic coding sequence
atggccgagatcagccggatccagtacgagatggagtacaccgaggggattagccaaagaatgcgtgttccagagaagctcaaggtagccccacccaatgccgacttagagcaggggttccaggaaggagtgcccaatgcttcggtaataatgcaagtcccagagcgaattgttgtcgcagggaataatgaagacgtgtccttctccaggccagctgatcttgatctgattcagtctactccctttaagcccctggccctaaaaacgcccccacgagtgctaacgctgtccgaaaggccattggactttctagatctggaacggcccccaaccaccccccagaacgaggagattcgggccgtgggtagattgaaacgggaaaggagcatgagcgaaaatgctgtgcgccaaaacggccagttagtgagaaatgacagcttggtgaccccgagcccacagcaggcccgggtctgcccaccacacatgctgccagaggacggggcgaacctgtctagcgcacgtgggattctttctctcattcagtcaagtacgagacgcgcatatcagcagatactagacgtgctcgacgaaaatagaaggcctgtactgcgaggcggctctgcagccgcaacatccaacccacaccatgacaatgtccgatatggaatttccaatattgatacgacaatcgaggggacgtccgacgatctcaccgtggtggatgcagccagtctccggagacagattatcaagctcaaccgccggttgcagctcctggaggaggagaacaaagaacgggctaagcgcgagatggttatgtactcaattacagtcgctttctggctcctgaattcctggctctggtttcgcagatag

SEQ ID NO: 43777 - DNA, 732 bp, Artificial Sequence
  Description of Artificial Sequence: Synthetic coding sequence
atggccgagatcagccggatccagtacgagatggagtacaccgaggggatctcccaacgcatgcgggtacccgaaaagctgaaagtggctccgcccaatgctgaccttgagcaaggattccaggagggtgtccctaacgcctcggttataatgcaggtgcctgagcgtatcgttgtggccgggaataatgaagacgtatcattcagccgcccagctgacttggacctgatacagtcgaccccgtttaaaccattggctttgaaaaccccacctcgggtcctgactcttagtgaacgacccctggactttttagatctggagcggccccctactacgcctcagaacgaagaaatccgggctgtgggtcgtctgaagagggagagatcaatgagcgagaacgccgtccggcaaaacggccagttggtaagaaacgactccctctggcatcggtctgactccgctcctagaaataagatttctcggttccaggcgcctatctcggctccggaatacacctacggtatctccaatatcgacaccacaatcgaaggcacctccgatgacctgacggtggtggacgcagccagtcttagaagacaaattattaagctaaatcgacgtctccaacttctggaagaagaaaataaagagagagcaaagcgcgagatggttatgtactcgataaccgtggcattctggctgctcaactcctggctgtggtttagacgctag

SEQ ID NO: 43778 - DNA, 717 bp, Artificial Sequence
  Description of Artificial Sequence: Synthetic coding sequence
atggccgagatcagccggatccagtacgagatggagtacaccgagggaatttctcaaagaatgagagtacccgagaagctgaaggtggctccacccaacgctgacctggaacaaggctttcaagaaggcgtgccgaacgcctctgtcatcatgcaggtcccagagcggattgtggttgcaggtaataacgaggacgtgtctttttcgcgaccagctgacttggacctcatccagagtactccttttaagcctctggcactcaagaccccccctagagttctgaccctgtctgagcggcctttagacttccttgatctcgagaggccacctaccactccccagaacgaagagatacgcgccgtcgggcgccttaagcgggaacgctccatgtcggaaaacgctgtgcggcagaatggccagctggtgcgtaatgattccctcccagtgctgcgaggaggaagcgcagcagccaccagcaacccacaccacgacaacgtgcggtatggcattagcaacatcgataccacgatagaaggcactagtgacgacttaacagtggttgatgcagcttccctgcggcgtcaaataattaagctgaacaggcgcctccaactcttagaagaggaaaataaggaacgcgcgaaacgagagatggtcatgtactcgatcacagtggccttttggttgctcaacagctggctatggtttcgacggtag

SEQ ID NO: 43779 - DNA, 1029 bp, Artificial Sequence
  Description of Artificial Sequence: Synthetic coding sequence
atgagcaagggcaccagcagcgacaccagcctgggccgggtgagccgagctgcgttcccatcccctacggcagctgaaatggcagagatctctcgtatccagtatgagatggagtacactgagggtatttcccagcgcatgcgggttcccgagaaattgaaagtggccccccctaatgctgacctggaacagggctttcaagaaggcgtgcctaacgccagcgtgatcatgcaggtccctgaaaggatagttgtcgcaggcaacaatgaggatgttagctttagcagaccagctgatttagacctaattcagagcacaccattcaagcccctcgctttgaagacaccaccgagagtacttaccctcagtgaacgaccattggacttcctggatctggaacggccacctactaccccccagaatgaagagataagagccgtggggcgcctgaagcgggagcgctctatgagcgaaaatgccgtgaggcagaatggtcagctggttagaaatgattctctctggcatcgttctgattctgcacctaggaataaaatttctaggtttcaggcaccaatctccgctcctgagtatacagttacgccctcgccccagcaggcacgcgtgtgcccaccgcatatgttgcctgaggacggagcaaacctgagtagcgctcgcggtatcctctccctcattcaatcatccactcggagagcctatcagcagattctggacgtgctggacgagaacagacgccccgttctgagagggggcagtgctgccgcaacatccaacccacatcatgataatgtccggtacggaatctctaacatagacacgaccattgaaggaacatcagacgaccttactgtagttgacgccgctagcctcagaaggcagatcataaagttgaacaggcgtctgcagttgttggaggaagaaaacaaggagcgggccaagcgcgagatggtcatgtatagtatcactgttgctttctggctactcaactcgtggctctggtttcgccgctag

SEQ ID NO: 43780 - DNA, 657 bp, Artificial Sequence
  Description of Artificial Sequence: Synthetic coding sequence
atggccgagatcagccggatccagtacgagatggagtacaccgagggcattagtcagcgtatgagagttcctgagaaattaaaagtagcgccaccaaatgcagacctggaacaggggtttcaggagggagtaccaaacgcctccgtaattatgcaggtgccagaacgcatcgtggttgcagggaacaacgaggatgtgtcatttagccggcctgcagatctggatctaatacagagcactcccttcaaacccctcgccctcaagacgccacctagggttcttacactgagcgagcgccctttggacttcctggatctagagcggcccccgacaaccccccaaaacgaggaaatcagagctgtcggccgcttaaagcgagaaagatccatgtcagaaaatgctgttaggcagaacggccagctcgtgcgtaacgattccctgtatggaatctctaacatagacacaacaattgaggggacatcagacgaccttacagtggttgatgctgcctccctaaggaggcagatcattaagcttaatcgccggctgcaactgctagaagaagaaaataaagaacgcgcgaagagggagatggtgatgtacagcataaccgtggctttttggctgcttaattcctggttgtggtttcgcagatag

SEQ ID NO: 43781 - DNA, 1029 bp, Artificial Sequence
  Description of Artificial Sequence: Synthetic coding sequence
atgagcaagggcaccagcagcgacaccagcctgggccgggtgagccgagcagctttccctagtccgacagccgcggaaatggcggaaatctcaaggattcagtatgagatggagtatactgagggcatcagccaacgcatgcgggtgcctgaaaaactgaaggttgcaccccctaacgcagatttggagcagggctttcaggaaggggttcccaacgcatccgtgatcatgcaggtgccggagaggatcgtggtggccgggaataacgaggacgtgtcgttttccagacccgctgatttggatctgattcaatcaacaccgttcaaaccgcttgcactgaagacccctccgcgtgtcctgacactgtcagaaagacccctcgattttctggatcttgaacgtcccccaaccactcctcaaaacgaggaaatccgggccgtgggccgtctgaaacgggagagaagcatgagtgaaaacgcagttagacagaacggccagcttgtcaggaatgacagcctctggcatagatctgacagcgcccccaggaacaaaatcagcagatttcaggccccgatatcggcacccgaatacacagttaccccttctccacagcaggcacgcgtgtgccccccccacatgctccccgaggacggggcgaatctgagttcagcccgggggattctgtccctgattcagagctctacgcggagagcataccagcagatcctcgatgtgttagatgaaaatcggagaccagtgctacggggaggatctgctgctgccaccagcaatccccaccacgataacgtgaggtacgggatcagtaacatcgatactaccatcgaaggaacctccgatgaccttactgtagtagatgccgcctccctgagaagacagatcatcaaactcaaccgaagactccagcttctggaggaggagaacaaagagcgcgcgaagcgcgagatggtcatgtactctatcactgtggccttctggctcctcaatagttggctatggtttcgccgctag

SEQ ID NO: 43782 - DNA, 657 bp, Artificial Sequence
  Description of Artificial Sequence: Synthetic coding sequence
atggccgagatcagccggatccagtacgagatggagtacaccgagggcatttcgcagagaatgagagtcccagagaaactgaaagtggcaccacctaacgcagacctcgaacaggggttccaagagggcgttcccaatgctagcgtgatcatgcaggtcccggagagaattgtggtcgctggtaacaatgaagacgtcagtttctcacgacccgctgatctggatctcatccaaagcacacccttcaagccactcgctcttaagacccctcctcgggtgctgactctgtcagagaggccactggacttcctggatctggagcggccacccaccaccccacagaatgaggaaatccgtgcggtgggtagactcaagcgcgagcggtctatgtcagaaaatgcagtccggcagaacggtcagcttgttcggaacgactccctctacgggatctcaaacatagacacaacgatagagggaaccagcgatgatctgaccgtagtggatgccgcatctttaagacgacagattattaaattgaatagacgcctacagctcctcgaagaggaaaataaagaacgcgctaaacgagaaatggtgatgtactccataacggtggcattttggttgttgaattcgtggctctggttcaggaggtag

SEQ ID NO: 43783 - DNA, 717 bp, Artificial Sequence
  Description of Artificial Sequence: Synthetic coding sequence
atggccgagatcagccggatccagtacgagatggagtacaccgagggaatcagccagagaatgagagtgcctgaaaaacttaaggtcgcgcctcctaacgccgatctagaacagggctttcaggagggcgtgcccaatgcaagtgtaatcatgcaggtaccagagagaattgtggtggcaggcaacaatgaggacgtgtcattcagccggccagccgacctggacttgatccagtccacaccgtttaaacccttggcgctcaagacgcccccacgggtactcaccctgagtgaacgccccttagacttcctggaccttgaacggccacccacaaccccgcaaaacgaagagattagggcagttgggagacttaaacgcgagcggagcatgtctgagaatgcagtgagacaaaatggacagctcgtgcgaaatgactctttgcccgtactccggggaggtagtgcagccgccacctctaacccacatcatgacaacgttaggtatggtatctcaaacatagacactaccattgagggcacaagtgacgatctgaccgttgtcgatgccgcatcgctgaggcggcagattatcaaattaaacaggaggctgcagttactggaggaggagaataaagagagagcaaaacgcgagatggtcatgtattccatcacagtggccttctggcttttgaattcttggctgtggtttaggcggtag

SEQ ID NO: 43784 - DNA, 183 bp, Artificial Sequence
  Description of Artificial Sequence: Synthetic coding sequence
atggccgagatcagccggatccagtacgagatggagtacaccgagggaatttcccagaggatgagggtcccggaaaaattgaaggtggctccgccaaacgccgatctggaacagggcttccaggagggagtccctaacgccagcgtgattatgcaggtccctgagagaattgtggtggcttag

SEQ ID NO: 43785 - DNA, 99 bp, Artificial Sequence
  Description of Artificial Sequence: Synthetic coding sequence
atggccgagatcagccggatccagtacgagatggagtacaccgagggaatctctcagagaatgagggttcctgaaaaattgaaggtggccccgccatag

SEQ ID NO: 43786 - DNA, 105 bp, Artificial Sequence
  Description of Artificial Sequence: Synthetic coding sequence
atgagcaagggcaccagcagcgacaccagcctgggccgggtgagccgcgccgctttccctagtccgaccgctgccgaaatggcagagattagccggattcagtag

SEQ ID NO: 43787 - DNA, 216 bp, Artificial Sequence
  Description of Artificial Sequence: Synthetic coding sequence
atgagcaagggcaccagcagcgacaccagcctgggccgggtgagccgcgctgcattcccttcaccaaccgccgcggagatggctgaaatcagcagaattcagtacgaaatggagtacacagagggcatttcccagagaatgagggttcccgagaagttaaaagtggctcctcctaatgccgatctagaacaaggattccaggaaggcgtcccctag

SEQ ID NO: 43788 - DNA, 417 bp, Artificial Sequence
  Description of Artificial Sequence: Synthetic coding sequence
atggccgagatcagccggatccagtacgagatggagtacaccgagggtatcagccaacgtatgagagtacccgaaaagctcaaggtcgctcccccgaacgccgacctagagcaaggtttccaagaaggagtgccaaacgcctcagtgataatgcaggttcctgaacgaatcgtcgttgccggcaataatgaggacgtctcattttcccggcccgcggatctggatctgatccaatctactccatttaaacctttagctctcaaaaccccaccaagggtcctcaccttaagcgaacgccctctggacttcctcgatttagagcgccctcctacaactccacagaacgaagaaatcagagctgtcggacggttaaagcgagaaaggtctatgtcagagaatgcggtgaggcagaactag

SEQ ID NO: 43789 - DNA, 159 bp, Artificial Sequence
  Description of Artificial Sequence: Synthetic coding sequence
atggccgagatcagccggatccagtacgagatggagtacaccgaggggatttcacagcgcatgcgcgtcccagaaaagttgaaggttgcacctcccaatgctgatctcgagcaggggttccaggagggagtgcctaacgcttcagtcattatgcagtag

SEQ ID NO: 43790 - DNA, 501 bp, Artificial Sequence
  Description of Artificial Sequence: Synthetic coding sequence
atgagcgagccccagccccggggcgccgagcgggacctgtaccgggatacatgggtgcgatatctcgggtacgctaacgaggtcggcgaggctttcaggtctctagtaccagcagcagtagtgtggctcagctacggcgtggccagttcctacgtgctggccgacgccatagataaaggcaaaaaggctggcgaagtgccttctcccgaggccgggcgcagtgctcgcgtgaccgtggcagtggtggatactttcgtgtggcaggccctcgcaagtgtggccattccgggcttcacgataaacagagtttgcgctgccagcctctacgttctcggtactgctacaagatggcccttggccgtgcgcaagtggactactaccgctctgggactgctcactatcccaatcatcatacaccctattgaccggtccgtggacttcctgttggatagttcgcttagaaaactataccccaccgttggaaagcccagtagcagctag

SEQ ID NO: 43791 - DNA, 408 bp, Artificial Sequence
  Description of Artificial Sequence: Synthetic coding sequence
atgagcgagccccagccccggggcgccgagcgggacctgtaccgggatacctgggtgagatatctgggttatgccaacgaggttggcgaagcattcagatccctggtgcccgcagcggtggtttggctgtcatatggcgtggctagtagctatgtgcttgctgatgccatcgataagggaaaaaaggccggggaggttgggggatttccgccgggcctgcagcctgcgcaggcactgcctaattctggcgaggcccagcttttgttgataatcctttggtacctggcctgcgcctccgcatcatgtttcatgagtacctcctactcttgccagggcatgtggacgccgggatccctggtgtccaaggatcccggcacgtgggttggcctctcatggacagaagcctag

SEQ ID NO: 43792 - DNA, 1002 bp, Artificial Sequence
  Description of Artificial Sequence: Synthetic coding sequence
atgctgggctggatcaagcggctgatccggatggtgttccagcaggtcggagtgtccatgcaatctgttctatggtcccgcaagccgtatggtagcagtcgtagcatcgtaaggaagatcggaaccaacttaagtctgatacagtgtccccgggtgcaattccagatcaacagtcacgctaccgagtggagccctagccaccctggagaagatgccgtggcaagctttgcagatgttggctgggtggctaaggaagaaggcgagtgtagcgcacgtctccgaaccgaggtgcggtcccggcctcccctgcaagacgatctccttttctttgagaaggcaccaagccgtcagattagtttgccggacctgtcccaggaagagccacagcttaagactccggcgctcgctaacgaggaggcattgcaaaagatctgtgccctggagaacgagctggctgcgttaagagcccagatcgcaaaaatcgttacccagcaggaacagcagaacctgacggcgggagacttagatagtaccacctttggaactatccccccacacccgccccctccccctccgcctctccctcccccggccttaggcctgcaccaatctacatcagctgtggatctgatcaaggaaaggcgcgaaaaacgtgccaacgccggcaagacacttgtgaagaacaaccccaagaaaccggagatgccaaacatgctggaaattctgaaggagatgaattcagtgaaactgcgatccgtcaagcgctcagagcaagacgtcaagcctaagcctgtagacgctacagaccctgccgctttgatcgctgaggcgttgaaaaagaaattcgcatatcgctaccgtagtgattcccaagacgaagtggagaagggcattccgaagagtgaatcggaggctacatccgagcgcgtgctgttcggaccccacatgttaaaacccactggtaaaatgaaagcattaattgagaacgtgagcgactcctag

SEQ ID NO: 43793 - DNA, 903 bp, Artificial Sequence
  Description of Artificial Sequence: Synthetic coding sequence
atgctgggctggatcaagcggctgatccggatggtgttccagcaggtaggtgtgagcatgcagtctatcaactctcatgctactgagtggagcccctcccatcccggagaggacgctgtagcttcctttgcggatgttggatgggtggcaaaggaagaaggagagtgttctgccagactgaggacagaggtgagatcccgccctccgttacaggacgatctcctgttctttgagaaggctcccagccgacagatcagcctgcccgacctgagccaggaggagccacagctgaaaacgccagcgctcgcgaacgaggaagcactccagaaaatctgtgctctggaaaatgaactagccgccctgcgtgcccagatcgcaaagattgtcacgcagcaggaacagcagaacctgacagccggcgatctggactctactacatttggcacgatcccacctcatccccctccgccaccccctcccctcccacctccggcactgggcctccatcaatccacctccgcagtggacctgataaaagaacgacgcgagaagcgggcgaatgcgggtaaaacacttgttaagaacaacccaaaaaaaccagaaatgcccaacatgttggaaattttgaaggagatgaacagcgtgaagctccggagcgtgaaacgttctgaacaggatgtgaagcccaagcccgtagatgcgactgacccagccgccctcattgctgaggccctgaagaaaaagtttgcctacaggtatagaagtgatagccaggatgaagtggaaaagggtatccctaaatccgagtctgaagccaccagtgagcgagtgttgtttggacctcacatgctgaagcccactggaaaaatgaaggccctgattgagaatgttagcgattcatag

SEQ ID NO: 43794 - DNA, 1005 bp, Artificial Sequence
  Description of Artificial Sequence: Synthetic coding sequence
atgcggctgaccccccgggccctgtgcagcgccgcccaggccgcctggagggagaatttccctctctgtggccgtgacgtggccaggtggtttccaggtcacatggctaagggcctcaaaaagatgcagtcctccctcaagctggtggattgcattattgaggtacacgatgctagaatccctctcagcggcaggaatcctctctttcaggaaactctggggttgaagccccaccttctggtactgaataagatggacctggccgacctgacagagcaacagaagatcatgcagcatcttgaaggggaagggttgaaaaatgtcatcttcacaaattgtgtgaaggacgaaaatgtgaaacagatcatccctatggttacagaattaatcgggcggagccaccgttaccacaggaaggagaatttggagtactgtattatggtcattggggtgccaaacgtcggaaaatcatcattgatcaatagtctccggcgtcagcacctgcgaaaaggaaaagctacacgtgtgggtggcgaaccaggaatcacgcgtgcggtcatgtccaagattcaggtcagtgaaagacctctcatgttcctgctcgatacacctggcgtcctcgcccccaggatcgagagcgtggagaccggtctgaagctggctctgtgcggtaccgtgcttgaccatttagtgggtgaggaaactatggccgattacctactatataccttaaataagcaccaacggtttggctacgtccagcattatgggttggggagcgcttgcgacaacgtggaacgggttctcaagtcagtcgcagtgaagctcggaaaaacacaaaaggtcaaggtgcttaccggaacaggaaatgtgaacatcatccaacccaattatcctgctgctgcaagagacttcctgcagacctttcgacgcggcctcttgggatctgtgatgctcgacctcgatgttctgcggggtcatccgccagcagagaccctaccttag

SEQ ID NO: 43795 - DNA, 852 bp, Artificial Sequence
  Description of Artificial Sequence: Synthetic coding sequence
atgcggctgaccccccgggccctgtgcagcgccgcccaggccgcctggagagagaacttccctctttgcggccgggacgtcgctaggtggttccccggccacatggccaaaggcctgaaaaagatgcaatctagcctcaaactagtggactgcatcatagaagtgcatgacgcccgaatccccctgtctggaagaaacccactttttcaggagaccctgggcctgaagcctcacttactggtcttgaacaagatggacctggctgaccttacagaacagcagaagatcatgcagcacctcgagggagaaggactcaaaaatgtcatctttaccaattgtgtgaaggatgaaaacgtcaagcaaattatccccatggtcactgagctcattggacgaagccacaggtatcacagaaaagaggtgagcgaacgccctttgatgttcctattagacacccctggcgtgctagcacctaggattgagtctgttgagacaggtctgaagttagcgctgtgtggcacagtgctcgatcaccttgtgggggaggaaacaatggccgattatcttctgtacactctgaacaagcaccagcggttcggctatgtccagcactacggacttggctccgcctgtgataatgtggagcgggttctcaagtcagttgcggttaaattgggcaagacccagaaggtgaaggtactaactggtactgggaacgtgaacatcattcagccaaactatcccgcagctgccagagactttctgcagacatttcgtagggggttattggggtctgtcatgctggacctggacgtacttcgaggccatccacccgctgagacacttccgtag

SEQ ID NO: 43796 - DNA, 681 bp, Artificial Sequence
  Description of Artificial Sequence: Synthetic coding sequence
atgcagagcagcctgaagctggtggactgcatcatcgaggtgcacgatgcaagaatcccactctctggcaggaacccattatttcaggagacgctaggtctcaaacctcatctgctcgtgttaaacaagatggacttggctgatcttacagagcagcagaagatcatgcagcacttagagggggaaggtctgaaaaatgtgatattcaccaattgcgtaaaggacgagaatgtgaaacagatcatcccaatggttacggagttgattggtagatctcaccggtatcatcgaaaagaaaatttggagtactgcatcatggtgataggtgttcctaatgttgggaagtcctctttgatcaactcgctacgcagacagcatctgaggaaaggcaaagccacgcgggtgggcggcgagcctggcattaccagagctgttatgagcaaaattcaagtggagtcttccggggctagacctagtactctatcccgggctttgcaggccagcgggacgtgcagacctctgtgcgggtttcgactgttgacaacactgccaagccctccgctgtctgtccctgccgagcatccacgagggcgccattgcccctgtccttactccaccgtggtaattgtctttgcaccaaacctctggggacgccacgccgtttttcctatctcaagatag

SEQ ID NO: 43797 - DNA, 237 bp, Artificial Sequence
  Description of Artificial Sequence: Synthetic coding sequence
atgagcgagagcgagctgggccggaagtgggaccggtgcctggccgatgcagtggtgaaaatcggtaccggttttggcctcggcatcgtcttctcccttacgttttttaagcgtaggatgtggccactggcctttggctccggaatgggtctgggcatggcgtatagtaactgccagcacgattttcaggccccctatctgttgcacggcaagtatgttaaagagcaagagcagtag

SEQ ID NO: 43798 - DNA, 1467 bp, Artificial Sequence
  Description of Artificial Sequence: Synthetic coding sequence
atgaacagccagaccgaggaccacgccctggcccccgtgcggaacactatccagcttccgacccaaccccttaactctgaggagtgggacaaactaaaggaggacctcaaggagaatactggaaagacctcctttgagtcctggattattagccaaatggcaggttgtcactcatctatcgacgtggctaaatctctcctggcgtgggtcgccgccaagaataacgggatcgtgtcttatgacctgctagtcaaatatttgtatctgtgtgtcttccacatgcagacgagcgaggtaatagatgtcttcgaaatcatgaaagcccgatataagacacttgaacctcgggggtatagcttattaatccggggccttatccactccgaccgttggagagaggcactgctcttgctggaggatatcaaaaaagttatcaccccctctaaaaaaaattataatgattgcattcaaggcgccctgttgcaccaggatgtaaacacagcctggaatctctaccaggagctactcggccatgatatcgtaccaatgttagagactctgaaagccttctttgatttcggtaaagatatcaaagacgataactacagcaataaactcctggatatcctgagctatctacgaaacaaccagctctatcccggagagtcctttgctcattcgatcaagacatggttcgagagtgtgcctggcaagcagtggaaaggacagttcactacggtgcggaaatctggacagtgcagcgggtgcgggaagaccattgagtcgatccagctgagtccggaagaatacgagtgcttaaagggcaagataatgcgtgacgtgatcgatggcggggatcagtaccgaaaaactaccccacaagagcttaagaggttcgagaattttatcaaatctcgtcctcccttcgacgtggtgattgatggattaaacgtcgcgaaaatgttcccaaaagtccgcgaaagccagttgcttttgaatgtggtttctcagctcgcaaaacgcaatttaagactcctggtcttaggacgaaaacatatgctgcgtaggagctctcagtggtcacgcgacgagatggaggaggtgcagaagcaggcatcctgtttcttcgccgacgacatctccgaggacgacccattcttattatacgctacactacactccggaaatcactgtaggtttatcacccgagacctcatgcgggatcacaaggcatgtctcccagacgctaagactcagaggctatttttcaagtggcagcaaggtcaccagctggctattgtgaaccgtttcccaggatcaaaactgaccttccaacgcatactatcttatgacacagtggtgcagaccaccggagatagttggcacataccttatgatgaggaccttgtggagcggtgctcctgcgaggtgccaacgaagtggctgtgcctgcaccagaaaacctag

SEQ ID NO: 43799 - DNA, 1704 bp, Artificial Sequence
  Description of Artificial Sequence: Synthetic coding sequence
atgaccttctacctgttcggcatccggagcttccccaagctgtggaaatctccctacctggggcttggcccaggtcattcatatgtgtcactgtttctcgcggatcggtgtggcattaggaatcagcagagactgtttagcctgaaaactatgtccccgcagaatacaaaagccaccaacctcatcgccaaagcccggtaccttcgcaaagacgagggaagtaacaaacaagtgtattcagttcctcacttcttcctggcaggcgccgctaaggagcgatcgcagatgaatagccagacagaggaccacgcactcgccccagtcagaaatacaatacagctacctacccagccgctgaatagtgaggagtgggacaagttgaaggaagacctgaaggagaacacaggcaaaactagcttcgagtcctggattatttcccagatggctgggtgccatagcagcatcgatgtggcaaagtcattgcttgcttgggtggctgcgaaaaacaacgggattgtgagctacgacctcctcgttaagtatctttacctatgcgtgtttcatatgcagacttcagaagtgatcgacgtctttgagatcatgaaggcacggtataaaaccctcgagcctcggggctactctctgctgatacgggggttgatacattctgaccgctggagagaggcgttgctgttgcttgaagacatcaaaaaggttattacacctagtaagaaaaattacaacgactgcattcagggcgctctactccatcaggacgtgaatactgcatggaacttgtaccaagagctcctgggccacgatatcgtgccgatgctggagacattgaaggctttcttcgactttgggaaggacatcaaggacgataattactctaacaaactactggatattctgtcttatttgcggaataaccagctgtacccgggggaaagctttgcccatagcattaaaacttggtttgagtcaggccagtgttcgggatgcggtaaaacaattgagagtattcagcttagcccagaagaatatgagtgcctaaaaggcaagataatgcgagacgtgatagatggcggtgaccagtatcggaaaacaacaccgcaggaattgaagcggtttgagaatttcataaagagcaggccaccgttcgacgtggtgatagacggtctcaacgtggcgaaaatgtttccgaaggtacgcgagagccaactgttgctgaatgttgtatcccaattagcgaaacgcaatctgcggctgctggtcttgggacggaaacacatgctgcgccggagctcgcagtggagtagggacgaaatggaggaggttcaaaaacaggcatcatgcttcttcgctgatgatataagtgaggacgacccatttttgctgtacgcaaccctacactcaggaaaccattgtagattcatcacccgcgacctcatgcgggaccacaaggcttgcctccctgatgctaaaacacagcgccttttttttaaatggcagcaaggtcatcagttggccattgtcaacagattccctgggtccaagctgaccttccaacgcatccttagctacgataccgtggtgcaaactacaggagacagttggcatatcccttacgacgaagatctcgtggagcgttgtagctgtgaggttccaacaaagtggctgtgccttcaccagaagacctag

SEQ ID NO: 43800 - DNA, 1752 bp, Artificial Sequence
  Description of Artificial Sequence: Synthetic coding sequence
atgaccttctacctgttcggcatccggagcttccccaagctgtggaagagcccttatctgggattgggccctgggcactcatatgtcagtttatttcttgccgaccgctgtggcatcagaaaccagcagaggctgttctcacttaaaactatgtctcctcaaaataccaaagctactaacttgattgcaaaagcacgctacctgcgaaaagacgagggaagtaataaacaagtctactccgtgccccacttcttcctcgctggagcagcaaaggagcggtcccagatgaacagccaaacagaagaccatgcactggcccccgtgcggaataccatccagcttccaacgcaacctctgaacagtgaagagtgggacaagctcaaagaagatttgaaagaaaatactggcaagacgagctttgagtcctggataataagccagatggcgggatgtcattccagcatcgacgtggccaaatctttattggcctgggttgcagcaaagaacaatggcatcgtgagctatgatctccttgtgaaatacctttacctctgtgtcttccacatgcagacaagcgaggtgattgacgttttcgagataatgaaggcaaggtataagacactggagccaagggggtatagtctcttgatccgggggctcatccatagcgaccgatggagggaagcactcttactgttggaggatattaaaaaggttattacaccttcaaagaagaactataacgattgcattcaaggcgccctgctgcatcaggacgttaacaccgcgtggaacctttatcaagagctgttaggccatgacattgtgcccatgctggaaactcttaaggctttcttcgacttcggaaaagacatcaaagatgacaattacagcaacaagttgttggacattctgagttatctcagaaacaaccagctgtatccaggggaaagcttcgcacattccataaagacgtggtttgaatccgttcccgggaagcaatggaagggccagttcaccactgtcaggaagtctggccagtgcagcggatgcggaaaaactatcgagtccatacaactgtcccctgaggaatatgaatgcctcaagggcaagattatgcgcgacgtaatcgacggaggtgatcagtatcgaaaaacaacacctcaggagcttaagcggtttgaaaactttattaaatctcgcccaccattcgatgtcgtgatcgatggactgaacgttgcaaagatgtttcctaaggtaagggagtcacagcttctcctgaacgtcgtgagccagttggccaaaaggaacttgcgtctgctggtgttgggtaggaagcacatgctgcgtaggtccagtcagtggagcagagacgagatggaggaggtgcaaaaacaggcctcttgcttcttcgcggatgatatatccgaggatgatcccttcttgctgtacgccactcttcactccggtaaccactgtcggtttatcacgagagatttaatgagagatcataaagcctgcttgccggatgctaaaacgcagaggctgttcttcaagtggcagcaaggccaccagttagccatcgtgaatagattccctgggtcgaaactgacgttccagagaattctttcatacgataccgttgtccaaactacaggtgattcctggcacattccttacgacgaagacctggtcgagcggtgctcttgcgaggtgccaacgaagtggctctgcctccatcagaaaacctag

SEQ ID NO: 43801 - DNA, 105 bp, Artificial Sequence
  Description of Artificial Sequence: Synthetic coding sequence
atgaccttctacctgttcggcatccggagcttccccaagctgtggaagtccccctatctgggcctgggcccgggtcactcctacgtcagtttatttttagcgtag

SEQ ID NO: 43802 - DNA, 63 bp, Artificial Sequence
  Description of Artificial Sequence: Synthetic coding sequence
atgaccttctacctgttcggcatccggagcttccccaagctgtggaagtcgccttacctttag

SEQ ID NO: 43803 - DNA, 1467 bp, Artificial Sequence
  Description of Artificial Sequence: Synthetic coding sequence
atgaacagccagaccgaggaccacgccctggcccccgtgcggaacacaatccaactcccaacccagcctctgaattctgaagaatgggacaaactgaaggaggacttgaaagagaatactggcaaaacctccttcgaatcctggattatttcacagatggcaggatgtcattcatctatcgacgttgcgaaaagcctgttagcatgggtcgcagccaaaaataacggcatcgtcagctacgaccttctggtgaagtatttgtacttatgtgtgtttcacatgcagacttctgaggtcattgatgtatttgagattatgaaagcacgatataagactctggagcctagaggctatagcctgcttattagaggactgatacactccgacagatggcgggaggctctgctgctgctggaagacattaagaaggtgattacccccagcaagaaaaactacaatgattgtatccagggcgcgctactgcatcaagatgtgaacactgcgtggaatctctaccaagagcttctgggacacgacattgtaccaatgttggaaaccttgaaggccttttttgactttgggaaagacataaaggatgataactactcgaataaactgttagacattctgagctacctgagaaacaatcaactgtatcctggggagtctttcgctcacagcattaaaacctggtttgagagcgtcccgggtaagcaatggaaggggcaatttaccacggtgcgcaagagcggacagtgctcaggctgcggtaagactatcgagtctattcagctgtcacccgaagagtatgagtgtctgaagggcaaaattatgagagatgttattgacggcggtgaccagtatagaaaaactacacctcaggagctcaagcgctttgaaaatttcatcaagtcacgccccccctttgacgtcgtgattgacgggcttaatgtcgctaaaatgtttccgaaggtgagagaaagccaacttctgctgaatgttgtgagtcagctggccaaaagaaacctgcgtctgctagtgctagggcgaaaacacatgcttcgaagatcaagccaatggtcgagagatgagatggaagaggtgcaaaagcaagcgagctgcttctttgcagacgacattagtgaggatgaccccttcctcttgtacgctacactgcacagtggcaaccactgtcgtttcattacacgggacttaatgcgagatcacaaagcctgcctcccggacgccaagacccagcgcttattctttaagtggcagcagggccaccaattggctattgtgaataggttccccgggagcaaactgacattccagagaatcctctcttacgacacagttgtgcagacgacaggcgattcttggcacatcccttatgacgaagacttggttgagcgctgctcctgcgaggtgccaaccaagtggctgtgtctgcaccagaagacatag

SEQ ID NO: 43804 - DNA, 72 bp, Artificial Sequence
  Description of Artificial Sequence: Synthetic coding sequence
atgaccttctacctgttcggcatccggagcttccccaagctgtggaaaagtccgtatctcggactggggtag

SEQ ID NO: 43805 - DNA, 1704 bp, Artificial Sequence
  Description of Artificial Sequence: Synthetic coding sequence
atgaccttctacctgttcggcatccggagcttccccaagctgtggaagtctccatacttagggctcggcccaggccactcatacgttagcttgtttctggccgatcgctgcggtattagaaaccagcagagattgttctctctgaaaacaatgtctccccagaacactaaagctacgaatctgattgccaaagccagatacctcaggaaagacgaggggtccaacaaacaggtatattctgtgcctcatttctttttagcaggggctgccaaagagcggtcccagatgaatagccagaccgaggatcatgcattagccccagtaaggaacaccattcaactccctacacagcctcttaatagcgaggagtgggacaagttaaaagaagacttgaaggagaatactgggaaaacaagctttgagagctggattatcagtcagatggcagggtgccattccagtatagacgtcgcaaagtccctgcttgcgtgggttgccgccaagaacaacggcatagtgagctatgacctactcgttaagtacctgtacctctgcgtgtttcacatgcaaacaagcgaagtgatcgatgtttttgagattatgaaagcccgctacaagacattggaacctcgcgggtattcattgttgattcgtggcctgattcattcagaccgttggagggaggctctgctgcttctcgaggatattaagaaggtgatcacaccttctaagaagaactataatgattgtattcagggcgccctgctccaccaggatgttaatacagcttggaacctgtaccaggagctgctgggtcatgatattgtgcctatgcttgagactctcaaagctttttttgactttggaaaagacatcaaagatgacaattacagtaacaagctccttgacatactgagttatttgcggaataatcaactgtatccgggtgaatcattcgcccatagtattaagacatggtttgagtcgggacagtgctccgggtgtggtaaaacaatagagagtatccagctgtctcctgaagagtacgagtgtctgaaggggaaaattatgagagacgtaatcgatgggggtgaccagtacaggaaaacaaccccccaggaacttaagcgattcgaaaattttattaaatcaaggccaccttttgatgtggttatagacgggcttaatgtcgcgaagatgttcccgaaagtgagggagagccagctcctcctaaacgtggtgtcacagctcgcaaagaggaatcttaggctgctggtactcgggcgcaaacatatgctccgacggagttctcagtggagccgtgatgagatggaagaggtgcaaaaacaagcaagctgcttttttgccgatgacatctccgaagatgacccttttttactgtatgccacgctacattcgggcaaccattgccgctttatcaccagagacctaatgagagatcacaaagcctgtctgcccgacgccaagacccagcgcctgttcttcaagtggcagcagggccaccagctggctattgtcaacagatttcccggatctaagctgactttccagcgaatcctaagctatgacactgtggtccagaccacaggagatagttggcatatcccgtatgacgaggacctggtcgagcggtgtagctgtgaagtcccgactaagtggctctgtctgcaccagaagacatag

SEQ ID NO: 43806 - DNA, 636 bp, Artificial Sequence
  Description of Artificial Sequence: Synthetic coding sequence
atgcgggacgtgatcgacggcggcgaccagtaccggaagaccaccccacaggaactcaaaagattcgagaatttcattaaatcacggccgccattcgatgtggtcatcgatggcctgaatgtcgcaaagatgtttcccaaggtgcgggaatcgcagttgttactgaatgtggttagtcaactggccaaacggaatctgcggctgttagttctgggcagaaagcacatgctgaggcgtagcagccagtggagtagggacgagatggaagaggtgcagaaacaagccagttgttttttcgccgatgacatcagtgaagatgatccttttctcctctacgccacactacatagcggaaaccattgtagatttatcactcgagacctgatgagggatcataaagcttgtttaccggacgccaagacacagcggctgtttttcaagtggcaacagggccaccaactcgcaatcgtgaaccgttttccaggttccaagctgacatttcagcggatactcagctatgataccgtggtccagacaactggggattcgtggcatattccgtatgatgaggacctggtcgagaggtgttcctgtgaggtcccaactaaatggctatgcctccatcagaaaacctag

SEQ ID NO: 43807 - DNA, 633 bp, Artificial Sequence
  Description of Artificial Sequence: Synthetic coding sequence
atggccctgggcctgaagtgcttccggatggtgcaccccaccttccgcaactatttagccgccagtattcgccctgtgagtgaagtgaccctcaagactgtgcatgagagacagcacgggcacaggcagtacatggcttatagcgcagtccccgtccgccacttcgctaccaagaaagctaaaggatcccttgataaaattgctgttgtcacagccgatgggaagctggctctcaatcagatctcgcagatttctatgaaatcgccccagttgattcttgtcaacatggcctcattccccgaatgcactgcagccgctattaaagctataagagaaagtggaatgaacctgaaccctgaggtggagggtacactgatccgcgttcccatcccacaagtcactcgagaacacagagagatgttggtgaagcttgctaaacagaacaccaataaggccaaggactctctgcgaaaagtccgcacgaatagtatgaataaactgaagaaaagtaaggacactgtgtctgaggacaccatccggctcattgaaaaacagatctcccaaatggctgatgacaccgtggccgaactggacaggcacctcgctgtcaaaaccaaggagctcttggggtag

SEQ ID NO: 43808 - DNA, 789 bp, Artificial Sequence
  Description of Artificial Sequence: Synthetic coding sequence
atggccctgggcctgaagtgcttccggatggtgcaccccaccttccgtaattacctggctgcttctattcggcccgtatcagaagttaccctcaaaaccgtacacgaaaggcagcacgggcaccgccagtatatggcctacagcgctgtgcctgtgaggcatttcgcaaccaagaaagctaaggccaagggcaagggccagtcccagactagggtgaatattaatgcagcactcgtagaggatatcatcaacctggaagaggtgaatgaagagatgaaatcagtgatcgaggctctgaaggataacttcaacaagaccttgaacatccgaacgtctcccggttcactagataagatcgcggttgtgaccgctgacggcaagctggcactcaatcagataagccagatctctatgaaatcaccccagcttatcttagtcaacatggccagctttcctgaatgtaccgccgcagccatcaaagccatccgcgagagtggcatgaatttgaacccagaggtcgaaggcaccctcattcgggtgcccattccacaggtgacccgcgagcacagagagatgcttgtcaagctggccaaacaaaatacaaacaaagccaaagactcactgcggaaagtccggacaaattctatgaacaaactgaaaaaaagcaaggataccgtgtcggaggacacaattcgcctgatcgaaaaacagattagccagatggccgacgacacagtggctgagctcgatcgccatctggcggtgaaaacaaaggaattactgggctag

SEQ ID NO: 43809 - DNA, 606 bp, Artificial Sequence
  Description of Artificial Sequence: Synthetic coding sequence
atggccctgggcctgaagtgcttccggatggtgcaccccaccttccgcaactatctggccgcttccatcaggcccgtgtcggaagtgacactgaagacagtccatgaaagacagcacggccatcgacagtatatggcctactccgctgtccctgtgcggcatttcgctacaaagaaggcaaaggcaaaaggaaaagggcagtcccagacacgggtgaatatcaacgctgcactagtggaagacattattaatcttgaggaagttaacgaggaaatgaagtcagtaatagaggcactcaaagacaacttcaataagactctcaatataaggacctcgcccggctcacttgataagatcgctgttgtgaccgctgatggaaagctcgccctcaatcagatctcgcaaatcagtatgaaaagcccacagctcatactagttaatatggcctcttttcccgagtgcaccgccgccgccattaaggctatccgggaaagcgggatgaacctcaaccctgaggtggaggggactctgattagggtgcctattccgcagagcgctaaatggcctatgacccagtggcaaaattggaccggaatctggcagtag

SEQ ID NO: 43810 - DNA, 375 bp, Artificial Sequence
  Description of Artificial Sequence: Synthetic coding sequence
atggcctacagcgccgtgcccgtgcggcacttcgccaccaagaaggctaaagctaaaggaaaggggcagagccagactagggtgaacatcaatgcagccctggtggaagacattattaatctcgaagaggtgaatgaggagatgaagtctgttatagaagctctgaaagataatttcaacaagaccctcaacattcgtacatccccaggctcacttgacaagatagctgtagtgacggccgacgggaagcttgcccttaatcaaattagccaaatttccatgaaatccccccagttaattctggtgaatatggcttcttttcccgaaactatgaaacaaatcaaacagtactttaatggacccaatgttgcatag

SEQ ID NO: 43811 - DNA, 477 bp, Artificial Sequence
  Description of Artificial Sequence: Synthetic coding sequence
atggccctgggcctgaagtgcttccggatggtgcaccccaccttccgaaactacttggcagctagcatcagacccgtctcggaagtcactcttaaaaccgttcacgaacggcaacacggacaccggcagtatatggcttattccgcagtgccggttcgtcattttgcgaccaagaaggccaaggctaagggaaaaggccagagccagactcgcgtgaacattaatgcagcgttggtggaggatatcataaacttggaggaggtgaacgaggagatgaaatccgtaattgaagctttgaaggataacttcaataagactctcaacataagaacatctccgggaagcctggataagatcgctgtggtaacggcagacggcaaattagctttgaatcagattagtcagatatccatgaagtcgccccagttaatactcgttaacatggcctcattcccagaggtgcgctggccatgctag

SEQ ID NO: 43812 - DNA, 477 bp, Artificial Sequence
  Description of Artificial Sequence: Synthetic coding sequence
atggccctgggcctgaagtgcttccggatggtgcaccccaccttccggaattatctggcggcgagtataagacctgtttcggaggtcacattgaaaactgtgcacgagcgccagcatggccaccggcagtacatggcttatagcgctgtcccagttagacactttgccacaaagaaggctaaggctaagggtaagggtcagagccagacacgcgtgaatataaacgcagctctggtggaagacatcatcaatctggaggaggtaaatgaagagatgaagagcgttatcgaagcattaaaggacaacttcaataaaaccctgaacatccgcacatcgccaggcagcctggacaaaatcgccgtggtgactgcagatggaaagttagcgttgaatcagatttcccaaatatctatgaagtctcctcagctgattctggtcaatatggcatcgtttcctgaagtcaggtggccgtgctag

SEQ ID NO: 43813 - DNA, 657 bp, Artificial Sequence
  Description of Artificial Sequence: Synthetic coding sequence
atggcctacagcgccgtgcccgtgcggcacttcgccaccaagaaggccaaggcaaaaggaaaaggtcaatcacagaccagagtgaacatcaatgccgctctggtcgaagatatcatcaacctcgaggaggtaaatgaggagatgaaatctgtgattgaggctctgaaagacaattttaacaagactcttaatatccggacaagtccgggcagtttggataaaatcgcagtggtaactgctgatgggaagttggccttaaatcagatctctcagatttcaatgaagtccccacagttgatcttggtgaacatggcttcttttcccgaatgcaccgctgccgccattaaagctatccgcgaatcaggaatgaatttgaacccagaagtcgaagggacactgattcgcgtccccattccccaggtgactagggagcaccgggaaatgttggtgaaactagctaaacaaaacacgaacaaggctaaggattctctgagaaaagtgagaaccaactctatgaacaagctcaagaaatcgaaggatacggtctccgaggacacaatccgtctgattgagaagcagatcagtcagatggccgatgacacagtggctgagctggatagacatctcgccgttaagaccaaggagctgctgggatag

SEQ ID NO: 43814 - DNA, 531 bp, Artificial Sequence
  Description of Artificial Sequence: Synthetic coding sequence
atggccctgggcctgaagtgcttccggatggtgcaccccaccttccggaactacctcgccgccagcatcaggcccgtgtctgaggtaacacttaaaactgtccatgaaagacagcatggccaccgacagtatatggcatactctgcagttcccgtcagacacttcgccaccaagaaggcaaaggctaagggcaagggtcagtcccaaacaagagtaaacattaacgcggccctagtagaagatataatcaacctggaggaggtaaacgaggaaatgaagtcagtcatagaagctcttaaggacaatttcaataaaaccctcaatatccgaacctccccaggaagcctggataagatcgccgtagtgactgctgatggcaagttagccttgaatcaaataagccaaatttctatgaaaagccctcagttgattttggtgaacatggcttccttccccgaagagctggcctggataaggagtcttagagtccccgggattcggagtcacctgtatcatcagctagccgtatag

SEQ ID NO: 43815 - DNA, 606 bp, Artificial Sequence
  Description of Artificial Sequence: Synthetic coding sequence
atggccctgggcctgaagtgcttccggatggtgcaccccaccttcaggaactacctggctgcatcgatccgccctgtgtcagaggtcacactcaaaactgtgcatgagcggcagcacggacatagacagtacatggcatactctgccgttcccgttaggcatttcgctactaagaaagctaaggccaagggtaaaggacagtcgcagacaagggtgaacattaacgccgccttggtagaagacatcatcaatctggaggaggtaaacgaggagatgaaaagcgtcattgaagctcttaaggataatttcaacaagactcttaatatcaggaccagtcccggttctttagataagatcgcggtggtgacagccgacggaaagctcgcgttaaatcaaataagccaaatttccatgaagagtccacagcttatcctggtgaacatggcctcatttccagaatgcacagccgcggccataaaggcaatcagggagtcagggatgaatcttaatccagaagtagaaggaaccttaattcgggtacctattccgcagtcagctaagtggcccatgacccagtggcagaattggactggaatttggcagtag

SEQ ID NO: 43816 - DNA, 462 bp, Artificial Sequence
  Description of Artificial Sequence: Synthetic coding sequence
atggccctgggcctgaagtgcttccggatggtgcaccccaccttccgcaactatctagccgcctccatacggccagtgtccgaggtcaccttgaagaccgtgcacgaacggcagcacgggcacagacagtacatggcatactcagcggtccctgtacgccatttcgcaactaaaaaggccaaagcaaagggcaaaggacagtcccagacccgcgtcaatatcaatgccgccctggtagaggatattataaacctcgaggaggtgaacgaagagatgaaatctgttatagaggcactgaaagataactttaataagaccctcaatattcgcacaagccccggatctctagacaagatcgccgtcgttactgctgacgggaagctggccttaaatcagatctcccagatcagcatgaagtccccacagctaatcttggtgaatatggcatccttcccagagtag

SEQ ID NO: 43817 - DNA, 507 bp, Artificial Sequence
  Description of Artificial Sequence: Synthetic coding sequence
atggccctgggcctgaagtgcttccggatggtgcaccccaccttcagaaactacctggccgccagcatcagacccgtatcggaagtcactttgaaaactgttcacgaaagacagcacggccaccggcagtacatggcttattccgccgtgcctgttaggcattttgctaccaagaaggctaaggcaaaggggaagggccagtcccagactagagtgaacattaacgctgcacttgttgaagatattattaacttggaggaggttaatgaggagatgaagagcgttattgaagcactgaaggataatttcaataagaccctgaatataagaactagcccaggtagtcttgacaaaatagcagtggtgacagcagacggaaaactggcactgaaccaaattagtcagatctctatgaagtcccctcagctgatccttgttaatatggcctcgtttcccgagactatgaaacagattaaacagtatttcaatggcccaaacgttgcctag

SEQ ID NO: 43818 - DNA, 1062 bp, Artificial Sequence
  Description of Artificial Sequence: Synthetic coding sequence
atggccctgctgagcaccgtgcggggcgccacctggggccggctggtgacccggcattttagtcacgcagccagacacggtgagcgccctgggggtgaggagctgtcccggctcctcctagacgatcttgtaccgacatcccggctggaattgctctttgggatgacaccatgcctattggcccttcaggctgcacgccggagcgttgcacgcctgctgctgcaggctggaaaggcgggcctccagggaaaacgtgccgaactgttgcgtatggctgaagctcgggacattcccgttctcaggcctagacggcagaagttagataccatgtgtagataccaggtccatcagggcgtctgtatggaagtctctccactccgaccacgaccctggcgagaagctggggaagcctccccaggtgatgaccctcaacagctttggttggtgctcgatggcatccaagaccctaggaacttcggagccgtcctaagatccgctcactttctgggggtagacaaagtgatcacttcacgcaggaattcttgtccgctgacccccgtcgtgtctaaaagctcagctggagcaatggaagtgatggatgtgtttagcaccgatgatcttaccggtttcctccagacgaaggcccagcagggatggctggtcgccggcaccgtggggtgtcctagcacggaagacccccagtcgtctgagatccccattatgtcctgtcttgaattcctctgggaaagacctaccctccttgtgctgggaaatgaaggatctggcctctcccaggaagtgcaggccagctgtcaactcctcctgaccatcctccctcggcgccagttgccccccggcctggagagcctgaatgtctcagtagccgcgggcatcctgctacactctatatgctcacagcgcaaggggttcccgacagagggtgaaaggcgccagcttctgcaggaccctcaggaaccctctgccaggtctgaaggactaagcatggcacagcaccctggccttagttccggtcccgaaaaagagcgtcaaaacgaaggatag

SEQ ID NO: 43819 - DNA, 837 bp, Artificial Sequence
  Description of Artificial Sequence: Synthetic coding sequence
atggccgccctgttcctgaagcggctgaccctgcagaccgtgaagtcagagaattcatgcattcgctgtttcggtaaacatattctgcagaagacggcccccgcacaattatctcccattgcctccgcgccgcgcctgagctttttgattcatgctaaagccttcagtacagctgaggacacccaaaatgagggcaagaagaccaaaaaaaacaagaccgccttctccaacgttggccgtaaaatcagccagcgggttattcatctgttcgacgaaaaggggaacgacttaggcaacatgcacagggccaacgtcatcaggctgatggacgagcgtgatctgagactggtccagcggaataccagtacggaaccagctgagtatcagctcatgacaggcttgcagatcttgcaagagcgccagcgtctgcgcgagatggagaaggcaaatccaaagacaggaccaaccctaagaaaagaactaatcctctcctctaacattggtcaacacgatctggacacaaaaacgaagcagatacaacaatggattaagaaaaaacatctggtccagataaccatcaagaagggtaagaacgtggacgtgtctgaaaacgaaatggaagagatattccaccaaattcttcaaaccatgcccggaattgctactttctccagccgcccccaagccgtccaggggggcaaggctctgatgtgtgtattacgcgctttcagtaagaatgaggagaaagcttacaaagaaacccaggaaacacaggaacgcgacacactgaacaaggaccacggcaatgacaaagaaagtaatgtgctgcaccaatag

SEQ ID NO: 43820 - DNA, 837 bp, Artificial Sequence
  Description of Artificial Sequence: Synthetic coding sequence
atggccgccctgttcctgaagcggctgaccctgcagaccgtgaagtccgagaatagctgtatcaggtgcttcggaaagcatattcttcaaaagaccgcacctgcgcagctcagccccatcgcgtcagccccacgactcagttttctgatacacgcgaaggcatttagcactgccgaagatacgcagaatgagggcaagaagacaaaaaagaataagaccgctttttccaacgtcggtcgaaaaatctcccaacgtgtcatacacctgtttgacgagaaggggaacgacttgggcaatatgcacagagctaacgtcatccggctcatggacgagcgtgacctcagattagttcagcgcaacaccagcacagagcccgctgagtatcaactgatgaccggattgcagattttgcaagaaaggcagcgtttgagggagatggagaaggccaatccaaagacaggcccaacgcttagaaaggaattgatcttgtcaagcaacattggccagcacgatcttgatacaaagacgaagcagatccagcagtggataaagaagaagcacttagtccagatcacaatcaaaaagggcaagaacgtcgatgtcagcgaaaatgaaatggaggagatatttcaccagatcctgcagaccatgcctggcattgccactttctctagtagaccccaagccgtccaaggaggaaaggctttgatgtgcgtgcttcgcgcctttagtaaaaatgaggagaaggcgtacaaggaaactcaggagacacaggagcgggataccctgaacaaagaccacggaaacgacaaagagagcaacgtactgcatcagtag

SEQ ID NO: 43821 - DNA, 837 bp, Artificial Sequence
  Description of Artificial Sequence: Synthetic coding sequence
atggccgccctgttcctgaagcggctgaccctgcagaccgtgaagagtgaaaactcttgtattaggtgtttcggcaaacatatactacagaaaactgcccccgctcaactgtcccccattgcctcggctcctaggttatcctttctaatacacgccaaggcattcagcaccgccgaggatacccagaatgaggggaagaagacaaaaaaaaacaaaacagctttcagcaacgtggggaggaaaatcagccagcgggtgattcacctgttcgatgagaagggaaatgatcttggcaatatgcatagagctaatgtgatcaggcttatggacgaacgagatttgagattagtgcagcgcaacacttcaaccgaaccagctgaatatcagctgatgactggacttcagatcctccaggaacgtcagaggctgagagagatggagaaggcaaaccccaaaactgggcctaccctgaggaaggaactgatcctcagcagcaatattgggcagcatgacttagataccaaaacaaagcagatccagcagtggatcaagaagaaacatctagttcagatcacaattaaaaagggtaagaacgttgatgtgtccgagaacgagatggaggaaatctttcaccaaattcttcagaccatgcccgggatagccacgttttcctctcgacctcaagcagtgcagggtgggaaggctttgatgtgcgttctcagggccttttcaaaaaacgaggaaaaggcatacaaggagacccaagagacccaggagcgcgacacacttaataaggaccacggcaatgacaaggagagtaatgttctccaccagtag

SEQ ID NO: 43822 - DNA, 837 bp, Artificial Sequence
  Description of Artificial Sequence: Synthetic coding sequence
atggccgccctgttcctgaagcggctgaccctgcagaccgtgaagagcgaaaactcttgtatccgttgttttggcaaacacatccttcagaagaccgcacctgcacagttatctccaatagcctctgctccgagattgtccttcctgatccacgccaaggctttcagtaccgcggaggatacacagaatgaaggcaagaagaccaaaaagaataaaacagcttttagcaacgtgggccgaaaaattagccagagagtcatccatctgtttgacgagaagggtaacgacctggggaatatgcacagagccaacgttatcagactgatggacgaaagagatttgagactcgtgcagcggaacacttcaactgaacccgccgagtatcagctgatgacagggcttcagatacttcaggaacggcagaggctacgcgagatggaaaaggcgaaccccaaaactggccctacgctgaggaaggaactcatactttcatccaacataggccagcacgatctggatacaaaaacaaaacagattcagcaatggatcaagaagaagcacctggttcagattacaatcaaaaagggtaagaatgttgacgtctccgaaaatgaaatggaggagatatttcatcagattctgcagactatgccaggtatcgcgactttctcctcccggccgcaggcggtgcaggggggaaaggccctgatgtgtgtgctgagggcatttagtaagaatgaggagaaggcttacaaggaaacgcaggaaacacaggaaagagataccttaaacaaggatcatggcaacgacaaagagagcaatgtcctccaccagtag

SEQ ID NO: 43823 - DNA, 681 bp, Artificial Sequence
  Description of Artificial Sequence: Synthetic coding sequence
atgaacgagaacctgttcgccagcttcatcgcccccaccatcctggggcttccagcggctgtactcattatactatttccccccctccttattccgacctcaaagtatttgattaacaatcggctgatcacaacacagcagtggttgatcaagctgacttccaagcagatgatgacaatgcataacaccaagggtcgtacatggagcctcatgctagtctctctgatcatctttattgctaccaccaacctgctgggactcttgcctcattctttcacaccaacaacgcagcttagtatgaatttagccatggccattccactttgggccggtactgtgataatgggattccgctcaaaaattaagaacgcactcgcgcatttcctccctcaggggacacccacacctctcataccaatgctagtcatcattgagaccatcagtcttttaattcagcccatggcactagctgttagactcaccgctaacataacagcaggccatctgctcatgcatctaattggctcagcgactctggcaatgtccaccatcaacttgccgtctactcttattatcttcacgattctgatcctgcttactatccttgagatcgccgtggctttaatccaggcctacgtttttacactactggtgtccctctacctccatgataacacctag

SEQ ID NO: 43824 - DNA, 1143 bp, Artificial Sequence
  Description of Artificial Sequence: Synthetic coding sequence
atgacccccatgcggaagaccaaccccctgatgaagctgatcaaccattctttcatcgacttacctacaccctcgaacatctccgcctggtggaattttggctcgctgctgggcgcttgtctgatcctacagatcactactggtttatttcttgcaatgcactactctcctgatgctagcacagcctttagctctattgctcacataacccgtgacgtgaactacggttggattattcgatatttgcatgctaatggcgccagtatgttttttatttgcctgtttctccatatcggacgcggcttgtactacgggagtttcttatactcagagacctggaacattggtattatcctccttctcgccacaatggcaaccgccttcatgggttacgtgctgccatggggccagatgtccttttggggcgctaccgttatcaccaacctgctgtccgccattccctacataggaaccgacttggtgcaatggatctggggcgggtacagtgtggatagccccacattgacgcgcttcttcaccttccactttatcttgcccttcatcatcgccgcattggcgactcttcacctactgtttctgcatgaaactggcagcaataatcccctaggaatcacatcacactccgacaaaatcaccttccacccctactacactatcaaagatgccctggggctgttactgtttctgctcagtttgatgacactgacactgttcagccccgacttactgggagatccggacaattataccctggcaaacccgctgaatacccccccccatatcaagccggagtggtatttcttgttcgcatatacaatcctgaggtctgtgcccaacaagttggggggcgtactggccctacttctctctatcttgattctggccatgatcccaatcttgcacatgtccaagcagcagagtatgatgttccgtccactgtctcagtcactttattggctcctcgctgctgatctgctgatactgacttggattggaggccagcctgtgagctatccctttaccatcatcggacaggtcgcaagcgtcctgtatttcactactattctaatactaatgcccaccatcagcctgatagaaaacaaaatgctcaagtgggcatag

SEQ ID NO: 43825 - DNA, 1542 bp, Artificial Sequence
  Description of Artificial Sequence: Synthetic coding sequence
atgttcgccgaccggtggctgttcagcaccaaccacaaggacatcgggacactgtacctattgtttggagcctgggcgggagtgctggggaccgctttaagtcttttgatccgggctgaactagggcagcctggtaatctgctgggcaatgatcatatctacaacgtcattgttacagctcacgcctttgtgatgatcttctttatggtgatgcccattatgatcgggggcttcggaaattggctggtgcctctcatgatcggggcacctgacatggcgttccccaggatgaacaacatgtctttttggcttcttccgcccagcttgctcctgctgctggccagtgctatggtggaggctggggccggcaccggttggactgtgtaccctcccctggccggcaattactctcatcctggggcctcggtggatctgaccatcttttccctccacctggctggagtctcatcaatactgggcgctattaatttcataacaaccatcataaacatgaaaccacctgccatgacgcagtatcagacacccttgtttgtctggagcgtcctgatcactgccgttctgctgcttctttctcttcctgtcctagccgccgggattacaatgctgcttacggaccggaatctgaacaccactttttttgaccccgctggcggcggtgatcctatactatatcaacatcttttctggttctttggccaccctgaagtgtatatcctgattcttcccggttttggcatgatcagtcatatagtcacgtactatagtggcaaaaaggagccattcggctatatggggatggtctgggccatgatgtctataggctttctgggcttcatagtttgggcacatcatatgtttacagtcggtatggacgtggataccagagcttattttacaagcgcgacaatgattattgccatccccactggagtgaaggtctttagctggctggcgaccttgcatggctctaacatgaaatggagcgctgccgtcctgtgggccttggggtttatattcctctttaccgttggtgggcttactggaattgttctggcgaactctagcctggatatcgttctccacgacacatattacgtagtggctcactttcattacgtgctaagcatgggggctgtcttcgctatcatgggtggctttatccattggttcccactgtttagtggatacacactcgatcaaacttacgccaaaattcacttcacgatcatgttcataggggttaacctgacttttttccctcagcatttcctgggactgtctggaatgcctagaagatatagcgactaccccgatgcttacactacttggaatatcctgtccagtgtggggtctttcattagtctaactgctgtaatgcttatgatattcatgatatgggaggcctttgcaagtaaaaggaaggttctgatggtggaggagccatctatgaatctggaatggctgtatgggtgcccccccccttaccacacattcgaggagccagtgtatatgaaatcctag

SEQ ID NO: 43826 - DNA, 684 bp, Artificial Sequence
  Description of Artificial Sequence: Synthetic coding sequence
atggcccacgccgcccaggtgggcctgcaggacgccaccagccccattatggaggagctgattacctttcacgatcacgctttgatgattatcttcttaatttgtttcctggttctgtatgcactgtttctaaccttgacaacgaagctcacgaacaccaatatctccgatgcccaggaaatggagaccgtatggaccattctccctgctatcatactggtgttaattgctttgccgagcttgcgtatactctatatgacagacgaggtaaatgatccctcgcttaccatcaaatcaattggccaccagtggtattggacctatgagtacactgattacggcgggctcatctttaattcctatatgctccctcccctgttcttggagcccggagatctccggttgctggatgtagataatcgagtggtcttgccgatcgaggcgcccatcaggatgatgattacatctcaggatgtacttcactcttgggccgtgccaaccctcggcctgaaaacagatgctattcctggacgtcttaaccaaacaacgttcacagctacaagacccggcgtctattacggtcagtgctcagagatctgcggggctaatcactcttttatgcccatcgtcctggaactgattcctctcaaaatctttgaaatgggacctgtttttaccctttag

SEQ ID NO: 43827 - DNA, 786 bp, Artificial Sequence
  Description of Artificial Sequence: Synthetic coding sequence
atgacccaccagagccacgcctaccacatggtgaagcccagcccctggccactcaccggagccctgtctgccctgcttatgacatccggcttggcaatgtggtttcacttccacagtatgacattgttgatgctggggctcctgacaaacaccttgacaatgtatcagtggtggcgcgacgtcacccgcgagtcaacgtatcaaggccaccacactccacctgtccagaagggtttaaggtacggtatgattctgttcattacgagcgaggtgttctttttcgccgggttcttttgggcattctaccatagcagcctggcccctacaccccaactaggcggccattggccacccacaggtatcacacctctgaaccccctggaggtgcccctgctgaacacctcggtgcttctcgcatctggcgtttctattacttgggcccatcactccttgatggaaaataatcgcaaccagatgattcaggcactgctgattacaatcctcttaggtctgtacttcaccctattacaggcaagcgaatacttcgagtctcccttcacaatatccgacgggatttatgggtctacatttttcgtggctactggtttccatgggctgcatgtgattatcggatccacttttctcactatttgtttcattcgacagctaatgtttcatttcacatctaaacaccacttcggatttgaagctgccgcttggtattggcactttgttgatgtcgtgtggctttttctttatgtgtccatttattggtggggcagctag

SEQ ID NO: 43828 - DNA, 957 bp, Artificial Sequence
  Description of Artificial Sequence: Synthetic coding sequence
atgcccatggccaacctgctgctgctgatcgtgcccatcctgatcgccatggcttttctgatgctgacggagcggaagatcctcggctacatgcagttgcgcaagggacccaatgttgtgggcccctacggcctgttacagccattcgccgatgcgatgaagctgttcaccaaggagcctctcaagccggccacatcaacaataacactgtatataactgcaccaaccttagcgctcacgattgccttgctgctgtggaccccccttcccatgcctaatccactggtaaacctcaaccttggccttctgttcatcctggctacaagctccttagccgtatacagcatcctgtggtcggggtgggcctcaaattcaaactacgctcttatcggcgccctacgcgctgtggcacaaacaatttcctacgaagtgaccctcgccattatattgctctccactctgctcatgtctggctcattcaatctgtcaaccctgataactacgcaggaacacttgtggttgttgttaccttcatggccattggcaatgatgtggttcatatcaacccttgccgagactaaccgaacaccatttgatcttgctgagggagagtccgagctggtcagtggcttcaatatcgaatatgccgcaggaccttttgccctgttctttatggcagaatataccaatattatcatgatgaataccctcacaaccactatttttctgggcactacatacgatgccttgagtccagaactctacacaacctacttcgtcactaaaactctgctgctgacatccttattcctgtggattcgcactgcttacccgcggtttcgatatgaccagctcatgcacttactgtggaaaaacttcctgcccctgactctggcgctactcatgtggtatgtttctatgccaatcaccatctcctccattcctccgcaaacctag

SEQ ID NO: 43829 - DNA, 1044 bp, Artificial Sequence
  Description of Artificial Sequence: Synthetic coding sequence
atcaaccccctggcccagcccgtgatctacagcaccatcttcgccggcaccctcattacggccctgagcagccactggttctttacgtgggtcgggcttgagatgaacatgctggccttcattccggtcctcacaaagaagatgaacccgagatctacggaagcagcaatcaagtatttcctcacccaagccaccgcctccatgattctcctgatggccatcctgttcaataatatgcttagtggtcagtggacgatgacaaatactacaaaccagtattcaagtttgatgattatgatggctatggctatgaagctcggtatggccccttttcatttttgggtgccagaggtgacccaaggtacaccactgacaagcggcctattgttgctgacctggcagaagctcgcccccatttctataatgtaccagatttcaccatccctgaatgtgtccctcctgctgactctatctatacttagcattatggccggcagctggggggggcttaaccagacgcaactgcgcaagatcttggcctattcttccattacccatatgggatggatgatggctgtcttgccttataaccctaacatgactattcttaacctgaccatctatattatactgactactaccgctttcctgttgctcaacctgaatagctccactactaccctgctgctgtcccggacctggaataagctgacctggctgacccccctgattccatcaacgcttctgagtctcggcggcttaccccctctcacagggttcttaccaaaatgggctatcatcgaggagttcactaagaacaattccttgattatcccaactatcatggctaccattacattactcaatctctacttttacctgcgcttaatctacagcactagcatcacattgctgcccatgtccaacaatgtgaagatgaaatggcaatttgagcacacgaaaccaactccatttcttcctactttgatcgcacttactacattacttctgcccatctctccattcatgcttatgatcctatag

SEQ ID NO: 43830 - DNA, 348 bp, Artificial Sequence
  Description of Artificial Sequence: Synthetic coding sequence
atgaacttcgccctgatcctgatgatcaacaccctgctggccctgttactgatgatcattacgttttggctgccccagttgaatggctacatggaaaaatccactccctatgagtgcggattcgatcccatgagcccagcgagggtgccattttcaatgaagtttttcctggtggcaataactttcttgctgttcgatttggaaatcgccttgcttctaccactgccctgggcgctgcagaccacaaatttacccctcatggtcatgtcatccttgctacttattataattctggccctgagtctggcttatgaatggcttcagaaagggcttgattggaccgaatag

SEQ ID NO: 43831 - DNA, 1380 bp, Artificial Sequence
  Description of Artificial Sequence: Synthetic coding sequence
atgctgaagctgatcgtgcccaccatcatgctgctgcccctgacctggttaagcaaaaagcatatgatctggattaacaccactactcactctctgatcatttccatcatccctctgctctttttcaaccaaatcaataacaatctcttttcttgttcccccacgttttccagcgaccctctgacaaccccgctgttgatgctgactacctggctgctgccactaaccattatggcctctcagaggcacctcagttctgaacccttgagtcgtaagaagctctatcttagtatgctgatatccctgcaaatttctctcatcatgactttcactgcgactgagctgattatgttttatattttcttcgagactaccctgatccctacccttgccataatcacccgttggggtaaccaacccgagcggctgaatgcgggtacctactttctgttctacactctggtggggtcacttcccttgttgattgctctgatttatacacataacaccctcggcagtttaaatattttattgctaacactaaccgctcaggagttgtccaactcttgggcaaacaatctgatgtggctcgcttatacaatggccttcatggtgaaaatgcctctctatggtcttcatctttggctgcctaaggcccacgttgaagcccccatcgcaggatcaatggttttagcagctgttctgctgaaactaggcggctacggaatgatgcgactaaccctgatcctgaaccccctgacaaagcatatggcctatccctttctggttctgtcgctctggggcatgattatgacaagctcaatctgtcttcgccagaccgacttaaagtccctaattgcctacagcagtatttcacatatggccctggtggtgaccgctatccttatacaaaccccttggtcttttaccggcgctgtcattctaatgatagcgcacggactgacgtcctccctcttattttgtcttgctaactctaattacgagaggacccactcgcggattatgattctgtcacaggggctccagacacttctacccctgatggctttctggtggcttttggcttctctggctaatcttgctctcccaccaacaataaacctgctaggggagctcagtgtgttagtcacaacctttagttggtccaacattaccctgcttcttacaggattaaacatgctggtaactgccttgtattcactgtacatgttcacgaccacgcagtggggtagcctcacccatcacatcaataatatgaagccgtcatttactcgggaaaatactttaatgtttatgcatctgagcccaatactgctgctgtccctaaatcccgacatcataaccgggttctcatcatag

SEQ ID NO: 43832 - DNA, 297 bp, Artificial Sequence
  Description of Artificial Sequence: Synthetic coding sequence
atgcccctgatctacatgaacatcatgctggccttcaccatcagcctgctagggatgctggtgtatcgttcacacctgatgagttccctgctctgcctggagggaatgatgctgtcactgttcattatggcaaccctgatgacactcaacacacactctctgctagccaatatcgtgcctatcgccatgctcgtgtttgccgcttgcgaggcagccgttggcctcgcccttctcgttagcattagtaacacatacggattggactatgtccacaacttgaatttgcttcagtgctag

SEQ ID NO: 43833 - DNA, 1812 bp, Artificial Sequence
  Description of Artificial Sequence: Synthetic coding sequence
atgaccatgcacaccaccatgaccaccctgaccctgaccagcctgataccccctatcctgactacactcgtcaatccaaacaagaaaaattcctatccacactatgttaagagcattgtcgcctcgacatttattatctctctcttccccaccacgatgttcatgtgtctcgatcaggaagtgataatttccaattggcattgggccacaacccagacgacccagctgtctctttcttttaaattagattactttagtatgatgtttatccctgtggctttattcgtaacatggtccataatggagttttctttatggtatatgaactcagaccccaatattaaccagttttttaaatacttactcatctttctcatcacaatgttaattctggtcacagcgaacaacctattccagctcttcatagggtgggagggcgtgggtattatgtctttcctgctcatcagctggtggtatgcccgggccgatgctaatacagccgcaattcaggcgatcttgtacaacaggatcggggacatagggtttattctggcactggcatggttcatcctgcactctaattcctgggacccacagcaaatggctctcctgaacgctaatccatccctgacacctttgctggggctgctcctggctgcagcagggaaaagcgcacagctgggactgcacccatggttgccctcggcaatggaaggccctactccagtatccgccctccttcactcgagtaccatggtggtggccgggatctttcttctgatccggttccaccccctcgctgagaattcaccacttatacagactctgaccctgtgcctaggggccattacaacgctcttcgccgccgtctgcgctctgacgcagaatgacatcaaaaagattgttgcattttctactagcagccagctggggctgatgatggtcactataggaatcaatcagccacacctggctttcttacatatctgcactcatgcattctttaaagctatgctgttcatgtgtagtggcagcatcatccataatttgaacaatgagcaggacatcagaaagatggggggtctcctcaagaccatgcccttgacatctacttcacttacaatcggctcattggccctggccgggatgcctttcctgaccggattttactctaaggaccacatcattgagacggctaacatgagttacactaatgcgtgggcattaagcattaccctgatcgccacttctctcacttcagcgtatagcacgcggatgatcttattgactcttacagggcagccacggtttcccactctcactaacatcaacgagaataaccccacgctgctgaaccccatcaaacgactcgccgccggctcactttttgccggcttccttatcacaaacaacattagcccggcttccccattccagaccacgattcccctctatctgaaactcaccgcactggctgtgacttttttagggttacttacggctcttgatctcaactacctgacaaataaactgaaaatgaaaagccccctctgcaccttctacttctcaaatatgctggggttctacccctcgatcacccacaggaccataccatatcttggtttgcttaccagtcagaacctacccctgttgctgctggatcttacatggctggaaaaacttctccctaagacgatatctcagcatcaaatctctacgtccattattacaagcacccaaaaaggcatgatcaagctatattttctgagcttctttttccccttgatcctgacattactgctgatcacctag

SEQ ID NO: 43834 - DNA, 525 bp, Artificial Sequence
  Description of Artificial Sequence: Synthetic coding sequence
atgatgtacgccctgttcctgctgagcgtgggcctggtgatgggctttgtcggcttcagctctaaaccgtctcccatttatgggggactggtgctgatcgtgagcggggtggtgggatgtgtgatcatactgaattttggtggtggttatatgggactcatggtgttcctgatctatctcggcgggatgatggtggttttcggctacaccacagccatggccatcgaggagtaccctgaagcttgggggtcaggggtggaggtgctcgtgtctgtgttggtcggtctcgccatggaagtcggtcttgtcttatgggtgaaagagtatgacggggtcgtggtcgtggtgaacttcaactctgtgggaagctggatgatctacgaaggtgaggggagtggcttgatccgcgaggatccaatcggggctggcgccttgtacgactatgggaggtggctggtggttgttacaggctggacactctttgttggggtctacatcgtgatcgaaattgcgcgaggtaattag

SEQ ID NO: 43835 - DNA, 2226 bp, Artificial Sequence
  Description of Artificial Sequence: Synthetic coding sequence
atggccgagcccgtgagccccctgaagcacttcgtgctggccaagaaagccatcaccgcaattttcgaccagctgctagaatttgtgactgaaggatcgcattttgtagaagcgacatataagaaccctgaactcgatcgaatcgctacagaagacgatctggtggaaatgcaagggtataaagacaagctctccattataggagaggtcctatcgaggcggcacatgaaggttgcattcttcggccggacctccagcgggaaatcgtccgtgatcaacgctatgctttgggacaaagtgttaccctccggtattggccatattactaattgttttctgagtgtggaagggactgatggcgataaggcatacctgatgaccgagggcagcgacgaaaagaagtctgtgaagactgtaaaccaattggcccatgccctgcacatggataaggacctgaaagccggttgcctggtgcgagtgttctggcccaaggcaaagtgcgccttactgcgtgatgacctcgtcttagtagacagcccaggaaccgacgtcaccactgagctggactcatggatcgataaattctgtctcgacgccgatgttttcgtgctggtcgcaaactccgagtctacactcatgaatactgaaaaacacttttttcacaaagtaaatgagagactgagcaagccaaacatctttattctgaataatagatgggacgcatcagcatccgaaccagagtacatggaggatgtgaggcgccagcatatggagcggtgcctgcactttctggtggaggaactgaaagtggtcaacgccctggaggctcagaatcgcatattctttgtgtctgccaaggaagtcctctctgctaggaagcagaaggcacaggggatgccagaaagcggcgtggccttggccgaaggctttcatgcccgtttacaagaatttcagaacttcgagcagatttttgaagaatgtattagccagtctgccgtgaaaacgaaatttgaacaacacaccatacgcgcaaagcaaattttagctactgtcaagaatattatggacagtgtgaatctggctgctgaggataagcgccactactccgttgaggagcgtgaggatcagatcgataggttggattttatccggaaccagatgaatctcctaaccctggacgtgaaaaagaagattaaggaagtgacagaagaagtggccaacaaggtgtcctgcgccatgacagacgagatctgccgtctgtcggttttggtggatgaattttgttcggagttccaccctaaccctgacgttctaaagatctacaaatctgaactgaataagcacattgaggacgggatggggagaaatctggccgaccgttgcaccgatgaagtcaatgccctcgtacttcaaacccagcaggagattatcgagaacctcaaacctctgctccccgcaggaatccaggataaattacacacactgattccctgtaagaagtttgacctgagctataacttgaactatcacaagctctgctctgacttccaggaggacatagtatttcccttctccctgggttggtctagccttgtgcacagattcctggggccacgaaatgcccaacgtgtgttacttggactgagtgagccaatatttcagctgccacggtccctggcgagcacccctacagcaccaaccacccccgcgactccagataatgccagccaggaagaattgatgatcaccctcgtgacgggactagcatcagtgactagccggacgtcaatgggtataattatagtgggaggcgtgatctggaagacgatagggtggaaacttctgtcagtgtcgctgacaatgtacggggccctgtatttatatgagaggttgagctggaccacccacgctaaagagcgggctttcaaacagcaatttgtgaactacgcaacggaaaaactgagaatgatcgtaagcagtacatcagcaaactgctctcatcaagtcaagcagcaaattgcgacaacattcgcgaggttatgtcagcaagttgacatcacacagaagcagctcgaggaggagatcgcccggttgccgaaggagattgatcagttggaaaagatccaaaacaattctaagctgcttcgtaacaaagctgttcagctggagaatgaactggagaacttcactaagcagtttttgccctcgtctaacgaggaatcatag

SEQ ID NO: 43836 - DNA, 1893 bp, Artificial Sequence
  Description of Artificial Sequence: Synthetic coding sequence
atggccgagcccgtgagccccctgaagcacttcgtgctggccaagaaggccataacagctatttttgaccagctgttagaatttgtgaccgaaggctcacatttcgttgaggcaacatataaaaaccccgagctagaccggatcgctacagaggatgatctggtggagatgcaaggatataaagacaaacttagcatcatcggtgaggtgctgtcacgtcggcatatgaaggtcgccttttttgggagaacgtcctccgggaagtccagcgtcatcaatgccatgctctgggacaaagtgctgccgagtggaattggacacatcaccaattgtttcctctctgtggaaggaactgatggagataaagcctatctaatgacagagggctctgatgaaaaaaagtctgtgaaaacggtgaaccagttggcgcatgcactccatatggataaggacctgaaggctggatgtcttgtcagagtcttctggcctaaagctaaatgtgctctgctgcgggacgatctcgtcttggttgatagcccaggaaccgacgttacgacagagctggatagttggattgacaagttctgtctcgacgcagacgtgtttgtgctggtggctaactccgaatctacgctgatgaatacggaaaagcatttcttccacaaggtgaacgagcggctgagtaagcccaacatttttattctaaacaatcgttgggatgctagtgcatccgaacctgaatacatggaagatgtcagaagacagcatatggaaagatgcctccactttctggtggaggagctaaaggtcgtgaacgcgcttgaggcacagaacaggatattctttgtgagcgcaaaagaagtgctttcagccagaaagcagaaggcccagggcatgccagagagcggtgtggcactcgcagaagggttccatgcaaggcttcaagaatttcagaactttgaacagatctttgaagagtgcatctcacaaagcgccgtgaagacaaagttcgaacagcatacgattagggctaagcagatcttggctacagtgaaaaatatcatggactcagttaatctggccgccgaggacaagagacactacagcgttgaagagcgggaggaccagatagataggctggactttattaggaatcagatgaacctgctaaccctggacgtgaagaaaaagataaaggaggttaccgaagaagtggctaataaagtgtcgtgtgccatgacagacgagatttgtagactctcagtcttagtcgatgaattctgctccgagtttcaccccaatcctgacgtgctgaagatctataagtcgttgccaaggtcccttgcgtccactccaaccgcgcccacgactccagcgaccccagacaatgcttcccaagaagagctcatgataacccttgtcaccggcttggcttccgtgacctctaggaccagcatgggaataatcatcgtaggtggcgttatctggaagaccattggttggaagctcctgtccgtcagcttgacaatgtatggagcactctacctgtatgagagactgtcatggacaacacatgcaaaagaacgagctttcaagcaacaatttgtcaactatgccaccgagaagttgaggatgatcgtttcttcaactagcgccaattgtagtcaccaggtaaaacaacagattgcgactacttttgcaagactatgccagcaggtggacatcacacaaaagcagctggaggaggagatagccagactcccaaaggagatcgaccaactcgaaaagattcagaataattccaagctcttaagaaataaggcagttcagcttgaaaacgaacttgagaattttaccaaacagtttcttcctagctccaatgaggagagttag

SEQ ID NO: 43837 - DNA, 468 bp, Artificial Sequence
  Description of Artificial Sequence: Synthetic coding sequence
atggccgagcccgtgagccccctgaagcacttcgtgctggccaagaaagccatcacagccatattcgaccagctcctggagttcgtaactgagggctcacactttgtcgaggccacctacaagaaccccgagttggatcgcattgccacagaggatgacctggtggagatgcaggggtataaggacaagcttagtatcatcggtgaggttttgagcagaagacatatgaaggtggcattttttgggcgcacaagttccggaaagtcctccgtaataaacgctatgctttgggataaagtgttgccaagcggtattggccacattactaactgtttcttgtcggtggagggaacagatggcgacaaggcatacctgatgactgaggggtccgacgaaaagaagtctgtcaagaccgtgaaccagctggctcatgcccttcacatggataaggatctaaaggccggctag

SEQ ID NO: 43838 - DNA, 2226 bp, Artificial Sequence
  Description of Artificial Sequence: Synthetic coding sequence
atggccgagcccgtgagccccctgaagcacttcgtgctggccaagaaggccattactgccattttcgatcagctgctcgaattcgtcaccgagggtagccactttgtggaggctacctacaaaaatcctgaactggaccgcatcgcaactgaggacgacttagtggagatgcaagggtataaagacaaacttagtattatcggagaggtgctatcccggcgccacatgaaggtggcattttttggccgaacctcatctggtaaatcaagtgtcatcaatgccatgttatgggacaaagtgttgccctccggtatcggtcatatcactaactgtttcttatccgtggagggtacagatggagataaggcttacctgatgaccgaagggtccgatgaaaaaaagtctgttaagacagtcaaccagctggcccacgcactacatatggacaaggacctcaaagccgggtgtctggtccgcgtgttctggcccaaagcaaaatgcgccttgttacgggatgacctggtcctagtagactcacccggcactgacgtgaccaccgagctggatagttggatcgacaagttctgcctggatgccgatgtttttgtgctcgtagctaatagcgaaagcactctcatgaacaccgagaagcacttcttccacaaggtaaacgaaaggctgtctaaacccaatatcttcatcctgaataatagatgggatgcatcagcctcagagcctgaatacatggaagacgttcgcagacagcacatggagcgatgccttcactttttagttgaggagttgaaagtggtcaatgccctcgaggcccagaacagaattttttttgtgtctgcaaaggaagtgctcagcgcacgcaaacagaaggcgcagggcatgcctgaatctggcgtcgccctggccgaaggatttcatgcgaggctgcaggagttccaaaacttcgagcaaattttcgaagagtgtatctcccagagcgctgtgaaaacgaagttcgagcagcataccattcgagcaaaacagattctggccaccgttaagaatattatggacagtgttaatctggctgcagaggacaagagacattattcggttgaagaaagagaggaccaaattgaccgcctggacttcattcgcaatcagatgaacctgctgacactcgatgttaagaaaaaaatcaaagaagtgacagaagaggtggctaacaaagtgtcatgcgctatgacggacgagatttgtagactgtccgtgctggtggatgaattctgctctgagttccatcctaaccccgatgtactgaaaatctataaatcggagttaaacaaacacatcgaagacgggatgggccggaatctggctgaccgttgtacagatgaagtaaatgcactcgtcctgcaaacccagcaagaaatcattgagaacctgaaaccactcctccccgccggcatccaggataagctgcataccctgatcccctgcaaaaaattcgacttatcttataatctgaattaccacaagctgtgcagcgactttcaggaagacattgtctttccgttcagcctcgggtggtcctctctggtccatcgattcctcggacctaggaacgctcaacgagtgctacttggcctgagtgaacctattttccagctgccccgttctctagcgagtactccaaccgcacctaccaccccggctacgccggacaacgcatcccaggaggaactcatgatcaccctggtgaccggactggcctcggttacgagtcgaacaagtatggggatcataattgtggggggagtaatctggaaaactatcggctggaaactgttatcagtttcactcaccatgtatggtgccctgtatctatatgagcgactttcctggaccacacatgccaaagagcgggccttcaaacaacaattcgtcaactatgcaaccgagaagctgcggatgatcgtgagctccacttccgcaaactgttcgcatcaagtgaaacagcagatcgccaccacttttgctaggctctgccagcaggtggacattactcaaaaacagttggaagaggagatcgctagactgccaaaggaaatcgatcaactagagaagatccagaataacagtaaactccttcgtaataaagcggtgcagctcgagaatgaactagaaaacttcacaaagcagttcctgccaagttcgaacgaggagtcttag

SEQ ID NO: 43839 - DNA, 1344 bp, Artificial Sequence
  Description of Artificial Sequence: Synthetic coding sequence
atggccgagcccgtgagccccctgaagcacttcgtgctggccaagaaggcgataaccgctatattcgatcagctcctggaatttgttacggagggctcacactttgtggaagctacatacaagaacccggagttggaccggatcgctaccgaggacgacttggtggagatgcaaggctataaagacaagctctctattatcggcgaggtgctatcacggcggcacatgaaggttgcatttttcggcaggaccagctcaggaaaatcctccgttataaacgccatgctgtgggacaaggtactgccaagcggtattggacacataaccaactgtttcctctcggtagagggaactgacggcgacaaagcctacctgatgacagagggttcggacgagaagaagagtgttaagactgtgaatcagctcgctcatgctctgcatatggacaaggacttaaaggccggctgtctcgtcagagttttctggcctaaagccaagtgtgcccttctccgggacgatctagtcctagtggattcacccggaactgatgtgacgaccgagctggacagctggatcgataaattctgtctggatgccgatgtgttcgtcctggtggcaaactcggagtctaccctgatgaacactgaaaagcactttttccacaaagttaatgaaaggctgtcaaagccaaatatctttattttaaacaataggtgggacgccagtgcctccgagccagaatatatggaagatgtgcgccgacagcatatggagaggtgccttcatttcttggtcgaggagctgaaggttgtgaacgcgctggaggctcagaataggatcttctttgtgagtgccaaagaagtcctgtccgcacgtaagcaaaaggcgcagggaatgccggagagcggtgtcgctcttgccgaaggatttcatgcacggctgcaggagtttcagaactttgagcaaattttcgaagagtgcatctctcaaagcgcagtaaaaactaagttcgagcagcacacaattcgggcaaagcaaatacttgccacagttaagaatattatggactctgtgaatctcgcagccgaagacaagcggcactattcagtggaagagcgcgaagatcagatagacaggctagacttcatccggaaccagatgaatctacttaccctcgatgttaagaaaaaaattaaggaggtgaccgaggaggtggcaaataaggtgtcatgcgcgatgactgacgaaatctgtagactgagcgtcctggtggacgaattttgcagcgaatttcacccgaaccctgatgtgctcaagatctacaaatctaaaaagaagaagtag

SEQ ID NO: 43840 - DNA, 4011 bp, Artificial Sequence
  Description of Artificial Sequence: Synthetic coding sequence
atgatggagatccagatggacgagggcggcggcgtggtggtgtaccaggatgactactgctccggctctgtcatgagcgaaagggtttccgggcttgccgggagtatctaccgggaatttgagcgtctcatacattgctatgacgaggaagtagtgaaggagctgatgcccctggtcgtcaatgttctagaaaatctggattccgtgctgagcgaaaatcaggagcacgaagtcgagctggagctgctaagagaggataatgaacagctgctgacccagtacgagagagagaaggcgctgaggcgccaggcggaagagaagtttatcgaattcgaggacgctctagagcaggagaagaaggagctgcagatccaggtcgagcactacgagttccaaacgcgtcagctggaattgaaagccaaaaattacgcggaccagatctctagactggaagagcgggagagcgagatgaagaaagagtacaacgcactccatcagagacataccgagatgattcagacctacgtagagcacatagaacgatccaagatgcagcaggttggcggtaacagccaaacggagtcaagcctgccaggcaggcggaaggaaagacccactagtttgaacgttttcccactcgccgatggcaccgtgcgggcacaaattggaggcaagctcgtgccagcgggagatcactggcacttaagcgatttgggacaactgcagtcatcttcatcttatcagtgtccgcaagatgagatgagtgaaagcggacaatcgagcgccgcagccaccccaagtacgacaggaaccaaatccaacaccccaacatcctcggtcccatcggcagccgtgactccgcttaatgagtcactgcagcctctgggcgattacggtgtgggctcaaagaactctaaacgggctcgagaaaagcgagatagccgtaacatggaggtacaagttacccaagagatgaggaatgtttcaatcgggatgggatcctccgatgaatggtccgacgtgcaggatatcatagactcaacgcctgagctggacatgtgccctgagacgcgtctcgaccgcaccggtagcagcccgactcagggtatcgtgaataaggccttcggcattaatacggacagcctttatcatgagctgtctaccgctggatccgaggtaatcggtgacgtggacgagggtgctgacctgttaggcgagttctccgttcgggacgacttttttggcatgggaaaagaggttggcaacctgctgctggagaactcccagctgctcgaaactaaaaacgccctgaacgttgtgaaaaacgatctgattgcaaaggtggaccagctgtccggcgagcaagaagtgctgcggggcgagctggaggcagcgaagcaagcaaaagtgaaactcgaaaaccggatcaaggaactggaagaggagctaaaaagagtaaaatctgaggctattatcgcccgtcgagagcctaaggaggaggccgaggatgtgtcttcttacttatgtaccgagtctgacaagatacccatggctcagaggaggcgctttacgcgcgtggagatggctcgggtgcttatggagagaaatcagtataaagagcgcttaatggagctgcaggaagcagtgcgatggaccgagatgatcagagcaagtagggaacacccctccgtgcaggaaaaaaaaaagagcactatctggcagtttttctctagacttttcagctctagttcctccccccctccagccaaacgaccttatcccagtgtaaacattcactataagagtccaacgaccgctgggttctcccaacggagaaatcatgcaatgtgccctatctcagcgggttctcgcccacttgagtttttccctgatgatgattgtacaagcagtgccagaagagaacagaaacgtgaacagtataggcaggttcgcgaacatgtgcgcaatgatgacggccgcctgcaggcgtgcggttggtcgttaccggccaaatataagcagctttcacccaacggcggccaagaggacacccgtatgaagaatgtccctgtgcccgtctactgccgcccactcgtagaaaaagatcctactatgaagctttggtgcgcagccggagtgaacctcagcggttggagacctaacgaggatgatgcagggaacggggtgaaaccggcacccggaagggatccccttacttgcgatagggaaggtgatggggagcccaaatctgcccatacatccccagaaaaaaagaaggccaaagagttgcctgagatggatgccacctcctcacgagtttggattctgacaagcaccctgactacttccaaggtggtgattatagatgctaaccagcccggaaccgttgtcgatcagttcaccgtatgcaacgctcacgtgctgtgcatttcctctatcccagccgcgagcgacagtgattaccctccgggtgaaatgttcctggactctgatgttaacccagaagatcctggcgccgatggtgtgcttgcagggatcacccttgtcggatgtgccaccagatgcaatgtccccaggagtaactgcagctcacgtggcgatacccctgtcctggacaaagggcaaggcgaggtggccaccatcgccaatggaaaagtcaatccaagtcagagtaccgaggaggccacggaggctacagaggttcccgaccctggcccgtctgaacctgaaactgcaacccttagaccaggccctctcaccgaacacgttttcactgacccagctcccaccccttcaagcggccctcagcctgggtctgaaaatggcccagagcccgattccagctcgacgcggccagagccggaaccatccggagatcctacgggtgccggatcatcagctgcccctaccatgtggctgggggcccagaatggctggctgtacgtgcacagcgctgtggctaattggaagaaatgtctacacagtattaagctaaaagattctgtattgtccctggttcacgtcaaaggtcgggttctcgttgcactggccgacggcacactcgccatcttccatagaggcgaagacggtcagtgggatctttcgaattatcaccttatggacctgggccacccccatcacagcataagatgtatggccgttgtgtatgacagggtatggtgtggctacaaaaacaaagtgcacgttatccagcctaagacaatgcagattgaaaagtccttcgacgctcacccccgtagagaatcacaggtgaggcagttggcttggattggggacggcgtctgggtgtcgatccggctcgatagcaccttgcggctataccacgctcatacccatcagcacctccaggatgtggacatcgagccctacgtgtcaaagatgcttggtacaggaaagctggggttttcttttgtcaggatcaccgctttacttgtggccggctctagactatgggttggtactggaaatggagtggttatcagtatcccactgaccgaaaccgtcgttttgcatcgaggtcaattgttgggtttacgtgctaacaagacctccccaacatctggtgaaggcgcaagacctggagggattattcacgtttacggcgatgactcctctgacagagcagcttcaagtttcataccgtattgtagcatggcgcaagctcaactatgctttcacggtcaccgggatgccgtgaaattctttgtttcagtgcccgggaacgtgcttgcgacattaaacgggagtgttctggatagccctgctgagggcccgggtcctgcggcgccagcaagtgaggtggagggtcagaaattgagaaatgtgctggtgctgtctggcggtgagggctatattgactttcggatcggcgatggggaggatgacgagacagaggaaggggccggtgacatgtctcaggtgaagcctgtactgagcaaagccgagaggagccacattattgtgtggcaggtatcctacactcctgagtag

SEQ ID NO: 43841 - DNA, 3993 bp, Artificial Sequence
  Description of Artificial Sequence: Synthetic coding sequence
atgatggagatccagatggacgagggcggcggcgtggtggtgtaccaggacgattattgtagtggatctgtaatgtctgagcgagtaagcggacttgctggatcaatctatagggagtttgagcgcttgatacactgttatgatgaggaagttgtgaaggagttgatgccacttgtggtgaacgtactggaaaacctggattcagttctgtctgagaatcaggagcacgaagttgagctcgagttactgcgcgaggataacgaacagctgctcactcagtatgagcgggaaaaagcactcagacgccaggccgaagagaagttcatcgagttcgaggacgccctggagcaggaaaagaaggagcttcagatccaggtggaacactatgagttccaaacccgccagcttgaactcaaggcgaagaactacgcagaccagatcagccgactggaggagagagagtctgagatgaagaaagaatacaacgcactgcatcaaagacacaccgagatgattcagacttacgtcgaacatatcgaaagatccaagatgcaacaagtgggaggcaacagccaaaccgagagctcactccctggacggcgtaaagagaggccaacatccctgaacgtttttcccctggccgatggcaccgtccgggcacagatcggaggcaaactcgtgcctgccggggaccactggcaccttagcgacctgggccagttgcagtctagcagcagctaccagtgtcctcaggacgaaatgtctgagtcaggtcaatcctccgcagcggccacccctagtacaacagggaccaaaagcaatacgcctacatcatctgtgccatccgcagccgtgacacccttgaatgaaagcctccagccactgggggactatggtgtcggttccaagaactcaaaaagagcacgggaaaaaagagatagtcggaatatggaggttcaggttactcaggaaatgcggaacgttagtattggaatgggcagttcagatgagtggagtgatgtgcaggacattatcgattccacacccgagctcgatatgtgccccgagacaaggcttgatcggaccggatcgagccctacacagggaatcgtaaataaagccttcgggattaacacggactcgctctatcacgagctgtcaactgccggctcagaggtgataggcgatgtcgatgagggggcagacttactcggtgaattctctggaatgggaaaggaggttggaaatctgctgttggagaatagccagctgcttgagactaagaacgcgctgaatgtggtcaaaaacgacctcatagcaaaagtggaccagttgtctggtgaacaagaggttctcaggggggagcttgaggcggcaaagcaggctaaagttaagcttgagaataggattaaggagctggaggaggaactgaagcgcgtgaagtcagaagcaatcattgcgcgccgtgagccgaaggaggaggcagaggatgtgtcctcttacctctgcactgagagcgataagatacctatggcccagcgacggaggtttacgcgggtggaaatggcgcgcgttctgatggagagaaaccagtacaaagagaggctgatggagctccaggaagcagttaggtggactgagatgatccgagctagccgagaacacccatccgtccaagagaagaaaaagagcaccatttggcaattcttcagccgcctgtttagcagttcttcatctcctcctccagcaaaaagaccctatccttccgttaacattcattataagagccccactaccgccgggttctcccagcggcgaaaccatgctatgtgtccaatttccgcagggagcagacccctcgagttcttccccgatgatgactgcacaagttcggcaagacgtgaacaaaaaagggagcagtacagacaggtgagggaacatgtgcgtaatgacgatggccgactccaagcatgcgggtggtcgctgcccgctaaatacaagcagttgtctcctaacggagggcaagaagataccagaatgaaaaacgtgcccgttcctgtctattgcagacctttagtggagaaagaccctaccatgaagctgtggtgtgcagccggtgtcaacctatctggctggaggcctaatgaggatgatgctggcaatggtgtgaagcccgcccctggcagggaccccttaacttgtgaccgagagggagacggcgaaccaaagtccgcccatacctctccagagaagaaaaaggcaaaggagctgcctgaaatggacgcaacttcgtctcgggtctggatccttacgtccacactgacgacatcaaaggtagtcattattgacgcgaaccagccaggaaccgtggtcgaccagttcactgtttgcaatgcccacgttctttgcattagcagtattcccgcagctagcgattcggactacccaccaggcgagatgttcctggactccgatgtgaaccccgaggatcccggagcggacggggttttggcgggcattacccttgttgggtgtgcgaccaggtgtaatgtcccccgcagcaactgctcttccagaggcgacacaccagttctcgataagggccagggggaagtcgccactatcgctaatggcaaagtaaatccaagccagagcaccgaggaggctacagaggccacggaggtgcccgatcccgggcctagcgaacccgagactgccaccctccggccgggcccactgaccgagcacgtgttcactgacccagctcctacaccatcttccgggcctcagccaggtagcgaaaacggaccagaacccgatagtagctccacccggcccgagccagagccctcgggggatccgactggggctgggagtagcgcagctcccaccatgtggttaggtgcacagaatgggtggctgtacgtgcatagcgcagttgccaactggaagaagtgcctccactctattaagttgaaggattcagtgctgtccctggtacacgtgaaaggcagagtgttagtggctcttgcggatggaacactcgccatatttcacagaggggaggacggacagtgggacttgtccaactaccatctgatggacttgggccatccccaccattcgatccgatgcatggcagtcgtgtatgatagagtttggtgtggttacaagaataaggttcacgtcattcaacccaagaccatgcagatcgagaagagcttcgacgcacatccaagaagagagagtcaagtccgccagctggcctggattggcgatggagtgtgggtcagtataagactggactccaccttgcggctatatcacgcccacacccatcagcacctgcaggacgtcgacatagaaccctacgtgagcaagatgctcgggactggcaaacttgggttcagtttcgtgcgcataactgctttgctggtcgcaggtagcaggctctgggttgggacaggtaacggagtggtgatatcaataccactgaccgaaaccgtggtgctccaccgcggacagctcctgggcctcagagctaataagacctctcccacatctggcgaaggcgccaggcctgggggtataatccatgtctacggtgatgattccagtgatcgtgctgcgagctcctttatcccttactgttcaatggcccaagctcagttgtgctttcatggacaccgtgatgctgtgaaattcttcgtgtctgtcccgggcaacgttttagccactttgaatggctccgttctcgacagcccggctgaagggcctggccccgccgcccccgcctcagaagtggaaggtcagaagctcagaaatgtcctggtactttccggcggggagggatatattgatttccggattggcgacggcgaagatgatgaaactgaagagggcgctggcgatatgtctcaggtgaaacccgtactgtcgaaagcagagcggagtcacataattgtttggcaggtatcttatacacccgagtag

SEQ ID NO: 43842 - DNA, 1569 bp, Artificial Sequence
  Description of Artificial Sequence: Synthetic coding sequence
atggccttcctggacaaccccaccatcatcctggcccacatccggcagtctcacgtaacctccgacgacacagggatgtgtgagatggtacttattgatcatgacgtggacctggagaagattcacccgccctccatgcctggcgattctggatcggagattcaaggatccaatggtgagacccagggatacgtatacgcccagagtgttgacataacttcgtcctgggatttcggcattagaagaagaagcaacaccgcccaaagactggagagactgcgcaaggagcgtcagaaccagattaaatgcaagaatatacagtggaaggagcgcaacagcaagcagagcgcacaggagctgaagtctctgtttgagaagaaaagcctcaaagagaagcccccaatttcagggaaacaaagtatcctcagcgttagattggaacagtgtccccttcaactgaacaatcctttcaacgagtattcgaagttcgatggaaaaggccacgttgggaccacagccacaaagaaaattgatgtgtacctcccactgcattcgagccaagatcgcctattacccatgacggttgtgaccatggcttcagcacgggtgcaggacctcataggtcttatctgttggcaatacacctcagagggtcgggagcctaagttgaatgataacgtttcagcatattgcctccatatagcagaggacgatggggaagttgacactgattttccacctctcgactccaatgagcctattcacaagtttgggttcagcacccttgccctggttgagaagtactcatcccctggactgacttctaaggagagtttgtttgtccgcattaacgctgcacatggcttttctctcatccaggtggataacacaaaggtgaccatgaaagaaattttgctgaaagcagtaaagagacggaaggggtctcagaaagtgtccggtccccagtaccggcttgagaagcagagtgaacctaacgtggccgtggacttggattccacacttgaatcgcagtcggcttgggaattctgcctggtgcgggaaaattcctctcgggccgacggtgtgtttgaagaagacagccagatcgatattgcaaccgtccaggacatgttgagtagtcatcactacaaatcttttaaggtcagtatgatacacagactgaggttcaccaccgatgtccagcttggaattagcggcgacaaggtggagatcgatccagtcactaaccagaaggcttccactaagttttggatcaagcagaaacctatttccatcgacagtgacctgctgtgcgcctgcgacctggcagaagagaaatctccaagccacgcaattttcaagctcacatatctctcaaatcacgattacaaacacttgtactttgagtccgatgctgcaactgtgaacgaaattgtcctcaaggtcaactacatccttgagtctcgagcttcaaccgcacgggcggactacttcgcccagaaacagcgaaagttgaatcgcaggaccagcttcagcttccagaaggagaagaaatcaggccagcaatag

SEQ ID NO: 43843 - DNA, 1461 bp, Artificial Sequence
  Description of Artificial Sequence: Synthetic coding sequence
atggccttcctggacaaccccaccatcatcctggcccacatccggcagtctcacgtaacatccgatgatacagggatgtgcgagatggtcttaattgatcatgacgtagatctggagaaaattcacccacccagcatgccaggcgactcaggttccgaaatccagggatctaatggggagactcaggggtacgtatatgcgcagagcgtggatatcacttcctcatgggatttcggtatcagacgccggagcaacacagcccagcggcttgaaaggctgagaaaggaaaggcagaatcaaattaagtgcaagaacattcagtggaaggaacgaaatagcaagcagtcggctcaggagctcaagagtctcttcgaaaagaaatcactcaaggagaaaccgcctatatctggaaagcagtccatactgtcagtgagattggagcagtgccctctacagctgaataatcccttcaacgagtatagtaagtttgacggcaaaggacatgtcggcacaacggcgaccaaaaagatcgacgtctacctgccactgcatagcagtcaggacaggcttctaccaatgacagtggtcacaatggcatctgcccgggtgcaagaccttatcggcctgatatgctggcaatacacatccgaggggagggagcccaagctaaatgacaatgtgtctgcatattgcctgcacatcgctgaggacgacggagaagtagacacagatttccctccactagattcaaatgagcctatccataaattcgggttctccaccctggccctggtagagaagtacagttcacccgggctaacctcaaaggagtcgttgtttgttcggatcaacgctgcacatggattctccctcatccaggtcgacaacaccaaagtcacaatgaaggagatcttactgaaggccgtaaagaggaggaaaggcagccaaaaggtctccggaagccgggcggacggagtttttgaagaggattcccagatcgatatcgcaacagtgcaggacatgctcagcagccaccactacaaatcatttaaggtgagtatgattcaccgcctgagatttaccaccgatgtgcagctgggaatttctggcgacaaggtggagatagaccccgttacaaaccagaaggcctcaactaagttttggattaagcaaaagcccatcagtatcgactcggatctgctctgcgcctgtgatcttgctgaagagaagagtcccagtcacgcaatcttcaagttgacctacttatccaatcacgattacaaacatttatacttcgaatcggatgctgctaccgttaacgagattgtgttgaaagtaaattacatcctagaatcgcgagcttccactgcaagggctgactactttgcccagaaacagcggaagttgaataggaggacttcatttagcttccaaaaagagaagaagtcgggccaacagtag

SEQ ID NO: 43844 - DNA, 399 bp, Artificial Sequence
  Description of Artificial Sequence: Synthetic coding sequence
atggccttcctggacaaccccaccatcatcctggcccacatccggcagtctcacgtgactagtgacgatactgggatgtgtgaaatggtgctcatcgatcatgacgtggacctggaaaaaatccaccccccaagtatgccaggtgacagcggctctgagattcagggtagcaacgcgcagcgtttggaaaggttaagaaaggagaggcaaaaccagattaagtgtaagaatattcaatggaaggagcgtaactcaaaacagtctgcgcaggagctcaaaagcctatttgagaagaagagcctcaaggagaaacccccaatcagtggtaaacagtcgattctgtctgtgcgcctggaacaatgtcccttgcaattgaataacccatttaacgagtattag

SEQ ID NO: 43845 - DNA, 708 bp, Artificial Sequence
  Description of Artificial Sequence: Synthetic coding sequence
atgaccgtggtgaccatggccagcgcccgggtgcaggacctgatcggcctcatctgctggcagtatacctcagaagggagggagcccaaacttaaaaatgcggcccacggattctccctgatccaagtggacaacacgaaagtgaccatgaaggaaattctcctcaaggctgtcaagcgtcgaaagggttcccagaaagtgagcggtagccgcgccgatggagtctttgaggaagattcccaaatagatatagctaccgtccaggatatgctatcatcacaccattataagtcctttaaagtatcaatgatccatagactccggtttaccaccgatgtgcagttgggcattagtggcgataaggttgaaatcgatcctgtgaccaaccaaaaagcctccacaaaattctggataaaacagaagcccatcagtattgattcggacctgttgtgtgcctgcgatctcgctgaagagaagtccccatctcatgcaattttcaagttaacttatctctctaatcacgattacaagcacctgtatttcgagtctgatgctgcaacagttaacgagattgtccttaaggtgaattacatactcgagtctcgcgcctctaccgccagggccgactattttgcgcaaaagcagcgcaagctcaatagaaggactagcttcagttttcagaaggaaaaaaagtctggacagcagtag

SEQ ID NO: 43846 - DNA, 1569 bp, Artificial Sequence
  Description of Artificial Sequence: Synthetic coding sequence
atggccttcctggacaaccccaccatcatcctggcccacatccggcaaagtcacgtgacgtcagacgacacgggcatgtgtgaaatggtcctgatcgaccatgatgtggatctggagaagatccacccacccagcatgccaggcgacagcggcagcgagatccagggaagcaatggtgagactcaaggctatgtgtatgctcaaagtgtggatatcacgagctcctgggatttcggcattagacgcaggagtaataccgcacaaagactcgaacgactgaggaaggaacgccagaaccagattaagtgcaaaaatatccaatggaaggagcgtaactctaaacagtctgcgcaggaattgaaatccctatttgaaaagaaaagcctgaaggaaaagcccccaatctccgggaagcagtctatcctgtcagtacggctggagcagtgtcctctgcaactgaataatcctttcaacgaatattcaaagtttgatggtaagggacacgttggcacaacagccacaaaaaagattgatgtatatctgcctctgcacagttctcaggataggctgctgcccatgacagttgtcaccatggcctcagccagggtccaggatctgatcggtctgatctgttggcagtatacatccgaagggcgcgaaccgaagctgaacgataatgtatcagcttattgtttgcacatcgcagaagacgatggcgaggttgacacagatttcccccctcttgatagcaatgagccaattcacaagtttggcttctcgacattggcattagttgagaagtactcgtctcccggacttacgtcaaaggaaagcctctttgtgaggataaacgccgctcacggattttccctgattcaggtggacaatacaaaagttactatgaaggagattttgttgaaggcggttaagcgtcgcaaaggctcacagaaagtcagcgggccacagtatagactggaaaagcagtctgagccgaatgtggccgtggacctggatagcactttagagtctcagtccgcgtgggaattctgcctggttagagaaaacagctctcgagccgatggggtgtttgaggaggacagtcagatagatattgcaacagtgcaggacatgttaagctcgcaccattataagtcattcaaagtatccatgatccaccgcttgagattcaccacagatgtacagctgggcatctcaggtgacaaggtagaaattgatcccgttacaaaccaaaaagcctctacaaagttttggatcaagcagaagcctattagcatcgactcagatctgttgtgtgcatgcgacctggccgaggaaaaatccccctctcacgccatcttcaagctgacctacctcagtaaccatgactacaaacatctctattttgaatcagacgccgctaccgtgaatgagattgtgctgaaagttaattacatccttgagtcacgtgcttcaacagctcgggccgactacttcgcacaaaaacagaggaaattgaaccgtaggacatccttcagtttccaaaaggagaaaaaatcaggacagcagtag

SEQ ID NO: 43847 - DNA, 993 bp, Artificial Sequence
  Description of Artificial Sequence: Synthetic coding sequence
atgaccgtggtgaccatggccagcgcccgggtgcaggacctgatcggactaatctgttggcagtacacttctgaggggcgcgagcccaaactgaacgacaacgtgtcggcttactgccttcacatagcggaggacgatggtgaagttgatacggacttccccccattggatagcaatgaacctatacataagtttggtttctccaccttggccctagtggaaaagtatagtagcccggggctgactagtaaagaatcactttttgttcggatcaatgcggcacacgggttctcactcattcaggttgacaacacaaaggttaccatgaaggagattttactgaaggcggtgaaaaggaggaaggggagtcagaaggtgtctgggccgcaataccgactcgaaaagcagtctgagcctaacgtggctgttgacctagactctacactcgagtctcagtctgcctgggagttctgcctggtgagagagaatagttccagggccgatggagtttttgaggaggacagccagattgacattgccaccgtccaggacatgctctctagccatcactataaatcttttaaggtgagtatgattcatcggctgaggtttactaccgacgtgcagctgggcatttcaggggataaggtggaaatagatcccgtaacgaatcaaaaggcctcaacgaagttttggatcaagcaaaagccaatatctatcgactcagatctgctgtgcgcttgcgatctggccgaggagaaaagcccatctcacgccatttttaagctgacgtatctttccaaccatgactataaacacctgtacttcgagtctgacgctgccactgtaaatgaaattgtgctcaaagtgaactatattctggagtcccgggcctccaccgctagagcagattactttgcccagaagcaacggaagctcaacagaaggacgtcattctcttttcaaaaggaaaagaagagcggccaacagtag

SEQ ID NO: 43848 - DNA, 678 bp, Artificial Sequence
  Description of Artificial Sequence: Synthetic coding sequence
atgcccggcgacagcggcagcgagatccagggcagcaacggcgagacacaggggtatgtctacgcacagtcagtggacatcaccagtagttgggattttgggatccgtcgtaggagcaacacagcccaaaggctggagcggttacgtaaggagcgccaaaatcagattaaatgtaaaaacattcagtggaaggagagaaactccaaacagtcagcacaggagcttaagtcgcttttcgagaagaaaagcttgaaggagaagccaccgataagcgggaaacagtccattttatcggtgcgtttggagcagtgccctcttcaactgaataatccttttaacgaatactctaagttcgatggaaaacactgttcttctctgtgccggatcattatgaacaagtgcttccttcagagcttggcccttaacagttcccttcaacgcaagtccctgaaaactctgcagaagtccatgaaaccaccaaggaatgtcgcaaattcagagaaaggccatgtggggacaacagccaccaaaaagattgacgtttacctgccactgcactccagccaagaccgactcctgcccatgaccgtggtgactatggctagtgcccgggtccaggatctgatagggctcatctgctggcagtatacatccgagggtcgggagcctaagttgtag

SEQ ID NO: 43849 - DNA, 1428 bp, Artificial Sequence
  Description of Artificial Sequence: Synthetic coding sequence
atggccttcctggacaaccccaccatcatcctggcccacatccggcaatctcacgtgaccagtgacgatactggaatgtgtgagatggtgttgatcgatcacgacgtcgatctcgaaaagatccaccctccctctatgccaggcgattcaggatccgaaattcagggcagcaacggtgaaactcaggggtacgtgtatgcacagtcagtagacatcacgagctcttgggattttggtatacgtcgcagaagcaacaccgcccagcgcctcgaaagacttcggaaagagagacagaatcaaattaagtgcaagaatattcagtggaaagaacgtaacagcaaacagtcagcccaagaactcaaaagcctcttcgaaaaaaagtccttgaaagaaaagccaccaatttctggaaagcaatccatcctctccgtcagactggagcagtgtcccctccagctgaacaacccatttaatgaatattcgaagtttgacggcaagggccatgtgggaacaacagctacaaagaagatcgacgtttacctgcctctgcactcctcccaggacagactgctgcccatgaccgtggtcacgatggcgagcgccagagttcaagacctgattggactcatctgctggcagtacacttctgagggccgggagcctaagcttaacgataacgtctctgcttactgccttcatatcgccgaagacgatggtgaagtcgacactgactttccccctctggactcgaatgagcctatccacaaatttggcttttctactcttgcacttgtcgagaaatatagtagccctggtctcaccagcaaggagagtctgttcgttcgcattaacgccgctcatggattttccttgattcaggtcgacaacacgaaggtgaccatgaaggaaatcctgttaaaagccgtcaaacgcagaaaagggtcccaaaaggtgagcggtcctcagtaccggttggagaaacagtcagagccgaacgtggctgtagacctcgattctaccctcgagagtcagtctgcatgggagttctgccttgtgagagagaattcaatttccggcgacaaagtagagatagacccggtcaccaatcagaaagcttcaactaagttttggattaagcagaagcctatctcgatagattctgacttactctgcgcctgcgacctggccgaagaaaagagccctagccacgctatcttcaagctgacgtatctcagcaatcacgactacaaacatctctatttcgaatctgatgcagctaccgtcaatgaaatcgtcttaaaagtgaattacatactggaaagccgcgctagtacggctagggccgattatttcgcacagaagcaacggaaactaaatcgcagaacgagtttttcattccagaaagagaagaaatcaggccagcagtag

SEQ ID NO: 43850 - DNA, 993 bp, Artificial Sequence
  Description of Artificial Sequence: Synthetic coding sequence
atgaccgtggtgaccatggccagcgcccgggtgcaggacctgatcggattgatctgttggcagtatacctcagagggccgggaacctaaactgaacgataatgttagcgcatattgtctgcacatcgccgaggatgacggcgaagtcgatacagattttcctcccctcgactccaacgaacctattcataagtttggcttttcaacgcttgcccttgtggaaaagtattcatccccggggctgaccagcaaggaatccctctttgtcaggattaacgcagcccacggcttcagtctgatacaggttgacaatactaaggtcaccatgaaggagattttgctaaaggccgtcaaacgcagaaagggatcacagaaggtttccgggcctcaatatcgtttggagaaacaatctgagcctaatgtcgccgtggacctggattcaaccttggagtctcagagtgcttgggagttctgtctggtgcgggagaactcttcgagggccgatggagtgttcgaagaagattcgcagatcgacatcgccacagtgcaggacatgttgagttcacaccactataagtcgtttaaagtttccatgatacaccgcctcagattcacaaccgatgtccagctcgggatttccggtgataaggtggaaatcgaccccgtgaccaatcagaaggcctcaaccaagttttggatcaaacagaaacccatctccattgactcagatttactctgcgcatgtgacctcgcagaggaaaaatccccttcgcatgcaatcttcaaactcacatatctcagtaaccacgactacaaacacctgtacttcgagagtgatgccgcaaccgtaaacgaaattgtgctgaaagtgaattacatactagaatccagagccagcacggcgcgcgccgattactttgcccagaagcagcgtaagctcaatcgccggacaagttttagctttcagaaggagaaaaagtccggtcagcagtag

SEQ ID NO: 43851 - DNA, 282 bp, Artificial Sequence
  Description of Artificial Sequence: Synthetic coding sequence
atggccttcctggacaaccccaccatcatcctggcccacatccggcaatcccacgtcacgagtgatgacaccggcatgtgtgaaatggttctaatcgatcatgacgtcgatctggagaagatacaccctccttccatgcccggggatagtggatctgagatccaagggagtaatggtgagacacaggggtacgtgtatgctcagagcgtggatataacatcttcttgggactttggaattaggcggcggagtaacactgcccaacggcttgaaaggctgtag

SEQ ID NO: 43852 - DNA, 285 bp, Artificial Sequence
  Description of Artificial Sequence: Synthetic coding sequence
tgaaagagcttcaaggtgagcatgatccaccggctgcggttcaccaccgatgtgcaactgggccacgccattttcaagttaacgtacctaagcaatcacgattataagcacttgtattttgagagcgatgccgcaaccgtgaatgagattgtgcttaaggtaaattatattctcgagtcgcgtgcctccactgccagagcagattacttcgctcagaagcaacgtaagcttaaccggcgtacttcattttcctttcagaaggagaagaaatctggacagcagtag

SEQ ID NO: 43853 - DNA, 972 bp, Artificial Sequence
  Description of Artificial Sequence: Synthetic coding sequence
atggccttcctggacaaccccaccatcatcctggcccacatccggcagtcacacgtcacgagcgacgataccggaatgtgtgaaatggtattgattgaccacgacgttgatctggagaagatccacccccctagcatgccaggggacagcggaagtgagatccagggctcaaacggagagactcaggggtacgtctacgctcaatccgtggatattacaagctcttgggacttcggaatccggcggcgttctaacaccgcacagaggctggaaagactgcggaaagaaagacagaaccagatcaaatgtaagaacatccagtggaaagagcgtaattcaaaacagagcgcccaggaattgaaatctttgttcgaaaagaaatctcttaaagaaaaaccccccatctcggggaaacagagcatcctctccgtgcgcctggagcaatgtccactccagctcaacaaccctttcaatgaatatagcaaatttgacggaaagggccacgtaggaactactgccaccaaaaaaattgacgtgtacctgcccctgcattcctctcaggatcgtctcctccctatgacagtggtcactatggcctcggcccgcgttcaggatctcattggccttatctgttggcagtacacctcagaggggcgtgaacctaaactgaatgataacgtctctgcctactgtctacatatagctgaggacgacggtgaggtggatactgactttccccctctggacagcaacgaaccaatacataaatttggtttctccacattggcactggttgaaaagtactccagtcctggactcacctctaaagagtcgctgttcgttcggataaacgcagcgcacggctttagtctaatccaggtggataacacaaaagtgacgatgaaggagatcctcctgaaagcagtaaagaggaggaaggggtcccagaaggtgtctggggcctgcgattag

SEQ ID NO: 43854 - DNA, 1008 bp, Artificial Sequence
  Description of Artificial Sequence: Synthetic coding sequence
atgaaggtggagttcgcccccctgaacatccagctggcccggcggctgcaaacagttgcagtgttacaatgggtgcttaaatacttactactggggcccatgagcattggtattactgtcatgctgatcattcataactacctgtttttgtacattccatatctgatgtggctctatttcgattggcacacacccgaaagggggggaagaaggtcatcctggatcaaaaactggactctctggaagcattttaaggactactttccgatccacctgatcaaaacccaagacctggatccatcccacaactacatctttggatttcacccccacggaatcatggccgtgggggccttcggaaacttctcggttaactactccgattttaaagatttgttcccgggttttacatcttacctccacgttctgcctctgtggttttggtgtccagttttcagagagtacgtaatgtcagtgggacttgtgtccgtgtctaaaaagtctgtgagctatatggtttccaaagagggagggggaaacatctccgtgatcgtgctaggcggtgctaaggaatcactagatgcacatccaggaaagttcactctgtttatcagacagcgcaaagggttcgtaaagatcgccctgacccacggcgcctccctcgtccccgtcgtgagctttggtgagaacgagctctttaagcagaccgataacccggagggaagctggatcagaaccgtgcagaacaagctccagaaaattatgggcttcgcacttccactatttcatgccagaggagtgtttcaatacaactttgggctcatgacataccgaaaagccattcacacggtcgtgggaagacctatccctgtgcgccagacacttaatcccactcaggaacagattgaggagttgcaccagacatacatggaagaactgaggaaactttttgaggagcacaaggggaagtacggaatccccgaacatgagacactagttctgaaatag

SEQ ID NO: 43855 - DNA, 1005 bp, Artificial Sequence
  Description of Artificial Sequence: Synthetic coding sequence
atggtggagttcgcccccctgttcatgccctgggagcggcggctgcagacgctggccgtgctgcaattcgtgttttcctttttggccctcgccgaaatatgtaccgtgggcttcatcgccttgctgttcacccgcttctggctgttgaccgtgctgtacgctgcctggtggtacctcgaccgcgacaagccgcggcaggggggtcgccatatccaagccatccgttgttggacaatttggaagtatatgaaagattattttccaatcagtctagttaaaacagctgagcttgatccaagtagaaactacatcgccgggttccaccctcacggggtcctggcggtgggcgcgtttgccaacctctgtaccgagagcaccgggtttagttcgatcttccctggcattagaccccatttgatgatgttgaccttatggtttcgcgctcctttttttagggactatatcatgtctgccggcctcgtgaccagcgaaaaggagtccgcagcccacattctgaatcgtaaagggggcggcaacctcctgggaattatcgtgggtggagcgcaggaggcattagacgcccggccaggcagcttcacccttctgcttagaaataggaagggtttcgtgagactggccctcacccatggagcaccactcgttccgatcttcagcttcggcgaaaacgatctatttgaccagataccaaatagctctggtagctggctgaggtacatccagaataggctgcagaagatcatgggaatttcgctgcctctattccacgggaggggcgtcttccaatattcgtttgggttaattccataccgacggccgatcaccacagtcgttggtaaacccatcgaagtccagaagacacttcatccctcagaagaggaggtgaaccaacttcaccagagatatattaaagagttatgtaatctctttgaggcacataagttgaagtttaatatacctgccgaccagcatctggaattctgctag

SEQ ID NO: 43856 - DNA, 759 bp, Artificial Sequence
  Description of Artificial Sequence: Synthetic coding sequence
atgaaggactacttccccatcagcctggtgaagaccgccgagctggacccttcaaggaactacatcgctggttttcacccacacggtgtgcttgcagtgggcgcctttgcgaatttgtgtaccgaaagcactggtttcagcagtatctttcctgggatccgaccacaccttatgatgctcactctttggttcagggcacctttttttcgcgactatattatgtctgccggcctcgtgacctccgaaaaggaaagcgcagcacatattctgaatcggaagggggggggtaatctgctgggaataattgtcggaggagctcaggaggccctggacgcccgccctggctcatttacactcttgcttcgcaatagaaagggctttgtgagacttgccttaacccatggcgctcccttagtacccatcttttcttttggtgagaacgacctgttcgaccagattcccaattctagcggatcctggctccggtatattcagaaccgtctgcaaaaaattatggggatttcccttcctctcttccacggtagaggagtgtttcagtactctttcggactcattccctatagacggcccatcactacggtcgtgggaaaaccaatcgaggtgcaaaaaaccctccacccttctgaggaagaggtcaaccagcttcaccagcggtacatcaaagagctatgcaacctgttcgaggcccataagctcaagttcaatattcccgccgatcaacacctcgaattttgctag

SEQ ID NO: 43857 - DNA, 1209 bp, Artificial Sequence
  Description of Artificial Sequence: Synthetic coding sequence
atgcagatgagccccgccctgacctgcctggtgctgggcctggccctagtatttggggagggcagcgctgttcatcaccccccatcctacgtggcccacctggcctctgactttggggtgcgggtttttcagcaggtcgcccaggcttctaaggacagaaatgtggtgttttccccttatggggttgcttctgtattagctatgttacagcttacgactggcggggaaactcagcagcagatacaggcagcgatgggcttcaaaatagacgataagggcatggcacccgccctgcgccacctatataaggagctgatgggcccttggaacaaggatgaaatctcgacaactgacgcaatcttcgtgcagcgagatctgaaattggtgcaaggcttcatgccccatttcttccgcctgtttcgatcgacagtgaaacaagtggattttagcgaagtggagagggctcgattcattatcaatgattgggttaaaacccacaccaagggcatgatctctaatctcctgggaaagggggcggtggatcagctgacgcggctcgtgctcgttaacgccctatacttcaacggtcagtggaagaccccttttcccgactcatctacgcaccggcgattgttccataagtccgacggaagcaccgtctcggtccccatgatggcccaaaccaataaattcaattacacagagtttactacgcctgacggacactactatgatatcttagagctcccataccatggggacactctgagtatgttcatcgcggctccatatgaaaaagaagtgcctctgagcgcattgacaaacattctcagcgcacagctgatctcacattggaaagggaatatgactaggctgcctcgtttactcgtcctcccaaaattcagtctcgagacagaagttgatctccgtaaaccattagagaatctgggcatgactgatatgtttagacagtttcaggccgacttcacatcattaagcgaccaggagcctctgcacgtggctcaagccttacagaaagtcaaaattgaagtcaacgaatctggaactgtagctagctcttctacagcagtaatcgtgagtgctcggatggcgcccgaagaaattatcatggataggcctttcttatttgtcgtacgccacaaccctaccggcacagtgctcttcatgggccaagtgatggagccttag

SEQ ID NO: 43858 - DNA, 846 bp, Artificial Sequence
  Description of Artificial Sequence: Synthetic coding sequence
atgggcgtggccaccaccctgcagccccccaccaccagcaagaccctgcaaaagcagcacctcgaagcggtgggcgcctaccagtatgtgctgactttccttttcatgggtccatttttttcactgctggtcttcgtgctcctgttcacctctctgtggccattcagtgtcttctacctggtctggttgtatgtggattgggatactccgaatcagggcggacggcgttctgagtggatccgcaaccgggccatctggaggcaattacgggattattaccccgtgaagctcgttaaaaccgcagagctgcctcccgataggaattatgtccttggcgcacacccacatggaattatgtgtacaggttttttgtgcaacttcagcactgaatccaacgggttctcacagctgttccctggcctgagaccgtggctagcagttttggcagggctgttctacctgcccgtgtatagggactacatcatgtcttttggcctctgtcctgtttcccgccagtccctggacttcatactcagtcagccacagctaggccaggccgtcgttatcatggtaggtggggcccacgaggccctttatagtgtccccggtgagcactgcctcaccctgcaaaaaaggaaaggctttgtacggctggcacttcggcacggcggaccaccgcatccgaggccaccagccccacctccccataggggaggcagccagagtctaagccgccccctgcatgatgggcccggagccgctttgcgaggtgcacaaggtaaactctggggccctagatttcatttaccacaccttcacctgggtctagcagccgcttttcgctag

SEQ ID NO: 43859 - DNA, 1035 bp, Artificial Sequence
  Description of Artificial Sequence: Synthetic coding sequence
atgggcgtggccaccaccctgcagccccccaccaccagcaagaccctccagaagcaacatttggaagccgtaggcgcttatcaatatgtgcttaccttcctgtttatgggaccattcttctctctgctagtcttcgtgctcctatttacttcattatggccattctctgtgttttatctggtgtggctctacgttgactgggataccccgaaccagggcggccgaagatccgaatggatccgtaatcgagcaatttggcgacagctgcgcgactattacccagtgaagctcgtaaagactgctgaactcccacccgacaggaattatgtgctaggcgcgcatccacatggaatcatgtgcactggttttttgtgcaacttctccaccgagtccaacggcttctctcagttgttccctggcctcaggccctggctggctgtcctcgccggactattttacctcccagtctaccgtgactatatcatgtcctttgggctgtgccccgtctcgagacagtcattggacttcatcctgtctcaacctcagctcggccaggcagtggtaatcatggttggcggagctcatgaagctttgtattctgttcccggagagcactgtctgactcttcagaaaagaaaaggcttcgtgcgtctggctctgagacacggagcctcacttgtaccggtctactcctttggtgaaaatgatatattcaggctgaaagcctttgctacagggagctggcagcactggtgccagcttacattcaagaagttaatgggtttcagcccatgcatcttctggggtcgtggcctgtttagcgccacttcttggggtctcctgccctttgccgtgccaatcacaacggtgggcgagtgccccccccccggtggcagaccaccggctgctgcctgggcaagcggcattcctagaccaccagtgagtttgtcacttcagtgggccgcccctagcccttccccaagtgcctccacccccccacggcgaaagagtataaccataacacccagcacttag

SEQ ID NO: 43860 - DNA, 645 bp, Artificial Sequence
  Description of Artificial Sequence: Synthetic coding sequence
atgcaccagcagaagcggcagcccgagctggtggagggcaacctgccggtgttcgtgttccccacagagctgatcttttacgccgatgatcagtccacgcataaacaagtcttaacgctttataacccgtacgaatttgccctcaaatttaaagtactgtgcacgacacctaacaagtatgttgtggtggatgcagccggggccgtcaagcctcaatgctgtgtcgacatcgtgattcgccacagggacgtgcgctcctgtcactacggcgttatcgataaattccgtctgcaggtcagcgagcaatcacagaggaaagctcttggacggaaagaggttgtcgcaactctcctaccatccgcgaaagagcagcagaaagaagaggaggagaaacgcctaaaggagcatctgaccgaatcccttttttttgagcagtccttccagccaggcaagaatcgcgctgtgtcctctggaccaagtctgctcacagttttcctgggggttgtgtgcattgccgccttaatgctgcctactctgggcgatgtggagtccttagtgcccctgtaccttcacctgtcggtgaatcagaaactagtcgctgcttatattctcggtctaattacaatggcaattttgcgcacttag

SEQ ID NO: 43861 - DNA, 480 bp, Artificial Sequence
  Description of Artificial Sequence: Synthetic coding sequence
atgcaccagcagaagcggcagcccgagctggtggagggcaacctgcccgtgtttgtgtttcccactgaattaatcttttacgctgacgaccagtctactcataagcaggttttaacgctgtataacccctatgaattcgcgctcaaatttaaggtattgtgcaccacacccaataaatatgtggtggtggacgctgctggagccgtgaagcctcagtgctgtgtagatatcgtcatcagacaccgggatgtgaggagctgccattacggtgttatagataagtttcgtttacaggtgtctgagcagtcacagaggaaggctcttggtaggaaggaagtcgtagcgaccttgttaccatcagccaaagaacagcagaaagaggaagaagagaaacggctgaaggagcatctcacagagagtctattttttgagcagtcttttcaacccgggctaatcactatggctatcctcagaacctag

SEQ ID NO: 43862 - DNA, 642 bp, Artificial Sequence
  Description of Artificial Sequence: Synthetic coding sequence
atgcaccagcagaagcggcagcccgagctggtggagggcaacctgccggtgttcgtgtttccaacggagttgattttctatgcagatgaccagtccactcacaaacaggtgttgacactttacaacccttatgagtttgccctgaaatttaaggtgctttgcaccactcctaataagtacgtcgtggtggacgcagcaggggctgttaagcctcagtgctgtgtcgatattgtgattcggcatcgcgacgtgaggagctgccattatggtgtgattgataaattcaggttgcaggtaagtgaacagtcccagcgaaaagccttggggcggaaggaggtggtcgcaacactactgccttctgcaaaggagcaacaaaaggaagaggaggaaaaacgtttaaaggaacatctgacggaatcactgttcttcgaacagtcattccagcctgaaaacagggctgtttcatcgggtccctcgcttctgaccgtgtttctcggcgttgtgtgcattgctgcactgatgttacctactctaggagatgttgagagcctcgtgccactgtacctccacctaagcgtcaaccagaagctggttgctgcttatattctggggctgatcactatggccatccttaggacctag

SEQ ID NO: 43863 - DNA, 1557 bp, Artificial Sequence
  Description of Artificial Sequence: Synthetic coding sequence
atggccgagaaccacgcccagaacaaggccaagctgatcagcgagacacggcggcggttcgaggctgagtacgtgacggataagtccgacaagtatgatgccagggacgtcgaacgtctgcagcaggatgataattgggttgagagttacctgtcctggcgccataacatcgtggatgaaactctgaagatgctcgacgagtcattccaatggcggaaggagatctcagtgaacgacttgaacgagtcgagcattccgcgatggctgctggagattggtgtgatctatttgcatggatacgataaagaaggcaacaagctcttctggattcgtgtgaagtaccatgtgaaagaccaaaagaccatcctggacaaaaaaaaactgattgcattctggctagagcgatacgctaagagggaaaacgggaaacctgtcacagtgatgttcgatttgtcagaaacaggtattaactctatagacatggatttcgtgcgcttcatcattaactgctttaaggtgtactatccaaagtacttgagcaagattgtgatttttgacatgccgtggctcatgaatgcagcttttaaaatcgtaaagacatggctggggcccgaggcagtgagtctgttaaaattcaccagcaaaaacgaagtgcaagattatgtatctgtggaatacctacctccccacatgggcgggacagacccattcaagtacagctacccaccactggtggacgatgacttccagacccctttgtgcgagaatgggcctatcacgtcggaggatgagacgtcttccaaggaagatatagagagcgacgggaaggaaactctcgaaactattagcaatgaggaacaaactccgctgctgaaaaagatcaaccctacagagtctactagtaaggcagaggaaaacgagaaagtcgattctaaggtcaaagcattcaaaaaacctctttcagtgtttaagggtccactgctacatatctctcccgccgaggaactctattttggctctacagaaagcggggagaagaagactctcatcgtcctcaccaacgttaccaagaacattgtggccttcaaggtgagaacaacggctccggagaaataccgagtgaaacctagtaatagtagttgcgatcccggggctagtgttgatatagtggtgagcccccacgggggactgacagtaagcgcccaggacagatttctgatcatggctgcggaaatggagcaatcatccggcacgggaccagcagaactgacgcagttctggaaggaggtgcctcgaaataaagttatggaacaccgcttacgatgtcacaccgtcgagtcttctaagccaaacactctgacactgaaggataacgccttcaacatgtctgacaagaccagcgaggatatctgccttcagctctctaggctcttagagtcaaatcgcaaactggaggatcaggttcagcggtgcatttggttccaacagctgctgctttctctcactatgctcctgttagcattcgtaaccagcttcttctatctgctctacagttag

SEQ ID NO: 43864 - DNA, 2406 bp, Artificial Sequence
  Description of Artificial Sequence: Synthetic coding sequence
atggagcggctgtggggcctgttccagcgggcccagcagctgagccctcgatcctcccagactgtgtatcagcgagtcgagggacctagaaaggggcaccttgaagaggaggaagaggacggggaagagggcgcagaaacattggcccatttctgtcccatggaacttcgcggcccagagcctcttggttctagacctcggcagcctaacctgatcccttgggcggcagccggcagacgggcggctccatatctggttctgacagctctgctcatatttaccggtgcctttctgttaggctatgttgcctttcgagggtcatgccaggcatgcggcgacagcgtgcttgtggtgtccgaggacgtcaattacgagcctgacctggattttcatcaggggagactttattggtcagatctgcaggctatgttcctacaattcctgggagaaggccggctggaggacactattagacaaactagtctgagagaacgcgtggccggtagcgcgggaatggctgctctgacacaagatatccgcgccgccctgagtaggcagaaactcgatcatgtgtggacagatactcactacgtaggtttgcagttccctgacccagcccaccctaacaccctccactgggtggacgaagcaggaaaggtcggtgaacagctgcctctagaggatcccgatgtctactgcccctattcggcgatcggtaacgtcactggtgaattggtatacgctcactatggaaggccggaggatctgcaggatttgagggcacggggtgttgatccagtcgggcgcttactgctcgtcagggttggggtgatttctttcgcccagaaggtcaccaacgctcaagactttggagctcagggcgtcctcatatacccagaacctgccgacttcagccaggatccccccaaaccgagtctatcctctcagcaggccgtttatggccacgtgcatctgggcacaggtgatccctataccccgggtttccccagttttaatcagacccagtttccgccagtggctagttctggattgccaagcatacctgctcaaccgataagcgccgacatagcgtcccgattattgcggaaactgaaaggacctgtggcgccccaggaatggcagggcagtctgctaggttcgccttaccacctcggccctggcccccggctcaggctggtggttaacaaccatcgcacttccacccccatcaataatatatttggatgcatcgagggaaggagcgagcctgaccactatgttgtcatcggagctcaacgcgatgcctggggcccgggggctgccaagtcagccgttggaactgccattctgcttgaacttgttaggacattctccagcatggtgtcgaacgggttccgcccgcgcagaagtctgctgtttattagctgggacggcggtgacttcggctcagtcgggtcgactgaatggctcgagggctatctgtctgtgctgcatttgaaagctgtcgtctatgtgagtctggataacgcggtgctgggggatgacaaattccatgccaaaacaagtcccctgcttacctcattgattgagtctgtgctcaaacaggttgacagccctaatcactctgggcaaaccttatatgaacaggtggttttcacaaatccttcttgggacgcagaagttattcgaccattgcccatggatagtagtgcctattcctttaccgcttttgtgggcgtgcccgctgtggagttctcctttatggaagacgatcaagcgtatccatttctgcatactaaagaagacacctacgaaaacctacacaaggtgctacaggggcgcctgcccgccgttgcccaggctgtggcccagttagccggccagctgctcatccgcctttcgcatgaccgattactccctcttgatttcggcaggtacggggatgtggtgttacgacacattggaaacctcaacgagttctcgggtgacctcaaagcccgcggcttgacccttcagtgggtttatagtgctcgcggagactatatacgagcggcagaaaagctgcgccaagagatttactccagtgaagagagggacgagaggctgacaaggatgtacaacgtccggataatgagagtcgaattttatttcctttcacagtacgtatcccccgctgattccccattcaggcacatatttatgggaaggggtgatcatactcttggcgctctgctcgaccacttgaggctgctgcgttcgaattcatccggcactcctggtgctacaagcagtacgggatttcaggaaagccggttccgtcgtcagttggctctgttaacctggacactgcagggagcagcaaacgctttatcaggtgacgtttggaatatcgacaacaacttctag

SEQ ID NO: 43865 - DNA, 708 bp, Artificial Sequence
  Description of Artificial Sequence: Synthetic coding sequence
atgcggcggggcgccccccaggaccaggagctggtgggccccggcccccccggccggggatctcggggggcccccccaccgctaggaccagttgtgccagtcctggtttttccaccagatcttgttttcagagccgaccagaggtccggtcctagacagctgctgaccttgtacaaccccactgggactgctttgcggtttcgggtgctctgtacagctcctgcgaaatacaccgtgttcgatgcagaaggctacgtaaagccgcagagctgcatcgatattgtgatccgccacgtcgcacccatcccctctcactatgacgtccaggaccgcttccgaatcgagctttcagaggaaggagctgaaggccgcgtggtgggccgcaaggatataacctcaatccttcgcgccccggcctaccctttagagcttcagggacagccggatcctgccccgagaccaggccctcctgcgggcactccaccacctaccgccagacatttccaagaacaccctaggcagcagcttgctacatctagcttcctgctgtttctgctgacaggcatcgtgagcgtcgcatttctactgctgcccctccctgacgagttgggtagccagcttccccaggtacttcatgtgtccctggggcagaagctggtggcagcgtacgtgcttggcctgctgaccatggtgttcttacggacatag

SEQ ID NO: 43866 - DNA, 708 bp, Artificial Sequence
  Description of Artificial Sequence: Synthetic coding sequence
atgcggcggggcgccccccaggaccaggagctggtgggccccggccctcccggacggggaagtaggggtgctccacctcccctcggaccggtggtaccagtgcttgtgttcccccccgacctagtctttcgcgccgaccagcgcagcggaccgaggcagcttctcaccctctataatcccaccggcaccgctctcaggtttcgagttctgtgtacagcgcctgctaagtatacagtgttcgatgcggaaggctacgtcaagccacagagttgtattgatatcgtgatccgccacgtagcaccaattccgtcgcactatgatgtccaagaccgttttcgaatagagttaagcgaagagggcgcagagggacgggtggtaggccgcaaggacataacctcaattctccgtgcgccggcttaccctcttgaactgcaggggcagccggatccagctcctcggccaggaccacctgccggcacgccaccgccaaccgctaggcatttccaagaacaccccagacagcagctggccacctcatcctttctcctattcctgctgacaggaatcgtgagcgtggcattcctcttactgcccctccctgatgaactgggatcccagctgccacaggtcttgcacgtgtctcttgggcagaaactggtggctgcctatgtgctgggcctgttgactatggtgtttctgcggacttag

SEQ ID NO: 43867 - DNA, 666 bp, Artificial Sequence
  Description of Artificial Sequence: Synthetic coding sequence
atgagcgaccggcccgagcccgcctgcgcccccccccccctgggccctgttgtgcccgtgcttgtgtttcctccagacctggtgtttagagcggatcaacgttctgggccacgtcagcttctgactctatacaaccccactggcactgcactcaggtttcgcgtgctgtgcacggcccctgcaaaatataccgtcttcgatgccgaaggctacgtgaaaccgcagagttgtatcgatattgtaatcagacatgtggctccaatcccgtcacactatgacgtccaggatagattccgtattgagctctcagaggagggggctgaaggcagggtagttggtagaaaagacataacaagcatactgagagctccagcatacccactcgaattacagggacagcccgatccggcaccgagacccgggcctcccgctggcacccccccccctactgcccgacattttcaggaacatccgcggcagcagctcgccacatcctcttttctactgttcttgctgacaggcatcgtctcagtagcctttctgctgctcccccttcctgacgaacttggtagtcagctcccgcaggtcctccatgttagcttaggacagaaactggtcgctgcgtacgtcctggggttgttaaccatggtttttctccggacttag

SEQ ID NO: 43868 - DNA, 678 bp, Artificial Sequence
  Description of Artificial Sequence: Synthetic coding sequence
atgcggcggggcgccccccaggaccaggagctggtgggccccggcccacctgggaggggaagtcgtggcgcgcccccccccttagggcctgtcgtccctgtacttgtgttcccacccgatctggtgtttagggccgatcagcgaagcggccccaggcagctgcttactttgtataatccaaccggaaccgctttaaggttcagggtgctttgcacagcccccgcgaaatacactgtttttgacgctgaagggtacgtgaaaccccaatcttgcatagatatccactatgatgttcaggatagattccggatcgagttatctgaggagggtgcggagggacgcgtggtaggccggaaggacattacctcaattctgagagccccagcatacccattggaacttcagggccaacctgaccctgccccgagaccagggccccccgcgggtacgcccccacccacagcccggcattttcaggagcatcctcggcagcagctggcgacttcgtcgttcttgctgtttctccttacaggaattgtaagcgtcgcctttttattgctcccgttacccgacgaactgggctctcagctgccccaggtgctacatgtcagcctgggtcagaagctggtggctgcatacgtgctcgggctgctaaccatggtgtttctgaggacttag

SEQ ID NO: 43869 - DNA, 444 bp, Artificial Sequence
  Description of Artificial Sequence: Synthetic coding sequence
atggccggctggtggcccgccctgagccgggccgcccggcggcacccttggcccacaaacgtgctactgtacggctcactcgtgtcggccggggatgctctacagcagaggctccagggcagagaagcaaactggcgtcagacgaggcgagtagcaacactggtggttacgttccatgcaaacttcaactacgtctggctcagattactggaaagagcacttcctggcagggcccctcacgcgctcctggctaagttattatgcgaccaggtggtcggggctccgattgctgtttccgctttctatgtggaatggacagacgtgttggccctgtgcacggccgatcaattacagccatgctcatgctctatggaaaacagcctccgttggtctctctggttcagcctgggccatttgcatttattttttcctgccgagtggtag

SEQ ID NO: 43870 - DNA, 591 bp, Artificial Sequence
  Description of Artificial Sequence: Synthetic coding sequence
atggccggctggtggcccgccctgagccgggccgcccggcggcacccttggcccactaatgttctgttgtatggatccctagtgtcagctggagacgctctccagcaaaggctgcagggccgcgaggcaaattggagacagactagaagggttgctacattagtggtgacgtttcatgcaaattttaattatgtttggctgcggctgctcgaaagggctttgccgggaagggcccctcatgcactgcttgccaagctgctctgtgaccaagtcgttggggctccaatcgccgtctctgctttttacgttggaatgtccatcctccaggggaaggatgacattttcttagatctgaagcaaaagttctggaacacctatctctccgggttgatgtactggcccttcgttcaattaacgaatttttccctggttcctgttcaatggaggacagcatacgcaggcgtgtgcgggttcctgtgggctacgttcatttgcttctctcaacagagtggcgatggaacttttaagtcagcatttacgatcctttacactaaaggcaccagcgcaactgaaggatatcctaaaaagtag

SEQ ID NO: 43871 - DNA, 621 bp, Artificial Sequence
  Description of Artificial Sequence: Synthetic coding sequence
atggcccggggcggctggcggcggctgcggcggctgctgagcgccggccagctgctgtttcagggccgagccctgctggtcactaacaccctgggatgtggcgcccttatggctgcgggtgacggtgtgagacagtcctgggaaatccgggccaggcctggacaggtcttcgatccgcgaagatcagccagtatgttcgcggtcggttgttcaatgggcccttttcttcattactggtatctgtccctcgatcgacttttccctgcatcaggacttcggggtttcccaaatgtccttaaaaaggttctggttgaccaactggtcgcgagtccactgcttggtgtatggtacttcctgggcttaggctgcctcgaaggccagactgtcggtgagagctgtcaggagttacgtgaaaagttttgggagttttataaagccgactggtgcgtgtggccagctgctcagttcgtcaacttcctgttcgtgccacctcaattcagagttacatatattaatggccttacgctgggctgggacacgtatcttagttacctgaaatatcgttcccctgtgcccctaaccccccccggttgcgtggctctcgacacaagagctgattag

SEQ ID NO: 43872 - DNA, 354 bp, Artificial Sequence
  Description of Artificial Sequence: Synthetic coding sequence
atggagtgcctgcggagcctgccctgcctgctgccccgggccatgcggctccctcggagaacactgtgtgctctggccctggatgtgacctcagtggggcctccagtcgcggcatgcggccggagagcaaacctaattggacgtagccgggccgcccaactctgcggccccgatcgattgcgggtggctggcgaggtacaccgctttcggacctcggatgtaagccaggccacgctggcatcagtggcccctgttttcacagttacgaagttcgataaacagggcaacgtgacctctttcgtgttcgagtcttgcgataatagtcgcgtttctagcgacatccgcctgtcatag

SEQ ID NO: 43873 - DNA, 1227 bp, Artificial Sequence
  Description of Artificial Sequence: Synthetic coding sequence
atggagtgcctgcggagcctgccctgcctgctgccccgggccatgcggcttcccaggcgcactctctgcgcattggccctcgacgtcacgagcgtcggcccaccagtggccgcatgtggccggcgggccaacctgatcggacggtcacgggcagcccagctctgcgggccagacagactccgagtggccggcgaggtgcacagatttcgcacctcggacgtctctcaggctacactggcctccgtagccccagtgtttacggtaactaagttcgataagcagggcaatgtgacaagttttgagaggaaaaagactgagctgtatcaagagttgggactgcaggccagggaccttagattccagcatgtgatgagcattaccgttcgcaacaatcgtattattatgcgaatggagtacctgaaagcagtgatcacccctgagtgtctgcttatactggattatcgcaatctaaacctggagcagtggctgttccgcgagctgcctagtcaattatccggtgaggggcagttagtcacttaccctctgcccttcgagttcagggcaatcgaggcccttctacagtactggattaacaccctacagggaaaattgtcgatcttgcagcccctgatcctggagacattggatgctctggttgaccctaaacactcatctgtggatcggagtaagctccatatcctacttcaaaacggcaaaagtctgtctgaactggagaccgacatcaaaatctttaaagagagtattctcgaaatcctcgatgaggaagagctgttagaggagttatgtgtgagtaaatggtctgacccccaggtcttcgagaaaagcagtgcaggaattgaccacgccgaggaaatggagttgctgttagagaactactacaggttggcggacgatctgagcaacgcagcccgcgaactgcgcgtcctcatcgacgacagtcagtctatcatattcattaaccttgatagtcatagaaacgtgatgatgcggctcaatttacagcttactatggggacttttagtcttagcctgttcgggctgatgggggtagcctttggaatgaacttggagagttccctggaagaggaccacaggattttctggctgataaccgggatcatgttcatgggttccgggctgatttggagaagactgctctcatttttgggtcgacagctcgaagcccccctgcctcctatggtatag

SEQ ID NO: 43874 - DNA, 1332 bp, Artificial Sequence
  Description of Artificial Sequence: Synthetic coding sequence
atggagtgcctgcggagcctgccctgcctgctgccccgggccatgcgattaccacggcgtactttgtgtgccctggctctcgatgtgacctccgtagggcctcccgtggcagcctgcgggcgacgagccaatctaatcggaagaagtcgtgccgcacagttgtgcggaccagatcgcctgagggtggcgggcgaagtacataggttccggacctcagatgtgtctcaagcgacactggcttcagtggcacctgtgtttacggtgactaaatttgataagcagggcaacgtcacatccttcgagaggaaaaaaactgaattatatcaggaactgggcctgcaagcccgggatcttagatttcagcatgtgatgtctattactgtcaggaacaatcgcattatcatgcgaatggaatacttgaaggcggttatcacccccgagtgtcttttgattctggactacaggaacttaaacctcgaacagtggctgtttagggagttgccgagccagctatccggcgagggccagttggtcacgtacccacttcccttcgaattcagggccattgaagctctgttgcagtactggattaacacacttcaggggaagctcagtatactgcaacccctcattctggagactctggacgccctagtggatccgaaacatagcagcgtagatcgatccaaactgcatatcctgctgcagaatggcaaaagcctgtccgagctagagacagatatcaaaatcttcaaggagtccattctggagattctcgacgaggaagagctgctcgaagagctgtgtgtgtctaagtggtccgatcctcaggtcttcgagaagtcatctgcaggcattgatcacgccgaagagatggaactccttctagagaattactaccgcctagcagatgacctctcaaatgctgcccgggagctacgagtgctgattgacgactctcagagcatcattttcattaacttggacagtcacaggaacgtgatgatgcgcctcaaccttcagctcactatggggactttctccctgtccctgttcggtcttatgggagtagcatttgggatgaacctcgaaagtagtttggaagaagatcaccgcattttttggctcatcactggtatcatgtttatggggtccggcctcatctggcggcgccttctgagcttcctcgggcgacagctggaggctccactgcctcctatgatggccagcctgcccaaaaagacattattggccgatcgcagtatggagctgaagaattccttgcgcctagatggtctcggttctggtcggagtattctcaccaacagatag

SEQ ID NO: 43875 - DNA, 1341 bp, Artificial Sequence
  Description of Artificial Sequence: Synthetic coding sequence
atggagtgcctgcggagcctgccctgcctgctgccccgggccatgcgcctgccacgcagaaccctgtgcgcactggctttggatgtgacttctgtgggtcctcccgtcgcagcctgtggccgtagagccaatctgatcggtcggagccgggccgcccagctgtgtggccctgatcgccttcgagtagcgggtgaggttcacaggttccgcacgtccgacgtaagccaagccaccttggccagcgtggctccagtcttcaccgtcaccaagttcgacaagcagggaaatgtcacatcttttgagcgtaaaaaaacggagctctaccaggaattgggtctgcaagctagagacttacgtttccagcacgtcatgtctattacggtgcgcaataataggatcatcatgcggatggaaaagtactcacttctgttagagtccgtggccagtattttgcagaatagtgttagcttcatggagcggcagaccgaacagtggttattccgggagttgccaagccagctttctggagaaggccagctcgtcacatatcctctgccatttgagtttagagctatcgaagcactactacagtactggatcaacacgctgcaaggaaagcttagcattcttcagccactgattctggagacacttgacgccctcgtggatcccaagcacagcagcgtagacagaagtaaactccacattctccttcagaatggaaagtcactgtctgaattagagactgacattaagatattcaaggaatccatcctggagattctggatgaagaagaactgctggaggagctgtgcgtgagcaaatggtcagatcctcaggtattcgagaaatcatcggctgggattgatcatgctgaggaaatggagctgttgctggaaaactactataggctggccgacgatctctctaacgcagctcgggaactgcgggtcctgatcgatgattcgcagagtattatattcattaatctcgactctcatcggaacgtgatgatgcgccttaatctccagctgaccatgggaacctttagcctatccttgttcggacttatgggagtcgccttcggcatgaacttagagagctctttggaggaggaccaccggattttttggctgatcacaggcataatgtttatggggagcggcttgatctggaggcgccttttatccttcctcggccgccagctagaagcgccattaccgcccatgatggcatccctgccaaaaaagacgctgctggctgacaggtcaatggagctgaaaaattccctgcggcttgatggcctggggagcggcaggtcaatcttaacaaataggtag

SEQ ID NO: 43876 - DNA, 549 bp, Artificial Sequence
  Description of Artificial Sequence: Synthetic coding sequence
tgacgggccgcccagctgtgcggccccgaccggctgcgggtggccggcgaggtccaccggttcaggactagcgacgtgtctcaggcaacccttgccagcgtggctccagtgttcacggttaccaagtttgataagcagggcaacgtgacatcttttgagagaaaaaaaacagagctgtatcaggaactggaaacagacattaaaatttttaaagaatccatcttagagatcctggacgaagaggaacttctagaggagttatgtgttagtaaatggagcgatccccaggtttttgagaaaagcagcgcaggaatcgaccacgccgaggaaatggagctgctattagagaactactatcgcctcgctgatgacctgtctaatgcagcccgtgagctgagagttcttattgatgattcacagagcatcatctttatcaaccttgacagtcatagaaatgtcatgatgcgcctcaaccttcaactcacaatgggcactttttcattgtcccttttcggcctgatgggcgttgcgtttggcatgaatttatag

SEQ ID NO: 43877 - DNA, 1182 bp, Artificial Sequence
  Description of Artificial Sequence: Synthetic coding sequence
atggagtgcctgcggagcctgccctgcctgctgccccgggccatgaggctgccgagaaggactctgtgcgccctggccctggacgttacgtcagtgggtccccccgtggcagcctgcggccgacgcgcgaatctaatcggccggtcaagggctgcgcaattgtgtggccccgacaggctaagagttgccggagaggtccatcggttccggacctcagacgtcagccaggccactttggcaagcgtagcgccggtattcacagtctaccttaaagccgttattactcccgagtgtctactgattttagactacaggaacctgaatctcgagcaatggctcttcagagagctgccttcacagctcagtggcgagggccagctggttacctatcctcttccctttgaattcagagctatcgaagcactccttcagtattggatcaatacattgcagggcaaactctcaatactgcaacctctgatcctggaaaccctggacgcgcttgtggaccctaagcattcctctgttgaccgcagcaaactgcacattcttttgcagaacggcaaaagtctgagcgaactggagactgatatcaaaatcttcaaagaatccatcttggaaattctggatgaagaggaactgttggaagagctatgcgtgtccaagtggtccgatccccaagtgtttgagaaatcctctgcgggcatcgatcacgccgaggagatggaattactactggaaaattattaccgcctggctgacgacctctccaatgccgcaagggagcttcgcgttcttattgacgactcccagtccattatctttatcaacctggactcacaccgcaacgtgatgatgagactgaacctgcagctgactatgggaacatttagcctgtctctcttcgggcttatgggtgttgctttcggcatgaatttggaatctagcctggaggaggaccaccgaatattctggcttattactggcatcatgttcatgggcagcgggctcatatggcgacggctgctctccttcctgggacggcagctggaggctccccttcccccaatgatggcctccctgcccaaaaagacgcttctcgccgatcgtagtatggaacttaagaattctcttagattggacggccttgggagtggacgctccattttaacgaatcgctag

SEQ ID NO: 43878 - DNA, 459 bp, Artificial Sequence
  Description of Artificial Sequence: Synthetic coding sequence
atggagctgctgctggagaactactaccggctggccgacgacctgtcaaatgcagcacgcgagctgcgcgtgttaatcgacgattcacagagtatcatcttcattaatctggattcccatcgcaatgtgatgatgagacttaacctgcaattgacaatgggtaccttctccttgagcctgtttggactcatgggggtggcatttggaatgaatctggagtcatcgctcgaggaagatcaccgcatattctggctcattactgggattatgttcatgggttcaggattgatatggcgcaggctgcttagcttcctgggtcggcagctggaggcccccctgccacctatgatggcatccttacccaaaaaaactctgctcgcggaccgcagcatggagctgaaaaacagcttgcgcctagatggcctgggatctggaaggtcaattctgacgaataggtag

SEQ ID NO: 43879 - DNA, 1254 bp, Artificial Sequence
  Description of Artificial Sequence: Synthetic coding sequence
atggccctgagcgcccagcagatcccccggtggttcaacagcgtgaaacttcgctcactgatcaacgccgcacagttgaccaagcggttcacaaggccggctagaacccttcttcacggtttctctgcgcagcctcagattagctcagataattgctttctgcaatggggattcaagacttatcgcaccagctctctgtggaacagctcgcagagcacaagcagctcaagccaagaaaataatagtgctcaaagcagcctcttgcctagcatgaacgagcagtcacagaagacacaaaacatctcttcattcgactcggagctgttcctcgaagagctggacgagctaccgccactgagtcctatgcagcctatctcagaggaggaggctatccaaataatcgcagatccgccactgcccccggccagctttactctgagggactatgttgatcacagtgagaccttacagaaactggtgcttctgggggtggatctatccaagattgagaagcacccagaagcagctaacctgcttctgcgattagatttcgagaaagacatcaaacagatgctgctatttctgaaggacgtgggaatcgaagataatcagctaggagcattcttgaccaagaatcatgccatcttcagtgaggacctggaaaatctgaagactcgtgtcgcctatcttcactctaaaaacttctctaaagccgatgtcgcacaaatggtgaggaaagcgccctttttgctcaacttttccgtagagcggcttgacaaccgcctgggcttcttccagaaagagctagagttgtctgtgaaaaaaacgagagacctggtcgtacgcctaccacggctgctgactggctcattagagcctgttaaggaaaatatgaaggtctatcgcttagagctgggatttaagcataatgagatacagcacatgattacacgaatccccaagatgctgaccgccaacaagatgaagcttaccgagacattcgactttgtacataatgtcatgtccataccccaccacattatcgtgaaattcccacaagtgttcaacacccggctcttcaaggttaaggagaggcatttgtttctgacttatcttggcagagcacagtacgacccggccaaacccaactatatcagcttagacaaactagtttctattcctgatgagatcttctgcgaggaaatcgctaaagctagtgtgcaagattttgaaaagtttctcaagacgttatag

SEQ ID NO: 43880 - DNA, 1158 bp, Artificial Sequence
  Description of Artificial Sequence: Synthetic coding sequence
atgctgtggaagctgctgctgcggagccagagctgccggctgtgctccttcaggaaaatgaggagcccacccaaataccggccctttctggcctgtttcacatatacaacagataaacaatccagcaaggaaaatactaggactgtcgaaaaactttataagtgttcggtggatattcgaaagatacggcgcctgaaaggctgggtgttgttagaggatgagacatatgttgaggaaatcgccaacatcctgcaggagttaggcgcagacgagacagccgtggcctcgattctggagaggtgtccggaggccatcgtgtgctcccctactgcagtgaacacacagaggaaactctggcagctcgtctgtaagaacgaggaggaactgattaagttgattgagcagtttccagagtcattctttaccataaaggatcaggaaaaccagaaactaaacgtgcaattttttcaagaactcggcttgaaaaacgtcgttattagtcgcctgctgacggctgcacctaacgtgttccacaacccagtggagaagaataagcaaatggtgaggattctacaagaatcttacctagacgtgggcggttctgaagccaacatgaaagtttggctgctgaagctgctgagtcagaatccattcattctgttaaacagtcctaccgcaatcaaggagacactggagttcctccaagagcagggctttacttcgttcgagatcctacagttgctgtctaagctgaagggtttcctgttccagctttgtccccggagcattcagaactcgatctccttctctaaaaatgcctttaaatgcacggatcatgatctaaaacagttagtcctaaaatgtcccgccctgttatactactcggtccctgtgcttgaggagcggatgcaagggctgttacgagagggaatcagtatagcccagattcgagagactcccatggtactggagctaacaccccagatcgtccagtataggattagaaagctgaattcttcaggctatcggatcaaggacggacacctcgcaaacttaaacggcagtaagaaggagtttgaagcaaattttggaaaaatccaggctaagaaggtacgtccactcttcaacccagttgcacccctaaacgttgaggaatag

SEQ ID NO: 43881 - DNA, 1158 bp, Artificial Sequence
  Description of Artificial Sequence: Synthetic coding sequence
atgctgtggaagctgctgctgcggagccagagctgccggctgtgctcgttcaggaagatgcgcagccctcccaaatatcgaccttttttagcctgcttcacgtatactacggataagcaatctagtaaggagaataccagaaccgtggaaaaactgtataagtgctccgtagatattcggaaaattcggagattgaagggctgggtcctcctcgaagacgagacctatgtagaggaaatcgccaacatcctgcaggaacttggagccgacgagactgctgttgcctctatcctcgaaagatgtccagaggctatcgtttgtagtccgaccgccgtgaatactcagaggaagctatggcagctggtctgtaagaatgaagaggagttgattaagttgattgagcagtttcccgaatccttctttacgattaaggaccaggaaaatcagaaactgaatgttcagttcttccaagagctgggtctcaagaacgtggttatcagccggctgcttacagcagcacccaatgtttttcataaccctgtcgagaaaaacaagcaaatggtacgtatcctgcaagagagttacctggacgtaggaggcagcgaggccaacatgaaagtgtggctgctgaagctgctatctcaaaatcccttcatactcctgaattctccaaccgctattaaggagaccctggagtttcttcaagaacaaggatttacatctttcgaaattttacaactccttagtaagcttaagggctttctttttcagctgtgccctcgcagtattcagaacagcataagtttcagcaaaaatgcgttcaagtgtaccgaccacgacctaaagcagttagtgctgaaatgtcctgccctgttatactattcagtacccgttcttgaagagcgcatgcagggtctgctaagagaaggaatctctattgcacagatccgcgagactccgatggttctggaactgaccccccagatcgtgcaataccgcatacggaaattaaactcctccgggtatcgaattaaagacggacacctcgccaatctgaacggatccaaaaaggaatttgaagccaattttggcaagatccaagccaaaaaggtgcgccccctcttcaaccccgtcgcgccccttaatgtcgaggagtag

SEQ ID NO: 43882 - DNA, 537 bp, Artificial Sequence
  Description of Artificial Sequence: Synthetic coding sequence
atgctgtggaagctgctgctgcggagccagagctgccggctgtgctcctttcgaaaaatgaggagtcccccgaaatatagacctttcttggcttgctttacttatactacagacaagcagtcctccaaggagaatacacgaaccgtagagaaattgtacaagtgcagcgtcgacataaggaagatacgacgactcaaggggtgggtcctgctggaagacgaaacctatgtcgaggagattgcaaatattctacaggagcttggggcagacgaaacagctgtcgcaagtatcttggaaagatgccctgaggccatcgtgtgtagtccgaccgctgtcaatactcagcgcaagctctggcagcttgtatgcaaaaacgaagaagaattgataaaactcatcgaacagtttccagaaagctttttcacaatcaaggatcaagagaaccagaagcttaacgtccagttcttccaggagctgggactcaagaacgtggtgatctcccgccttctgacagctgcccctaatgtcttccattag

SEQ ID NO: 43883 - DNA, 102 bp, Artificial Sequence
  Description of Artificial Sequence: Synthetic coding sequence
atgctgtggaagctgctgctgcggagccagagctgccggctgtgctcatttaggaagatgaggagtccacccaaatatcggcctttcctcgcttgtttttag

SEQ ID NO: 43884 - DNA, 261 bp, Artificial Sequence
  Description of Artificial Sequence: Synthetic coding sequence
atgctgtggaagctgctgctgcggagccagagctgccggctgtgctccttcaggaagatgcggtcacctcccaagtatcgtccttttctggcatgttttacatacacaacagataaacaaagttccaaggaaaacacccgcaccgtcgagaaactgtacaaatgctctgtggatatccggaagatacgtaggctcaaaggttgggttctactggaggatgagacatatgtggaagagatcgccaacatactccaggaatag

SEQ ID NO: 43885 - DNA, 1158 bp, Artificial Sequence
  Description of Artificial Sequence: Synthetic coding sequence
atgctgtggaagctgctgctgcggagccagagctgccggctgtgctcctttagaaagatgaggagtccaccgaaatacaggccattcttagcttgttttacttatacgacagataaacagagctctaaggaaaatacaaggacggtcgaaaagctttataagtgttccgtcgacatccgaaagatccggaggctgaagggatgggtcttgttggaggacgagacctatgtagaggaaatcgctaatattctgcaagaactgggcgccgacgagaccgctgtggcgtcaattctggagagatgcccggaagccatcgtatgttcgccgactgctgtgaacacccagagaaaactctggcagttggtgtgcaagaacgaggaagagctcatcaaactcatcgagcaattccccgagtctttcttcactattaaggatcaagaaaatcagaaacttaatgttcagttcttccaggagctgggcctgaagaacgtcgtgatcagccggctgctgactgctgcccccaacgtgtttcacaacccagtagagaagaacaagcagatggttagaatcctccaagagtcttacctggatgttgggggctctgaggccaacatgaaagtgtggctactcaaactgctcagccagaacccctttatcctgttgaactcacctaccgctatcaaagaaaccctcgagttcttacaggagcaggggttcacgagttttgagatcctgcagttgctgagtaagttaaagggatttctctttcagctgtgtcccaggagcattcagaattcaatatctttttccaagaacgcttttaaatgcaccgaccacgacttgaagcaactggtgctgaaatgcccagctctgttgtactatagcgtgccagtcttagaagagcggatgcagggtctactgcgggaaggaatcagcatcgcccagattagggagactcctatggtactcgagttaacacctcagattgtccagtacaggattagaaagttaaactcatcaggatatcggataaaagatggacacctggcgaacctaaatggctccaagaaagaattcgaagctaacttcggaaaaatacaggctaagaaagtgagaccactgttcaacccagtcgcgcctctcaatgtagaggagtag

SEQ ID NO: 43886 - DNA, 1701 bp, Artificial Sequence
  Description of Artificial Sequence: Synthetic coding sequence
atgaagatgcagaagggcaacgtgctgctgatgttcggcctgctgctacacttggaggctgccaccaactctaatgagacaagcacgtcggctaacactgggtcttcggtgatctcaagcggagcctctactgcaaccaattcgggcagctcagttacatccagcggagtgtccacggcgaccatctctgggagcagcgttaccagtaacggcgtgagcattgtgacaaattcggaattccacaccacaagttctggcatcagcaccgccaccaattctgagtttagtactgtgagttcaggcatatcaattgcaaccaatagtgaaagtagcaccacttcgtcgggcgcaagcaccgccacaaactcggaatcttctaccccatcaagcggagccagcactgccaccaactctgattcatccacgacctcctccggagcttctaccgcaactaactcagacagcagtacaacttcaagtgaagccagcaccgcaacaaactccgaatcttctacgactagttccggggcctctaccgcgactaacagtgaaagttctactgtgagcagtcgtgcatctacggccactaacagtgagtcctccactacgtcttcaggagcttccacagctaccaatagcgaaagcagaaccaccagtaatggggcagggaccgccaccaattcagaatccagcacaacttctagtggcgcttcaactgcgacaaactccgagagtagtacgccctcaagcggcgccggtactgcaaccaacagtgaatcctctacaacatctagtggagctggaaccgctacgaactccgagagctcaacagtttctagcgggatttcaaccgtaactaacagcgagtcctccaccccatctagtggtgctaacacagctactaacagcgagtccagtaccacatcgagcggcgccaacacagcaacgaactccgatagctcgacaacctcgtctggtgcttcaactgccacaaactccgagagctccactacctcctcaggcgcaagtacagccactaactcagagagctccactacgtcctcaggcgcctccaccgctaccaattccggaagctccacaacttcttctggaacatcaacagcgaccaacagcgagagttctacagtcagcagcggggcttccactgctaccacatcagagtcttctacaacatcaagcggagctagtactgccaccaatagcgagtcgtcgactgtgtcatccggggcatccaccgctactaacagtgaaagctccactacctcttcgggcgctaataccgccactaattctgggagcagcgtaacatccgcggggtcaggaacagcagccttaacaggcatgcacaccacctcccattctgcgtcaacagcggtgagcgaggcaaagcctggcggctcccttgttccttgggagatattcctcattaccttggttagcgtggtagccgccgtcggcctgtttgccggcttgttcttctgtgttcgaaattccctgtctctgcgcaacacattcaataccgcagtctaccacccacacgggttgaatcacggtctgggccccggtcctgggggtaatcacggcgctcctcacagacctaggtggtctcccaattggttctggcggcgccctgtcagcagcatagcaatggaaatgtccgggagaaacagtgggccctag

SEQ ID NO: 43887 - DNA, 1251 bp, Artificial Sequence
  Description of Artificial Sequence: Synthetic coding sequence
atgaagatgcagaagggcaacgtgctgctgatgttcggcctgctgctgcatctagaggctgctaccaatagcaacgagacctcgacatctgcaaatacgggctcctccgtgatctcaagtggcgcaagcaccgctacaaattctggatcctcggttacttccagtggcgtgtcaactgctaccatctccggctctagcgtgacgtcaaacggcgtgtccattgtgacaaactctgagtttcacacgacctcaagcgggatctccaccgctacaaatagtgaattctctacggtctcgtcgggcatttcaatagccaccaacagcgagtcttccaccacgtccagtggtgcatccacagccaccaacagcgagagctctactccctctagcggagccagcactgctactaacagcgattcctctactacaagctctggagcatccaccgcgacaaatagcgatagctctacaacgagtagcgaggcttccacagcaaccaattcggagtcttccactacttcgtctggcgctagtactgctaccaactcggagagcagcacgacctcctccggagcctccaccgctacgaatagcgagagcagcaccactagttcaggggccagcaccgccactaactccggatcttcaaccacatcctccggtacatctacggcaaccaacagcgagtcatctactgtcagctctggggcgtccactgcgactactagcgagtcatccactacatcctctggagctagcaccgctactaactccgagagcagtacggttagcagcggggcgtctaccgctacaaacagtgagagctccacgacaagcagtggggctaacacagcaacaaactccgggagcagcgtaaccagtgccggctcaggtacagctgccttgaccgggatgcacacaacctcacacagcgcctcaaccgcagtgtcggaagctaagcctggagggtctttagttccctgggaaattttcctcatcaccctggtgtccgtagttgctgccgtgggcctgttcgccggccttttcttttgtgtgcgcaattccttgagccttaggaacacatttaacaccgctgtgtaccacccccatggtttgaatcatggcctcggacctgggccaggagggaaccacggtgcaccgcatagacccagatggtcacctaattggttttggcgccggcccgtgtcctcgattgccatggaaatgtctggccgcaacagcggaccttag

SEQ ID NO: 43888 - DNA, 483 bp, Artificial Sequence
  Description of Artificial Sequence: Synthetic coding sequence
atgaccctggaggagctggtggcctgcgacaacgccgcccagaagatgcagactgttactgcagccgtggaggagttactagtggctgcacaaagacaggatcgtctcaccgtgggcgtgtacgagagtgccaaactaatgaatgtggacccagatagtgtggtgctgtgtctcctggctatcgacgaggaagaggaggatgatatcgcactacagatacactttacccttattcaaagcttctgctgcgacaacgatattaacatcgtacgcgtgtcaggtatgcagagactagcacaactgctcggagagccagcggaaacacagggaactaccgaggcaagggaccttcactgcctcctcgttacaaacccacatacagacgcttggaaatcacacggtctcgtagaggtcgcctcctactgcgaagaatcccgcggcaataatcagtgggttccctacatttcgcttcaggaacgttag

SEQ ID NO: 43889 - DNA, 888 bp, Artificial Sequence
  Description of Artificial Sequence: Synthetic coding sequence
atggacttcggcctggccctgctgctggccggcctgctgggcctgctcttaggccagtctttacaagtgaaacccttacaggtagaacctccagagccagtggtggcggtggccctgggagcctctcgccagctgacatgcaggctggcttgtgctgatcgaggagcttccgtccagtggcgcggccttgacacttccttaggtgccgttcagtcggatacaggtcgctctgtgttgacagtaaggaatgcttctctgtctgccgccggcacacgcgtatgcgtgggttcttgtggcgggaggaccttccagcataccgtacagctgcttgtgtacgcgtttcccgatcagctgacagtgtctcctgccgcccttgtgccaggcgatcccgaagtggcgtgtactgctcataaggtgacacctgtggatcctaatgccttgagcttctcattgctggtgggcggacaggaattggaaggggcacaggccctgggccccgaggttcaggaggaggaagaggaaccacagggggacgaagacgtcctttttcgagtcactgaaaggtggcgccttccccctttgggaacacctgttcctcccgcgctgtattgccaggcaacaatgcgccttccaggcctggagctgagccaccgccaggccatcccggcctccaagccggccggggaccagctccccgctgcactgtggacgtcaagcgccgtgctgggcctgctgctcctggccctgccaacgtaccacctctggaagcgctgtcgtcaccttgcggaggacgacacccacccacctgctagcctgcgcttattaccccaagtgtctgcgtgggcggggctgcggggcactgggcaggttggcatctcgcctagttag

SEQ ID NO: 43890 - DNA, 603 bp, Artificial Sequence
  Description of Artificial Sequence: Synthetic coding sequence
atggacttcggcctggccctgctgctggccggcctgctgggcctgctgctcgcctttcctgaccaactgaccgtctctcccgctgcgcttgttcctggtgacccagaagtggcgtgtaccgctcacaaggtcactcccgtagacccaaatgccctgtctttctcccttctggtgggaggacaggagctggaaggggcacaagcccttggcccagaggtccaggaagaggaagaagagccccaaggagacgaagatgtgcttttcagagtgaccgagcgatggcgcttgccaccgctgggaactcccgttcctcccgctctgtactgccaggccactatgcggcttcccgggctggaactctctcaccgtcaagctatcccagccagcaagcctgccggcgaccaactgccagctgctctgtggacaagtagtgcggttctaggtctcctgttgctggccctcccgacctatcacctgtggaagcggtgcaggcatctggcggaggatgatacccatccccctgcttcattacgtttgcttccccaggtgtccgcctgggcagggctccgcggcactggccaagtagggattagtccttcttag

SEQ ID NO: 43891 - DNA, 1221 bp, Artificial Sequence
  Description of Artificial Sequence: Synthetic coding sequence
atggacttcggcctggccctgctgctggccggcctgctgggcctgttgttgggccagagtctgcaggtgaagcccctccaggtggagcccccggaaccagtggtggccgtcgcccttggtgcttctcgccagctgacctgtaggctggcctgcgctgaccgcggtgcttcggtccagtggcgcggactagatacaagtcttggcgctgtgcagtctgacacgggcagatcagtcctgaccgtgaggaacgcatctctgagtgccgccggtaccagggtctgcgtggggtcatgtggcggaagaacatttcagcataccgtccagctgctcgtgtatgcattccctgatcagttgacggtcagccccgctgctctggtgcccggtgatccagaagtcgcctgtacagcccacaaggttacacccgttgaccccaatgcactgagtttctcactgctggtgggtggccaggagttggaaggagcacaggcccttggccctgaggtgcaggaggaggaggaagaaccccagggcgacgaagatgtgctgttccgcgtcaccgaacgatggcgcctgccgcccctcgggaccccggtgcccccagccctctattgccaagctacgatgcgtctccctggcctggaactgtcccatcgacaggccatccctgcactacatgcattatccaaccctgaggcccccgcagcagagagcccgcaggctccatctctgagtactccagcgagctctcacccgactagccctgagccgcccgatacaacctctccggaatcccccgatactacaagccccgagagcccagacaccacaagtcaagagccaccagatacgacgtcgccagagccccccgacaaaacctctcccgagcccgccccacagcagggctctacacatacccccagaagccccggctccacgaggacgcgccgacccgagatctcacaagccggcccaacccagggcgaggttatccccaccggttcttctaagcccgcgggagaccaactgcccgccgcactgtggacatcctccgccgtgctcggactactcctgttagctctccccacctatcacctttggaagcgatgtaggcacctggctgaggatgacacccacccccccgcatccctgaggctgctgcctcaggtgagcgcctgggctggtctgcgtgggaccgggcaggtcggtatttctccgtcatag

SEQ ID NO: 43892 - DNA, 1197 bp, Artificial Sequence
  Description of Artificial Sequence: Synthetic coding sequence
atggacttcggcctggccctgctgctggccggcctgctgggcctgctcctcggtcagtcattgcaggtgaaaccactgcaagtcgaacccccagagccagtggtggctgtggcattgggggcctcgagacagctgacatgccgcctggcgtgcgccgatcgtggggcttctgttcagtggaggggtcttgatacctctctgggcgcggtgcagtctgatactggacggagcgtgttgactgtaagaaatgcaagtctctcggctgccgggaccagggtatgcgttggtagctgtggcggacgtacctttcagcatacggttcagctgctcgtgtacgcatttcccgaccaattgactgtgagcccggccgcccttgtacctggagatccggaggtggcctgcacagcacataaagtgacgccagtcgaccccaatgcactgagcttttcactcctagtcggggggcaggagttagagggcgcccaagcactgggtcccgaagtccaggaggaggaagaagagcctcaaggtgacgaggatgtcctgttccgggtgaccgaaagatggcgccttcccccactggggactcctgtcccccccgccctttactgccaggcaaccatgagacttcctggtcttgagctctcccatcgtcaagcaatacctgcgctgcacgggtggctgtcccccccaccaccacaaaatacaggacctcatgggccccatcctacctctccagaacccccagatactacgtcgccggaaagccctgacaccaccagtccagagagcccagatactacatcgcaggagcctcccgatacaacttcccctgagcctcccgacaagactagccccgagcctgcgcctcaacagggctccactcacaccccccgcagccctgggtcgacccggacacggaggccagagatctcccaggccggacccactcagggagaggttatcccgaccgggtccagcaagccagccggggaccagctgccagctgccctgtggacttcctctgccgtactgggtttgctgttactagctcttccaacgtaccatctctggaaacgatgccggcacttagctgaagatgatactcatcctccggcctctttgaggctcctcccccaggtgtcagcatgggcaggcctgagggggaccggacaagtgggtattagtccgagttag

SEQ ID NO: 43893 - DNA, 1173 bp, Artificial Sequence
  Description of Artificial Sequence: Synthetic coding sequence
atggacttcggcctggccctgctgctggccggcctgctgggcctgttattgggccagtccctccaggtcaagcctttgcaagtagagccccccgagccagtggtggctgtcgctctcggcgcttcccggcaattaacctgccgactggcgtgtgctgaccgcggagcttcagttcagtggagaggcctggacacttcactcggcgcggtgcagtcagatactggtcgttctgtcctcactgttcggaatgcctcactaagtgcggccggcaccagagtctgtgtgggcagctgtggcggccggacctttcagcataccgtgcagctattggtgtacgccttccctgatcagctcaccgtaagccctgctgctttagtgcccggcgaccctgaagttgcctgtactgcccataaggtgacaccagtagacccaaatgctttatccttttctctcttggtggggggtcaggaactcgaaggtgctcaggccctgggaccagaggttcaggaagaggaggaggaacctcagggggacgaagatgtgctgttccgggtcacagaacgatggcgcctacccccgttgggcaccccagtgcctcccgctctgtactgtcaggcgaccatgaggcttccgggactggagttgtcgcaccgtcaggcgattccagctctgcacgctctctcaaacccggaggcccccgccccaacatcccccgagccacctgacaccacgtctcccgaaagccccgataccacttctccggagtctcccgacacaactagtcaggagccccctgacactacctcccccgaaccaccggacaagacctctcccgagcccgccccccagcagggaagcacccacaccccgcgctcccctggatccacacgtaccaggaggcctgaaatatcccaggcaggacccacccagggggaagtcattccaactggctcttccaaaccggccggcgaccagctgccagcggcgttgtggacttcttcagccgtactgggccttctcctgctagcgctgcctacctatcacctttggaagcgttgcagacatttggcggaagatgacacccacccgcccgcctcattgcgattactgccccaagtgtctgcctgggcaggtcttcgtggaaccggccaggtcggaatttcaccctcttag

SEQ ID NO: 43894 - DNA, 921 bp, Artificial Sequence
  Description of Artificial Sequence: Synthetic coding sequence
atgggcatcctggacatcgaggtgtggggcaaggacaacaagaagcacgaggagcgactaggtacttgcaaagtagacatttcagcactccccctaaagcaggctaattgcctggaactccccctcgatagttgtctcggcgcactccttatgcttgtgactctcaccccatgcgcaggggtcagcgtgagtgacctctgcgtttgcccacttgccgacctgagtgaacggaagcagatcacacagcgctactgtttgcagaactcgctgaaggatgtgaaagatgtgggcatcttgcaggtgaaggtcctgaaggcagcagaccttctggccgccgatttcagtggaaaatctgatccattctgcttgctcgagctgggcaacgatcgcctgcaaacacacacggtatacaagaatctgaaccccgaatggaataaagtctttacgtttcccattaaagacatccacgacgtcctcgaagtgaccgtgtttgacgaggacggggataagccacccgattttctgggaaaagtagccattccgctgctgtctattcgcgacggccagccgaactgttacgtgcttaagaacaaggatttggagcaggcttttaagggggtgatctaccttgaaatggaccttatttacaatcctgtgaaggcatctattcgcactttcacccctagagagaaaaggttcgttgaggatagccggaagttgagcaagaagatcctgtcacgggacgtcgacagggtgaagaggataaccatggcaatctggaacaccatgcaattcctaaagagctgtttccaatgggaaagcacccttcgcagcacgatcgcgttcgcacaccggaaagaggagcctccactgagcatgaagtgtaccttatttagcggtgatataggccctagcttgtag

SEQ ID NO: 43895 - DNA, 2337 bp, Artificial Sequence
  Description of Artificial Sequence: Synthetic coding sequence
atgctggacagctgcaagctgaagagcgcctgcaacctgcccttcatttgcaataagaaaatcattaacaccgccggtacatccaacgccgaggtgccacttgctgatcccgggatgtatcagctcgacattacactccggcgagggcagtctctggctgcacgggatcgaggtggtactagcgacccttacgtgaaattcaagattgggggcaaagaagtgttccgcagtaaaataatccacaagaacttgaatcccgtctgggaggagaaagcatgtatcttggtggatcaccttagagagcctttatacattaaggtctttgactatgacttcgggctgcaagacgacttcatgggctctgcgtttctggacctgactcagttggaactcaacagaccaaccgatgtgactctaaccctcaaagacccacactaccctgaccacgacctagggatcatccttctaagcgtaatcctgacacccaaagagggggagtctcgggacgtgaccatgctgatgcgtaaatcgtggaagaggagcagcaaagagctttccgaaaacgaggtcgtgggttcctatttctctgtgaagtcgctcttttggcgcacatgtgggcggcccgctctccccgtccttggtttttgccgagccgagttgcaaaacccctattgcaaaaatgttcagtttcagacccaaagcctgagattaagcgacctgcaccggaagagccacctgtggagggggatcgtctctatcaccctgattgaagggcgcgatctcaaggccatggactcaaatgggttaagcgatccctacgtgaaatttagactgggtcatcaaaagtataaatcgaagatcatgccaaaaacactgaatccccagtggagagagcaattcgatttccacctctatgaagaacgcggcggtgtcatcgacatcaccgcctgggacaaagatgccgggaagagggatgactttatcggcaggtgccaggtcgatctctcagcactgtcacgagaacagacacacaaacttgagctccagctcgaagagggcgagggtcatctggttttactggtgaccctgacagcgagtgccaccgtcagtatcagcgatctgtcagtgaattctctggaggaccagaaggaacgggaagagattttgaagcgttacagtcccttgagaatttttcataatctgaaagatgtagggttcctgcaagtgaaagtaatccgggccgagggcctcatggccgctgatgtaacgggaaagagcgaccccttttgcgtggttgaactcaataatgaccgactgctcacacataccgtttacaagaatcttaaccccgagtggaataaggtcttcacgttcaatattaaagatatccactctgtgctggaggtaaccgtttatgatgaggatcgtgaccgatccgccgacttccttggcaaagtggctattcctctgttgagtattcaaaacggcgaacaaaaagcatatgtgcttaaaaacaagcagctgactggcccaaccaaaggggtaatatacttggaaattgacgtgatattcaacgccgtgaaagcaagtcttaggactctgattcccaaggagcagaaatacattgaagaggagaatcgtctgtccaagcagttactgctgaggaactttatcaggatgaagcgatgtgtgatggttctcgtgaacgccgcttactacgtgaacagttgtttcgactgggactccccaccccggagtctggccgccttcgtgttgttcctctttgtggtctggaacttcgagttgtatatgattcccctggtgcttcttttgctcctgacatggaactattttctcatcatatcagggaaagataacagacaacgggataccgtcgtggaggacatgctcgaagatgaagaggaggaggatgacaaggatgataaggactcggagaaaaaaggcttcattaataagatatatgccattcaggaggtttgcgtctctgtgcagaacattctggatgaagtggcttcgttcggagaacgtattaaaaacacctttaactggaccgtaccattccttagctggctggcaatcgtggcactctgcgtgttcacagcaatcctgtactgtatcccactacgatatatcgttctcgtctggggcatcaataagttcactaagaaactccggagcccctacgccatagataacaacgaactgctcgactttctctctcgtgtgcctagtgacgtccaggtggtgcagtatcaagaactgaaaccggatcccagccatagcccatacaagcgcaagaagaacaacttgggttag

SEQ ID NO: 43896 - DNA, 738 bp, Artificial Sequence
  Description of Artificial Sequence: Synthetic coding sequence
atgtaccagctggacatcaccctgcggcggggccagagcctggccgcaagggataggggcggtacctctgatccatacgtcaaattcaagatcggcggcaaggaggtttttcgcagtaagattatccacaaaaacctgaaccccgtgtgggaggagaaagcctgtatacttgtggatcaccttagggaacctctgtacataaaagtgtttgactatgattttggcctgcaggacgacttcatgggcagcgctttcctggatctgacacagctggagttgaaccggcctaccgatgtgacgcttacccttaaggatccacactatcccgatcacgacctggggatcatcctgcttagtgtcattctgacgccaaaggagggtgagtctcgagatgtaacaatgctgatgaggaaatcttggaagcggtcgtcgaaatttcagacgcagagtctgcgattgagcgacctgcaccgcaaaagccatctttggcggggaattgtgagcattaccctcattgagggcagagacttaaaggccatggacagcaatgggctgagcgatccctacgtcaaattcagattaggccaccaaaaatacaaaagtaagattatgcccaagaccctgaatccacagtggcgggaacagttcgactttcacctgtatgaagaaagatgtggcattagtcccggtgaatcccaccaaagcgggcgcgtgaatggctgcagaagacattggtag

SEQ ID NO: 43897 - DNA, 2079 bp, Artificial Sequence
  Description of Artificial Sequence: Synthetic coding sequence
atgctggacagctgcaagctgaagagcgcctgcaacctgcccttcatttgcaataagaaaatcataaacaccgcaggtacatcaaacgccgaggtacccctggccgatcctggcatgtatcagttggatatcacccttcgaaggggacagagcctagcagccagagacagaggcgggacgtccgacccctatgtgaagtttaagattggaggaaaagaggtgtttcgaagcaaaataatccacaaaaatcttaatcccgtgtgggaagagaaggcatgcattctggttgaccatctgcgcgaaccactgtatattaaggtgttcgattatgacttcgggctacaggatgactttatggggagtgcattcctagatctcacgcagctggaattaaacaggcctactgatgtgacgttgaccctaaaagaccctcattacccagaccacgatcttggaatcattctgctgtcagtgatactgacccctaaggaaggtgagtctagggatgtgactatgctgatgcgcaaatcttggaagagaagctctaagttccaaactcagtccctgagactttctgacctccacaggaaaagccacttatggagaggcatcgtatccattaccttgatcgaaggtagggatctgaaggcaatggacagcaacgggttgtccgacccatacgtgaagttcaggctgggacaccagaaatataaaagtaagattatgccgaaaacactgaacccgcaatggcgtgaacagttcgatttccacctctacgaagaacgtgggggggtgatcgatatcacagcatgggacaaagatgccggaaagcgggacgacttcatcggcagatgccaggtggacctgtccgcactaagtcgggagcagactcacaaattagagttacaactggaggagggtgagggccacttagtcctcctcgtcacgctgacagcttcagcaaccgtgtcgattagcgacctttccgtcaactctctcgaggaccagaaggaaagagaagagattctgaagcggtactcccctctgcgcatcttccacaacttgaaggacgtgggcttcctgcaggtgaaggtaatccgagcggaaggcctcatggccgccgacgtcaccgggaaatcagaccctttctgcgtcgtcgagttaaacaatgacagactattgacacatacggtctataagaatctcaatccagagtggaataaggtgttcactttcaatataaaggacatccattcggtgcttgaggtgactgtttacgatgaggacagagaccgaagcgccgatttcttagggaaggttgcaattcccctgcttagcatccaaaatggcgagcaaaaggcatacgtgctcaagaacaagcagctcaccggaccaacaaagggcgtgatctaccttgaaatagacgttatcttcaacgcagtgaaggcttcactgagaactctgatcccgaaagaacagaagtacatcgaggaggagaatcgtctgtctaagcagcttctgctgcggaactttatccggatgaagcggtgcgtcatggtcctggtcaacgctgcatactacgttaattcatgttttgactgggacagcccaccaaggtccctcgctgctttcgttgttgtggaagacatgctggaagacgaggaggaggaggatgataaggatgacaaagacagcgagaagaaaggatttatcaataagatttatgcaattcaggaggtgtgtgttagcgtacaaaacatcctggatgaggtggccagcttcggcgaaagaataaaaaatacatttaactggaccgtgcccttcctgtcatggctggccattgtcgcgctttgtgtcttcacagcgatcctgtattgtataccactacgctacattgtgctcgtgtggggaattaacaagtttacaaagaagttacggagtccatatgccatcgacaataatgaactcctggacttccttagtcgtgtgccctctgatgtgcaagtggtgcagtaccaggagctgaagccagaccctagtcacagcccctacaagcggaaaaaaaataacctgggctag

SEQ ID NO: 43898 - DNA, 1548 bp, Artificial Sequence
  Description of Artificial Sequence: Synthetic coding sequence
atggacagcaacggcctgagcgacccctacgtgaagttccggctgggacatcaaaaatacaagtctaagattatgccaaagaccctgaatcctcaatggcgggaacagttcgatttccatctctatgaagaacggggcggtgtgatcgatataaccgcctgggataaagatgccggtaagcgggacgattttatcggacgctgtcaagttgacctgtccgctctaagtcgcgagcagacgcacaagcttgaacttcagctggaggagggtgagggccacctggtgttgctggtgactctgacagcttctgccacagtatcaatttcagatttgtctgtgaactctctggaggaccagaaggagagggaagaaatcctcaaaagatattctcccctgcgcatcttccataatctgaaggacgtcgggttcctgcaggtgaaggtaattcgggctgagggtctgatggctgcagacgtgaccggaaagagtgatcccttctgtgtggtcgagctaaataatgataggctgttaacacacactgtgtataaaaacctgaacccagaatggaacaaggttttcacctttaatattaaggacatccacagtgtgctagaagtgactgtgtacgacgaggaccgagaccgcagcgccgacttcttgggcaaggtggcgatacctttgctcagtatccaaaatggcgagcaaaaagcttacgtcctcaagaataaacaattgacaggtccaacaaaaggggtcatttatctcgagatagacgtgatattcaacgcagttaaagcatccctacgcaccctgattcctaaggaacagaagtatattgaggaagagaacagactgtccaaacagctgctgctgagaaattttattcgcatgaaacgatgcgtcatggtcctcgtgaacgcagcttactacgttaattcatgcttcgactgggatagtcctcccagaagtctagcggcctttgtcctctttctgttcgttgtctggaatttcgaattgtatatgatcccattggttctgctgctgctgctgacttggaactactttctgatcatttcagggaaagacaatcgccagcgagacactgtcgttgaggatatgctggaggatgaagaagaagaagatgacaaagatgataaagacagcgagaagaaggggtttatcaataagatctacgctattcaggaagtatgtgtgtccgtgcagaacatcctggatgaagttgctagctttggcgaacgcatcaagaatacctttaactggaccgtgccttttctgtcgtggctggccattgtcgcactgtgtgtgtttaccgcaattttatattgtatcccgctccgctatattgtgcttgtgtggggcatcaacaagtttacgaaaaagctgcgatctccttacgccatagacaataatgaactgctcgattttctctccagggtgccttccgatgttcaggtggtgcagtatcaggagttgaagcctgatccttctcatagtccttacaaacgcaaaaagaataacctcggatag

SEQ ID NO: 43899 - DNA, 1803 bp, Artificial Sequence
  Description of Artificial Sequence: Synthetic coding sequence
atgctggacagctgcaagctgaagagcgcctgcaacctgcccttcatctgcaataagaagatcattaacacggctggcacaagcaatgcggaagtccccctcgcagatcctggcatgtatcagcttgacattaccctgagacgcggccaatccctggccgcacgagaccgggggggcacttccgacccgtatgtcaaatttaagatcggaggaaaggaagtgttcaggtcgaagataatccataaaaacctcaatcctgtttgggaggagaaagcctgcattctcgtggaccacttacgtgaaccgctgtacatcaaagtgtttgactatgactttggcctgcaggatgacttcatggggagcgctttcctggatctgactcagctagagctgaatcgacctaccgacgtgacactgactcttaaggacccacactatcccgaccatgacctcgggattatcctcctctccgttatcctgacgcctaaagagggcgaatcccgggacgttaccatgctgatgcgtaagagctggaaacggagcagtaaggagctgtccgagaacgaggtggtggggtcttatttttcggtcaagtcactgttctggcgtacttgcggtcggcccgccctgcccgtcctggggttttgtagggctgagctacagaatccttactgtaaaaacgtgcagtttcagacacagagcctgagactgtcagacttgcatcgtaaaagtcatctctggcgtgggatcgtgagcatcactctgatcgagggccgcgatttgaaagcaatggacagtaatggcctcagcgatccctatgttaagtttaggcttggccatcaaaaatataagagcaagatcatgcccaaaacacttaatcctcagtggcgggagcagtttgactttcatctgtacgaagagcggggtggcgtcattgacatcaccgcctgggataaggatgcaggcaaacgggatgatttcatcgggaggtgtcaggtggatctatccgcactcagccgggagcagactcataaattagagcttcagcttgaggagggcgagggtcacctggtgctcttagtgaccctgacggccagcgccacagtgtccatcagcgacctgtcggtgaacagcctggaggatcaaaaagaacgcgaggaaatccttaagcgttactctcctctccggatctttcataatcttaaggacgttggcttccttcaggtaaaggtgattcgggccgaaggactgatggcagcggacgtgactggcaagtccgaccctttttgcgtcgtggagttgaacaatgacagactgctgactcacactgtgtacaagaacctcaatcccgaatggaataaggtctttacatttaatatcaaagacatccatagcgtcctggaggtcacggtctacgacgaggaccgggatagatctgccgattttctgggaaaggtagccattcctctgcttagcatccagaacggcgagcagaaagcatacgtcctgaagaataagcagctgaccggccccactaagggcgtaatctacctggagatcgacgtcatattcaacgctgtcaaagcgtcgctgcgaactcttatccccaaagaacagaagtacattgaggaggaaaataggctctctaaacaactgctgctgcgcaacttcataaggatgaaaagatgtgtgatggtgctagttaacgcagcgtattacgtgaatagttgctttgattgggatagtcctcctagatcattggcagccttcgtggcgctatatggtacatttataaacgtgtag

SEQ ID NO: 43900 - DNA, 246 bp, Artificial Sequence
  Description of Artificial Sequence: Synthetic coding sequence
atgctggacagctgcaagctgaagagcgcctgcaacctgcccttcatatgcaacaaaaaaatcattaacactgcaggcacctccaatgccgaggtgccactggctgatcctggcatgtatcagctggatattacactccgccgtggacagagtctagccgcacgagataggggtggcacctctgatccctatgtgaaatttaaaatcggagggaaagaagtgttcaggtcaaagattatccattag

SEQ ID NO: 43901 - DNA, 3000 bp, Artificial Sequence
  Description of Artificial Sequence: Synthetic coding sequence
atggagccccgggccgccgccgccggcgagcccgagccccccgccgcctcatctagttttcaggcccggctttggaaaaatctccagctcggggtagggcgcagcaaaggaggcggaggcggacgcgccggcgggcctgaacgcagaacagccgacaccccctcaccatctcctcccccaccggtgggaaccggaaatgcacccgcccgcgggagcggcgctggatccaggtggagtgggtttaagaagaggaagcaggttctggatcgagtgttcagctcatctcaacctaatctctgttgcagcagccccgagccattggagcctgggggtgccggccgggccgaacagggaagcactttgagacggcgcattagagagcaccttttaccagcagtgaaaggtcctgccgccgcaagcggcgcggcaggaggtactcctcctggtggtcggtctcctgactctgcccctagttcctcttccgctagtagttcattatcatcttccccacaacctcccccccggggcgacagagcgcgggatgagggcgcaagacgccaggggccaggtgcacatctgtgccatcagaagagctcatcactgcctggcactgcatgtctggagcagttgctcgagccacctccacctcctgccgagccagcccgaagccccgcagagagcagggccccagagacgggggaagagcatggttcttctcaaaaaatcatcaacacggccggtacgtcgaacgcagaagtccctctcgccgatcctgggatgtaccagcttgacataacccttcgaagaggacagtcactcgccgccagagatcgcggcgggacttctgacccctatgtgaaattcaagataggtggtaaggaggtcttcaggtccaaaataatccacaagaacctgaacccagtttgggaagagaaagcatgcatcttggtagatcacttgagggagcctctatacatcaaggtgtttgattacgactttggcttacaagacgactttatgggctctgcattccttgatcttacacagctggagttgaataggccaaccgatgttaccctgaccctgaaggacccccattaccccgaccatgatttgggcatcatcctactgtctgttatcctcacccctaaggaaggcgagagtagggatgttacaatgctgatgcgcaagtcatggaagcgctcatcaaaagagctgtcagaaaacgaggtggtgggttcctattttagtgtcaagtcactcttttggcgaacctgcgggcgtccagccctcccagtgctagggttttgccgcgccgagctgcaaaatccttattgtaagaatgtccagttccagacgcagagcctaagactctcagatcttcaccggaaaagccatctatggcgcgggattgtatcaatcaccttaattgaggggagagacctcaaggctatggactctaatggactgagtgacccctacgtgaagttccggctcggccatcagaaatataagtccaaaatcatgccaaagaccctcaatccacagtggcgcgaacagtttgacttccacctgtacgaggagagaggcggcgtcatcgatatcaccgcgtgggataaagatgccgggaaacgcgacgacttcataggtagatgtcaggttgacctcagcgccttatcccgagagcagacgcataaactggaactccaactggaagagggagagggccaccttgtacttctggttactctgacagccagtgctacagtgtccataagcgatctttcagtcaattccctggaggatcaaaaggaacgtgaagaaattctaaaacgatactcccccctgagaatattccataacttgaaggacgtgggttttctccaggtcaaagtgatccgcgcagagggcttaatggccgccgacgtgacagggaagagcgacccattctgcgttgtcgagctgaacaacgacagactactaactcacacggtctacaaaaacctgaatcccgaatggaacaaagtgttcacattcaacattaaagatattcactcagtcctggaagtcacagtctacgatgaggaccgcgatcgcagtgccgacttcctcgggaaagtggcaattcctctgttaagcattcagaacggggagcaaaaggcctacgtactgaaaaacaagcagctaacaggacccacgaagggagtgatttacctggaaatagacgtgatctttaacgcagtaaaggcctcactaaggacattgattccaaaagagcagaagtacattgaggaagagaaccggctctccaagcaactcttgctgcggaatttcattcgcatgaagcgctgtgttatggtgctggtaaatgcagcctattatgttaacagctgttttgattgggactcacctcctaggagtctggccgcctttgtgctcttcctgtttgtggtgtggaattttgagctctatatgatccccctggtcctgcttcttctgttgacttggaactacttcttgattatatcaggaaaggataatcgccaaagggatactgtcgtggaggacatgctggaagatgaggaggaggaggacgataaagacgataaggacagcgagaagaagggcttcattaacaaaatctatgccatccaggaagtctgtgtatcagtgcagaatatcctcgatgaggtagcatcttttggcgagaggataaaaaacacattcaattggacagtgccattccttagttggctggccatcgtcgcactctgtgttttcaccgccattctgtactgcatacccctgcgatacatagtcctggtatggggtatcaataagtttacgaagaagcttagatcaccctacgcgattgacaacaatgaactcctggactttctcagtcgggtgccaagtgatgtgcaggtagttcagtatcaggagctcaaacctgacccttctcattctccctacaagcggaaaaagaataacctcggttag

SEQ ID NO: 43902 - DNA, 921 bp, Artificial Sequence
  Description of Artificial Sequence: Synthetic coding sequence
atgggcatcctggacatcgaggtgtggggcaaggacaacaagaagcatgaggagcggttgggaacctgcaaagtggatatcagtgcgctcccgcttaaacaggccaactgcctggaactcccgctggacagctgcctgggcgccctcttaatgctggtgactctgactccgtgtgctggcgtgtcagtctcggacctctgtgtgtgtccgctggcagatctgagcgaaagaaaacaaattactcaacggtactgcctgcaaaacagtttgaaggacgtcaaagacgtaggtatcctccaggttaaggtgttgaaagcagcagatctgctggccgcagactttagcggcaagagtgatcctttttgcctacttgagctagggaatgatcggctacaaactcataccgtctacaaaaatctcaacccggagtggaacaaagtgttcacttttcctatcaaggatatccatgacgtgctcgaagtaactgtctttgatgaggacggcgacaaacccccagatttcctggggaaagtggcgattccattgctaagtatccgggacggacagcctaactgctacgttcttaaaaataaggatctggagcaggcttttaagggggtaatttatctcgagatggatctcatatataatccagtgaaggcatctatccggacgttcacacccagagagaagcggttcgtggaggattctcgaaagctgagtaaaaagatcctgagtcgggatgtggaccgcgtgaagcgtatcacaatggcaatttggaacactatgcagtttctaaaatcgtgttttcagtgggagagtaccttaagatcaacgattgcctttgcccaccgaaaagaagagccacctctgagtatgaagtgtactctgttctccggtgacatcggaccctctctctag

SEQ ID NO: 43903 - DNA, 2637 bp, Artificial Sequence
  Description of Artificial Sequence: Synthetic coding sequence
atggacctggacaagcccagcgtgtggggcagcctgaagcagcggactcgtccactgctcatcaatctgagtaagaagaaagtcaagaagaacccgagtaaaccacccgacctcagggctaggcatcaccttgacagaagactctctctgtccgtgcctgatctcttggaggccgaagcactggcccctgaaggccgcccctattcaggcccgcagtcatcctatacctctgttcctagctccctctccacagcaggtattttccccaagtccagctcttcctccctaaagcaatccgaagaagagctagactggagtcaggaagaggccagccacctacatgtagtagagacagactccgaagaggcatatgccagcccagccgaaagacgccgagtctcaagtaatggtatcttcgatctgcagaaaacctctctaggaggggatgcccccgaggaaccggaaaagctatgtgggagttcagatctaaatgcttctatgacctcacaacatttcgaagaacaatcagtccctggtgaggcatccgacggcctgtcaaacctgccctcccctttcgcctatctcttgacgatccacttaaaggaagggcgcaatctggttgtccgggatcggtgtggtaccagtgatccttacgtgaaattcaagctcaatgggaaaaccctctataaatccaaggtgatctataagaacttgaatccagtgtgggatgagatcgtggtcttgcccatacaatccctggatcagaaacttagagtgaaggtgtacgatagggacctcactacctccgacttcatgggaagcgcattcgtgatactgtctgatctcgaactgaacagaacaaccgagcatattctaaagcttgaagaccctaactctctggaggacgatatgggggtcatagtgctcaatttaaacctcgtcgtgaagcaaggagacttcaaacggcatcgctggagtaatagaaaaagactgtccgcgtctaaatcaagtctgataaggaacttgcgactgtctgaaagcttaaaaaaaaatcagctttggaacggaataattagtattacactgctcgaggggaagaacgtatccggtggaagcatgaccgagatgttcgtgcagctcaaactgggagaccaacgctataagagcaagactctctgcaagagcgccaacccacagtggcaggagcagttcgacttccactacttttccgaccgcatggggatcctcgatatcgaggtgtggggcaaagacaataagaagcatgaagaacgactcggtacttgcaaagtggatatttccgcgctcccacttaagcaggcaaactgtctggagctgccattggactcatgcctaggtgctctcttgatgctggtaacactcactccctgcgccggagtttctgtctcagatctatgcgtctgtcccctcgctgatctctcagagcgaaagcagatcacacagcgctattgcctgcagaactcattgaaagacgttaaggacgtcggcatcctgcaggtgaaggtgctcaaagctgccgatctcctggctgctgacttttctggaaagtctgaccctttttgcctcttggagttgggtaatgaccggcttcagactcacacggtctacaaaaacctgaaccccgaatggaacaaggtgttcacatttccaatcaaagatattcacgatgtcctggaagtgaccgtgtttgatgaagatggcgacaagcccccggactttctgggcaaggtggcgattcccctgctctcaatacgagacggccagccgaactgctacgtcctgaaaaacaaggacctggagcaggccttcaaaggcgttatctatctggaaatggatttgatctataatcctgtgaaagcatcgattagaacattcacaccccgggagaaaagatttgtggaggattcaaggaaactgagtaaaaagattctgtctagagacgtggatcgggtgaaaagaattaccatggcaatatggaacactatgcagttcctcaaatcctgtttccagtgggaatcaacccttcggagtaccattgccttcgctgtgttcctgatcacagtatggaacttcgaactatacatgatacccctggccttattattgattttcgtctacaatttcattcggccagtcaagggaaaggtgagctccatccaggactctcaggagtccaccgatatagacgacgaggaggatgaggacgataaggaatccgagaaaaaggggctcatcgaaagaatttacatggtccaggatattgtaagtacggtgcaaaatgtcctggaggaaatagcatcctttggggaacgtattaagaatacatttaattggactgttccatttctctctagcttagcttgcctaattttggctgccgccacaattatcctatattttattccactacgatacatcatactgatctggggtatcaataaattcactaagaagctgcggaacccctacagcattgataataatgagctgctggattttctgtccagagtccctagtgacgtgcagaaagtgcagtatgcagaactgaaactctgctcctcacactctcccctgcggaaaaagcggagtgcgctgtag

SEQ ID NO: 43904 - DNA, 2472 bp, Artificial Sequence
  Description of Artificial Sequence: Synthetic coding sequence
atggacctggacaagcccagcgtgtggggcagcctgaagcagcggactcgccctcttctgattaatctcagcaagaagaaagtcaagaaaaatcccagcaaaccaccggatctgagggcccgtcaccacctcgatcggcgactgtccctctccgtgcccgatctcctggaagccgaagcactggctccggagggaaggccttactccgggcctcagtctagctatacaagcgtaccaagttcactcagcacggctgggattttcccaaagtcctctagtagctctttaaaacagtctgaggaggaactggactggagccaagaggaagcaagccacctgcatgtggtggagaccgactccgaggaggcttatgcttcccccgccgaacgacgacgtgtgagctcaaatgggatcttcgacctgcagaagaccagcctgggaggtgatgcgccagaggagcccgaaaagctttgcggctccagcgacttaaatgcctctatgacgtcccaacatttcgaggagcagtcggtcccaggagaggctagtgacggcctgtcaaatttgccatccccttttgcatatctcctgacgatccacctcaaagagggtcggaatctggttgtgagagatcggtgtgggacctctgacccttatgtaaaatttaagctaaacggcaaaaccctgtacaagagcaaagtgatatacaaaaatctgaatccagtgtgggacgagatcgtggttctacctattcagagcttggaccagaagctccgggtcaaggtgtatgaccgtgatctcacaacatctgactttatgggctcagcgtttgtgattctctctgatttggaactgaaccggacaacagaacacatactcaaactggaagatccgaattcattggaagacgatatgggcgttatcgtattgaacctgaacctcgtggtgaagcagggcgattttaagaggcacagatggtccaataggaaacgattatcagcctcaaaatcgtctctgatcagaaatctgcggttgagcgagtccctgaaaaagaatcagctgtggaacgggattatcagtattaccttgttggagggcaaaaacgtgagcggcgggtccatgacagagatgtttgtgcagctgaaactgggcgaccagcgttataagtctaaaactttgtgcaaatccgccaacccgcaatggcaagagcagtttgactttcattacttctcggaccggatggggattctggatatcgaggtttggggtaaagacaataagaagcatgaagagcggctggggacctgtaaggtagatatctctgcgcttcctctcaaacaagccaactgtctggaattaccactggacagttgcttaggtgcactcctgatgctggtgaccttaaccccctgcgcaggggtatctgtctccgacctgtgtgtgtgtcccctagccgacttatcagaacgcaaacagataacacagcgctactgcctgcagaacagcctgaaagatgtaaaagacgtgggaattcttcaggtgaaggtgctaaaagcagccgacttactcgcagccgactttagcgggaaaagtgatcctttctgccttctggagctgggcaatgaccgcctccagacccacacggtgtataaaaatctgaaccctgagtggaataaggtgtttacctttcccattaaagatatccatgatgtgcttgaggtgaccgtgtttgatgaggacggagataagccacccgatttcctgggaaaggtggctatccctctcttgtctattcgcgacggacagcccaactgctatgtactgaagaacaaggacctggagcaggccttcaagggcgtcatatatctagagatggatctcatatataaccccgttaaggcatccatcagaactttcactccacgcgagaaaaggttcgtggaggattcaagaaaactgagtaagaaaattctgagtagggacgtggatcgggtaaaacgcatcacaatggctatatggaataccatgcagttcctgaaatcatgttttcagtgggaaagcactctgaggagtacgatcgcctttgcggaaagtgaaaaaaagggcctcattgaaaggatctatatggttcaggatatcgtgtccaccgtacagaatgtgctggaagagattgcaagctttggcgagaggattaaaaacacattcaactggaccgtgcctttccttagtagtctggcctgtctcatactggccgcagctaccatcatcctgtactttatacctctccggtacatcatactgatttggggtatcaacaaattcacaaaaaaactgagaaatccctattctatagataataatgagctgcttgatttcctgtcccgagtgcctagcgacgtgcaaaaggtgcagtatgcagagctgaagctctgcagctcccattctcccctgaggaaaaaacgttcagcgctgtag

SEQ ID NO: 43905 - DNA, 1191 bp, Artificial Sequence
  Description of Artificial Sequence: Synthetic coding sequence
atggacctggacaagcccagcgtgtggggcagcctgaagcagcggacacgcccactgctaatcaatctttcaaagaagaaggtgaagaagaacccgagcaaacctcccgatctgagagcgaggcatcaccttgaccgacgcctctctctgagcgtccctgatctgttggaagctgaggctctagctccagagggtaggccgtatagtggcccacaaagcagttatacgtcagtgcctagcagcctctcaacagctggaatattccctaagagcagttcttccagcctgaaacagtccgaagaggaactggattggtcacaagaggaggcatctcatttgcacgtcgttgaaaccgattctgaagaggcctacgctagccccgccgagcgccggcgagtctccagtaatggcatttttgacctgcagaagacttcattaggaggagatgcaccagaagagccggagaagctgtgcggctcctctgatctgaacgcctctatgaccagccagcacttcgaggagcaaagcgtgccgggggaggcaagtgatggcttgagcaatctgcccagtccattcgcatatctgttgaccatccatctgaaggaaggcaggaaccttgtggtgagagacagatgcggcacatcagatccctatgtgaaattcaaactgaatgggaaaacattgtacaagagcaaggttatttacaagaatttgaaccccgtctgggacgagatcgtagtgctgcctattcagagcctggatcaaaaactgagagtcaaagtctatgacagggaccttacaacgtctgactttatgggcagcgctttcgtaattctgtccgatctcgaattgaatcggaccaccgagcatattctcaagctggaagaccctaattctctcgaggatgacatgggcgtgatcgttctcaacttaaatttagtggtaaagcagggagactttaaacggcatcgttggagtaatcgcaagagactgagcgcatccaaatcttctctgatcagaaatctgaggctgagcgagtcactgaaaaagaatcagctctggaatggaattatttccattacccttttggaaggaaagaatgtgtcggggggcagcatgactgagatgttcgtgcaattaaaactgggcgatcagcggtacaagtcaaaggatggccatttcggacactag

SEQ ID NO: 43906 - DNA, 2661 bp, Artificial Sequence
  Description of Artificial Sequence: Synthetic coding sequence
atgggcatggacctgacctgccccttcggcatcagccccgcctgcggagcccaggctagctggtcgatattcggcgcagacgctgctgaggtccctggtactagaggccactcccagcaggaggctgcaatgcctcacatcccagaggatgaggaaccccccggtgagccgcaggctgcccagagtccagctgggcagcaaggaccccctgcggcaggcgttagctgctcaccgaccccaaccatagtcctgaccggggatgccacaagtcccgagggcgagactgataagaacttggctaatcgcgtgcacagtccccataaacgcctctctcacagacacctcaaggtcagcacggcgtctttgactagcgtggaccccgccggccatattattgatttagtgaatgaccagctgcccgacataagtatatccgaggaggacaaaaagaaaaacctggccttgctggaggaagccaaactggtgtccgaacgcttcctcactaggaggggaagaaagagccgtagtagcccaggtgattctccgtcagcagtgagcccaaatctgagtccaagtgcgtccccaactagctcacggagtaatagtctgactgtacctaccccaccagagggtgatgaagctgatgtgtcttcccctcatcctggcgaacccaacgttccgaagggtctggctgatcggaagcagaatgatcaaagaaaagtatcgcagggccgccttgccccacgtcctcccccagttgagaagagtaaagaaattgccatcgagcaaaaagagaacttcgatcccctgcagtaccctgagactacgcccaagggcttagcccccgtaaccaacagctctggcaagatggcccttaattccccgcagcctggccccgtcgagagcgagctgggtaaacagctacttaagactggctgggagggctctccccttccgcgcagcccgacccaggacgccgctggtgtgggaccaccagccagccagggtcgcggacctgcaggcgagcctatgggaccagaagccggctctaaggccgagctgcccccaactgtttctagaccccctcttctgcgcggtctttcatgggacagcggtccagaggaaccggggcccaggttgcagaaagtgcttgctaaactgcccctggcagaggaggagaaaaggtttgccggcaaagccggcggaaagcttgcaaaggcccccgggctgaaagacttccaaattcaggtgcaacctgtgagaatgcaaaaattaactaagctcagggaagagcatatcttaatgagaaatcagaatttggtgggtctgaaactgccagacttatctgaagcggctgagcaggaaaagggccttcccagtgagctaagccctgccattgaggaagaggagagtaagtcggggctggacgtgatgccaaacatatccgatgttctactgcgcaagctgagagtgcacagatctttgccagggtccgctccgcctctgactgaaaaagaggtggaaaacgttttcgttcagctcagcttagcattcagaaatgattcatatactctggagtccaggattaatcaggctgagagagagaggaatctgaccgaggagaacacggagaaagagctcgagaacttcaaagccagcattacgtcatcagcatccctgtggcaccactgtgagcaccgggagacgtatcagaaattgctagaggacatcgccgttctgcaccgacttgccgcgaggctgagctcccgggcagaagtcgtgggcgccgtcaggcaggaaaaacgaatgagcaaggcaactgaggtgatgatgcagtacgtcgagaatctgaaacgaacttatgagaaggaccatgccgagctgatggaattcaagaaattggccaatcagaactcctccagaagttgcgggcccagtgaggacggagtgcctcggaccgcgcggtctatgagtctcacactcgggaaaaatatgcccagaagacgggtgtcggttgccgtggtgcccaaatttaacgccctcaacctacccggacaaactccgtcttccagcagtattccctccctacccgccctatcagaatccccaaacggtaaaggatcccttccagttaccagtgcactcccagccctgctggagaatggcaagactaatggtgaccctgattgcgaagcctccgcacctgcccttacactctcatgcctggaggaattaagtcaagagaccaaggccagaatggaggaagaggcctatagtaaaggattccaggaaggtctcaagaagacaaaggagctccaggacctgaaggaggaagaggaagaacagaaatccgagtctccagaggagcctgaagaggtagaggaaacagaagaggaagagaaagggcctagatcgagcaaacttgaggaactagtgcattttttacaggtcatgtaccctaaactgtgtcagcattggcaggtgatctggatgatggccgccgtaatgttagttttaaccgtcgtgctgggactgtacaactcttacaattcatgcgctgagcaggcagacgggcccctgggccgcagtacctgtagcgctgcacagcgggattcatggtggtcctctggcctccaacatgagcagcctacggagcaatag

SEQ ID NO: 43907 - DNA, 2712 bp, Artificial Sequence
  Description of Artificial Sequence: Synthetic coding sequence
atgggcatggacctgacctgccccttcggcatcagccccgcctgcggggctcaggcctcctggtccattttcggagcggatgccgccgaggtcccaggcacccgggggcattcccaacaagaggcagccatgcctcacatccctgaggacgaggaacctcctggggagccccaagccgctcaatcgcccgccgggcagggcccacctgctgctggggtctcgtgtagcccaacccctaccatagttctgaccggtgacgccacaagccccgagggcgagacagataagaatttggccaacagagtccacagtccccacaaaaggctgtcccaccgccacctgaaggtctcaacagcaagcctgaccagcgtcgaccccgccggtcacattatcgatctcgttaacgaccagctgccagacatcagtatcagtgaagaagataagaaaaagaatctggccctgcttgaggaagctaagttggtctcagaaaggttccttacgagacgcgggagaaaatctcggagttctccaggggattccccgagcgccgtatctcccaacctatctcccagcgcatctcctaccagctcaaggtctaacagtttgaccgtacccacccctcctggccttgacgtgtgcagtggtccaccctcccccttgccgggcgcaccgcctcaaaagggtgacgaggcagatgtttcatccccccaccctggggagcccaatgttcctaagggactggcggatcgcaaacaaaatgatcagaggaaagtttcacagggacgacttgcgcccagacctccccctgtggagaagtctaaagagattgctatcgagcagaaggagaattttgaccctctgcagtatccagagaccacgcctaaaggactggcgccggtgaccaactcttccggaaaaatggcactgaactcacctcagcccgggcccgtcgagtccgaactgggcaagcagctcttgaaaaccggctgggaaggttccccactcccgcgaagtccgacccaggatgccgctggcgtgggcccaccagcctcccagggaaggggcccggctggtgaacctatgggaccagaggccggttctaaggcagagttaccacctaccgtaagtcgacctcctctgttgcgtggcctatcgtgggatagcggccccgaagagcccgggccccggcttcagaaggtgcttgccaagctgcccctggctgaagaggaaaagaggtttgccgggaaggccggcgggaagcttgccaaggcccccgggctgaaggactttcaaattcaggtccagccagtcagaatgcagaaattgaccaagcttcgggaggagcacattctcatgcggaaccagaatctggttgggctgaaactcccggatttgtctgaggctgccgagcaggagaaaggactcccttcagaactctctcccgctatcgaggaggaggaatccaagagcgggttagacgtgatgcccaacatttccgatgttctgttaaggaagttgcgcgtgcatagaagtctgcctggctccgcaccgcccttgactgagaaagaggtcgaaaatgtgtttgtacagctgtcattggcgtttcgtaatgacagttatactctcgaatctcgaatcaaccaggctgagcgggaacgcaatttaacggaggagaacacagaaaaagagcttgagaactttaaggctagtatcacgagcagtgcgagcttgtggcaccactgcgagcaccgtgagacatatcagaaactgctcgaggacatcgctgtgctccacaggctcgccgctcgcctgtcctctagggccgaagttgttggtgctgtgcgtcaggaaaagcgaatgtccaaagccacagaagtgatgatgcagtatgttgaaaatttaaaaagaacatacgaaaaggatcacgccgaacttatggagtttaagaagcttgccaatcaaaactctagtcgcagctgcggaccgtcagaagacggtgtgccccgaacggcaaggtccatgtcactgacgcttggcaagaacatgccccggaggagagtgagcgttgcggtcgtgcccaagtttaacgctctcaaccttccagggcagacgcctagcagttcctccataccctctctccccgccctctcggaatcacctaacggcaaagggtcgctgcccgttacttccgcattgcccgctcttcttgaaaatggaaagactaacggcgaccccgactgcgaagcaagcgccccagctctgactctatcttgcttggaagaattaagccaggaaacaaaagccagaatggaagaagaggcatacagcaaggggtttcaggagggattaaaaaagactaaagagttgcaagatttaaaagaggaggaggaagagcaaaagtccgagagccctgaggagcccgaggaggtggaggagactgaggaggaggaaaaggggcccagaagcagcaaactcgaggaattggtgcactttctgcaggttatgtatccgaagctttgtcaacactggcaagtgatatggatgatggcggccgtgatgctcgttctgaccgtcgttcttgggctatacaacagctacaactcttgcgcagaacaagcggacggtcccctgggacggtctacatgcagcgctgctcagcgggattcttggtggagctccggccttcagcacgagcagcccactgagcagtag

SEQ ID NO: 43908 - DNA, 1794 bp, Artificial Sequence
  Description of Artificial Sequence: Synthetic coding sequence
atggccctgaacagcccccagcccggccccgtggagagcgagctgggcaaacagcttctgaagacagggtgggaaggcagccctctccctaggtcaccaacccaggatgcagcaggcgtcggtcctccagcatctcaaggacggggccccgccggcgaaccaatggggccagaagccggctcgaaagcagaactccctcctactgtaagccgccctccactgttaaggggcctttcttgggactcgggaccagaggagcctggcccccgcctccagaaggtgctggccaagctgccccttgctgaggaggagaagcggtttgccggcaaagccggcgggaagttagcaaaagcccccggcctaaaggacttccagattcaggtacagcctgtgcgtatgcagaagctaaccaaactgcgagaggaacacattctcatgaggaaccaaaacctcgttggtctgaagcttccggacctgagtgaggccgccgagcaggagaaggggcttccctcagaactgagccctgccatcgaagaggaagagtctaaatctggtcttgacgtgatgccgaacatcagtgacgtcctcctccggaagctacgtgtccacagatccctccctggcagtgccccaccgctgacggaaaaggaggtagaaaacgtgttcgtccagcttagtctcgccttcaggaatgactcctataccttggagtcgcggattaatcaggccgaaagggaacgtaatcttactgaagagaacacagaaaaggagcttgagaattttaaagcctccattacatcttcagccagtctatggcatcactgcgagcaccgggagacttatcagaagttgttggaggatatcgcagtgctccataggctggcagctcggctgtccagtcgggcagaggttgtgggtgcggtgcgccaagagaaaaggatgagtaaagccaccgaagttatgatgcagtacgtggagaacctgaagaggacctatgaaaaagatcacgccgaattgatggagttcaagaaactcgctaaccaaaactcctcccgttcatgtggtccctctgaggacggtgtgcctagaacggcccggagcatgtctctaacgctaggcaagaacatgccccgaaggagagtgagcgtggctgtggtgcctaagtttaacgcattgaacctgccgggccagacccccagcagtagcagcattccctccctgcccgccctatcagaatctcctaacggcaagggcagccttcctgtgacctctgcactgcccgcgctcttggagaacggaaagactaacggagatcctgattgtgaagcgtcagcacccgcactcaccctgtcctgtttggaggaattgagccaggagactaaggctcgtatggaagaggaggcttatagcaagggattccaggaaggtcttaaaaagaccaaagaattgcaggatctgaaagaggaggaggaagagcaaaagagcgagagcccagaggaacctgaagaagtagaagagactgaggaagaggaaaaggggcctcgctccagcaaactggaggagctagtacactttctccaggtcatgtatccaaagctgtgccagcactggcaggttatctggatgatggccgcagtaatgctggtactgacagtcgttttgggtctgtataactcctataactcctgcgcagagcaggctgatggccctttagggagaagtacgtgttctgctgctcaaagggactcttggtggagcagtggcctgcagcacgaacagccgaccgagcagtag

SEQ ID NO: 43909 - DNA, 2658 bp, Artificial Sequence
  Description of Artificial Sequence: Synthetic coding sequence
atgggcatggacctgacctgccccttcggcatcagccccgcctgcggagcccaggccagttggtcgatcttcggagccgatgcagccgaagttcccggtacaagggggcattcccaacaggaggctgccatgccacacatccccgaagatgaggaaccaccaggcgagcctcaggccgcccagtcccccgcaggccaggggccacccgccgctggtgtgtcttgctctcccacacctaccatcgtgctgactggcgatgccacatcacccgagggggaaacagacaagaatctagccaaccgcgtacactccccccataagaggctatcacataggcatctgaaggttagcaccgccagtctgacttccgttgacccagcagggcatataatcgacctggtgaacgaccaactccccgatattagcatctccgaagaagataagaaaaaaaatttagccctgttagaggaggctaaactggtctccgagagatttttgacacggcgcggtcgaaaatctcgatcttctcccggagatagcccttctgccgtcagtcccaaccttagcccatcagcctctcccacctcatcacggtcaaacagcctcacggtgcccaccccgcccgacggcgatgaggcagatgtgtcaagtcctcaccctggtgagcccaatgttccaaaaggcttggccgataggaaacagaatgatcagagaaaggtgtcccagggtcggctggccccaagaccccctcccgttgagaaaagcaaggagatagcaatagaacagaaagagaattttgatcctctccagtatcccgagactacacctaagggtcttgctccagttactaacagctctggaaaaatggctctcaacagcccgcagccggggcctgtggagtctgagcttggcaaacaattgttgaagactggttgggagggatccccactgcctcgatcgcctacccaagatgctgctggggtaggaccaccggcaagccaggggcgaggtccagctggagagcccatggggcctgaagcaggaagtaaagcagagttacccccaaccgtgtctaggccacccctgctacgcggtctttcttgggacagcggccccgaagagccaggtcccaggctgcaaaaggtccttgccaaattgcccctggccgaggaagagaagagattcgccgggaaggcggggggcaaactcgccaaagctcctggtctgaaggatttccagatccaagtacagccagtgaggatgcagaagctgactaagctccgggaggaacatatcctgatgcggaatcagaaccttgtggggttgaagcttccagatctgtcggaggcagctgaacaagagaagggactgcccagcgagctatctcccgctatcgaagaagaggagtcaaaatccggcctcgacgttatgcccaacatctccgacgttctgctgcgcaagttaagagtccaccgctccctccctggaagtgctccaccactcaccgagaaggaagtagaaaacgtctttgtgcagctgagtctggctttccgcaacgattcatacacactggaatctaggatcaatcaggctgaacgggaacgcaatctgacagaggaaaatactgagaaggagcttgaaaacttcaaggcctcaattacttctagcgctagcctgtggcatcattgtgagcatcgcgaaacctaccaaaagctgctggaggacatagcggtgctgcaccggctggccgcccggctgtccagccgtgcggaagtagtaggcgccgtgcgacaggagaagcggatgtcaaaggccacagaggttatgatgcagtatgttgagaaccttaaacggacatacgagaaagaccatgctgaactgatggagtttaaaaagttggccaaccagaatagcagtcgatcctgcggacctagtgaagacggtgtgcccaggacagccaggagcatgagtctaaccttaggcaagaacatgccgcgcagacgcgtgtcagtcgccgtggtgccaaaattcaacgctctgaacctgcctgggcagactccctcgagtagtagcattccatctctccctgctctcagtgagagcccaaatggcaaaggatcactacctgttacgagtgctttgccagcgctgcttgaaaacgggaagacgaacggtgacccagactgcgaggcatctgcgcctgcgttaaccctctcatgcctcgaggaattaagccaggagactaaggctagaatggaggaggaggcatactcaaaagggtttcaggagggcctgaagaagactaaagaattacaggatctcaaagaggaggaggaggaacagaaaagcgaatctcctgaagaacccgaagaggtcgaggagacagaagaagaagagaaggggcctcgcagtagcaagctggaagaattagtgcactttttgcaagttatgtaccctaagctctgccagcactggcaggtcatctggatgatggcggctgtgatgctagtactcaccgtggtactgggcctctacaacagctataactcatgtgccgaacaagcagatggacctttggggcgctcaacttgcagcgccgcgcagagggattcttggtggagtagcgggctgcaacatgagcagccgactgagcagtag

SEQ ID NO: 43910 - DNA, 2466 bp, Artificial Sequence
  Description of Artificial Sequence: Synthetic coding sequence
ctgaccggcgacgccaccagccccgagggcgagaccgacaagaacttggcaaaccgcgtgcatagcccccacaagcgcctgagtcaccgccacttaaaggtttctaccgcttcactaacctccgtcgatcctgccggccacatcatcgatttagtgaacgatcagctcccagatattagtatcagtgaagaagacaagaaaaagaatctcgccctactggaagaggctaagcttgtcagtgagaggttcctgaccaggagagggcggaagtctcgcagttcccctggagatagcccaagtgccgtgtctcccaatttgtctccatcagcatctccaacaagttcacggtcaaattctctcactgtgcctacaccacctggtctagacgtttgtagtgggcccccttcgccactgccaggcgccccacctcaaaaaggcgacgaggccgatgtctcatccccccatccaggagagcctaacgtccccaaaggcttagctgacaggaaacagaacgatcagcgcaaggtcagccagggcagactcgcccctcggccccccccagttgagaaaagcaaagagattgcaatcgagcagaaggaaaattttgaccctttgcagtaccctgagactacccctaaaggcctggcacctgtcactaatagttctggcaaaatggccctgaattccccccagccagggcccgtcgaaagtgaattaggtaaacaactgctaaaaactggctgggagggatctccgcttcccaggagtcctacacaagatgctgcgggtgtcgggcctcctgcatcgcaggggcggggcccagcgggagaaccgatgggccccgaggcaggaagtaaggccgaattgccccctacagtatcgcggcccccccttctgaggggcctgtcctgggattctggccccgaggaaccagggccaagactgcagaaagtgttggctaagctacccctcgccgaagaagaaaagcgctttgcgggcaaagccggcggaaaactggcgaaggcacctggactgaaggactttcagatacaggtgcagccggtcaggatgcaaaagcttaccaaactaagagaagagcatattctgatgagaaatcagaacctggtaggtctgaagctgcccgatctgtctgaggctgccgaacaggagaagggcttacctagtgaactgtcacccgctatcgaggaagaggaatctaaaagcgggctggatgtgatgcctaatattagcgacgtgctgctcagaaagctccgagtgcacagatctttacccggatctgctcctcccctaaccgaaaaggaggtcgaaaatgtcttcgtgcagcttagtttagccttcaggaacgattcctatacactcgagtcccggattaaccaggccgagagagagcggaacctgacagaagagaatacagagaaggaactggagaattttaaggcctcaataacatcttcagcctcgttgtggcaccattgcgaacaccgggagacttatcagaaactgttagaggacatagcagttcttcacaggcttgccgcaaggctatcctctagagctgaagtggtcggtgctgtgaggcaggagaagcggatgagcaaggccaccgaggtgatgatgcaatatgtagaaaacctgaagcgcacttacgagaaggaccatgctgagctcatggagttcaaaaagctggccaaccagaatagctcacggagctgtggcccgtcagaagatggtgtcccgaggaccgccagatctatgtccctgaccttggggaagaacatgcctcggcggcgagtctccgtggcagtggtgccgaagtttaatgccctgaacctcccgggtcagacccctagcagctcctcgataccatcattacccgccctgtcggagtcgcccaatggtaaggggtctctgccagtcacttccgctttgcccgctctgcttgagaatggaaagaccaacggcgacccggactgtgaggcctctgcgccagccttaaccctgtcatgtctggaagagctcagccaggaaacaaaggcgcgtatggaggaggaggcctatagtaagggctttcaggagggcctcaagaagacgaaagaacttcaggacctgaaagaagaagaggaggaacagaaatccgaatcccctgaggaacctgaagaagtggaagaaacagaggaagaggagaagggccccagatcgagcaagctggaggaactcgtgcacttcttgcaggtaatgtacccaaagctgtgtcaacactggcaggtcatttggatgatggcagcagtgatgcttgtcctgacagtcgtgctcgggctatacaattcctacaactcttgcgctgagcaggctgatggaccccttgggcggtccacttgttccgcggcccagcgggattcctggtggtctagcggcctgcagcatgagcaaccaactgaacaatag

SEQ ID NO: 43911 - DNA, 1794 bp, Artificial Sequence
  Description of Artificial Sequence: Synthetic coding sequence
atggccctgaacagcccccagcccggccccgtggagagcgagctgggaaaacagctgttaaagaccggatgggagggttccccactccctcgcagcccaactcaggacgcagctggggtgggccctcctgcatctcagggccggggacctgccggggaaccaatggggcccgaggccggatccaaggctgaattgccgccaaccgtgagccgtccaccgctactccgtggcctgagttgggactccggacccgaagaacctgggccaagactccagaaggtgctcgcgaaactgcccttagccgaggaggagaaaaggtttgctggcaaagcgggcggaaaacttgccaaggcccctgggctcaaagactttcagattcaagtccagccagtacgtatgcagaagttgactaagttgagggaggaacatatcttgatgaggaatcagaacctggtgggcctcaagctgcccgacctgtcggaagcagcagaacaggaaaaaggtctccccagcgaactgtcccctgccattgaagaggaagaatctaagtccggattggacgtgatgcctaacatctctgacgtgctgctgagaaaattacgggtgcacaggtccctaccgggctctgcaccaccgcttactgaaaaggaggtggagaacgtcttcgtccagctgtcactcgcgttcagaaacgacagctacactctagagagtcgcattaaccaggcagagagggagaggaacttgaccgaagaaaacaccgaaaaggagcttgaaaattttaaagccagcattacctcaagcgctagcctgtggcatcactgtgagcaccgcgagacctatcagaagctgttggaggacattgccgtcttacaccgcctcgccgctcggctgtctagtagggccgaggtggtgggtgcggtcagacaagagaagcgcatgtcaaaggcgaccgaagttatgatgcagtatgtggaaaacttaaaacggacttacgagaaggatcacgctgaactgatggaatttaaaaaactggctaatcagaattcctcccgatcttgcggacctagtgaagacggtgtacctaggacagccaggtccatgagcctaacgctaggcaaaaacatgccacgcagacgggtgtccgtggcagtggtccccaaatttaacgccctgaatcttcccggacagaccccatcttcgagttccatcccttccctgcccgccctgagcgaaagccccaacggcaaaggcagcctacccgtgacttcagcccttcctgccctactggaaaacgggaagaccaacggcgaccccgactgcgaggcgagcgcgccagctctgaccctaagctgcctggaagaactctctcaggaaaccaaggcccgtatggaagaggaggcttattcaaaaggctttcaggaggggctgaaaaaaactaaggagctccaagatctcaaagaggaggaggaagaacagaagagcgaatccccggaggaacctgaagaggtggaggagactgaggaggaagaaaagggccctaggtcatccaaactcgaagagctcgttcacttcttacaggtgatgtatccaaagctttgccagcactggcaggtcatttggatgatggccgcggtcatgctggtgctgacagttgtgctgggcctttataacagctataactcctgtgccgaacaggcagacggcccattaggccggtctacatgcagtgccgcacagagagattcctggtggtcgagcggcctgcagcatgagcagccaacagagcaatag

SEQ ID NO: 43912 - DNA, 2466 bp, Artificial Sequence
  Description of Artificial Sequence: Synthetic coding sequence
ctgaccggcgacgccaccagccccgagggcgagaccgacaagaacttggctaatcgcgtgcattcaccgcacaagaggctcagccacaggcacttaaaggtaagcacggcttcactcacatccgttgatcctgccggccacatcatcgacctagttaacgaccaattgcccgacatctcgatcagcgaagaagacaagaagaaaaacctggctcttttggaagaggccaagttagtgagtgaacggttcctaaccaggagaggccgaaagagccgctcaagcccaggtgatagtccatcagccgtatcaccgaatctgtcaccttctgcaagcccaacatccagtcggtctaatagcctcactgttcctacccctcctggcctcgatgtatgctcagggccccccagtccactgccaggggctcctccacagaaaggcgacgaggcagacgttagttccccacatccaggcgaaccaaatgttcctaagggcctggccgatcgaaagcaaaatgaccagcgaaaggtatctcagggtagactagctccccgcccacctcccgtggagaagtccaaagagatcgccatcgagcagaaagaaaactttgaccccctgcagtaccccgagactactcccaaggggctggcacctgtgacgaactcgagcgggaaaatggccttgaattctcctcagcctggccccgtcgagtcggagctgggcaagcagctcctcaaaacaggctgggagggcagtccccttccccggtcccctactcaggacgccgctggagtgggtcccccggcatctcaaggacgaggccccgccggcgagcctatggggcccgaggccggatccaaggctgaacttcctcccaccgtgtctagacctcctctgctacggggtctgtcctgggattctggccccgaagagcctggtcctcggctgcagaaggtccttgccaaactacccctggcagaggaggagaagcgatttgctggaaaggccggaggaaaactcgctaaggctcccgggttgaaggacttccagatccaggtacaacccgtgaggatgcaaaagttaaccaagttgagagaggaacacattctgatgaggaatcaaaatttggttggcctaaagctgccagacttgtccgaagctgcagaacaggaaaaaggtcttcctagcgagctgagccctgccattgaggaagaagaatccaaatccgggcttgatgtgatgcctaacatctcagacgtgctcctgaggaagctgagggttcatagatctcttccaggatcagcgccgccccttaccgagaaagaggtcgaaaatgtctttgtgcagctgagcctcgccttccgcaacgattcctacaccttggagtctcgaatcaaccaggccgagcgtgaacgcaacttaactgaggagaataccgaaaaggaactggagaacttcaaggcctccatcactagcagtgcatcactgtggcaccactgtgaacacagggagacctatcagaaactcctggaggacattgccgtgctccatagattggccgcgcggctgtcgagccgggccgaagtagtgggagcagttcggcaagaaaaacgtatgtctaaagccaccgaagtcatgatgcaatacgtggagaacctcaagagaacgtacgagaaagaccacgcagaacttatggagttcaaaaagctcgccaatcagaactcttcacggagctgcgggccaagcgaggatggcgtcccacgaactgcccgcagcatgtccctcactctgggtaaaaacatgcctaggcgtcgtgtctccgtggccgtagtgccaaagttcaatgcactgaacctgccaggacaaacacccagcagctcatccattccgtcactcccagctttgtcggaatctcccaatggtaaggggagcctaccggtgacctctgcccttcctgccttgttggagaacggcaaaaccaacggcgatcctgattgtgaagctagcgcccccgcactcaccctgagttgcctggaggagttatctcaggaaaccaaggctcgtatggaagaagaagcgtacagcaagggctttcaggaggggttgaaaaagaccaaggagttgcaagatctcaaagaagaagaggaggagcagaaaagcgagtccccagaagaaccagaggaagtggaagaaaccgaagaggaggagaagggaccccggtccagcaaactggaggagctcgtccactttctgcaagtcatgtaccccaagctctgtcagcactggcaagtgatttggatgatggcagcagtgatgttagtcctgaccgttgttctgggcctgtataattcctacaattcctgtgctgagcaggctgatggccccctgggcaggagcacttgtagcgctgcccagcgggattcttggtggagttctggtcttcagcacgaacagcctaccgagcaatag

SEQ ID NO: 43913 - DNA, 2466 bp, Artificial Sequence
  Description of Artificial Sequence: Synthetic coding sequence
atgaccggcgacgccaccagccccgagggcgagaccgacaagaacctggctaacagggtgcattccccccataaaagactgtcccaccggcacttaaaggtcagtacagcctcactgaccagcgtggaccctgcagggcatattatcgatttggtaaacgaccagctgcctgacatctccatctctgaagaggacaagaaaaagaatctcgcactgctcgaagaggcgaaactggtgtcggagcgctttctgacacggcggggtagaaagtcacgaagttcaccaggcgactccccctcagcggtgtcgccaaacctctcaccgagtgcaagccccacttccagtaggtctaattccctgactgttcccacacctcctggcttggacgtgtgctcaggccccccaagtcccctgcccggggcgccacctcagaagggcgacgaggccgacgtctccagcccccatcccggtgaacccaatgtgccgaaaggacttgctgaccgaaaacagaatgaccaaaggaaggtgtcacagggccgcctcgcacctaggccaccccccgtggagaagtctaaggagatcgctatcgagcagaaggaaaacttcgaccccttgcagtaccctgaaaccacacccaaaggcttggcccctgtgacgaactcttcaggaaagatggcccttaatagtcctcagcccgggcccgtggaaagcgagctaggaaagcagctgttaaagactggttgggagggctctcccttgcccagatcacctacacaggatgcggccggggtcggccctcccgctagccagggccgcggtcccgccggagaacctatggggcctgaagccggcagtaaggccgagctgccacctaccgtgtcccggcccccactgttaagaggtctgagctgggatagcggacccgaggagcccggaccaagactccagaaggtgctggctaaactgcctcttgccgaggaggagaaacggtttgctggtaaggccggagggaaactagccaaggctccaggcctgaaagatttccagattcaagtacagcctgttcgcatgcagaagttgactaaattgcgggaggaacacattctcatgcgcaaccagaatctagtcgggttaaaactacccgatctgtctgaagccgccgaacaggaaaagggccttccatctgagctttctcctgcaattgaagaggaggaaagcaagtcagggctggatgtgatgcccaacatctccgacgtcctgctgcgcaaactgcgtgtgcatagatcactccctggtagtgcacccccattaacagaaaaggaggtggaaaacgtgtttgtacagttgagcctggccttccgcaatgactcttacaccctggaaagccggataaatcaagctgagcgcgagcgaaatctcacagaggaaaataccgagaaggaattagagaattttaaagctagtataacatcatcagcgtcgctctggcaccactgcgaacaccgagaaacttaccagaagctcttggaggatatcgcagtgctgcatcgactggcggcacggctgagtagccgggctgaggtagtgggcgccgtgcgccaggagaagagaatgagcaaggctacagaggtgatgatgcagtatgtggaaaatctgaaacgcacgtatgagaaggatcacgcagaattgatggagttcaagaagcttgctaaccagaattcttcccggagttgcggacccagtgaggacggagtgccccgaactgcacggagcatgtccctaacacttgggaagaatatgccaagaaggagagtgtcggtggccgtcgtgcccaaattcaacgccttaaacctcccagggcaaacaccaagtagctcgtctatcccttcactacccgcccttagtgaaagcccaaacggaaaaggaagcctccccgtgacctcagccttaccagcacttctggaaaacggtaagaccaatggtgaccccgactgcgaggcaagcgctcccgctctcaccttatcttgtctggaagagctcagccaggagactaaggcacgaatggaagaggaagcttatagcaaggggttccaagaggggcttaagaagacaaaagaattgcaggatctgaaggaagaggaggaggagcaaaagagtgagtcgcccgaagagccggaggaagtcgaggagacagaagaggaggagaagggaccaaggtcttcaaagttggaagaacttgtgcactttctgcaagtcatgtacccgaagttgtgccagcactggcaggttatatggatgatggcggctgtgatgcttgtgctaacggtggtactgggtctctataatagttacaattcctgcgccgagcaggcagacggccctctgggccgaagcacttgctccgccgcacagcgcgacagttggtggagttccggactccagcacgagcagcccactgaacagtag

SEQ ID NO: 43914 - DNA, 1794 bp, Artificial Sequence
  Description of Artificial Sequence: Synthetic coding sequence
atggccctgaacagcccccagcccggccccgtggagagcgagctgggcaagcagctgctaaagaccggttgggaaggcagcccattgccaagaagccccacacaggatgccgctggggtcgggccgcctgcatcccagggtagaggtcccgccggggaacccatgggacccgaggctgggagcaaggcggaactcccccccactgtgagtcgacccccactactccggggactatcttgggatagtggtcctgaagaacccggacctagacttcagaaagtactggccaagctgcccctggccgaggaagaaaagcgcttcgccggcaaggccggtggcaaattggccaaagccccaggactaaaagattttcagattcaggtgcagcccgtgaggatgcaaaagctaactaaactgcgcgaagaacacatccttatgcgcaatcaaaacctggttggcctgaagctccccgacctgagtgaagccgcggagcaggaaaaggggctcccgagcgaactgtcccccgccattgaagaagaagaatccaagtccggattagacgtcatgccaaatatttctgacgttctgctacggaaactgcgcgtccatcgctccctgccgggtagcgcgccaccactgacagagaaggaggtggagaacgtcttcgtacagttgtctttggcattccgtaatgacagctatacgttggagtcacgcatcaaccaggccgagagggaacgtaacttaaccgaagagaatacagaaaaggagttggaaaacttcaaggcttccatcacgagctccgccagtctgtggcatcattgcgagcaccgcgaaacctatcagaagcttctggaagacattgccgttttgcaccgcctcgctgcacgccttagtagcagggccgaagtggtcggcgccgtcagacaggaaaaaagaatgtcaaaagcgacggaagtcatgatgcagtatgtggagaatctgaaacgtacctacgagaaggaccatgcagagctcatggaatttaagaaactagctaaccagaatagtagccgttcctgtgggccctctgaggacggtgtgccacggacggccaggtctatgtcactgactctcgggaagaatatgccccgaaggagggtctccgtcgccgtggttcctaagttcaacgctttgaacttaccaggccagacgccctcctctagtagtattccgtccctcccagctttgagcgagtcccccaatggcaagggtagcctgccagttacctctgcattgcctgcgctcttggagaacggcaaaaccaacggggacccggactgtgaggccagtgcacctgcgctaaccctgtcctgtctcgaggaactgtcccaggagactaaggcccgaatggaagaggaggcatactcaaaaggattccaagagggcctcaagaaaacaaaggagcttcaggatcttaaagaagaggaggaagagcaaaagtccgagagcccagaagagcccgaagaagtagaagaaacagaggaggaagagaaaggacctaggagttctaaactggaggagctcgtgcacttcctgcaggtcatgtacccaaaactttgccagcactggcaggtcatatggatgatggctgccgtgatgctcgttttgaccgtggtgctcggcctttacaacagttataattcgtgcgcagaacaagctgacggaccccttggccggtctacctgttccgccgctcaacgagattcctggtggtcatccggactgcagcacgagcagccaacggaacagtag

SEQ ID NO: 43915 - DNA, 2739 bp, Artificial Sequence
  Description of Artificial Sequence: Synthetic coding sequence
atggtgaaggccccccagagcgaggagcggctggcccggggcggcaaagagaataactcggtattagcttgcggagcgcaggccagctggagtatctttggagcagatgccgctgaggtgcccggaactcgggggcactcacagcaggaagcagccatgcctcacataccagaggacgaagagccgcctggcgaaccacaggcagctcagtcccccgcagggcagggccctcctgcagcaggtgtaagctgctccccaacgccgacaatcgtcctaactggcgacgccaccagccccgagggagagaccgataagaaccttgctaaccgtgtgcatagccctcacaagaggcttagtcaccggcacctaaaagtgtccactgcaagcctgactagcgtggatccagccggtcatatcatcgatctagtgaacgaccagctgcccgatatcagcatttccgaagaggataagaaaaagaacttggccctgctggaggaagccaagctggtcagtgagaggtttctgacccgacgcggccgcaaaagcagatccagccctggcgattcgccatctgctgtcagcccaaaccttagccccagcgcctcccccacttcctcccgttcaaacagcctgacagtaccaactccacccggcttggacgtttgcagcgggcctcccagccccctgcctggagctccgccacagaaaggcgacgaagcagacgttagttccccgcacccaggagaacccaatgttcccaaggggcttgccgatcggaagcagaatgatcaacggaaagtcagccaggggaggctggcccctagacctccacctgtggaaaagagcaaggaaatcgctattgagcagaaagaaaactttgaccctctgcagtaccccgagacaacccctaaaggcctagctcccgtcaccaactcatctggcaaaatggccctgaactctccccagcccggtccagttgaaagcgaattgggtaaacagctgttgaagacaggctgggagggatcccctctgccgcggagcccgacccaggacgcggccggagtgggacccccagcatctcagggccggggtccagcaggagagcctatggggccagaagctggaagcaaagcggagctgccaccaacagtctcccgtcctcctctcttacgcgggttatcatgggactctgggcccgaggagcctggcccaagactccagaaagttctagcaaagctccccctggccgaagaggaaaaaagattcgcgggcaaagctggcggaaagctagctaaggcaccaggactgaaggacttccagattcaggttcagccagtcagaatgcagaagcttaccaagcttagggaggaacacatcctgatgcgcaaccagaatctggtgggtttgaaacttcccgatctttcagaggcagccgaacaagagaaaggactgccttctgagttgagtccagccatcgaggaggaggagtctaaatctggcttggatgtgatgccaaacatttctgatgtcctcttgcggaaattgagggtgcataggtctctgccgggcagtgccccccctctgacagagaaggaagttgagaacgtattcgttcaactctctttggcatttcggaacgattcctacactctggagtctaggatcaaccaggcagaacgggagcgcaacctgacagaggaaaataccgaaaaggagctggagaatttcaaagcatccatcactagttccgctagtctctggcaccactgcgagcatagggaaacataccagaaactgttggaagacattgcggttcttcaccggctcgccgcccggctatcatcgcgcgccgaagttgtcggagcagtaagacaagaaaaacgcatgtccaaagctaccgaagtgatgatgcaatacgtggaaaatctgaagaggacatatgagaaagaccatgccgagctcatggagtttaagaaacttgccaatcagaacagctcccgaagctgtggaccttcagaagatggggtgccccgaacagctcgatcaatgtcacttactctggggaagaacatgccacggcggcgggtgtccgtggcagtggtgccaaagttcaacgcacttaatctcccagggcagacgcctagcagctcgagcattccctccttacccgccctgtctgaaagcccgaacgggaaaggatccctccctgtgaccagtgccctaccggcactcctggagaatggcaaaactaatggtgatccggattgtgaggccagcgcccccgcactgacactgagctgtctggaagagctgtcacaggaaaccaaggccaggatggaggaagaggcttactccaagggcttccaggaggggctgaaaaaaacgaaggagctgcaggatttgaaggaggaggaagaggagcagaagtcggagagtccggaggagcccgaagaagtcgaagaaaccgaggaggaggaaaaaggacctcggtcttctaagttagaggagctcgttcacttcctccaggtgatgtaccccaaattatgtcagcactggcaggtcatctggatgatggcagctgtgatgctggttctgaccgtagtcttaggtctgtacaatagctataacagttgtgctgaacaggccgacggcccccttgggaggagtacatgcagcgctgcccagcgggacagctggtggtcctccggcctgcaacatgaacagcccactgagcagtag

SEQ ID NO: 43916 - DNA, 2715 bp, Artificial Sequence
  Description of Artificial Sequence: Synthetic coding sequence
atgggcatggacctgacctgccccttcggcatcagccccgcctgcggcgctcaagcctcatggtcaatctttggcgccgatgccgccgaggttcctgggacccgcggacactcccagcaagaggccgccatgccccacattccggaagatgaggagcctcctggtgagccgcaagcagcacagagtccagccggtcagggtccaccagccgcaggagttagctgctctccaactcctaccatcgtgctcaccggcgatgccacctcacccgagggcgagacagacaaaaacttggcaaatcgagtgcactcaccacacaaacgactctctcatcgtcatcttaaagtcagtacagcatcactgacatctgtggatcccgcggggcatattatcgacctcgtgaatgaccagcttcctgatatttccatatcggaggaggataagaaaaagaatctggcccttctggaagaggcaaagctcgtgtcagaacggttcctgaccaggaggggccgcaaatcccggagcagtcctggagattcaccaagcgccgtaagtcctaatctgtcaccctctgccagccccacttcttcccggagcaacagtctcactgtgccaactcctccaggtctggacgtgtgctccgggccaccatcccccctgcccggcgcaccccctcagcagaagggagacgaggcagatgtctcttctcctcaccccggggaacctaacgtgcccaaaggcctggctgatcgaaaacaaaatgaccagaggaaggtcagccagggtaggctcgcgcccagaccacccccagtcgagaagagtaaggagatcgcaattgaacagaaggagaacttcgacccattacagtacccggagaccactcctaaggggctggcacctgttacaaactcatccgggaaaatggctctgaacagcccccagccaggcccagttgaaagcgaacttggtaagcagcttctaaagacgggatgggagggtagcccattgccccgcagtccaacacaagatgccgcgggggttgggccccctgcttcacaggggcgggggcccgccggtgaacccatgggaccggaggcaggaagcaaggccgagctgccgcccaccgtctcacgtcctcctctcctgaggggattaagctgggatagtggccccgaagaaccaggacctcggctgcaaaaggtgctagcgaagctcccactggctgaagaagagaagcgtttcgcaggcaaggcaggaggaaaactggcaaaggccccaggtcttaaggatttccaaattcaggtgcagcctgtcaggatgcagaaactcaccaaactcagagaggaacatatccttatgagaaatcaaaacttagttggcttgaaacttcccgacctttcggaggccgctgaacaggagaaaggcctgcctagtgagctgtcccctgccatcgaggaggaggaatctaaatccggactggacgtgatgcccaacatttctgacgtactgctgcggaagttgcgcgttcaccgatcattaccagggtctgcaccaccccttactgaaaaggaagttgagaacgtttttgttcagctgagtctcgcattcaggaatgatagctacaccctcgaatctcggattaaccaagctgagcgagagagaaatctgacagaagagaacaccgaaaaggagctggagaatttcaaagctagcataacaagctctgccagtttgtggcaccactgcgagcacagagagacctaccaaaaattgttggaggacattgctgtgctgcacagactggctgcccggctgagtagccgcgccgaagtggtaggggctgtgagacaggaaaagaggatgtccaaagcaactgaggtgatgatgcagtatgttgagaatttaaagcgcacctacgaaaaggaccacgctgaactgatggagtttaaaaagctggctaaccagaacagtagtagatcatgtggaccatcggaagacggagtgcctaggaccgcacgatccatgtcactgactcttggtaagaacatgccccggaggagggtgagtgtggcagtcgtgcctaagtttaacgcgctcaacctgcccggccagaccccttcatcctcctctatcccttcgctgcctgcccttagtgaatcaccaaatggcaaggggtcgttacctgtaacatcagccttacctgctctacttgaaaatggaaagactaacggagacccggattgtgaagcgtcagcccccgcactgacgctgtcttgtctggaggaattgtcccaggagactaaggctcgcatggaggaggaagcctattccaagggcttccaggaaggcctgaaaaagacgaaagagttacaggaccttaaagaggaggaggaggaacagaagtcagaatcacccgaggaacctgaggaggtagaggagactgaagaagaggagaaaggtcctcgatcctcaaagctggaggagctggtgcacttccttcaggtgatgtaccccaagctgtgtcagcactggcaggttatttggatgatggctgcggttatgttggtactgacggttgttttaggcctctacaattcctataacagctgcgccgagcaggcggatggcccgctgggcagaagtacctgctccgccgcccagcgcgattcctggtggtcaagcggcttacaacacgaacagccaaccgaacagtag

SEQ ID NO: 43917 - DNA, 2121 bp, Artificial Sequence
  Description of Artificial Sequence: Synthetic coding sequence
atggtgaaggccccccagagcgaggagcggctggcccggggcggcaaggaaaataactctgtcctggcatgtggtgctcaagccagctggagtattttcggagccgacgctgctgaggtccctggcactcgcggccactctcagcaggaagctgccatgcctcatattccagaggacgaagagccccctggggagccgcaggctgcacagagtcctgcaggtcagggaccccctgctgcaggcgtgtcatgcagccctactccaaccatcgtactgacaggcgacgccactagccctgagggcgagaccgacaagaacctggcaaatcgagtgcactcaccccataaacgcctctctcaccgccatttgaaggtctcaacagcaagcctgacgtcggtggaccctgcgggtcatattatagatctcgtcaacgaccagctgcctgatatcagcatcagtgaagaggataaaaaaaaaaacctagctctcctagaggaagccaagctggtttcagagaggttcctgacacgtagggggcggaagtcaagatcttccccaggggatagtccttctgccgtctctccaaacctgtccccgtctgctagtcccacttcctcaaggagcaacagcctcacagttccaacaccacccggcttggatgtgtgttctgggccccctagtccattaccaggggcacctccccagaagggagatgaggctgacgtttccagccctcatcccggcgagccggagcatatcctgatgaggaaccaaaacctggtaggactgaagcttccagatctctccgaggctgcagaacaggaaaagggtctgccctcagagctgagcccagccattgaggaggaggaatccaagtccggcttggacgtgatgcctaatattagcgacgtcctccttagaaaactgagggtccaccgaagtctcccagggagcgcaccaccactcaccgaaaaagaagtggaaaatgtgtttgtgcagctctccctcgcctttcggaacgattcatatacattggagtctaggattaatcaggctgaaagggagcggaacttgacagaggagaacactgagaaggaattggagaactttaaggcttcaattacatcatctgcatcattgtggcaccattgtgagcacagagaaacgtaccagaaactcctggaggacattgccgtcttgcatagacttgcagcacgactgagcagccgcgcagaggtcgtgggcgccgtgcgccaggagaagcggatgtcaaaggcaacggaagtgatgatgcaatatgtcgagaaccttaagcggacatatgagaaggaccacgctgaacttatggagttcaagaaacttgccaatcaaaactctagcaggagttgcggaccgtccgaggacggcgtaccacgcacggctagatccatgtcactgacccttggcaaaaatatgcccaggagacgggtttcagtagccgtggtgccaaaattcaacgccctgaacctgccaggtcagacacctagctcaagcagcatcccctccctaccggcactttctgaatcacctaatgggaaaggatccctgcccgtcacctccgcactgcccgcgcttctcgaaaacggtaagaccaacggcgaccccgattgcgaggcgagcgcacctgcattaacactgtcctgtctggaggaactttcccaggagaccaaggctcggatggaggaggaagcctactcgaagggattccaagaagggctgaaaaaaacaaaagagcttcaggacctcaaggaggaggaggaggaacagaaatccgaatcgcctgaggagcctgaggaggtcgaggagactgaagaggaagaaaaaggcccacggagcagcaagcttgaggagctggtacattttctccaggtgatgtacccgaagctgtgccaacactggcaggttatatggatgatggccgctgtaatgctcgtcctcaccgttgttctggggctctacaactcctacaattcatgcgctgagcaggctgatggacccctgggtagatccacttgttcagccgctcaacgggacagctggtggagcagcggcctgcagcacgagcagcctacggagcaatag

SEQ ID NO: 43918 - DNA, 1731 bp, Artificial Sequence
  Description of Artificial Sequence: Synthetic coding sequence
atggccgacgccaacaaggccgaggtgcccggcgccaccggcggcgacagcccacacctgcagcccgcagagcccccaggagaacctaggcgggaaccccatccagccgaggcggagaaacagcagcctcaacacagctcaagcagtaatggcgtgaaaatggagaatgatgagtctgcgaaagaagagaagtcggacttaaaggaaaaatctaccggctcgaagaaggcaaatcgtttccacccttactctaaggacaaaaattccggcgcaggcgaaaagaaggggcctaaccgtaatcgagtctttatatccaacatcccctacgatatgaaatggcaggctatcaaagatctgatgcgcgagaaggtcggtgaggtaacatacgtggagttgttcaaagatgccgaaggtaaatcgcgcggttgcggagtggtggaatttaaagatgaggagttcgtgaagaaagctcttgaaactatgaataaatatgatctttcaggcagaccactgaacattaaggaggacccagacggagaaaacgcaagacgtgctcttcagagaaccggcggctcgttccccggtggccacgtgcccgatatgggcagtgggctcatgaacctaccaccatcaatactgaacaacccgaacattccccctgaggtcatttccaacctccaggccggtcggctgggaagtaccatcttcgtggctaatctggattttaaagtgggatggaagaagcttaaggaggtgtttagtatcgcgggcacagtgaaacgcgccgacatcaaggaggacaaggacggaaagtcgagagggatgggtaccgtgacattcgaacaagctattgaagcagtccaggctatatccatgttcaacggccagtttctctttgatcggcctatgcatgtgaaaatggatgacaagtccgtcccacacgaggagtatcgatcacatgacggcaaaactccacagctgcctcgcgggctggggggcattggaatgggcctcggaccgggtggtcaacccatctctgccagccagctaaacattggcggcgtcatggggaacttggggcccggaggcatgggtatggacggcccaggatttggtgggatgaaccggattggcggaggaatcggcttcggggggctggaagcaatgaattctatgggcggttttggaggggtcggccgcatgggggagctgtatcgcggggcaatgacgagtagcatggaaagggatttcggtcgcggggatatcggcatcaatcagggatttggggattccttcggtcggctcggggggggcatgggatcgatgaactcagtgacagggggcatgggtatggggctggacagaatgtcgtcgagctttgatcgaatgggcccagggattggggctatcctagaaagatctatagatatggacaggggattcttatctggccctatgggctctgggatgagggagcgcattggcagcaagggcaatcagatatttgttcggaacttaccatttgatctgacctggcagaagttaaaagagaagttctcccagtgtggccacgtgatgttcgcagagattaaaatggagaacggcaaatcgaaggggtgcggaacggtacgatttgacagccctgagtctgcagaaaaagcctgtagaattatgaacggaattaagatttcagggcgggaaattgacgtcagactggaccgcaatgcctag

SEQ ID NO: 43919 - DNA, 1803 bp, Artificial Sequence
  Description of Artificial Sequence: Synthetic coding sequence
atggccgacgccaacaaggccgaggtgcccggcgccaccggcggcgattcaccacatctccagcccgcagagcctcctggcgaacctcgtagagagccccacccagccgaggctgaaaaacagcagcctcagcattcgtcctccagcaatggcgtcaagatggaaaacgatgagagcgccaaagaggaaaaatccgacctcaaggagaagtcaaccggatccaaaaaagcgaaccgtttccatccctatagcaaggacaaaaattctggtgctggtgagaaaaagggcccgaatcggaatcgagtgtttatcagtaatatcccctacgacatgaagtggcaggccataaaagacttaatgagggagaaagtgggggaggtcacgtacgtggagctgttcaaggacgcagaagggaaaagtagagggtgtggagtggttgagttcaaagacgaggaattcgtaaagaaggccctggagacgatgaacaagtatgatcttagcggtaggccgctaaatattaaagaggatcccgacggcgagaatgctaggagagctctgcaaaggacggggggaagcttcccaggagggcacgtcccagacatgggatccggattgatgaacctgcccccttctattctgaacaacccaaatatcccaccagaggtgatcagcaacctgcaggctggccggcttggatccacaatattcgtggcaaatctggactttaaggtgggctggaaaaagctaaaggaagtcttttcaatcgcaggcactgtgaagagagcagatattaaggaggataaagacggaaagtcaaggggtatgggaacagtgaccttcgagcaggcgatcgaggctgtgcaagcgatcagtatgtttaacgggcagtttttgtttgatcggccaatgcacgttaagatggatgataaaagcgttcctcacgaggagtatagatctcacgatggcaaaactcctcagttaccacggggcctgggcggcataggtatggggttaggtccagggggtcaacctatcagcgcatcacagctgaacattggtggggtgatgggcaacttgggccctggcggcatggggatggatggaccaggttttggtggcatgaatcggatcggaggtgggatcggcttcggcgggcttgaggcaatgaatagcatggggggcttcgggggcgtcggacggatgggtgagctgtatcgcggggctatgaccagctcgatggagcgtgacttcggccgcggtgatatcgggattaaccagggtttcggagacagttttggacggcttggaagtgcgatgataggcggctttgcgggaaggataggaagtagtaatatggggcccgtcgggtcaggcatttccggtgggatgggatctatgaatagcgtgaccggtggcatgggaatgggcctcgaccgcatgtccagctcttttgacagaatgggacccggaatcggggccattttggaacggagcatagacatggatagaggcttcttgagcggtcccatgggctccggtatgagggaacgcataggaagcaaagggaaccaaattttcgtgcggaacttgcccttcgacttgacatggcagaagttgaaggagaaatttagccaatgtggccatgttatgtttgctgaaatcaaaatggagaacggtaagtccaagggctgtggcacagtgcgattcgactctcccgaatcagcagagaaggcttgtcgcataatgaacggaattaaaatatccggtagggagatagatgtgaggcttgaccgcaacgcctag

SEQ ID NO: 43920 - DNA, 567 bp, Artificial Sequence
  Description of Artificial Sequence: Synthetic coding sequence
atgaacagcatgggcggcttcggcggcgtgggccggatgggcgagctgtaccggggggcaatgacctccagcatggagcgggattttggaagaggggacataggaatcaatcagggctttggggactcatttggacgcctgggaggtggtatgggcagtatgaacagcgtgacagggggcatgggcatgggactggacaggatgagtagctcctttgacaggatggggcccggtattggcgcaatcctggagcggagtattgatatggatcggggtttcctgagtggccccatgggcagcggtatgagggagagaataggaagtaaaggcaaccagatctttgtccgcaacctgccatttgatcttacgtggcagaaactgaaagagaaattctcacaatgcggtcacgtcatgttcgccgaaattaagatggagaacgggaaatctaaaggctgcggcactgtccggtttgactcccccgaatctgccgaaaaagcttgtcgtatcatgaatggcattaaaatttccggaagggagatcgacgtccggctagataggaacgcctag

SEQ ID NO: 43921 - DNA, 381 bp, Artificial Sequence
  Description of Artificial Sequence: Synthetic coding sequence
tgaggcctggaccggatgagcagcagcttcgaccggatgggccccggcattggggccattttagagagatctatagatatggacaggggcttcctgtccggacccatgggttctggaatgcgcgaacgcatcgggtcgaaaggaaatcagatcttcgtgcgaaacctaccttttgatctgacttggcagaagctgaaagagaaattttctcagtgcggccatgtcatgtttgcagaaatcaaaatggagaatggtaagtccaaggggtgtgggactgttagattcgacagccccgaatctgccgaaaaagcatgtcgcatcatgaacggtattaagatttctgggcgcgagatagacgtccgcctcgatcgtaatgcatag

SEQ ID NO: 43922 - DNA, 810 bp, Artificial Sequence
  Description of Artificial Sequence: Synthetic coding sequence
atggccgccagcgccggcgccggcgccgtgatcgccgcccccgactctcgacgatggctttggtcggtcctcgccgcggcactggggcttctgacagcaggagtatccgccctagaagtgtatacaccaaaggagattttcgtcgccaacggcacccagggaaaactcacctgtaaatttaagagcacatccacgaccggcggtctgacttctgtgagctggtcatttcagcccgagggagctgatacaactgtatcgttcttccactattcacaaggtcaagtttacctcggaaattacccgccattcaaagatcggatcagttgggccggtgacctggacaagaaagacgcgagtataaacattgaaaatatgcagtttatacacaacggaacttatatttgcgacgttaagaacccaccagacatcgtggtgcaacccggccacatccggttgtacgtcgtagagaaggagaatcttcctgtcttccctgtgtgggtggtcgtggggatcgtgaccgcagtggtgttaggcctgacgttgttgatatctatgatcctagcggtgttgtacaggcgaaagaacagtaagagagattacacaggctgctccacatcagagtccttaagcccggtgaagcaggccccacgcaagagcccttcagataccgaaggactcgtgaagtccctccctagtgggtcccaccaggggcctgtcatttatgcacagttggaccatagcgggggacaccacagcgataaaattaataagagtgagagtgtggtttacgctgatattcggaaaaattag

SEQ ID NO: 43923 - DNA, 630 bp, Artificial Sequence
  Description of Artificial Sequence: Synthetic coding sequence
atggccgccagcgccggcgccggcgccgtgatcgccgcccccgactccaggaggtggctctggtccgttcttgccgcagccttggggctgctgacagctggcgtctccgccctggaggtttacacgcccaaggaaatcttcgtggccaatggaactcaggggaaactcacctgcaagttcaagagcacatcaaccactggtggccttactagcgtgtcgtggagtttccaacccgagggcgccgacactactgtgtccttcttccactattcccagggccaggtttacctgggcaattaccctccattcaaagatagaatttcatgggctggggatttagacaaaaaggatgcctccatcaatattgagaatatgcaattcatccacaacggcacctacatctgcgacgtcaagaacccccctgatatcgtagttcaacctggccacattcgcctctacgtcgtggaaaaggaaaatctgcccgtattccccgtttgggtggtagtggggatcgtcacagcggtagtgcttggcctcacacttctgatttccatgattctggccgttttgtacagaagaaagaactccaagagggattacaccggcgcccagtcctacatgcactcctag

SEQ ID NO: 43924 - DNA, 360 bp, Artificial Sequence
  Description of Artificial Sequence: Synthetic coding sequence
atggccgccagcgccggcgccggcgccgtgatcgccgcccccgacagccggaggtggctgtggtccgttttggcagccgcgttgggacttctgacagcaggggtctcagctctggaagtgtacacccctaaggaaatcttcgtggcgaatggcacccaggggaaactcacatgtaagtttaagtccacctccacaactggtggactgacgagtgtgagctggagctttcagccagagggtgctgacaccacagtatccggacctgtaatttatgcacagttagaccactctggtggccaccactcagacaagattaacaagtccgagtcagtggtgtacgctgacattaggaagaattag

SEQ ID NO: 43925 - DNA, 6147 bp, Artificial Sequence
  Description of Artificial Sequence: Synthetic coding sequence
atgctgcgggtgatcgtggagagcgccagcaacatccccaagaccaaattcggcaagcctgatccgatcgtgagtgtgattttcaaagacgagaagaaaaaaacgaaaaaagttgataacgaactcaacccggtgtggaatgagattttagaatttgacctccgcggtatcccacttgactttagttcctctctcgggatcattgttaaggatttcgagaccattgggcaaaataagctcataggtacagcaactgtggcccttaaggacctaacgggagatcaatcccgctcgctgccatacaagcttatatcccttctgaacgaaaagggtcaggatacaggcgcaaccatcgacctggtgattgggtacgaccctccttccgctcctcacccaaacgacctgagcggcccctccgtccctgggatgggaggagacggggaggaggacgagggcgacgaagacagactcgataatgctgtgagaggcccaggcccaaaaggaccggtgggtaccgtgtcagaggcacagctcgctcgccgcctcacaaaggtgaagaacagcagacgaatgttgtctaacaagccacaggactttcagatacgcgttcgggtcatcgagggacgccagctatctggaaacaatattcgaccagttgtcaaagttcacgtatgcggccaaacacacagaactcgaatcaaacgggggaataacccattctttgacgagctgttcttttataacgtcaatatgactccatcagaacttatggacgagatcatttcaatcagggtgtataattctcactctctccgggccgattgtctgatgggcgaattcaaaatagacgtcggcttcgtgtatgacgagccaggtcatgccgtgatgcggaagtggttgttgctgaatgacccagaagacacatcttccggcagcaagggctacatgaaagttagcatgtttgtcctcgggaccggggatgaaccaccccccgaaaggcgggacagagacaatgattctgacgatgttgaaagcaacctgttgttgccagcaggcatcgccctccgctgggtcaccttccttcttaaaatttatagggccgaggatattccccagatggacgatgccttcagccaaaccgtgaaagaaattttcggagggaacgccgacaagaagaatctggtcgacccgtttgttgaggttagctttgctggaaaaaaagtgtgcaccaacatcattgagaagaatgctaatcccgagtggaaccaagtggttaacctgcagattaaatttcccagcgtttgtgagaagatcaaactgacaatctatgactgggacagattgacaaaaaatgacgtggttgggactacatacctccacctgagcaagatcgctgcttccggaggcgaggtggaggtcaatactggagagacggaagttggttttgtgccaacatttggcccttgttaccttaacctgtatggctccccacgtgagtacactggctttccagatccttatgacgaactcaacacaggtaagggagaaggcgtcgcctaccgcgggcgaattcttgtggagctggctaccttcctggaaaaaacacccccagataaaaaactagaacccatttccaatgatgatctcctagtcgtcgagaagtaccagaggagacgtaaatatagcttgtcagctgtgttccacagcgccactatgctccaggacgtaggcgaagccatccaattcgaagtgagcatcggcaattatggcaataagttcgatacgacgtgtaaacctttggcgtccaccactcagtatagtcgggccgtgtttgacggcaattactactattatctcccctgggcccacacaaaacccgttgtgaccctgacgagctattgggaggacatctcgcacaggcttgatgccgtgaacaccctgctagccatggccgagcgcctacaaacaaatatcgaagcactgaagtctggcattcagggcaaaatcccagctaaccagctggcagagctttggcttaagctcatcgacgaagtgattgaggacacaaggtacaccctgcctctgaccgaagggaaagctaatgtcaccgtgctggatacccaaattaggaagcttcggagcagatccctgagccagatccatgaagcggctgtgagaatgcgatctgaagctactgacgtgaaatctacgcttgccgaaatcgaggattggttggacaaacttatgcagttgaccgaggaaccgcagaatagcatgccggacatcataatctggatgatccgaggggaaaagcgcctggcttatgcacgcattcccgcacaccaagtgctgtattccacctcaggtgaaaacgcttcaggcaaatactgcggaaagacacagacgatctttctgaagtacccacaggagaagaataacgggcctaaagtccccgtggagctcagggtgaacatttggctaggcctgtctgctgtcgagaaaaagtttaatagttttgccgagggtacatttactgtgttcgccgagatgtatgaaaatcaggcactgatgtttggaaaatggggcactagtggcttagtcggccgacacaagttctctgacgtcacggggaagataaagctgaagagggagttttttcttccgcccaagggatgggagtgggagggggaatggatcgtggatcccgaacgatctttgttgacagaagctgatgcaggtcatacagaattcaccgatgaagtgtaccaaaacgagagcagatatccaggaggcgattggaaacctgccgaggatacttatacagacgctaacggcgacaaggccgcatctccgagcgaactcacatgtcccccaggttgggaatgggaggacgacgcttggagttacgatattaatagggctgtagatgagaaagggtgggaatacgggatcaccatccctcctgaccataagcccaagtcgtgggtcgccgccgagaaaatgtaccacacgcataggcgccgaaggttagttaggaagagaaagaaagaccttacacaaactgcaagtagcacagctcgcgcgatggaggaacttcaggaccaggaggggtgggagtacgcctccctgatcggctggaaatttcactggaagcaaagatcctccgatacattccgccgtagacggtggcggcggaaaatggccccaagtgagacacacggcgccgcagccatttttaagctggaaggggcgctgggggcggataccacggaggatggtgacgagaaatctctggagaagcagaaacatagtgccaccacagtgtttggggcaaacacacctatcgtctcgtgtaactttgaccgtgtgtatatttaccacctcagatgttacgtctaccaggcacgcaacctactcgctttagacaaggacagtttttcagacccttatgcacatatatgcttcctgcaccggtccaagaccactgagatcattcacagcaccctgaatcctacttgggaccagacgattatctttgacgaagtggagatctacggggagccacagaccgtccttcagaatccaccaaaagtgataatggaactgttcgacaatgatcaagtgggaaaggacgagtttctgggcaggagtatctttagtcccgtcgtcaagctgaattccgagatggatatcaccccaaagctgctgtggcatcccgtgatgaacggggacaaagcctgcggggacgttttagtcacagccgagcttatcctgcgggggaaagatggctctaatttgcctatattgccccctcagagagcccccaatctttatatggtgccacaagggattagaccagtggtccagctcaccgcaatcgagattctggcctggggactacgcaatatgaaaaatttccagatggcatcaataactagccctagccttgttgtggaatgtggcggagaaagggtagagtcggtcgtcatcaaaaatctgaagaagactccaaattttccctcttctgtgctcttcatgaaggtgttccttcctaaagaggagctttacatgcctccgctggtaattaaagtgatcgatcacagacaatttggacgaaaacccgtagttgggcagtgtactatcgagagattggataggttcaggtgcgacccttatgccgggaaggaggatattgtccctcaattgaaagcatcccttctgtctgcgccgccttgccgcgatattgtaatagaaatggaagacactaaacctttgttggcgtcaaaactgactgagaaggaggaagaaatagtcgactggtggagcaaattctacgccagctccggggagcatgaaaaatgcggccagtatatccaaaaagggtactcaaagctcaaaatttataattgcgaactcgagaatgtcgctgaattcgaaggcttaacagacttcagcgacacctttaaattgtaccgggggaagagcgacgagaacgaagatccatccgtcgtgggcgagttcaagggtagcttcagaatctacccactgcctgatgatccatctgtccccgcccctccaaggcagtttcgagagttgccagattcagtgccacaggagtgcaccgtgcgcatttacatcgtccggggactggagcttcagccccaggacaacaacgggctatgtgatccatatattaagatcacactcggcaagaaggttatcgaggatcgggatcactatattcctaataccctgaatcctgtgttcggtaggatgtacgagctctcctgctacctgccacaagagaaagacttgaagatttcagtctatgattatgacacctttacccgcgatgagaaggtcggggagaccatcatagacctcgaaaacagatttctgtcccgattcgggtctcattgtggcattcccgaagaatattgcgtttccggtgtcaatacctggcgggatcaacttcgccccacccagctgctccagaatgtcgctaggttcaagggattcccacagccgatcctgtctgaggacggttcccggattaggtacgggggccgcgattacagcctagacgaatttgaagctaacaagattctgcatcagcatctcggcgcccccgaggaacggctggcactgcatatccttcgtacacaggggctcgttcccgagcacgtggaaaccagaactctccactcaacattccaacccaatataagccagggcaagctgcagatgtgggtggacgttttccccaagagcctgggccccccaggccctccctttaatattactccacggaaagctaaaaaatactacctgcgggttatcatatggaacactaaggatgtgatcttggatgagaaatctatcacaggtgaagaaatgagtgatatctatgtaaaagggtggattcccggtaatgaagagaacaagcagaagactgatgtccattatcgatccttagacggtgaaggaaattttaattggcgatttgtgttcccatttgattacctgcctgcggaacaactgtgtatcgtggcaaagaaggagcacttttggagtatcgaccagacagagtttaggattcctcctcggctaatcatccagatttgggataacgacaagttctcacttgatgactatctgggattcctggagttggacctacggcacacaattattccagctaagtcgcctgaaaagtgtcggctagacatgatccccgacctaaaagccatgaatcccctcaaagctaagacggcctcattattcgagcagaaatctatgaagggctggtggccttgctatgcagagaaggacggcgccagagttatggcaggcaaggtggagatgaccctcgagatcttgaatgagaaggaggcagacgaaagaccagccgggaagggtcgggacgaaccaaatatgaaccccaaactcgatctccctaatagaccagagacatccttcctctggtttaccaatccgtgtaagaccatgaagttcattgtgtggagaaggtttaaatgggtcatcatcgggctgctttttttacttattctgttactctttgtggcggtgctcttatactcgctaccaaattacctgagtatgaaaatcgtgaagcctaatgtgtag

SEQ ID NO: 43926 - DNA, 6186 bp, Artificial Sequence
  Description of Artificial Sequence: Synthetic coding sequence
atgctgcgggtgatcgtggagagcgccagcaacatccccaagaccaagtttggcaagccagacccgatcgtgagcgtgatattcaaagatgagaagaagaagaccaagaaggttgataacgagttaaaccctgtgtggaacgaaatcctggaattcgatctgagggggattcccctggacttctcctccagcttgggtataatcgtcaaggactttgagactattggccagaataagttgatagggactgcaacagttgcgctgaaggatctgactggcgaccaaagccgctctctcccttataagctcatcagtctgcttaatgagaagggccaggatacaggggctacgattgatttagtgattggttacgaccccccgagtgcccctcatcccaatgatctgtcaggtcctagcgtccctggcatgggcggcgatggggaagaagacgagggggacgaagatcgactggacaacgccgtgagagggccaggacccaaagggccagtgggaaccgtgtcagaagcccagctggccagacggctaaccaaagttaagaactctcgccgtatgcttagtaacaaacctcaggacttccagatccgagttcgggtgatagagggccggcagctgagcggcaacaatatcaggccggtggtcaaggtccacgtgtgtggacagactcaccgcacaagaattaagcggggcaacaatcccttctttgacgagctgttcttttacaacgtcaacatgactcccagcgaattgatggacgaaattatctctattagggtgtataactcacacagtctgcgcgccgactgcttaatgggcgagttcaaaatcgacgtcgggtttgtgtatgatgagcccggacatgctgtcatgcgaaagtggcttctgctgaacgatcctgaggatacaagttctggatccaaggggtatatgaaagtgagtatgttcgtactgggcacaggggacgaacctcccccagaacggagggacagagacaacgattccgacgatgtggaatcaaacttgctgctacctgccggaatcgctttgagatgggtcacatttctcctcaagatctatagagccgaagatatccctcagatggatgacgccttttcacagactgtgaaggagatctttggcgggaatgctgataaaaagaacctcgtggatccattcgtcgaggtgtccttcgctgggaagaaggtttgtactaatatcattgagaaaaacgccaatcctgaatggaaccaggtcgtgaacctgcagattaagttcccatcagtttgtgagaagatcaagctgacaatttacgattgggatagactgactaaaaacgatgtcgtgggcactacataccttcacctttctaagattgccgctagcggaggagaggtcgaggacttttccagcagtggcaccggagcagccagctacacagtgaataccggggagacggaagttggatttgtgccaactttcggcccatgctaccttaacctgtacgggtcaccaagggaatacacaggatttccggacccgtacgatgagctgaacacaggaaagggagaaggggtggcttatcggggacgaatattggtggaactcgctacttttttagagaagaccccccctgataagaaattagaacccatcagtaacgacgacctgcttgtcgtcgaaaaatatcaaagacgtcgcaaatattcgttatccgccgtttttcatagcgctacgatgcttcaggacgtaggagaggccatccagttcgaagtctccataggtaactacggaaacaagttcgacacaacttgtaaaccactcgcctcgaccacacagtattcacgagcggtgttcgacggcaactactattactacctgccctgggcccatactaaaccagtggtaacccttacctcctattgggaggatatctcccacaggctggatgcggtgaatactctactggccatggccgagcgcctccaaacaaacatcgaggccctgaaatccggcattcagggcaaaattccggcaaaccaattggccgagctgtggctcaagcttatagatgaggtcatcgaagataccaggtataccctccctctgacagagggaaaagccaacgttaccgtacttgacacacagataagaaaactcagaagtcggagcctgtctcagatccacgaggccgccgttagaatgaggtctgaagccacagatgtgaagtccacgctcgccgagattgaagattggctggacaaacttatgcaactgacggaagagccgcaaaactccatgccagacataattatctggatgattcgcggagaaaagaggctcgcctatgctcgaatccctgctcaccaggtactctacagcacttccggcgagaacgcctccggcaagtactgcggtaaaacgcaaacaatttttctcaaatacccccaggaaaaaaataatggccctaaggtgcccgtggagctaagggtaaacatctggctgggcctcagcgccgtcgagaagaagttcaacagtttcgccgaagggacatttactgtttttgctgagatgtatgagaatcaggcactgatgtttggaaagtggggcacctccggtctcgtcggaagacataaattctccgacgtgacaggaaaaatcaagctgaaaagagaattcttcctgccacctaagggctgggagtgggaaggggagtggatcgtcgaccctgagcgtagcctgctcactgaggcagacgcaggccataccgagttcacggatgaggtttaccagaatgagtcaaggtatccgggtggggattggaaaccagcagaggatacatacaccgatgctaatggcgataaagctgcctcacccagcgagctgacatgtccgcccggatgggaatgggaggatgacgcctggtcttacgatatcaatcgagctgtggacgagaagggatgggagtatggaatcacgatccctccagaccacaagcccaagagctgggtggccgcggaaaagatgtaccacactcaccgaaggagaagattagtgagaaagaggaaaaaggacttaacgcagactgcttccagtaccgcacgggccatggaggaactccaggatcaggagggttgggagtacgcgtccctgattggctggaagttccactggaaacagcggtcctctgacaccttccggcgtaggcggtggaggcggaaaatggccccaagcgaaacacatggtgccgccgcaatctttaagctggagggtgctctcggcgcggataccacagaggatggggatgagaagtctctggaaaagcagaaacattccgcgaccacagtttttggcgccaatacccccatcgtgtcctgcaattttgatcgggtgtatatataccatctgcgctgttacgtgtatcaggccagaaacttgctggccctagacaaagatagcttttctgacccatacgcacacatttgctttctgcacagatccaagacaacagagatcatccacagcaccttgaaccctacatgggaccaaacaatcatttttgacgaagtagaaatatacggggagccccagacagtgttacagaatcctcctaaagttatcatggagcttttcgacaacgaccaggtgggcaaagacgaatttcttggtaggagcattttcagtcctgttgtgaaactaaattctgaaatggatatcaccccaaagcttttgtggcacccagttatgaatggcgacaaagcttgcggggacgtcttagtgaccgcagagcttatcctacgcggaaaggatgggtctaatctgcctatcttgccccctcaaagagctcccaacctgtacatggtgccacagggaatccgacctgtcgtgcagctgaccgcgatagaaattctagcatggggcctcagaaacatgaaaaattttcagatggcaagcatcacatcccctagcctggtggtggaatgcggaggagagcgagtggagtcagtggtgatcaagaatctgaagaagacacctaactttccatcctccgtgctctttatgaaagttttcttgcccaaggaggaactgtacatgcctcccctggtgattaaagtgatcgaccacaggcagtttgggcgaaagcccgttgtcggtcagtgtaccatagaacgtcttgacaggtttagatgtgatccctatgctgggaaggaggacattgtgccgcaattaaaagcctcattactctccgcccctccctgccgtgatatcgttatagagatggaagacaccaaaccactgttagcgtctaaactcactgagaaggaggaagaaattgttgactggtggtctaaattttacgcgtcatcaggcgagcatgaaaaatgtggtcaatatatacagaaaggctattctaaactgaagatctataactgcgaactggagaatgtggcagagtttgaggggctcaccgatttctccgataccttcaagttgtaccggggaaagagcgatgagaacgaggacccaagcgtagtgggagagttcaaggggagtttccgcatctatcccctgccagacgacccctcagtgccggcccccccccgccaattcagggaacttcctgattcagtgccacaggagtgtacggtgcgcatatacattgtgagaggtctggaacttcagcctcaggacaataacgggctatgcgacccatatatcaagataaccctcgggaaaaaggtgatcgaggacagggatcattacattccaaacacactgaatccagttttcgggaggatgtacgagttgagttgttacctgccccaggagaaggacctgaagatatctgtgtatgactacgatacattcacccgcgacgagaaggtcggtgaaactatcattgatcttgagaataggttcctgtcacgcttcggaagtcattgtggaattcctgaggagtactgcgtgagcggggtaaacacatggagagatcagctgcgccccacacagcttctccaaaatgtcgcaagatttaaggggttcccccagcccattctgtccgaggatgggtcgcggatccgctacggcggcagagattattccttggacgaatttgaggccaacaagatactgcaccaacatttgggggctcctgaggaacggctagctctgcacatcctgaggacccaaggcttggtacccgagcacgtcgagacacgcactctccactcgaccttccaacctaacattagtcaggggaagttacaaatgtgggtcgacgtgtttccgaaaagtctgggcccccccggaccaccgttcaatatcacacctaggaaggcaaagaaatactatcttcgtgtaattatatggaacactaaggatgtcattctggacgagaagtcaattaccggggaggaaatgtctgatatatacgtcaagggctggattccaggtaatgaggaaaataagcagaaaacagatgtgcattataggagtctggacggcgagggcaattttaactggcggttcgtgtttccttttgattatctgccagccgaacaactgtgtattgtagctaagaaggaacacttctggagtatcgaccagacagagttcagaatccccccacgtttaatcattcaaatatgggacaacgataagttttccttagacgactacctggggtttctggaattagacttgaggcatacgattatacccgccaagtcaccagagaagtgccggcttgacatgataccagatttgaaggctatgaatcctctaaaggcgaagaccgcctcactttttgaacagaaatcaatgaaaggctggtggccatgctatgctgagaaggatggagctcgggtgatggccgggaaggtcgagatgaccctcgaaatcttaaacgagaaggaagcagacgagaggcccgctgggaaaggccgggacgaaccgaatatgaaccccaagcttgatttacctaaccgccctgagacatcctttctgtggtttacaaatccctgtaagacaatgaagttcatcgtttggcggaggttcaagtgggttataattggtctgctatttttattgattttattgctttttgtcgctgtgttgctgtactcactgcctaactatctttcgatgaagatcgtcaaacctaacgtttag

SEQ ID NO: 43927 - DNA, 483 bp, Artificial Sequence
  Description of Artificial Sequence: Synthetic coding sequence
atgctgcgggtgatcgtggagagcgccagcaacatccccaagaccaaattcgggaagcccgatcctattgtttctgtgatctttaaggacgaaaagaaaaaaactaaaaaagttgacaatgagttgaatcccgtttggaacgaaattctcgaattcgacttaagaggtattccactagacttctccagctctttgggcatcatcgtgaaagacttcgagacaataggtcaaaacaagctgattggaaccgcaacagtggcccttaaggatctgaccggggaccagtccagaagtctcccctataagctgatttcactgctcaacgaaaagggccaggacacaggcgccaccatcgacctggtaatcggctatgatccgccctccgccccgcaccctaacgacttgtctggcccaagcgtccccggcatgggcggtaagttgactctgttaaaagcgcagcccccgccgggagggggttgctag

SEQ ID NO: 43928 - DNA, 1338 bp, Artificial Sequence
  Description of Artificial Sequence: Synthetic coding sequence
atgctgcgggtgatcgtggagagcgccagcaacatccccaagaccaaattcgggaagcccgatcctatagtgtccgtgatatttaaggacgagaaaaagaagactaagaaggtggataacgagctgaaccccgtatggaatgaaatactcgagtttgatcttcgcggaattccgctggacttctcaagcagcttaggcattatagtgaaggacttcgagacaatcggccagaacaagctcatcggcacggccacagtcgcccttaaagacctgaccggagaccaatcacgctcactgccctataaattaatctcattactaaatgagaaggggcaggataccggcgcgactatagatctcgtgattggctatgatcctccgtcggccccacaccctaatgacctgtcaggaccgagcgttcctggaatgggaggcgacggagaggaggacgagggagacgaggatcggctggataatgcagtccgaggacccggccccaaggggccagtgggaaccgtctctgaggcgcagctggccagacggttaaccaaggtgaagaatagtcgcaggatgctgtcaaataaacctcaggactttcagattcgcgtgagggtcatagaggggcgccaactgtccggcaacaacatccgtcctgttgtgaaagtccatgtgtgcggccagacgcaccgcacaaggattaagcgtggcaacaaccctttctttgatgaattgttcttctataatgttaatatgacccccagtgagctcatggacgagatcatctccattcgagtgtataattcacatagcctcagggcagattgtctgatgggtgagttcaagatagacgtcggctttgtgtatgatgaacccggacacgccgtgatgcgaaaatggctgctgctcaacgatccagaagatacttccagcgggtctaaggggtatatgaaagtctctatgtttgtgcttggcacaggcgatgaacccccgcccgagcgcagagatagggataacgacagtgacgacgtggaatcgaatctccttttaccagctggcatcgctctccggtgggtgacattcttgttgaaaatttatcgggccgaagatatcccacagatggatgacgcgtttagccagacggttaaagagatttttggtggcaacgctgacaaaaagaacctggttgatccattcgttgaagttagctttgctggcaagaaggtgtgtaccaatatcattgaaaaaaacgccaatcctgaatggaaccaggtcgtaaatctacagatcaagtttccgtccgtgtgcgaaaaaattaaactgacaatttacgattggtag

SEQ ID NO: 43929 - DNA, 6186 bp, Artificial Sequence
  Description of Artificial Sequence: Synthetic coding sequence
atgctgcgggtgatcgtggagagcgccagcaacatccccaagaccaaatttggcaagcccgacccaatcgtcagcgtaatttttaaagacgaaaagaaaaagacaaaaaaggtagacaacgagctcaacccagtgtggaatgagattctggagttcgacttacgcggaattcctcttgatttttctagttctttgggcatcatcgttaaagacttcgagacaattgggcagaataaattgatcggaactgccactgtggctctcaaggaccttaccggagatcagagtcggtcgctgccctataagctgatcagcctactcaacgagaagggccaggataccggagcaactatcgacctggttatcggctacgatcccccctccgccccacatcctaacgatctttccggtccttccgtacccgggatggggggagacggagaagaggatgagggggatgaggatagactggacaatgcagtgagggggccggggcccaaaggacctgtgggcaccgtctccgaggcgcaactggcccgacgcctgactaaggtgaagaatagtcgcagaatgctcagcaacaaaccacaagactttcagatcagggtaagagtaatagaagggaggcagctaagtggcaataacatccgccccgtagttaaagtgcacgtgtgtgggcagacccatagaacacggataaagcgaggaaacaatcccttttttgatgaactcttcttttataatgtgaatatgacacccagcgagctgatggatgaaatcatctccatccgcgtgtacaactctcacagtctgcgggccgattgtctgatgggcgagtttaagatcgacgtggggttcgtctacgatgagcccggccacgctgtgatgagaaaatggctgctgcttaatgatcctgaggacacaagctcgggttccaaggggtacatgaaggtgagtatgtttgtgctcgggaccggggatgaaccccccccagaacggagggacagagataacgattctgatgacgtggagtcaaatctgctgctgcccgctgggatagcgttacggtgggtgacgtttcttttgaaaatctatagggctgaagacattccacagatggacgatgccttcagccagaccgtaaaagaaatttttggcgggaacgctgataaaaaaaatcttgtcgatcccttcgtggaggtttcttttgcaggcaaaaaagtttgtactaacataattgaaaagaatgctaatccagagtggaaccaggtggtgaatctgcagatcaaatttccatccgtctgtgagaagatcaagctgactatttacgactgggacagactcaccaaaaatgacgtggtgggtactacctacctccacctaagtaagattgcagcctccgggggtgaagtcgaagacttttcgagttctggcactggggctgcctcatatacagtaaacaccggagaaacggaggtcggattcgtgccaacatttgggccatgctaccttaacctttacggttcgccaagagaatatacaggttttccagatccctacgatgagcttaacactgggaagggcgagggggtggcatacaggggccgtatcctggtcgagctggccactttcctggaaaagacaccgcccgacaaaaagctggagcctatcagcaacgatgatctactcgtggtggagaaatatcagagacgcaggaagtactcattatctgccgtgttccatagcgctactatgctgcaggatgtgggtgaggcaatccagttcgaggtctctatcgggaattacggtaacaaatttgatacaacatgtaagccactggcctctaccactcagtattctagggccgtgtttgacgggaactactattattacctgccctgggcccacacgaagcctgtcgtgacactgacctcctattgggaggacatttcacataggctggatgctgttaacacgctcctggcgatggcagaacgactccaaacaaacatcgaggccctgaagtcgggcatccagggcaaaatacccgctaatcagctggctgaactttggctgaaactgattgatgaagtaatcgaggacaccagatataccctcccgttaactgaaggaaaggccaacgtgactgtgttagatacccagatacgaaagctgcgtagccggtccctgtcgcagattcacgaggctgccgttcggatgcgtagcgaggccaccgacgtgaaatcaacccttgcagaaattgaggactggttggacaaactcatgcagctcaccgaggaaccacaaaacagcatgcctgatatcatcatctggatgattagaggagaaaagagactggcatacgcgcggattcccgctcatcaagtgctctatagcacaagcggagaaaacgccagcggcaaatactgtggaaaaacacagacaatttttctcaagtaccctcaggagaagaacaatggccctaaagttcccgtcgagcttcgggtgaatatctggttgggcctgtccgcggtcgagaagaaatttaattcgttcgccgagggaaccttcactgtcttcgccgaaatgtacgagaatcaagccctaatgttcggaaaatggggcacctcgggactggttgggcgccacaaattttccgacgtaaccggcaaaatcaagctcaagcgggagttcttcctcccaccgaaaggctgggagtgggaaggcgaatggatcgtggaccccgaacggtctttgttgactgaggcagacgctggccatacggaattcaccgacgaagtgtaccagaatgaaagccggtacccaggcggggactggaagccagcagaggacacatatactgacgcaaacggcgacaaggcagcatctccctcagaactcacatgtccccccggatgggagtgggaggacgatgcttggtcctatgatattaatcgggccgttgacgagaagggctgggaatatggcattacaattccaccggaccacaagccaaaatcttgggtcgcagctgagaagatgtatcatacccatcggagacgtcgcttagtgcgaaagcggaagaaggacctgactcagactgcttctagtactgcccgtgccatggaagagctgcaagaccaggaagggtgggaatatgctagtctcatcggttggaagttccactggaaacagcgctcttcagacacctttcgacgccgacggtggcgacgtaagatggctccctcagaaactcatggggccgccgcaatttttaagttggaaggcgcactcggagccgacactacagaggatggggatgagaaaagtctcgaaaaacaaaagcattcagctactaccgtgttcggcgccaacactccaatcgtcagctgtaacttcgatcgtgtgtatatataccacctacggtgctatgtttaccaagccagaaatcttctcgccctggataaggactcattttctgacccgtatgcacacatctgctttctgcatcgcagcaagactactgagattattcactctacactgaatccaacgtgggaccagactataatatttgatgaggtagagatttatggcgaaccacagaccgtgctgcagaatccccctaaggttattatggagctgttcgacaacgatcaagtgggcaaggatgagttcttaggtcgcagcatattttctccagtcgtgaagcttaactctgagatggacataacccctaagttgctttggcatccggtcatgaatggtgataaggcctgcggtgatgtgctcgtcacagccgagctgattctccggggtaaggacgggtcaaatctacctattctgccgccccaacgcgcacctaacctatacatggtccctcagggcattaggccagtggtacagctaaccgctattgagatcctggcctggggcttacgtaacatgaaaaacttccaaatggccagcataacctccccctcactcgttgtcgagtgtgggggagagcgggttgagtccgtcgtaataaaaaatctgaagaagacccccaattttccgtcttccgtgttgttcatgaaggtgttcctgcctaaagaagaactgtacatgccaccgctggtgataaaggtgatcgaccaccgacagttcgggcgcaagcccgtggtaggtcagtgtaccattgagcgcttggatcgattcagatgcgatccttacgcagggaaggaggacattgtgcctcagctaaaggcatctctcctgtctgcgccaccctgcagggacatcgtcatcgaaatggaagacacaaagccgcttctcgcaagcaagttagtgagtatcgaggaggagattgtagattggtggtctaagttttatgcctccagtggagagcatgagaagtgcgggcagtacatacagaagggatacagcaaactgaagatttacaattgtgagcttgaaaatgttgcagagtttgagggcctgaccgacttcagcgacactttcaaactgtatagggggaaatctgacgagaacgaggatccatcggttgtgggtgagttcaagggatccttccgcatttatcccctgcctgatgatccctccgtgcctgccccccctagacagtttcgtgaactgcccgactccgtgccccaagaatgcacagtacgaatctacatcgtcagaggcctggagttacagccccaagataataacggcctgtgtgatccttatatcaaaatcaccctagggaagaaagttatcgaagatcgcgaccattatattcccaatacattaaaccctgttttcgggagaatgtacgaactcagctgctatttgcctcaggaaaaggacctgaaaattagcgtctacgactatgatacttttacaagggacgaaaaggtgggtgaaactattatcgacctggaaaacagattcctctcccgcttcgggagtcactgcggcatccccgaggagtactgcgtttctggagtcaacacctggagggaccagttaagaccaacccagttgcttcagaacgtcgcccgcttcaaaggcttcccgcaaccaattctatcagaagacgggagccggatcaggtacggggggcgagactactctctggacgagtttgaagccaataagatactgcatcaacatctaggggcccctgaggaaagattagcactgcacatactgagaacccagggcctggtccctgagcacgtggaaacacgcactttgcactcaacattccagcctaacattagtcaaggcaaactccagatgtgggtggacgttttccccaagagcctcgggcccccagggccgcctttcaacattacccctagaaaagccaagaagtattatctacgggttatcatctggaacaccaaagacgtaatactggacgagaaaagtatcacaggcgaggaaatgagcgatatctacgttaaagggtggattccaggcaacgaagaaaataaacagaagaccgatgtgcattataggagcctggatggagagggcaactttaattggcggtttgtctttccattcgattacttgcctgctgagcagctgtgcatcgttgcaaagaaggaacacttctggtccatcgatcagacagaattcagaattccccctagactgataatccaaatctgggataacgataagttttcgctcgatgattacctgggctttttagagttggacctgcggcataccatcattccagccaagagtccagaaaagtgtcgacttgatatgattcctgacttgaaggcgatgaatcccctcaaagctaagacggcttcactttttgaacaaaagtctatgaagggttggtggccatgctatgctgagaaagatggcgctagggtcatggctggtaaagttgagatgactctggaaatcctcaatgagaaggaggctgatgaacgacctgccggcaaaggccgcgatgagcctaacatgaatccaaagttggaccttccaaacaggcccgagaccagctttttgtggttcactaatccttgtaagactatgaagtttatcgtttggcggcgttttaaatgggttattattggtctcctctttcttctgattttgctgctgtttgttgccgtcttgctatattcgctccctaactatctcagcatgaaaattgtaaagccaaacgtttag

SEQ ID NO: 43930 - DNA, 6156 bp, Artificial Sequence
  Description of Artificial Sequence: Synthetic coding sequence
atgctgcgggtgatcgtggagagcgccagcaacatccccaagaccaagtttgggaagcccgaccctatagtctctgtgattttcaaggacgagaaaaagaaaacaaagaaagtggataacgaactgaatcctgtatggaatgagatcctcgagttcgacctccgagggatcccactcgacttttctagctcattgggtattatagtcaaggatttcgagacaatcggccagaataagttgatcggcaccgctacggtggcactcaaagacctgacaggagatcagtccaggtcacttccttacaagttgatctccctgttgaacgaaaagggtcaggacactggcgctaccattgatttagtgattggctacgatccgcctagtgctccgcaccccaacgatttaagtgggccctcggtgccaggaatgggtggagatggcgaagaggatgagggagacgaagaccgtttagacaacgccgtacgtggtcctggccctaagggccctgtggggaccgtgtcagaagcacagctcgctcggagactcactaaagtgaaaaatagccgtaggatgctgagcaacaaaccccaggacttccaaatcagagttcgcgtcatcgagggtcggcagctgtccggtaataacatacgacccgtggtaaaagtccatgtgtgtggccaaacccacaggaccaggatcaaaagaggcaataaccccttctttgacgaactcttcttctataacgtaaacatgaccccaagtgaactgatggacgaaataatttctattcgcgtatataacagccattccctacgggctgattgcctgatgggcgaattcaaaatcgacgtcggttttgtgtatgatgagcccgggcacgccgtgatgagaaaatggctgctgctaaacgacccggaagacacttcttccggttccaaaggctacatgaaagtctctatgttcgtccttgggacaggagacgagccccccccggagagaagggatagggataatgattctgacgacgtggagtctaacttgctcctacccgcaggcattgcattgaggtgggtgaccttccttctgaagatctatcgcgctgaagacatcccacagatggacgatgccttctctcaaactgtgaaggagatctttgggggaaatgctgacaagaaaaacctggtcgatccctttgtggaggtttcatttgcaggcaagaaggtctgtaccaacattattgagaaaaacgcaaaccccgagtggaatcaggtggttaatctgcaaattaaattcccctctgtgtgtgaaaagatcaagttgaccatttacgattgggatcgcctgaccaaaaatgacgtggtgggaactacctaccttcacctttctaagatcgccgctagtgggggggaggtagaagatttttcatcttctggaaccggagctgcatcttataccgttaacacaggagaaactgaagtaggcttcgtgccgaccttcggtccttgttatctgaacctgtatggcagtcctagagagtacacaggttttcccgacccttacgatgagctgaacacggggaaaggcgagggtgtcgcttacagggggcgcatcctcgtcgaactggcgaccttcctggaaaagacccccccagacaagaagctagaaccgatttcaaacgatgacctgcttgtggtcgagaagtatcaacggcggaggaaatactctctgtccgctgtgttccatagtgctacaatgttgcaggacgtcggagaagctattcagttcgaagtgtctatcgggaattacggaaataaattcgatactacttgtaagccactcgcttcaacaactcagtattctcgggctgttttcgacggtaactactactactatctgccttgggcccatacgaaaccagtggtgactttaaccagttactgggaagatatcagtcatcgactagacgcggtgaacaccctgctggcaatggcggagcgcctgcagaccaatattgaagctcttaaatccggaatacagggaaagatacctgccaatcagctggcagaactgtggctgaagctgattgatgaggtgatcgaggacacacggtatactcttccactcacagagggcaaggcaaacgtgaccgtccttgacactcagataagaaaactgcgttcaaggagtctgagtcaaattcacgaagctgccgtccgtatgcggtccgaagcaacggacgtgaaatcgacacttgcggagatcgaggactggctggataagctgatgcagctgaccgaggagccacaaaacagcatgccggatatcatcatttggatgattcgtggggaaaagcgtttggcctacgctcgaatccctgcccaccaggttctgtatagcacttccggcgagaatgcttcgggtaagtactgtggcaagacacagactatttttcttaaatatccccaggaaaaaaataatggtcctaaggtcccggtggaactgcgcgtgaatatttggctggggctttctgctgtagaaaagaagtttaactctttcgctgagggcacttttacagtgtttgcagagatgtacgaaaatcaagcccttatgtttggcaagtggggaacttccggtttggttggccgacataaattctccgacgtcaccgggaagatcaagttgaagcgcgagttcttcctcccccctaaagggtgggaatgggaaggcgaatggatcgttgacccagaacggtctctcctgactgaagctgatgccggtcatacagaattcacagatgaagtttaccagaatgagtctcgatacccaggaggcgactggaaacccgcagaggatacttacactgatgccaacggtgacaaagcagctagtccaagcgaacttacttgcccacccggttgggagtgggaggatgacgcttggagctacgacattaaccgggctgtcgacgagaaaggctgggaatatggcatcaccattccacccgatcataagccgaaatcctgggttgccgctgagaaaatgtaccacactcatcgcagacgtagactcgttaggaaaagaaagaaagaccttacacagactgcttcctcaaccgcccgcgccatggaagaactgcaggaccaagagggctgggagtacgcctccctgatcgggtggaaatttcactggaaacagcggtcctccgatacgtttaggcgcaggcggtggagacggaagatggccccatctgagacacacggagcagccgccatttttaaactagagggggccctcggggccgatactactgaagacggagatgagaagtcattggaaaaacagaagcacagcgccacgacagtgttcggagctaacaccccaatcgtttcttgtaacttcgaccgcgtatacatttatcatctgcggtgttacgtgtaccaggcaaggaacctgctggcactggataaagatagctttagcgacccgtacgcccatatctgtttcctgcatagatcaaagactacagagatcattcactctacactgaatccgacatgggaccaaaccattatttttgacgaagtggaaatctacggtgaacctcagacagtactacagaacccccctaaggttataatggagctgttcgacaacgaccaagtgggaaaagatgaatttctgggacgctccatctttagtcctgtggtcaagctgaatagcgaaatggatatcacccccaagctgctgtggcatccggtcatgaacggtgacaaggcgtgtggggatgtcctggtgaccgcggagctcatcctgcggggtaaagacgggtcaaacctgcctattctcccaccccagagggcacccaatctgtacatggtgccccaaggtatcagaccagtcgtccagctgacggccattgagatcctagcctgggggctgcgaaatatgaagaactttcagatggctagcattaccagcccgtctcttgtggtggagtgcggaggagagagggttgagtcggttgtgattaaaaatctgaagaaaacccctaacttcccttcctctgtgctttttatgaaggtcttcctccctaaagaagagttgtatatgcctcccctcgtcattaaggtaatcgaccatagacagttcggcaggaagccagtcgtaggccagtgtacaattgaaaggttggaccgcttcagatgtgacccctacgcgggcaaagaggatattgtgccccagttgaaggctagtttgctgtctgcgcctccctgcagagatatcgtgattgagatggaagacaccaagcccttgttggcatcaaaatgcctctcatctatgtctacggccctcagcaaaatggccagtccggccactgtgcacgttttggatgaggaagaggagatagttgattggtggtctaagttctacgctagtagcggcgagcatgagaagtgtggacagtacattcagaaaggctattcaaagctaaagatctataactgcgagttagagaacgtggcagagttcgaaggccttacagacttcagcgacacgtttaagttatataggggcaagagtgatgagaacgaagatccgtctgtggtcggcgaatttaagggcagttttagaatctaccctctgcccgacgacccaagtgtaccagcacccccacggcaattccgtgagttgcccgattcagttcctcaggaatgtactgtcagaatttatatcgtgcgcggcctggagctgcaaccccaagacaacaatgggctgtgcgacccatatattaagatcactctgggaaaaaaggtgatcgaggacagggatcactatatccctaatacactgaaccctgtctttggacggatgtatgagctgtcatgctaccttccccaggagaaggacctgaagatcagcgtttacgactacgacactttcacaagggacgagaaagttggcgagacaataattgatctggagaatcgcttcctttctaggttcggaagtcattgtggcattccagaagaatactgtgtgtccggtgtaaatacttggagggaccaactgcgacccacccaattgctgcagaatgttgccagattcaaaggattcccacagcccatcttgtcagaggacggatctaggattaggtacggtggaagggactattccctagatgaattcgaggccaacaaaatcttacaccagcatctgggcgcccccgaagaaagactggccctacacattttgaggacgcaggggctggttccggagcacgtcgagacgcgcaccctacatagcacattccagcccaatatttctcagaggtattatcttagggtgataatctggaataccaaggacgtgattctcgacgagaaatcaattaccggggaagaaatgtccgatatttacgttaagggatggattcctggcaatgaagaaaacaaacagaagactgatgtgcattacaggtccttggacggggaggggaatttcaactggagattcgtcttcccgttcgactatctgcccgcggagcaactgtgcatcgtcgctaagaaggagcatttttggtcaatcgaccaaactgaatttaggatcccgccacgcttaatcattcagatttgggataatgacaagttctccctggatgattacttgggatttctagaactcgatctgaggcacaccattattccagccaaatccccagagaagtgcagactcgatatgatccccgacctgaaggcaatgaatccactcaaagccaaaactgcaagtttgtttgagcaaaagagtatgaagggttggtggccatgttatgccgagaaagacggcgcacgagtaatggcaggcaaggtggaaatgacactggagatacttaacgaaaaggaggccgacgaaaggccagcaggcaaaggaagagacgagccaaatatgaatccaaaactggacctcccgaatcgaccggaaacatccttcctttggttcaccaatccttgtaagacaatgaagtttatagtgtggaggagattcaagtgggtgataattgggctcctgttcctgctcattcttctgcttttcgttgctgtcctcctctactctcttccaaattacctctcgatgaagatcgtgaaaccaaacgtgtag

SEQ ID NO: 43931 - DNA, 873 bp, Artificial Sequence
  Description of Artificial Sequence: Synthetic coding sequence
atgcaccccatcaacgtgcggcgggaccccagcatccccatctacggactacgacagagcattctcctaaacacgaggctgcaggattgctatgtcgacagtcccgccctgaccaacatctggatggcccgaacctgcgccaagcagaacataaatgcgcccgctccggccaccacaagcagctgggaagtggtgcgcaatcctttgatcgcatctagcttctccctggtgaagttggtgctcagaagacagttaaaaaataagtgctgcccgccgccctgtaaatttggtgaaggcaagctgtcaaagaggctgaaacataaagacgactctgtgatgaaggccactcagcaagccaggaaacgaaacttcatttcgagtaagagtaagcagcccgccggacaccgcagaccggccggcggaatacgcgaaagtaaggaaagtagcaaggagaagaagttaaccgtacgccaggatctcgaggacaggtatgccgagcatgtggccgctacgcaggctttgccccaggattcaggtaccgccgcctggaaaggccgggtccttttgcctgagacacagaagagacagcagctttctgaagataccctaaccatccatggtttgccgacagagggctatcaagcattatatcacgcagtcgtggaaccaatgctgtggaaccctagtggaacacccaaaagatactcactcgagctgggtaaggccatcaaacagaaactgtgggaagctctctgctctcagggcgcaatttccgagggagcgcagagagataggttcccaggcaggaagcaacccggagtgcatgaggagccagtgctcaaaaaatggcctaagctaaagagcaaaaagtag

SEQ ID NO: 43932 - DNA, 813 bp, Artificial Sequence
  Description of Artificial Sequence: Synthetic coding sequence
atgaaggtgaccgtgggccccgaccccagcctggtgtaccggcccgacgttgaccctgaagtggccaaagataaagcaagctttcgaaactatacctctgggcctctgcttgatcgcgtgtttaccacatacaagctgatgcacacacatcagactgtagactttgtaagatctaaacatgcacagttcggggggttcagctacaaaaagatgacagttatggaggccgtcgatctgctggatggactcgtcgatgaatccgaccctgatgtcgatttcccaaattcttttcacgctttccaaactgctgaaggaatcaggaaggcacatccagacaaggattggttccatctggtcggactgttgcacgatctcgggaaggtccttgctcttttcggggagccgcaatgggcagtagtgggcgacacctttcctgtggggtgtaggccccaagccagcgtagtattctgtgattcaacctttcaggataatcccgatctgcaagatcctaggtacagcacagagctcggtatgtaccagcctcactgtgggcttgacagggtgctgatgtcctgggggcatgacgaatatatgtatcaagtcatgaagtttaataaatttagtttaccgcctgaggctttttacatgatacgtttccatagcttttacccatggcacacgggccgggattatcagcagctgtgttcgcagcaggacctggccatgctaccatggcaggtacgacccttgcatcaggttccaggtcccgctggccgaggccaggcagcagctctgctccccggtgctcactag

SEQ ID NO: 43933 - DNA, 696 bp, Artificial Sequence
  Description of Artificial Sequence: Synthetic coding sequence
atgaaggtgaccgtgggccccgaccccagcctggtgtaccggcccgatgtggatcccgaggtggcgaaagacaaggccagttttcggaactatacaagcggcccactgctggatagagtcttcaccacctacaaactcatgcatacccatcagacagttgacttcgtccggagtaaacacgctcagttcggcggattctcctacaaaaagatgaccgttatggaagccgtcgacctacttgacggcctcgtcgatgaaagtgatccggatgtcgactttccaaattcgtttcacgcttttcagaccgctgagggcattcgaaaggctcacccagacaaggtgccaaacttgccctgtccctctcctagtcagacagggtcaactagctctggtagttgtaccacttggggccggtcttggccttgctccggctctcctagcggcctatctagtgctactccatctccatccgatgcagtgcgcagacccccatggtttagcgcaaccccaccatccagaaccactcttacttcaaggatcctggataccgcacaatcaagtggctgcatcagccccaccgtcggctccacaggttccagctgcccaggcgctatgatgcaggtccgtcctctgcaccaggtcccaggtcctgccggacgtggacaggccgctgctctgcttccaggtgctcattag

SEQ ID NO: 43934 - DNA, 798 bp, Artificial Sequence
  Description of Artificial Sequence: Synthetic coding sequence
ggccccgaccccagcctggtgtaccggcccgacgtggaccccgaggttgccaaagataaagcttcatttagaaattacactagcggtcccttgctcgatagggtgttcacaacttacaagttgatgcatacccatcagactgttgattttgtgcgcagcaagcatgcacagttcggcggctttagctataaaaaaatgaccgtgatggaggcagtcgacctgcttgacgggcttgtagatgagagtgaccccgatgtcgacttcccgaactcgttccacgcattccagaccgcagagggcattaggaaggcacaccccgataaagactggtttcatttagtgggcctgttacacgatctcggtaaggttctagcactttttggcgagcctcaagctagtgttgttttctgtgattcaacttttcaggataacccggacctgcaggatccacgctattcgacagagttgggcatgtatcagcctcattgtggattggacagggtcctgatgtcgtggggtcatgacgagtatatgtatcaggttatgaaattcaataaattctccctgccacccgaggccttctacatgatccggttccactcattctatccctggcacacaggccgggattaccagcaactatgcagccaacaggaccttgctatgcttccgtgggtcagagaatttaataagtttgacctgtacaccaagtgcccagacttgccagacgtggacaagctgaggccttattaccaaggcctcatcgacaagtactgccccggcattctgtcttggtag

SEQ ID NO: 43935 - DNA, 2823 bp, Artificial Sequence
  Description of Artificial Sequence: Synthetic coding sequence
atggagatcgaccagtgcctgctggagagcctgcccctgggccagcgacagcgactcgtcaaaaggatgcgctgcgagcagatcaaggcatactatgaacgagaaaaggcgtttcagaagcaggaaggtttcctgaaaagactcaagcacgcgaagaacccaaaggtgcattttaatctgaccgatatgcttcaggacgctataatccaccacaatgacaaagaggtgctgcggctcctgaaggaaggcgccgacccccacactctggtctcctcaggggggagtttgttgcacttatgcgctcggtatgacaacgcctttatagccgaaatcctcatagaccgaggagtgaatgtgaatcaccaggacgaggatttctggactccaatgcacatagcctgcgcctgcgacaacccagacatcgtgctgcttctggtactggccggggctaacgtcctcctgcaggatgtaaacggcaatattcccctcgattacgctgttgaagggaccgagtcatccagcatcctcctgacttacttggatgagaacggagtggatctcactagtcttcgccaaatgaaactgcagagacctatgagcatgttaacggatgtgaaacattttctgagcagcggggggaatgtgaatgagaagaatgacgaaggggtaaccttgctgcatatggcttgtgcgagtgggtacaaggaggtcgtgtcgcttattctcgagcacggaggtgacttaaatattgtagatgatcaatactggacccccttgcacctggccgctaagtacggccagaccaacctggtcaaactgctgttaatgcatcaggcgaatccccatctggtgaattgcaacgaggagaaggcatcagacattgccgcctccgaatttattgaggaaatgctgttaaaagcagaaatagcatgggaagaaaagatgaaagaacccctgagtgcatcaactctggctcaggaggagccctatgaagaaataattcacgatttacctgtactttcgtcgaagctcagtcccctcgtgctgcccatcgccaaacaggactctttactggaaaaggatataatgtttaaggacgccaccaagggactgtgcaaacagcaaagccaggactcgattcccgagaatcctatgatgtccggttctacaaaaccagaacaggtcaagctaatgcctcctgctcctaacgatgacctggccaccctgagcgaattaaacgatggttccctgctctacgagattcagaagagatttgggaataatcagatatacacattcataggtgatatcctgttactggtaaacccctacaaggagctgcccatctattcaagtatggtgagtcagctgtacttctcctcctccggtaagctttgctcctcgttgcccccacacctatttagttgcgtagaaagggcttttcatcagctgttcagggagcagcgaccgcagtgcttcatcctgtcaggtgagaggggatcaggaaagtctgaagccagtaagcaaataattcgtcacctgacctgtcgagcaggcgcgagtcgcgccaccctggactcacgcttcaagcacgtcgtgtgtattttggaagcgtttggtcacgcaaaaactactttgaatgaccttagcagttgcttcataaagtattttgaacttcagttctgtgagcgcaagcagcaactgacaggcgcccgcatctacacctacctcctcgagaagtctaggcttgtctcacagcccctgggccagtcaaattttttgatattctaccttctgatggatggactcagcgccgaagagaagtatgggctgcatcttaataatttgtgtgctcacagatatctgaatcagacaattcaggatgatgcgagtacgggcgagcggtcactgaacagggagaagctcgctgtactcaagagggccttgaatgtggtcggcttttcctctctggaggttgaaaatttgtttgtgatcctggctgcgattctgcatctaggggacatccggttcaccgccctgaacgagggcaactctgcctttgtaagcgatctccagcttctggaacaagtggcaggcatgctgcaggtttccacagatgagctggcatccgccctcactacggatatacagtatttcaagggcgacatgatcatccgccggcatactattcaaattgcagagttctttcgggacctgctggcaaaatctctgtattctcggctattcagctttctcgtgaacaccatgaactcttgcctgcattctcaagatgaacagaaatccatgcagactcttgacattggaatcctggacatattcggtttcgaagagttccaaaagaatgagtttgaacagctgtgcgtaaacatgacgaacgagaaaatgcaccactatatcaatgaggttctctttctgcatgagcaggtagaatgcgtgcaggaaggagttaccatggagaccgcatacagcccaggcaaccaaaacggcgtgcttgatttctttttccaaaagccatctggatttctgacccttctcgacgaggaatcccagatgatttggtccgtggaaagtaatttcccgaaaaaactccagtctctgttggagtcgtccaatacgaacgccgtgtactctccaatgaaagatggaaatgggaatgtagcactgaaggatcatggaacagcatttacaataatgcactacgctggccgtgtgatgtatgacgtggttggagcaatcgagaaaaataaagattccctgtctcagaatttgctctttgtgatgaagaggggtcggtgcttctag

SEQ ID NO: 43936 - DNA, 5577 bp, Artificial Sequence
  Description of Artificial Sequence: Synthetic coding sequence
atggagatcgaccagtgcctgctggagagcctgcccctgggccagaggcagcggctcgtcaaaagaatgagatgtgagcagattaaggcttattatgagcgcgagaaggctttccaaaaacaagaggggttcctgaagaggctaaagcatgcaaaaaatccaaaagttcatttcaatctcactgacatgttgcaggatgccatcattcaccacaacgataaggaggtccttcggctcctcaaggagggagcggatccacatactttggtgtcctctggagggagcctcctgcacttgtgcgctagatatgacaacgccttcattgctgagatactcattgaccgcggcgtgaacgttaatcatcaggacgaggacttctggactcctatgcatattgcttgtgcttgcgataaccccgatattgtgctgctgctggtcctggccggcgccaacgtgctactgcaggacgtgaatggaaatatcccgctcgactatgctgttgaggggacggagtcaagtagcatcctccttacctacttggatgagaatggagttgaccttacatctttacggcaaatgaagctgcagagaccgatgagcatgctgaccgatgtgaagcatttcctgtccagtggagggaacgtgaatgagaaaaacgatgagggggtgacactgttacacatggcctgcgcttctggttacaaggaagtggttagcctcatcctcgaacacggaggagatctcaacatagtggatgaccagtactggacacccctccacctagccgccaagtatggtcaaaccaacctggtcaaactcctcttaatgcatcaggccaacccacacctcgtgaactgtaacgaagaaaaagcgtccgatatcgccgcctctgaatttattgaggagatgcttcttaaggccgagatcgcatgggaagaaaaaatgaaagaacctttgagcgcctccaccttggctcaagaagagccttatgaggagattatccatgacctgcccgtcctgagctccaaactgagcccacttgtacttccgatagccaaacaggacagtttactggaaaaggatataatgtttaaggacgcgacaaaaggtttatgcaagcaacagtcccaggattctatcccagagaaccccatgatgagtggatcaacaaagcctgagcaggtgaaactgatgccccctgctccgaacgacgatcttgctactttatcagagcttaatgacggctctctgctgtatgagattcaaaaaagatttggaaacaatcagatttatactttcatcggtgatattctactgctagtgaacccctacaaggagctgcccatttattccagtatggtgtcacaattatactttagttcctcgggcaagctgtgctcatctctccctccacatttattctcctgcgtggaaagggcatttcaccagctgttcagagaacaacgaccccagtgctttattctgagcggtgaacgtggaagcggaaagtctgaagcaagcaagcagatcattaggcatctcacttgccgtgctggtgcaagcagagcaacactggactcaagattcaagcacgtggtatgtatcctagaagctttcggacatgctaagaccacattgaacgatttgtcatcctgttttattaagtatttcgaactccagttttgtgaacgcaaacagcagttgacaggcgcccgaatttacacctacctgctagaaaaaagtcgtttagttagccagccattgggtcagagcaacttcttgattttttacctcctcatggatgggctgtccgccgaggagaagtatggcctgcatctgaacaatctttgtgcccatagatacttaaaccaaacaattcaagacgacgcgagcacgggagagcgttcgctgaaccgcgaaaagttggccgtgctgaaacgcgcactgaacgtggtaggattctcctccctggaggtggagaatctgttcgtgattctggccgcgatcctgcatctcggggatattaggttcacggccctgaatgaggggaacagcgcatttgtgtccgacctccagcttctcgagcaggtggctggcatgctgcaggtgtccactgacgagctcgcctccgctcttacgaccgacatccagtattttaaaggagacatgatcatccgccgtcacacgattcagattgctgaatttttccgtgacctgctggccaaatccctctattcccgtttgttctcattcctggtgaataccatgaacagctgcctgcacagtcaggacgaacagaagtctatgcagacactggacataggcattctggacatctttggcttcgaagagtttcagaaaaacgaattcgaacagctttgcgtgaacatgaccaacgagaagatgcatcattatattaacgaggtgctgtttctgcacgagcaggttgagtgtgtgcaggagggagtaaccatggagactgcttatagtccgggcaaccagaacggagtgctcgatttcttctttcagaaaccatccggattcctcacgctgctcgacgaggagtcacagatgatatggtcagtggagagcaattttcccaaaaagctccagtcactcctggagagttcaaacaccaacgctgtgtactccccaatgaaagatggcaacggcaacgtggccctgaaggaccacggtacagcattcacaatcatgcattatgccgggagagttatgtatgatgtggttggcgccattgaaaagaacaaggactctctgagccagaatctgttattcgtcatgaaaacttctgagaacgtggtcattaatcatctattccagtctaaactgtcccagactggctcgctggtttcggcctaccccagctttaagttccgcggtcacaaatcagctctcctatccaagaagatgacggcatcctctattattggagagaacaaaaactacctagaactctctaagctcctgaagaaaaagggcacctccaccttcctgcagcggctggagagaggagaccctgtgaccattgcatctcagcttcggaaatctctgatggatattatcggaaagttgcaaaagtgcacccctcacttcatccactgtatccgccccaataactcaaaactccccgatacatttgataacttctatgtctccgcgcagttacagtacattggcgtcctggaaatggtgaaaatattccgctatgggtaccctgtgcgtctatccttttctgattttctttcccgttacaaaccactcgccgacacctttctcagagaaaagaaagagcagagcgctgcggagagatgtaggttggtgctgcaacagtgcaagttgcaaggatggcagatgggagttcggaaagttttcctgaagtattggcacgcagaccagctcaatgatctctgccttcagctccagcgtaaaattatcacctgccagaaggtgatcagggggtttctggctaggcaacacttgttgcaaagaatcagcatccgtcagcaggaggttaccagcatcaactctttcctacaaaatacagaggacatgggacttaagacatatgatgctctggttatccagaatgcgtctgacattgccagggaaaatgacagactacgttctgaaatgaacgccccataccacaaggaaaagctggaggtaagaaacatgcaggaagagggcagcaagcgcaccgacgacaaatcagggcctcggcatttccacccatccagtatgtctgtctgcgcggccgtggacggacttggccagtgtctggtcgggccctctatctggtctccctctctgcacagcgtgttttcgatggacgatagctctagtttacctagcccacgcaaacagcctcctcccaaacccaagagggacccaaataccagactctctgcgtcctatgaggccgtgtcggcttgcctttcggcggcccgagaagcagccaacgaggctctggcacggccccgcccacattccgatgattacagcaccatgaagaagatacctcccagaaaacctaagcgtagcccaaataccaaactgagcgggagttacgaggagattagcggttctcgccccggtgatgccaggccagctggtgctcctggggccgcagcccgagtcctaacgccaggaacgccacaatgtgcgctgccaccagccgctcctcctggagatgaggacgattccgaaccagtgtacattgaaatgctggggcacgccgctaggcccgactcccccgaccccggggagtcagtctatgaggaaatgaaatgctgcctgcccgatgacggagggccaggcgccggctcatttctccttcacggggcatctccaccactgctgcatcgggcacctgaggacgaggcagcgggccctcctggcgacgcatgcgatattcccccaccctttccaaacctgctgcctcatcggcctccactgctggtgttcccaccaacaccagtcacctgctcaccggcctcggatgaaagccctttaactcctctggaggtcaagaagctaccagtactggagaccaacctaaaataccccgtacagcctgaaggaagcagtccgttaagcccacagtactctaagtctcaaaagggagatggtgaccggccagcatcacctggtctcgcactctttaacggatccgggagagcctcgcccccaagtacacccccccctccaccccccccgccgggaccacctcccgcaccatacaggccatgtgcacatcttgcgtttccccccgaacctgcccccgtgaacgctggcaaagccggcccatctgccgaagcgccaaaagtacaccccaaaccgaactcggctcctgtagccgggccatgtagctcttttccaaaaataccgtacagtcccgtgaaggctactcgtgccgacgccaggaaggcaggaagttccgcttcgcctcccgccccctacagtcccccatcttctagaccattatcttcacccctcgatgagttagcgtccctattcaacagcgggcggagtgtgctgcggaaatccgccgctggccgcaagatccgcgaagcggaggggttcgaaacgaacatgaacatctctagtcgtgatgatccttcaacctctgagattaccagtgagacccaggatagaaatgcaaataatcatggcatccagctaagcaattcccttagctccgccatcaccgctgaaaacggaaatagtatcagcaacggtctgcccgaggaagatggatacagtaggctgtccattagcggcaccggcacttcaacattccagcgccacagagattcacatacgacccaagtcattcaccaactgcggctgagcgaaaacgaatcggtcgccttgcaggaactgttagattggcggcgaaaactctgcgaggagggccaagattggcagcagatactccaccatgccgagcctagggtaccacccccaccaccgtgcaaaaagccaagcctcctgaaaaagcccgaaggggcaagctgcaacaggcttccaagtgagctgtgggacacgacaatctag

SEQ ID NO: 43937 - DNA, 5577 bp, Artificial Sequence
  Description of Artificial Sequence: Synthetic coding sequence
atggagatcgaccagtgcctgctggagagcctgcccctgggccagcggcagagactggtgaaaaggatgcggtgcgagcagatcaaggcatactatgagagggaaaaagcttttcagaaacaagaaggctttctcaaaagactgaagcatgctaaaaatccaaaggtgcactttaacctgactgacatgctccaggatgctatcatccaccacaacgacaaggaggtgctccggctcttgaaagagggcgctgaccctcacaccttggtgtcctccggcggctctctgcttcacctctgcgctcggtacgacaatgcctttatagccgagatcttaattgacagaggggtgaacgtaaaccatcaggatgaagacttctggactcccatgcatattgcttgtgcttgcgataaccctgacattgtcctacttcttgtgctagccggcgccaacgttctgctgcaggacgttaacgggaacatccccctggactacgccgtggaagggaccgagtcctcttccatacttctgacatatttggacgagaatggtgtggatctgacctctctccgccagatgaaacttcagcggccaatgtccatgctgacggacgtcaaacactttctctccagtggcggcaacgtcaatgaaaaaaatgatgaaggcgttacccttctgcatatggcctgtgcttccggttataaagaagtggtttcgctcatactcgagcatggaggcgacttgaacatagttgatgaccagtattggactcccctacatttggcggctaagtatggacaaactaacctggtcaaattgctgttgatgcaccaagctaacccgcatttagtgaactgcaacgaggagaaggccagcgatattgctgcctccgagttcattgaagaaatgctgcttaaagctgaaatcgcatgggaggaaaagatgaaggagcccttgtcggccagtaccctggcccaggaggagccctacgaagagattatccacgatctgcctgtgttgtcgtcaaagctaagtcccctggttttgcccattgccaaacaagactcccttcttgaaaaggatattatgtttaaggacgcgactaagggtctctgtaagcagcagtcacaggatagcatacccgagaacccaatgatgtccgggtctaccaagcctgagcaggttaaattaatgcctcccgctcccaacgatgatctggccaccctcagcgagctcaacgatggaagcctgctttacgaaatacagaagcgctttggtaacaaccagatctacaccttcataggggatatcttgttactggtgaatccatacaaagagctcccgatatattcaagcatggtatctcagctttactttagcagtagtggaaaactgtgttcaagcctacccccccacctctttagctgcgtcgagcgagcattccatcagctatttagagaacagagaccccagtgtttcattctgtccggggagaggggcagtggcaagagcgaggcgtcaaaacaaatcatccggcacctgacatgccgagcaggagcctctagagccacattagactccagattcaagcacgtggtgtgcattttggaggcatttggtcatgccaagaccaccctgaacgatctgtcttcttgtttcatcaaatattttgaactgcagttttgtgaaagaaagcaacagctgaccggggcgcgcatctatacatacctgctggagaagtcccgtctggtgtcccagcccttgggtcagagcaatttcctgatcttctaccttttgatggatggattgagtgccgaggaaaagtacggcctccacttaaacaacctatgtgcccatcggtatctgaatcagaccattcaggatgacgctagcaccggagaaagatcgctcaacagggagaagttggcggtgctcaagcgagctctcaatgtggtgggattctcctccctcgaagtggagaacctgtttgtgatacttgccgctattctacacctgggagacatccggttcacggccctcaacgaggggaattctgcgtttgtgtctgacctgcagttattagagcaggtggctggtatgctccaggtttcgactgacgagttggcttcagcattgactacagacatacagtattttaagggggacatgatcatccgtcgccatacaatacagattgcagagttttttcgggacttgttagcgaagagtctctactcaaggctgttcagcttcttggtaaatactatgaattcctgcctgcattcacaagatgagcagaagagtatgcagaccttggatatagggatccttgacatctttggcttcgaggaattccagaagaacgaattcgagcagctttgtgtgaatatgactaacgaaaagatgcatcactacatcaatgaagtcttgttcttgcatgagcaggtagagtgtgtgcaagagggggttactatggagaccgcctacagtcctgggaaccagaatggggtcctcgatttcttttttcagaagccttccggctttctgaccttgctggacgaggagagccagatgatttggagcgtcgagagtaacttccccaagaaacttcaatccctactcgagagcagtaacacaaacgctgtgtactcccctatgaaagacggaaacggcaatgtggccctgaaggaccacggaaccgcatttaccatcatgcattatgccggccgagtaatgtatgatgtcgtgggtgccattgagaaaaataaggatagcctgtcccagaacctgctatttgtgatgaagaccagtgagaatgtggtaatcaatcatttgttccaaagcaaattatcgcagacagggtcactggtttctgcctacccatcatttaaattccgcggacacaaatctgcactccttagcaagaaaatgaccgcctcgagcatcattggcgaaaacaaaaattatctggagctctcaaaactgctgaagaaaaaaggaacatccacgttccttcagaggctggagcgtggggaccctgtcacgattgcgagtcagctgcgcaaaagcttgatggacatcataggaaagctgcagaaatgtacgccccattttatccactgcattaggccaaataactccaagttgcctgacacattcgataatttttacgtgagcgctcaattgcagtatattggcgtgttggaaatggtgaaaatctttcggtacggataccccgtgcggctcagtttttccgatttccttagtcgctacaagccactggctgatacctttctcagagagaagaaggagcagtccgcagcagagcgctgccgactcgtcttgcagcagtgtaagttacagggctggcagatgggggtgcgaaaggtatttctgaagtattggcacgctgaccaacttaatgacctctgcttgcagctgcaacggaaaatcattacgtgtcagaaggtcatccgcgggttcttggccagacagcacctcctacagcggatttcaatacgccaacaggaagtaactagcattaatagctttctgcagaataccgaggacatgggtctcaaaacttacgacgcacttgtaattcaaaatgcctcagacattgcacgggagaatgatcggttgcggagcgaaatgaatgccccttaccataaggaaaagctagaggtgaggaatatgcaggaagagggcagtaagaggactgacgacaaaagtggaccgcgtcactttcatccttctagcatgagcgtctgcgctgcagtggatggactcgggcagtgcttggtgggtcccagcatatggtcaccttctctccacagcgtctttagcatggacgatagcagtagcttgcccagtccccgcaaacagcctcctcctaagcccaaacgagacccaaacactcgactttcagcctcatacgaggccgtctctgcatgcttgtcggccgctcgtgaggcagccaatgaggcccttgcccgccctagaccccatagcgatgactatagtacaatgaagaaaatcccccccaggaaacctaagcgctcacctaacaccaaactatctggatcttacgaagagatctctgggtctcgccccggagatgctcgccctgcaggcgctcctggagctgcagcacgggtattaacgcctggcacacctcagtgcgccctgccccccgctgcaccacccggggacgaagacgactccgagcccgtatatattgaaatgctgggacacgcagctcgccccgattctccagacccaggcgagagtgtctacgaggaaatgaaatgttgcctacccgatgacggggggcccggggcaggcagctttctcctccacggcgcctcccctccactgctgcaccgcgctcccgaggacgaggccgctggccctccaggcgatgcatgcgacattccacctccctttcccaacctgctgccccatcggcctcctctgctggtcttcccacctaccccagtaacttgcagtcccgcttccgatgagtcaccactcacacctcttgaagtaaagaaactgcctgttttagagactaatctgaagtatccagtgcagccagagggctcaagccctcttagcccccagtactccaaatcccagaagggagacggggatcggcctgccagtccaggtctcgcactgttcaatggttcgggccgcgcatctccgccatcgacccctcccccaccacccccaccacccgggccgccccccgctccttatcgaccctgtgcacacctggcttttcctccagaaccggctcctgtgaatgcagggaaggccggtccatccgcggaagcacctaaggtgcacccaaaacctaatagcgccccagttgctggaccgtgttcctcttttccaaagattccatattcccccgtaaaagcgacacgcgccgacgcgaggaaagcaggcagttctgcctccccgccagccccttatagccctccaagctccagacctctgagtagcccattggacgagttagcgtctctgtttaatagtgggcggtccgtgttacgcaaaagcgccgcaggccgcaaaatcagggaggccgagggattcgagactaacatgaatatttcatccagagacgacccttccacctcagagattacgtccgagacgcaagaccgcaacgcaaataatcacggaatccagctgagcaacagtctctcctcagctattacagcagagaacggaaacagcatttcgaatggacttccggaagaggacgggtatagccgcctgagcatttcaggcactggcacaagcacatttcagcgccaccgtgattcccataccacccaagtgattcaccagcttcgtttgagtgaaaacgagtctgttgccctgcaggaattgctagactggcggcgaaagctctgcgaagaaggccaagattggcaacaaattcttcatcatgcggagcctcgagtgcccccgcccccgccctgtaaaaagccatccctgctcaagaagccagaaggcgcctcttgcaacaggcttccgagtgaactctgggataccacaatttag

SEQ ID NO: 43938 - DNA, 2637 bp, Artificial Sequence
  Description of Artificial Sequence: Synthetic coding sequence
atgaagctgcagcggcccatgagcatgctgaccgacgtgctgcacatggcctgcgcttccgggtataaggaggtagtgtctctgatcctcgaacatgggggagacctaaatattgtggatgaccaatattggacccccctccacttagctgcgaaatatggccagacaaatctggtgaaactactgcttatgcaccaggctaatccccatctagtaaactgcaacgaggagaaagcctccgatatcgcagctagcgaattcattgaagaaatgttgctgaaggctgaaatcgcctgggaagagaaaatgaaggagccgctttctgcctctacacttgcccaggaagagccatatgaggagattattcacgatcttcccgtccttagttccaagcttagtccactcgtcctcccaatcgcgaaacaagatagtctgctggaaaaggacatcatgtttaaggacgccacaaaaggcctttgtaaacagcagagccaggatagcattccagagaatccaatgatgtctggctccaccaagccagagcaggtaaaactgatgccacccgccccaaatgatgatcttgcgacgcttagtgagctaaatgacggcagtttactgtacgaaatccagaagaggttcggtaataaccagatctatactttcattggtgatattctcctgttggtgaacccctataaggaactaccgatctattcatcaatggtgagtcaattgtatttctcctcttccggcaagctctgctcttccctcccaccccacctattctcttgcgtcgagcgggcatttcaccaactgtttcgtgagcagaggcctcaatgctttatcctcagtggtgaaagagggtcaggcaagtccgaagcttcaaaacaaattatccgccatctcacctgccgcgcaggtgccagccgggctactctcgactcacgctttaagcatgtggtgtgtatcctggaagcattcggacatgccaaaaccacgcttaatgatttgtcatcatgctttatcaagtatttcgagctccagttctgcgagcgaaagcagcaattaactggcgctaggatctacacatacctactcgagaagtccaggcttgtatcacagcccctgggtcagagtaactttctgatcttttacctgctcatggatggtctgtccgccgaggagaaatacgggctgcacctcaacaatctgtgtgcccacagatatctcaatcaaacaatccaggatgatgcgtctactggagagcgtagccttaacagggaaaagctcgcagtactcaagcgtgcccttaacgtagtcggtttttcctctctcgaggtggaaaacctgtttgtaatcttggccgccatcttgcaccttggagatatccggttcacagcactgaacgaaggcaattctgccttcgtcagcgacctgcagttgctggaacaggtggctggcatgctgcaagtgtccactgatgaattggcatccgcactcacgaccgatattcaatacttcaagggggacatgattatccggcgccataccatccaaatagctgaattttttcgggacttactggctaagagtctgtatagccgattgtttagctttttggtcaatacaatgaatagctgtctgcattcccaggacgagcaaaaatctatgcaaactctagacattggaatccttgacatctttggtttcgaggagttccagaaaaatgaatttgagcaactatgcgtgaacatgacaaacgagaaaatgcatcactatatcaatgaggttctgtttttgcatgagcaggtggagtgtgttcaagaaggggtaactatggaaacagcttattcccccggaaaccagaacggggttcttgatttcttctttcagaaaccatctgggttcttgaccctgcttgacgaggaatctcagatgatctggagtgtggaaagtaatttccctaaaaagttacagtccctcttagagtctagtaatacaaatgccgtgtattctccaatgaaagatggtaacggaaacgtcgcgttaaaagaccatggaaccgcttttaccataatgcattatgccggaagagtgatgtatgacgtggtaggcgcaatcgaaaagaataaagacagcttatcacagaatctgctgttcgtgatgaagacttcagaaaacgtcgtgatcaatcacttgttccaaagtaaactgtcacagacagggtcactagttagtgcatatccaagttttaagttcagaggacacaagagtgcactgctcagcaagaaaatgacggcgtcctctatcatcggcgagaacaagaactatctagagctttcaaagctgctgaagaaaaaaggtacttcaacctttctgcagcgattagaacggggtgatcccgtgaccatcgcaagccagctgagaaagtcactcatggatatcatagggaagttgcaaaagtgcaccccgcacttcatacactgtattaggcctaataactccaagttacctgacacctttgataacttttatgtctcagcgcagctccagtacattggcgtgctggagatggttaagatttttcgatatggatacccagtccgcctgagcttctcagattttctttcccgctag

SEQ ID NO: 43939 - DNA, 2823 bp, Artificial Sequence
  Description of Artificial Sequence: Synthetic coding sequence
atggagatcgaccagtgcctgctggagagcctgcccctgggccagcggcaacggttagtgaagaggatgcggtgcgagcagattaaagcctactatgagagggaaaaggcctttcagaagcaagaaggttttctgaagagacttaagcatgccaaaaacccaaaagtgcatttcaacctaacagatatgctgcaagatgccatcatccatcataatgataaagaagtgctgcgcctcttgaaggagggggcagatcctcatactctggtgagcagcgggggaagtctgctgcatctgtgtgcccggtatgacaacgcctttatcgcagagatactaatcgatagaggcgtcaacgtcaaccatcaagacgaggatttctggacacccatgcacatcgcttgcgcttgtgataacccggatattgttctgctcctggtcttagcgggagcaaacgttttactgcaggacgttaacgggaacattcccctggactacgccgttgagggtaccgaaagctcatcaatcctcctcacatacctagacgaaaacggcgtggacctgacctctctgcggcaaatgaaacttcagcgccccatgagtatgttgacagatgtcaagcatttcctatccagcggaggtaacgttaacgagaagaacgatgaaggtgtgacattgctacacatggcctgtgcgtcgggttataaggaagtcgtcagcctaattttggagcatgggggggatctgaacatcgtcgatgatcaatattggacaccactgcacctcgccgcaaaatacggtcagacaaacctagtaaaactactgctaatgcaccaggctaatccacacctggtcaattgtaatgaggagaaggcctcagacatcgccgcttccgaattcattgaagaaatgctgctcaaggcggagatcgcctgggaggagaagatgaaggagccattgtccgccagcaccctcgcgcaggaggagccttacgaagagattatccacgatctccctgtgctttcaagtaaattatctccattggtgttgcctattgccaaacaggattccttgctggaaaaagacattatgttcaaagatgccactaaaggcctttgtaaacagcagtcacaggactctatccccgagaatcccatgatgtctggtagcactaagccagagcaggtgaaacttatgccccctgcacccaatgacgatctggccactctgtcggaacttaacgacggaagtttactgtatgaaatccagaaaaggttcggaaacaaccaaatctacaccttcatcggggatatcttgctcctggtgaacccatataaagagctgcccatttatagtagcatggtaagtcagctgtatttctctagctcaggtaagctttgtagtagtttacctccgcatctcttttcatgcgtcgaacgggcgttccatcagctcttcagagagcaacgccctcagtgcttcatattgagcggtgagcgcggatcaggcaaatctgaggccagcaaacaaattatccgccacttgacatgccgcgccggagcatcaagagccactctggacagccgcttcaaacacgtcgtatgtatcctcgaggcctttgggcacgcgaaaacaactcttaacgatctgtctagctgctttatcaagtatttcgagctgcaattctgtgagcgtaaacagcagctcaccggggctcgaatctatacctacttgctcgagaagtccagactggtaagccagcccctgggccagtcgaactttctcatcttttacctgctgatggacgggttatccgcagaagaaaagtatggcctgcatctgaacaacttatgcgcccacagatatctcaaccaaacgatacaggacgatgcctcaaccggagaaaggtccttgaacagagaaaagctggcagtgctgaagcgcgccctgaacgtagtgggcttcagttcactggaggttgaaaacctgtttgtgatcctcgctgccattctgcacctcggagatatccgctttaccgcattgaatgagggcaattccgctttcgtgagtgatctccagcttttggagcaggtggctggcatgctacaggtcagtacagatgagttggcaagtgcgctcacaacggacatacagtacttcaagggcgacatgataatccgccggcatacaatccagattgctgagttttttcgggacctgttggcaaaaagcctgtattcccgcctcttcagttttctagtaaatacaatgaattcttgtctccattcacaagacgaacagaaatcaatgcaaaccttggacatagggatattggacatcttcggcttcgaggaattccaaaaaaacgagtttgaacagctgtgtgttaacatgactaatgaaaagatgcatcactatatcaacgaggtcctcttcctgcacgaacaagtcgagtgcgtgcaggagggcgtcaccatggagacagcatactctcctggcaaccagaacggcgtgttagactttttcttccagaaaccatcgggattcctgacacttcttgacgaggagtctcagatgatctggagcgtagagtctaacttcccgaaaaagctgcagagcttgctggagagtagcaatacaaatgctgtatactcccccatgaaagatggtaacggtaatgtcgcgcttaaagatcacgggaccgcattcaccatcatgcactacgctggcagagtgatgtacgatgttgttggcgccatagaaaaaaacaaagatagtctctcccagaacttgctctttgtaatgaaaaatcggagatgtttttag

SEQ ID NO: 43940 - DNA, 2574 bp, Artificial Sequence
  Description of Artificial Sequence: Synthetic coding sequence
atgcggcgggccgacacccgggacggcgagcggggcagcggcaagagtgaagccagcaaacaaattataagacatcttacctgtcgcgctggcgcaagcagggctacgcttgatagtagattcaagcacgttgtatgtattctggaggcgtttggacacgccaagactaccttgaacgatctgagttcttgcttcatcaagtattttgagcttcagttctgcgagcgcaagcaacagctgactggcgcaaggatttacacttatctgctcgaaaagagcaggttagtgagccagccgctgggacagagcaattttttaattttttatttgttgatggacggtctgtccgcagaagagaaatacggactccatctcaacaacctttgtgcacatcgctatctgaaccaaaccatccaagacgacgcaagtaccggtgaaaggagcctgaatagagagaaattagccgtgctgaagcgcgccctgaacgttgtcgggtttagcagtctggaagtagaaaacctgttcgtcatattggccgcaatcttacacttaggtgacatccgttttactgcgttaaacgaggggaatagtgcattcgtctctgatctgcagctcctggagcaagtggcagggatgctacaggtctcaacggacgagctggcttcggctctgactaccgatatccagtattttaaaggggatatgattatcagacgccatacaatacagatcgccgagtttttccgcgaccttctagcgaagtctctgtactcccgcctgttctccttcctcgtgaataccatgaacagctgcttgcattcacaggatgagcaaaaaagcatgcagactcttgacatcggaattttggacatatttggtttcgaggagttccagaaaaatgagtttgaacagttgtgtgtcaacatgacaaatgagaaaatgcatcactatatcaacgaagtgctgtttctacacgagcaggtggagtgcgtccaggagggcgtgacaatggaaacagcttacagtcccgggaaccagaacggggtgttagacttcttcttccagaaaccaagcggtttcctcacactcctggacgaagaaagccagatgatttggtctgtcgagagcaattttcccaaaaaactacaaagcctcttagaaagtagcaataccaatgcggtatactctcccatgaaagacgggaacggtaatgtcgctctgaaagaccacggcacggcattcactataatgcattacgctggacgggtcatgtacgatgtggtcggcgcgattgaaaagaataaggattctctcagccaaaacctgctgttcgtcatgaagactagtgagaacgtggtgatcaaccacctctttcaaagcaaactgtcccaaaccggctctcttgtgagcgcctatccatctttcaaatttcgcggccacaaaagtgctttgctgagcaaaaagatgactgctagctcgatcatcggagaaaacaaaaactacctggaactttcaaagctcctgaagaaaaagggtacatccacctttttgcagagacttgagcggggcgacccagtgaccatcgcgagccaattacgaaagtcactgatggatatcatcggaaagctccagaagtgcacaccacactttatccactgcatcaggcctaataattcaaaacttcctgatactttcgataacttctacgtgtccgctcagcttcaatatataggggtcttagagatggttaaaattttcaggtacggatatcctgtgcgacttagcttcagcgacttcctgagtaggtataagccactggctgacacattcctgcgagaaaagaaggaacagagtgcagccgaaagatgcagactggtcttgcagcagtgcaaactgcagggatggcagatgggcgtgagaaaagtctttctgaaatactggcacgccgatcaactgaacgatttgtgtctgcagctgcaacgcaagatcattacatgccagaaggtcattcggggttttctggcaaggcagcatctccttcagaggatcagcataaggcagcaggaggtgacgtccataaatagttttctgcagaacaccgaagatatgggtctgaaaacatacgatgccctggtcatacagaacgcatctgacattgcacgagagaacgaccggttaagatcggagatgaatgcaccataccacaaggaaaagctggaggtgcgaaatatgcaggaggaaggaagcaaaaggaccgacgataaatcaggccctcggcacttccaccctagttctatgtccgtgtgcgcggccgtggatggattaggccagtgcctggtaggaccatccatctggagcccatccctgcactctgtgttctcaatggatgatagctcttcattgcctagcccacggaaacagcctccacccaaaccaaagcgtgatccgaacacccgattaagcgcgagttatgaagccgtcagtgcctgcctgtctgctgctcgcgaagcggccaatgagggccaaccatggggcggaacacagccccgcgtgcctggctcccgcatgctctag

SEQ ID NO: 43941 - DNA, 1644 bp, Artificial Sequence
  Description of Artificial Sequence: Synthetic coding sequence
atgagcaccgccagcagcagcagcagcagcagcagcagccagaccccccatcctccaagccagcgtatgagacgctccgccgccggttccccaccagctgtggccgccgccggatcaggtaacggagcaggaggcggcggcggagtaggctgtgcgcccgcggcaggcgctggcaggttgctgcagcctatcagagccacagtcccatatcaactactgaggggatctcagcattctccgacaaggccacccgtcgctgccgctgccgccagccttggaagtttgccaggccccggagctgccagaggcccctccccgagcagtccaacaccgcctgctgcagctgcgccagccgagcaggcccctcgtgccaagggacgtccccgaagatcacccgaaagtcaccgcaggagctcctctcctgagagaagaagtcctgggagccctgtttgtcgggctgacaaggcaaagtcgcaacaggtccgcacatcatccacaatacggcggaccagcagtctggacaccatcactggaccctacctaaccggacagtggcctcgggacccccatgtgcactacccttcctgcatgaaagataaagcaactcagacaccctcttgttgggcagaggaaggggcagaaaagagatcccaccagaggagtgcctcgtgggggtcagccgaccagttgaaagagcagattgccaaactgcggcagcaactccagcgatctaagcagagttcccgccactcaaaagagaaagacagacagtccccgctccacggaaaccatatcacgattagccatactcaggcaaccgggtctagaagtgtgccaatgcctctgtctaacatctctgtgcctaaatcctctgtgagcagggtaccctgcaatgtcgagggaatctctccagagcttgagaaagtgttcattaaagaaaacaacgggaaggaggaagtaagtaagcccctcgacattccagacggccggcgagcccctttaccagcacattataggtctagctccacacggtcaatcgatacccaaactcctagcgtccaagagcgatcatcatcctgttcttcacactcgccatgcgtgtctcccttctgcccgcctgagtcgcaggatgggagcccatgctccaccgaggatctactctatgaccgggataaggattctggcagctcatctccactgccgaaatatgcatcatcgcccaagccaaacaattcttatatgttcaagagagaaccaccagagggctgcgaacgcgtcaaagtcttcgaagaaatggcttcaagacagcccattagtgcgccactatttagctgccctgacaagaataaggtgaactttattccaacgggtagcgctttttgtcctgtaaagctcctcgggcctttgctaccggctagcgacctcatgctaaagaacagcccaaacagtggacagagctccgccctcgctacacttaccgtcgagcagctgtcatcccgagtgtcctttacttctctttccgacgatacctcaacagctggctctatggaagcttctgttcagcaaccaagtcagcagcagcagctcctgcaggagctgcagggagaggatcatatatcggcacaaaattacgtgattatttag

SEQ ID NO: 43942 - DNA, 999 bp, Artificial Sequence
  Description of Artificial Sequence: Synthetic coding sequence
atgggcgcccagttcagcaagaccgccgccaagggcgaggccgccgctgaacggcctggtgaggctgccgtggcctcctcccccagcaaggctaacggccaggagaacggacatgtgaaagtgaatggcgacgcctcccccgccgccgccgagtcaggggctaaagaggagcttcaggccaacggcagcgccccagccgccgataaggaagaacctgctgcggcagggtcaggagccgcatctccttcagccgccgagaaaggggaaccagctgccgcagccgcacctgaggcaggggcatccccggtcgagaaggaagcgccagccgaaggtgaagccgctgagccgggcagtcccaccgcagcagagggagaggcagcctccgctgcaagctctacgagttcccccaaggctgaggatggtgccacaccttccccgtctaatgaaactcctaaaaagaagaagaagaggttctcgttcaagaagagttttaagctgtctggctttagtttcaagaaaaacaaaaaagaggcgggagagggcggcgaagccgaggcacctgcagctgaaggaggaaaagacgaagctgccggaggagcggctgccgctgctgctgaagccggcgccgcctctggagagcaggccgcggctcctggcgaggaagctgccgccggcgaagaaggagccgcaggaggcgacccccaagaggctaaaccacaggaggccgctgtggcgccagaaaagccaccagccagcgacgaaactaaagccgcagaagagccctccaaggtggaagaaaaaaaggctgaggaagcaggtgcgtctgccgccgcctgtgaggccccaagcgctgccgggcccggcgcacccccagagcaggaggctgctcccgctgaggagcccgcagctgcagcggcaagtagtgcatgcgccgctccatcgcaggaggcccaacccgagtgcagccctgaggcgcctcctgccgaggctgccgagtag

SEQ ID NO: 43943 - DNA, 978 bp, Artificial Sequence
  Description of Artificial Sequence: Synthetic coding sequence
atggccgaggtgccccccggccccagcagcctgctgcccccccccgcccctccagcacccgcagctgtggagccccggtgccccttccctgccggcgcagcactggcttgctgttcggaggacgaggaacaacagcagctcaatggtcttataagtcctgagctacggcacctccgggccgccgcttccctgaaaagtaaagttctcagcgtggctgaggtggccgccaccacagctacacctgatggcggccctagagcaactgcaactaaaggcgcgggcgtgcatagcggtgagcgacctccgcacagcctctcctctaatgcccgcacagctgtgccgtcacctgtggaagctgccgcagcatctgatcccgctgcagcccggaacggcctggccgagggcaccgagcaggaagaagaagaagaagatgagcaggtgcgactcctatcctcatcattgacagctgactgctccttaagaagccctagtggtcgtgaggtcgagcccggtgaggaccgcaccatcaggtatgtaaggtacgagagtgagttgcaaatgccagacatcatgagactgatcacaaaagatctatctgagccatacagtatatacacctacaggtactttatacataactggccgcagctgtgctttctggctatggtgggcgaagaatgcgtgggtgccatcgtttgcaagctggatatgcacaagaaaatgttcaggcggggatatattgcaatgctggccgttgattccaagtaccggaggaatggcattggtactaacttggtgaagaaggcaatctacgctatggtggagggagactgcgacgaagtggtgctcgagaccgagattacaaacaaaagcgctcttaagctgtacgagaatttaggctttgttcgggacaaaagactgtttagatattatctcaatggtgtcgacgccctacggctcaaactgtggctcagatag

SEQ ID NO: 43944 - DNA, 1089 bp, Artificial Sequence
  Description of Artificial Sequence: Synthetic coding sequence
atggccgaggtgccccccggccccagcagcctgctgcccccccccgcaccacccgcccctgcagcagtggagccccgctgcccatttcccgccggagccgcgttggcttgctgctcagaggacgaggaggacgacgaggagcatgagggggggggcagtagatcaccagcaggaggagagtctgcaaccgtggccgcaaaagggcacccctgcttgcggtgtccccagccaccccaggaacagcagcaactcaatgggctcatctcacctgagctgcgacatttgagggcggcagcctcactgaaatctaaggtgctgtccgtggcagaagtcgccgcaacgacagccacccctgatggggggccacgcgctactgccactaagggagccggtgttcacagcggcgaacgtcctcctcacagcctctcctccaatgccagaaccgccgtcccatcccccgtggaagctgccgcagcatcggatcctgccgccgctagaaacggtttagccgaagggaccgagcaggaggaagaggaagaggacgagcaggtgaggctcctgagttcatctctaaccgccgactgtagcctacgctcaccaagcggcagggaggttgaaccaggggaggaccggaccataaggtatgtccggtacgaatccgagctgcagatgccagatattatgcgactcatcaccaaagatttaagtgaaccatactcaatctacacataccgctactttatacacaattggcctcagctgtgctttcttgccatggtgggcgaggagtgcgtgggcgcaattgtgtgtaaattagacatgcataagaagatgtttaggcggggttacattgcaatgttagctgtggatagcaaatataggcgcaacgggattggaacaaacctcgtaaaaaaggctatttatgccatggtcgagggggactgtgatgaagttgtgctcgaaacagagatcaccaataagtcagctctgaagctgtatgaaaatttaggatttgtcagggataagaggttatttaggtactatctaaatggagtggacgcattgcggttgaagctgtggctccgatag

SEQ ID NO: 43945 - DNA, 2178 bp, Artificial Sequence
  Description of Artificial Sequence: Synthetic coding sequence
atggtgatgaaggccagcgtggacgacgacgacagcggctgggagctgagtatgccagagaagatggaaaagtccaatacaaactgggtggacattactcaagactttgaggaagcatgcagggagttgaagctgggggaactgctacacgacaagctttttggactgttcgaagctatgtcggctatcgaaatgatggaccccaagatggacgctggaatgatcggcaatcaggtcaatagaaaggtcttgaacttcgaacaggctattaaggatggtacgataaaaatcaaggacctgactctcccagagctcataggaatcatggacacctgtttctgttgtttgatcacatggctggagggccacagccttgctcagacggtcttcacttgcctctatatccataaccctgacttcatcgaagacccagcaatgaaggccttcgccttggggatcttgaagatttgcgacattgctcgcgagaaggtcaacaaagccgccgtgttcgaggaagaggacttccagtccatgacctatggctttaaaatggcgaacagcgtgactgacctgcgggtcactggaatgttgaaggacgtggaagacgatatgcaaaggcgcgttaaatcgacacggagtagacaaggcgaggagagagatcctgaggtcgaactggagcaccaacaatgccttgctgttttcagcagggtaaagttcacgcgggtgctcctaactgtactgatagcctttacgaagaaagaaacaagtgcagtggctgaggctcagaagctgatggtgcaggcggcagacctactgtctgctatccacaactcattgcaccacggcattcaggcccaaaatgatactacaaaaggcgatcatcccatcatgatgggcttcgaaccgctggttaatcagaggctacttccaccaaccttccctaggtatgctaaaattattaaacgcgaggaaatggttaactatttcgctcgcctgattgacaggattaagacagtatgcgaagtggtgaatctgactaatctgcattgcatcctggactttttttgtgagttctccgagcagtcaccatgtgtgctgagccgttcactcctccagacaaccttccttgttgataacaaaaaggtcttcgggacccaccttatgcaggacatggtaaaagacgccttgcgcagtttcgtgtcaccccccgtgctgagtcccaagtgttacctatacaacaatcatcaggcaaaagattgtatcgactcattcgtcactcactgtgtacgcccattctgttctttgattcagatccatggtcacaatagagcccgccagagagataaactgggccatatcttggaggagttcgcaactttacaggacgaggccgaaaaggtggatgccgccctgcacaccatgctgcttaagcaggaaccccagaggcagcacctggcttgcctcgggacctgggtactgtaccacaacctcagaataatgatccagtatctgctcagcgggttcgagttagaactgtatagtatgcacgagtattattacatttattggtaccttagcgaatttctgtacgcttggctaatgtccaccctaagtcgagcagatggctcccagatggcggaggagagaatcatggaggagcaacagaaaggccgcagttccaagaagacaaaaaaaaagaagaaggtgcggccactcagccgggagattaccatgagccaggcgtatcagaacatgtgtgccggcatgttcaagaccatggttgctttcgatatggatggcaaagttcgtaagccgaagtttgagctagacagtgagcaggtaagatacgagcacagatttgccccgtttaacagcgtcatgactcccccgcctgttcactatcttcaatttaaggaaatgagtgacctaaataaatatagtcccccaccacagagcccggagttgtacgtggcagcttctaagcattttcagcaagccaaaatgatcctggaaaatattcctaaccctgaccacgaagttaacaggatcctgaaggtagccaagcccaatttcgttgttatgaagctgctggctggcggacacaagaaggaatcaaaagtcccacccgagttcgacttttctgctcacaagtattttccagtcgttaagttggtgtag

SEQ ID NO: 43946 - DNA, 885 bp, Artificial Sequence
  Description of Artificial Sequence: Synthetic coding sequence
atggtgatgaaggccagcgtggacgacgacgacagcggctgggagctttctatgccagagaagatggagaaaagcaataccaactgggtcgacatcacccaggattttgaggaggcttgtagagagctcaaattgggagagctgctgcacgataagctgttcggccttttcgaggctatgtctgccatcgagatgatggatcctaagatggacgctgggatgatcggtaaccaagtgaataggaaggtgctgaacttcgagcaggccatcaaagatgggacgatcaaaatcaaagacctcacactgccagagctaattgggattatggacacttgtttttgctgcctgataacctggctggaaggccactcgctggcacaaacggttttcacttgcttgtacatccacaaccctgacttcattgaggaccctgctatgaaggcttttgctcttggaattctcaaaatctgtgatatcgcccgcgagaaagtaaacaaggccgccgtttttgaagaagaggacttccaaagtatgacttacggcttcaagatggctaactcagtcacagatctgcgggtgactggaatgttgaaggatgtcgaagacgatatgcaacgccgggtaaaatctacccgctctcgccagggcgaggagcgcgatcccgaagttgaattagagcatcagcaatgcttagcagttttttctagagtgaaattcaccagagttctcctaaccgtactgatcgcatttaccaagaaagagacatccgccgttgccgaagcgcagaaattgatggtgcaagcagcagaccttctcagcgcaattcacaatagcctgcatcatggcatccaggctcagaatgatactactaaaggaggattgtag

SEQ ID NO: 43947 - DNA, 594 bp, Artificial Sequence
  Description of Artificial Sequence: Synthetic coding sequence
atggtgatgaaggccagcgtggacgacgacgacagcggctgggagcttagcatgccggagaaaatggagaagtctaatacaaactgggttgatatcacacaggacttcgaggaagcctgcagagagctcaaattgggtgagcttctgcatgacaagctgtttggcttattcgaggctatgtccgcgatagagatgatggatccaaaaatggatgctgggatgatcggaaatcaggtgaaccgcaaggttctaaattttgaacaggccatcaaggatggcactatcaagatcaaagatttaactttgccagaactgattggtattatggacacatgtttttgctgcctaatcacatggttggaaggccactctcttgcccagacagtgtttacatgcctttacatccacaatccagactttatagaagatccagctatgaaagcctttgccctgggaattctgaagatctgtgatatcgcccgggagaaggtaaataaggccgctgtgttcgaggaaatcagccgcctgttagagcttattgattttcacgagtacaatttcaaaaacgagaacgttcagtgttggaaagagtag

SEQ ID NO: 43948 - DNA, 1857 bp, Artificial Sequence
  Description of Artificial Sequence: Synthetic coding sequence
atggtgagcccccggatgagcggcctgctgagccagaccgtgatcttggccctgatcttcttgccacagactagacctgctggagtctttgaactgcaaatccacagcttcgggccagggcccggccccggagccccacgcagcccttgttcggccaggctgccatgccgcctttttttcagggtctgtctgaagcctggcctctccgaggaagccgccgagagcccgtgtgctttgggagccgctctatccgcaaggggccctgtctacacggagcaacccggggccccggcccctgaccttccccttccggacgggctattacaggtcccctttcgagacgcttggcctgggactttctctttcataatcgagacatggagggaggagctgggagatcagattgggggtcctgcctggtccctgctcgcccgtgtggccggccgtaggcgcctagccgccggggggccgtgggcacgagacattcagagggctggtgcctgggagctgaggttttcgtacagggccaggtgcgaaccgcctgctgtcggcaccgcctgtactcgcctctgcaggcccagatcagccccatcccgctgcggtcccggactcagaccctgtgctcccctggaggacgagtgtgaagcccccctagtctgtagggctggatgctccccagaacatggattttgtgaacagcccggggaatgtcgctgtcttgagggatggacaggacctttgtgcactgtacctgtttcgacgtcttcttgcctttctcctcgtggtccttccagtgctactaccggctgtttggttccagggcccggtccctgtgacggaaacccttgcgccaacggagggtcctgctcagagacgcctcgaagcttcgaatgcacatgcccccggggcttctacgggctcaggtgcgaagtgtctggcgtcacctgcgcggacggcccttgctttaacggcggcctttgcgtaggaggtgccgaccctgattcagcatacatctgtcattgcccccccggcttccaaggcagcaactgcgaaaagcgcgtggacagatgtagtttacagccatgcaggaacggaggactgtgtctagacctagggcacgccctcagatgcaggtgccgtgcgggctttgccggtccacggtgcgagcacgatctggacgattgtgcagggagagcatgcgcaaatggaggcacctgtgtagaagggggcggagcccatcgctgtagctgcgccctcggcttcggtggcagggactgtcgcgaaagggccgatccttgcgccgcccggccgtgcgcccacggagggcgctgttacgcacacttctcaggtctggtttgtgcttgtgctcctggctacatgggcgctaggtgcgagttcccagtgcacccagatggagcatcagcgctccctgctgcccctcctggtcttaggcccggagatccgcagcggtacttgttgccacctgcgctgggcctcctcgtggccgccggggtggcgggcgccgccctactgctcgtgcatgtacgaagaaggggccactctcaggatgcaggcagtaggctcctagctggaactccagagccttctgtgcatgcattgccagatgcacttaacaacttgcgtacccaggaaggctccggcgacggcccatccagtagtgtcgattggaaccgccccgaagacgtcgaccctcagggaatttatgtgatcagcgcccctagtatctatgcccgcgaagtggctacgccattgttcccccccctccacactgggcgcgctggacagcggcaacacctactctttccatacccctcatcgatcctgtccgttaaatag

SEQ ID NO: 43949 - DNA, 2181 bp, Artificial Sequence
  Description of Artificial Sequence: Synthetic coding sequence
atgagcgccatcaccgtggccctgctgagcctgctgttcatcaccagcggaactatcgagaatcataaggacttgggggggcacttcttcagcaccacacaatctccccctgctacacaaggaagtactgccgcccagcggagtaccgctacccaacacagcaccgcaacccagtcatccacggccactcagacaagtcccgtgcctctcaccccggagtctccgctgttccaaaatttcagtggctaccacattggtgtcggtagagcagactgtaccggacaggtagctgacatcaatctgatgggatacggcaagtcgggccagaacgcgcaagggatcctcacccgcctgtactcccgcgcgtttatcatggctgaaccagatggatccaaccgaaccgtgttcgtgtccatagatatcggaatggtgtcacaacgcctccgactcgaggttctgaatcggcttcagtccaaatacggtagcctctacagacgtgacaatgtcattctgtcggggactcatacacactctggtcctgcagggtactttcaatacacagtatttgtcatcgccagcgaggggttctctaatcaaaccttccaacacatggttactggaatcctaaaatcaatcgacatcgcgcacactaacatgaaaccgggtaaaatcttcatcaacaaagggaacgtcgatggtgttcagattaatcggtctccctatagctatctgcaaaacccacagagcgagcgagccaggtactctagcaatactgataaggaaatgattgtactgaaaatggtggatttaaatggcgacgacctaggcctgatctcatggttcgctattcatccagtgtctatgaacaattccaaccatttggttaactctgataatgtgggctacgccagttatctcctggagcaggaaaagaacaagggatacctgccaggtcagggaccgtttgtggctgcattcgcttcctcaaatctgggagacgtgtctccgaatatactcggtccacgttgtatcaatacaggcgagagttgcgacaatgcaaattccacgtgtccaatcgggggtccatctatgtgcattgctaaagggcccgggcaggatatgtttgactcaacccaaatcattggtagagccatgtatcagagggccaaatcgaagacatgcaagccagctctaggatacagttttgccgccggcacaatcgacggcgtgggcggcctcaatttcactcagggcaagacagagggcgaccccttttgggacacaatccgggaccagattctgggcaagcccagcgaggagatcaaggaatgtcacaagcctaagcccatcctgctgcacaccggagaactcagtaaaccacatccatggcatcccgacattgttgatgtgcaaataataaccttgggaagcctggccatcacagctattccaggcgaatttactactatgagtggaagaagattacgtgaggccgtccaggcggaatttgctagccacggcatgcaaaatatgactgtggtcatctccggcctctgtaacgtttacacccactatattactacatacgaggagtaccaggcacaacgctacgaggctgccagcaccatctacggccctcatacgttgtcagcctacatacaacttttccggaatctggcaaaggcaattgcgaccgacacggtggccaacctgtctaggggccccgagcctccttttttcaaacaactcatcgttcccctgattccctccatcgtagacagggcaccaaagggcagaacatttggagatgtgcttcagccagccaagccagagtaccgcgtaggagaagttgcagaggtgattttcgtaggcgccaaccccaagaactccgtacagaaccagactcaccagacatttctgaccgttgagaagtatgaagcaacctctacctcatggcagatagtgtgcaatgacgcatcctgggagacccgtttttattggcataaaggcctcctgggtttatcgaacgccacagtggagtggcatatacccgatacagcacagcccggaatatacaggatccgctattttggccataaccgaaagcaggatatacttaaacccgccgtgatcctaagttttgagggaacttcaccagctttcgaggttgtcacaatctag

SEQ ID NO: 43950 - DNA, 723 bp, Artificial Sequence
  Description of Artificial Sequence: Synthetic coding sequence
atgagcggccggcggctgcgggaggccgtgcaggccgagttcgcctctcacggtatgcagaatatgacagtggtgatctccggtctctgtaatgtgtatacacactacattaccacatacgaagagtaccaggctcagcggtacgaggcagcatccactatatatggaccccataccttgtcagcttacatccagcttttccggaacctagctaaggctattgccacggataccgtggctaatctatctaggggcccggagccacccttcttcaagcaactgatcgttcctcttataccttctatagttgaccgcgctcccaaagggcggacctttggggacgtactgcagccagccaagcccgagtaccgcgtaggcgaagtggctgaggtgatttttgtcggggcaaaccctaagaactccgtgcagaaccaaacacatcagacattcctgactgtggaaaaatacgaggcaacttccaccagttggcaaatcgtttgtaatgacgcctcttgggagaccagattttattggcataaaggcctcctgggcctgtcgaacgccacggttgagtggcacatccccgacaccgcccagcccggcatctatagaatcaggtactttggtcacaacagaaagcaggacatcctgaagcccgctgtcatactcagctttgagggaacatccccagcctttgaagtgcccaattctggcctgcactag

SEQ ID NO: 43951 - DNA, 2343 bp, Artificial Sequence
  Description of Artificial Sequence: Synthetic coding sequence
atggccaagcggaccttcagcaacctggagaccttcctgatcttcctgcttgtgatgatgtccgccatcactgtggctctgctgagccttctgttcatcaccagcggtaccattgagaaccataaagacctgggaggccactttttctccacgacacaatctcctccagcgacccaagggtctacggctgctcaacggagcactgcgacccagcattcaactgcaacccaatcatccacagcgacccagacgagtcctgtgccactgacaccagaatcacccctattccagaacttcagcggttatcatattggcgtgggcagagcggactgtacaggtcaggtggccgacatcaatcttatgggatatggcaagagcggccagaacgcgcaaggcattttgacacggctgtactctagagcttttatcatggctgaacccgacggcagcaatagaaccgtgtttgtctccattgacattggtatggtgagccagaggctgagactggaagtgctgaaccgactacagagcaagtacggatcactgtacagacgcgacaacgtaatcctgtccggcacacacacacacagtggtcctgcaggctattttcagtacacggtcttcgtgatcgcaagtgagggcttttcaaaccaaaccttccagcacatggtgacggggattctgaagtccatcgatatcgcccatactaatatgaagcctggaaagatctttattaataaaggtaacgttgacggagtccaaatcaatcgctcgccatactcatacctgcagaatccacagtcagagcgagctcgctactcttctaacaccgacaaggagatgatcgttttgaaaatggtagatctgaatggggacgacctgggattgatctcgtggttcgccattcaccctgtatcaatgaacaactccaatcatttagttaactcagacaatgtcggctacgcatcttacctgctggaacaagagaagaataaagggtatcttcctgggcagggaccctttgttgccgcatttgcgtcttccaacctgggtgacgtgagtcccaatattctgggtcctcggtgtataaatacaggcgagtcttgcgataacgccaacagcacatgcccaatcgggggcccctctatgtgtatcgccaagggtccaggccaagacatgttcgattccactcagattatcggcagagctatgtaccagagagcgaaggaattgtacgccagcgcctcacaagaggtcacgggaccactggcaagcgctcatcaatgggtggacatgaccgatgttaccgtgtggctaaattcgactcacgctagcaaaacctgtaagcccgccctgggttattcttttgcggctggcacgattgacggcgtgggcggcctcaattttactcagggcaagacagaaggggatcccttttgggataccattagagatcaaattctcggcaagccctcggaagaaattaaggagtgccacaagccgaaacccatactgcttcatactggtgaactctccaaaccccacccctggcatccagacatcgtggacgtgcagattattactctgggcagccttgccattacagcaataccgggcgagtttacaacaatgagcggtcggagactccgggaagctgtacaggccgagttcgctagtcatggcatgcaaaacatgaccgtcgtcatatccgggctttgcaatgtctatacccattacataactacatacgaggaataccaagcacaaaggtatgaggcggcttcgacgatatacggccctcataccttgagcgcttacatccagctcttccgcaacctggccaaggcaatcgcaaccgataccgtcgctaatctcagccgtggaccagaaccccctttcttcaagcagctcattgtgccactcatcccttcaattgtagaccgcgcgcccaagggtaggacattcggagacgtcctgcagcccgccaagcccgaatacagagtgggcgaggtggccgaagtcatcttcgttggcgctaatcccaagaatagcgtgcaaaaccagacccaccagactttcttgaccgttgaaaaatacgaggccacaagcactagctggcagatcgtatgcaatgacgcttcatgggaaacccgattctactggcataagggcctgctggggttatcaaatgctaccgtcgagtggcacatacctgatactgctcagcccggtatctatcggatcaggtacttcggccacaatcgcaaacaggacattctcaagcccgccgtgattctatctttcgagggtacctcccccgcctttgaggtagtgaccatctag

SEQ ID NO: 43952 - DNA, 1869 bp, Artificial Sequence
  Description of Artificial Sequence: Synthetic coding sequence
atggacagcgagaagagcagcgagtggcggagcgacgtgctgaaccgccttcaaagcaagtacggctcgctctaccggagagacaatgtaattctttccggaacccatacccattcaggcccagctggttattttcaatacactgtattcgttattgcatccgaagggttctctaatcaaacttttcaacatatggtgacagggatacttaagtccatcgacatcgcacacaccaatatgaaacctggaaaaatcttcatcaataagggcaatgttgatggagttcagattaaccgctcaccttacagctacctgcaaaatcctcagtctgagcgggctcgctattcctccaataccgacaaagaaatgattgtactgaagatggtcgacctaaatggcgatgacttagggctgatctcttggttcgccatccacccagtctcaatgaacaatagcaatcacttggtaaattccgataatgtcggctacgccagctacttactggagcaggagaaaaataaaggatatctgcccgggcaaggtccattcgtcgccgccttcgcttcaagcaatctaggcgacgtgtctccgaatatcctgggaccacgttgtatcaatactggagaatcatgcgacaacgctaactccacttgcccaattgggggtccaagcatgtgcatcgctaagggacccgggcaggatatgtttgattctactcagataataggccgcgctatgtaccaaagggctaaggaattatacgcctcggcatctcaggaggtcacaggtcccctggcaagcgctcaccagtgggtcgatatgacagatgtgaccgtgtggttgaattcgactcacgcctccaaaacttgtaaaccagcacttggctactctttcgcggcaggaaccatcgacggagtggggggcctcaatttcacgcagggaaaaacggagggtgacccattctgggacactattagagatcaaattctcggcaagccctccgaggagattaaagagtgccataagcctaagcctattttactgcacactggtgaactgtctaaaccccacccctggcatcccgacattgttgacgtgcagattataaccctcgggagtctggccatcaccgcaatcccaggggaattcactaccatgtcaggaagacgcttgcgtgaggctgtacaggccgaattcgcatcacacggaatgcagaacatgacggtcgtcatctctggtttatgtaatgtttatacgcactacattactacatatgaggagtaccaagcccagcgctacgaagccgcaagcacaatttatggccctcacacacttagtgcatatatccagctgtttagaaaccttgcaaaggccattgcaaccgatactgtggccaacctgtcccggggcccagagccaccgtttttcaagcagttgatagtccccctgataccttcaatcgtggaccgtgctcccaagggacggacctttggcgacgtacttcaacctgccaaacctgagtatcgagttggcgaggtagcggaggtgatttttgtcggggccaaccccaagaactctgtgcagaaccagactcaccagacctttttgactgtggaaaaatacgaagcgacttctacatcttggcagatcgtgtgcaacgatgcaagttgggaaactaggttctactggcacaagggcctactcgggctgagtaacgcaactgtggagtggcatattcctgataccgctcagcccggcatttaccggattcggtatttcgggcacaacaggaagcaggatattctgaagccagcagtgatcctgagcttcgagggcacaagtcctgcatttgaggttgtgaccatttag

SEQ ID NO: 43953 - DNA, 2238 bp, Artificial Sequence
  Description of Artificial Sequence: Synthetic coding sequence
atggccaagcggaccttcagcaacctggagaccttcctgatcttcctgttggttatgatgtccgccatcacggtggccctgctgagcttgcttttcatcacatccggcactatcgaaaaccacaaagatttggggggacactttttcagtactactcagtccccacctgctacacaggggagtacagcggcgcaaaggtccactgcaactcagcacagcactgcaacacaatcttccaccgccactcagacgagtccagtgccactgactcccgaaagccccctgtttcagaatttcagcgggtaccacatcggggtagggcgagctgattgtactggccaggtcgcggacattaacttgatgggatatggaaaatcaggtcagaacgcacaaggcatcttgacacggctctattcgcgggctttcattatggcagaacccgatggatcaaaccggaccgtttttgttagcatcgatattggcatggtgtcccaacggctgagacttgaggtcttgaatcggctccagtctaaatacggtagtttgtaccggcgcgacaacgtgatactgagcggaacgcatacacatagcgggcccgcaggctactttcagtacacagttttcgtgattgcatcagaaggcttctccaaccaaacatttcagcacatggtcacaggcatactgaagagcatcgatattgctcatacaaatatgaaacccggaaagatcttcataaataaaggcaacgtggatggggtccagattaatcgctcgccatactcttatctgcagaatccccagtccgaaagggcacggtattcaagcaatacagacaaggagatgattgttttgaagatggtcgacctaaatggagatgacctgggcctgattagctggtttgccatacaccccgtctccatgaacaacagcaatcacctggtaaactctgacaacgtcgggtatgcttcctacctcctggagcaagaaaaaaacaaaggctatctcccggggcaggggccttttgtggccgcatttgcctcttcaaacttaggggatgtttcgcccaacatcctgggcccgcgttgcattaataccggtgagtcttgcgataatgcgaattctacatgtcctattggagggccttcaatgtgtatagcgaagggacccggccaggacatgttcgattcaacgcagattatcggaagggccatgtaccaacgtgcaaaatcaaaaacctgcaaaccagctctgggttattccttcgctgccggcaccattgatggagtaggcggtctgaattttacccaggggaaaacggagggcgatcccttttgggataccatcagggatcaaatactggggaagccttccgaagaaatcaaagagtgccataaacccaaaccaatcctccttcacacaggcgagttgtccaaaccccacccttggcatccagacatcgtggacgtgcaaatcatcaccctcgggtccttggccattactgcaattcctggcgaattcacgaccatgtccggtcggcgtctcagggaggctgtgcaagctgagtttgccagccatggcatgcagaacatgacggtggtgatatctggcctgtgtaacgtgtacacccactacattacaacttacgaagagtatcaggcacagagatacgaagctgcatctaccatctacggtccacacacactgagcgcgtacattcagctattcagaaatttggccaaagccatcgcgaccgataccgtggcaaatttatcaagaggacctgagcctccgttctttaaacagctgatagtgccactcataccctccatcgtagaccgagcacccaaggggagaacgttcggagacgtgctccagcctgccaagcctgaatacagagtaggggaggtagccgaagtaatcttcgtgggtgccaaccccaagaatagcgttcagaatcagactcaccagacctttctgacagtcgaaaaatatgaagcaacatccaccagttggcagatcgtatgcaatgatgcgtcttgggagacacgcttctactggcacaagggactccttggtttatcaaatgccacagtcgaatggcatatcccagataccgctcaacctgggatttaccggatccgctatttcgggcacaaccgcaaacaggacattctcaaacctgccgttatcctgtctttcgaagggaccagcccagcttttgaagtcgtcacaatttag

SEQ ID NO: 43954 - DNA, 840 bp, Artificial Sequence
  Description of Artificial Sequence: Synthetic coding sequence
atgctgctggccgccagcaaggtgctggaccggctgaagcccgtgatcggggttaatactgatccagagcgctccgaaggccacttgtgtttgccagtgaggtatacccactcattccccgaggcattacagaaattctatagaggcgaattccggtggttgtggagacagagaatacggctttatttggagggtacagggatcaaccccgtacccgtcgacctgcatgagcaacagctgagcctcaatcagcataacagagctctgaacatcgaacgggcacacgacgaaaggtccgaggccagtggcccacaactcttacccgttcgggcgctgaacgaggtgttcattggcgaaagcttgtcttcacgggcaagctactacgaaatatccgtggatgacggcccgtgggaaaaacagaaatctagcggactgaatttatgtaccggaacaggcagcaaagcctggagcttcaacattaatcgggtggctacccaggcggtcgaggacgtgctaaatatcgccaaacggcaggggaatctgtccttgcccctgaacagggagcttgtcgagaaagtgaccaatgagtataatgaatccttgctctacagccccgaggagcctaaaatcctgttctctattcgcgaaccaatcgcgaatagagtgttttcttccagtaggcagcgatgctttagcagtaaggtatgtgttagaagccggtgctgggacgcgtgtatggttgtggacggcggcacgagtttcgaatttaatgatggagctattgcctccatgatgattaacaaggaagacgaattgagaaccgtcttgctggagcagtag

SEQ ID NO: 43955 - DNA, 1329 bp, Artificial Sequence
  Description of Artificial Sequence: Synthetic coding sequence
atgacctgctaccggggcttcctgctgggcagctgctgccgggtggctggaggaagagcggccgccctcagggggccgggggccggcggccccgctgcacggccccggctcggcggtgacggcggcggtcgccgccatttgggacaggggcagccacgggaactggccggatgcggctcaagggccgatggcggattcaggccttcacgtgttgtagttgtagcaaaaactaccaggtatgagtttgagcagcaaaggtatagatatgcggagctgtcggaagaggatctgaagcagttgctcgccctcaaaggctccagctattccggcttgctcgaacggcatcatatacacacaaagaatgtggagcatataattgactcactcaggaacgagggcatcgaggtgcgattagtgaagagacgcgaatacgatgaggaaactgtaaggtgggctgatgcggtgattgccgcgggcggggacggaacaatgctcctcgccgcatcaaaggtgctcgaccggctgaagcccgtgataggtgttaatacggaccccgaaaggtccgaggggcacctttgccttccggttagatacactcactcttttcccgaagcccttcagaagttctacagaggggagttccgttggctgtggcgccagaggattcgcctttacctcgaaggcaccggaataaaccctgtccccgtggacctccatgagcagcagttatcactcaaccagcacaatcgtgctctgaatatcgaaagggcacacgatgaacggtccgaggcctctggcccccagctcctgcccgtgcgcgctctgaatgaagttttcataggagagtctctttcctcaagagcaagttactacgagatttccgttgatgatggaccctgggagaaacagaagagcagcggactcaacctgtgtactgggacaggctctaaggcatggagttttaatataaatcgtgttgctacacaggccgtcgaagacgtgctgaacatcgccaagcgacagggaaatctctcccttccattaaatcgggaactcgtcgagaaggttaccaacgagtacaacgagagcctgctgtattccccagaagagcccaagatccttttttccatcagggagcccattgccaatcgggtcttctctagctcccgacaacggtgcttcagcagtaaggtttgtgtgcgatcaagatgttgggacgcatgcatggtggtggacggtggcacctctttcgaattcaacgacggtgctatcgcttcaatgatgatcaacaaagaagacgaactgcggaccgttttactggagcagtag

SEQ ID NO: 43956 - DNA, 840 bp, Artificial Sequence
  Description of Artificial Sequence: Synthetic coding sequence
atgctgctggccgccagcaaggtgctggaccggctgaagcccgtgataggagtaaataccgatcccgaacggtctgaaggccacctatgcctcccagtacggtatacacattcttttccggaggctctccagaagttctatagaggggaatttaggtggctgtggaggcaacggattcgcttatacctggaaggaaccgggattaaccccgttcccgtggatttgcatgagcagcagctgagtctgaaccagcataatcgagctctgaatattgagagagcgcacgatgaacggtcggaggcatctgggccgcagttgctgcctgttcgggccctcaatgaagtcttcatcggcgaaagcctgtcaagtcgggcttcctattatgagatctccgtggatgatgggccgtgggaaaaacaaaaatcctccggtttgaacctatgcactggcaccggctcaaaggcctggtcgtttaatattaaccgggtggcaacccaggctgtagaggacgtgctcaatattgccaaacgccaaggcaacttgtccctacccttgaaccgcgagttggtcgagaaagtgaccaacgagtacaatgagagcctcctgtattctcccgaagagccaaagattctcttcagcataagagagccaattgccaatcgcgtgtttagttcatctagacagaggtgcttctcgtcaaaggtttgcgtcagatctagatgttgggacgcctgtatggttgtggacggcggtacctccttcgagttcaacgacggagcaatcgctagcatgatgatcaataaggaagatgaactacggaccgtcctgctggaacagtag

SEQ ID NO: 43957 - DNA, 906 bp, Artificial Sequence
  Description of Artificial Sequence: Synthetic coding sequence
atgctgctggccgccagcaaggtgctggaccggctgaagcccgtgatcggggttaacacagacccagaaaggagtgaaggccacttgtgtcttcccgtcagatatacccactcatttcccgaggcacttcagaaattttaccgaggagaattcaggtggctgtggagacagcgcatccggctgtacctcgaagggacggggataaatccagtgccggtggatctccacgagcagcaactttctctgaatcaacacaatagagccctaaacatcgagcgagcgcatgacgagagaagtgaggcatcaggtccccagctgttgccggttcgggcactgaacgaggtcttcatcggagagtccctgagttccaggatgagctattcatgggcggtggccgtggacaatttgcgccgctccattccaaccctcaaaggcctcgccagttattatgagattagcgtggatgacgggccttgggagaagcagaagagtagtggactgaacctgtgtactgggacaggctccaaggcatggtcttttaacattaatcgtgttgccactcaggccgtcgaagacgtgctgaacattgccaagcgccaagggaaccttagcctcccgctgaacagagagctggttgaaaaagtgacaaacgagtacaatgagtcactcttatatagtcccgaggagcccaagattctgtttagtatccgtgagccaatcgcaaaccgggtattctctagctccagacagcgttgtttttccagcaaggtctgcgtccggtcacgctgttgggacgcatgcatggtggtggacggtggcacctctttcgaatttaatgacggcgctatcgcctccatgatgataaataaggaggatgaactgaggactgtcctccttgaacagtag

SEQ ID NO: 43958 - DNA, 1233 bp, Artificial Sequence
  Description of Artificial Sequence: Synthetic coding sequence
atgacctgctaccggggcttcctgctgggcagctgctgccgggtggcgggggggcgggccgcagcactgaggggtccaggggcgggaggaccagcggcacgccctcgtcttggcggcgacggaggaggaagacgtcacctgggtcagggacagcctagagaactcgccggttgtggttcccgagccgatggaggattcaggccaagtagggtggtggtggtagcaaagacaacccgctatgaattcgagcaacagcgctacagatacgcagagctgagcgaggaagacttaaaacaactcctggccttgaaaggatcctcatactcgggacttctggagcggcatcacattcacaccaaaaatgtggagcacattatagactcactcagaaacgaagggatcgaggtgagactcgtgaagcgtcgcgagtatgacgaggaaacggtcaggtgggcggatgctgttattgccgctggaggcgatgggactatgctccttgccgcatccaaagtcttggatcgcctcaaaccagttattggagtgaatactgatcccgagcgtagcgaagggcatctctgtttgcctgtgcgctatactcactcctttccggaagctcttcagaaattttatcgtggcgaatttcgatggttgtggcgccagcgaatacgcctctatcttgaagggacaggaatcaaccccgttccagtggatctgcacgagcagcagctcagcttaaaccagcataacagagcacttaatatcgagagagcccatgacgagcggagcgaggcatcagggcctcaactgctgcccgtgagagcactgaatgaagtattcatcggggaaagcctctcatcccggagctttaacatcaaccgagtggccacacaggcagtcgaggacgttctcaatatcgccaagcgtcagggaaatctgtcattgcccttaaacagggagttggtcgagaaggttaccaacgagtataatgagagtctgctctattcacctgaggagcccaagatcttattctccattcgagaaccgatcgcaaatcgagtgttcagtagctccaggcaacgctgcttctcttcaaaagtgtgcgttaggtctcggtgctgggacgcatgcatggttgttgatggtgggacgtcattcgaatttaatgacggcgccattgcgtcgatgatgatcaacaaggaagacgaacttagaactgtacttttggagcagtag

SEQ ID NO: 43959 - DNA, 192 bp, Artificial Sequence
  Description of Artificial Sequence: Synthetic coding sequence
atggagctggtgcaggtgctgaagcggggcctgcagcagatcaccgggcatggcggcctcagaggttaccttagggtctttttccgcactaatgatgccaaggttggcactctggtgggtgaggataagtacggaaacaagtattatgaggataacaagcagttctttggaatagtgggttttaccgtttag

SEQ ID NO: 43960 - DNA, 438 bp, Artificial Sequence
  Description of Artificial Sequence: Synthetic coding sequence
atggagctggtgcaggtgctgaagcggggcctgcagcagatcaccggacatggcggcctgaggggctatctccgcgtgttcttccgaactaacgatgctaaagtgggcaccctcgtgggagaggataaatatggcaacaaatactacgaagacaacaaacagttctttggaagacatagatgggttgtttataccaccgaaatgaacggtaaaaatacgttttgggacgttgatgggagcatggtccccccagagtggcacaggtggctccatagtatgaccgatgatcccccaaccacaaagcctttgaccgccagaaaatttatatggactaatcacaagttcaatgtcacagggacccccgagcagtatgtgccatacagtaccacgcgcaagaagatccaggagtggattccgccaagtaccccctacaaatag

SEQ ID NO: 43961 - DNA, 255 bp, Artificial Sequence
  Description of Artificial Sequence: Synthetic coding sequence
atggccgcccgggtgggcgccttcctgaagaacgcctgggacaaggagcccgtactggtggtgtcctttgtcgtgggcggcctggctgttatccttcctcccctcagtccctacttcaagtactccgtaatgataaataaagcaacaccatacaactacccggttcctgtgagggatgacggtaacatgcccgatgtcccttcgcacccccaggatccacaaggaccgtcactggaatggttgaagaaactctag

SEQ ID NO: 43962 - DNA, 255 bp, Artificial Sequence
  Description of Artificial Sequence: Synthetic coding sequence
atggccgcccgggtgggcgccttcctgaagaacgcctgggacaaggagcctgtcctggtggtgtctttcgtcgtcggaggactggcggtgatcctgccacccctgagtccctatttcaaatactcagtgatgatcaacaaggccaccccatacaactatccggtgccagttcgtgacgacgggaacatgcccgacgttccctcacacccacaggacccgcagggaccttctttagagtggctgaaaaagctttag

SEQ ID NO: 43963 - DNA, 255 bp, Artificial Sequence
  Description of Artificial Sequence: Synthetic coding sequence
atggccgcccgggtgggcgccttcctgaagaacgcctgggacaaggagccggtgttagtagtctcattcgtggtaggcggcctcgcagtaattctgccgcccctctccccatattttaagtactctgttatgataaacaaggcaaccccatacaattacccagtaccggtgcgtgacgacggcaacatgcctgacgttccttctcaccctcaggaccctcagggcccgagcctggagtggctgaagaaactgtag

SEQ ID NO: 43964 - DNA, 246 bp, Artificial Sequence
  Description of Artificial Sequence: Synthetic coding sequence
atgctgcggcagatcatcggccaggccaagaagcaccccagcctgatcccattgtttgtgtttattggcacgggcgcgaccggcgctactctctatcttctgcggctcgctttattcaatcctgatgtgtgttgggatcggaacaacccagagccttggaataaactagggccaaacgaccagtataaattttattcagttaacgttgactactcaaagctgaagaaggagaggcccgacttctag

SEQ ID NO: 43965 - DNA, 171 bp, Artificial Sequence
  Description of Artificial Sequence: Synthetic coding sequence
atccccgtggccatcttcatcaccctggtgaacgtgttcatcggccaggccgaactggctgagatccccgagggttatgtcccagagcactgggagtactacaaggggaagggagccggcagtgctaagattgatgcctgtgagcgacgctggactctcgtacttctgtag

SEQ ID NO: 43966 - DNA, 318 bp, Artificial Sequence
  Description of Artificial Sequence: Synthetic coding sequence
atgatctgctggcggcaccccagcgccccctgcggccggggcgagtggcaggtgcctcggtcccagttgcctctagcacgagtggagttcccagttgccttgggcctgggagtcgctgtgggagcggaagctgcagccataatggtcaatctcctgcaaattgtgcgggatcactgggttcatgttcttgtccccatgggcttcgtcatcggttgttacctcgatcggaagagcgacgaacgcctcacagccttccggaacaagagtatgctctttaaacgggagctgcagccatcagaagaggtcacctggaaatag

SEQ ID NO: 43967 - DNA, 177 bp, Artificial Sequence
  Description of Artificial Sequence: Synthetic coding sequence
atggtgaacctgctgcagatcgtgcgggaccactgggtgcacgtgctggttccgatgggcttcgttattggatgctaccttgatagaaaaagtgacgagcgactcactgccttccggaacaaatccatgttgttcaaacgggagttacagccaagtgaagaggttacctggaagtag

SEQ ID NO: 43968 - DNA, 177 bp, Artificial Sequence
  Description of Artificial Sequence: Synthetic coding sequence
atggtgaacctgctgcagatcgtgcgggaccactgggtgcacgtgctagtgccaatgggctttgtaatcgggtgctacctcgacaggaagtcggatgagcggctgactgcctttaggaataaaagcatgctcttcaaacgcgaacttcagccctccgaggaggtgacttggaaatag

SEQ ID NO: 43969 - DNA, 288 bp, Artificial Sequence
  Description of Artificial Sequence: Synthetic coding sequence
atggagagccacgagcggcagcccctggtgctgcacgaggagatgggcgaatgccgctcttcactctcggccgggggtggggtgcacatcgagcctaggtatcgccaattcccacagttgaccagaagtcaggtgttccagtccgagtttttctcgggactcatgtggttttggatattgtggcgcttttggcacgactcagaagaggtactgggccacttcccttatccagatccatcacagtggacagatgaggagttgggcatcccgcccgatgacgaagactag

SEQ ID NO: 43970 - DNA, 318 bp, Artificial Sequence
  Description of Artificial Sequence: Synthetic coding sequence
atgagcgccctgacccggctggccagcttcgcccgggtgggcggccgtctctttcggagcggctgtgccagaacggccggggacggaggcgtgcgacacgcaggcggtggggtacacatcgaacctcggtatagacagttccctcaactgactcgctcccaggtgtttcaatctgagtttttcagcggtttaatgtggttttggatcctctggagattttggcacgattctgaagaagtcctgggtcattttccttatccagatccaagccaatggaccgatgaggagctgggaattccaccggacgatgaagactag

SEQ ID NO: 43971 - DNA, 315 bp, Artificial Sequence
  Description of Artificial Sequence: Synthetic coding sequence
agcgccctgacccggctggccagcttcgcccgggtgggcggccggctcttcaggagcgggtgcgcccgcaccgcaggggacggcggggtgagacatgccggaggaggcgtgcacatcgaaccccgatatagacagttcccccagctaactcggtcccaagtttttcagtctgaattcttttctggattgatgtggttctggatactctggcgcttttggcacgacagcgaggaagtgctggggcacttcccttaccctgacccatcccagtggacagacgaggaactgggaatccccccggacgacgaagattag

SEQ ID NO: 43972 - DNA, 318 bp, Artificial Sequence
  Description of Artificial Sequence: Synthetic coding sequence
atgagcgccctgacccggctggccagcttcgcccgggtgggcggccgactttttaggtctggctgtgcccggactgcaggagatggtggggtgagacacgccggcgggggagtgcacattgagccgcggtaccggcagtttccccagcttacccggagccaggtcttccagtcggagtttttctccggcctgatgtggttttggatactatggcgtttctggcacgattctgaagaagtactcgggcacttcccctatcccgaccccagtcagtggacggatgaagagcttggcattccaccagatgatgaggattag

SEQ ID NO: 43973 - DNA, 318 bp, Artificial Sequence
  Description of Artificial Sequence: Synthetic coding sequence
atgagcgccctgacccggctggccagcttcgcccgggtgggcggccgactcttcagatccggttgcgcacgaacagccggcgacggcggtgtgcggcacgccggcgggggggtgcacatcgagccacgctatagacagttccctcagttgactcgaagccaggtgttccagtccgagtttttttctggcctgatgtggttctggatactgtggaggttctggcatgattctgaggaagtcctgggccactttccctaccctgacccatctcagtggacagacgaagaactagggatcccccctgacgacgaagattag

SEQ ID NO: 43974 - DNA, 390 bp, Artificial Sequence
  Description of Artificial Sequence: Synthetic coding sequence
atgagcttccccaagtacaagcccagcagcctgcggaccctgcccgaaacacttgaccccgctgaatacaatatttctcccgaaacccgccgggcgcaagcggaacgactagctatccgagcccagctaaagcgcgaatatctgctgcagtataatgaccctaatcgtaggggactcatcgaaaaccccgccttgctgcgctgggcctatgctagaacgatcaacgtttatccaaacttccgaccaactccgaaaaactcactcatgggagccctgtgcggttttggacccttgatcttcatttattacatcatcaaaaccgagagggatcgcaaagaaaagttgattcaggaaggaaaactcgatcggaccttccacctgtcctactag

SEQ ID NO: 43975 - DNA, 363 bp, Artificial Sequence
  Description of Artificial Sequence: Synthetic coding sequence
atgagcttccccaagtacaagcccagcagcctgcggaccctgcccgagactctggaccctgcagagtacaacataagtcccgaaacgagaagagcccaggcagaacgattggcaataagagcccagttaaaaagagaatacctgctgcaatataatgatccaaaccgccggggattgatcgaaaatcccgctctactgcggtgggcctatgccagaactatcaacgtctaccctaatttccgtccaacccccaagaactctcttatgggtgctctctgtggttttggccctctgatattcatttattacatcattaagaccgaacgtgtgagtatccaaacccggtgtttagtgttcgagtag

SEQ ID NO: 43976 - DNA, 570 bp, Artificial Sequence
  Description of Artificial Sequence: Synthetic coding sequence
atggccgccatgagcctgctgcggcgggtgagcgtgaccgccgtggccgcactctccggtcggcctttgggaacccggctcggcttcgggggctttttaacaagaggctttccgaaggccgcagctcccgtgcgccacagtggggatcacggcaaacgtctgttcgtcatcagaccaagccgattttacgatcgccgttttcttaaactcctcagattttacatcgctctgactggcatccccgtggccatttttattaccttagtaaatgtgttcattgggcaagccgagctggcagagatcccagaggggtacgtgcctgaacactgggagtattataagcaccctatcagtcggtggatcgccagaaacttttacgacagtcccgagaagatctatgagagaacaatggccgtgctccagatagaagcagagaaggcagaactgcgtgtgaaggagctggaagttagaaagttaatgcacgttaggggcgacggtccttggtactactatgagactatagacaaggaactcatcgatcacagtccaaaggctacccccgataactag

SEQ ID NO: 43977 - DNA, 414 bp, Artificial Sequence
  Description of Artificial Sequence: Synthetic coding sequence
atggccgccatgagcctgctgcggcgggtgagcgtgaccgccgtggctgcactgtcaggccgccccctggggacacgtctaggatttggcggctttcttactcgagggtttcctaaagcagctggccaagccgagctcgcagagattcctgagggatatgtccctgaacactgggaatactataagcatcccataagtcggtggatcgccagaaatttttacgacagtccggaaaaaatttatgagagaaccatggcagtcctacagatcgaggcagaaaaagctgaattgagggtgaaggagttggaagtccggaagctgatgcacgtgcgaggagacggtccctggtactactacgagacaatagacaaggaattgatcgatcatagcccaaaagctaccccagataactag

SEQ ID NO: 43978 - DNA, 342 bp, Artificial Sequence
  Description of Artificial Sequence: Synthetic coding sequence
atgaccggctacacccccgacgagaagctgcggctgcagcagctgcgcgagctgaggcgaaggtggctcaaggaccaggagctgtccccacgggaacccgtgctgccgcctcagaaaatgggtcctatggaaaagttctggaataagtttctagagaacaagtcgccctggcggaagatggtgcacggggtgtacaaaaaatctatttttgtctttacgcatgtcttggtgcctgtttggattattcattactatatgaaataccacgtgagcggcgacactattctggaaaccggagaagtgatccctccaatgaaggagtttcccgatcaacaccattag

SEQ ID NO: 43979 - DNA, 291 bp, Artificial Sequence
  Description of Artificial Sequence: Synthetic coding sequence
atgatcgcccggcggaaccccgagcccctgcggttcctgcccgacgaggccagaagcctccctccacctaaattgacagacccccgcctcctctacattggctttctgggttactgctctggcctgattgacaaccttatcagacggcgcccgatcgccacggctgattacctgtacgctgtgagagaccgcgaaatgttcgggtatatgaaactgcatccagaggactttccggaggaggataaaaagacgtacggcgaaatctttgagaaattccacccgatacgatag

SEQ ID NO: 43980 - DNA, 267 bp, Artificial Sequence
  Description of Artificial Sequence: Synthetic coding sequence
atgatcgcccggcggaaccccgagcccctgcggttcctgcccgacgaagccaggtctctgcctccacctaagctcactgacccaaggctgctgtatatcggctttctggggtactgcagcgggctgattgataatctaatcagaagacgaccaatcgctacagcaggacttcacaggcagctcttgtacattaccgcctttttttttgctggctactatctggtgaagctcgaggcttatgctaatttgtatgtggatactttgtag

SEQ ID NO: 43981 - DNA, 360 bp, Artificial Sequence
  Description of Artificial Sequence: Synthetic coding sequence
atgatcgcccggcggaaccccgagcccctgcggttcctgcccgacgaggccagatccctgcctcctcctaagctgactgacccaagactcctgtatattggcttcctggggtactgcagtggccttatcgataacttaatcaggagaaggcccatagctacggccggcctgcacagacagctgttgtacattacagccttcttcttcgcgggctattacctggtaaagagggaagattatttgtatgcggttcgggacagggaaatgttcggctacatgaagctccatccggaggactttccggaggaggacaagaagacctatggcgagatcttcgagaagtttcatccaattcggtag

SEQ ID NO: 43982 - DNA, 231 bp, Artificial Sequence
  Description of Artificial Sequence: Synthetic coding sequence
atgatcgcccggcggaaccccgagcccctgcggttcctgcccgacgaggccaggtccctgcctccacccaaactgacagacccgagactgctgtacattggtttcctcgggtactgctcaggtctgatagacaatctgatacgacggcggccaattgccaccgctggcctgcaccggcagttactgtacatcaccgctttcttttgttggatcttgagttgcaaaacatag

SEQ ID NO: 43983 - DNA, 1032 bp, Artificial Sequence
  Description of Artificial Sequence: Synthetic coding sequence
atgagcgtgctgctgcggagcggcctgggccccctgtgcgccgtggcccgcgctgccatacctttcatatggagaggaaaatatttttccagtgggaatgagcctgccgagaatcctgtgacacccatgttgcggcacctaatgtacaagatcaaaagcactggtcctattactgtcgccgagtatatgaaagaggttctcactaatcctgctaagttgttgggaatctggtttattagcgagtggatggctacgggcaagtcgaccgccttccaattggtggagctcgggccagggagaggcactctggtaggggatatcttgagggtcttcacccagttgggaagcgtgctgaagaactgcgacatttcggtgcaccttgtggaaaagacgccacaggggtggagagaagtattcgtagacattgacccgcaggtgagcgataagctgagattcgttctcgccccctccgccacacctgccgaggcatttattcagcatgacgagactagggatcatgtcgaagtgtgccctgatgctggcgtcattattgaggagctgtcccagcggattgccctgaccggaggcgccgctctggtggctgactatggccacgacggcaccaagactgacacatttaggggattttgtgaccataaactccatgatgtgctcatagcccctggaacagccgatctgacggctgacgtggacttcagttatttgagacgaatggcccagggaaaggtcgccagcctcggcccaatcaaacagcacacattcctcaaaaatatgggtatagatgttcgcctgaaggtcctgcttgacaagtctaacgaaccaagcgtccgacaacagctgctgcaggggtacgacatgctgatgaaccccaagaagatgggtgaacgatttaatttcttcgctctacttccacatcagaggctgcagggagggcgataccagagaaacgccagacagtccaagccatttgctagcgttgtggccggcttcagcgagttagcatggcagtag

SEQ ID NO: 43984 - DNA, 1452 bp, Artificial Sequence
  Description of Artificial Sequence: Synthetic coding sequence
atggccagcctgggcgacctggtgcgggcctggcacctgggcgcccaggcagtggatcgcggcgactgggcccgagcactgcaccttttctcaggggtaccagcaccccctgcgcgcttgtgcttcaatgctggatgtgtgcatcttcttgcaggagatccagaggcggcactgcgcgcctttgatcaggccgtcacgaaagacacatgtatggcagttggattttttcagcgcggcgtcgcgaatttccagctggctaggttccaggaggcactgagcgatttctggctcgcgctcgaacagcttcggggccacgccgctattgactacacacaattgggacttcgctttaagctccaggcctgggaagttctccacaacgtggccagcgcgcagtgtcagttgggcttgtggacggaggccgcaagttcactgagagaagcaatgtccaaatggcctgaagggagccttaatggactggacagtgccctggatcaggttcaaaggcgggggtccttgcctccccgccaggtaccaagaggcgaagtcttccgacctcatagatggcatctaaagcatttagaacctgtggactttctcggaaaggcgaaagtcgtggctagcgccattccggacgatcagggctggggagtgaggccccaacaacctcaaggaccgggtgcaaaccatgatgcaagaagtttaatcatggacagcccccgagctggcactcaccagggacccctggacgccgagacagaggtcggggctgaccgttgcacctcgacagcctaccaggaacagaggcctcaggtagagcaagtcgggaaacaagctccgctgagcccaggactacccgcgatgggcggaccagggcccggaccatgcgaggatccagctggtgccggcggagcaggtgcgggcggttctgaacccctggtgactgttaccgtgcagtgcgcctttaccgtagcactacgcgctcgtagaggagccgacctgagcagcctgagggccctgctcggacaggccctcccccatcaggctcagctggggcagttgtcctatctggccccaggagaagacggccactgggtccctatcccggaagaggaaagcctccagagagcctggcaggatgcggccgcatgccccagaggcttacaacttcaatgtcgaggcgccggcggccggccagtgctgtaccaggtggtcgctcagcactcgtatagcgcccagggaccagaggatctagggtttaggcagggagatactgtggacgtgctatgtgaagaacctgatgtgcctctggcagtggatcaagcatggttagaagggcactgtgacggaagaattggcatctttccgaaatgttttgtggtaccggctgggcccaggatgagcggggctcctggcagactgccaagatcacagcaaggtgatcaaccttag

SEQ ID NO: 43985 - DNA, 1284 bp, Artificial Sequence
  Description of Artificial Sequence: Synthetic coding sequence
atggccagcctgggcgacctggtgcgggcctggcacctgggcgcccaggctgtcgataggggggactgggcacgagctttgcaccttttttccggcgttccggctcccccagcacgcctttgtttcaatgcgggatgtgtgcatctcttggctggtgaccccgaagctgcccttcgtgcattcgaccaagcagtcaccaaagatacatgcatggcagtcgggttcttccagaggggcgttgcaaactttcagttggcccgattccaggaggccctgtcagacttctggctggccttggagcagctgagaggtcatgccgccattgattatacgcagttggggctgagattcaagcttcaggcatgggaagtcttacacaatgtggcctctgctcaatgccagctggggctctggacggaagcggcttccagcctgcgcgaagccatgagcaagtggccagagggttcactgaatggtcttgattctgcgctggaccaggtgcaagggcctggagcaaatcatgacgcccggagcctaattatggactctcctcgagcaggcacccaccaggggccattggatgcagaaacggaagtaggcgccgatagatgtacctctacggcataccaggagcagagacctcaggtggagcaggtaggtaaacaggctcctttatccccaggactgcccgcaatggggggccccgggcccggcccatgtgaggaccccgctggcgctggcggggcaggagctggaggatctgagcctcttgttacggtgacagtccagtgtgccttcacagtagccctcagagccagacggggggctgacctgtccagcctccgggctctcttgggccaggctttgcctcatcaagctcaactgggccagttgagctacctggcccctggcgaagacgggcactgggtcccaatcccggaggaagagtcccttcagagggcctggcaggacgccgccgcttgcccccggggcctgcagctccaatgtcggggggccggaggccggccggtgctgtatcaggtcgtggcccagcatagctactcagcccaggggcctgaggatttaggctttagacagggcgacaccgttgacgttctctgcgaagagcccgacgtacctctggcggtcgaccaggcttggttggagggtcactgtgatggtcggattggcatttttcctaagtgcttcgtcgtgcccgctggtccccgcatgtccggcgctcctgggcgcctcccaagaagccagcagggtgatcagccatag

SEQ ID NO: 43986 - DNA, 1113 bp, Artificial Sequence
  Description of Artificial Sequence: Synthetic coding sequence
atggccggcccccggtaccccgtgagcgtgcagggcgccgccctggtgcaaataaaacgattgcaaacctttgccttctctgtgaggtggagcgacggatccgacaccttcgtgaggcgctcctgggacgagtttagacagctgaaaacattgaaggaaacattcccagttgaagccggcttacttaggaggtcagaccgagtactgcccaagcttctggacgccccgctgctggggagggtggggagaactagtcgcggcttagctcgcctacaactactggaaacttacagccgtcgcctgctcgcaaccgccgagcgtgtggcccggagcccaacaataacggggtttttcgctccccaaccactggacctggaacccgctctgcccccgggatccagagtaatcctgccaacaccagaggaacagcccttgagccgggccgcaggtcggctctctatccatagcttggaagctcaatccctgaggtgtctgcagcctttctgcacccaggatactcgagaccgtcctttccaagctcaggcccaggagagtctcgacgtccttcttcgccaccctagtggctggtggttggtggagaacgaagaccggcagacagcctggttcccagccccatatctagaggaggccgctccgggccagggcagggagggcggcccttcgctcggctccagcggtcctcaattttgtgcatccagggcatacgaaagcagcagggccgatgaactaagtgtgcccgccggcgctcgcgtcagggtcctcgaaaccagcgataggggttggtggctttgtagatatggggacagagcgggtctgctacctgctgtcctgttaaggcctgaggggctcggcgcgctgctgtctggaactggcttccgggggggagacgacccagcgggtgaagccagggggtttcctgagccatctcaagctacagctccccccccaaccgtccccacacggccctctcccggagccatacagagcaggtgttgcaccgtgactaggcgcgcactagaacgcagaccacggcggcaaggtaggcctcggggttgcgtcgactccgtcccgcatccaaccaccgaacagtag

SEQ ID NO: 43987 - DNA, 1116 bp, Artificial Sequence
  Description of Artificial Sequence: Synthetic coding sequence
atggccggcccccggtaccccgtgagcgtgcagggcgccgccctggtgcaaattaagagactccagacctttgctttttcagtccgctggtcagacggtagtgacacttttgtgagaaggtcatgggatgagtttcggcagctgaagaagacccttaaagagacctttcccgtggaggcaggactgctccgcagaagcgatcgcgtgctgccaaagttattggatgcgcccctcttgggtcgagtgggccgtacctctagagggctggcacgcttgcagcttcttgagacttattcccgcaggctgcttgcgaccgctgagagggttgcacgctccccaactatcaccggcttctttgctccacaacccttagacctcgagcccgctttgcctccgggaagccgggtcattctgccaacacctgaggagcagcccctgtctagagctgctggtaggttgtcaatccattccctcgaggcccaatcgctccgctgtctgcaaccattctgcacacaggatactagagaccgtccattccaggctcaggcccaagagtccctggatgtactactgcggcatcctagcggctggtggcttgtggaaaatgaagataggcagactgcatggtttccggccccatatttagaggaggcagcccctggacagggtcgcgagggaggacctagcctcggatcttccggaccacagttctgtgcttctcgtgcctacgaaagctcccgggcagacgaacttagtgttccagctggtgcccgagtgagagtcctcgaaacatccgaccgcggctggtggctttgtagatatggtgacagagcaggcctgctccctgctgttctcctccggcctgaaggtctcggtgccctactaagtgggactggttttagggggggagacgacccagccggagaagcgagaggtttcccggaaccgtctcaagccaccgcaccaccaccgacggtgccaaccagaccttctcctggtgctatccagagtcgttgttgcacagttactcgccgcgcacttgaaagacgccctaggcggcaaggccgtcccagggggtgtgtggacagtgtccctcatccaaccacggaacagtag

SEQ ID NO: 43988 - DNA, 1131 bp, Artificial Sequence
  Description of Artificial Sequence: Synthetic coding sequence
atggccggcccccggtaccccgtgagcgtgcagggcgccgccctggtccagataaaacgcctccaaacgtttgccttttccgtgcgttggtccgacggttctgacaccttcgtaaggcggtcatgggacgagtttagacagctcaaaaagactctaaaggagacgttccccgtggaggctggactgttgcgccggagtgacagggttctgccgaagttgcttggacaagccagtttggacgcccccctcctaggcagagtgggtagaacatcccgaggattggcccggctccagctgctagaaacctacagccgcaggctcctggccacagccgaacgagtggccagatctcccactatcacagggtttttcgccccacagccactcgaccttgaaccggcccttcccccgggctccagagttattctccctacccccgaagaacagcccctctctcgggctgccgggagactcagcatccactcgttggaggctcagagtcttcgatgtctccagcccttctgcacccaagatactcgagaccgccctttccaggctcaggctcaagaatcactggacgtgctgcttcgccatcctagcgggtggtggctagttgagaacgaggatcggcagacggcctggttccctgccccatatcttgaggaggccgctcctgggcagggaagagaaggcgggccctccctgggctcctccgggcctcagttttgtgcatctagggcctacgagtcgagtagagctgacgaattatcagttcctgctggcgccagagttcgagtgcttgaaaccagtgataggggctggtggctgtgtagatatggggacagggcaggcttgcttcccgctgtactgctccggcccgaagggcttggagctctcttgtcgggaactgggttccgaggtggtgacgaccctgcaggggaggctagaggctttcctgagcccagccaagccaccgcaccccccccgacggtgcctactcgcccctcgccgggcgcaatccaatctcggtgttgcaccgtgactcgcagagccctcgaacggcggccacggcgtcaaggccgacctagagggtgcgttgattccgtgcctcaccctacgacagagcagtag

SEQ ID NO: 43989 - DNA, 1413 bp, Artificial Sequence
  Description of Artificial Sequence: Synthetic coding sequence
atgggcaagctgcacagcaagcccgccgccgtgtgcaagcggcgggaaagccccgaaggggactcattcgcagtgtcggcagcctgggcaaggaagggcatcgaggagtggattggccgtcaacgatgtccgggcggagtttcaggaccccggcagctcaggctggctggaaccattggccgcagtaccagggaactagtcggtgatgtcctgagggacaccctgagcgaagaagaggaggatgatttcaggcttgaggttgctctgcctccagaaaagacagatggactcggtagcggagatgagaagaagatggagagggtctctgagccgtgtcctgggtctaaaaaacagctgaagttcgaagaacttcagtgcgatgtcagcatggaggaggactcacggcaagaatggacatttaccctgtatgattttgataataacggaaaagtgacacgcgaagatattacttctttgctccataccatttatgaagtggtcgacagcagcgttaaccattcccctacgagcagcaaaatgctgcgagtcaaattgaccgtggccccggatggaagtcagtcaaagcgatcagttctcgtgaatcaagcggaccttcaaagcgcccgaccaagggctgagaccaagccgacagaggatctgaggtcatgggagaagaaacagcgggccccactgaggttccagggcgattcaaggctggaacagtccggatgctaccatcactgcgttgatgagaacatagaacggcgcaaccactacctggatctcgcagggatcgagaattacaccagccagtttggacccgggagtcccagcgtcgctcagaaaagcgagctcccccctcgaacatccaaccccacacgaagcaggtcacacgaacccgaggcaatccatataccccacaggaaaccccaaggcgtggaccccgcatcctttcatttcctcgatacccccatagccaaggttagcgagctacagcagcgcctgagggggactcaggacggctccaagcacttcgttagatcccccaaggcacaaggcaagagcgtcggagtaggacacgtggccagaggggcacggaataaacctccactcggcccagctatacccgctgtctcgccatccgcacacctggctgcgtccccagccctgctacctagcctcgcacctctgggccataaaaaacataaacaccgcgcaaaagagagtcagcaggggtgtcgaggactacaggcaccattggcctcaggaggcccggtcctggggagggagcacctccgcgaactgccggcccttgtggtatacgagtcccaggccggacagccagtgcagaggcatgagcatcatcaccaccacgagcaccaccatcactaccaccacttctatcagacctag

SEQ ID NO: 43990 - DNA, 1356 bp, Artificial Sequence
  Description of Artificial Sequence: Synthetic coding sequence
atgggcaagctgcagagcaagcacgccgccgccgcccggaagcggcgcgaatctccagaaggcgactcatttgtagcctctgcctatgccagtggcaggaaaggcgccgaggaggctgagcgccgagcccgcgacaagcaagagctgccgaatggagatcctaaagaaggaccttttcgtgaggaccagtgccctctacaagttgccctccccgctgagaaggccgagggtagggagcaccctgggcaacttctatctgccgatgacggcgaacgggccgccaatcgagagggcccaagaggcccgggtggccagagacttaatattgatgcactccagtgcgacgtctctgtggaggaagatgatcgtcaggagtggacattcaccctgtatgatttcgacaactgcggcaaggtcactagagaggacatgagcagtctcatgcacaccatttacgaagtggtggacgcaagcgtaaaccacagctctggctcctctaagaccctccgagtcaagctgactgtcagccctgagccctcgagtaagcggaaagagggtcctcctgccgggcaagatcgggaacccacccgctgcagaatggaaggagaattggcggaagaaccccgagtcgctgatcgccgcctgtctgcacatgtgcgccgaccctccacagatccccaaccatgcagtgagcgcgggccttactgtgtggatgaaaatacagagcgccgcaaccactatctcgatctggccggcatcgagaactacacgagcagatttggtcccggctcaccgcctgtccaggcaaaacaggagccgcaggggcgagcatcacacttgcaggctagatctaggtctcaggagcctgatactcacgccgtgcatcaccgtagatcccaggtgttggtcgaacatgtggtccccgcctccgaacccgccgccagggctctggatacacagccacggcccaaaggtcctgagaaacaatttctgaaatcacccaagggcagtggcaagccccctggagtgcctgcatcatcaaagagtgggaaagctttctcctactacctccctgcagtgcttcctccccaggcaccccaggatggccaccatctcccccaaccccccccacctccctacgggcataagcgctatcgccagaaagggcgtgaagggcattcaccgttaaaagcgccccacgcccagccggctactgtcgagcacgaagtggtacgggacctcccccccactcccgcgggtgagggttacgccgtaccagtgatacagagacatgagcaccaccaccatcacgagcaccaccatcaccatcatcatcatcattttcatcccagttag

SEQ ID NO: 43991 - DNA, 507 bp, Artificial Sequence
  Description of Artificial Sequence: Synthetic coding sequence
atggccggcagcgtggacaaccggcagtgcggccggcagggccggcagtgtggccaacagacagtttcaaccgctggctccgtggacggccgtcaggcagtgtggatggctggctctgttgatgcctgtcatagtggcgctcgcggtggcgccggacctgcagcgcacgcctcacggagagggctgagaggagcttcagacccagctgcccgggctcctcctcccccaagagcccctccccctcctcccccccccccactgcctccggtgctcgccccattgccatccactccccgttcccagcatactaccgccagagatctacgcgccggctctcgcgctgctgccggatgtgtgcccatggggagccccgccccaaccccacaccttcggcagcagactgctacggactgccgatgctggcatgacggagggggggccccctggaccagaggccagggccccggcgccctgtgctcaagtgcacttgatgcaacctggcggtag

SEQ ID NO: 43992 - DNA, 936 bp, Artificial Sequence
  Description of Artificial Sequence: Synthetic coding sequence
atgggcaagctgcagagcaagcacgccgccgccgcccggaagcggagagaatctccggaaggagactcttttgttgcatccgcctacgcttctggccggaagggtgcagaggaggctgaacggcgggcgcgcgacaagcaagaacttccaaatggagaccccaaagagggtcccttcagagaggaccagtgcccacttcaggtggcactacccgcagagaaagctgaaggcagggagcacccaggccagctcctcagtgccgacgacggagagcgggccgcgaatcgagagggcccaagaggtcctggaggccaaaggttgaatattgatgcattgcagtgtgacgtgtccgtggaagaggatgatagacaggagtggacatttaccttatatgattttgacaattgtggtaaggtcacgcgggaggacatgagttctctcatgcatacaatctatgaggtcgtagacgctagcgtgaatcactccagtggaagctccaagacactccgagtgaaactgacagtgtcacccgagccctcaagcaaacgaaaggaaggaccgccagctggacaggaccgcgagccgacccgatgcaggatggagggtgagctggcagaggagccgcgcgtggcagaccggcggcttagcgctcacgttcgcagaccctcaacagacccgcagccttgttctgaacggggcccttattgtgtggacgaaaacacagagcgacgtaaccattacctggacctggcgggaatcgaaaactacacatctcggtttgggcctggatcacaactgtgcgagaaacggtcttccgcaccgcgcacacactctggtgataaggccagaggggtcggcttgtgccgcgagctatggagccaagccggtcaccctcagtggcctggaccttttccctccggcctggtggctgtgtag

SEQ ID NO: 43993 - DNA, 936 bp, Artificial Sequence
  Description of Artificial Sequence: Synthetic coding sequence
atgggcaagctgcagagcaagcacgccgccgccgcccggaagcggcgggagtcacccgagggggattctttcgtggctagcgcctacgccagtggccgtaaaggtgccgaggaggccgaaaggagggcaagggataagcaggaactcccaaacggtgatcccaaagaggggccttttagagaagaccagtgtcccctgcaggtggccctcccagcagaaaaggccgagggacgcgagcatcctggccagctcctctccgccgatgacggagagcgggccgctaaccgggaggggccacggggacctggcggacaacggctgaacatcgatgccttacagtgcgacgtgtccgttgaagaagatgaccgtcaggagtggactttcactctttacgactttgacaactgtggtaaggtaacacgcgaagatatgagcagtttgatgcatacgatatatgaggtagtggatgcgagcgtaaaccacagttcaggatcttccaaaacactgcgggtgaagttgactgtctccccagagccaagctccaagcgaaaggagggacctcctgccggacaggacagagaacctacgagatgccgcatggagggggaactggccgaagaaccacgggtggccgaccggcgcctgagcgctcacgtccggcggccgtccacagacccgcagccttgcagtgagaggggcccttactgcgtggatgaaaacaccgagcgtaggaatcattacctggacctcgctggcatcgaaaattacacctcccggtttggaccaggctctcagctttgcgaaaagcgaagtagtgctcctcgcactcacagtggcgataaagccagaggggtcggactctgccgtgaattatggtcccaggccggccatcctcagtggcccggcccattcccctctggcctggtggccgtgtag

SEQ ID NO: 43994 - DNA, 438 bp, Artificial Sequence
  Description of Artificial Sequence: Synthetic coding sequence
atgcccggcgtgaccgtgaaggacgtgaaccagcaggagttcgtgcgcgcactggccgctttcctcaaaaagtcaggaaagctaaaagtgcctgaatgggtagacaccgttaagctcgcaaagcataaagagcttgctccttacgacgagaactggttctacactagggcagccagtaccgcaagacatttgtacctgagaggcggggctggtgtgggaagcatgaccaaaatctacggcggccgccagcggaacggggtcatgccttcccattttagcaggggctcaaagagtgtcgcacggcgggtacttcaggccttggaagggctcaaaatggtggaaaaggaccaagatggaggccgcaagcttactccccagggccaaagagatctcgaccgcatcgctggacaggtcgccgcagccaataagaaacactag

SEQ ID NO: 43995 - DNA, 1134 bp, Artificial Sequence
  Description of Artificial Sequence: Synthetic coding sequence
atggccgaggaggtggtggtggtggccaagttcgactacgtggcccagcaggagcaggagttagatattaagaagaatgagagattatggctcttggacgatagtaagagttggtggagggtcagaaacagcatgaataaaaccggctttgtcccctcgaactacgtcgagaggaaaaactcagcacggaaggcctcgatcgtgaagaacctcaaggacacccttggcatcggaaaggtgaagagaaaaccgtccgtgcccgatagcgcctcgccggcggacgactctttcgtggacccgggggaacggctgtacgatttaaatatgcctgcatacgtaaagttcaattacatggcagaacgggaagatgagctgtcccttataaaaggcactaaggttatagtcatggagaagtgcagcgacggatggtggcggggctcctacaacgggcaggtgggctggtttccgagtaattatgtaactgaagagggcgactcccccctgggcgaccatgtcggcagtctaagtgaaaaactggcagcagtggttaataacctgaataccggccaggtcctccacgtggtccaggcactctatcccttcagcagctccaacgatgaggagctcaatttcgagaagggcgacgtgatggatgtgatcgaaaagcctgaaaatgatcccgagtggtggaaatgcagaaagataaacggcatggtgggtctagtcccaaagaattatgtaacggtaatgcagaataaccccctcacctccggtctcgaaccaagcccccctcagtgcgattatatacgacccagtttaaccggtaaatttgccggtaacccctggtattacgggaaggtcactagacatcaggccgaaatggcattgaacgaacggggtcatgagggtgatttcttgattcgggattctgagagttcacctaacgacttttccgtctctctgaaggcacaagggaaaaataagcattttaaggtccagcttaaagagaccgtatattgcataggacagcgtaagttcagtaccatggaagagctggtagaacactacaagaaggctccaatcttcaccagtgagcaaggcgaaaagctgtacctggttaagcacctgtcctag

SEQ ID NO: 43996 - DNA, 228 bp, Artificial Sequence
  Description of Artificial Sequence: Synthetic coding sequence
atggccgaggaggtggtggtggtggccaagttcgactacgtggcccaacaggagcaagaattggatataaagaagaacgagcgattgtggttgctcgatgatagcaaatcctggtggcgagttcggaacagcatgaataagactggtttcgtgcccagtaactacgtggagaggaaaaattctgcccggaaggctagcatcgtgaagaacctcaaggatacactgtag

SEQ ID NO: 43997 - DNA, 1134 bp, Artificial Sequence
  Description of Artificial Sequence: Synthetic coding sequence
atggccgaggaggtggtggtggtggccaagttcgactacgtggcccagcaagagcaggagctggatattaagaagaacgagcgtttgtggctgctcgacgattcaaagagttggtggcgagtgagaaattccatgaacaaaaccggctttgtgccatctaattatgtggaacgcaagaattccgcccggaaggcttccatagttaagaacctgaaagacactctgggcattggtaaggtgaagaggaaaccttccgtgcctgactctgctagtcccgccgacgactcattcgtcgatcctggcgaaagactgtatgacctgaatatgccggcatacgtcaagtttaactatatggccgaacgggaggatgaactgtccctcatcaaaggcactaaggtgatagtgatggagaaatgctctgacggatggtggaggggatcttataacggtcaagtaggctggtttccaagtaactacgtcactgaggagggcgatagcccactgggggatcatgtgggatctttatctgaaaagttggccgcagtagtcaataacctgaacaccggccaggttttgcatgtcgtacaggccctctacccgtttagctcatccaatgatgaagagcttaactttgagaaaggcgacgtgatggacgtgatcgaaaagccagagaatgatccggaatggtggaagtgcagaaagatcaacggcatggttggtctcgtgcccaaaaattacgttaccgtgatgcagaacaaccctctcacgagcgggttagaaccttcacccccgcagtgcgactacatccgacctagccttacaggcaagtttgctgggaatccttggtactatggaaaggtcaccaggcatcaggccgaaatggcgctcaatgaacgcggtcatgagggggacttcctgattcgagacagcgaatcaagtccaaacgacttcagtgtcagcctaaaggctcagggtaaaaataagcacttcaaagtgcaactcaaagagactgtgtattgcatcggccagcgaaagttttcgacaatggaggagctggttgagcactacaaaaaggcccctatcttcacctcagaacagggcgagaagctctatctggtaaagcatttgtcatag

SEQ ID NO: 43998 - DNA, 348 bp, Artificial Sequence
  Description of Artificial Sequence: Synthetic coding sequence
atggccgaggaggtggtggtggtggccaagttcgactacgtggcccaacaggagcaagagctagatataaaaaagaatgagagattgtggcttctggacgactcgaaaagctggtggcgcgttcgaaactccatgaacaaaaccggatttgtgccctctaattatgttgagcggaagaactccgctaggaaggctagtatcgtgaaaaatttgaaggacacgctcggtatcggaaaggttaaaaggaagcctagcgtccccgatagcgcatcccctgctgacgattcctttgtcgaccccggtgaacgactgtacgacctgaacatgcctgcctatgttaagttttag

SEQ ID NO: 43999 - DNA, 390 bp, Artificial Sequence
  Description of Artificial Sequence: Synthetic coding sequence
atggccgaggaggtggtggtggtggccaagttcgactacgtggcccagcaggagcaggagttggacatcaaaaagaacgaacgactctggctcctggacgactcaaaaagttggtggagagtcagaaacagcatgaacaaaacaggattcgtgcccagcaattacgtggagcgaaaaaactccgctcggaaagcatcaatcgtgaagaatctgaaggatacccttggaattgggaaagtcaagagaaagccatctgttcccgattctgctagccccgcagacgatagtttcgtggaccctggggagcgtctctatgatctgaacatgcccgcctatgtaaagttcaattacatggccgagagagaggacgagctgagcctcataaagtag

SEQ ID NO: 44000 - DNA, 942 bp, Artificial Sequence
  Description of Artificial Sequence: Synthetic coding sequence
atggactggctgaacgtgttcaaggacttcttcagcatcggcaaggtgaaacgtaagcccagcgtgccagatagcgcatcgcccgctgatgatagcttcgtcgatcctggggagcggctctacgacctgaacatgcccgcctacgttaaattcaattacatggccgagagggaagacgaattaagcctgattaaaggcactaaggtgatcgtaatggaaaagtgcagcgatggctggtggcgaggaagctacaacggccaggtagggtggttcccgagcaactatgttacggaagaaggggacagccccctgggagaccatgtggggagcttatcggagaagctagctgcggttgtgaacaatctgaacacaggacaggtcctgcacgtggtgcaggccctgtatcccttctcaagctcgaacgatgaagaactcaactttgaaaaaggcgatgtcatggacgtcatcgaaaaacccgaaaacgatccagagtggtggaagtgtcggaagattaacggcatggtcggacttgttcccaagaactatgtcactgttatgcagaataatcctttaacatcaggcctggagccttccccaccccagtgcgactatattcgcccgagcctgaccggcaagtttgccggaaacccgtggtattacggcaaggtgacaagacatcaagccgaaatggctttgaacgaaaggggacatgaaggcgattttctgattcgcgatagcgaaagtagccccaacgacttcagcgtctcgctcaaggctcaggggaaaaataagcacttcaaggtgcagttaaaagaaaccgtatattgtatcggtcaaaggaagttctcgacgatggaagaattagtggaacactacaagaaagcccccatatttacttcagagcagggcgagaaactgtatctcgtgaaacacctttcctag

SEQ ID NO: 44001 - DNA, 3384 bp, Artificial Sequence
  Description of Artificial Sequence: Synthetic coding sequence
atgagcctgaccagcgcctaccagcacaagctggccgagaagctgacaatcttgaatgatcgggggcaaggcgtcctaatacgtatgtacaatattaagaaaacctgctccgaccccaagtcaaaaccacccttcttattggagaagtccatggagccgagcctaaagtatatcaataagaagtttcccaatattgatgtgagaaattccacccaacatctggggccggtgcaccgggagaaggctgaaatcataaggtttctcacaaactactaccagtcattcgtcgacgtgatggagtttcgcgaccatgtctatgaacttctgaataccatcgatgcgtgtcaatgccatttcgatataaatcttaacttcgactttacgcggagctacctggatcttattgtaacatacacaagtgtgatcttgctcctgagtcggattgaggatagacgtatcttgattggcatgtataattgcgcacatgagatgctgcatggccacggagatccatcatttgccagacttggccagatggtcctcgaatatgatcatcccttgaagaagttgaccgaagagtttgggccccacacaaaggccgtgtccggggccctattgtccctgcacttccttttcgtccggcgcaaccagggcgccgaacagtggagatccgcgcagctcttgtcactcatctccaatccaccagcgatgatcaaccccgctaattccgacactatggcctgtgagtatctgtccgtggaggtcatggagcgatggattatcatcggattcctactgtgtcacgggtgtctgaatagcaattcccaatgccagaaactgtggaagctgtgtttacaaggcagcctttacattacactcatccgcgaggatgtgctgcaggtgcataaggtgaccgaggatcttttttcttcactgaagggctatggcaagcgagtggcagacataaaggaaagcaaggaacacgtgatcgccaatagcgggcaattccattgtcaaaggagacagtttctgcgcatggccgtgaaggaactcgagaccgttttagcggatgaacctgggctcttgggcccaaaggctctatttgcgttcatggctctgtcattcattagagacgaggttacatggctcgtgcggcatactgaaaatgtcaccaaaacaaaaaccccggaggactatgcagatagcagcattgccgaactgttatttctcttagagggcatccgtagtctcgttcggaggcatattaaggtgatccaacagtaccacctccagtacttggccagattcgacgctctggtcctgagcgacattattcagaacttgagtgtgtgtcctgaggaagaatccattataatgtccagctttgtcagcatattgtcgtcactcaacctgaaacaggtcgataatggggagaaattcgaattttccggcctgagactggactggttcaggcttcaggcttacacatccgtcgcgaaagctcctctgcatctgcatgagaacccggatctagcgaaagtaatgaatctgatagtctttcactctagaatgctggattcagttgagaagctcctggttgagaccagtgatctgtctactttctgtttccaccttaggatcttcgaaaagatgttcgcaatgaccctcgaggagagcgccatgctgagatatgctatcgcgtttcctctgatctgtgcacacttcgtccactgtacacacgagatgtgtcccgaggagtatcctcaccttaagaatcatgggctgcaccactgcaactcctttttggaagagctggccaaacaaacctcaaattgcgtgttggaaatctgcgccgagcaaaggaatctctcagaacagcttctgccaaaacactgcgcgactactatcagtaaggcaaaaaacaagaaaacccgtaaacaacggcagacaccccgtaagggcgagccagaacgggataaacctggagctgagtcccacaggaaaaacaggtctattgtaaccaacatggacaagcttcacttgaacctcaccgagctggctctgactatgaatcacgtgtactccttcagcgtattcgagcacaccatcttcccctctgagtatcttagcagtcacctcgaagcgaggcttaaccgcgccattgtgtggctcgcaggttacaatgccacaactcaggagattgtgagaccctccgagttactggccggagtgaaggcgtacatcgggttcatacaaagcctggctcaatttttaggggcggatgcctcacgggtgatccgtaacgccctgctacagcagacgcagcctcttgactcctgtggagaacaaacaataacaaccctttacacaaactggtatctagaaagcttactcaggcaggcttcctctggtactattattttgtcaccagccatgcaggcgtttgttagcctccctagagaaggagagcagaatttcagcgctgaggaattttctgatatcagcgagatgcgcgcactggccgaactgctgggaccttatggcatgaagttcctgagcgaaaatctgatgtggcatgtcacatcccaaatcgttgaactgaaaaaactggtggtcgagaacatggatattctggtgcaaatcaggtcaaatttctccaaacccgatctgatggcaagcttgctacctcagctcaccggcgctgaaaacgtcctcaagaggatgactatcatcggggtcatcctgagcttccgtgccatggcccaggaaggcctaagggaagtcttctcatcacactgcccctttctaatggggccgatcgaatgcctcaaggagttcgtgactccagacactgatattaaagtgaccctgagcatctttgagctggccagtgccgccggcgtgggatgtgatatcgatccagctcttgtggccgccattgcgaacctaaaggctgatacttcttccccagaggaggagtacaaggttgcctgcctccttctgatcttcctcgcagtgtccctgccactactggccaccgaccctagtagtttctacagcatcgaaaaagacggctacaacaacaacatccactgccttactaaagccatcattcaggtgagcgccgcccttttcaccctgtataataagaatatcgaaacccatctgaaggaatttttggtagtggcctctgtgtccttgctccaactgggacaagagacagacaagcttaagaccagaaatcgagagtccattagcctcctcatgagactcgtagtggaagagagctctttcctgacacttgatatgttggaatcatgcttcccctacgtactgcttagaaatgcataccgagaggtttctcgggcctttcacctgaactag

SEQ ID NO: 44002 - DNA, 3234 bp, Artificial Sequence
  Description of Artificial Sequence: Synthetic coding sequence
atggagcccagcctgaagtacatcaacaagaagttccccaacatcgacgttcggaacagtacgcaacacctcggtcctgtgcaccgggagaaagcagagatcatccgctttctgaccaattattaccagagctttgtggacgtcatggagtttcgggatcacgtttacgagctcttgaacacaatcgacgcctgccagtgtcactttgacattaatctcaatttcgacttcacccgtagctaccttgacctgattgtgacttatacctccgtaatcctgcttctctcgagaatcgaggaccgaagaattctcatcggtatgtacaattgcgcacatgagatgctgcacggccacggcgatccctcatttgcccgtctgggccagatggtgctggaatacgaccacccactgaaaaagcttactgaggagtttggcccacataccaaagcggtgagcggcgcattgctgagcctccactttctgtttgtgcgtcgaaaccagggggcggagcagtggaggagcgcgcagctgctgtccctgatctcaaatccaccagctatgattaatcctgctaattcagatactatggcttgcgaatacctgagcgtcgaagttatggaacggtggatcattatcggatttctgctgtgtcacggctgtctcaatagcaacagccagtgtcaaaaactgtggaaattatgcctccaaggcagcctgtacatcacacttattcgggaggatgtgctacaagtgcataaggtcacggaggacttattttcttccctgaagggatacggtaagagggtcgctgatatcaaggagagcaaggagcatgtgatagctaattctggccagttccattgtcagcggcgacagtttctgagaatggccgtcaaagaactggaaaccgtgctggccgatgaacctggtctcctcggccccaaggcacttttcgcattcatggccctgtcctttattcgcgacgaggtgacttggctggttagacacaccgagaacgtgacaaagacaaagactccagaggactatgctgatagctccattgcagaactattattcctactggaaggcataagatccttggtccgccggcacatcaaggtgattcagcagtatcatctccagtacctagctcgcttcgacgctctggtgctatcggacataatccagaatctttcagtttgccctgaagaggagtcaattatcatgagcagcttcgtttcgatacttagttcgctgaacttgaagcaggtggataacggcgaaaagtttgagttttctggcttgagattagattggtttcggctccaagcctacacgagcgtcgccaaggctccactgcatctgcacgaaaacccagaccttgcgaaagtgatgaatctgatagtatttcattccagaatgttggatagcgtggaaaaactcttggtcgaaactagcgatctctctacgttttgtttccacctgcggatcttcgagaaaatgtttgccatgacgctggaagaaagcgctatgctcaggtatgccattgccttccccctgatctgtgcacatttcgttcattgtacgcatgagatgtgtcccgaagaatacccccacctcaagaaccacgggttgcaccactgtaactccttccttgaagaactggcaaaacaaacctcaaactgcgtgttagagatatgtgcagagcagcggaatctgtcagaacagttactgccaaagcactgtgcaaccacaatctccaaggcaaagaacaagaagacaagaaagcagcgccaaactccccgcaaaggagaacccgagagggacaaacctggtgccgaaagtcatcgaaagaatagaagcatagtgaccaatatggacaagttacaccttaatctcacagaactggcgttaacaatgaatcacgtctacagcttcagtgtattcgagcacactatttttccctccgagtatttgagctcacacctcgaagcacgactgaatcgagccattgtttggttggcagggtataacgcaactacccaggagatcgttcggccatcagaacttctcgctggtgtaaaggcatatattggctttattcagtctctggcgcagtttctgggagcggatgcttcccgggtaatccgtaacgccctcttacagcagacacagccactggatagctgtggtgaacaaactatcacgaccctgtataccaattggtatctcgaaagcctcctgaggcaagctagcagtggcaccatcatactgtctccagcgatgcaagcgttcgtgagcctgccgcgtgagggggagcagaatttcagtgccgaagaattcagcgatatatcggaaatgcgggccctggcagagctccttgggccttacggaatgaagtttctgtctgaaaacctcatgtggcatgtgacttctcaaatcgtggaactgaaaaaactggtggtggagaacatggatatcctcgtgcagatcagaagcaatttctctaagcccgatctgatggcttccctgctgcctcagttgacaggagccgagaacgtgctgaagcggatgacaataattggtgttattctgagttttcgggcaatggcccaggaagggcttagagaggttttcagcagtcactgcccattcctgatgggccctattgaatgtcttaaagaatttgtcacccccgacactgatatcaaggtgactctgagcatattcgagttagcttctgccgcgggggttggatgcgatatcgatcctgcactggtcgccgccatcgccaatctcaaggctgatacctcgtcaccagaggaggagtacaaagtggcttgcctcttgctgatattcttggcagtgtctttgcctctgctggctacagacccctcaagtttctacagcattgaaaaagacggttataacaataacattcactgtctgacaaaagcaataatccaggtgagcgctgcactctttaccctctataataaaaacatcgagacccacctgaaagagttcctcgtagtggcgtccgtgtccctcctgcagctgggacaggaaacggataaactaaaaactaggaaccgcgagtctatatccctgctcatgaggcttgttgtagaggagagctccttcctgactctcgacatgctagagagctgtttcccctacgtcttgctcagaaacgcttatagggaagtaagcagagccttccatctcaactag

SEQ ID NO: 44003 - DNA, 2622 bp, Artificial Sequence
  Description of Artificial Sequence: Synthetic coding sequence
atgagcttcatcatgaagctgcaccggcacttccagcggaccgtgatactcctggccaccttttgcatggtgagtatcattatcagcgcgtactacttgtacagcggatacaaacaggagaacgaactgtccgagaccgcttcagaagtcgattgcggcgacctccaacacttgccatatcaattgatggaagtgaaggctatgaagttgttcgatgcaagccggactgatcccaccgtgttagttttcgtggaatctcagtacagctccctgggtcaagacataattatgattctggagtccagccggttccaatatcacatagagattgcaccggggaaaggcgaccttccagtgttgattgataaaatgaagggcaaatacattctcatcatttacgaaaatatcctgaaatacatcaatatggacagttggaaccgatctctgctggataaatactgcgttgagtacggagtcggggtcatcggctttcacaaaacaagtgagaagtcagtccagagcttccagctaaagggattcccgttttcgatctatggcaatcttgccgtcaaagactgttgcataaatccgcactccccactgatcagggtgacaaaaagcagtaagctcgagaagggctctctgcccggtactgattggacggtgttccaaataaatcacagcgcctaccagcctgtgattttcgctaaggtaaagacgccagagaacctgtctccctctatctccaagggcgcgttttatgccacaatcatacacgaccttggattacacgatggcatccaacgggtgctattcggaaacaacctgaatttctggcttcataagctcatcttcatcgacgccatcagtttcctatccgggaaacggctgactctgagtctggataggtatattcttgttgacatcgatgacatcttcgtgggtaaggaggggactcgtatgaacacaaatgacgtgaaggcattgttggatacacaaaatctgctcagagcccagatcacgaactttacattcaacctcgggttcagcggtaagttttatcacaccggcaccgaggaagaagatgagggggacgactgccttttgggctccgtggatgagttctggtggttcccgcacatgtggtcacatatgcagcctcatctgtttcacaatgagtcatccctagtagaacagatgatactgaataaaaagttcgcgctggaacatgggatccctaccgacatgggttacgccgtcgccccccatcacagtggtgtgtatcccgtacatgtgcagttgtatgaagcatggaaaaaggtgtggaatatcaagatcaccagcacagaagagtacccgcacctcaaaccagcacgttacagacgggggttcattcacaagaatatcatggtactgccgaggcaaacctgcgggctctttacacacacaattttctacaaggagtacccagggggaccaaaggaactggataaaagtattcaaggaggtgagctgtttttcacagtggtactcaacccgataagtatttttatgactcatctgtccaactatggcaacgaccggctcggactctataccttcgttaacctcgccaatttcgtaaagagctggaccaatctgcgtctacagacactgccccccgtgcagctcgcacacaaatactttgagctattccctgaccagaaagaccccctgtggcagaacccatgcgacgacaagaggcaccgcgacatctggagtaaggagaagacctgcgataggttgccaaaatttctggtcatcggccctcaaaagactgggacgacagcgttgtatctttttcttgtgatgcatcccagcatcctgtccaacagccccagcccaaaaacatttgaagaggtacaatttttcaacagaaacaattatcacagaggaatcgactggtacatggattttttccctgtcccctccaacgtcacgacagacttcctgtttgaaaaaagcgccaattatttccactcagaggaagcgccaaagagggctgctagcctggtgcctaaggcaaagatcataaccatcctgatcgatccgagcgatcgggcatacagctggtaccaacatcagaggagccatgaggacccagccgccttaaaatttagtttctatgaagtcatctctgccgggcctagggccccctcggaattaagggccctccaaaagcggtgcttggttccagggtggtacgcgtctcacatcgagagatggctcgtatatttccctccattccagttgttgataattgacggacaacagctgcggaccgaccctgctacggtaatggacgaggtacagaagtttcttggagtgctccctcactataattatagcgaggcactcacatttgatagtcacaagggattctggtgccaacttcttgaggaggggaaaactaaatgtcttggtaaatcgaaggggagaaagtatcctccaatggactctgattccaggacatttctgtcgtcgtactatcgcgaccataatgtcgaactgtctaaactgcttcacaaactaggccagccgctgccctcctggttgcgacaggagctgcaaaaggtcaggtag

SEQ ID NO: 44004 - DNA, 1686 bp, Artificial Sequence
  Description of Artificial Sequence: Synthetic coding sequence
atgagcttcatcatgaagctgcaccggcacttccagcggaccgtgatcctcctcgccactttttgcatggtgtcaattattatcagcgcttattacctgtactccggctacaagcaggagaacgaactgagtgaaaccgcatccgaagtcgactgtggcgacctccagcacctaccttaccagctcatggaggtaaaggctatgaagttgttcgatgccagtcggaccgaccctaccgtgcttgtgtttgtggagtcacagtactcatcattaggacaggatatcatcatgatcttggaaagctcccggttccagtaccacatcgagattgcccccgggaagggggatctgcccgtactcatcgacaaaatgaaagggaagtatatcctgattatttacgagaatatcttaaagtacattaacatggattcttggaacagatccctgctggacaaatattgcgtggagtatggcgttggtgtgatcggcttccacaagacctccgaaaaatccgtgcagtcttttcagctgaagggatttccttttagtatctacggcaacctcgccgtgaaagattgttgtatcaacccacattctccattgatccgagtgactaagtctagtaagctggaaaaaggaagcctccctggtaccgactggaccgtgttccaaatcaatcattcagcataccaacctgtgattttcgctaaagtgaaaaccccggagaacctctctcccagcatcagtaagggggctttctatgctacgataattcatgatctgggcctccacgacgggatacagcgagttctatttggcaacaacttgaacttttggctccacaaattgatcttcatcgacgctataagctttctgtccggtaagcggctcactctgtcactcgataggtacatattggtcgacattgacgacatcttcgtcggaaaggagggcacaagaatgaatactaacgacgttaaggaacacggcatacccaccgacatgggctacgctgttgcccctcaccactcaggggtgtatcctgtgcacgtgcagctctacgaagcttggaagaaagtttggaacattaagattacctcaacagaagagtacccccatctcaaacccgctaggtaccgtcgaggctttatccataagaatattatggtcctgccacgccagacatgtggactcttcacacacaccattttttacaaagagtacccgggaggcccaaaggaacttgataagtctattcagggcggcgagttgttttttacggtggtactcaatcctattagcatcttcatgacccacttgtcaaactatggaaacgacagattgggcttgtatacgttcgtaaacctggccaattttgtaaagagctggaccaacttgcgacttcagaccttacccccagtgcagttggctcacaagtattttgaactatttccagatcagaaggaccctctatggcagaacccttgcgatgataagcggcacagagatatttggtcaaaggaaaagacctgtgacagactgccgaagtttctggtgatcggccctcagaaaacggggaccacagctctgtatctttttttagttatgcacccatccatcctgtctaacagtccaagccctaagacatttgaggaagtctatggttttcttccctctccaatatag

SEQ ID NO: 44005 - DNA, 2619 bp, Artificial Sequence
  Description of Artificial Sequence: Synthetic coding sequence
atgaacctgatcgtgaagctgcggcggagcttccggaccctgatcgtgctcctggctacgttttgtctggtttctattgtgatcagtgcttacttcttatactccgggtacaagcaggagatgacgctgatcgagaccacagcagaagcagagtgcactgacattaagattctcccttaccggagcatggaactaaaaacagtcaaacctattgacacgtctaagacagatccgacagttctgctgttcgtagagagccagtatagccaactggggcaggacattatagctattctagaatctagtcgtttccagtatcatatggtgattgcccctgggaaaggagacatcccccctctaactgataatggcaagggaaaatacaccctagtgatctacgagaacatcctcaagtacgtgagcatggacagctggaaccgggaattgttggagaaatactgcgtcgaatattccgtgtcgatcattggcttccacaaggctaacgaaaactcccttccaagcacgcaattgaaaggcttccctctgaacctgtttaataatctggccctcaaagactgtttcgtgaacccccagtcgcccctattgcatattacaaaagctcccaaggtggagaagggcccactgccaggagaggactggacaatttttcaatacaatcacagtacctatcaacctgtgctgctcacggaactgcagacggagaagtcattgagttctctttcctctaaaactctgtttgccactgtgattcaagacctaggcttacatgacgggatccaacgtgtgctgtttgggaataatctcaacttctggctgcacaagctaatcttcatcgacgcaattagttttctaagcggcaaacgcttaacactgtccttagacagatatatcctggtggatattgatgatatttttgtcggcaaggaaggaacacggatgaacgtgaaagacgtgaaggctctactcgagacgcagaatttactccgtacacaggttgccaactttacctttaatctcggttttagcggcaagttctaccacacaggcacagaggaagaggacgaaggggatgatttgctcttgaggagtgtcgacgaattctggtggttccctcatatgtggtcccatatgcaacctcatctattccacaacgaatcttctctcgtggagcagatgatcttgaacaaagaattcgctttagagcacggaatacctatcaacatgggatatgccgtggcaccccaccatagcggcgtttacccagtccacattcagctgtatgccgcctggaagaaggtgtggggaattcaggtcaccagtactgaggagtacccccatctgaaaccggccaggtatcgaaaaggttttatccacaatagcataatggtgctgccacgccaaacatgcggcttattcacccatacaatattctacaaagaatatccaggtgggccccaggagctcgacaaatctataagaggtggcgaactctttctgaccatccttctcaatccaatcagtattttcatgactcacctaagtaactacggcaacgatcgccttggcctgtatacttttgtgaatttggtaaacttcgtacagtcgtggactaatctgaagctccagaccctgcccccggtccagttagcgcatcagtactttgagctttttccagaacaaaaagaccctctctggcagaatccttgtgatgataagaggcataaggacatctggtcaagggaaaagacttgcgatcacctccccaagtttctggtaatagggccacaaaagacgggtaccactgcactctacctgttcctgctgatgcatcccagcatcataagcaatctaccaagtcccaaaaccttcgaggaggtccaattcttcaatggaaataattatcataaagggattgattggtatatggatttcttccccacgccctcaaacaccacgtccgatttcctcttcgagaaaagtgccaattatttccattccgaggaagctcctagacgagccgccagcttggtgccgaaggcgaagatcatcactattctaattgatccatcagaccgtgcctattcctggtaccagcatcagagatcccacgaagacccagcggctttgagatttaatttctacgaagtcatctcgaccgggcattgggccccatccgatctcaagaccctgcaacgacgctgcctggtccctggttggtacgccgtccacatcgaacgatggttgacttacttcgcgacctcccagttactaattatagacggccagcagctgagaagtgatccagccactgtgatggatgaggtgcagaagttcctgggagtgaccccaaggtataattattcagaggccctgacctttgaccctcagaaaggcttttggtgtcagttactggagggcggtaagaccaagtgcctgggcaagtcaaaaggtagaaaatatccaccaatggaccctgaatctcggaccttcctgtcaaactattacagagaccacaacgtagagttatcaaaacttctgcacaggctgggtcagccattgccatcctggcttcgtcaagaactacagaaggtccggtag

SEQ ID NO: 44006 - DNA, 1635 bp, Artificial Sequence
  Description of Artificial Sequence: Synthetic coding sequence
atggccaccgcccccggccccgccggcatcgccatgggcagcgtgggtagcctgctggagagacaggattttagtccggaagagctgcgcgcagcacttgcaggctcaagaggatctaggcagcctgacggactgctccgtaagggcctcggccagcgggagttcctttcgtacctccacctgcccaagaaggacagtaaatcgacaaaaaatactaagcgagcaccccggaacgaacccgccgactatgctacactttattatagggagcattcaagagccggtgacttctcaaagacatctctgcccgagcgaggaaggttcgataaatgcagaattagaccatctgtttttaagcctaccgccggaaacggcaaaggcttcctgtccatgcagtcactggctagccacaaggggcagaaactgtggaggtctaacggctctctgcatactctcgcttgccaccctcctctttctccagggccgagggcctcgcaagccagggcccagcttctgcacgcattgtcacttgacgagggaggccctgaacctgaaccatcgttgtctgactcctccagtgggggctcattcggaagatctcctggcaccgggccttcaccgtttagtagctccttgggccacctgaaccatcttggcggctctttggacagagcatcacagggtcccaaggaggccgggccccccgccgtgctttcatgcctgcccgagccgccgccaccatacgaatttagctgctccagtgcagaggaaatgggcgcggtcctccccgagacctgtgaagagcttaagagagggcttggcgacgaagatgggagtaacccgtttacccaggtgctcgaagagagacagagactgtggttagctgagttaaagagactgtacgtcgagaggctgcatgaggtgacacagaaagctgaaaggtctgagcgcaatctccaactgcaactcttcatggcgcaacaggaacagcggcgcctcaggaaggagctgagagcacagcaggggctcgccccggagccgcgggcacctgggaccctgcctgaggccgaccctagtgctcgacctgaggaggaggctagatgggaagtgtgtcagaaaacggcagagatctcgcttctgaaacagcaactccgcgaagcacaagctgagttggctcagaaactcgccgagatatttagcttgaagacacagttgagaggcagtagggcacaggcccaggcccaggatgccgagttggtcaggcttagagaagccgtgcgatccctacaagagcaggcccctagagaagaggctccgggaagctgtgaaaccgatgactgcaaaagccgtgggctgttaggcgaagcaggcggtagcgaagctcgagatagcgcagagcagttacgcgctgagctgctccaggaacgtctgcgggggcaggaacaagcactgcgttttgagcaagagcgccgcacctggcaggaggaaaaggagagagtcttgcgataccagagggagatccagggtggatacatggatatgtacagaaggaatcaagcgttagaacaggagttgagggccttgagggagcctcctaccccatggtcccctcggttggagagcagtaagatttag

SEQ ID NO: 44007 - DNA, 939 bp, Artificial Sequence
  Description of Artificial Sequence: Synthetic coding sequence
atggccgcccagaagatcaacgagggcctggagcacctggccaaggccgagaaatacttgaagacaggctttctgaagtggaagccagactacgacagcgccgcaagcgaatacggcaaggctgcggtagcattcaagaatgcgaagcagtttgagcaggccaaggacgcttgcctgcgggaagctgttgctcacgagaacaatcgggcactgttccatgccgccaaagcctacgaacaggccggaatgatgttgaaggaaatgcagaaattgcctgaagccgtccaactgattgagaaggcttccatgatgtaccttgagaatggcactcccgataccgctgccatggcactcgaacgcgctggcaaattgattgagaatgtggaccccgaaaaggcggttcagttgtaccaacaaacggcaaatgtcttcgagaacgaagaacgcctgagacaggcagtcgaactccttggaaaggcatctcgactgctcgttcgcgggcgaaggttcgacgaagctgccttaagcattcagaaagagaaaaacatttataaagagatagagaactacccgacatgctacaagaagacaattgctcaggtcctcgttcatctccaccggaatgactatgtggcagctgagcgatgcgttcgggaaagctatagcatacccggatttaatggttctgaagattgcgctgccttggaacagctactcgaggggtacgatcagcaagaccaggatcaggttagtgatgtgtgcaacagccccttgttcaagtatatggataacgattacgcgaaattaggcctctccctcgtcgtgccaggaggaggaatcaagaaaaagtccccagcgaccccgcaggccaagcctgacggtgtgaccgccacagccgccgatgaagaggaggacgaatacagcggcggcttgtgttag

SEQ ID NO: 44008 - DNA, 693 bp, Artificial Sequence
  Description of Artificial Sequence: Synthetic coding sequence
atgatgctgaaggagatgcagaagctgcccgaggccgtgcagctgattgaaaaagcgtccatgatgtacctggagaatgggacccctgacacagcagccatggccttggagcgcgcaggcaagttgattgagaacgtcgaccccgagaaggcggttcagttgtaccagcaaactgctaacgtgttcgagaatgaagagcgcctgcgtcaggcagtcgaacttctaggaaaggcaagcaggcttttggtgcgagggagaaggtttgacgaggcggccctgagtatacagaaggagaaaaacatctataaagaaatcgagaactaccctacttgctacaagaaaactatcgctcaggttttagttcacttgcaccgtaatgactatgtcgcagccgagcggtgcgttagagagtcctactcaatccccggattcaatggtagcgaggattgtgccgcactcgagcaactgctggaaggatacgatcagcaggaccaagaccaggtttccgacgtgtgcaattctccactgttcaagtacatggacaatgattacgccaagctaggtctgagtttagtggtgcccgggggtggcatcaaaaagaaaagtcccgcaactccacaggctaaaccagacggtgtgaccgctacagcagccgacgaagaggaagatgagtatagcggcggtctctgttag

SEQ ID NO: 44009 - DNA, 1611 bp, Artificial Sequence
  Description of Artificial Sequence: Synthetic coding sequence
atgctgcacctgctggccctgttcctgcactgcctgcccctggcctccggagactacgatatctgcaagtcttgggttaccactgacgagggccctacttgggagttttatgcgtgccagcccaaggtaatgcgattaaaagattacgttaaggtaaaggtcgaaccctctgggattacttgtggagatccacccgaacgcttttgctcacacgagaacccgtacctctgctccaacgagtgcgacgccagtaatcctgacctggctcaccctccccgactgatgtttgacaaagaggaggagggactcgctacttattggcagagcatcacgtggtccagataccccagccctctcgaggccaatataaccctaagctggaataagactgtcgagctgaccgatgacgtggtgatgacctttgagtatggccgaccgactgtgatggtcctcgagaaaagcctcgataatggcaggacctggcaaccatatcaattttatgctgaggattgtatggaggccttcggaatgtcagcccgccgcgcccgagacatgagcagcagttccgcacaccgggtcctgtgcactgaagagtactctagatgggctgggtcaaagaaagaaaagcatgtgaggttcgaggtgcgagacagattcgctattttcgcgggaccagatctgcgaaatatggacaatctgtatacgaggttggaatccgccaaaggtttgaaagaattctttacactgaccgaccttcgcatgagactcctgcggcccgctctgggcggcacctacgtccagagggagaatctctataagtacttttatgctatctcaaacatagaagtcatcgggcggtgcaagtgtaatctgcacgcaaacctgtgcagtatgcgcgagggctctctccaatgcgaatgcgaacataacaccaccggtcccgattgtggaaaatgcaagaaaaacttccggactagatcctggcgggctgggtcttatctccccctccctcacggcagtcctaacgcatgtaccgcccccagcggcacctttagcaaagacgccttcctgcactgtgaatgctacggacatagcaaccgctgctcatacatcgatttcttaaacgtcgtcacatgtgtatcctgtaaacataatactcggggccaacattgccaacattgtcgtctgggctattatagaaatggttccgccgaactggacgatgagaatgtgtgtattgaatgtaactgcaatcaaataggaagcgtgcacgatagatgtaatgaaacaggcttctgcgagtgtagggaaggagcagccggccctaagtgcgacgattgtttacctactcactactggcgtcagggctgctaccctaacgtctgtgacgacgaccagctcctctgccaaaacggcggcacatgtctgcagaatcagagatgtgcctgtcccaggggatacactggggtccgctgcgagcagcctcgatgcgatcccgccgacgatgatggtggtttagattgcgacagagccccaggcgccgcccccaggcctgccacattactgggctgtctcctgctcctgggcctggcagccaggctggggcgttag

SEQ ID NO: 44010 - DNA, 1269 bp, Artificial Sequence
  Description of Artificial Sequence: Synthetic coding sequence
atgctgcacctgctggccctgttcctgcactgcctgcccctggccagcggtgactatgatatttgcaagtcttgggtgacgaccgatgaaggccctacttgggaattctacgcatgccagcctaaggttatgcgtctgaaagattatgtaaaagtcaaggtggagccttccggtatcacctgcggagaccccccggaacggttttgttctcacgagaatccctatctgtgctcgaacgagtgtgacgcttctaatcccgatctggcacatcctccccgcttgatgttcgacaaggaggaggagggtttggccacttattggcagagcataacgtggtcccggtacccatcccccctggaggctaatatcacgctgtcctggaataagaccgtggaactgaccgatgacgtcgtgatgaccttcgaatacggccgccctacggtaatggtcttggaaaagagccttgacaacgggcgaacatggcagccctatcagttctacgccgaggattgcatggaggcttttggcatgtccgcccgcagagccagagacatgagttccagtagtgcacacagggttctgtgtacggaggaatacagccgctgggccgggtcgaaaaaagaaaagcacgttagattcgaggtccgcgaccgctttgccattttcgccggccctgacctccgcaatatggataatctgtacactaggctcgaatcggccaaaggcctgaaagagttcttcactttaactgatttgcgcatgagactgctgagacccgcactggggggcacctacgttcagcgcgagaacctgtacaaatacttttacgcaatcagcaacatcgaggtaatcggtaggtgtaagtgcaatctccacgccaatctgtgttccatgagggaggggtccctgcagtgtgagtgcgaacacaataccaccggtcctgactgtggtaaatgcaaaaaaaatttccggacaaggtcatggagagccggatcgtacctgccgcttccacacggatctcccaacgcctgcgccacggcgggaagctttggtaccctgcagacccctccccctgggaggtcaccctctgccctccgaggctctcgtagggggttggctaacgtcaaggagccagccggatccagaccacagatctctgagatgctgcttggctgcacagtgacattacaccagggttcagtcggtccgcacatcccacctaaactttctcttcctgacccgggtggcccttggttaggatcccagtag

SEQ ID NO: 44011 - DNA, 1569 bp, Artificial Sequence
  Description of Artificial Sequence: Synthetic coding sequence
atgctgcacctgctggccctgttcctgcactgcctgcccctggcctctggtgactatgatatttgcaaaagttgggtaacgacagacgaggggcctacttgggagttctatgcgtgccagcctaaagtgatgcggctgaaggattacgtgaaagtgaaagtggaacccagcgggatcacatgtggagatcccccagaaagattctgcagccacgaaaacccatacttgtgctccaatgaatgcgacgcatccaatccggatctcgctcatccgccccgtctgatgttcgacaaggaagaagaaggtctcgctacctattggcagtctatcacctggagccggtacccgagccccctggaggcaaatatcactctatcatggaacaagactgtcgaattaactgacgacgtcgtgatgaccttcgagtacggaaggcccactgtgatggtacttgaaaaatccctggataatggccgtacgtggcaaccctatcagttctacgccgaggattgtatggaggctttcgggatgtcagcgcgccgggcccgggacatgagtagttcgagcgctcacagagtgctctgtacagaggaatacagccgctgggcaggatccaagaaggagaagcacgtgcgttttgaggtcagggaccggttcgctattttcgctggtccagatctgaggaacatggacaacctttacactaggcttgagtctgctaaaggattaaaagaattcttcaccctcacggaccttcggatgaggctactgaggccagcactcggaggcacctatgtgcagcgtgagaatctttacaagtatttttacgcgataagcaacattgaggttataggcagatgtaagtgcaacctccatgcaaacttgtgcagcatgcgcgaagggagcctgcaatgcgaatgcgagcacaataccacgggccccgactgcggcaaatgtaaaaaaaatttccgcactagatcgtggagggcgggcagctatctgcccctgccacatggcagcccaaatgcctattgcgaatgttatggacattccaatagatgcagctacattgatttcctgaacgtggtgacatgcgtgtcctgcaagcacaatacgcgcggacagcattgccagcattgtagattggggtattaccggaatggctcagccgaactagatgacgagaacgtttgtatcgagtgtaactgcaaccagattggcagcgtgcacgatcgctgcaacgaaaccggcttctgcgaatgtcgcgaaggagctgctggccccaagtgtgacgattgccttcccacccattactggagacaaggttgttatcctaacgtctgtgacgatgatcagctgctgtgtcagaacggtggtacttgcctgcagaatcagcgttgcgcctgcccgcgcggctataccggagtgcggtgcgagcagcccagatgtgatccggccgatgacgatggggggttggattgcgaccgggcaccaggcgctgccccaagaccagccacgttgctcggatgtttgctcctactgggcctggcggcaagactggggcgttag

SEQ ID NO: 44012 - DNA, 1593 bp, Artificial Sequence
  Description of Artificial Sequence: Synthetic coding sequence
atgctgcacctgctggccctgttcctgcactgcctgcccctggcctccggcgactatgacatctgtaaatcttgggtgaccacagacgaggggcctacttgggagttctatgcctgccaaccaaaggtcatgcggctgaaggactacgtgaaggtcaaagtcgagccatcagggataacctgtggggaccctcccgaaagattctgctcccacgagaacccatacctttgcagcaacgagtgcgatgcttccaacccagacctggcacatccccccaggctaatgttcgacaaagaagaagaaggactggccacctactggcagtctataacctggtcacggtacccatctcccctcgaggctaacatcacactttcttggaacaaaactgtcgaactcacagacgatgttgtaatgacgtttgagtacggcagacccactgttatggtactggaaaagtccctggacaacggacggacatggcagccttaccagttttacgccgaagactgcatggaagcctttggcatgagcgcacggagagcccgtgatatgagctcctctagcgcacaccgggtgctgtgtacagaagagtactctcgctgggccgggagcaaaaaggagaagcatgtgcggttcgaggttagggacagattcgcaatattcgccgggccggatctgaggaatatggataatctatacacccgtcttgagtccgccaaagggctcaaggagtttttcactctgacagacttgaggatgcggttactgcgccctgcactgggggggacatatgtacagcgggaaaacttatacaaatacttctatgccatcagcaacatcgaggtgattgggcgctgcaagtgtaatctccacgctaacctatgtagcatgcgcgagggctccttgcagtgcgagtgcgaacacaatacaacgggaccagattgcggaaaatgtaaaaaaaactttcggacacggtcatggcgggcaggaagttacctgcccctcccacatggctctccaaacgcatgcgccaccgccgggagtttcggcaattgtgagtgttacgggcactctaaccggtgctcctatatcgactttctcaacgtcgtgacctgtgtatcttgtaagcacaacacacgcgggcagcactgccaacactgccgactgggatactaccggaacggcagcgcagaattggatgatgaaaacgtatgcattgagtgcaattgcaaccagataggtagcgtgcatgataggtgcaatgagactggcttttgcgagtgccgcgaaggtgcagccggcccaaaatgcgacgattgtctcccaacccattactggcgccaaggatgttaccctaacgtgtgtgatgacgaccagttactgtgccaaaacggaggcacctgcctccagaatcagaggtgtgcgtgtcctcgcgggtatacaggggtgaggtgtgaacagccccgctgcgaccctgctgacgacgatggaggtctggattgcgatcgcgcccccggggccgcacccaggcctgccacactgctgggctgcttgttgctgctgggtctggcggccagactcggacggtag

SEQ ID NO: 44013 - DNA, 858 bp, Artificial Sequence
  Description of Artificial Sequence: Synthetic coding sequence
atggccgccgccagcgagcccgtggacagcggcgccctgtggggcctggaacgacccgagcctcccccgacacggttccacagagtccatggcgcaaatattcgggttgatccaagcggcacccgggcaacacgggtggaatctttcgcgcatggggtttgttttagtagagagccactcgctccaggccaggtattcctggtggagattgaggagaaggaattgggatggtgcgggcatctccgtctcggactgaccgctttggaccccgcatccttggctcccgtgcccgaatttagcctgccagacctagtgaatctggggcacacatgggtgtttgcgatcacccggcaccacaatcgggtgcctcgggagggacgcccagaggctgaggctgcggccccctctcgtccacccaccctgctggtggagccctacctgagaatcgaacagtttcggatccctcgggaccgacttgtgggacgttctcgcccaggtctttattcacacctgctcgatcagttgtatgagttaaacgtgctgccacccacagctcgaagatcccgcctgggcgtactcttttgcccacgacctgacggaacagcggatatgcatataattatcaacggcgaagatatgggtcccagcgcccgcggcctgcctgccgcgcaaccactttatgcggtggttgatgtattcgcatcgacgaagtccgtgcgactggtgcaactcgagtatgggctgccctcgctgcagaccctgtgccggctcgttatccagcggtcaatggtccaccgtctggctatagacggcctgcacctgcccaaagagctgaaggacttctgcaagtatgagtag

SEQ ID NO: 44014 - DNA, 441 bp, Artificial Sequence
  Description of Artificial Sequence: Synthetic coding sequence
atgagcagctgcagcaacgtgtgcggcagccggcaggcccaggccgcggcggaggggggctaccagcgatacggagttcgcagctatcttcaccagttctatgaagattgtacagccagtatctgggaatatgaggacgactttcagatacagcggtcccccaatcggtggagttctgtgttctggaagcaggagctcggcttccacacctcatctcattcgcaggaatggaatcggaagctccagcacaagaattgtccacgatgttgtttcggcagtctgagcccgcctggagaggcactcctgtgcaggcattgggactggccataccatccaaaagcacccggatgctccgctgaaccaggtggtgggcccttccagtcgattcccaccttgctgtgtggtccaaagcgtggctgctttgcgtctagtgaactgtag

SEQ ID NO: 44015 - DNA, 534 bp, Artificial Sequence
  Description of Artificial Sequence: Synthetic coding sequence
atgagcagctgcagcaacgtgtgcggcagccggcaggcccaggccgctgccgaaggaggataccagcgctacggcgtgcgtagctacctgcaccagttctacgaggattgtaccgctagtatctgggagtacgaggacgatttccaaattcagcgctccccaaatcgttggtccagtgtgttctggaaagttggccttatctctggcaccgtgtttgtgattctagggctaacagtcctggccgtgggctttttggttccccctaaaatcgaggctttcggggaagccgacttcgtagtggtcgatactcatgctgtacaattcaatagcgctttggacatgtataaattggccggcgcggtactgttctgcatcggaggaacttccatggccggatgcttgctgatgagcgtgttcgtgaaatcatattccaaggaggaaaaatttctgcaacaaaagttcaaagaacgcattgcagacattaaggctcacactcaaccggtcactaaggcacccgggacccccctgtcgtag

SEQ ID NO: 44016 - DNA, 441 bp, Artificial Sequence
  Description of Artificial Sequence: Synthetic coding sequence
atgagcagctgcagcaacgtgtgcggcagccggcaggcccaggccgccgccgagggcggataccagcggtacggagtgagatcatacctccatcagttttacgaggattgtacggcctctatatgggaatatgaggatgattttcagatacagaggagtccaaatcgttggagctcggtgttttggaaacaggaactagggtttcatacttcttcccattcccaggaatggaaccggaaactgcagcacaagaactgtcccaggtgctgtttcgggtccctgtcccccccgggcgaggctttgctgtgcaggcactgggattggccttaccaccctaaggccccagggtgttccgcagaacctggcggaggtcctttccagagtatacctaccttgctgtgcggacccaagaggggctgcttcgcgtccagcgagctttag

SEQ ID NO: 44017 - DNA, 588 bp, Artificial Sequence
  Description of Artificial Sequence: Synthetic coding sequence
atgagcagctgcagcaacgtgtgcggcagccggcaggcccaggccgctgccgaggggggctatcaaaggtacggggtccggtcctatctccatcagttttatgaggattgcacggcaagcatctgggagtacgaagacgatttccaaattcaaagatccccaaaccgatggtcaagcgtgttctggaaagtggggctaatctcaggaaccgtgttcgtgattctaggattgaccgttttggccgtgggcttcttggtgccccccaagatcgaggctttcggggaagcagattttgtcgtggtggatacccacgccgtccaattcaactccgctttagatatgtacaagttagccggcgccgtgcttttttgcatcggtggcaccagtatggctggttgccttttgatgtccgtgtttgtaaaaagctactctaaggaagaaaaatttctgcagcagaaattcaaagagcgaatcgcagacatcaaggcgcatacccagccagtcacaaaagcaccgggccctggggagactaaaatcccagttacacttagccgtgtacaaaacgtgcagcctctgctcgccacctag

SEQ ID NO: 44018 - DNA, 498 bp, Artificial Sequence
  Description of Artificial Sequence: Synthetic coding sequence
atgatgcggtgctgccggcggcggtgctgctgccggcagcccccccatgcactgcgcccgttgcttcttctgcctctggttctccttcctcccctcgcggccgctgcagcaggccctaatcgctgcgacacaatttatcagggtttcgcggagtgcctgattcgcttgggcgactccatgggcaggggaggtgagctggagaccatttgccgtagctggaacgattttcacgcttgcgcctcacaggtgctgtccggctgccccgaggaagccgctgcagtttgggagtccctgcagcaggaggcccgccaggccccccgtcctaacaatctgcacaccctgtgcggggcccctgtgcacgtgcgcgagagagggacaggaagtgaaaccaaccaggagacgcttcgagccactgctccagctctcccaatggcccccgcaccccccctgctcgctgcggcacttgctctcgcctacctgctccggcctctcgcctag

SEQ ID NO: 44019 - DNA, 2451 bp, Artificial Sequence
  Description of Artificial Sequence: Synthetic coding sequence
atgagccggccccagggcctgctgtggctgcccctgctgttcaccccggtgtgtgtgatgctcaatagcaacgttctgctgtggctgacagctctggccattaagtttaccctgatcgattctcaggcacagtatccagttgtcaatacgaattatggaaaaattcggggtctccggacacccctgcccaacgagattctgggaccggtagaacagtaccttggggtcccctacgcttccccgcccactggggagcgtaggtttcagccacccgaacccccatcctcctggacggggatcaggaataccacacagttcgcggccgtgtgcccacagcacctggacgagcgaagcttactgcacgacatgttgcctatctggtttaccgccaacctggataccctgatgacatacgttcaggaccagaatgaggattgcctttacctcaacatttatgttcctaccgaggatgacatccatgaccagaatagtaaaaagccggttatggtttacattcacggaggttcctatatggaagggactgggaatatgattgatggctctattcttgcctcatatggcaatgtgatagtgataactataaactacagactgggcatattggggtttctgagtacaggcgaccaagctgccaaaggaaactatgggttgctcgaccagattcaggctctgcgctggatcgaagagaacgtgggggcctttggcggtgaccctaaacgagttactatattcggtagtggggccggggcctcttgcgtgtcactcctcaccctatctcattattctgagggtctcttccagaaggcaattattcagtcaggtacggccctgtcaagttgggctgtcaactaccagcctgccaagtacacacgtatcctggccgataaggtaggatgtaatatgttggataccacagacatggtcgagtgcctccggaataagaactataaagaactcattcagcagaccattacacccgctacatatcacattgccttcggtcctgttatcgacggagatgtcatccctgatgacccacaaatacttatggaacaaggagagtttctgaattatgatatcatgcttggggtcaaccagggagaggggctgaaatttgtagacggcattgtggacaatgaggacggggtgacaccaaatgattttgactttagtgtcagtaactttgtggataacctgtatggctaccctgagggcaaagacactcttcgcgagacgatcaaattcatgtatactgactgggctgacaaggaaaacccagagacgcgacgcaaaaccctggtagctttattcacagatcatcaatgggttgcccccgccgtcgctacagctgatctacatgcccagtatgggtcccctacttatttctatgcattttatcatcattgtcagagtgagatgaagccctcttgggcagattctgcacacggagacgaggtcccctacgtgtttgggattccaatgatagggcctactgagctgttctcctgcaacttctctaagaacgatgtgatgctttctgccgtagttatgacgtattggaccaactttgccaagacaggtgatccaaatcagccagtgccccaggacacaaaatttatacatacgaagccaaaccgattcgaagaggtggcttggtctaagtacaatcctaaggatcagctctacctccacatagggctgaaacccagagtgagagaccactatagggctactaaagtcgctttctggctggaacttgttccccatttgcacaacctaaatgaaatctttcagtatgtgagcaccactaccaaagttcccccccctgatatgacgtcatttccatacggtaccaggagaagccccgcaaaaatctggcctaccacgaaaaggcccgctatcacaccagcaaacaatcctaaacattcaaaggacccccataagacaggccctgaagataccaccgtgctgatcgaaacgaagcgagactactccaccgagctgtccgtgaccattgcagtgggagcaagccttctttttctgaacatcttggcctttgccgcactatattataaaaaggacaagaggcgacacgaaactcaccgccggcccagccctcaaagaaataccaccaatgacatcgctcatatccaaaacgaagaaattatgtctctccagatgaagcagctagaacacgatcatgagtgcgaatccttacaggcccatgacaccctgagactaacatgtccccccgactacactctgaccctgaggaggagcccagatgatataccacttatgacccctaatacaataaccatgatccctaacacgttaacggggatgcagcccctccacacatttaatacgttcagcggggggcaaaactcaacaaatctcccacatgggcattctactacacgcgtatag

SEQ ID NO: 44020 - DNA, 2451 bp, Artificial Sequence
  Description of Artificial Sequence: Synthetic coding sequence
atgagccggccccagggcctgctgtggctgcccctgctgttcacccctgtctgtgtgatgctcaatagtaatgttctactttggcttacagccctagctattaagtttacgctcatagattcccaggctcagtaccctgttgtgaacaccaattacggaaaaatacgcgggctgcgaacccctttgccgaacgagattctgggtccagtagaacagtatctgggcgtgccctatgctagtccacctactggcgagagacgctttcagcccccagagccaccatccagttggacaggaatacgtaacacaacccagtttgccgcagtttgcccacagcatttggacgaaagatcgttacttcacgacatgctgcccatttggttcacagccaatctcgacacactcatgacctacgtccaggatcaaaacgaagactgcctctacttgaacatctatgtccctaccgaagatgacatccatgatcaaaactcaaaaaagcccgtaatggtgtacatccatggtggttcttacatggaaggtaccggcaatatgatcgacggctccatattggccagttatggcaacgtcattgtaatcactattaattaccggctgggaattctcggcttcctctccactggcgaccaggccgctaagggaaactacggcttgctggatcagatacaggccctgcgctggatagaggaaaatgtgggcgccttcgggggcgatccgaagcgggtgacaattttcggaagcggcgcaggggcttcatgtgtgtcacttctcaccctcagccactattccgagggactcttccagaaagctattatccagtccggaacggccttgagttcgtgggccgtaaattatcagcctgcaaagtacacacgcattctggctgataaggttggatgcaatatgctggatacaacggatatggtggaatgtttacgaaacaagaattacaaagagctgattcagcaaactattacccccgctacttaccacatcgccttcggccctgtgatcgacggtgacgtgattccagatgatcctcaaatcttgatggagcagggtgagtttttaaattacgacattatgctgggggtgaaccaaggcgagggattgaagttcgtcgatggcatcgtcgacaacgaggacggcgtgactccaaatgacttcgatttctcggtgtccaactttgtggataacctgtacggatacccggaagggaaggatacactaagagaaaccattaaattcatgtatacagattgggctgataaggaaaaccctgagactagaagaaagactcttgtagcactgtttactgatcaccagtgggtggcacctgctgtcgccacggctgatttgcacgcccaatacggttctccaacttatttttatgccttttatcatcactgtcagagcgagatgaagccatcttgggctgattccgcccacggagacgaagtcccctatgtgttcggaattccaatgatcggaccaaccgaattgttttcgtgtaacttttctaaaaatgatgttatgctgtccgcggtggtcatgacttattggacaaactttgcaaagacaggggatcctaaccagcctgtcccccaggataccaaattcatacataccaagcccaatcgctttgaggaagtggcctggtctaaatataatcctaaggaccagctttatctgcacattggcctcaagcctcgggtgagagaccattaccgtgccactaaagttgcgttctggcttgaactagtgccgcacctccataacctgaatgaaatcttccagtacgtgtcgaccactacgaaagtacctccacctgacatgacatcatttccctatggaaccaggcgctctcccgcaaagatatggcccactactaagagacctgccattacacccgccaacaatccaaagcactccaaggacccacataaaacaggccccgaggataccactgtgctgattgaaaccaagagggactacagcacagagctgtcagttaccattgccgtgggggcttcactgctttttctaaatattctggccttcgctgcattatactacaaaaaggataagaggcggcatgagacacacaggagaccctctccgcaaagaaacaccaccaatgatatcgcacatatccagaatgaggagatcatgtcactgcaaatgaaacagttggaacacgaccacgaatgcgagtccctgcaagcgcatgacaccctcagattgacatgtcccccagattatactctcacactacggaggagcccagatgatattcctctgatgacaccaaatacgataacaatgattccaaataccctcacaggaatgcagcctcttcacaccttcaacacattcagcggaggacagaattctacaaacttaccgcatggtcactccacaaccagggtttag

SEQ ID NO: 44021 - DNA, 2511 bp, Artificial Sequence
  Description of Artificial Sequence: Synthetic coding sequence
atgagccggccccagggcctgctgtggctgcccctgctgttcaccccggtctgtgtgatgctgaacagcaatgtactcctgtggctgaccgcattagcaattaagttcaccttgatcgacagccaggcccagtacccagttgtgaatactaattacggcaaaattcgaggactcagaaccccactgcccaatgaaatcctgggacccgtagaacaatatttaggagtcccgtatgccagccctcctacgggtgagcgcagatttcaaccccctgaaccgccctcctcttggacggggattcggaatactacgcagttcgccgccgtgtgcccgcagcatctggatgaacgctcacttttgcacgatatgttgcccatctggttcacggctaatttggacaccctcatgacttatgtgcaggaccaaaatgaagactgtctgtatttgaatatctacgtaccgaccgaagatggcgccaacaccaagaagaatgccgacgatattacctctaatgacagaggtgaagacgaagatatccatgatcagaactccaagaagcctgtgatggtgtacatccatggaggcagttatatggaggggacaggaaatatgatcgatggatccatcttggcttcctacggcaacgtcattgtgattacaatcaattacagactggggatcctggggtttctgtccacgggtgatcaggccgcaaaaggtaactacggtctcctggatcaaatccaggctttgcggtggattgaagagaatgtgggcgcctttggtggcgaccccaagcgcgtcaccatctttggcagcggggcaggcgcatcttgtgtctccctgctaaccttgtcacactattctgaaggactcttccaaaaagctatcatccaatcgggcacggctcttagctcctgggctgtaaattaccaacctgccaagtacacgcggatcctggctgataaggtgggatgcaatatgctggatacaactgacatggtagagtgcctgagaaataaaaactacaaagagctaattcagcagaccataacccctgctacatatcatattgctttcggacctgtaatagatggcgacgtgattccagatgatccccagatccttatggagcagggcgagtttctgaactacgacatcatgctcggagttaatcagggagaaggcctgaagtttgtggacggtattgtcgacaatgaagacggcgtcacgcccaacgatttcgatttcagcgtgagcaatttcgtggacaatttatatggctacccagaggggaaagacaccttacgagaaactatcaagtttatgtataccgattgggccgacaaggaaaacccggagactcggcgcaagacccttgttgccctgttcacggatcatcagtgggtcgcccctgcggtggctacggccgacctgcatgcccagtatgggtcgcccacatacttctacgcattctatcatcattgccagtcagagatgaagccctcttgggccgatagtgcccatggcgatgaggtcccgtatgtgtttggaatccctatgattggccctacagaattattcagttgcaattttagcaaaaacgacgttatgcttagcgcagtagtcatgacttattggaccaactttgctaagactggagaccctaatcagccagtacctcaggatactaagttcattcacaccaagcccaatcggttcgaagaggtggcatggtccaaatataatccaaaggatcagctgtatctccatatagggcttaagccccgcgtgagagatcattaccgggctaccaaggttgcattttggctggaactcgttccccatcttcacaacctcaacgaaatcttccagtacgtctcaactactactaaggttcctccaccggatatgacatcattcccctacggcacacgcagaagcccggcaaagatctggcccactacaaaacgcccagcaataactccggccaataatcctaagcattctaaggacccccacaaaacaggaccggaggacactacagttctgatcgaaacgaaaagggattattccacagaactgtctgtgacaatcgctgtcggagcctcgctgctgtttctgaatatcctcgcgtttgccgccctatactacaagaaggacaaaaggcgacacgagacccatagacgcccatcaccacagcgcaataccacgaatgacatcgcgcacattcagaatgaagagatcatgtccttgcaaatgaagcaactggagcacgaccacgaatgcgagtccctgcaagcccacgatacccttagattgacctgcccccccgactacaccttgactctaagaaggagtccagatgacattcctctcatgacaccaaacaccatcacaatgatcccaaataccctaacaggaatgcagccgcttcacactttcaatacctttagcggaggacaaaattccacgaacctcccacacgggcacagtaccactagagtctag

SEQ ID NO: 44022 - DNA, 2451 bp, Artificial Sequence
  Description of Artificial Sequence: Synthetic coding sequence
atgagccggccccagggcctgctgtggctgcccctgctgttcacccctgtgtgtgtcatgctgaactctaacgtcttattatggctcacagcgttggccatcaagttcacacttatcgattcccaggctcagtatcccgtcgtaaatacgaactacggcaagatacgcggtctgagaacccccctgcccaatgagatcctgggccccgtggagcagtatctcggggtgccttatgcttcgccccccacaggagaacgaaggttccagcctccagagccccctagcagttggaccggaatcagaaacaccacccagttcgccgccgtgtgtccccagcacctggacgaaaggtctctgctgcatgatatgctacccatttggttcacggcaaacctagacacactcatgacttatgtccaagatcagaacgaagactgcttgtatctgaatatttacgtcccaaccgaagacgatattcacgaccaaaacagtaaaaaacctgtgatggtgtacatccacggagggagctacatggaaggcacagggaacatgatcgacggtagtatcctggcctcttacgggaacgtcatcgtcattacaattaattatcgacttggtatcctcggttttctgtctaccggggatcaggctgcaaaagggaactacgggctcctggaccagattcaagctttaaggtggatagaggaaaatgtgggagcgttcgggggggatcccaaaagagtcacaatatttggatccggcgcaggagctagttgcgtgtctctactaacgctcagtcactactccgaggggttattccagaaggccataattcagtccggaacagccctgagtagttgggctgtgaattaccaacccgctaagtacacaaggatccttgccgacaaagtgggctgcaatatgctggacacgacagacatggtcgaatgtctgcgaaacaaaaactacaaggaattgatacagcagacaatcacccccgcgacctaccacattgcctttggccccgttatagatggcgacgtgattccagatgacccccaaatactgatggaacagggagaatttcttaattacgatattatgctgggcgtgaatcagggcgaggggttgaaattcgtcgatggtatagtcgataatgaggacggagtgactcccaacgatttcgactttagcgtgtcaaattttgtggataatctgtatggttacccagagggaaaagacacattaagagagactatcaagtttatgtatacagattgggccgataaggaaaaccctgaaacccgaaggaagacattagtggccttatttactgatcaccagtgggtggcccccgcggtggctacggctgacctccacgcgcagtacggcagccctacatatttttatgccttttaccaccattgtcaatccgaaatgaagccaagttgggcagacagtgcccacggcgatgaagtcccttatgtgtttgggattcctatgataggccctaccgagttatttagctgcaacttcagtaagaatgacgtaatgctgagcgccgtggtcatgacttactggactaactttgcgaaaactggtgatccaaatcaacccgtgccgcaggacactaagttcattcataccaagcctaacagattcgaggaagttgcttggtctaagtataaccccaaagatcagctgtacctccatatcggactcaaacccagggtgagggatcactaccgggccactaaggttgcattctggttagaacttgtgccccatcttcataatttgaacgagatttttcagtacgtgagtaccaccacgaaggtgccgcctcccgacatgacctcatttccttacggcaccagacgatcccctgcgaaaatatggccaaccacaaagaggcctgcgattacaccggctaacaaccctaagcactctaaggatcctcacaagacagggcccgaggacacaaccgtgctcatcgagactaagcgcgactactctacagagctgtcggtcactattgccgttggtgcctcactgctgttcttaaatattctggcattcgcagctctgtattacaagaaggacaaacgcagacacgaaacccatcggagacctagccctcagagaaatacaacaaacgacatcgcccatatccagaatgaggagatcatgtcactccagatgaaacagctcgaacacgaccacgagtgtgagagcctccaggcccacgatactctgcgcttaacttgcccaccagattacacactaaccctgagaagatctcccgacgatattcccctcatgacacccaacactataaccatgattccaaacacactaaccggaatgcagcctctccacacgttcaacaccttctctggagggcagaattcaactaatctgcctcacggacacagcactacaagggtttag

SEQ ID NO: 44023 - DNA, 2451 bp, Artificial Sequence
  Description of Artificial Sequence: Synthetic coding sequence
atgagccggccccagggcctgctgtggctgcccctgctgttcaccccagtctgcgtcatgcttaacagtaatgtcttactctggctcaccgcgctggccattaagttcacactcatagatagtcaggcacagtatcccgtcgtgaataccaattacggtaagatcaggggtctgcgcacacctctgcctaatgagattctcgggcctgtcgagcaatacctgggagtcccctacgcatcccctcctacgggcgagagaagattccagccccccgagcccccgtcaagctggacagggatcagaaatacgacccagttcgctgcagtgtgcccgcagcatttggacgaacgaagtctcctgcacgacatgcttcctatctggttcaccgccaacctagatacgctgatgacctatgtccaggatcagaatgaagattgtctttacctcaacatatatgtgcccactgaagacgacattcacgaccagaactctaagaagccagtgatggtgtacattcacggtggcagctatatggaagggactgggaacatgatcgatggaagcatactcgcctcctacggcaacgttattgtgattacaattaattaccgattgggcatcctaggtttcctctcaactggcgatcaagcagccaagggaaactacggtttgctcgaccagatacaagctctgcggtggatagaagagaatgtcggggcgtttggtggtgaccctaaaagggtgacaatattcggttccggcgctggagcgagctgtgtgtcactgcttactctcagtcattacagtgagggcctgtttcagaaggcaatcattcagtccgggactgccctgagttcgtgggctgtaaattaccagcctgcgaaatatacacgaattctcgctgataaagtcggctgcaacatgctggataccacagatatggtggagtgcctgcgtaacaagaactacaaggaactcattcaacagactattacccctgctacataccacatagcgtttggaccggtcatcgatggggacgtgattccagatgacccccagatcctaatggaacagggcgagttcttgaactacgatattatgctgggggtgaaccagggcgaagggcttaaattcgtcgatggtatagttgataacgaagacggagtcacaccaaacgattttgacttcagtgtgagcaatttcgtggacaatctgtacggctatcctgaggggaaagatacactgcgcgagactatcaaattcatgtacactgactgggcagataaagaaaacccggagactaggagaaagacactggttgccctgttcaccgaccaccaatgggtggccccagccgtcgcaaccgccgacttgcacgcacagtatggcagccctacctatttttacgcattttaccatcattgtcagagtgaaatgaagcccagctgggccgatagcgctcatggggatgaggtgccatacgtgtttgggatccccatgattggcccaactgagctgttctcctgcaatttcagcaaaaacgatgtcatgctgagcgccgtggtaatgacttactggactaacttcgccaagactggagacccgaatcaaccagtgccacaggacacgaagtttattcacacaaagcccaataggtttgaagaggtggcatggtcaaagtacaaccccaaggatcaactgtacctgcatattggactcaagcctagagtgcgcgaccattaccgagccacaaaagtggccttctggttggagctagtgccgcaccttcacaacctgaacgaaattttccagtacgttagcacaactacgaaggtgccaccgccggatatgacatcattcccctatggcacccgtcggtctccggctaagatttggccgacaaccaagaggccggctattaccccggcaaacaaccctaagcacagtaaggatccgcataagaccggtccagaggataccaccgtgctgatcgaaacgaagcgagactatagtaccgagctgtctgtcacaattgccgtgggagccagcctgttattcctgaatatcctcgcgtttgctgccctctactataaaaaggacaagcgccggcacgagacacaccgaaggccttccccccagcggaatacaaccaatgacatcgcccacattcagaatgaagagatcatgtcattgcagatgaagcagcttgagcatgaccacgagtgcgaatcacttcaagcacatgataccctgagattaacctgtccaccagattatacactgacactgcgccggagcccggacgatattccgttaatgacccctaacacaatcaccatgattcccaatacattaaccggaatgcagcccttacacaccttcaacaccttttcgggaggccagaactctacgaaccttccccacggccactccactacgagagtttag

SEQ ID NO: 44024 - DNA, 558 bp, Artificial Sequence
  Description of Artificial Sequence: Synthetic coding sequence
atggtgaagctgggcaacaacttcgccgagaagggcaccaagcagcccttgctggaggacgggtttgataccatccccctgatgacacccttggacgtcaaccagctccagtttccaccgccagataaggtcgtggtgaaaaccaagacagagtacgaacccgacaggaagaaaggaaaagcgagacctcctcaaatcgccgaattcactgttagtataacagagggcgtgaccgaaagattcaaggtcagcgtgcttgtcctctttgctctggccttcctgacctgtgtggttttccttgtagtgtataaagtgtataagtacgatcgcgcctgcccagacgggtttgtcctgaaaaacacccaatgtatcccggaaggcctggaaagttactacgccgaacaggacagttctgctagagagaaattctatacagtgatcaaccactataatctcgctaaacaatccatcacaagaagcgtgtcgccttggatgagcgttttgagcgaagagaagctcagcgaacaggaaaccgaggccgctgagaagtcggcatag

SEQ ID NO: 44025 - DNA, 558 bp, Artificial Sequence
  Description of Artificial Sequence: Synthetic coding sequence
atggtgaagctgggcaacaacttcgccgagaagggcaccaagcagccattgctggaggacggatttgacacaatcccactgatgacccccctggatgtcaaccaactccaattcccccctcctgacaaggtcgtagtaaaaacgaagacggagtatgaacccgacaggaaaaaggggaaggccagaccgccccagatagccgagtttaccgtatcaatcacggagggggtgacggagcgatttaaggtctctgtgctggtattgtttgccctggctttcctcacctgcgtggtgttcttagtcgtctacaaggtctataaatatgaccgggcctgtcctgatggattcgttttaaagaacacgcagtgcattcccgagggcctcgagtcatactacgctgaacaggactcctcagccagagaaaaattctacacggttattaaccactacaatctggcaaagcaatccattactcgaagtgtctctccttggatgtcggtgctctccgaagagaaactgtccgagcaggagacagaagctgccgagaaatctgcttag

SEQ ID NO: 44026 - DNA, 558 bp, Artificial Sequence
  Description of Artificial Sequence: Synthetic coding sequence
atggtgaagctgggcaacaacttcgccgagaagggcaccaagcagccactgctggaagacgggtttgatacaatccccttgatgacacccctggatgttaaccagttacagtttccaccacctgataaggttgtcgttaaaactaaaacagagtacgagccagatcgtaagaagggaaaagcgcggcccccacagatcgccgagtttaccgttagtatcaccgagggagtgaccgagcgatttaaggtgtctgtgctggtgcttttcgccctggctttcttaacctgcgttgttttcctggtcgtgtacaaagtgtataagtacgacagagcctgccccgacgggttcgttctgaaaaatacacagtgcattccggagggattagagagttattacgctgaacaggattcatcagcacgggaaaagttctacacagtcattaatcactacaatcttgcaaagcagtccattacgcgatccgtgtcaccctggatgagtgtgttgagtgaagagaagctgtcggagcaagaaaccgaagctgccgaaaaatctgcttag

SEQ ID NO: 44027 - DNA, 441 bp, Artificial Sequence
  Description of Artificial Sequence: Synthetic coding sequence
atggtgaagctgggcaacaacttcgccgagaagggcaccaagcagcccctcctcgaagatgggttcgataccatacctctgatgacgccattagatgtcaatcaacttcagttcccgcccccagacaaggtcagcgtcctggttctgttcgctctggcctttttgacctgcgtcgtgttcctggttgtctataaggtttataagtatgaccgcgcctgcccggacgggttcgtcctgaaaaatactcagtgtatccctgagggtcttgaaagttattatgccgagcaggacagtagcgcaagggagaagttttatacggttattaaccactataacctggcaaaacagtccattacacgaagcgtttctccatggatgtcagtgctgtccgaagaaaaattatctgagcaggagacagaggcggctgaaaagagcgcttag

SEQ ID NO: 44028 - DNA, 558 bp, Artificial Sequence
  Description of Artificial Sequence: Synthetic coding sequence
atggtgaagctgggcaacaacttcgccgagaagggcaccaagcagcctctgctggaggatggctttgatacgatacctcttatgacacccctggacgtgaatcaattgcagttcccacctcctgacaaagtcgtagttaaaacaaagacggaatacgagccagatcgaaaaaaagggaaggcacgacccccccagatcgcggagttcacagtctcaattaccgagggggtcacggagaggtttaaagtgagcgttctggtgctgtttgccctcgcatttcttacgtgtgtggtgttcctggtggtgtacaaagtatacaagtacgatcgtgcttgccccgacggtttcgttctgaaaaacacacaatgtataccagaaggtttagagagttactacgcggaacaggactccagtgccagggaaaagttttacactgtgattaaccattacaacctggcgaaacagagcatcacccgctctgtgtcaccctggatgtccgtgctcagtgaagaaaaactcagcgaacaggaaacagaagctgcggagaaaagtgcctag

SEQ ID NO: 44029 - DNA, 558 bp, Artificial Sequence
  Description of Artificial Sequence: Synthetic coding sequence
atggtgaagctgggcaacaacttcgccgagaagggcaccaagcagccgctcctcgaggacggtttcgacaccatcccacttatgacaccccttgacgtcaaccagcttcagttccctccacctgataaggtagttgtgaagaccaagaccgaatatgagccagaccgtaagaaagggaaggcacgccctccacagattgctgagttcactgttagcattacggaaggcgtgaccgagagatttaaagtttcggtactcgtcctcttcgccctcgcatttctcacatgtgttgtatttctcgttgtctacaaggtgtacaaatacgacagagcctgtcccgatggcttcgtgctgaagaatactcagtgtatccctgaaggtctagaatcatactacgcagagcaagattcatcagcaagagagaaattctatactgtaataaaccactataacctggccaagcagagcattacaaggagcgtatcaccgtggatgtcagttctgtctgaggaaaagctcagcgagcaagagacagaggctgctgagaaatccgcctag

SEQ ID NO: 44030 - DNA, 558 bp, Artificial Sequence
  Description of Artificial Sequence: Synthetic coding sequence
atggtgaagctgggcaacaacttcgccgagaagggcaccaagcagcctcttctggaggatggctttgacactattccactcatgacacccttggatgttaatcagctccaattcccacctcccgacaaagtggtagtcaagactaagacagagtatgagcccgatcggaaaaagggtaaggctcggccccctcagatagccgagttcaccgtcagcataacagaaggcgtcacagagcggttcaaggtgtcagtgctggtgctcttcgcgctggccttcctgacatgtgtcgtgtttctcgtcgtgtacaaggtttacaaatacgatagggcatgccccgatggattcgtgctcaagaatacacagtgtattcccgaaggactggagagctattacgccgaacaggactcttccgccagagagaagttctataccgtgattaatcactataaccttgctaagcagagcatcaccagaagcgtttctccatggatgtctgtgctgagtgaggagaagttgagcgaacaggagacagaagcagccgagaaaagtgcctag

SEQ ID NO: 44031 - DNA, 558 bp, Artificial Sequence
  Description of Artificial Sequence: Synthetic coding sequence
atggtgaagctgggcaacaacttcgccgagaagggcaccaagcagccgctgcttgaggacggatttgacacaatcccccttatgacgccgctcgacgtcaatcagctccagtttcctcctccagacaaagtcgtcgttaagactaagacagagtacgaaccggatcggaagaaagggaaggcccgccccccccagatagctgaatttactgtcagcatcacggaaggggtgacggaaagattcaaagtgagtgtactggtgctctttgctttggcattccttacctgcgtggtttttctggtagtctataaggtatataaatatgacagggcctgcccagacggctttgtgcttaagaacacccaatgcatcccagaaggtctggagagctattacgccgaacaggactcgtccgccagagagaaattttataccgttatcaaccactacaacctggcaaagcaatctatcacaaggtccgtgtccccatggatgtccgtgcttagcgaggagaagctatcagaacaggagacagaagcagccgagaagagcgcatag

SEQ ID NO: 44032 - DNA, 516 bp, Artificial Sequence
  Description of Artificial Sequence: Synthetic coding sequence
atggtgaagctgaacagcaaccccagcgagaagggcaccaagcccccctccgtggaagatggcttccaaaccgtgccactgattacccccctggaggtgaaccacttacaactgcccgccccggagaaggtgatcgtgaagaccagaaccgagtaccagccagaacagaagaacaagggcaaattccgagttccgaagatcgctgagtttacagtgactatccttgtgtcactggccctggcattccttgcctgcatcgtattcctggtggtctacaaagcattcacttacgatcactcctgcccagagggctttgtgtataagcataaacgatgcattcccgcgtccttggatgcttactacagcagccaggacccaaactccagatctcgattttacactgtcatcagtcattactccgtggcaaagcaaagtactgcaagagcaattggaccatggctctccgccgcagccgttattcacgaacccaagccaccaaagacacagggccattag

SEQ ID NO: 44033 - DNA, 516 bp, Artificial Sequence
  Description of Artificial Sequence: Synthetic coding sequence
atggtgaagctgaacagcaaccccagcgagaagggcaccaagcccccctcagtcgaggatggttttcaaacggtgcccttaatcacccccctggaggtgaaccatcttcagctgcccgcacctgaaaaagtcatagtcaagacgcggaccgagtaccaacccgagcagaaaaacaagggtaaatttcgggtccccaaaattgctgaattcaccgtaaccatcttagtttcactggcactcgcctttctggcatgtatcgtatttcttgtggtttataaggcgtttacgtatgaccattcttgtccagagggttttgtatataagcataaaaggtgtatcccggcatcgctggatgcgtactactccagtcaggaccccaactctcgcagcaggttttacaccgttatctcccactactcggtggccaaacagtctactgctcgggccatcgggccctggttaagcgctgcggcggtgattcacgaaccaaaacctcctaaaacccaaggacattag

SEQ ID NO: 44034 - DNA, 441 bp, Artificial Sequence
  Description of Artificial Sequence: Synthetic coding sequence
atggtgaagctgaacagcaaccccagcgagaagggcaccaagcccccaagcgtcgaggacgggtttcagactgtcccacttattactccattggaagtcaatcatttacagttgcctgcccccgaaaaagtgattgtgaaaacgaggaccgagtatcagcccgagcagaaaaacaagggcaaattccgggtacccaaaatcgcagagtttaccgtaacgatccttgtgagtttggctttggcttttctcgcttgtattgtgttcctggtggtgtataaggcttttacttacgaccatagctgccccgaaggtttcgtatacaaacataagagatgcatccctgccagcctagatgcttattattcctcgcaggaccccaactctcgtagccgcttttacaccgtgattagccactacagcgtggccaaacaatccacctag

SEQ ID NO: 44035 - DNA, 480 bp, Artificial Sequence
  Description of Artificial Sequence: Synthetic coding sequence
atggtgaagctgaacagcaaccccagcgagaagggcaccaagccccccagtgttgaggatggttttcagacggtgccgttaattacaccattggaggtgaaccacctgcagctaccagcccctgagaaggtgatcgtaaagacacgcacggagtaccagcctgagcagaaaaataaggggaaattccgggtgccaaagattgctgagtttactgtcaccattcttgtctcgctggctttagccttcctagcctgtatcgttttcctggtggtgtacaaggcctttacatacgaccactcttgcccagaaggcttcgtttacaagcataagcgatgtattccagcctcgctggacgcctactattcttcacaagaccccaatagccggtcccgcttctatacggtcattagccactactccgtggccaagcaatctactgcacgtgctatagggccatggctcagtgccgctgccgtatag

SEQ ID NO: 44036 - DNA, 1293 bp, Artificial Sequence
  Description of Artificial Sequence: Synthetic coding sequence
atggagggcgagcccagccagccccccaacagcagctggcccctgagtcagaacggtacaaacacagaggctactcccgctactaatcttacctttagctcctactaccagcatacttcacccgttgctgcgatgtttattgttgcctacgccctaatttttctgctgtgcatggtgggcaataccctggtttgctttatcgttctgaagaatcggcatatgcacactgttactaatatgtttattctcaatctggcggtctcagacctcctggtgggcattttctgtatgcccacaacgcttgttgacaacctgatcactggctggcctttcgacaacgcaacatgcaaaatgtctggcctggtacagggcatgtctgtatccgcctctgtcttcactctcgttgccatagccgtggaacggttccgctgtatagtacatccattcagagagaagctcaccctgagaaaggctctcgtcactattgccgttatttgggccctggctctactgatcatgtgcccctctgcagtgacactgacagttaccagagaggaacaccacttcatggtagacgccagaaatagaagctatccactgtactcatgttgggaggcttggcccgagaagggtatgcgcagagtgtatactacagttcttttttctcacatatacctggcacctctggcattgatagtggtgatgtatgcccgcattgcacgcaagttgtgccaggctcccgggcctgctcctgggggtgaggaagccgcggatccgcgtgctagtagaagaagagcacgcgttgtgcatatgctcgtgatggtggcactgtttttcacactttcctggttacccctgtgggccctacttctactgatcgattacggacagctgagcgctcctcagcttcacctagtcaccgtgtatgctttcccttttgctcattggcttgctttctttaacagttcagccaatcctattatttatggatattttaacgagaatttcagacgcggattccaggctgcattccgggcacgcttatgtccaaggccatctggaagccataaagaagcgtactcagaacgtccaggcggattactgcacagaagggtgttcgtcgtggttcgtccatcggatagcgggctgccatccgagtcaggccccagctcaggggcaccgagaccaggtcgtcttccgctgcgaaacggcagggtcgctcaccatggactgccccgggagggacccgggtgcagccatctgcccttgactattccagcatgggacatttag

SEQ ID NO: 44037 - DNA, 1287 bp, Artificial Sequence
  Description of Artificial Sequence: Synthetic coding sequence
ggcgagcccagccagccccccaacagcagctggcccctgagccagaatgggaccaacacagaagccaccccagccactaacctcactttcagttcttactaccagcataccagccccgttgcagcaatgttcattgtcgcttacgctctcatcttcctgctgtgtatggtcggcaatactctggtgtgctttattgttctaaagaataggcacatgcacacagtgaccaacatgttcatcctgaacctcgcagtttccgatctcttagtgggaatcttctgcatgcctaccaccctggtcgataatcttatcactggctggcctttcgataatgccacgtgcaagatgtccgggcttgtccaggggatgtctgtgagcgccagtgtgtttaccctggttgccattgccgtcgaaagatttcgatgtattgtccatccatttcgtgagaagctcaccctccgtaaagctttagtgacaatcgctgtgatatgggctcttgccctcctcattatgtgccccagtgctgtgaccctcactgtcacaagggaagagcatcacttcatggtcgatgcacgaaaccggtcctaccctctgtactcgtgctgggaagcatggccagagaaaggtatgcggcgggtgtacactaccgtgctattcagccatatctatctggcaccactcgccttgattgttgtcatgtacgcacgcattgccagaaaattgtgtcaagcacctggacccgctcccggcggcgaagaagccgccgaccccagggcgagcagaagaagagcacgggtcgtgcacatgctagtgatggttgccctgttctttacactgagctggcttcccttgtgggcgttactattattgattgattatggtcaactgagcgccccgcagttgcatttggtaacagtttacgccttcccctttgcgcattggttagcgttcttcaattcatccgctaatcctatcatctacgggtacttcaatgaaaacttccgccggggctttcaagcagcttttcgggcccgtctttgtcctcgaccctctggttctcacaaagaggcctacagcgagcgccctgggggcctgctccatagaagagtatttgttgtagtacgacctagtgactcaggcttaccttctgagtcaggcccaagcagtggggcgcctaggccgggcaggcttcccctgcggaatggccgggtagcccatcatggtctgcctagagaggggcccggctgctctcacctgcccctcacaatcccggcctgggacatttag

SEQ ID NO: 44038 - DNA, 1569 bp, Artificial Sequence
  Description of Artificial Sequence: Synthetic coding sequence
atgaacagcttcttcggcacccccgccgccagctggtgcctgctggaaagcgacgtctcatcagcccctgacaaggaggctggccgtgagagaagagctctgtcagtgcagcagcgtgggggacccgcgtggtctggcagtttggagtggagtagacagagtgctggagacaggagacgcctgggcctgagccgccaaactgctaagtcctcttggagcagaagtcgcgaccggacttgttgctgcaggagagcttggtggatccttgtccccgctgctgaccgcgcgcggcgcgaaagatttatcatgaatgaaaaatgggatactaactcctccgagaattggcacccaatttggaatgtgaacgatacaaagcaccacctctacagtgatattaatatcacgtatgtaaactactacctacaccaaccccaggtcgctgctatcttcattatatcatattttctaatcttttttctttgcatgatgggcaataccgttgtgtgctttattgtcatgcggaataaacatatgcatacggtgacaaacctgtttattctcaacttggccatctccgaccttcttgtgggaatattttgcatgccaattactctgctcgataatattatcgcaggctggccttttggaaacactatgtgcaaaataagcgggctggtgcaaggcatcagtgttgccgcgagcgtcttcacattggtggcgatcgccgtggaccggtttcaatgtgtagtgtacccttttaagcctaaactcacaatcaagacggccttcgtcataattatgatcatctgggtgctagctataacaataatgtcaccaagtgcagttatgctgcacgtgcaagaagagaaatattaccgagtgagactgaacagccagaataagacctcaccagtgtattggtgccgcgaggactggcctaaccaggaaatgagaaagatctacaccaccgtgttattcgctaacatatacctcgctccattgtctctaatagtgattatgtatgggcgcatcggaattagtctcttcagggcagccgtgccacataccggaagaaaaaaccaggaacaatggcatgtcgtgtcccggaagaagcaaaagatcataaagatgctcctgattgtcgccctgctattcattctgtcttggctgcctctgtggactttaatgatgctgtccgattacgcagaccttagccccaacgaactacagattatcaacatctatatctatccattcgcccactggttggcctttgggaattcctcggttaatcccatcatttacggttttttcaatgagaattttagaaggggcttccaggaggcgttccagttgcagctctgccaaaaacgagccaaaccgatggaagcttacgccttgaaggccaaaagccatgtccttattaacacgagcaatcagctggtacaggagagcacgttccagaaccctcacggagaaacactgttgtatcgcaaatccgccgagaagccgcagcaggagctggtgatggaggagcttaaggaaactaccaactcctctgagatctag

SEQ ID NO: 44039 - DNA, 399 bp, Artificial Sequence
  Description of Artificial Sequence: Synthetic coding sequence
atgaacagcttcttcggcacccccgccgccagctggtgcctgctggaatctgatgtctcgagcgcccctgacaaagaagctggaagggaaaggagggcgctgtccgtccaacagaggggaggtccagcctggtctggaagcctggaatggtcgcgccagtcagctggcgacagaaggcgacttggacttagtaggcaaactgccaagagctcatggtctagaagcagagatcgtacttgctgttgccgccgcgcctggtggattttggtccccgctgccgatagggcccggcgggagcgcatggccatctggaaacacgatgtacaggatcagtggattggtccaggtaatatttgtcgatctttctctctgtatgtaagctgcaactgctgcagatag

SEQ ID NO: 44040 - DNA, 1263 bp, Artificial Sequence
  Description of Artificial Sequence: Synthetic coding sequence
atgaacgagaagtgggacaccaacagcagcgagaactggcaccccatttggaacgtgaacgataccaagcaccatctgtactctgatattaacatcacttacgtgaactactatctacaccagccccaagtcgccgccattttcataatctcgtactttctcatcttctttctgtgtatgatggggaatacagtggtgtgttttatcgttatgcgcaataaacacatgcacaccgtaacaaatctgttcatattgaacctggccatctccgatctcctcgtcggtatcttttgtatgcccataacccttctggacaatatcattgcaggatggcctttcggtaatacaatgtgtaaaatttctgggctggtgcagggcatctccgtggcggccagcgttttcacactggtggccattgcagtcgatcgctttcagtgcgtggtctaccccttcaaacccaaactcactattaagaccgctttcgtgatcatcatgattatttgggtgcttgctatcacaataatgtccccttcggctgtgatgctgcatgttcaggaggagaaatactatagagtcagactgaactctcagaataagacatcacctgtctactggtgtcgggaagactggccaaaccaagagatgcggaagatctacacaacagtactctttgccaacatttacctcgcccctctttctttgatagttatcatgtatggccgaattggcatcagcctgttccgggcagccgtacctcatactggacgaaagaatcaggaacagtggcacgtcgtgtcccgcaagaagcagaaaatcatcaagatgctgctgatagtggctcttttgtttattctgtcatggctccctctgtggaccctcatgatgctttcagattacgcagacttatctccaaacgagttacagattattaacatttatatatacccctttgcccattggctcgcatttgggaatagcagtgtgaaccctataatctacggtttctttaacgaaaacttcaggcgggggttccaggaggcttttcagctgcagctgtgtcaaaaacgagcaaagcctatggaagcatatgcacttaaggctaaaagccacgtcctcatcaatacttctaaccagctggtgcaggagtctacattccagaatcctcatggcgagacactcctgtaccgcaagtccgccgaaaaaccacagcaggagctggtgatggaagagctcaaggaaaccacaaactcctcggaaatctag

SEQ ID NO: 44041 - DNA, 1272 bp, Artificial Sequence
  Description of Artificial Sequence: Synthetic coding sequence
atgttcatcatgaacgagaagtgggacaccaacagcagcgagaactggcatccaatctggaacgtcaacgacacgaagcatcatctgtattcagatatcaacattacctatgtcaactattatctgcaccaaccccaagttgccgccatctttatcatttcctatttcctcattttttttctctgcatgatgggcaataccgtcgtctgctttatcgtcatgagaaacaaacatatgcacaccgtgacaaacctgttcatccttaatttggcaatatctgacctgttggtgggaattttctgcatgccaatcaccctcctagacaatataatcgcaggctggcctttcggaaatacaatgtgtaaaatctctggactagtgcagggaatctccgttgcggcctctgtctttaccttagtggccattgcggttgatcggttccagtgtgtcgtgtacccattcaagcccaagctgaccataaagaccgcatttgtgatcattatgatcatctgggtgctggctattactatcatgagcccatcagccgtgatgctccacgtgcaggaagagaagtattacagggtgaggctgaattcacaaaataaaacctcaccagtttactggtgtcgtgaggactggcccaaccaagaaatgagaaaaatttatacgaccgttctgtttgccaacatttacctggcccccctgtcactgattgtgatcatgtatggccgcattgggatcagcctgttccgcgccgctgtgccgcacacagggcgcaaaaaccaggagcagtggcatgtcgtgagccgcaagaaacagaagatcataaagatgttacttatagttgcgctgctgtttatcctgtcatggctccccctctggacattaatgatgttatcagattacgctgacctgtcccccaatgaactgcagatcattaatatctacatctacccatttgcccattggctggccttcggaaattcttcagtgaaccccattatttacggcttttttaacgagaatttccgtcgggggtttcaggaagctttccagctacaattatgtcagaaaagggctaaaccaatggaggcttacgcattgaaggccaagagtcacgtgctgatcaacaccagtaatcagctggtgcaagaaagtacatttcagaacccccacggggagacactcctataccgtaaatccgccgagaaacctcagcaggagctagtaatggaggaactgaaagaaactaccaattcaagcgaaatctag

SEQ ID NO: 44042 - DNA, 1002 bp, Artificial Sequence
  Description of Artificial Sequence: Synthetic coding sequence
atgcaggccgccggccaccccgagcccctggacagccggggcagcttcagcctgccgaccatgggcgccaacgtgtcccaggacaacggcaccggccataatgcaacatttagtgagcccctgccattcctatacgttcttctgcccgctgtgtatagcggcatttgcgcggtaggactcactggcaacactgccgtgatactggtgattcttagggcccccaagatgaagactgtcaccaatgttttcatcctcaacttagctgtagcagatggcctcttcacactggtgctgcccgtgaatatcgctgagcacctgcttcaatactggccttttggagagctgttgtgcaaactcgtactcgctgtagaccattacaacatttttagctcgatatacttcctggcagtaatgagtgtcgatcgttatttggtcgtcctggcaaccgtacggtcaagacacatgccgtggcgcacctatcgaggcgccaaagtggcttccttatgtgtctggctgggggttactgtgcttgttttacccttcttctcattcgcaggcgtgtattctaatgaactccaagttccctcgtgcggactatcctttccctggccagagcaggtctggttcaaagcatctcgcgtttatactctggtactgggctttgtcttgcccgtgtgcaccatatgtgtcctctatacagacctgctccgccgtttacgcgccgtccgactgaggtccggtgccaaagccctaggaaaagcaagacgaaaagttacagtgcttgtgcttgtggtgctggctgtgtgcttgctgtgctggactccatttcacctggcgtcagtggtcgcactcacgactgatcttccccagaccccgcttgtgatctccatgtcatacgtaattactagtctcagctacgccaactcctgcttaaaccccttcctatatgcttttctggatgataatttcagaaagaactttcgcagtattttgaggtgctag

SEQ ID NO: 44043 - DNA, 1578 bp, Artificial Sequence
  Description of Artificial Sequence: Synthetic coding sequence
atggccctggagcggctgtgcagcgtgctgaaggtgctgctgatcacagtgctggtggtggaggggatagcagttgcacagaagacccaggacggccagaacattgggattaaacacatccctgccacacagtgcggcatatgggtcagaacatctaatggagggcactttgcgtcgcctaactacccagacagttacccacctaacaaggaatgtatatatatactggaagctgcaccccgccaacgaatcgagttaactttcgatgaacactactacatagagccaagcttcgagtgcagatttgaccatctagaagtccgggatggaccattcgggttctcgccgctgatcgaccgttattgcggtgtgaaatctccccccctgatccgatccaccggccggtttatgtggatcaagttctcaagtgatgaggagcttgaaggattaggatttcgcgctaaatactcttttatcccagatccagatttcacatatttgggcggtattctaaaccctatacccgattgtcaatttgaactgagcggcgctgacgggatcgtgcgtagcagtcaagtggaacaggaggagaagactaagccggggcaggccgtcgattgtatttggacgatcaaggcgacccctaaagccaaaatctatctcagatttctggattaccagatggagcacagtaatgagtgcaagcggaattttgtcgcagtgtacgacggctcctcgagcattgagaatttgaaagctaaattttgctccacagttgcgaacgatgtcatgctaaaaaccggcattggcgtcatccggatgtgggccgacgaggggagtcgcctgagccggttccgcatgctctttacctcattcgtggaacctccatgcacctcttccacttttttttgtcactccaatatgtgtatcaacaatagcctagtatgcaacggtgtccaaaactgcgcgtacccttgggacgagaaccattgtaaggaaaaaaaaaaggcaggtgtgttcgaacagatcacaaagactcacggtactattatcggcataacgtctggaatcgtcttggttctactgatcatctccatactggtacaagttaagcaacccagaaagaaggtgatggcctgtaagaccgcattcaacaaaacaggcttccaggaggtgtttgatccaccccattatgagttattctccctgcgcgacaaggagatttccgccgatctggccgatttatctgaagaactggacaattaccagaagatgcgccgttcctccacagcttcacggtgtattcatgaccaccattgtggttctcaagcgtcttccgtcaagcagagccggaccaacctgtcctctatggagctcccctttagaaatgattttgcacaaccccaaccaatgaagactttcaactccaccttcaaaaaatctagttatacatttaagcaaggacacgaatgtccggagcaggccctcgaagacagagttatggaggaaattccctgcgagatctacgtgcgaggaagggaagacagtgcacaagctagcatttctatcgacttttag

SEQ ID NO: 44044 - DNA, 1578 bp, Artificial Sequence
  Description of Artificial Sequence: Synthetic coding sequence
atggccctggagcggctgtgcagcgtgctgaaggtgctgctgatcaccgtgctggtggttgaaggcattgctgttgcccagaagacccaggacggacagaacatcggtataaagcacatccctgcaacccagtgtggaatttgggtaagaacctctaacggagggcactttgcatctccaaactatccagacagctacccccccaacaaggaatgtatttatatcctcgaggcagctccccggcaaagaattgagctgacgtttgacgaacactactacatcgagccgagtttcgagtgcagatttgatcacctggaggtgcgagacggccccttcggcttctcgccactcatcgaccgctactgtggggtgaagtccccgccattgatccggagcactggaaggtttatgtggataaagtttagctccgatgaagaactggagggcctggggttcagagcaaagtactcttttatcccagacccagactttacatacttaggtggcattctgaaccctatccctgactgccagttcgagctttcaggagctgacggaattgttcgctcttcccaagtggaacaagaggaaaaaaccaaaccagggcaggccgtggactgtatctggacgattaaggcaacccctaaggccaaaatctacctccgattcctggactatcaaatggagcattcaaatgagtgcaaacgaaacttcgtcgctgtttacgatggatcttcatcgattgaaaacctcaaggcgaagttctgttcaacggtcgcgaacgacgttatgctaaaaaccggcattggtgtgataagaatgtgggccgacgagggcagtagactctctagatttagaatgctcttcaccagttttgtcgaacctccttgtacaagttccacattcttttgccacagcaacatgtgtatcaataactccctggtatgcaatggggtgcaaaattgcgcttatccttgggatgaaaatcattgcaaggagaagaagaaggctggagtgttcgagcagatcactaagactcacggcactatcattgggatcacctcggggattgtgctggtgctgcttataataagcatcttggtccaagtgaaacaaccacgaaaaaaagtgatggcctgcaaaactgcttttaataaaactggtttccaggaggtatttgaccctccacactatgagctcttttcgctacgggacaaggagatttcggccgatctggccgacctgagcgaagaactggacaactaccaaaaaatgcggcgatcaagcacagcttctaggtgtatccacgaccatcattgcggctctcaggcgtcaagtgtcaagcagtcccgaaccaatttatccagtatggaattaccttttcgcaatgatttcgcccagccccagccgatgaagacttttaattccacgtttaaaaaatcttcctacactttcaaacagggacacgaatgccctgagcaggctctcgaggatagggtgatggaggaaataccatgtgagatctacgttcgaggtcgggaggactctgctcaggcatcaatttccatagacttttag

SEQ ID NO: 44045 - DNA, 1233 bp, Artificial Sequence
  Description of Artificial Sequence: Synthetic coding sequence
atggagaccagcagcccccggcccccccggcccagcagcaaccccgggctgagtttggacgctcgtttgggagtggacactagattgtgggccaaggtgcttttcacggccttgtacgccctcatctgggccttaggcgcagcggggaatgccctgtccgcacacgtggtcctgaaggcccgagcgggacgagcgggtcgactgcggcatcacgtgctaagcctcgctcttgctgggctgcttctgctcctcgtcggcgtgccagtggagctgtatagctttgtctggttccactacccttgggtcttcggggatctcggttgcaggggatactatttcgtccacgaactgtgtgcctatgcgacagtgctgtctgtagccggcctgtctgccgaacgatgccttgcagtgtgccagcctctgcgggctcgatcattacttactcccaggaggacccggtggctcgtagcactctcgtgggcagcctccttgggtctggcccttcccatggcagttatcatgggccagaagcatgagctggagacagctgacggagagcccgaaccggcgagtcgagtctgtactgtattagtttccaggactgctctgcaagtattcatccaggtcaatgttctggtctctttcgtgcttccattggccctgaccgcttttctgaatggtgtcactgtctctcatctgctcgccttgtgtagtcaggtccccagcacgagtactcctggaagcagcacaccatccaggctcgaattgctcagcgaagagggcctgctttcctttatcgtatggaagaaaacattcatacaaggtggccaggtctctttggtccgtcataaggacgtccgcaggattcggagcctccagcgcagtgtgcaggtcctcagggcaattgttgttatgtacgtgatttgttggctgccataccatgcacgacgactgatgtactgttatgttccggacgacgcatggaccgatcccctttataatttttaccactacttctacatggtaaccaacactttattctatgtgtcatccgctgtgacccctctgctgtataatgcagtgtccagctctttcagaaagctgttccttgaagctgtgtcttctctttgtggggagcaccatccaatgaaaaggctgcccccaaaaccgcagtccccaacactgatggacaccgccagcgggttcggggaccccccagaaacacggacatag

SEQ ID NO: 44046 - DNA, 1692 bp, Artificial Sequence
  Description of Artificial Sequence: Synthetic coding sequence
atgctggaggaggccggcgaggtgctggagaacatgctgaaggccagctgcttgcctttaggcttcatcgtgtttttacccgccgtcctgcttctggtggccccacccctgcccgcagcagacgcagcccacgaatttacagtgtaccggatgcaacaatacgatttgcagggacaaccttatggcactcgtaatgccgtacttaacacagaggcgcgcaccatggcggctgaggtccttagccgccggtgcgtgctgatgcgtctactggatttctcctacgaacagtaccagaaagcactgagacaaagcgccggtgctgtggttatcatactgccccgcgctatggccgcggtccctcaggatgttgtgaggcagtttatggagatcgagccagagatgctggccatggagaccgccgtgccagtatacttcgcagtcgaggacgaagcccttctttctatttataagcaaacccaggcagcaagcgctagccagggcagcgcaagcgcagctgaagtcctcctgaggactgccaccgccaacggctttcagatggtgacctctggggtgcagagtaaagctgtgtccgattggctgatcgctagcgttgaggggcggctaactggtctcggcggtgaagatctgcccacaatagtgatagtagcacactatgatgcgttcggggtggccccctggctgagtctcggcgcagattccaatggatctggtgttagtgtccttctggagcttgcgcggttattttctcgcctctatacttacaagcgcactcacgctgcttacaatctgctctttttcgcctctggcggcggaaaattcaactaccagggaactaagcgttggctcgaagataatctcgaccacaccgattcatctcttttgcaggacaatgtggcctttgtgctgtgtttggataccgtcggaagagggagctccttgcatctgcatgtttcaaagccaccacgggagggtacattgcagcacgccttcctcagagagctggagacagtcgcagcgcatcagtttcctgaggtcaggttcagcatggtgcacaaaaggattaacctggcagaggatgtccttgcatgggagcatgaacgatttgcaatccgccgcttacccgctttcaccctctcgcacctggaatcccatagggatggccagcgcagctcaattatggatgtgaggtcccgcgtggattccaagacgctgacacggaatacccggattattgcagaggctcttaccagagtaatctataacctgaccgaaaagggcacacctcccgacatgccggtcttcactgaacagatgcagatacaacaggagcaactggactcagtgatggattggctgacgaaccagccccgggctgctcagttagtggataaggactccacctttctcagcactctcgaacaccacctcagtcgctacctcaaggatgtcaagcaacaccatgttaaagccgacaaaagagaccccgagttcgtcttctacgatcagcttaagcaggtcatgaatgcatatagggttaagccagcagtctttgatctgttattggcagtgggtatcgccgcctatctgggcatggcctatgtggcagtccagcacttcagcttactgtataaaaccgtgcagagacttttagttaaagctaagactcaatag

SEQ ID NO: 44047 - DNA, 1233 bp, Artificial Sequence
  Description of Artificial Sequence: Synthetic coding sequence
atgggcgcccaggtgcggctgccccccggcgagccctgccgggaggggtacgttctctctttggtgtgcccaaatagctcacaggcctggtgtgagatcaccaatgtgtctcaactccttgctagccccgtcttgtatactgacttaaattattccatcaataatctctcaatttctgcaaatgtggagaacaaatatagcctgtacgttggtttagtattggctgtcagttcgtcaatatttatcggctcttcctttattttgaaaaagaagggactgcttcaacttgccagcaaggggttcaccagagccggacaaggcggccattcgtacctcaaggaatggctgtggtgggtgggactgctgtctatgggtgctggtgaggccgcaaattttgctgcatatgcttttgccccagccacactggtaacccctctgggtgcactgagcgtgctgataagcgccattctgtccagttattttctcaatgagcacctcaatatccacgggaaaatcggctgcattctctccattctaggctctacagttatggtcatccacgcccctcaggaggaagaggtgactagcctgcacgagatggagatgaagcttagagacccgggattcatctcttttgcagttatcataacggttattagtctcgttctgatattgatagtcgcaccaaagaaaggtcaaacaaatattctggtgtacataagcatttgttctttaatcggagccttctctgtgtccagcgtgaagggtctcggcatcgcaataaaggaacttatagaatggaagcctgtgtataagcaccccctggtcttcgtcctactggctgttcttgtgctctccgtcacaacccaaattaattacctgaataaagcacttgatacatttaatacctcgctggtgaccccaatatactatgtgtttttcacttctatggtcgtgacctgttcagccatactgtttcaagagtggtacggcatgacagctggagatataatcggaacactgagtggcttctttacaatcatcatcggaatcttcttgctgcacgccttcaagaataccgatatcacatggagtgagttgacaagcaccgctaagaaggaagccgtcagtctgaatgtgaatgaaaacaactatgtgctgttggagaacctggaatgtagtgcacccggctacaatgacgacgtgaccctgttcagtagaacagatgattag

SEQ ID NO: 44048 - DNA, 1107 bp, Artificial Sequence
  Description of Artificial Sequence: Synthetic coding sequence
atggccgccgtggcccccgccggccccggcgacagcgccagcgccgctttggatgaattgagccttaatttcacatatggtgcacctggcgctgggaacgggagtctcagtggcgactggtaccggaggaatcagatccatctgtttggggtgctgctcgcaatcttgggcaacctggtgatctccatctcacttaatattcaaaaatactctcacctgcagctggcacagcaggagcaccccagaccttactttaaatctgtactttggtggggcggtgttctgctcatggccgtgggcgagaccggaaacttcgctgcatacggtttcgccccaatcaccttgatcgctcccctcggttgtgttagcgtcacaggttcggccatcatcagcgtgacctttctgaaagacaacttacgcgcctcagatttgctcgggaccaccttggcctttgcaggtacatacttgttagttaactttgctcctaacattactcaggcgatttccgcaagaaccgttcaatactacctggtcggctggcaattcctaatatacgtgattcttgagatcttgatcttctgtatactgttgtacttctacaaacgaaaagggatgaaacatatggtgatcctcttaactctggtcgccattctggcaagcctcacagtaatttcagtgaaggccgtgagcggaatgatcaccttctccgtgatggataaaatgcagctgacctatcctattttctatattatgtttattataatgatagccagctgcgtgttccaggtgaagtttcttaaccaggccactaagctatataatacaactacagtggtgcccgtcaaccatattttctttactattagcgccatcatcgctggcatcatcttttatcaggagttcttgggtgctccattcctgactgtcttcatctacctttttggatgctttctgtcctttctaggagtctttctcgttactcggaacagagagaaggagcacctccagcagtcgtatatcgattttggcaatatcccagacaccacccccgagcgaaaagcctggagggaaaccaatgtaggtcagaatacaacccgcttcacttag

SEQ ID NO: 44049 - DNA, 975 bp, Artificial Sequence
  Description of Artificial Sequence: Synthetic coding sequence
atgctgctgggcgagctgggcgtgttcgccagctacgccttcgcccccctcagcttgatcgtccctttgagtgccgtgagcgtgatagcaagcgcaatcatcggcataattttcataaaggagaagtggaaaccgaaggacttccttcgtcgctatgttctctcattcgtggggtgcggcctggccgtcgtcggcacatatctgctggtgacatttgctcctaattcacatgagaagatgaccggtgagaacgtgacccgccacctggtttcatggcccttccttctgtatatgttggtcgaaatcattctgttctgcctgctcctctatttctacaaggagaagaacgccaacaacatcgtggtgatcttgctcctggtcgccctcctggggagtatgacagtggttaccgtcaaggcggtcgcgggcatgctggtactgtctattcagggaaacctgcagttggactacccaattttttacgtgatgttcgtgtgtatggtggctaccgctgtgtaccaggccgcctttttaagtcaggcaagtcagatgtatgatagctccctcattgcctctgtgggctatatcctttcaaccacgatcgccatcactgctggcgccattttctatttggatttcataggcgaggacgtgctgcatatttgcatgtttgccctgggctgtttgattgcatttctgggcgtgttcctcatcacacggaatcggaaaaaaccaattccctttgagccttatatctcaatggatgcaatgcctggcatgcagaatatgcacgacaaaggcatgaccgtccagccggagttaaaggcaagcttttcctacggagcactggagaacaacgacaacatctctgagatttacgcaccggctacactcccagtgatgcaggaggagcacgggtcaaggtcagctagtggcgtcccctatagggtgctggagcatacgaaaaaggagtag

SEQ ID NO: 44050 - DNA, 1107 bp, Artificial Sequence
  Description of Artificial Sequence: Synthetic coding sequence
atggacggcagccacagcgccgccctgaagctgcagcagctgcccccaacatcatcaagtagcgccgtgtccgaagctagttttagttataaggaaaatctcattggtgcccttctagcaatatttgggcacctggtggtctcaatagcacttaacctgcagaagtactgtcacattcgcctggccggaagcaaagacccaagagcctacttcaaaaccaagacatggtggctcggtctgtttctcatgctgctgggagagctgggggtcttcgcttcatacgcttttgccccactgtcgctgatcgtgcccctcagtgcagtgtcggtgatcgcctcagcgataatagggattattttcattaaggagaaatggaagcccaaggactttctgcgccggtacgtacttagtttcgttggatgcggactcgctgtggtgggcacatatctgctggttacctttgctcccaactctcacgagaagatgactggggaaaatgtcactcgccacctggtgtcctggccattcctgctctacatgctggtcgagataatcctgttctgtctgttgctgtatttttacaaagaaaagaatgcaaataacattgtggtgatcctgttactggtggctcttctgggctccatgactgtcgtgacagtaaaagccgtggcgggcatgctagtcctcagcattcaggggaacttgcagctggattaccccattttctacgtcatgttcgtgtgcatggtggccacggccgtttaccaggcagcatttctcagccaggcatcccagatgtatgacagttctcttatcgcttcagtggggtatatcctctcaactaccatcgctatcacggctggcgccatcttttatctggacttcataggtgaggatgtcctccacatctgtatgtttgccctaggatgtctgattgcctttctgggcgtgtttctgattacacggaacagaaaaaagcctataccctttgagccttacatttcgatggacgccatgccagactcgtaccttcacaatcggcaactgttgttcaaacgctacagtaattccagaaatcttcctcaccataacctcgagtccctatag

SEQ ID NO: 44051 - DNA, 681 bp, Artificial Sequence
  Description of Artificial Sequence: Synthetic coding sequence
atggacggcagccacagcgccgccctgaagctgcagcagctgccccccacctcaagtagtagtgccgtgagcgaagccagcttctcctataaagaaaatctgattggggcactgctcgcaattttcggccatcttgtagtgtcaatcgccttgaatcttcagaaatactgtcatatcaggctggccggtagcaaagatcctcgagcgtactttaaaacgaagacctggtggttggggctcttcctgatgctgctaggggaacttggagtgtttgcaagctatgccttcgcacccctaagcctgattgtaccgttgtcagctgtgagcgtgatcgcaagtgccatcattggtatcattttcattaaagaaaagtggaaacctaaagatttccttaggcgatatgttctcagtttcgtggggtgcggcttagctgtagttggcacatacctgctggtgacattcgcgcccaacagccatgaaaagatgactggggaaaacgttacgcggcatctggtcagttggcctttcctactgtatatgttagtggaaataatcttgttttgcctcttgttatacttctacaaggagaaaaacgctaacaatattgtcgttatcttactgctcgtggcactgcttgtcctgctgtgccaccctggctggtccgccgtggtacaatcctag

SEQ ID NO: 44052 - DNA, 1221 bp, Artificial Sequence
  Description of Artificial Sequence: Synthetic coding sequence
atggacggcagccacagcgccgccctgaagctgcagcagctgcccccaaccagctcgtcttctgctgtgtccgaagcaagtttctcttataaggaaaacctgattggcgcattgttagctattttcggccacttggtcgtgagtatagccctcaatttgcagaagtattgtcacatacgactcgctggcagcaaggatcctcgggcgtattttaagacaaaaacatggtggctgggcttattcctgatgcttctgggggaactcggtgtattcgctagttatgctttcgccccccttagtcttattgtcccattatcagccgtttctgtgatcgcctctgctatcatcggcataatctttattaaggagaagtggaagcctaaggactttctacgacggtatgtgctgtcctttgttggctgcgggctcgctgtggttgggacatacctgctggtgacattcgcgcccaactctcatgaaaagatgaccggggaaaacgtgacccggcatctagtcagctggccctttctcctgtatatgctggtggagattattttattttgccttctgttgtatttttataaggagaagaacgcaaataacatagtggtgatcttacttctggtcgctttactgggttcgatgactgttgtgacagttaaggccgtcgcaggaatgctggtgttatccattcagggcaaccttcagctggattatccaatcttctacgtcatgtttgtatgcatggtagcaacagccgtgtatcaagcggctttcctgtcccaggccagccagatgtacgatagcagcctcattgcgtcagtcggttatatcctcagcacgacaatcgctattacggcaggggcgatcttctacttggatttcatcggcgaggacgttctgcacatctgtatgtttgctttaggttgtttgatcgccttcctgggcgtctttcttatcaccagaaatagaaagaagcctattcctttcgagccttatatctcgatggacgctatgccggggatgcagaacatgcacgacaagggaatgactgttcagccggagctcaaggcatcttttagttacggcgctttagagaacaatgacaatataagtgagatctacgctcccgctaccctaccggtgatgcaggaagagcacgggtctcgtagtgcttcgggtgtgccctatcgggtcctcgagcacactaagaaagagtag

SEQ ID NO: 44053 - DNA, 681 bp, Artificial Sequence
  Description of Artificial Sequence: Synthetic coding sequence
atggacggcagccacagcgccgccctgaagctgcagcagctgcccccgacgagttcaagcagcgcagtgagcgaggccagttttagctacaaggagaacttaatcggtgcacttctggccatcttcgggcacttggtcgtttctattgctttaaatctgcaaaaatactgtcacatccgcctggcgggctcaaaagacccccgcgcctactttaagacaaaaacttggtggctggggctgtttttaatgttattgggcgagttgggggtattcgcctcctacgcatttgcccctctaagcctaatagtacctctttcagccgtctcagtaattgcgtccgcaattattgggatcatattcatcaaggaaaagtggaagcccaaagactttctgaggaggtacgtccttagctttgtcggttgtggactcgcagtcgtgggcacatacctgctggtgacgttcgctcctaatagccacgagaagatgacaggagagaatgtaaccaggcatctggtctcatggcccttcctgctctacatgctggtggagattatactcttttgtctgctgttatacttctacaaagaaaagaacgcgaacaacatagttgtgatactgctcctggtcgccctcctcgttctgctgtgccaccccggatggtcggccgttgtccagtcatag

SEQ ID NO: 44054 - DNA, 405 bp, Artificial Sequence
  Description of Artificial Sequence: Synthetic coding sequence
tgagtggccggcatgctggtgctgagcatccagggcaacctgcagttggactatccgattttctatgtgatgttcgtgtgcatggtggcgacggcggtgtatcaggccgccttttccaagacggatagtagtcctgctaacgaaaacaatagcccatacctgcgggagtcacatgaagccttgatgaggatgtcactggggaagtgccccgtgtttgagtcaagcctgacagatgtacgtctgcttttcgactgccagtgcggcctgcactcggtacacaaccactgctaccatagtaggtgcaatatcttgcccggactccacagaggaggtagggcagcccatctacacgtgtgcaccggggtccctcactgcattctggggcgtttgctcaaccacgcatag

SEQ ID NO: 44055 - DNA, 4515 bp, Artificial Sequence
  Description of Artificial Sequence: Synthetic coding sequence
atggccaccgcccggaccttcggccccgagcgggaggccgagcccgccaaggaggctcgagtggtggggtccgaattggtggatacatacaccgtctacatcattcaggtgacagacgggagccacgaatggaccgtgaagcaccgttattccgacttccatgacctgcacgaaaagctggttgccgagcgaaagatcgataagaacctattgccaccaaagaagatcataggtaagaattctaggagtttggttgaaaaaagagagaaggacctggaagtgtatctgcagaaactgctggctgccttccccggcgttacccccagggtactggcccattttctacacttccacttctatgaaatcaatggcatcaccgctgctctggcagaggaacttttcgagaaaggtgagcagctactcggtgctggggaagtgttcgcaattggccccctgcagctatacgccgtgactgagcagcttcagcaggggaagcccacctgcgcatctggcgatgcaaaaacggatctgggacacatcctggactttacatgtaggctgaaatacctcaaggtctcaggcacggaagggccgttcggcacctcgaacattcaggagcagcttctgccttttgacctttcaatctttaagtcacttcaccaggttgagatctcacattgtgatgcaaaacacatacgcgggctggttgcttccaaacccactttggcaaccctgtccgtgcgatttagcgcaacttctatgaaagaagtgcttgtacccgaggcaagtgagttcgacgagtgggaaccagagggaactaccctggagggcccagtgactgccgttatacccacatggcaggccctgactaccctggacctgtcacacaactccgtcagcgagatagacgaatcagtgaaactgatacctaaaatcgaatttctggatttgagccacaacggcttgctggtagtagataacttgcagcacctctacaatttagttcatttggatctgtcgtacaataaattgagttccttggaggggctccatacgaaactgggaaatataaagacacttaatctggcagggaatctgctggaaagcctgagtgggttgcacaagttgtacagcttggtgaaccttgatctcagagataaccgaatcgaacagatggaagaggtgcgttctattggtagcctgccatgtctggaacatgtctctctacttaataacccactcagtatcattccagactatcggacaaaagttctggcccagttcggggagcgagctagtgaggtctgtctcgatgacacagtaactactgaaaaagaactcgataccgtcgaagtattaaaagccattcagaaggctaaggaggtcaagagtaagctgagtaacccagagaagaagggcggcgaagacagccggctgtccgccgcgccctgtatcaggccatcctcctcccccccgacagttgcgccagcctctgcgtccctcccacagccaatcctgagtaatcaggggatcatgtttgtgcaagaggaggctctggcatcctccctttctagcacagactccctaacccccgagcaccagcccatagctcagggctgtagcgattctctggagtcaataccagccggacaggctgctagtgatgatctgagagatgtacctggagcagtcgggggagcatccccagagcacgccgagcctgaagtgcaggttgtgccaggtagcggtcaaataattttcctgccctttacctgtattggctataccgcaaccaatcaggattttatacagagactttccacgctgatcaggcaggcaatcgagcgccagctgccggcttggattgaggctgccaaccagcgggaggagggccagggcgagcagggggaggaggaagatgaggaagaggaagaggaggaggatgtagccgagaaccgctacttcgagatgggcccgcctgatgtcgaagaagaggaaggtggtggccaaggggaagaagaggaggaagaagaagaagatgaagaagctgaggaggagaggctggcactggaatgggctctcggagctgacgaagactttctccttgagcacatcagaatactcaaagtcctctggtgcttcctgattcacgtgcagggctcaatcagacagttcgccgcatgtctggttttgaccgacttcggcattgcggtgttcgagatcccccaccaggagtctagggggtcctcacagcatattctttcgtcccttcgattcgtgttttgtttccctcacggcgatttaaccgaatttgggtttctcatgcctgagctgtgcctggttctgaaggtcagacacagtgaaaacaccttgtttatcatctccgatgccgcgaacttgcatgagtttcatgctgacttacgaagctgctttgccccacaacatatggccatgctctgttcaccaatcctgtatgggagccacacgtcactacaggagtttctgagacagctgctgactttttataaagtggcgggcggctgccaggagaggtcacagggttgcttccctgtttacctcgtctacagcgacaaacggatggtgcagactgctgctggagactactctggaaacattgagtgggcgtcttgtacactatgctccgctgttcggcggagctgttgcgctccaagcgaggccgtaaagtccgcagctatcccatactggctcctgctcaccccacaacacctcaatgtgattaaggcagacttcaaccccatgccaaatcggggcactcataactgtcggaaccgtaatagttttaagctttcaagggtacctctcagcaccgttctgctggacccaacccggagctgtacacagccacgaggtgcatttgcagacggccatgtcctggaactgctggtggggtaccgattcgttactgccatcttcgtgctgccacacgagaagttccacttcctccgcgtgtataatcagttgcgggcatcccttcaggatctcaaaaccgtagtgattgctaaaactccggggactggcggatcaccgcagggctcatttgccgatggccagcccgctgagcgccgtgcttccaacgatcagcggccacaggaggtacccgcagaggcgttggccccagcaccagccgaggtgccggcccccgcaccagctgctgccagtgcttcaggtcccgcgaaaactccagccccagctgaagccagcacatctgctttggtgcctgaggaaacccctgtggaagctcctgctcccccgccagctgaggcccccgctcaatacccctcagaacacctcatccaagcaacttccgaggagaaccagatcccttctcacctgccggcgtgccccagtctgaggcatgtcgcgagcctgcgcggctctgctattattgagttgttccacagctcaatagctgaggtggaaaatgaagagttgcggcacctgatgtggtcctccgtggttttctatcaaacccctggactagaagtgaccgcctgtgtcctgctttcaaccaaagcagtttacttcgtgctacatgatggactgagaaggtactttagtgagccacttcaagacttttggcaccaaaagaacactgactataacaactctccatttcacatctctcagtgcttcgtgttaaagttgtccgacctccagtctgttaacgtcgggcttttcgaccaacatttcagattgacaggctctaccccaatgcaagtggtgacctgtctgactagggattcctaccttacacactgttttttgcaacacctgatggtcgtcctctcatctttggagaggactccttccccagagcctgttgacaaagacttctatagcgaatttggaaataagactaccggcaagatggaaaactacgaactgatccactcctcgcgggtgaaattcacctatcccagcgaggaagagatcggagatctgaccttcacggtggcccaaaagatggctgagccagagaaggctccagcactgagcatcctgttgtacgtgcaagcttttcaggttggtatgccaccacccgggtgctgtcgcggacctcttcgtcccaagactctgctgctgacttccagcgagatatttctcctcgatgaggattgtgtgcactatcctttgcccgaatttgcgaaggaacctcctcagcgtgaccgatatagacttgacgacggccggagagtccgcgaccttgacagagtgttaatgggctatcagacataccctcaagctctgacgctggtcttcgatgatgtccaggggcacgacctgatgggttcagtcaccctggatcacttcggagaggtccccggtggcccggctagagctagccaaggcagggaggttcagtggcaagtgtttgtgccatccgccgaaagcagagagaagttgatcagtctcctggccagacaatgggaagccctttgtgggagggagctgccagtggagctgacaggctag

SEQ ID NO: 44056 - DNA, 2457 bp, Artificial Sequence
  Description of Artificial Sequence: Synthetic coding sequence
atgggcccccccgacgtggaggaggaggagggcggcggccagggcgaggaggaggaagaggaggaggaggacgaagaagccgaggaagaaagacttgccctcgaatgggcactcggcgccgatgaagactttctccttgaacacatcaggatcctgaaagtgctgtggtgcttcctgatccatgtccagggatctatccgtcagttcgccgcctgcctggtgctgacagattttggaatagccgtgttcgagataccacaccaagagtctcgtggctcaagccaacatattctgtcctcactgcgttttgtcttctgttttccacatggggacctgactgaattcggatttttaatgccagaactgtgtctagtgttgaaagtgagacattctgagaatactttgttcattattagcgatgcagccaatcttcacgagtttcatgcagaccttcgtagctgttttgccccccagcacatggctatgctgtgcagccccatcctgtacggctcccacacctctctccaagagttcctgaggcagctcttaacattctacaaggtggctggcgggtgccaggagaggtcacagggctgcttccctgtgtatctggtgtattcagataaaagaatggtgcagacggcggccggagactacagcgggaatatcgaatgggcctcttgtacactctgttctgccgtgcggcgaagctgctgcgccccctcggaagccgttaaaagcgcagctataccctactggctgttgctaacacctcagcacttgaacgttattaaagccgacttcaatccaatgccaaatcgcggcacacacaactgtcgaaatcgcaattcattcaagttgtctcgggtgcccctctctacagttttactggatcctacaaggagttgtacccaaccacgcggcgccttcgcagacggacacgttctcgaactgctggttggttatagattcgtcactgctatttttgtgctgccgcatgagaagttccacttcctgagagtctataatcagctacgggcctccttgcaggacctcaagacagtagtcattgctaaaacgcccggaaccggggggagcccacagggatctttcgctgatggacagcccgcagaacggagagcaagtaacgaccagcggcctcaggaagtgcctgccgaggcactcgctccagctcccgcggaagtacccgcacccgccccggccgctgcttctgcctcaggcccagcgaagactcctgcgccggcagaggccagcacttcggctttggtgccagaagagaccccggttgaggcccctgcaccgccacccgccgaggctccagcacagtatcccagcgaacaccttatccaggcaacatcagaagaaaatcagatccccagtcacttgcccgcttgccctagcctgagacatgtggcttcgctgagagggtccgctattattgagctttttcactccagcattgccgaagtcgagaacgaagagctgcgacatttgatgtggtcttctgttgtgttttaccagaccccgggcctggaagtaactgcctgtgtgctgctcagcacaaaggcggtctatttcgtcctccatgatggcctgcggcgctatttcagcgagcccttgcaggacttttggcatcagaaaaacactgactataacaactcccctttccacatctcccaatgttttgtgctgaagctttctgacctgcagtctgtaaatgtgggtctctttgatcagcatttccgccttaccgggtccacccctatgcaggtggtgacctgtttaactagggacagttacctcactcactgctttttacagcacctcatggtcgttctttcctcgctggaaagaaccccgtcacccgagcccgtagacaaagatttctactcggaatttgggaataaaacgacagggaagatggagaattatgaactgatccactcaagtcgcgtcaaatttacctatccctccgaggaggagatcggagacttgacctttacagtagcacagaagatggccgagcctgagaaggctcctgcactttcgatcttgttgtatgtccaggcgtttcaggtcggcatgccaccgcctgggtgttgtcgaggccccctccggcctaaaacgctgcttctcacgtctagcgaaatcttcctcctcgacgaggattgtgtgcactatccgttgcctgaatttgcaaaagaacctccacagagagatcgttatcgtctggacgatggtcgccgggtgagggacctcgatcgcgtgttgatggggtaccaaacttacccccaggctctgacgctcgtgtttgacgacgtgcaaggccatgacctcatgggctcggccgagagtagagagaagctcatcagcctgctcgctcggcagtgggaggcattatgtggcagggagttacctgtcgaattgactgggtag

SEQ ID NO: 44057 - DNA, 1287 bp, Artificial Sequence
  Description of Artificial Sequence: Synthetic coding sequence
atggccaccgcccggaccttcggccccgagcgggaggccgagcccgcgaaggaggcccgtgttgtgggcagcgaactggtggatacctatactgtgtacatcatccaggtgaccgatggatcccacgagtggaccgttaaacaccggtacagcgacttccacgatttgcacgaaaaactcgtggctgagagaaaaatcgacaaaaacctgttacctccaaagaagatcatcggcaagaattctaggtctctggttgaaaaacgcgaaaaagacctggaagtctacctccagaagcttttaactgcttgcgttttgctgtctacaaaagccgtgtatttcgtcctacatgatggactcagaaggtacttttctgagcctctgcaggacttctggcaccaaaagaatacagattacaacaattctcctttccacatttcacagtgtttcgtgctgaagctttccgatctacagtctgtgaatgtgggcttgttcgatcagcattttcgcctgacaggctccacccctatgcaagtggtgacctgtttaactcgcgattcgtatcttacacattgctttctgcagcatctaatggttgtcctgtcaagtttggaacgtactcccagccctgaacctgtggacaaagacttctattcagagttcggaaataaaactaccgggaagatggaaaactatgaactaatccattctagccgggtaaaattcacataccccagcgaggaagagattggtgacctgacctttacggtggcacagaagatggcggagcctgaaaaggcccctgccctcagcatccttttgtatgtgcaggccttccaggtagggatgcctcccccaggctgctgtagggggcctctgcgccccaagacattgctgctgacctcgtcagagattttcttactggacgaggactgtgtgcactatccacttcccgagtttgcaaaagagcctcctcaacgagatcgatatcgactcgatgacggacgacgagttcgcgacctggatagagtgttgatgggttaccaaacttatccccaggcgttgactttggttttcgatgatgtccagggacacgacttgatgggtagtgtcactcttgatcacttcggggaagttcccggcggaccagcacgagcctcacagggtagagaggtacagtggcaagtatttgttcctagcgcagagtctagggaaaagctcatctcactgctcgcacgacaatgggaggctctgtgtggacgcgagttaccagtcgaactgactggttag

SEQ ID NO: 44058 - DNA, 4515 bp, Artificial Sequence
  Description of Artificial Sequence: Synthetic coding sequence
atggccaccgcccggaccttcggccccgagcgggaggccgagcccgccaaagaagcaagggtcgtcgggtctgaactggttgacacatacacggtgtacattatccaggtgacagacggttctcatgagtggactgtcaaacatagatattctgatttccacgatctccatgaaaaactggtggccgagaggaaaattgataagaacttgctgccccctaagaagatcatcgggaagaactcacgctctctcgttgagaaacgcgagaaagatctggaggtgtatctgcagaagttgcttgcagccttccctggggtcaccccgcgggtccttgcacacttccttcactttcacttttacgagattaacggcattacagccgcactagcagaggaactatttgaaaaaggcgagcaacttcttggagcgggcgaagtgtttgccatagggcccctccagctgtacgccgtcacagagcagctacagcaggggaagcctacctgcgcgtcaggcgacgccaaaacagatctggggcacattcttgacttcacgtgccggctcaaatacttaaaggtatccggaaccgaggggccattcggcacaagcaacatccaggaacaactgctcccctttgacctgtcgatttttaagagcctccatcaagtcgagataagtcactgtgacgccaaacacatccggggcctggtagcctcgaagcccacactcgccaccctatctgtgcgcttcagcgcaacctcaatgaaggaagttttagtgcccgaggcctctgaatttgacgaatgggagccagaaggtaccacgctggaaggaccggtgacggccgtgatacccacctggcaggccctaacgaccctggacctctctcataactctgtgagcgagatcgacgaaagcgtgaagctcattccaaaaattgagttcctggacctgtcacataacggtttgctggtggtggacaatcttcagcacttatataacttagtccatcttgatttgtcgtacaataaactgagttcgctggaggggctccacactaaactgggcaacatcaagaccctcaaccttgccggaaacctgctggaatctctcagcgggctgcataaactgtactccctggtgaacttagacctgcgcgacaatcgcatagaacagatggaagaggtgagaagtatcggctcacttccttgcctggaacacgtgtccctgcttaacaatcctctatccatcattccagactacagaaccaaagttctggcgcagtttggggagcgggccagcgaggtgtgtctggacgatacagtgacaacagagaaagaattagatacagtggaggtgctgaaggccatccagaaggccaaagaagtcaaaagcaaactttctaacccagagaaaaaaggtggtgaggactccagactgagcgcagctccctgtattcggcccagttcaagtccacccaccgtggcaccggctagtgcttccttgccgcagccaattttgagcaatcaaggaattatgttcgtacaggaggaagcactcgcaagcagtctcagctccaccgactctctgactcccgagcaccagcctattgcccaaggctgcagtgacagtcttgaatccatacctgctggccaggcggccagcgatgatctgagagatgtccccggcgcagtaggaggcgcttccccagagcacgccgagcccgaagtgcaagttgtgcctgggagcggtcagattattttcctgccttttacctgtattggatacacagccacaaaccaggattttatccagcggctcagcactctgattaggcaggccattgaaagacaacttcctgcttggatagaggccgctaaccagcgtgaggagggccagggtgagcagggggaggaagaggacgaagaggaggaagaggaagaggacgttgctgaaaatcggtactttgaaatggggccacctgacgtagaggaagaagaaggcggggggcagggagaggaagaggaggaagaggaggaggatgaagaagcagaagaggagcgtctcgctttggagtgggcgctgggcgcagacgaagacttcttgctggagcatattagaattttgaaagtcctgtggtgcttccttatacacgtccaggggagcattcgccagtttgccgcatgcctcgtccttaccgatttcggaatagcggtgttcgagatcccgcaccaagagtccaggggctcctctcagcacatcctgagtagcctgagatttgtgttctgtttccctcatggcgatctgactgaatttggatttttaatgccagaactatgtctggtgctcaaggtacggcactccgagaacacactcttcatcatttcagatgcggcgaatcttcacgagtttcatgccgacttgaggtcttgttttgcccctcagcacatggcaatgctctgttcgcctatactgtacgggagccacacgtcactgcaggaatttttgcggcagttgttgacattttacaaggtagcaggagggtgtcaggagcgctcccagggctgcttccctgtatatctggtctactctgataagaggatggtgcagaccgctgccggtgattatagcggcaacattgaatgggccagttgcacgctctgctccgccgtgaggcggtcttgttgtgctcctagcgaggcagtcaagtctgccgctatcccttattggctactcctcactccgcagcacctgaacgtgatcaaggctgacttcaaccctatgcccaaccggggtacacacaactgtcgcaatagaaattctttcaagctttcccgggtaccactgtcgaccgtcctcctcgacccaactcgcagttgtacacagcctagaggcgcatttgcggatggccatgttctagagctcctggtggggtatcgttttgtgacagccatttttgttctgcctcacgagaagtttcattttctgcgggtatacaatcaactacgcgctagcctgcaggacctgaaaacagtcgtgattgctaagacaccagggacagggggatcaccgcagggctcttttgcggacgggcagccggcagagaggagagcatctaacgaccagaggccacaggaagtgccagccgaagcacttgcaccagcacctgctgaagtccccgcaccagcaccagccgccgctagcgcctcgggtcccgctaaaactccagcccctgctgaggcaagcacatcagccctcgtcccagaagagacgcctgtcgaggctcccgccccgccgcccgccgaagcgccggcacaatatccatccgagcacctgatccaagccacgtctgaggagaatcaaattccgagtcacctgcctgcctgtccttctctcaggcatgtcgcaagcctacgcggctcggcaattatcgagctgtttcactcctccatcgctgaggttgaaaacgaggagctgaggcacctgatgtggtcaagcgtggtgttctatcagacacccggtctagaggtgacagcatgcgtgcttttatccacaaaggccgtttattttgttctgcacgatggacttaggcgctacttttccgagcccctccaggatttctggcaccagaaaaacacagattataacaactctccattccatatctcacagtgcttcgtgttaaaactgtcagatcttcagagtgtaaacgtcgggctcttcgaccagcactttcgattaacaggcagcacgcctatgcaggtggtgacttgcctgacacgcgactcatacctgacacactgttttctccaacacctgatggtggtgttaagtagcctggagagaacccctagtcccgaaccagtcgacaaggacttttatagtgagtttggtaataaaaccactggcaaaatggagaactacgagctgattcactcctcacgggtgaaattcacgtacccatcagaagaggagataggcgatcttacattcactgtggcacagaagatggctgaacccgaaaaagcccctgctttgagtatattgctgtatgtgcaagcatttcaggtcggaatgcctccccctggatgttgcagaggacccttgcgtccaaagactctgctactgaccagcagtgagattttcctacttgacgaagactgtgttcactacccactccctgaattcgctaaagaaccaccgcagagagaccggtacagacttgacgacggtaggcgcgtacgtgacctggaccgagtgctgatgggatatcagacctacccacaagctctgacgcttgtgtttgatgatgtgcaggggcacgatctcatgggaagtgtgacactggaccactttggtgaggtgccaggcggccccgcacgggcctcccagggccgagaggtccagtggcaggtattcgtgccatccgcggagagccgggaaaaattgatttcattgctggcaagacagtgggaggctctttgcgggcgggaactgcccgtcgagctgaccggatag

SEQ ID NO: 44059 - DNA, 1752 bp, Artificial Sequence
  Description of Artificial Sequence: Synthetic coding sequence
atggccaccgcccggaccttcggccccgagcgggaggccgagcccgccaaggaggcacgcgtggtcgggtccgagctcgtcgatacttacactgtgtatattatccaggttacagatggctcgcacgagtggacagtgaaacaccgttattccgatttccacgatctacatgagaaactggtggccgaacggaaaattgacaaaaacctgctgccccccaaaaagataattgggaagaattctaggagtctggttgagaaaagggaaaaagatctggaggtgtaccttcagaaactcctggccgcctttcccggcgtgactcccagggtactggctcatttcctgcacttccacttctatgagatcaacggaatcacagctgctctagctgaggaactgtttgaaaaaggcgaacagctgctgggggccggagaagtcttcgctatcggtccgctgcagttgtacgctgttactgaacagctgcagcagggcaagcctacatgcgcctccggtgacgcgaaaactgatttggggcatattctggactttacctgtagactgaaatacctgaaggtgtcgggaactgaaggtcctttcggcaccagtaacattcaggagcagctgctgcctttcgatctgtcgatcttcaagtccttgcatcaggttgaaatctcccactgcgacgcaaaacacatccgagggctggtggccagcaagccaactctcgctacactgtctgtaagattcagtgcaacaagtatgaaagaggtcctggtccctgaggcctcagagttcgacgagtgggaaccggaagggacaaccctagagggcccggttacagccgtgatccccacttggcaagcgctcacaacacttgacctctcccacaattcagtgtccgagatcgacgagagtgttaagctgattcctaaaatcgagttccttgacctctctcacaacggcctattagtcgtagataacctgcagcacctgtacaatctggtgcatcttgacctttcttataataagctgagcagtttagagggacttcacaccaagctgggtaacatcaagaccctaaatctggccgggaacctcctggaaagcctgtccgggcttcacaagctttattccctggttaatctcgatttacgggataatagaatcgaacagatggaggaggtgcgatcgatcggctctttaccttgtctggagcacgtatctcttctgaataacccactctccatcattcctgactaccggacaaaagtgttagctcagtttggcgaaagggccagcgaagtctgcctggacgacactgtcacgaccgaaaaggaactcgataccgtcgaggtgttgaaagcaatccagaaagctaaggaagtgaaaagcaaactaagcaacccagaaaaaaagggcggcgaggacagtaggctgagcgcagcgccatgtatccgtccctcaagctctcccccaactgttgcacccgccagcgcaagcctaccccaaccaattctatcaaatcaggggaaccgcgtgtgtatcctcttactggtggagccccacagcccggcgtgggccccctggctcggctgggggtggggccgcggcgcaagtacttgtttccagcagggtcagacccaaggcggccagtgtctcctccaggcgggtccacgggggggtacacatggaaggggggcatggcccgacgccagctgctgcctcttaggagaagattctcagctactctag

SEQ ID NO: 44060 - DNA, 2097 bp, Artificial Sequence
  Description of Artificial Sequence: Synthetic coding sequence
atgctgcccgcccggctgcccttccggctgctgagcctgttcctgcgcggctccgcccccaccgccgcccgccacggcctgcgggagcccctgctagagcgaagatgtgctgctgcctctagcttccagcattcgtccagcctcggacgagagctgccttacgatcctgtagacaccgagggcttcggtgaaggcggagacatgcaggaacgttttctatttcccgagtacatcctcgaccctgaacctcagcccactcgtgagaaacaactgcaagaacttcagcaacagcaggaggaggaggaacggcagcgacaacaaagaagggaagaaagaaggcagcagaatctccgtgctaggtcacgggagcaccccgtagtaggccatcctgaccccgcactgcctcccagcggcgtcaactgttctggctgtggggcggaactccactgccaggatgccggagtcccgggttatctgccaagagaaaagttcttaagaacagctgaggcggatggcggtctggccaggaccgtctgtcagcgctgttggttgctgtctcaccaccgtagagctctgcgcttacaggtctcacgggagcagtatttggaattagtgtctgccgcactgcggcggccagggcctagtctcgtgttgtacatggtggaccttctggatctgcccgacgccttgctcccagatctgccggctctggttggccccaaacaactgattgtgctgggcaataaggtagatctgctcccccaggatgcccctggctaccggcagcggctcagggagagactgtgggaagattgcgcgcgagccggcctgctactggcccctgggcaccaaggcccccagcggcctgtcaaagatgagccccaggacggggagaacccaaatcctccaaactggtcacgcacggtggtgcgcgacgttaggcttatttccgccaagactggatatggagtggaagaacttatctccgcattgcagcggagctggcggtataggggcgacgtctatttggtgggagctaccaacgccggcaagtctactctctttaatacattactcgaaagcgactattgcaccgctaaagggtccgaggccatcgatcgggctaccatcagtccatggcccggaacgaccctgaacctcctcaaattcccaatctgcaaccccactccctaccggatgttcaaaaggcaccaaagattaaaaaaggattcgacccaggctgaggaggacttgtccgagcaggaacaaaatcaactgaacgtgttaaagaagcatggctacgtggttggccgcgtgggaaggactttcctctatagtgaagagcagaaggacaacattccattcgaatttgatgcagacagcctggcctttgacatggaaaacgaccctgtgatgggaacccataagtccacgaaacaggtagagcttaccgctcaggatgtgaaggatgcacactggttttatgacacacccggcattaccaaagagaattgcatcttgaacctgctgaccgagaaggaagtgaacatcgtcctgcctacccagtcgatagtgccaaggaccttcgtgctcaaacctgggatggtgctcttccttggcgccataggacgcatcgattttctccagggaaatcaaagcgcttggttcaccgtggtagcctcaaacatactgcccgtccacatcacatcactggatagggctgatgccctgtaccagaagcatgccggccatactttacttcagatacccatggggggcaaagaacgaatggcaggttttcccccgctggtggcagaggatatcatgctcaaggaagggctgggggcatcagaggccgtggctgatatcaagttttcgtctgccggatgggtatctgtgactcctaactttaaagatagattgcacttgcgcgggtataccccagaaggtaccgtgcttacggtcaggccgccgctgctcccctacattgtgaatattaagggacagcggatcaagaaaagcgtcgcatacaaaacgaaaaagccgccttccctgatgtacaacgtcagaaagaagaaagggaaaataaacgtatag

SEQ ID NO: 44061 - DNA, 3669 bp, Artificial Sequence
  Description of Artificial Sequence: Synthetic coding sequence
atgctggtgggccagggcgccggccccctgggccccgccgtggtgacagccgccgtggttttgctgctgtccggggtcggtcctgctcacggctccgaagacatcgtagtgggttgcggtgggtttgtcaaatccgatgtggaaattaactactctctgattgagatcaagctgtatacaaagcatggaactctgaagtatcagacagactgcgcccccaataatggctacttcatgatcccactgtatgataaaggagattttatcctgaaaatcgaacccccattaggctggtcgtttgaaccaaccaccgtggaactacatgtggatggggtaagcgatatctgcactaagggcggggacattaatttcgtgttcaccggattcagtgttaacgggaaagtcctgtccaagggacagccattagggcccgcaggcgtccaggtgagcctgcgcaataccgggaccgaagcgaagatacagtccacagtcacacaaccggggggaaaattcgcttttttcaaggtgctacctggagactacgaaatactggccacgcaccctacgtgggccctgaaggaagcctccaccacagtccgtgtgacgaattcaaatgccaatgctgccagtccattaatcgtggctggctacaacgtctcaggatctgtcaggagcgatggggagccaatgaaaggagtaaaattcctcctctttagcagcttggtgacaaaggaggacgtattgggctgtaacgtgtctcctgtgccagggttccaacctcaggatgagtccttggtgtacctatgttacaccgtttcccgcgaggatggttctttctccttttattcacttccatcaggcggctataccgtaatccctttttaccggggggagaggataacattcgacgttgctccatcaaggctggattttaccgtcgagcacgactctttgaagatagaacccgtttttcatgttatggggtttagtgtgaccgggagagtgctcaatggcccagaaggagacggcgttccggaggctgttgtcaccttaaacaaccaaattaaggtgaagacgaaggcggacggatctttcaggttggaaaacattacaacaggcacctataccattcatgctcagaaagaacacctgtatttcgagactgtaaccatcaagatcgctcctaatactccccaacttgctgacatcatagcaaccggcttttctgtgtgcggtcaaatctcgatcatcaggttccccgacactgttaaacaaatgaacaagtataaggtagtgttgagctcccaagacaaggacaagtcacttgtcactgtggagactgatgcccatgggtcattctgtttcaaggctaagcccggcacctataaggtgcaagtgatggtgccagaggcagagactagggctggcttgaccctcaagcctcagacattccccctgaccgtgacaaatcgccccatgatggacgtggcattcgtgcaattcctggcatcagtatcaggcaaggtcagctgtcttgatacatgcggtgatctgcttgtgaccctgcagtcgctgtcccggcagggagaaaagcgttctctccagctctctggcaaggtgaacgccatgacgttcacattcgacaatgttctgccagggaagtacaagatctcaatcatgcacgaagattggtgctggaagaacaagtctttggaagtggaagtgctggaagatgacatgtctgccgttgagttccggcaaaccggctatatgcttcgttgctctttgtctcacgcaattactctggagttctaccaagatggcaatggacgggagaatgtggggatctacaacctgagcaagggagtgaaccgattctgcctttctaagcccggagtatacaaagtcacccctaggtcttgtcaccgctttgagcaggcattttatacctacgacacgtcctcgccttcaatacttactctcaccgccattagacatcatgttctgggcacaataacaactgacaaaatgatggacgttaccgttactatcaaaagcagtatcgatagtgaacccgctctggtgctcggcccactcaaaagtgtgcaggagttgagaagagagcagcagctcgccgaaattgaggcccgccggcaggaacgtgagaaaaacgggaacgaggagggagaagagagaatgacaaaaccaccagtgcaagagatggtcgacgaactgcaaggaccattctcttatgacttctcttattgggcccgctccggcgagaagatcactgtgactccctcctcaaaggagctgctgttctacccccctagcatggaagccgtcgtgagtggagaatcttgcccagggaaacttattgagattcacggcaaggccggcctgttcctggagggacagatccaccctgaactggagggggtagagattgtgatctcggagaaaggagcctcgtcgcccctgataactgtctttacagatgataaaggcgcatactctgtgggtcctctgcactctgacctggagtacaccgtgacctcgcagaaagaaggatatgtgctgaccgcagtagagggcaccatcggagacttcaaagcgtacgccctggcaggcgtgtcattcgagatcaaagccgaagacgatcagcccctgcccggcgtcctgctctcgctgtccggtggtctgtttaggtcaaacttactgactcaggacaacggcatcttgacgtttagcaacctctctcctgggcagtattattttaaacctatgatgaaagaattccgctttgaaccgtcctcccaaatgatcgaggtgcaggagggacaaaacctaaagattacaatcacgggctaccgtaccgcttacagctgctatggaacagtaagcagtttgaatggcgagcctgagcagggagtggcgatggaagctgttggtcagaacgactgctccatctatggggaggatactgttacagacgaggaaggcaagtttagactgcgtggtttgctccccggctgcgtttatcatgtccagctgaaggctgagggaaacgatcacatcgaaagggcccttccccaccacagggtgatcgaggttgggaacaatgacattgatgatgtgaatatcattgtgtttaggcaaatcaatcagtttgacctgagcggaaacgttattacttcgtcggaatatctccccacgttgtgggtcaaactgtacaagtcggagaatcttgacaaccctattcagactgtcagtttggggcagtccctgtttttccactttcctccgttattgcgcgacggagaaaactatgtggttctgctggatagcacactgcctaggagccagtatgactatatcctgccccaggttagctttaccgcagtaggctatcacaagcacatcacattgatctttaaccctacccgcaaactgccggagcaggacatcgcacaaggttcatacattgctttgcccctaacactcctggtgctgttagccgggtacaatcacgataagctcattcccttgctcctgcagctcacttcccgcctacaaggcgtgcgcgccctggggcaggccgcgtccgacaatagcgggcccgaggatgccaaaagacaggctaagaaacagaaaacacgacggacctag

SEQ ID NO: 44062 - DNA, 3804 bp, Artificial Sequence
  Description of Artificial Sequence: Synthetic coding sequence
atgctggtgggccagggcgccggccccctgggccccgccgtggtgactgccgccgttgtgctgctattgagtggggtcggtcccgcgcacggctctgaagacattgtcgttggatgtggtggttttgtcaaatccgatgtcgaaattaattattccttgatagagatcaagttgtacacgaagcacggaacacttaagtaccagacagactgcgctcccaataacgggtacttcatgattcctttgtatgacaagggggactttattctgaaaatcgagccccccttaggatggtcttttgagcccaccacagttgaactgcatgtggatggtgtgtctgacatctgtacaaaaggcggagacatcaactttgtgtttaccggattttcggtgaatggtaaggttctgagtaaaggacagcctttagggccagctggcgtgcaggtgtccctccggaacactgggacagaggccaagatacagagtacagtgactcagcctggggggaaattcgcattttttaaggttctgcctggcgattatgagatccttgcgacccaccccacctgggccttgaaagaggcttccaccacagtgagagtcacaaattccaacgccaacgctgcctcacccctaatcgtggctggctacaacgtgtctggttcggttcgttctgacggagagcctatgaagggcgtgaaatttctgctgtttagcagtctggtgactaaggaagatgtcctgggctgtaacgtctctcctgttcccggcttccaaccccaggatgaatcactggtatatctgtgctataccgtgtccagagaggatggcagcttttctttctactcccttcccagtggaggttataccgttatccccttctaccggggcgagcgcatcacatttgacgtggccccatctaggttggattttacagtcgaacacgattcccttaaaatagaacctgtgtttcacgtgatggggttttccgtcacgggaagggtgcttaatggacctgaaggcgacggcgtgcctgaggctgtggtcacactgaataaccagatcaaagttaagactaaggccgacgggtcttttcgccttgagaacattacgacaggtacatatacaatccacgcccaaaaagaacatctgtattttgaaactgtgacaatcaagattgcaccgaatactccgcagctggccgatatcatcgcaactggtttttccgtgtgtggacagatctctatcatcaggttcccagacacagtgaaacaaatgaacaagtacaaagttgtgctttcaagccaggacaaggacaagagtctggttactgtggagaccgacgcccacggcagcttctgtttcaaggccaagccaggcacctacaaggttcaggtgatggtgcctgaagccgaaactcgcgctggtttaacactaaaacctcagacttttcccctaactgtgactaacagaccaatgatggacgtggcattcgtccaattcctagcatccgtgagcgggaaagtctcatgcctggacacttgcggcgaccttctggtgacactccaatccctaagccgtcagggagaaaaacgcagccttcagctctcgggtaaagtgaacgcaatgacctttacctttgataatgttcttccaggtaagtataagataagtataatgcacgaggactggtgctggaagaacaagagtcttgaggtcgaggtactggaggatgatatgagtgccgtggaatttaggcagactgggtatatgctgcgctgttccctgtctcacgcgattaccctcgagttctaccaggacggaaacggtagggaaaatgtgggcatatataatctaagcaaaggcgtgaatagattttgtctctcgaaacctggcgtgtataaggttacgcctagaagctgtcaccgcttcgagcaagcgttttacacttacgatacaagcagccccagtatcctgaccctgaccgcaattcgtcatcacgtgttaggaactatcaccaccgataaaatgatggacgtgactgtgactattaagtcaagtatcgacagtgagccggctttggtgcttggccctctgaaaagcgtgcaggaattaaggcgggaacagcaacttgccgagattgaggctcggaggcaggagagggaaaagaacggtaacgaggagggcgaagaaaggatgaccaaaccaccagtgcaggagatggtggatgagctccagggcccattttcctacgacttcagttactgggctcgttcgggagagaagattacggtgacaccttcaagtaaagagctcctgttttatcctccaagcatggaggcagtggtcagtggggagagctgccccggcaaactgatcgagattcatggtaaagcaggattattcctggaaggccagattcatcctgagctcgagggcgttgaaattgtgattagcgaaaaaggggcttcttctcctctcattacagtatttacagatgacaagggagcctactcagtgggtccactacatagcgacctcgaatatacggtgacaagccaaaaggagggctatgttcttaccgccgtggagggaaccatcggtgattttaaagcgtacgctttggccggggtcagtttcgagatcaaagccgaagacgaccagccactcccaggggtcctgttgtcactgtccgggggactgttccggtccaatctcctgacacaggacaatggcatcctgactttctcgaatctgtcacctggccaatactacttcaaaccaatgatgaaggagtttaggtttgaacctagtagccagatgattgaggtgcaggaaggccaaaacctcaagatcaccatcacaggctatcgcacggcctatagttgttatggcaccgtttctagccttaacggcgaacccgagcaaggagtggccatggaggcagtcggacagaatgactgcagcatttatggtgaggacacggtcaccgatgaagaagggaagtttcggctccgagggctcctcccaggttgcgtgtatcacgttcaactcaaggctgaagggaatgaccacattgagcgcgcactcccccaccatcgcgtcattgaggtcggcaataacgatatcgacgacgtgaacatcatcgtgttccggcagatcaatcagttcgacttgtccggcaatgtcatcaccagcagtgagtacctcccaaccctttgggtcaagctgtacaagagcgagaacctggataatcccatacaaacagtctctcttgggcaatccctctttttccatttcccccccctgctaagggatggggagaactatgtcgtgttgctcgatagtacactcccacgctctcagtacgattacattctccctcaggtttccttcacagctgtcggctaccataagcacataacgctgatcttcaaccccacacgcaaattgccagagcaggacattgctcaggggtcttatatagcgctgccactcaccctactggtcctcctggccggatacaatcacgacaagttgatcccacttttactacagttaacctcccgcctgcaaggagtccgggcgctgggccaggctgctagcgacaactccggcccagaggatgccaaaaggcaggctaagaagcaaaaaaccaggagaacgctccgcctgcagggagagtttcagttgacgtggtgtctcgtgccatggcgggggactctgggaatccacttgttttccagtctgccattcgcttctgaaattctcttggaaactacagccacatgcatccattactag

SEQ ID NO: 44063 - DNA, 3303 bp, Artificial Sequence
  Description of Artificial Sequence: Synthetic coding sequence
atggcccggttcgccttcttcaaggtgctgcccggcgactacgagatactggctacacatcctacatgggctctgaaagaagcatcaactactgtgagggtcactaattccaatgccaacgcggcttcccctctgatcgtcgccggatacaacgtgagcggcagcgttcggagcgatggcgagccgatgaagggcgtaaagtttctgctgttttcttccctggtaaccaaggaagatgttctaggatgcaacgtgtcaccagtacctggattccagccccaggacgaaagcctggtgtatctgtgctacacagttagcagggaagacggctccttctccttttatagcctgccttcgggcggatacactgtaatacctttctacaggggcgaacgaattacctttgacgtggccccctctcgcctagactttaccgttgagcatgacagtcttaagatagaacccgtcttccacgtcatgggattctcagtgacagggagagttttaaacggacccgaaggcgatggagtgcctgaggccgtggtgaccctgaataaccagattaaagtgaagactaaagctgacggctctttcaggctcgaaaacataacaactggcacctataccattcacgcccagaaagagcacctctattttgagaccgtgactatcaaaatcgctcctaacactcctcaactggccgatattattgctacggggttttccgtgtgtggccaaatcagtatcatccggttccctgatactgtgaaacagatgaacaaatataaggtagtgctgagcagtcaagataaagacaaaagcttggtgactgtcgagactgatgctcacggcagtttttgtttcaaggcaaaacccggcacttacaaggtccaggttatggtgcccgaagcggagacgcgggctgggctcaccttaaagcctcagaccttccccctgaccgtaaccaatcgtcccatgatggacgtggcttttgttcaattcttagcctctgtctctggtaaggtctcctgcctggatacctgcggcgatctgttagtgacccttcaatccctgagccggcagggcgaaaagaggtccttacagctctccgggaaggtaaacgccatgacatttaccttcgacaatgtattgccgggaaagtataagattagcattatgcacgaggattggtgctggaagaataaatctttggaagtagaagtgctggaagacgacatgtcggctgttgaatttcggcaaacaggttatatgcttcgctgttcactgagtcacgctattactctggaattttatcaggatggcaatggtagggagaacgtaggcatttataatttaagtaagggggtgaacaggttctgcctgtccaagccaggggtgtacaaagtgacaccaagaagctgtcacaggttcgagcaggccttttacacctacgatacctcctccccatcaattctcacattaactgctatccgccaccacgttctaggcacaatcacaactgacaagatgatggacgtgacggttacaattaaatcttctattgactcagagcccgccctcgtcctcggcccactgaaaagcgttcaggaactgaggcgcgaacagcaactcgctgaaattgaggctaggcgccaagaacgcgagaagaatggaaatgaggagggcgaggagaggatgaccaagcctcctgtgcaggagatggttgatgaacttcagggcccgttctcatacgatttttcttattgggctagatcaggggagaaaattacagtgaccccatcttccaaggagttgctgttttaccctcccagtatggaagccgttgtgagcggagagtcatgccctgggaagctgatcgagatccatggaaaagctgggctctttctcgagggccagatccaccctgagctggagggggtggaaattgtgattagcgagaaaggcgcaagtagtcctctgatcactgtcttcacagacgacaagggcgcctattcagtgggaccgctccatagtgacctggaatacacagtcacatcacagaaagaaggatacgtcctcaccgctgtcgaagggacaattggcgactttaaggcctatgctttagcaggggtctcgttcgagatcaaagccgaggacgaccaaccacttcccggcgtgttgttgagtctcagtggcggcttgttccggtccaatttgctaacccaggacaacggaatcctcaccttttccaatttatcccccggtcaatactactttaagccaatgatgaaagaattccgctttgaaccaagtagccagatgatcgaagtccaagagggccagaacctgaagattaccatcactgggtatcggactgcatatagctgctatggcactgtgtcatctttaaatggagaacccgagcagggggtggctatggaagctgtcggccagaacgattgtagcatttatggagaagacacagtgacagatgaagaaggcaaatttcggctcagaggtctcctccctggatgcgtgtatcatgtacagctgaaggctgagggcaacgaccacatcgaacgcgccttaccgcaccatcgggtgatcgaagttgggaacaacgatatcgatgacgtaaacatcatcgtgttccgccagatcaatcaatttgacctgtcaggaaacgtgataaccagttcagagtacctgcctactttatgggtgaagctctataagtctgagaatttggacaaccccatacaaaccgtcagtctgggacagagcttgttcttccacttcccccccctgttgcgggatggagagaattacgtggtgctgctggactcaacgcttccaagaagccaatacgattatatcctcccccaagtttcctttactgcagttgggtatcacaagcacatcacactgatctttaaccccacacggaaactccctgagcaggacatcgcacagggctcttacatagctctgcccctgacactactggtgttactggccgggtataaccacgacaagctaattcctctgctactgcagctgacctcccgtctgcaaggcgtgcgggctctgggtcaggcagccagcgacaactctggacccgaggacgccaagcgacaagctaagaagcagaagacacgccgcaccctgagactccaaggggaatttcaacttacctggtgcctggtaccgtggaggggcaccctgggtattcacctgttcagcagcttgcccttcgctagcgagatccttctcgaaactaccgccacttgcattcactactag

SEQ ID NO: 44064 - DNA, 3669 bp, Artificial Sequence
  Description of Artificial Sequence: Synthetic coding sequence
atgctggtgggccagggcgccggcctgctgggccccgccgtggtgaccgctgccgtggttctgctgctgtccggggtagggccggcccacgggagcgaggacattgtcgttggttgcggtggctttgttaaatctgacgtggaaataaactacagcctgattgagatcaaactgtacaccaagcatggaaccctgaaataccagactgattgcgcgcctaacaacggctacttcatgatccccctctacgataagggcgacttcattctgaagattgagcccccactcggatggtctttcgagcccactaccgtcgagctgcatgtagacggagtcagcgacatttgcacgaaagggggcgacataaattttgtgtttactgggttttctgtcaacggcaaggtgctctccaaaggacagcccctgggcccagccggcgtgcaggtgagccttcgaaacacaggaactgaagcaaaaattcaaagcactgtaactcagccaggtggcaagttcgctttttttaaggtcttacctggggattatgagatccttgctacccacccgacgtgggcactgaaggaggcatccactactgtccgagtcaccaacagtaatgccaacgccgcatctcccctgatcgtggctgggtacaatgtttccggcagtgtccgcagcgatggcgaacctatgaagggcgtaaagttcctgctattttcatccttagtcacaaaggaagatgtccttggatgcaacgtgagcccggtgcccgggttccaaccccaggacgagtccctagtgtacttgtgctacactgtctcgcgggaggacggaagctttagcttctattcactcccatccggcggctacacggtgatacccttttaccggggggagagaattactttcgatgtggctcccagtagactagacttcacagtagaacacgattccctaaaaatagagcccgtgtttcacgtgatgggcttttcggtgacaggaagagtgcttaatggaccagagggagacggagtgcctgaagcagtggtaactctgaacaatcagatcaaggtgaaaactaaggccgatgggagtttcagattggagaacatcacaacaggtacatatacgatccacgcccagaaagagcatctgtacttcgagacagtcaccataaagatagcacctaatacgccccagctggcagacatagtcgctaccggatttagtgtctgcggccgtatttccatcatcaggttcccggatacggtgaagcagatgaataagtataaggttgtgcttagtagccaggacaaggacaaaagcctggtcacagtcgagaccgatgcccatgggtccttttgtttcaaagcgaaacccggaacatataaggttcaggtaatggtgcccgaagctgagacacgagcggggttgacacttaagcctcaaacttttcctctaactgtgaccgatcgccctgtgatggatgtggcatttgtgcagtttttggcctccgttagcgggaaagtgagctgccttgatacctgtggagatttactggtgactctccagtccttaagtagacagggagaaaaacgaagcctccagttgtccggaaaagttaacgcgatgacgtttacttttgacaatgtgctccccggaaaatacaagatctcgatcatgcacgaggattggtgctggaaaaataagagcctcgaggtggaggtgctcgaggacgacgtttcggctgtcgaatttcggcagaccggatatatgttgcgatgcagcttgtcacatgccataactctggaattctaccaggacggaaacgggcgcgagaacgttggcatatacaacctgtcgaagggtgtgaataggttctgcttatcaaagcctggtgtgtacaaggtgacacctagaagctgccaccgatttgagcaagctttctacacctacgacaccagctcaccctccatcttaaccttgacagccattcgccaccacgtgctgggtacaataactacggacaaaatgatggatgtcacagtcactatcaagagctcgatagactctgagccagccttggtgctaggccccttgaagtctgtccaagaattgagaagagagcagcagttagcagagatagaggcccgccggcaggagagagagaagaatggcaatgaggagggcgaagaacgtatgaccaagcctcctgtccaagaaatggtcgacgagctccaaggtcctttctcttacgactttagctattgggcccggtctggcgaaaaaataacagtgacacctagctccaaggaactacttttttaccctccaagcatggaagccgtcgtgtcaggcgagtcctgtcccgggaaactgatcgagatacacgggaaggccggccttttccttgagggccagattcacccagagctggaaggggtggagattgtgatatccgaaaagggagcaagcagccctctcattacagtctttacagatgataagggtgcctacagcgtggggcctctgcacagcgacttggagtacaccgtgactagtcaaaaggagggatatgtgctgacagctgtagagggaaccatcggagattttaaagcctacgccttggctggggtcagcttcgaaattaaggccgaggacgaccagcccctgcccggagtgctgttgagcttaagcggagggctctttagaagtaaccttttgactcaggacaatgggattttgacattctccaatctctcgccgggccaatactattttaagcccatgatgaaggaattcagattcgaaccgtcatcacagatgatcgaagtacaggagggtcagaacctgaaaatcacaatcactggatatcggaccgcttattcttgttacggtaccgtctcttctctgaacggagaacccgaacagggggtggctatggaggccgtgggtcaaaacgactgctccatttatggagaagatactgtgacagatgaagagggtaagttcagactccggggtctactgccaggctgcgtatatcatgtccaactgaaggccgagggaaacgatcatatcgaacgggctctgccgcatcacagagtgatcgaggtgggaaataatgatatagacgatgtaaatattattgtttttcgtcaaatcaaccagttcgacctgtccggaaatgttattactagctcggagtacctaccaacgttatgggtgaaattgtacaagtcagagaatttggacaatccaattcagactgtcagtttgggacagtctctattctttcactttcccccgctcttgcgggacggcgagaactatgtggtgctcctggattcgacattaccccgaagtcaatatgactacattctgccacaggtcagttttacagccgtggggtaccataagcacattacgctcatctttaatcccactagaaaactccccgaacaagacatcgcgcagggcagctacatcgcgctgccactaaccttactggtgttgctggcaggctataaccatgacaagcttatccccctcctgctgcagcttacatcccgccttcagggagtgggcgctctcggacaggccgcctctgacaatagtgggcctgaagacgccaaacgccaagccaagaaacaaaagacgaggagaacctag

SEQ ID NO: 44065 - DNA, 3804 bp, Artificial Sequence
  Description of Artificial Sequence: Synthetic coding sequence
atgctggtgggccagggcgccggcctgctgggccccgccgtggtgacagccgctgtggttctgctcctgagtggcgtgggaccggcacatggctcagaggatatagtcgtggggtgtgggggctttgtaaagagtgacgtggagatcaactactctttgatcgagataaaactgtacactaagcacggcactctcaagtaccagactgattgtgctcccaacaacggctatttcatgatcccgctgtacgataagggtgactttattctgaagattgagccccctcttggttggagcttcgagccaacaacagtcgaattacacgtggacggcgtcagtgacatatgcacaaaagggggggatatcaattttgtgtttacagggttttctgtcaacgggaaagttctgtcaaaaggtcagccattaggcccagctggcgttcaggtgagcttgagaaatactggcactgaagcgaaaatccagagtactgttactcagccaggaggtaagttcgcctttttcaaagtcctgcccggagattatgagattcttgccacgcatccaacctgggccctgaaagaagcctccactacagtcagagtgacaaacagcaatgcaaatgccgcaagcccactgatcgtcgctggttacaacgtctctggaagcgttaggagtgacggcgagccaatgaagggagtcaaattccttttgttctcatccttggtgactaaggaagacgtcctaggctgcaacgtcagtcctgtgcccggattccaacctcaagacgaaagcctggtgtacttatgttatactgtctcaagggaggacggtagcttttccttttactctctaccttctggcggctataccgttattcccttctaccggggagaacgtattacttttgacgttgccccaagccggttggactttacggtcgaacacgactctcttaaaatagaacccgtttttcacgtcatggggttttccgtgactggaagagtgttgaatgggcccgagggggacggagtgcccgaggcagtggtgaccttgaataaccagataaaggtgaagactaaggccgacggctctttccgcttggagaacattaccacaggcacctacacaattcatgcacagaaggagcacttgtatttcgagacagtaacaatcaagattgcacccaatactccccagctcgctgatatcgtcgctacgggcttctctgtctgcggtagaatctctattataagatttccagacaccgtcaagcagatgaataagtacaaagtggtgctctcttcccaagataaagacaagtccttggtcactgtggagacagacgcccacgggagcttctgctttaaggcaaagcccggcacatacaaggttcaggtgatggtgccagaagcggaaactagggccggcctgactttaaaacctcagactttccctctaacagtcaccgatcgacccgtgatggacgtggcttttgtgcagttcctggccagcgtgtcagggaaagtgtcctgtttggatacatgcggcgacctgcttgtcacactccagtccctgagccggcagggcgaaaagagatccttacaactttctggcaaagtcaacgctatgacatttacatttgacaacgtgctaccagggaaatataagatatcaatcatgcacgaagactggtgttggaagaataaaagcctggaagttgaggtgctggaggacgatgtttccgcagtggagttccgccaaacgggctacatgctacgttgttcactctcgcacgccatcactcttgagttctaccaggatgggaatggcagggagaatgtcgggatttataacttgagcaaaggagtcaatagattctgcctgtccaaacccggtgtctacaaagtgactcctagaagttgccatagattcgaacaggcattttatacatatgatacctctagcccctccatcctcaccttgacggcgataaggcaccacgtgctaggaacaataacaactgacaagatgatggatgtcacagtgacaatcaaatcaagtatcgatagcgaaccagcattggtcttaggccccctgaaatccgtacaagaacttcggagagagcagcaactcgccgagattgaagcccggaggcaggagcgggagaagaatggcaatgaggagggtgaggagcgcatgacaaaacctcctgttcaggaaatggtggatgagctccagggacctttctcttacgacttctcttattgggccaggagcggcgagaaaattaccgttaccccctcttctaaggaactgttattctaccctccttctatggaggccgtggtgtccggagagagctgcccggggaaacttattgagatccatggtaaggccggcctgtttttagaaggccaaatacatcccgagctggaaggagtggaaatcgtaattagcgagaaaggtgcttctagtcccctgattacagtctttacagatgacaaaggcgcgtactccgtgggacctttacacagcgatcttgaatataccgtgacatcccagaaggagggctatgtgcttacggcagtggagggtacaatcggagattttaaagcttatgcactggccggcgtaagcttcgagatcaaggcagaggatgaccaacctcttcccggagtcctgttatcactctctggcgggctgttcagatcaaacctcctgacccaggacaacggtattctgacattcagcaacttgagccccggccaatactacttcaagcccatgatgaaagaatttcgctttgagccctcctcacagatgattgaagttcaggaaggacaaaacctcaagattacaataacgggatataggaccgcctactcttgctacgggacagtgagctcactgaacggagagccggagcagggcgtggccatggaggcagtgggacagaacgattgcagcatctacggtgaagacacggtgaccgacgaagagggcaaatttcgcctgcgggggctcctgccgggctgcgtgtaccacgtgcagctgaaggctgagggcaacgatcacatcgagagggccctaccacatcatagggttattgaagttggtaataacgacatagatgatgtcaatataattgtctttagacagatcaatcaattcgatctctcgggcaacgttatcacttcaagcgagtatcttcctaccctctgggtaaagttatataagagtgagaacctggacaatcctattcaaaccgttagcctaggtcagtcattgttttttcacttcccccctcttctgagggacggggaaaattatgttgtgctgctagattccacattgcctcggtctcagtatgattatatccttcctcaagtctctttcacggcagtgggctatcacaagcacattacactcatctttaatcctactcggaaattgcccgaacaggacattgcacaaggcagttacatcgcactgcctcttacactcctggtacttttagcaggatacaaccacgataaactgatacctcttcttctgcagttaaccagccgtttgcagggagttggggcattgggccaagcagcttcagacaacagtggaccagaggacgctaaacgacaggcgaagaagcagaagactcgacgtactctgcgccttcaggaggaatttcaactgatgtggtgtctggtgccatggagaggcaccttaggaattcacctgtttagctccctgccgttcgcatcggagatcctgttggagaccaccgccacttgtatccactattag

SEQ ID NO: 44066 - DNA, 3303 bp, Artificial Sequence
  Description of Artificial Sequence: Synthetic coding sequence
atggcccggttcgccttcttcaaggtgctgcccggcgactacgagattctggccacccacccaacctgggccctcaaagaggctagcaccaccgtccgcgtaacaaatagcaatgcgaatgccgcatctccattaattgtagctgggtataacgtgagcggctcagtcaggagtgacggggaacctatgaagggtgttaagtttctcctgttctcctccctggtgactaaagaagatgtccttggatgcaacgtttctcccgtacctggttttcaacctcaggatgagtctttggtatacttgtgttacaccgtgtccagagaagacggaagttttagcttctatagcctgccaagcggagggtacaccgtgatccctttctacaggggggagcgcatcaccttcgatgttgccccaagtcgtctggatttcacagttgagcacgactcactgaagattgagccggtgtttcatgtcatgggtttcagcgtgactggacgagtgcttaacggaccagaaggagacggcgtaccagaggctgtggtcaccttaaacaaccaaataaaagtcaaaacaaaagctgacggctcattccggttggaaaatatcacaactgggacttataccattcacgcccagaaggaacacctctatttcgagaccgttacgatcaagatagcccccaataccccccagttggccgacatagtagccaccgggttctctgtgtgcggacgtatttctatcatccgctttccagacaccgtgaagcagatgaataaatacaaggtggtgcttagctcccaggataaggacaagtcactggtgacggtcgagaccgacgcacacgggtccttttgcttcaaggccaagccagggacctacaaggtgcaggtcatggtgccagaggcggagacgagagctggcctgaccctgaagccacagacttttcccctaacagtcactgatagaccagtgatggacgtcgcattcgtccaatttttggcttctgtgtcaggcaaggtgtcgtgtctcgatacctgcggcgacctcctggtgactcttcagagtttaagccggcagggagagaagcggagtctgcagttgagtgggaaagtgaatgcaatgacgttcactttcgacaacgtgttgccaggcaaatataaaatttccattatgcatgaagattggtgctggaagaacaagagtctggaggtggaagtcctggaggacgacgtttccgcagtggagtttagacagaccggctacatgttgaggtgttctctgagccacgccattacattggagttctaccaagacggtaacgggagggaaaacgtaggaatctacaatctttcgaagggcgtgaatcggttctgtttgtcaaaaccaggagtgtataaggtgacccctagatcgtgtcaccggtttgaacaggccttctatacttacgataccagctcaccctccatcctgaccttaaccgctatcaggcaccacgttctgggcacaattaccacagataaaatgatggacgttactgttactataaaatcctccattgactccgaacctgccctggtactgggacctctaaagtcagtgcaggagctaagacgtgagcaacaattggctgaaattgaggcacgaagacaggaacgcgagaaaaacggcaacgaagagggcgaagagagaatgacaaaacctccagtacaggagatggtcgacgaactgcagggtccttttagctatgacttctcttactgggctagatctggcgaaaaaatcactgtgaccccttcaagcaaagagctccttttttaccccccctctatggaagccgtggttagcggggaatcttgcccagggaagctgatcgagatccatggcaaagcgggtctcttcctcgaagggcagatccaccccgagcttgaaggtgttgaaattgtaatctctgagaagggcgcatcttccccactgattacagtgttcacagatgacaaaggcgcctactccgtcggccccctccattctgacttggagtacacggtgactagccaaaaggaaggttacgtgcttacggcagtagagggaactatcggcgattttaaagcatatgctctggccggcgtgagttttgagatcaaagcagaggatgatcaaccgctaccaggtgtgctcctctccctgtcgggagggcttttcagaagcaatctgctgacgcaggataacggcatcctaactttctctaacttgagccctgggcaatattacttcaagcctatgatgaaagaattccgctttgaaccttcttcccagatgatcgaggttcaggaaggacagaacctaaagatcactattaccggctatcgaacagcatatagctgttatggtacagtatcctccttgaacggtgaacctgagcaaggcgtggccatggaagccgtcggacagaacgactgctccatttacggagaggatacggtgactgacgaggagggaaagttcaggctccgcggcctcttgcctggatgcgtgtaccatgtgcaactaaaggcggaaggaaatgaccacatcgagagggccctcccccaccacagggtgatcgaggtggggaataacgacatagacgatgtaaatatcattgtctttcgccaaatcaatcagttcgacctgtcaggaaacgttattacttctagcgaatatcttcccaccctgtgggtgaaactctataaaagcgagaatttagacaaccccatccagactgtcagcctgggccaatcccttttcttccatttcccaccgctcctcagggatggcgaaaactatgtcgtgctgctggacagcacattgccccggtcacaatacgactacatcctgccccaggtgagcttcaccgcagtggggtatcacaaacacatcactctgattttcaatccgaccagaaaactgcccgaacaggacatcgcccagggatcttacatagcattgccattgaccctgttggtcctgctcgctggctataatcacgacaagctgatccccctgctgctgcaattaacatcaaggctgcaaggggtgggggccttgggacaggccgctagtgataacagcgggcctgaagacgcgaaacgacaggcgaagaagcaaaagactaggcggaccttgcggctgcaggaggaatttcaactgatgtggtgtctggtgccttggagggggactctgggcatccacttgtttagcagtctaccatttgcctccgagattctactggagacaaccgccacctgcattcattactag

SEQ ID NO: 44067 - DNA, 3804 bp, Artificial Sequence
  Description of Artificial Sequence: Synthetic coding sequence
atgctggtgggccagggcgccggccccctgggccccgccgtggtgacagccgcagtagtgcttctgctcagcggcgtgggcccagcccatggaagcgaagacattgtcgtcggatgtggaggcttcgtgaaaagtgatgtcgaaatcaactactcactgatcgaaatcaaactgtacactaagcatggcacactgaaataccagaccgattgcgcccccaacaatggatattttatgatacctttgtacgacaaaggagactttatactcaagatcgaacctccattaggttggtcatttgaacccactacagttgagttacacgtggacggggtttccgatatttgtaccaaggggggcgacatcaactttgtgtttaccggcttttctgtgaatggcaaggtcctgtccaaaggccagcccctgggccccgccggagtgcaggtatcactgagaaataccggaaccgaggccaagattcagagtacggtgacccaaccaggaggaaaattcgcgtttttcaaagtcctcccgggggattacgaaatcctcgctactcaccctacttgggcgctgaaggaagcgtccacaacagtgagagtgacgaattcaaacgctaacgccgcatctcccctgatagtggccggatacaacgtctcgggttccgtcaggagcgatggggagcccatgaagggggtgaaattcctgctcttctccagcctggtgactaaggaggatgtgttagggtgcaacgtgagccccgtgcccggattccaaccacaagatgagtccctagtgtacttgtgttacacggtaagcagagaggacggcagcttctcattctactcattgccttccggaggatacaccgtgatacctttctataggggtgaacggattacttttgatgtggcccctagcaggctcgatttcaccgtggaacacgattcactgaaaattgagcccgtcttccatgtgatgggatttagtgtgaccggccgggttcttaacggtcccgaaggggacggcgtccctgaggccgtggtgaccttaaacaaccagattaaagtgaaaacaaaagcggacggatcctttcgcctggaaaacatcacaaccggtacttataccatccacgcacagaaagaacatctgtactttgaaacagtgacaatcaaaatcgccccaaatacccctcagctggctgacattgtagccacgggtttctcagtctgcgggcagatttcaataatcagattcccagacacagtcaagcagatgaataaatacaaagtggtcttgtcctcacaggacaaggacaagtcactcgttacagtggaaacagacgcccatgggagcttctgttttaaagccaatcctggcacatacaaggtgcaggtaatggtccccgaagcggaaaccagggcagggctcaccctgaagccccagacatttcccctaactgtgaccgacagaccagttatggacgtggctttcgtacaattcctcgcttccgtgtcagggaaggtgtcatgcctcgatacatgtggtgacttgctggtcaccctgcagagtctcagcaggcagggtgagaaaaggtcgttacagctgagcggcaaggttaacgcaatgactttcacattcgacaatgttttacccggtaagtataaaatctctattatgcatgaggactggtgttggaagaataagtccctcgaagttgaggtgttggaggacgatgtaagcgcagtcgagttccggcaaactggatacatgctgcgctgtagcctgtctcatgcaatcaccctagagttctaccaagacggaaacggtcgcgagaacgttggcatctataacctgtctaaaggggtaaacagattttgcctgagcaaacctggtgtctacaaagtgacacctaggtcatgtcaccgtttcgagcaggctttctacacctacgacactagcagtccatctattctgaccctcacagcaataaggcaccacgtccttggcactattacgactgacaagatgatggacgtgaccgtgactatcaaaagttcaatcgattcagagcccgcactggtgctgggcccccttaaatctgttcaggaactgcgtagagagcagcaattggcagaaattgaggccaggcgacaggagagagagaaaaatggcaatgaggagggagaagagagaatgaccaaacctccagtccaggagatggtggacgaacttcagggtccattttcgtatgatttcagctactgggccaggtcaggcgagaaaatcacagtgacaccatcgtccaaggaactgctgttttaccctccttcaatggaagcggtggtgagcggcgaatcttgtcctggaaagctgatcgagattcacggtaaagcgggtctttttctcgagggacagattcatcctgaacttgagggtgtcgaaatcgtaataagtgagaagggcgcctccagccctctcattactgtttttaccgacgacaagggcgcgtacagtgtgggccccctgcactcagatctcgaatacaccgtcacctcccagaaggaaggctatgtgttaacggcagtggaaggtacaatcggcgattttaaagcctacgccttagcaggagtgtcttttgagattaaggctgaagacgatcaacctttgccgggtgttttgctgtccctctcaggcggattgttccggagtaatttactgactcaggataatggcatcctgactttctctaatctcagtcccgggcagtattatttcaagccaatgatgaaggaatttagatttgaaccatcctctcaaatgatcgaagtgcaggaaggacagaatctcaagataactatcacagggtatcggacagcttactcgtgctatgggactgtgtcgtcgctgaacggcgagcccgaacaaggcgttgcaatggaagcggttggccagaacgactgctctatttatggtgaggacacagtaaccgacgaggaagggaaatttcggttgagaggtctgctgcctggctgcgtctaccacgtccagcttaaggctgaagggaatgatcacattgagcgcgccttgccacaccaccgggtgattgaagttggcaataatgatattgacgacgttaacattatcgtgttcagacagatcaatcagttcgacctctcaggcaatgtcatcacaagctccgaatatctgcctaccctctgggtgaagctgtataagtcggaaaatctggacaaccctattcagaccgtctctttgggacaatcgctctttttccatttccccccattattgagagacggcgagaactatgttgtgctgctggatagcacattaccccgctcgcaatatgactacatcctgccccaagtgagcttcaccgccgtcggataccataaacatattactctcattttcaatcccacacgcaagttacctgaacaagacatcgcgcaagggtcttatattgcccttcctctgacattgctggtgctcttggcaggatacaaccacgacaagctcattcctctcctgttgcagctcacctcacggctccagggagtcggagctctagggcaggcagcttctgacaattccggtccagaggacgctaagaggcaggcgaaaaaacagaaaacaaggcgcacactgcgcttgcaggaagaattccagctgatgtggtgccttgtgccttggcgtgggaccctgggaatacatcttttttcttctctgcccttcgcaagcgaaattctcctggaaacaacggccacttgcattcactactag

SEQ ID NO: 44068 - DNA, 3669 bp, Artificial Sequence
  Description of Artificial Sequence: Synthetic coding sequence
atgctggtgggccagggcgccggccccctgggccccgccgtggtgaccgcggctgtggtccttttgctctcgggcgtaggacccgcacacggttccgaggatattgttgtaggttgcggaggattcgttaaatccgacgtggagattaattacagcttaatcgagataaaattatatacaaaacatggaactttgaagtatcagaccgattgtgcaccaaataacggatatttcatgatccctttatacgataaaggcgactttatactaaagatcgagccaccgctcggatggtctttcgaaccgaccacagttgagttgcacgtagacggagttagtgatatttgtaccaagggcggtgacattaactttgtatttaccggattcagcgtcaacggaaaagtgttaagtaaaggtcaacccctcgggccagccggggtgcaggtgagccttagaaacacgggcacagaggccaagatacaatccaccgtgacccagcccggcggcaaatttgcttttttcaaagttttgcccggcgactatgagatactggccactcatcccacatgggctctgaaggaggccagtactactgtccgagtgacaaattccaatgcaaacgctgcatctcctctaatcgtggctgggtataatgtctcagggtccgtgcggagtgatggggaacctatgaagggcgtgaaatttctgttattctcgtcactggtcaccaaggaagatgttctggggtgcaacgtgagtcccgtgcctggttttcagccacaggatgaatcgcttgtgtatttgtgctatacagtgtctcgggaggatgggagcttctcattttattccttacctagtggcggctacacagtgattcctttctaccgcggcgagagaattacgtttgatgtcgctccctcccggctggacttcactgtcgagcatgacagtttgaagatcgagccggtatttcacgtcatgggttttagcgtgacgggccgggtactgaacgggcctgaaggagacggggtacctgaagccgtggttaccctgaataatcagatcaaagttaagaccaaagcggacggttctttccgcctggagaacattaccactggcacatacacaatccacgcccagaaagaacacctttatttcgagactgtgaccataaagatagcaccaaacactccccagctggctgacattgtagccaccggattttcagtgtgcggccaaatttccatcatacgattcccggacactgtcaagcagatgaataaatacaaagtagttctttcttctcaggacaaagataaatcgctcgtcactgtcgagacggatgcacacggctctttttgttttaaggctaaccctggtacttacaaggttcaggtaatggttccagaggccgagacgagagccgggcttaccttgaagcctcagacgtttcccctcacagtaacggaccgtcccgtcatggatgtcgcattcgtccaatttctcgctagcgtgtccggtaaggtgagctgccttgatacatgtggtgatctgctggttacgctccagagcttgtctaggcagggagagaaacggtcactgcaactgagcggcaaagtgaatgccatgacgttcacgttcgacaatgttttaccggggaagtacaaaatcagcatcatgcacgaagactggtgctggaaaaacaagtcactcgaggttgaggtgctcgaagacgacgtgtctgcagttgaattccgacaaaccggttatatgcttcggtgctccctgagccacgcaatcaccctggagttctaccaggacgggaacggccgggaaaatgtcggtatttataacttaagcaaaggggtcaatagattttgccttagcaaacctggtgtctacaaagtgacaccacgctcctgccatagattcgagcaggccttctatacatatgataccagcagcccttcaatcctgacattgacagccatacgacaccatgtgttggggaccatcaccacagacaagatgatggacgtaacagtgacaataaagtcttccatagactccgagcctgcgctggtcctcggaccactgaagtctgttcaggaactgcgccgagagcagcagctggcggagatcgaggccaggagacaggaacgggaaaaaaacggaaacgaggagggtgaagaacggatgaccaagcccccagtgcaggagatggtagacgagctacaaggtcccttcagctacgacttcagttattgggcccggtctggagaaaagattacagttacaccttcgagcaaggaacttctcttctatccaccctccatggaggccgtcgtttctggcgaaagctgccccgggaagctgattgagattcatgggaaggctgggctttttctcgaggggcagattcatcctgaacttgaaggcgtggaaattgtgatctctgaaaaaggggcatcgtcgcccctcatcaccgtgtttacagacgacaagggcgcctactcagtgggcccactgcattcagatctggagtacaccgtgacctctcaaaaagagggctacgttctgaccgcggtagagggaactattggagattttaaagcctatgcactggcgggtgtatccttcgaaatcaaggccgaggatgatcaacccctccctggagtgctgctgtccctgagcgggggcctcttcagatctaatctcctcacccaggacaatgggatactgactttttcaaacttgtcacctggacagtactacttcaaaccaatgatgaaggagttcaggttcgagccctcctctcaaatgattgaagtgcaggaagggcagaacttaaaaattactattactggctataggactgcatattcctgttacgggaccgtcagttcacttaatggcgagcctgagcaaggtgtggcaatggaagccgtgggacagaacgactgtagtatctacggtgaggacactgtgactgatgaggaaggcaagttcagattgagaggcttgctccctgggtgtgtgtatcacgttcagttaaaagccgaggggaacgatcacatcgagagagcattgccgcaccatagagttatcgaggttggcaataacgacatcgatgacgtgaacataattgtttttagacagatcaatcaattcgacctgtccggcaacgttataacgtcttccgaatacctgcctaccctctgggtcaaactgtataaaagcgagaacctagacaatcccattcagaccgtgagtttgggacagagcctctttttccatttccctccactgctcagggacggagaaaattatgtggttttactggacagcacattgccaaggtcccagtacgactacatcttaccccaggtgtccttcactgctgtgggctaccacaaacatataaccctgattttcaaccccaccaggaagctgccagagcaggacatagcccaaggctcatatattgctctcccattaaccctgttggtgctccttgccggctacaatcatgataaactcatacctctactgctccagctgacctctaggctacaaggagtgggggcattgggtcaggccgcaagtgataattcgggtcctgaagatgcaaaacgccaggctaaaaagcagaagacaaggagaacctag

SEQ ID NO: 44069 - DNA, 3303 bp, Artificial Sequence
  Description of Artificial Sequence: Synthetic coding sequence
atggcccggttcgccttcttcaaggtgctgcccggcgactacgagattctcgccacccatcctacttgggctttgaaggaggcctctacgaccgtccgggtgaccaatagcaatgccaatgcagcgagcccactgattgtcgcaggctataatgttagcggctccgtccgaagcgacggggagccaatgaaaggcgtcaaattccttctctttagttctctggtgaccaaagaagatgtgctcggctgcaacgtgtcccctgtgccaggttttcaaccgcaggacgaaagccttgtttatctctgttatacagttagcagagaggacggatcattttccttctattctctcccctccggcggttatactgtcatcccattttaccgtggcgagagaataaccttcgacgtcgctccaagcaggttggatttcacagtggaacatgactccctgaaaatagagcccgtattccacgtcatggggttctctgtcactggaagagtcttaaatggtccagaaggggacggagtgcctgaggctgtggtgaccctgaacaaccagatcaaagtaaagacgaaagcagacggctcatttcgcctggaaaatatcaccacagggacctataccatccatgctcagaaggaacatctgtacttcgagacagtcaccataaaaatcgctcccaatacgccacagttagcagatatcgtcgccactggtttctcagtctgtggccaaatttccattattagatttcctgacaccgtcaagcagatgaataagtacaaggttgtgctgtcatctcaggacaaagataagtccctggtgactgtggagaccgacgcgcacggcagtttctgttttaaggccaatcccgggacctacaaggtgcaggtgatggtgcccgaggctgagacccgagctgggctgaccttaaagccccagacctttcctttgacagtcaccgacaggccggtgatggacgttgcctttgtccagttcctggcctccgtgagcgggaaggtgtcttgtctggatacatgtggcgacctccttgttaccctccaatccctcagcagacagggagaaaagagaagcctgcagctctccggaaaggtgaacgccatgacatttacgtttgacaacgtcctgcctggcaagtacaagatttccatcatgcatgaagattggtgctggaaaaacaaatctttggaagtggaggtgctggaggacgacgtctctgccgtggaattcaggcagaccggctacatgctgcgctgctccctgagccacgcgattacattggaattttaccaggatgggaatggcagagagaatgtaggcatctataacctgtcaaagggcgtgaatcgtttctgtttgagcaaacctggtgtatacaaagtcactccgcgtagttgccaccgctttgaacaagcgttctatacatacgatactagttcccccagcattctgaccctaactgcaatccgccatcatgtcctgggcacaattacaacagataagatgatggacgtaaccgtcacgataaaaagttcaattgattctgaacccgcccttgtcttgggacctctgaagtcagtgcaagaactacggagggagcagcaattagctgaaatcgaagccagacgtcaggagcgcgagaagaacggcaacgaagagggcgaggagcgtatgaccaagcctccagtgcaggagatggtcgatgagttacaagggcctttcagctacgactttagctactgggcccgctccggagagaagattacagtgacgccaagtagcaaagagcttctgttctaccctccctccatggaggcagttgtttccggcgagtcctgcccaggcaagcttatcgagatccacggaaaagcagggttgttcctcgagggacagatccacccagagcttgaaggggttgaaattgtgatcagtgaaaagggtgcatcttcacccctcattaccgtgtttaccgacgataaaggagcatattcagtgggcccccttcactccgatcttgagtacacagtaacaagtcagaaggagggctatgtcttaactgctgtcgaggggacgatcggggactttaaagcgtacgccttggcgggagtcagctttgagattaaggcggaggatgaccagcccttgccgggggtgctactgtccctgtctggcggcctgtttcgatcaaatctcttgactcaggataacgggatcctgactttttccaatttgagccccggacagtactactttaaacctatgatgaaagaattcaggtttgaacctagcagtcagatgatcgaggttcaggaaggacagaaccttaagataactatcaccggctacaggaccgcttatagctgttacggcaccgtgagttccttgaacggagagcccgaacaaggagttgcaatggaagcagttggacagaacgactgcagcatctacggagaggacaccgtgacggacgaagagggaaagtttaggctccgcggccttctgccaggttgtgtgtaccacgttcaactgaaagctgaaggaaatgaccacatcgagcgcgcactgcctcatcaccgtgtgatagaggtgggcaataatgacatagatgacgtgaatattatcgtgttccgccagataaaccagttcgacctgtcgggaaatgtgattacatcttctgagtacctccccacgctctgggtcaagttgtacaaatccgagaacctagacaacccaatccagacagtcagtttgggtcagtcgcttttcttccacttccccccacttctgcgagatggggagaattacgtagtcctcctcgacagcaccctgcctaggagccagtatgactatattcttcctcaggtcagtttcactgccgttggctatcacaagcacattacgctgatcttcaatccaacacgcaaactgcccgagcaggacatcgcccagggatcctatatcgccctacctttgaccctgctggtgttgctcgcaggctataaccacgataagttaattccactgttgttgcaactgacaagtcgcctccagggcgtgggcgctttgggccaagctgctagtgataactcaggccccgaggatgctaagcgtcaagcaaagaaacagaaaacgcgaaggaccctgcgactccaagaggagtttcaactaatgtggtgccttgtgccttggcgaggaaccttaggcatccacctattttcttccctaccatttgcaagtgagattttactggagactactgcgacttgcattcactactag

SEQ ID NO: 44070 - DNA, 4206 bp, Artificial Sequence
  Description of Artificial Sequence: Synthetic coding sequence
atggccccccagatgtacgagttccacctgcccctgagccccgaggaactgttaaaatcaggaggggtcaaccaatatgtagtgcaggaagtgctgagcattaaacacctcccgccccagctgcgagcctttcaggccgcatttagagcccagggacctttggccatgctccagcactttgacacgatctattcgatactgcaccacttccgctcaatcgatcctggtctcaaagaagacactcttcaattcctgatcaaagtggtctctaggcacagtcaggaactgccggcaattcttgatgacactacactcagcgggagcgacaggaatgcccaccttaatgcactcaagatgaattgctacgcactgatacggttgttagagagctttgagactatggcatcccagaccaatctggtggaccttgatttgggcggaaaaggaaagaaagccaggaccaaagcagcccacggctttgactgggaggaagaacggcagccaattttgcagctgctgactcagctactgcaattagatatccggcatttgtggaaccattctataatcgaggaggaattcgttagcctggtgacaggttgttgttataggctgctcgagaaccccacgattaatcaccagaaaaataggcccactcgagaagccatcacgcatcttctcggtgtggcgctaacccggtacaaccacatgctttctgccacggtgaagattatccagatgcttcagcacttcgagcacctggcaccggtcctggtcgccgcagtctcactgtgggctacagactacggtatgaagtccatcgttggtgaaatcgtccgcgagatcgggcaaaaatgcccccaggaactaagtagggacccatcgggaacaaagggtttcgctgctttccttaccgagctggctgaaagggtgccagctattttgatgagttctatgtgtatcttactggaccaccttgacggggagaactacatgatgcggaatgctgtgctggcggctatggcagaaatggttctgcaggtactgagcggggatcagcttgaggctgctgcaagagacactagggaccagttcttagacaccctacaggcccacggccatgatgtcaatagcttcgtcaggagcagagtacttcagctgttcacacgaatcgttcaacagaaagcccttcctctgacacgtttccaggctgtggttgccctggctgtcggccgcctggctgataaatccgtgctggtatgcaagaacgcaatacagctcttggcctctttcctcgctaataatcctttctcctgtaagctctctgacgctgatttggccgggccccttcagaaagagacacagaagctccaggagatgcgtgctcagcgacgcactgccgcagcctcagccgtgctcgacccagaggaagagtgggaagcgatgctgcctgagttaaaatctacactgcagcagctgctccagctccctcaaggtgaagaagaaattcccgaacagatagctaacacagagacaaccgaagatgtgaaggggcggatataccagctgctcgctaaagcctcctataagaaggctatcatcctgactcgagaagctacaggtcacttccaggaatctgaacctttcagccatatcgaccccgaggagagtgaggagaccagattattaaatatactgggactgattttcaaaggccccgcagcgagcacacaggagaagaatccacgtgagtccaccggcaacatggttacaggccagactgtctgcaaaaataagcccaatatgagtgaccccgaagagtcccgggggaacgacgaactggtcaaacaggagatgctcgttcagtatctccaggacgcttactctttcagcagaaaaataacagaggcaatcggcattattagtaagatgatgtatgagaatacaactaccgtggtgcaggaagtaattgagttcttcgtaatggtgtttcagtttggcgtgcctcaagccctgttcggggtaagaagaatgcttcctctgatttggagcaaggagcccggcgtgcgcgaggctgtactcaacgcatacagacaactgtacctgaacccaaaaggggacagcgcacgggcaaaggcacaggccctgatacagaacctgtccctgttactcgtggatgctagtgtgggcactatacagtgcttggaggaaatcttatgcgagttcgttcaaaaggatgagctcaagcccgccgtaacacagctgctctgggagcgagctaccgaaaaggtcgcctgttgcccgctggagaggtgcagcagtgtgatgctgctgggaatgatggcgcgtgggaaacccgaaatcgtgggtagtaacctcgacaccctggtgagtataggactggatgagaaattcccccaagactatcgcttggcccagcaggtctgtcacgccatcgctaacatctcagaccgacgcaaaccttccctgggcaaaagacacccccccttccgactgccacaagagcaccgcctgtttgagcgcctgcgggaaaccgtgaccaagggcttcgttcacccagatccactgtggattcctttcaaagaggtcgcagtgacgttaatctatcagttagctgaaggccctgaggtgatctgtgcccaaatcctacagggatgcgctaagcaagccctcgagaaattggaggaaaagaggacatcccaagaggacccaaaagagtcaccagccatgctacctacttttctactgatgaaccttctcagtttggctggggatgtggctttacagcaactggtgcatctagagcaggccgtttctggtgagctatgtcgtcggagagtcctgagggaagagcaagaacataagaccaaggaccccaaagaaaagaacacatcttcggagacgacaatggaggaggaattaggcctggtcggcgctacagccgatgacactgaggctgagctcataaggggaatctgtgaaatggaactgttggacggcaagcagacattggctgctttcgtgcccttgctcctgaaggtatgcaataatcccgggctctactctaatccggacctgtccgccgccgcctctctcgccctgggaaagttctgcatgatttccgcaacattttgtgattcacagctccgtcttttgtttaccatgctcgaaaaatcccctctccccatcgtacggagtaatcttatggtggcaacgggcgaccttgctatcaggttccccaacctcgtggacccctggactccccacctttacgcccgtctgagggacccggcccaacaagtgcggaagaccgctggactcgtaatgacccacctgatccttaaggatatggttaaagtgaaggggcaagtctcagagatggcggttttactaatcgacccagagcctcagattgctgcattggctaaaaatttttttaacgagctgagtcacaaaggcaacgcaatttacaacctgttaccagatatcattagtcgcctcagcgacccagagcttggagtggaagaggagccatttcatacaatcatgaaacagctgctgagttacatcacaaaggacaagcagaccgaatccctggtggaaaaactctgtcagagatttcggacctcgaggaccgagagacaacaaagagaccttgcatactgtgtgagtcagctgccgttgaccgagcgcggccttaggaagatgctggataactttgattgcttcggggataaactgagcgatgagagcatctttagcgcatttctcagtgtggtcgggaaattgcggcgaggcgccaagcccgagggtaaggccatcatcgatgaatttgaacaaaagctgcgcgcctgccacaccagaggattggacggcattaaggaattagagatcggccaggcaggttcgcagcgtgctccgtcagctaagaagcccagcaccggcagtcggtaccagccactggcctcaaccgcatctgacaacgattttgtgaccccagagccacggaggaccacaagaaggcacccgaacacccagcagcgagcctcgaaaaaaaagccaaaggtggtatttagctctgacgaatcctctgaggaggacctgagtgccgagatgactgaagatgagacgccgaagaagactacccctatcctccgggcttctgcccggcggcacagaagctag

SEQ ID NO: 44071 - DNA, 2820 bp, Artificial Sequence
  Description of Artificial Sequence: Synthetic coding sequence
atggccccccagatgtacgagttccacctgcccctgagccccgaggagctgctgaagtccggaggcgttaaccaatacgtggtgcaggaagtgcttagtattaaacatttgccaccacagctgcgcgccttccaagctgcttttcgagcccagggacccctggccatgctgcaacatttcgataccatctattctattctacatctggtgacagggtgctgctaccgcttattagagaaccctacgattaaccatcagaagaataggcccacaagagaggccattacgcacctgttaggagttgcacttacccggtacaaccatatgttatccgccaccgttaagattatccaaatgctccagcactttgaacacctggctcctgtcctggtggcggcagtgtccctctgggctacagattacggaatgaagtcaatagtgggagagattgtgagggagatcgggcagaagtgtccacaggaattgtcacgcgaccccagcggcacaaagggttttgcagctttccttactgagcttgccgagagggtgccggcgatcctcatgagtagcatgtgtatactcttggaccacctcgatggggagaattacatgatgagaaatgctgtgttagccgccatggcagagatggtgctacaggttctgtcgggcgatcagttggaggcagccgctcgggacacacgcgatcagttcctggacacgcttcaggcacatggccatgatgtgaattcctttgtgaggagtcgagtcctgcagcttttcacccgcatcgtccagcagaaggcgctgcccctcactcgttttcaggccgtagttgcattggccgtggggcgcttggctgacaagtctgtgctggtatgtaagaacgcaatccagctgctggcaagcttccttgctaacaaccccttctcctgcaaactatccgatgctgacttagccggacctctccagaaggagacccagaagctgcaggagatgcgggcgcagcggcgaacagccgccgcttcggctgtgctagaccccgaggaggaatgggaggccatgctgccggagctgaagagcaccctccagcaactgctccagctcccgcagggtgaagaggaaatcccggagcagattgcaaacacagagactacagaggacgtcaagggcaggatttaccagctcctcgctaaggctagctacaaaaaagccatcatcctaacgagggaggccaccggccacttccaagagtctgagcccttcagccatatagacccagaggaatctgaggaaactagactccttaatatccttggcctaatttttaaaggacctgcagcttctacacaggaaaagaacccaagggagagtaccgggaacatggtgacgggacagactgtgtgcaagaataaacccaacatgtcagatcctgaagagagcagaggcaatgacgagctagtgaagcaagaaatgctggtccagtacttgcaggatgcatacagcttttctcggaagatcaccgaggctattggcataattagcaagatgatgtacgagaacaccaccactgtggtgcaggaggttatagaattttttgtgatggtcttccagtttggtgttccgcaagctttattcggtgtaagacgcatgctgccactaatttggtctaaagaacctggcgtgagggaggccgttctcaatgcttaccggcaactttacctgaacccaaaaggggacagcgcacgagccaaggcacaggcgctaatccagaatctaagcctgctgttagtggacgcaagcgtagggacaattcaatgcctggaggagatactgtgcgagtttgtgcagaaagatgaactgaagcccgctgttactcagttactgtgggagagagccaccgaaaaggtggcatgttgccccctggagagatgttcctcagtgatgttacttggcatgatggccagaggtaagccagagatcgtggggtcaaacctggatacgctggtgtccattggcttggacgagaaatttcctcaagattaccgactggcacagcaggtgtgccacgcaattgctaatattagcgacaggcggaaaccaagccttgggaaacgccaccccccttttcgcctaccacaggagcataggctttttgagagactgcgggagaccgtgacgaagggattcgtgcacccggaccccctttggatcccttttaaagaagtggccgtgacgctgatttaccagctagcggagggccctgaggtaatctgtgcccagatcctgcagggctgtgcgaaacaggctctcgaaaagctggaggagaagcgtacaagccaggaggaccccaaagaaagccccgcgatgctgcccacattcctattgatgaatctgctgagtctcgcaggagacgtcgctctgcagcagctggtccacctggagcaggccgtctccggcgagctgtgtaggagaagagtgttgagggaggaacaggaacacaagaccaaagaccctaaggagaagaacacatcttccgagaccactatggaggaggagctcggtcttgtgggagcgacggcggatgatacagaagccgaactgatccgtggaatctgcgagatggagctccttgacggtaaacagactcttgcagccttcgtccccctgctccttaaggtctgcaacaatccagggctctacagcaacccagacttgtcagcagccgcttccctcgcgcttggcaagttctgcatgatctccgctactttttgtgactcccagcacttcgcaattccacgccgggtggacaacttacggtag

SEQ ID NO: 44072 - DNA, 4071 bp, Artificial Sequence
  Description of Artificial Sequence: Synthetic coding sequence
atgctgtgcaagcggtactgccccagcaacatcttccaccacagcttggagttgttccgcttgccttttgaactgagggggccgtggctctgctgttccaccctgattctaagcaccgccttctgcatggttagcaggcactctcaagagctcccagccatcctcgacgacactactctgagtggttctgatcgtaacgcacatctgaatgctcttaagatgaactgttatgctcttatacgcctcttagagagcttcgagaccatggcctctcagaccaacctggtagatcttgatctcggcggaaaaggcaagaaagccagaaccaaagcggcacatgggttcgattgggaagaagaaagacagcccattctccagctgcttacccagctcctgcagctagatataagacacctctggaaccattcgataattgaggaagaatttgtgtccctagtgactggctgttgctaccgcctgctcgagaatccgaccataaatcaccaaaaaaaccggccaacccgtgaagctatcactcacctacttggcgtagccctgacccgctacaaccatatgcttagtgcaaccgtcaaaatcattcagatgctgcagcacttcgagcatctcgcccccgtgttagtcgctgcagtttctctgtgggcgaccgattacggcatgaaaagcattgtcggggagatcgtgcgcgagataggacagaagtgccctcaggagctctcaagagatccgtcaggaaccaagggctttgctgcttttttaacagaactggcggagagggtacctgccatactgatgtcctccatgtgtattctcctggatcacctagatggagagaactatatgatgcgtaatgcagtcctcgcggcaatggccgagatggtcctgcaggtcttatctggggaccagctggaggccgccgcaagagacactagagaccagttcctggacactctgcaggctcacggccatgatgtaaactcctttgtgagaagtcgcgtgctccagctgtttactcgcatcgtccagcagaaagcgctgcctctcacgaggttccaagccgtagtggccctcgctgtaggacggctcgccgacaagtccgtcctggtttgtaaaaacgccatccagctgctcgcaagctttctcgccaacaatccttttagctgtaaactgtcagacgctgatttggcaggccctctgcagaaggaaacgcaaaagctgcaggagatgagagcccagcgccggacagccgctgcctcagcagtgctggatccagaggaggagtgggaagcaatgttgcccgagctgaagtccacactccagcagctgttgcagttgcctcagggagaggaggagatccccgagcagatcgcgaacaccgaaacgacagaggatgttaaggggagaatttaccaactccttgccaaggcgtcctacaagaaggctattatactaacgcgggaagccaccgggcatttccaagagtcagaaccctttagccacatagaccccgaggagtccgaagagacgagactgttgaacattctgggactgatattcaagggcccggcggcatccacacaggagaaaaatcccagggaatccactggaaatatggtcacaggccagactgtctgcaaaaacaaacctaatatgtcagaccccgaggaaagccgggggaacgacgagttggtgaagcaggaaatgcttgtgcagtacctccaggatgcctactctttcagcagaaaaatcacggaggccatcgggataattagcaagatgatgtatgagaatactaccacagtagtgcaggaggtaattgaattttttgtgatggtctttcaatttggcgttcctcaggctctgtttggagttcggcggatgttgcctcttatctggagtaaggagccaggtgttcgagaggctgtactaaacgcttacaggcagctctacttgaaccccaagggggatagcgccagagccaaagcacaggcacttattcagaatctatcattactgttagttgacgccagcgttggcacaatccagtgcctcgaagagattttgtgtgaattcgttcagaaagatgagctcaaacctgccgtaacgcagctgctgtgggagagagccacggagaaggttgcatgttgccccctggaacggtgcagcagtgtgatgctcctgggcatgatggctcgcggaaaaccagaaattgttggttccaacttggacactctggtctctattggtctggacgaaaagtttccacaggattaccggcttgcgcaacaggtctgccacgcaatagctaatatatcggacaggcgcaaaccaagcctgggtaagaggcacccgccatttagattgccgcaggaacaccgtctcttcgagcgactccgcgagacggtgacaaaagggttcgtccatcccgaccccttgtggatccctttcaaagaggtagcagttaccctgatataccaattagcagagggaccggaggtcatctgtgcgcagatcctgcagggatgcgccaaacaggctttagagaagctggaggaaaaaaggacgtcccaggaagaccccaaagaaagtccggcaatgctgccaactttcctactaatgaatctgttgagccttgccggcgacgtggcccttcagcagcttgtgcacctagaacaggcggtatccggagaattatgtcgtcggcgggttctgcgtgaggagcaggagcacaagacaaaggaccctaaggaaaagaacaccagcagtgagaccacaatggaagaagaacttgggctagtcggagccaccgccgacgacacggaggcagaactaatcaggggtatctgtgaaatggagttgttggacggcaagcaaacactggctgcattcgtcccactgctgctgaaggtgtgcaacaatccgggcctgtattccaatccggacctgtcggccgcggcctccctggccctgggaaaattctgcatgatctctgcaaccttctgcgactcccaactccgactgctgtttacaatgttagaaaaatctcctttgcccatcgtgagatccaatctgatggtggccaccggcgatctggctataaggttccccaatcttgtggatccatggacacctcacctctacgctcggctgagagaccccgctcaacaggtcagaaagacagccggtctcgtgatgactcatctgattctgaaggatatggtgaaggtgaagggacaggtctcagagatggccgtgctgttgattgatccggaaccacagatcgcagcactcgcaaaaaatttcttcaatgagctgtcgcacaaaggtaatgccatctacaacctgctgcccgacatcattagtcgactgtccgatcctgagttgggagtcgaagaagaacccttccacaccatcatgaaacaattactcagctatatcaccaaagacaaacagacagagtcactcgtggaaaagctgtgtcaaaggttccggacgagtagaacagagcggcagcagagagacctcgcttactgcgtgagccagcttcccttaaccgagcgggggttacggaaaatgctggacaacttcgattgctttggcgacaaactgtctgacgagtctatcttctcagcattccttagcgtggtcggcaagctgaggagaggggccaaacctgaagggaaagccatcatcgacgagttcgaacagaaactcagagcttgccatacccgcgggcttgatggaatcaaggagctcgaaatcggtcaggctggttcccagagagcaccctcagcaaaaaaacctagtacaggaagccgttaccagcctctcgcctccacagcatctgacaatgactttgtgacccctgagccacgacgtaccactcggcggcaccccaacacacagcagcgcgcaagtaagaaaaagccaaaggtggtgttctcctccgacgaatcttctgaggaggacctgtctgctgaaatgacagaagacgaaacccctaaaaagaccacacctatcctgagggccagcgctagacggcacaggagctag

SEQ ID NO: 44073 - DNA, 2382 bp, Artificial Sequence
  Description of Artificial Sequence: Synthetic coding sequence
atggacagctggttcatcctggtgctgctgggcagcggcctgatctgtgttagcgctaataacgccactactgtagctccttcagtagggatcacgcgactcattaactccagtactgccgagcctgttaaagaggaggcaaaaacaagcaacccaacctcatctctgacaagcctcagtgtcgcacctacattttctccgaatattacactggggccaacatacctgacaaccgtcaactcttccgactcagataatgggacgacgcggaccgcttccacgaatagcattggaatcaccattagcccaaatggaacttggctccctgacaaccagttcaccgacgccagaaccgaaccatgggaagggaactcaagcaccgcagccactacacccgaaacatttccccctagtgacgagactccaattattgccgtgatggtggccctgtcctccctcttggtgatcgttttcatcattatagtcctctatatgctgaggttcaagaagtacaagcaggcaggctctcattctaattcattccggctttcaaacggaaggacagaggacgtggaacctcagagcgtgccactgctggccagaagtccgtctaccaaccgtaagtaccctcccctcccagtggataagctcgaagaggagattaaccggcggatggccgatgataacaagctgtttcgtgaggagtttaatgctcttcccgcctgtcctattcaagctacttgcgaagccgcgagcaaggaggaaaataaggagaaaaataggtacgtgaatattctgccctacgaccacagtcgtgttcacctgacaccagtggagggtgttcccgattctgactacattaacgcgtctttcatcaacggctaccaggaaaaaaataagttcattgcagcccagggccccaaagaagagacagtgaacgatttttggcgaatgatctgggaacaaaacacagccactatagtgatggtcactaacctcaaggaacggaaggaatgcaagtgcgcccagtactggcctgaccagggctgctggacctacggtaacattcgggtatctgtggaggatgttaccgtgttagtggattacaccgttcgcaaattctgcatccagcaagttggagacatgaccaacagaaagccacagagattgataacacagttccattttacatcttggcctgactttggcgtgcctttcacaccaattggtatgctgaaatttctcaaaaaggtcaaggcctgcaacccacagtatgctggcgctatagtggtgcattgttcagctggcgtcggtaggaccggcactttcgtagtcattgacgcgatgctggatatgatgcacacagaacgaaaagtggacgtctatgggttcgtgagcaggattcgcgctcagaggtgccagatggtgcaaactgacatgcagtatgtgttcatataccaggccctcctcgaacactacttgtacggcgatactgagctggaagtcacttccctggagactcacttgcagaaaatctacaataagattcccgggacctccaacaacgggctggaggaagagttcaagaagctgacatcaatcaagattcagaatgataagatgaggacaggcaatttacctgccaacatgaaaaaaaaccgcgtgctacagatcatcccctatgaatttaacagagttattatccctgtgaagcgcggggaggaaaatacagactatgttaacgcgagctttattgacgggtatcgccagaaggattcatatattgcaagtcagggtcccctccttcataccatcgaagatttctggaggatgatctgggaatggaagagctgctctattgtgatgctgaccgaacttgaagagagaggtcaggagaagtgtgcacaatactggcccagcgatggcctcgtcagctatggcgacattaccgtggaactgaagaaggaggaggagtgtgagtcatacaccgtgcgtgacttactcgtgaccaacactagggagaataagtctaggcagatccggcagttccacttccacgggtggcctgaggtcggcattccctcggacgggaaaggtatgatctctatcattgctgcggtgcagaaacagcagcaacaatccggcaatcaccccataacagtgcactgttcagctggcgccggacggacggggactttttgcgcactgtctaccgtgctggagcgggtaaaagcagagggcatcctggacgttttccaaactgtgaaaagcctgcgtcttcaacggccacatatggtgcaaaccctagagcaatatgagttctgttacaaagttgtgcaagagtatatcgacgcgttctccgattatgctaacttcaaatag

SEQ ID NO: 44074 - DNA, 1119 bp, Artificial Sequence
  Description of Artificial Sequence: Synthetic coding sequence
atggccgccgagcggcaggaggccctgcgggagttcgtggccgtgactggggcagaagaagaccgcgccaggtttttcctggaatccgcaggctgggacctgcagatcgccctggccagcttttacgaagatgggggggacgaggatattgtcactatttcgcaagcaacaccttcatcggtgtcccggggcaccgccccaagcgacaacagagtcactagcttccgggacctgattcacgatcaggacgaggacgaggaagaggaggagggtcagcgcgaccgtttctacgcaggaggatctgagcggagcggccaacagattgtggggccaccgcgcaagaagtccccaaatgaactcgtggacgatctgttcaaaggggctaaagagcatggtgccgtggcagtcgagcgtgttacaaagagcccaggcgaaacgtccaaacccagacccttcgccgggggaggttaccgcttaggggctgcgcctgaggaggagagtgcttacgtcgcgggggagaaacgccagcattcaagccaggatgtacatgttgtattaaagctgtggaagtcaggcttttccttggataacggggagttacggtcctaccaggacccatctaacgcccagttcttagagagtatacgccgtggcgaggtgccggccgaactgagaaggctcgcccatggcggacaagtgaatttggacatggaggaccatcgcgacgaagacttcgtgaagccaaagggagccttcaaagccttcacaggagaggggcaaaagttgggctctacagcccctcaagttcttagtacctcatctccggcgcagcaagcagaaaacgaggcgaaggctagcagtagtattctgattgacgaaagtgagcccacaacgaatattcaaatccgcttggcggacggtggacgcctggttcaaaaattcaaccattcgcatagaatatccgatatccgtctgttcatcgtcgacgctaggcctgcaatggctgcaacctcatttatactaatgaccacgtttccaaacaaagaactcgctgacgagagtcagactctcaaggaagcaaacctgcttaacgctgtgatcgtgcagcggcttacctag

SEQ ID NO: 44075 - DNA, 1020 bp, Artificial Sequence
  Description of Artificial Sequence: Synthetic coding sequence
atggccgccgagcggcaggaggccctgcgggagttcgtggccgtgaccggggcagaagaagacagggcccgcttcttcctggaatccgctggatgggatcttcagatcgctctggcttctttctatgaggatgggggggacgaggacatcgtcacgatcagccaggctaccccatcatcagtgtcacgagggaccgcccccagtgataatcgggttacgtcgtttcgggacctgatccacgaccaggacgaggatgaagaagaggaggaggggcaacgcttttacgcagggggttccgaacgtagcggtcagcagatcgtcggtcctccacggaaaaaaagccccaacgagctagtagatgatttattcaaaggggcaaaagaacatggggccgtcgccgtggagagggtgaccaagagcccgggagagacctccaagccacgcgtccatgtcgtgctcaaactgtggaaaagcggctttagcctcgataacggcgagcttcgcagctaccaggacccatctaatgcacaatttttggagtccatccgacgcggggaagttccagccgaactcaggcggctggctcatggcggccaggttaacctcgatatggaagatcacagagacgaggacttcgttaaaccaaagggggcttttaaggcgtttaccggcgaagggcagaagctggggtccactgctccacaggtgttgagtacgtcgtcaccagcccaacaagccgaaaatgaggccaaggcctccagtagcatcctgatagacgagtcagaaccaacaaccaacattcagatcaggttggctgacgggggcaggctggtgcaaaagtttaatcatagccatcgaatctcggatatcaggctattcatagtggacgcacgcccagccatggcagcgacctccttcattttgatgacgaccttccctaacaaggagttggctgatgagtcacagactttgaaggaggccaatctcctcaacgccgtcatcgtgcagcgccttacttag

SEQ ID NO: 44076 - DNA, 780 bp, Artificial Sequence
  Description of Artificial Sequence: Synthetic coding sequence
atgaccaagatgaagatgcggcggaagcggaaggcccggggcgccaaggagcatggcgcggttgcagtcgaacgggtcacgaagtcccccggggaaacttcaaagccgcgccctttcgcagggggcggttatcgtctgggggctgctccagaagaggagtccgcttatgtagcgggcgaaaagcggcagcactcaagccaggacgtgcacgttgtgttaaagctgtggaagtccgggttttcactggataacggggagctcagaagttatcaggatcccagcaacgcccaattcctagagtctatccgtagaggcgaggttcctgccgagctcagacgcctggcccacggcggacaggtcaacttggacatggaggatcaccgggatgaagatttcgtgaagccaaagggggcattcaaggctttcactggtgaggggcaaaaactcggttctacagcgccacaggtactttccaccagcagtcccgcgcaacaagctgagaatgaggcaaaggcttcatcaagcatcttaatcgatgaatctgaacctactacaaacatacagatcagactagccgatggcggtaggctggtgcagaagtttaaccattcacatagaatatctgatattcgtttgtttatagtagacgctcgacccgcgatggccgccacctcctttatcctgatgaccacgtttcccaacaaagaactggcagatgaaagccagactttgaaggaagctaatctcctgaacgctgtcatcgtccagcgccttacatag

SEQ ID NO: 44077 - DNA, 1119 bp, Artificial Sequence
  Description of Artificial Sequence: Synthetic coding sequence
atggccgccgagcggcaggaggccctgcgggagttcgtggccgtgactggcgccgaggaagatcgggccagatttttcctggagtcagccggatgggatttgcaaatcgccctcgcctctttttatgaagatggaggcgatgaagacattgtcaccattagccaggcaacaccttcaagtgtttctagaggcactgcacctagtgacaatagggtaacgtcgttccgggacctcatccacgatcaggatgaggacgaggaggaagaggaaggtcagcgcagcaggttctacgccggaggaagtgaacgatccggacagcaaattgtcggccctcctcgaaaaaagtcacccaacgaactggtggacgatttattcaagggagcaaaagaacatggcgccgttgctgtggaacgagtaacaaagtctccgggggagacttcaaagccacggcctttcgccggaggggggtatcgtctcggagctgctcccgaagaggagagcgcgtacgttgccggtgagaaacgccagcattcatcccaagatgtccacgttgtcctgaaactttggaaatccgggtttagccttgataacggtgagcttcggagctatcaagatcctagcaatgctcagtttcttgagtccatcaggcgtggggaagtgccggctgaactgcggaggctcgcccacggaggtcaggtcaatctggacatggaagatcatcgcgatgaggattttgttaagcctaaaggagcctttaaggctttcaccggggaggggcaaaaattgggatcaactgccccccaggtgctttccacctcatcccccgcccagcaggcagagaacgaggcgaaggcttcgtcttctattctaattgatgaatccgagcccaccaccaatatccagattcgtttggccgacggcggacgactcgtgcaaaaatttaatcactcccataggatatctgatatccgactgttcatcgtggacgcccggccggccatggcagcaacaagcttcattctcatgactacgttcccaaataaagaactggcagacgagtcccagaccctcaaggaggcgaatctcctgaacgctgtgatcgtgcagagactgacctag

SEQ ID NO: 44078 - DNA, 1056 bp, Artificial Sequence
  Description of Artificial Sequence: Synthetic coding sequence
atggaggacagccaggagaccagccccagcagcaacaacagcagcgaagagttaagttcagctctccacttgagtaaaggaatgagcatttttctggatatcttgcggcgtgccgataagaacgacgacggcaagctgagtttcgaagaatttaaggcttattttgctgatggtgtgttgtctggtgaggagttgcacgagctttttcacactatcgatactcataacacaaacaatctggatactgaggagctgtgtgaatatttctcccagcacctgggggagtacgaaaatgttctggctgctttagaggatctgaacttaagcatcctgaaggccatggggaaaacgaaaaaggactatcaggaagcgtctaatctggaacagttcgtgacccggttcctccttaaggagaccctcaatcagctccagtccctgcagaattcattagagtgtgccatggaaactacggaagaacaaaccaggcaggaacgtcaaggccctgccaaacccgaggtgctgagtatccagtggcctggcaagagatccagccggcgcgtccagagacataattctttctcacccaacagcccgcagttcaatgtttcaggacccggtctgctggaggaggacaatcagtggatgacccagatcaatcggcttcagaagctaatcgatagactcgagaagaaggatcttaaacttgaaccaccagaagaagaaattattgaggggaatactaaatcccacattatgttggtgcagagacagatgtccgtgattgaggaggacctcgaagaattccagctggcgcttaagcactacgtcgaaagtgcctcatcgcaaagcggctgcctgcggatctccatacagaaactgagcaacgaaagcagatacatgatatatgagttctgggaaaattcttctgtatggaattcccacctgcaaacaaactactcaaagaccttccagagaagcaatgtggatttcctggagaccccagagctcacatccactatgcttgtccctgcctcctggtggatcctcaacaactag

SEQ ID NO: 44079 - DNA, 303 bp, Artificial Sequence
  Description of Artificial Sequence: Synthetic coding sequence
atgctggtgcagcggcagatgagcgtgatcgaggaggacctggaggaatttcagctggcactgaagcactacgtcgagtcagccagtagccagtccggctgccttcgaatttcaatccagaagctgtccaatgagtcccgatatatgatctacgagttctgggagaatagttcggtttggaattctcacctacagactaattactctaagactttccaaaggtccaacgttgatttcctggaaacaccagaactgacttcgactatgttggttcctgctagctggtggatcctgaacaattag

SEQ ID NO: 44080 - DNA, 303 bp, Artificial Sequence
  Description of Artificial Sequence: Synthetic coding sequence
atgctggtgcagcggcagatgagcgtgatcgaggaggacctggaggagttccagctcgcccttaaacactatgttgagtcggcatcttctcaatctggctgtctgcgaataagcatacagaaactgtctaatgagtcgcgatacatgatttatgagttctgggagaacagtagcgtgtggaactctcaccttcagaccaattacagcaaaaccttccagagatccaatgtggactttctggagactccagagctgacatcaacaatgctggtccccgcaagttggtggatcttaaacaattag

SEQ ID NO: 44081 - DNA, 2499 bp, Artificial Sequence
  Description of Artificial Sequence: Synthetic coding sequence
atgcacaagcactacaaggtgcacttcgccaaggacgcccagagcccaaacggccactacttctgggatcccgagctgggacaccgcaagggctgctgccatcaatggcggcaggattctgcggcccttcgggcacacggcccatgccgtccaagcccccagtctcactggcaactcgcctaccattcccaccaggtgggaggcagtggctggcgccgaggccttctgccctcagtgttgcagcaacaaaggcagccccagtcccagccttcacctccatctcccttgcggcagagattgtgtcctattcatgaagcccaaaaagggcttcctgccacatcaacagtaccgaaagagcctgcaagtgcaccccaggcccccaccctgcccacaactgcgcctgcaatggctcgatccgggccagctctcccatccgctgccggagtgctgctcaaaccctccgagcctaccgacgcccgccctctgcctgcacctgcagcgtgtggatctttcaccgcgtacagcagcgatatcttaaccgaagatgatgtttactgcagttgtctcgctaagaccctctgtcatgtccccgttcctgtgacagttggtttttacgctccctttgggtgtcggctccacatgatgctggacaaaatcacagcactgatgcagcaggaagcggctcagcgcgagagcgaggaattgcagcatgttcaatggagaccacgggccgtgtcaggttggggagtgccacagttactgtggtaccttgtgtttctccaaccaatcattacagaggtccatttgcggcggcggaacgttcagtttctctttatccggtttagtgcctggcagtatgcagggaccgacaaattatgggcgggccttgtgaccactctgtgtgagggtatcagaaggcactacggggctttgccgttcagtgtctacagtgtcctcggaaataagccagccacccgccaggactgctgtcagagtgaatggcactgtcgacggagggtctgcctcggactactagctcttttagctgcactggggctgggtgtaggcctgttatacctgtctctggggggtcacgcgctgggtcatgggtcgccctcagggagtctccttaaggtttttggaggcgccgcaaccacactgtccggtagcggcctgcttatggcagtttattctgtcggcaaacacctgtttgtttcccagagaaagaagattgagaggctagtgtcaagggagaagttcggttcacagctgggattcatgtgcgaagtgaaaaaagaggtcgagctgctgaccgacttcctgtgctttttggagatctaccagcgccgcaggcttagggttgtgctggaggtgaccgggctggatacatgctacccagagcgggtggtgggagtcctcaacgctatcaacacgctgttgtcagacagccacgccccatttatatttatcctcgtggtagatccctcaattctggcggcatgcctggaatccgctggcaatatgaagggaacagccgataatggatacttgtttctcaatcgcaccgtcactttgcctttcagcgtgccaattatgggacggagaactaagcttcagttcctgcatgatgcagtgcagagccgcgatgatctgctgtaccgggagatgacgcgcaagccatggttgcccggtgatgccgggggcgaatccgcccagctgctggcagtgcaggcacaggccggaactgaaagggggcagggtcgcatagacgacgaagcggctcggaggatccaggaggctctgttttgcctccatgatgagcgcgactgcctgtatgagtatgtgccagacaatgtcgtctcaatgcggcgcattgtgaacacagtccccatcacagtcagactgctgcagcagcagcagcagcaaggtgacttcggaggccctactccccggcaggcggtggcctgggtggttctggccaaccaatggccctgccggctgagctgggcactgcaatgcctggaagaccgccagcagaccggcggagcaccagagggcagggctcgactgtgggacgtctttcgagacaattccagagagctgcatactatgactaaggcacttcaaaacgtactggatctggacggggatccagagttatttgaaagattcctaggggctgattttccctttacggttgcggaggctcagagcctccttcgttgcacagttaatctggatcatagcatcagaagaaggatgggcttgatccgagccgtgtctgcgctgaagcctccatctccccccaagtccccaactcgagatacgccccatgctgcacatcgcgcaaacagtgcttcgagagctccgccatcaggccgagctagtggccaagctggggagggccaccatacgggcgacctagcccacagaggcaaactgtggccagtggcgtgcgcccttttcaggccgggccagtcatccccaggggggccatag

SEQ ID NO: 44082 - DNA, 1596 bp, Artificial Sequence
  Description of Artificial Sequence: Synthetic coding sequence
atgcagcaggaggccgcccagcgggagagcgaggagctgcagcacgtacagtggagaccacgagctgtaagcggttggggtgtgccacaactcttgtggtacctcgtgtttctacagcctattataacagaggtgcacctgcgtcggcgaaatgtgcagtttctctttatcaggtttagcgcgtggcagtatgcaggaacagacaagctttgggctggtctggtcactacgctgtgcgagggaataaggcggcactatggggcgcttcctttctctgtgtactcggttctgggcaacaagcctgccacccgtcaggactgttgccagagcgagtggcactgcaggagacgcgtgtgtttgggtctgttggctctcctggctgccctgggcctcggggtgggcctgctctacctgagcctggggggtcatgctctgggccacggttctccttcaggatctctcctgaaagtgttcggcggagccgccacaaccctgtccgggtccggcttactgatggctgtgtacagtgttgggaaacacctgtttgtgtctcagaggaaaaagattgagaggctggtttccagggagaaatttgggtcgcagctggggttcatgtgtgaggtcaagaaggaagtggagctgctgaccgactttctgtgctttcttgaaatttaccagcgcagaagattacgggttgtactagaggtgaccggcctcgatacatgctaccccgagagggtggtgggcgtgctaaacgctatcaataccctgctgtctgatagccacgcacccttcatcttcatcctagtcgtagatccatccattctggctgcttgtctagaaagcgcagggaatatgaagggaaccgccgataacgggtatctgttccttaacaggacagtgacactgcctttctctgttccaatcatgggcaggcgcaccaaacttcagttcctgcatgatgccgtgcagagcagagacgaccttctctacagggaaatgacaaggaagccctggctaccaggagatgccggaggagaaagtgcgcagctgctggcagtgcaggcacaggctgggacagaacggggacaaggaaggatcgatgacgaagctgctcgtcggattcaagaggcactcttctgtctccatgacgagcgagattgtttgtacgagtatgtgcccgacaacgtcgtgtcaatgaggagaattgtgaatactgtgcctatcacggttaggcttcttcaacagcagcagcaacagggcgatttcgggggcccaacccctcgacaagccgtggcctgggttgttttggctaaccagtggccttgtcggctatcttgggcgctgcagtgtttggaagatcgacagcaaaccgggggggcccccgagggccgggcgcgcctgtgggacgtgttcagggatacacctcatgccgcccaccgggctaatagcgcgtcaagggcaccaccatccggtagggccagcgggcaggccggcgagggccaccataccggagacctggcccatcgtggaaagctctggcctgttgcatgcgcattgttcagaccaggccagtcgtcccccggcggcccttag

SEQ ID NO: 44083 - DNA, 1833 bp, Artificial Sequence
  Description of Artificial Sequence: Synthetic coding sequence
atgcagcaggaggccgcccagcgggagagcgaggagctgcagcacgtacagtggagaccccgcgctgtgagcgggtggggtgtgccacaactactgtggtacttagtgttcttacaacccatcatcaccgaagttcacttgcgaagacggaacgtgcagtttttgttcatcagattctctgcttggcagtacgcaggaactgacaaattatgggccggtctggtcactacactttgtgagggcatccggaggcactacggagccttgccatttagtgtttactccgtgctggggaacaagcctgctacacgtcaggactgctgtcagagcgaatggcattgccggcggcgagtgtgtctgggccttctggcacttctggcagctctgggcctgggtgtggggttgctctatcttagcctgggtggccatgctcttggccacggaagtccttcaggctccttgctgaaagtcttcggcggcgccgccacaactctctcaggcagcgggctactgatggctgtgtatagcgtaggaaagcacctgtttgtgtcacagcgaaagaagatcgaacgactcgtgtctagagaaaagttcgggagtcagctggggttcatgtgtgaggttaagaaggaagtcgagcttctcacggactttctgtgttttttggagatttaccagagaaggcggctgagagtggtgctggaagtcacaggcctggatacatgctaccccgaacgagttgtgggagtcctgaacgccatcaatacactgttgtctgacagccacgcaccttttatattcatcttagtcgtggacccctctatactcgccgcttgtttggaatccgcgggaaacatgaagggcaccgctgataatggctatctgttcctgaatcgtacagtgacactcccattttccgtaccgattatgggcaggcgaacgaagctgcagtttcttcatgacgctgtgcagagtcgagacgatctgctgtaccgtgaaatgacccgtaaaccgtggttgccaggagatgccggcggagaatccgcccagcttcttgcggtccaggctcaggcaggcactgagagaggacagggacgcattgacgatgaagccgcccggaggattcaggaagcactcttttgcctccacgacgaaagggactgtctgtacgaatacgtacctgataatgttgtgtcaatgcgtagaatagtgaacactgtgcccattactgtgagactcctccagcagcagcagcagcagggcgacttcggaggcccaacaccaagacaggcagtagcctgggtagtgctagccaaccagtggccctgtcgcctttcctgggctcttcaatgccttgaggaccgacagcagaccggcggagcgcctgaaggcagagccagattgtgggatgtattccgagacaatagtcgggagcttcatactatgacgaaagcactgcagaacgtgctagacttggacggagacccggaactgtttgagcgatttctcggtgcagattttccctttacggtggccgaggcccagtcactactaagatgtacagtaaatcttgaccacagcatccgacggcgtatgggcctgatcagggcagtgtctgctctgaagcctccctctccacccaagtcccccacgcgagataccccacacgccgcacaccgcgctaactctgcttctcgggcgcccccttccggcagagcgagcgggcaagccggggagggccatcatacaggcgacctcgcccatagaggtaagctctggcccgtggcctgtgcccttttccgtcccggccagagttcccctggtggcccctag

SEQ ID NO: 44084 - DNA, 1062 bp, Artificial Sequence
  Description of Artificial Sequence: Synthetic coding sequence
atgcggctgcggttctggctgctgatctggctgctgctgggcttcatctcacaccaaccaactcccgtttcattcctcaagacaattttttggtcacgtaatggacatgatgggagtatggacgtacagcagcgagcctggcgatcaaaccgtagccggcaaaagggactgaggtccatatgcatgcacactaagaagcgggtctcttcctttcgggggaataagataggtttaaaggacgtgattactttgcggcggcacgtggaaactaaagtacgcgccaaaatccggaaacgcaaggtcactaccaagattaacaggcatgacaagatcaatgggaaaaggaaaaccgcgaggaaacagaagatgttccagcgggctcaggagcttaggagacgcgcagaagactatcacaaatgtaagataccccctagcgccagaaaacccctgtgcaattgggtgcgcatggcagctgccgaacacagacattcttctggcttgccatattggctctatctgactgccgaaacactgaaaaatcgaatgggtagacagcctcctcctcctacccagcaacattcaatcactgacaatagcttgtcgctgaagactccccctgagtgcctcctgacgccactgccaccctcagtggacgataacattaaagagtgtcctctggcacccttgcccccttcccccctcccgccgagcgtggatgacaaccttaaggaatgcctttttgttccactgccccccagccctctgcctccctctgtggatgacaatttaaaagagtgtctgttcgtgcctctgccccctagccctctgcctccttccgtggatgataacctgaagaccccacctctcgccacccaggaagccgaggtggagaaacccccaaaaccgaagaggtggcgagtggacgaagtggagcagagcccaaaacccaaaagacagcgcgaagctgaggcacagcagttaccgaaacctaaacgccgacggctctcaaaactgcggaccaggcactgcacgcaggcctgggccatccggattaacccttag

SEQ ID NO: 44085 - DNA, 1827 bp, Artificial Sequence
  Description of Artificial Sequence: Synthetic coding sequence
atggccgagagcatcatcatccgggtgcagagccccgacggcgtgaaacggatcaccgccactaagagagagacagctgcgacgttcttgaaaaaagtcgctaaggaattcggttttcagaacaacggtttttctgtgtacatcaaccgcaataagacaggcgagattactgcaagctccaacaagtctttaaacctcctgaaaataaagcacggggacctcctgtttcttttcccttcaagcctagcagggcccagctccgagatggagacctcggttccccccgggtttaaggtcttcggggctcccaacgtcgtggaggatgagatcgaccagtacctgtcgaaacaagacgggaaaatttacagaagtagggatcctcagctatgtagacatggacccctgggaaaatgcgttcattgtgtcccactggagccctttgacgaggattacctgaaccacctcgaaccccccgtgaagcacatgtcttttcacgcatacattaggaaattaactggcggcgctgacaagggaaagttcgtggccctagagaacatttcatgtaaaatcaagtccggatgcgaaggtcacctcccttggccaaacgggatatgtacaaaatgccagccaagtgccattactctcaacaggcaaaagtatcgccatgttgacaatattatgtttgaaaatcataccgtggctgaccggttcctagacttctggcgaaagaccggaaaccaacactttggttatctgtatgggcggtataccgaacacaaggatatccccttggggatccgggcagaggttgctgccatttatgagccacctcaaatcggtactcagaactcacttgaattgcttgaggaccccaaagccgaagtggtggatgaaatagctgccaaactggggttgcgaaaggttgggtggattttcaccgatttggtgtcagaggatacacgtaaaggtacagtccgatacagccgtaacaaggatacctactttttatcatcagaggagtgcatcacagccggggatttccaaaacaaacaccccaacatgtgccggctatctcctgacggacattttggatccaaatttgtgaccgctgtcgcgaccggaggaccagacaatcaagtgcattttgagggctatcaggtgtcgaaccagtgcatggccctggtgagggacgagtgcctcctaccatgcaaggacgcacccgagcttggatacgcaaaggagtcgtcctcagaacagtacgttccagacgtcttctataaggatgtcgataagttcggtaacgagattacacagctggcaaggcctcttccagtcgaatatctgatcattgacatcactacaacatttcctaaagaccccgtctacaccttttcaattagccagaatccatttcctatcgaaaacagagatgtcctcggggaaacccaggatttccactcactggctacatacctctcacagaatacgagttctgtttttctcgatacaattagcgacttccacctcttacttttcctagtgaccaacgaggtaatgccactgcaggactcaatctctctcctccttgaggcggtgagaactcgcaatgaagagctcgcgcagacatggaaaagatcagagcagtgggcaaccattgagcagttatgttccactgtcgggggccagttgcccggtctacacgaatacggtgcggtgggcgggtctacccacactgctaccgccgccatgtgggcttgccagcactgtacattcatgaaccaacctggcaccggccactgcgaaatgtgctccctgccacgaacatag

SEQ ID NO: 44086 - DNA, 1851 bp, Artificial Sequence
  Description of Artificial Sequence: Synthetic coding sequence
gccgaggtggtgatcatccgggtgcagagccccgacggcgtgaagcggatcacggcaactaaacgtgaaactgccgctacttttttgaagaaggtggccaaagaattcggattccagaacaatgggtttagcgtctatataaatcgcaataagaccggcgagataacagcttctagcaacaaatctcttaatttacttaagatcaaacatggcgacctactctttctgtttccgagtagcctggctggtccctcatccgagatggaaaccagcgtacccccaggctttaaggttttcggtgctccaaacgtggtcgaggatgagatagaccaatacctgagtaagcaggacggcaagatctatcggtcaagagatccacagctgtgtcgccatggcccccttggcaaatgtgtgcattgtgtgcccctcgaaccgttcgacgaggattacctgaatcatctggaaccacctgttaagcacatgtcattccatgcttacatacgtaagctaaccggaggcgccgacaagggtaagttcgttgccctggagaacattagttgcaaaatcaagagtggctgtgagggccacctcccatggccaaatggtatctgcacgaaatgtcagccttctgctattaccctaaatagacagaagtaccggcatgtggataacattatgttcgagaaccataccgtcgccgacaggtttctagacttctggcgaaagacaggtaatcaacactttggatatctgtatgggcgttacacagaacacaaagacatcccattggggattagggcagaagttgcggctatctatgagcctcctcagatcggcacacaaaactctcttgagttattggaggaccctaaggctgaggtcgtcgatgagatcgctgctaagttgggcctgcggaaggtgggatggatcttcaccgatctcgtctcagaggatacacgtaaaggaaccgtgcgatactcacgaaacaaggacacgtactttctgtccagcgaagagtgtatcacagccggcgatttccaaaataaacaccctaacatgtgcagactgtcgcctgacggccactttgggagcaagttcgtcacggctgtggcaaccggagggcccgataaccaagtacactttgagggctatcaggtctctaaccaatgtatggctctggtcagagacgagtgcctgttaccttgtaaggatgcgccagaacttggctacgcaaaagaaagcagttccgagcagtacgtgcccgacgtcttctataaggatgtggacaaatttggcaacgagataacccagctggcccgacccctgcccgtcgaatatcttatcatcgacattacaacgacctttcccaaggatccagtgtacactttctcaatatcccagaatccatttccaatcgagaatcgggacgttcttggagaaactcaagattttcacagcctggcgacatatctaagccagaatacttccagtgtgttcctggataccatctccgattttcacctcctgctgtttcttgtgaccaatgaagtgatgcctctccaggatagtatatccctgctgctggaagccgtcaggaccagaaatgaggagctggctcagacatggaagcgctccgagcagtgggccaccatcgagcaactgtgtagcgaatacccccacccccttcctcgtcatccagtcgccggagccggcgagcaacccaccctccattcaagtccactgcctgtggtgccttggatcccacatccagcagcctcgtggcaagtgccgagtgctatgcagcgggttgagacccggccaccctgccaggcgcgcggcaggttacgctag

SEQ ID NO: 44087 - DNA, 1371 bp, Artificial Sequence
  Description of Artificial Sequence: Synthetic coding sequence
atgagcttccacgcctacatccggaagctgaccggcggcgccgacaagggaaagttcgtagcgctcgagaatattagttgcaagatcaaatccgggtgtgaggggcatttaccttggcccaatggaatttgtaccaagtgtcagcccagtgcaatcacactcaatcgccagaagtacagacacgtggacaatattatgtttgaaaatcacacagttgccgacaggtttctcgatttctggcgaaagactggtaaccagcacttcggctatctgtatggccggtacacggagcacaaagacatccccctgggaattcgcgccgaagtcgcggctatttacgagcccccccaaatcggaactcagaactccctagaattactggaagaccccaaggctgaagtcgtggatgagattgccgctaaactgggcctgcgtaaagtggggtggattttcacggatcttgtatcggaagatactagaaagggtactgtaaggtactcgcgtaataaagatacatactttctgtcctcagaggaatgcatcaccgccggcgacttccaaaacaaacaccccaatatgtgccgactatcgcctgacgggcacttcggaagtaaattcgtaactgccgtcgctaccggcggaccggataaccaggtacattttgaaggctatcaagtttccaaccaatgcatggctttagtcagggatgaatgcctactgccttgtaaagatgcgcctgagctggggtacgctaaagagagctcatccgaacaatacgtgcccgatgtcttttacaaggatgtagataagttcggcaatgagatcacacagctggcaagacccctgccagttgagtacctgattatagacatcaccacaacatttcccaaggatcccgtgtacactttttccatcagtcagaacccttttccgattgaaaacagagatgttctcggagaaacccaggattttcactccttggcaacgtacctcagtcagaatacctcatctgtctttctggacactatcagtgatttccatttactgctgtttctagtcacaaatgaagtaatgccactgcaagacagtatctctctgctcttggaggcagttcgtaccaggaacgaagagctggctcaaacatggaagagatctgagcaatgggccacaatagaacaactatgttcagagtatccacaccccctgccaagacatcctgtggctggagctggcgaacaacctacgctgcactcaagtcccttgccagtggttccttggattccccatcctgctgcgagctggcaggtaccttcagccatgcaacgagtggagacgcgccctccctgccaagccagagggaggctgcgatag

SEQ ID NO: 44088 - DNA, 2202 bp, Artificial Sequence
  Description of Artificial Sequence: Synthetic coding sequence
atggaggccagctggcggcaggtggccggcggccggggccggagccgaggtcgagccaccgcagccccaagcggcaatggcgtgcatttacgcggtgcggggggaggtcgtgaaaagggatccgtgggcgccgtgccatccggaactagtcctggaggcgtcgccaccaccgctgccgctggctcccgccactccccagcgggtagccaggcccttcagactaccgcggctagcgagctgatgtcccaaaagaagtttgaggagatcaaaaaagctaatcaggccgcagcaaggaagctagttgaagagcaattttcttcttctagcgaggaaggcgatgaagattttgagggcaaacagggtaaaatcttagcaaatacctttatcacctacactacacagactgatggagacactagagagttggagagaaccaagcagtatgtgaatgaagcttttcaggccggtgccatgacctgtttgatctgtatcgcaagcgttaaacggaaccaggccgtgtggagttgttccggctgtttctgtatttttcatatgccctgcattcagaaatgggccaaagatagtcaatttctggtatccagcgtgactgacgatgacttcggcaagaaggactgtccgtggccttgtccaaaatgccgattcgaatacaagaggtctgagactccatcaagatactactgttattgtggaaaagttgaggacccaccccttgatccatggctggtgcctcattcctgcggacaggtctgcgaacgcgaattcaaacccccctgcggccataagtgccttctcctgtgccacccaggcccttgccccccatgtcccaaaatggtgacgacaacctgttactgcaagaaagctaaacccattccgcgaaggtgttcggcaaaggaatggagttgccagctcccttgtggtcagaagctcctgtgtggtcagcacaagtgcgagaatccctgtcatgcaggctcttgccagccatgcccacgggtctcaagacagaagtgtgtgtgcgggaagaaggttgctgaacggtcctgcgcttccccactgtggcattgtgatcaagtgtgtggcaaaaccctgccgtgtggtaatcacacatgtgaacaagtatgccacgttggggcttgcggagaatgccctaggtctggcaaacgattttgtccatgtcagaaaagtaagttctccttaccctgcactgaggacgttcctacatgcggggatagctgcgacaaggtgctggaatgtggaatccatcgctgcagtcagcgatgtcaccgcggtccctgtgagacatgccgccaggaggtagagaaacactgtcgttgcgggaagcatacgaagaggatgccctgccacaagccttatctttgcgagactaaatgcgttaaaatgcgagactgtcaaaaacaccagtgccgacgaaagtgctgtcccggcaactgccctccctgtgaccaaaactgtggtaggactttaggctgcaggaaccacaaatgcccctcagtgtgtcaccgcgggtcctgctatccttgccccgagactgtcgatgttaagtgcaactgcgggaacaccaaagtgactgtgccctgcggccgcgagcgcacaacacggccccccaagtgcaaggaacagtgtagtcggccccctacctgtcaccacacttctcaggagaaacatcgctgccacttcgggtcgtgtccaccctgccatcaaccttgccaaaaagtgctcgaaaaatgtggccatctctgccccgccccttgtcacgaccaggcccttatcaaacagacgggccggcaccagccgactggcccatgggagcagccttctgagcctgccttcatccaaaccgctttaccatgtcctccttgtcaggttcccattcccatggagtgcttgggcaagcacgaggtctcccctctgccctgtcatgccgtgggtccctactcttgcaagcgagtatgcggcaggatactcgactgccaaaatcatacctgtatgaaggaatgtcacaaagtgacgaagaccgacggatgtaccggaaagaacaagattggaaagctgaaattgtgcgacctgagcatgatcctgcagcaggagtctagcaagagcgagtcaactgtaccagatctgctcacaccgagcccgatgtgttcaagcacccacgtcatttag

SEQ ID NO: 44089 - DNA, 2736 bp, Artificial Sequence
  Description of Artificial Sequence: Synthetic coding sequence
atggaggccagctggcggcaggtggccggcggccggggccggagccgcggcagagccacagccgccccctcaggtaatggagtgcacttgaggggagccggggggggcagagagaagggctccgtcggggccgtaccctcaggcacgagtcctggcggggtcgcgacaaccgccgctgccggctcgcgccattccccagccgggtcccaggctttgcagacaacagccgctagtgagttaatgagtcagaagaagtttgaagaaatcaagaaggcgaatcaagcagccgctaggaagctggtagaggaacagttcagctcctccagcgaagagggggacgaagacttcgaaggcaaacagggcaaaatcctggctaacacgttcattacctatactacgcagactgatggagacacccgggagctggagcgcacaaagcagtacgtaaatgaggcatttcaggcaggcgccatgacctgtttgatttgtattgctagcgtcaagagaaatcaggccgtatggtcatgcagcggatgtttctgtatctttcacatgccgtgcatacaaaagtgggccaaggattcccaattcctggtgtccagtgtgactgacgacgacttcggaaagaaggactgcccttggccctgtcccaagtgtcggttcgaatataagagaagcgaaacaccgagcaggtactactgctattgcggtaaggtcgaagatcctcccctcgatccatggcttgttcctcacagctgtggtcaagtctgcgagcgagagtttaagcctccttgtggccacaagtgcctgctcctttgtcatcccggaccatgccccccatgccctaaaatggtgaccacaacttgctactgcaagaaggcgaaaccaatcccaagacgttgttcagccaaagagtggtcttgccagttaccgtgcgggcagaagcttttgtgcggacaacataagtgcgagaacccctgtcacgccggcagttgccagccttgtcctagggtgtcccgacagaagtgtgtgtgtggcaagaaagtggccgagcgcagctgtgcgtcccctctttggcattgcgatcaagtgtgtggcaaaactctgccttgtggaaaccacacttgcgagcaggtgtgtcacgtaggggcctgtggtgagtgtcctcgctctggtaaaagattctgcccctgccagaaaagcaagttcagcctgccttgtacggaggacgtacctacgtgtggtgattcatgcgataaggtgctggagtgtggaatccaccggtgctctcagcgctgccaccgcgggccatgtgagacctgtcggcaggaagtggaaaagcattgtcgttgtggaaaacacaccaagcggatgccatgccataaaccatacctctgtgaaaccaaatgtgtgaagatgcgggactgtcagaagcaccagtgtaggcgcaaatgttgccccgggaattgtccgccttgtgaccaaaactgtggtcggacccttggatgccggaaccataaatgcccctctgtgtgccaccgagggtcatgttacccatgtccggagacagttgatgttaaatgcaattgtgggaataccaaagtcaccgtaccatgcggacgtgagcggaccactcgaccccccaaatgtaaagagcagtgttctcggccacctacctgtcatcatacgtcccaggagaaacacagatgccattttgggtcttgcccgccatgccaccagccctgccagaaagtgctcgagaaatgtggacatttgtgtcctgccccatgccacgaccaggcattgattaaacagaccggacgccatcaacccacaggaccttgggaacagccttctgaacctgcttttatccagaccgcactgccttgcccaccctgccaggtgccaatacccatggagtgcttgggcaaacacgaggtgagccccttgccctgtcatgccgtggggccatactcttgcaagagggtctgtggtagaatcctggattgtcaaaaccatacatgcatgaaggagtgtcacaaggttaccaagacagacgggtgtaccggtaaaaacaaagcagggcctgaatgtctccactgtgaagaaggctgttcaaagtcccgccctctgggttgcctccatccatgtatcctcaggtgccaccccggggagtgccccccctgcgtccagatgcttagaataaagtgtcactgcaaaattacgtcactgtacgtcgagtgcagaaaaatcacgaccgccgacgtgaatgaaaagaatctgctgagctgttgcaagaatcagtgccctaaagagttgccatgcggtcacagatgcaaggagatgtgtcatccaggggagtgcccctttaattgcaaccagaaggtgaaactgaggtgcccatgcaagcgcatcaaaaaggaactacagtgcaacaaggtgcgagaaaaccaagtctccatagagtgtgacacaacgtgtaaggagatgaagcgcaaagcatccgaaatcaaagaggcagaggccaaggcagctctcgaggaagaaaagaggcggcagcaggccgagctggaggcattcgaaaacaggttaaaaggccggcgtaaaaagaacagaaagagggatgaagttgctgttgaactctcactgtggcaaaagcacaaatattacttaatcagcgtctgcggcgttgttgttgtagtcttcgcgtggtatattacccatgacgtaaattag

SEQ ID NO: 44090 - DNA, 2736 bp, Artificial Sequence
  Description of Artificial Sequence: Synthetic coding sequence
atggaggccagctggcggcaggtggccggcggccggggccggagccgtgggcgagcaactgctgccccctctggaaatggtgtgcatctgagaggagctggcggggggagagagaagggctccgtgggcgcagtcccatccggaacgtcccctggtggagttgctaccacagccgcagccgggtctaggcactcccccgccggatctcaagccctgcaaaccaccgccgcttctgaactaatgtcccagaaaaagttcgaggaaatcaagaaagcaaatcaggctgcagctagaaaactggttgaggaacaattctcctcttcttcggaagagggagatgaggactttgaaggtaagcagggcaaaatcttggctaacacctttatcacttatacaacccagacagatggtgacacccgtgagttggaacggaccaagcaatacgttaatgaagcttttcaggcgggggccatgacctgtctgatctgcatcgcaagcgtgaagcggaatcaggccgtatggagctgcagcggctgcttctgcattttccatatgccctgcattcagaagtgggctaaagacagtcagttcctggtctcttccgtgaccgacgacgacttcgggaaaaaagattgcccctggccgtgtcctaaatgtcggtttgagtataagcggagcgaaaccccatctaggtattactgttactgtggaaaagtggaggatccgcctctggacccctggctggtgcctcattcatgtgggcaggtttgtgaaagagaattcaagcccccatgtggtcataaatgtctactgttatgccaccccggaccatgtcccccctgtccgaagatggtcaccacaacctgctactgcaagaaagccaaacccatcccacggagatgttccgcaaaggagtggagctgtcagcttccctgcgggcagaagctgttgtgcggccaacataaatgtgagaatccttgtcacgcagggagctgccaaccgtgccctcgcgtgtcccgtcagaagtgcgtttgtggaaagaaggtggctgagaggtcatgtgccagtcccctatggcactgtgatcaagtctgcgggaaaacactgccatgcggcaaccacacttgtgagcaagtatgtcacgttggagcctgtggtgaatgtcctagatccggtaaaaggttttgtccgtgccagaagtctaagttcagcttaccttgcacagaagacgtgcccacctgcggcgattcttgcgacaaggtgctcgagtgtggaatccatcgttgtagccagcgctgtcaccgcggcccttgtgagacctgtcgccaggaggttgagaagcactgcagatgcggcaagcataccaaaaggatgccatgccacaaaccctatctgtgtgagacaaagtgtgtgaaaatgagggactgccagaagcatcaatgcagaaggaagtgttgccctggtaattgtcctccgtgcgatcagaattgtggcaggactttggggtgtcgtaaccacaagtgtcccagcgtgtgccaccgaggctcttgctacccatgtccagagactgtggatgttaagtgtaattgcgggaacacgaaggtgaccgttccatgcggacgagaaaggacaactagacctcctaaatgtaaagaacaatgttcccggccacctacatgccaccacactagccaggaaaaacatagatgccactttggcagctgcccgccctgccaccagccatgccagaaggtgctggaaaaatgcggccacctatgccccgctccatgccacgatcaagccttaattaagcagactggccggcaccaacctacggggccctgggaacagccctccgagcctgctttcattcaaaccgccctgccctgtccaccgtgccaggtgccaatccccatggagtgccttggcaaacatgaagtctctccactcccttgccacgctgtcggtccttactcgtgtaagcgagtatgcgggcgcatcctggattgtcagaatcatacttgtatgaaggaatgtcataaggtaaccaagactgatggctgcacagggaagaacaaggctggccccgagtgtctgcattgcgaggaggggtgtagcaaatccaggccactggggtgcctgcatccatgcatattgaggtgccaccccggagagtgtccaccgtgtgtgcagatgctacgtattaaatgtcactgtaaaattacgagcctgtacgtggaatgccgcaagatcaccacagccgatgtcaacgagaaaaatctattgagctgctgcaagaatcagtgcccaaaggagctgccgtgcgggcatcgttgcaaggagatgtgccatccgggggagtgtccctttaactgtaaccaaaaagtcaagttgaggtgtccctgtaagaggattaagaaggagctgcagtgtaataaggtcagagaaaatcaggtgtcgatcgagtgtgatactacatgcaaagaaatgaagcgcaaagcctccgagatcaaggaagctgaagctaaagctgctctggaagaggagaagcgacgacagcaggctgagctggaggcattcgaaaacagactgaaaggaaggcggaaaaaaaacaggaaacgcgatgaggtagcagtggaactatctctctggcagaagcataagtactacctaatctccgtctgcggagtggtggtggttgttttcgcttggtacatcacccatgacgttaactag

SEQ ID NO: 44091 - DNA, 5211 bp, Artificial Sequence
  Description of Artificial Sequence: Synthetic coding sequence
atgaccggctgccccgccagcagccggcggcggggcttcggcctgttcttcttcctgagactacatcgcttacttctgttattcctagtgctaaggggaaccctggcaaacaagctgaatgtaccgcaagtactgctccccttcggccgggagccaggtcgagtgcccttccttctggaggcacagaggggatgctacacctggcattcaacacatcatgatgcggtgacagtcgagcccctctatgaaaatggtaccttatgctcgcaaaaagccgtgctcatcgctgagtcaacccagcccatcaggctgagttctattattctggctcgagaaatcgtgacagatcatgaactccggtgtgatgttaaagtggacgttatcaactcaatcgaaatcgtcagccgagcgcgagaactgtatgtggatgattccccactcgagcttatggtgcgcgcccttgacgctgaggggaacaccttctcctcattggccggcatgatgttcgaatggagcatcgcccaggacaacgaaagcgcccgggaagaactgagctccaaaatccgcatcttgaagtatagcgaagcggagtacgcaccaccgatttacatcgccgagatggagaaggaagaaaaacagggcgatgtcatcctggtgagcggcattcgtacaggcgctgctgtggtgaaggtgcggatccatgagccattttacaaaaaagtggctgctgcgttaataaggctgctcgtcctcgaaaacatctttttgataccgagtcacgatatctatttacttgttggaacatacattaagtatcaggtcgcaaagatggtgcagggacgcgtgactgaagtaaagttccctctggaacactatatactggagctccaggatcatcgtgtggccttaaacggctctcattccgagaaggtcgccattctcgacgacaaaactgccatggtgaccgcttcccagctcggacagactaatttagtgtttgtgcataaaaacgttcacatgcggagcgtatccggactgccaaactgtaccatctacgtggtggaaccaggatttctggggtttaccgttcaaccagggaacaggtggagcctggaagtagggcaggtctatgtgatcactgtcgacgtgtttgataagagcagcactaaggtttatatctctgacaacctcagaattacttacgatttccccaaggagtacttcgaagaacaattaacaaccgtcaatggcagctaccacatcgtcaaggcactgaaagatggcgtcgtagtgataaacgcatcattgacatcaattatctatcagaataaagatatccagcccattaagtttctaattaagcaccagcaggaggttaaaatctattttcccattatgctcaccccaaaatttctggcctttcctcaccaccccatgggcatgctgtataggtacaaagtgcaggtcgaggggggctccggcaacttcacatggacatcctcgaacgagactgtggttatcgtcaccaccaagggggtagtcacagcagggcaggtgaggggtaattcaacagttttggcgcgtgatgtgcagaatccctttcggtacggggaaatcaagattcatgtacttaagctgaacaagatggagctgcttcccttccatgcagacgtcgagatcggtcaaattatcgaaatacccatcgcaatgtaccatataaacaaggagactaaggaggcgatggcgtttactgattgcagtcacctgagcctggacctgaatatggataaacagggcgtgtttaccctcctaaaagaggggatccagcggcctggccccatgcactgcagttcaacccatatagctgctaagagtctcggccatactctggtgactgtatccgtgaacgagtgtgacaaatacttagagtcctcagctacattcgcggcctatgaacctctcaaggctcttaatccagttgaagtcgctctggtgacctggcaatccgtaaaggagatggttttcgaagggggcccacgtccttggatactagaaccctccagattcttcctcgagcttaatgcagaaaagacagagaagatcggcattgcccaagtctggttgccttcaaagcgcaagcagaaccagtacatctacaggattcagtgtttagacctgggggaacaggtactaacattccggattgggaaccaccccggagtgctgaacccgtcgcctgcagtagaggtgctgcaggtccgctttatttgcgcccacccagccagtatgtctgtgactcccgtgtacaaagtacccgccggagcccagccctgcccattgcctcaacacaacaaatggcttattccagtgtcaagattgagggacacagttctcgaactggccgtttttgaccagcaccgtcgaaagtttgacaatttttcctccctgatgttggagtggaagagcagtaatgagacccttgcccattttgaggattataaatctgtggagatggtagccaaagacgatggaagcggtcagacaaggttacacggccaccagattttgaaggtgcaccaaatcaagggcaccgtcctgattggtgtcaactttgttggctactctgagaaaaagagcccaaaggagatctccaaccttcccaggtctgttgacgtggaattactgttagtcgatgatgtgacagtggtacccgaaaatgctactatttacaaccatcctgacgttaaggagaccttctcacttgtagaaggaagcggatacttcttggtgaatagtagtgagcagggagtcgtaacaatcacctacatggaagctgaaagctcagtggagctggtacctctgcaccctggcttttttaccctagaagtgtacgacctctgtctggccttcctgggaccagccacagcgcacctgagggtcagcgatattcaagagctggaactggatcttattgacaaggtggagatcgacaagacagtgctcgtaaccgtgcgcgtcctcggctccagcaaaagaccgttccagaataagtactttcgcaacatggagctcaagctgcagttagcttccgctattgtcactctaaccccaatggaacaacaggatgagtatagtgagaattatatcctgagggccacaacaatcgggcaaactacccttgtggcaatcgccaaagacaagatgggacggaagtatacttccaccccaagacacattgaagttttccctccatttagactcctccccgagaaaatgaccctgatccccatgaatatgatgcaagtcatgtctgaagggggcccccagccccagtcaattgtccatttttccatctcaaaccagacagtcgccgtggtaaaccggcgaggtcaagttacagggaagattgtgggaaccgccgtggtgcatggcaccatccaaacggttaacgaggacacagggaaggttatcgtgttcagtcaggatgaggtgcagattgaggttgtccagctccgagccgtgcggatcttagcagcggcaacaaggctcatcacagcaactaagatgcccgtctacgtcatgggagtaacttccacccaaactcctttttctttcagcaacgctaacccagggctgacgttccattggtcaatgtcgaaaagggacgtcctagaccttgtgcctcgccactccgaggtatttttacaactgcccgtcgagcacaactttgcgatggttgtgcataccaaggccgcaggccgaacgtcaatcaaggtaaccgtgcattgtatgaattcaagctccgggcagttcgagggtaatctcctcgagctgtcagacgaggtgcagatcctggtattcgaaaagctgcagttgttctatcccgagtgccagcctgagcagatccttatgcccattaactcccaactaaaattacataccaatcgagagggagcagcctttgtgagctcacgagtgctcaaatgcttcccaaattcttctgtgatcgaggaagatggagaggggctgctgaaggccggctcaatcgcaggtaccgccgtactcgaggtgactagcatcgaaccctttggagtcaatcaaaccacaatcactggcgtgcaggtggcccctgtgacgtacctgcgtgtctcatctcagcctaagctctacacggctcaggggaggacgctctccgcttttccgttaggcatgtcgttgacgttcacagtccagttttacaactcaattggagagaagtttcatacacacaacactcagctttacctcgctctcaatagagacgatctcctccacatcggacccggcaacaaaaattatacctacatggcgcaggctgtgaatcgcggcctcaccctggtcggactctgggatcgccgccaccctggcatggcagactatattccagtcgccgtggagcatgctatcgagcccgatacaaagttgacttttgtgggcgacatcatatgcttttccactcatctcgtgagccagcacggcgaacccggaatctggatgatcagtgccaacaatatactgcagacagacatcgtgaccggtgtgggcgtagccagatccccaggtacagctatgatctttcacgacattccaggtgtcgtaaagacctatcgagaagtggtggtgaatgcgtcctcccggctgatgctatcctatgacctcaaaacttacttgactaatactttgaattccacggtctttaaactctttatcactacaggtcggaatggagtgaacctgaaggggttctgcacaccaaaccaagcgctcgccatcacaaaagtactgctgcccgccacactcatgctgtgtcatgtccagtttagcaatactctgttagacatccctgcgagtaaagtcttccaggtgcactctgatttttcaatggagaaagaccactgcgaggattctgctatactgaagcggtttactggttcttatcaaatcctgctgctgacgctttttgccgtcctggctagcacagcgtccatttttcttgcctataacgcctttttgaacaagatacagactgtgcctgtggtgtatgtgcccactctcggcactccccagcccggtttctttaattcaacgtcatctccacctcacttcatgagtttgcagcctcccttggctcaaagcagactccagcattggttgtggagtatcaggcactag

SEQ ID NO: 44092 - DNA, 2010 bp, Artificial Sequence
  Description of Artificial Sequence: Synthetic coding sequence
atgggccggaagtacaccagcaccccccggcacatcgaggtgttccccccctttcggctactgcctgagaagatgactttaattcccatgaacatgatgcaggtcatgtctgagggcgggccacagccccagtctattgtgcatttcagtattagtaaccagacggttgcagtcgtgaaccgacgggggcaggtgacaggaaaaatcgtaggcactgccgtggtccacgggaccatccagactgtcaatgaggatacgggcaaggtgatcgtgtttagtcaagatgaggtacagatcgaagtcgtgcagctgagagccgttagaattcttgccgccgcgacacggctaattaccgcaactaaaatgcctgtatatgtgatgggagtcactagtacccaaacacccttctctttttccaacgccaaccctggtctgactttccactggtccatgagtaagcgagatgtgttggacctcgtgccacggcactcagaggtgtttctccaactgccagttgaacacaatttcgccatggtcgtgcatacaaaggcggccggacggacaagcataaaagtaaccgtccactgtatgaattctagctcgggtcaattcgagggcaacctcctggaactgagtgatgaagtgcagatcctggtgttcgaaaagctgcagctgttctatcccgagtgtcaacccgaacagattctgatgcctattaattcccagctgaagttacacaccaacagagaaggcgccgcattcgtgtccagtagggtgctgaagtgctttcctaactcttcggtgattgaagaagatggagaaggcctcctgaaagctggatccattgcaggaactgccgtgctggaagtcacgtctatagagcctttcggcgttaaccagacgacgataacaggggtgcaggttgcgcctgttacgtacctgcgagtgagttcgcagccaaagctttacacagcccagggaagaactctgagcgcctttcctctcgggatgtccttgactttcacagtccagttctataattctatcggcgagaagttccatactcacaacacccaactttatttggctttgaaccgtgacgatctgctgcatatcggacctggtaacaagaactacacatacatggcacaggcagtcaaccgaggtttgactctggttggcctttgggataggcgtcatcctggaatggccgactacattccggtggccgtcgagcatgctattgaaccggacactaagctcaccttcgtaggagatattatctgcttcagtactcatctggtgagccagcacggggaacccggaatctggatgatcagcgccaacaatattctgcaaacagacatcgttaccggcgtgggtgtcgcgcgaagtccgggcacagccatgattttccacgacattcctggcgtggtaaaaacatatcgggaagtggtcgttaatgcttctagtagactaatgctttcatatgatttaaagacatacctgactaataccctgaactctacggtcttcaagctcttcattactactggcagaaacggggtgaacctcaagggattttgtactcctaatcaagcactggccattacaaaagtgctcctgcctgcgactctgatgctttgtcacgtgcaattctctaacaccttgctggatattcctgccagcaaggtgtttcaagtacattccgattttagcatggaaaaggatcattgcgaggatagcgccatcctgaagcgattcaccggatcatatcaaattctgctcctgaccctctttgcagtacttgcctcaactgccagcatcttcttagcctacaacgcttttttaaacaagatccagactgttcctgtggtctacgtccctacgctcggcactccacaaccggggttctttaatagtacaagttcacccccacacttcatgagcctccagccccccctggcccaatcgcgcttacagcactggctgtggtccatacgtcattag

SEQ ID NO: 44093 - DNA, 5667 bp, Artificial Sequence
  Description of Artificial Sequence: Synthetic coding sequence
atgaccggctgccccgccagcagccggcggcggggcttcggcctgttctttttcctgcgtctgcatcgccttttgctattattcctggtccttcggggcacactggccaataaacttaacgtgccccaggtattgctcccttttggacgggagcctggacgggtgccctttctgctggaggcacagaggggctgctatacgtggcattcgacacaccacgacgccgtgaccgttgaaccgctgtatgaaaatggcaccctctgctcacagaaggctgttttgatagcagagtcaactcagccgattcggctttcctcaattattcttgctcgagagatagtgaccgatcacgagcttcgttgcgacgtcaaggtagacgtgatcaattctattgaaattgtgtctcgcgcacgtgagctctacgtcgacgactcaccactcgagcttatggtgcgggccctggacgccgagggaaatacgttcagctccttggccggaatgatgttcgagtggagtatcgcccaggacaacgaatccgcccgggaagaactgtcctcgaagatcaggatcctgaaatattccgaggctgaatatgcacctcctatttacattgctgaaatggagaaggaggagaagcagggggatgtgatcctggtgtcagggatccgcaccggggcggcggtcgtgaaggtccggatccatgagcccttctataagaaagtggccgctgcgctcatcagactccttgttttggagaacatttttttgatccctagtcacgacatatatctgttagtcggcacatacattaagtatcaggtagccaaaatggtgcagggtagggttaccgaggtgaagttccctcttgaacactacattctcgaattgcaagatcaccgcgtcgccctcaatgggtctcacagcgagaaagtggccatactggatgataagactgccatggtcacagcttcacagctggggcagaccaatctcgtgtttgtccacaagaatgtgcacatgcggtcagtttctggtctcccaaactgcacaatctatgtggttgagccggggttcctgggctttaccgtgcaaccaggcaaccgttggtccctagaagttgggcaggtttacgtcatcacagtggatgtgttcgataaatctagtacaaaagtatatatcagtgacaatctcaggattacctacgatttcccaaaagagtattttgaagagcagctgacaacagtcaacgggagctaccacatcgtaaaagctttaaaggacggcgtggtggtgatcaacgcctcacttacaagcattatttatcagaataaagatatccaaccaatcaaatttcttattaaacatcagcaggaagtcaaaatttattttcctatcatgcttaccccaaagtttctggccttccctcaccatccaatgggcatgctttaccgttacaaggtccaggttgaagggggctccggcaacttcacctggacaagtagtaatgaaaccgtcgtcattgttacaacaaagggggtcgtaacggcgggacaggtgcgggggaattctacagtactggcccgggacgtgcagaatccctttcgctacggggagatcaagattcacgtgctaaagttgaataaaatggagctgctcccatttcacgccgacgtcgaaattggacagattatcgagatcccaattgctatgtaccacattaacaaagagactaaagaggcgatggctttcactgactgttctcatctcagtctcgatctaaacatggacaaacaaggagtctttacactgttaaaagaggggatacagcggcctgggccaatgcactgctcctccacacatatcgccgcaaagtctctgggccacactctggtcacggtgtctgtgaatgagtgcgataaataccttgagtccagcgctacgttcgcagcatatgaaccccttaaagctctgaaccctgtagaggttgcactggtgacctggcagtcagtaaaggagatggtgtttgaaggcggtccacgaccttggattttggaaccctccaggtttttcttagaactgaacgcagaaaaaaccgaaaagattgggattgctcaggtctggctcccatcgaaacggaaacagaatcaatatatatacagaatccagtgtttggacctcggggagcaagtactgacttttcgtatagggaatcatccaggggtgctcaatccgtccccagccgtggaagtgctgcaggtacggtttatttgcgctcacccagcctccatgagtgtgacccctgtttacaaggtgcccgctggggcccagccctgcccgttgccacagcacaacaagtggttgattcccgtgtctcgcctgcgggataccgtattagagctcgccgtcttcgatcagcatcgacgcaaatttgataacttttccagcctaatgctggagtggaagagcagcaacgaaacattagcacattttgaggactacaagtccgtcgagatggtcgctaaggacgatggatccgggcaaacacgcttacatgggcaccagattttaaaggtgcatcagatcaaaggtacagtcttgattggagttaattttgtgggttactcagagaaaaagagccctaaagagatttctaacctgccgcggtccgtcgacgtcgaacttcttctcgtggacgacgttactgtcgttccggaaaacgccacaatttataatcaccccgatgtgaaggagaccttctctttggtggagggcagcggttactttctcgtcaatagctctgaacagggcgtggtaactattacgtatatggaggccgaaagctccgtggaattagtgcctttgcatcctgggttctttactctcgaggtctacgatctgtgcctggcttttctcggcccagccaccgctcacttgagagtgagcgatatccaggagttagagctcgacctcattgacaaggttgagatcgataagactgttctagttaccgtcagagtgcttggatcatcgaaacggcccttccagaacaaatactttcgaaatatggaacttaaacttcaactggcctccgccattgtgacccttaccccgatggagcaacaggatgaatactccgaaaattatatcctaagagccactaccattggacagactacgctcgtcgctatagcaaaagacaaaatgggccggaagtatacgtccacacctaggcacatcgaggtgttccctcctttccgcctattacccgaaaaaatgacactgattccgatgaacatgatgcaggttatgtccgaaggcgggccacagccccaatcgatcgtgcatttttctattagcaatcaaaccgtagcagtcgttaaccgtcgcggacaagtgacgggaaaaatagtgggcaccgcagtggtccatggtactattcaaactgtgaacgaagacaccgggaaggtgatcgttttctcccaagatgaggttcaaattgaggtggttcagcttagggcagtgagaatcctggcggccgcgacacggcttatcaccgcgaccaagatgcccgtgtatgtgatgggcgttaccagcacacagaccccattctcttttagcaacgccaaccccggccttacattccactggtctatgtccaagagagacgtcctcgacctagttcccaggcattctgaagtgttcttgcagttaccagttgagcacaattttgctatggtggttcacacaaaggccgcaggccggactagcattaaggttacggttcactgcatgaatagcagttctggacaatttgagggaaacttactcgaactgtccgacgaagtgcagattctcgtgtttgaaaagctgcagcttttttatccagagtgtcaacccgaacagattctcatgcctattaattcccagctgaagcttcataccaaccgggagggagcagctttcgtaagctcacgcgttcttaaatgcttcccaaattcaagcgttatagaggaggatggggagggtttgcttaaggccggctctatcgctgggactgcggtactggaagtgacatccatagagcccttcggcgtgaatcagaccacaattacaggcgtccaggtggcccccgttacatatctgagggtctccagccaacccaaactgtacaccgctcaaggcaggaccctgtccgcttttcctctcggtatgtctctgaccttcacagtgcagttctataattcaatcggggagaaattccacacacacaatacccagttgtacctggccctgaaccgcgatgatctgcttcacatcggaccaggcaacaagaattacacttacatggcacaggctgtgaaccgcgggctgaccctggtcggcctgtgggatcggcgtcacccagggatggctgattacatccccgtggctgtggagcacgcaattgaacctgacacaaagttgaccttcgtcggggacatcatctgcttctctactcatctggtgagccagcacggagagcctggaatttggatgatttctgcgaataatatcctgcagactgacatcgtgaccggtgtcggcgtggcaagatctccaggtacggctatgattttccatgatatacccggcgtagtcaagacctatcgggaggtcgttgtaaacgcgtccagccgactgatgctatcgtacgatctcaagacgtatctgactaataccctgaattccactgttttcaagctgtttatcacgacaggaaggaacggcgtgaacctaaagggtttctgcacccccaatcaagccctggcgataaccaaagtactgttgccagccactcttatgctgtgccatgtccagttttcaaacactctactagatattccagcttctaaggtgtttcaggttcattctgacttcagcatggaaaagggagtgtacgtttgtataatcaaagtccgcccacagtctgaggagctgctccaggccctgtccgtggcggacacttccgtctacggatgggccacactggtgtctgagcgaagtaaaaacggtatgcagcgcattcttataccattcatccctgccttttacatcaatcagtccgaattggttctgtcccataagcaagatatcggagagatccgtgtgctcggcgtggaccgagtgctgcgcaagctcgaggtaatctcatcctccccagttctggtggtcgcagggcactcgcactccccactcacccctgggcttgcaatttacagcgttcgcgtagtgaattttacgtcattccaacaaatggctagccctgttttcattaacatttcctgtgttctgacctcacagtcagaagctgtagtggtgagagcgatgaaggataaattgggcgcagaccattgcgaagattctgcaatactcaagagattcacagggtcttatcaaattctcctgttgactctcttcgcggttctcgctagcactgcctctatttttcttgcttacaatgccttcctgaacaaaattcagacagtccccgtagtttatgtccctaccttagggaccccacagcccggtttttttaattcgacttcatccccaccacatttcatgtcattgcaaccacctctggctcagtcccggctgcagcactggctatggtccatccgccactag

SEQ ID NO: 44094 - DNA, 639 bp, Artificial Sequence
  Description of Artificial Sequence: Synthetic coding sequence
atggccagcctgttcagcggccggatcctgatccggaacaacagcgatcaggatgaactggacaccgaagctgaagtgagcaggaggctggaaaatagactcgtgctactctttttcggagcaggagcatgcccacagtgccaggctttcgtgccaatcctcaaggacttctttgtaaggctgaccgatgagttttatgtgctgcgcgcggcccaattggcgctggtttatgtgtcccaggactcaaccgaagaacagcaggacctattcttaaaagatatgccgaaaaagtggctcttccttccctttgaggacgatctacgccgcgacctgggccggcagttttctgtggaacgccttcctgccgttgtggttctaaaacctgatggcgacgtattaactcgcgatggggctgacgagattcaacgtctgggcaccgcatgctttgctaattggcaggaagctgccgaggtgctggatcgcaattttcagcttcccgaggacctggaagaccaggagccacgctccctgactgagtgcctcagacgccacaagtacagggtcgaaaaggccgcccggggagggcgggaccctggaggtgggggtggtgaagagggtggcgctgggggcctcttctag

SEQ ID NO: 44095 - DNA, 423 bp, Artificial Sequence
  Description of Artificial Sequence: Synthetic coding sequence
atgctgcccgactgcctgagcgccgagggcgagctgcggtgccggaggctgctggcaggggcaaccgcccgcctgcgggcaagacccgccagtgccgccgtgctcgtgcctctctgctccgttagaggcgtacccgccctgctgtacacactgaggtccagccgcttaacgggtcgtcacaaaggcgacgtttcctttcctgggggaaagtgtgaccccgctgaccaggacgttgtgcataccgcactccgcgaaaccagggaggagttggggctcgcagtgcccgaagaacacgtgtggggcctgctgcggcccgtgtacgacccccagaaggccactgtggttcccgtgctcgcaggcgttgggccactggatcctcagagtcttagacccaatagcgaggaagtgtcctggggcatctag

SEQ ID NO: 44096 - DNA, 711 bp, Artificial Sequence
  Description of Artificial Sequence: Synthetic coding sequence
atgctgcccgactgcctgagcgccgagggcgagctgcggtgccggagactcttggctggagctactgcacgcctacgagcacgccccgcctctgctgccgtccttgtgcccctctgctctgtgcggggtgtgccagctcttctttatacgctgagaagcagtcgcctgacaggcaggcataaaggagacgtgtcgtttcctggtggaaagtgtgacccggcagaccaagacgtggtccatacagcactgagagaaaccagagaggagttaggtctcgccgtgcctgaggagcacgtgtggggactgttaagacccgtctacgaccctcaaaaggctacggtggttccggtgcttgccggggtgggccctctggaccctcaaagtttgcgccccaattctgaagaggttgatgaagtctttgccctgccccttgctcacctcttacagacccagaatcagggctacacacatttttgccgcggaggccacttccgctacacactgcctgtttttctgcacgggccccatcgggtctggggtcttaccgcggttatcaccgagttcgcgctccagctcctagccccagggacgtatcagccccggctcgccggcttaacgtgctcgggggccgaaggcttggcccggccgaagcagccactggctagtccttgtcaggccagcagcaccccagggcttaacaagggcctttag

SEQ ID NO: 44097 - DNA, 1053 bp, Artificial Sequence
  Description of Artificial Sequence: Synthetic coding sequence
atggccggccggctgctgggcaaggccctggccgccgtgagcctgagtttagctcttgcatcagtgaccatcaggtcttctcgttgccgtggtatccaggctttccgtaatagtttttcaagctcttggttccatctgaacaccaatgtgatgagtgggtctaatggctccaaggaaaattcacataacaaggcaagaactagtccctatcctggcagcaaggtcgaacggtcacaggtgcccaacgagaaagtaggttggctggtggagtggcaggattacaaaccggtggagtacactgctgtgtcggtcttagctggaccacgatgggccgacccacaaattagtgagtctaacttctcccccaaatttaacgagaaggacggccacgtggaacgtaaatctaaaaatggcttgtacgaaatagagaatggcaggcctaggaaccccgctggcagaacaggtctggtgggtcgagggctactggggcgatggggcccgaaccacgctgccgacccaattattacccgatggaaacgggactcaagcggaaacaaaataatgcacccagtcagcggtaaacacattttgcaattcgtcgccatcaagaggaaagattgcggcgagtgggccattcccgggggcatggtggaccctggtgagaaaattagcgcgaccctcaaaagagagttcggagaggaggctctcaattctctccagaagactagtgctgaaaaaagggaaattgaggagaagcttcacaagttgttctcacaagaccatttagtgatttataagggctacgtggatgacccgaggaataccgacaacgcgtggatggagaccgaggccgtaaactatcacgatgagactggcgagattatggacaacttaatgctcgaagccggggatgatgccggcaaagtcaaatgggttgatatcaatgacaagttgaagctgtatgcctcccattcacagtttataaagctcgtggctgaaaagcgggatgcccattggagcgaggactctgaagctgactgtcatgctttgtag

SEQ ID NO: 44098 - DNA, 903 bp, Artificial Sequence
  Description of Artificial Sequence: Synthetic coding sequence
atgagcggcagcaacggcagcaaggagaacagccacaacaaggcccggacttccccttaccccggaagtaaagtagagcggtctcaggtacctaatgagaaggttggttggctcgtggagtggcaagattataaaccagtagagtacactgcagtttccgtgctagctggtcccagatgggccgacccccagatatctgaaagcaacttttcacccaagtttaacgagaaagatggacacgttgagaggaagagcaagaatggcctgtatgaaatagaaaatggcaggccacgaaatcctgccggcaggaccggcctggtgggaaggggactgctggggagatgggggccaaaccatgccgcagacccaattataacacgttggaagagggattcaagcggcaacaagatcatgcaccccgtttcgggtaagcacatcctgcagttcgtcgctattaagagaaaagactgtggagagtgggcgatccctggaggcatggtggatccaggcgaaaaaatctccgcaaccctcaaacgggaatttggggaggaggccctaaattccttacaaaagacaagcgcagaaaaacgcgagatagaagagaaattacataagttgttttcccaggatcacctggtgatctataagggctacgtcgatgacccgcggaacactgataacgcgtggatggagacagaggcagtgaattaccacgacgagactggggagattatggataatctgatgcttgaggcaggcgatgacgcggggaaggtgaaatgggtggatatcaatgataagctcaaactgtatgcttctcatagccagtttattaagttagtcgctgagaagcgcgatgcccactggtccgaggatagcgaggcggactgccatgcactgtag

SEQ ID NO: 44099 - DNA, 621 bp, Artificial Sequence
  Description of Artificial Sequence: Synthetic coding sequence
atgagcggcagcaacggcagcaaggagaacagccacaacaaggccagaacgtcgccatacccgggatctaaggtcgagcgatcccaggtacccaacgaaaaggtcgggtggctagtggagtggcaggattacaagcctgtcgaatacacagctgtttcagtgctagccggtcctaggtgggccgatccacagatttccgagtccaatttttcaccaaagtttaacgagaaggacggccacgtggagcggaagtccaagaatggtctgtacgagattgagaacggtagacccagaaatccggccggccggaccggacttgtcggccgcggactcctgggcaggtggggtccaaatcatgcagctgaccctataatcactcgatggaagcgggacagctccggcaataagatcatgcacccggtgtccggcaaacacatcctgcagtttgttgcgatcaagaggaaagattgcggtgagtgggcaatccccggaggcatggtggaccctggagagaagatcagcgccacactaaagcgcgaattcggtgaggaagcacttaacagtctgcagaaaacaagcgctgagaagcgggaaattgaggaaaaactccataagctttag

SEQ ID NO: 44100 - DNA, 789 bp, Artificial Sequence
  Description of Artificial Sequence: Synthetic coding sequence
atggcccccgccctgctgctgatccccgccgccctggccagcttcattctcgccttcggaacaggcgttgagttcgtcagatttacatctctccgacccctcctgggcggcattccagagtctgggggcccagacgctagacaaggttggctagctgctcttcaggatcgctccattctcgctcccctggcttgggacctggggcttctcttgctgttcgtaggccagcactcactgatggccgctgaaagagtcaaggcctggacatcaagatatttcggcgtgctgcagaggagcctttacgtggcgtgcaccgccctggcgctacagctggtgatgcgctactgggagccaatcccaaaggggccggtgctctgggaggcaagggccgagccctgggcgacctgggtccctctcctttgttttgttttacatgtgattagctggctgctgattttttccatcttgttggtctttgactatgccgaactcatgggcctcaaacaagtctactatcacgtcctgggtctcggcgaacctctggcgttgaaatcacctcgcgcattacgtctcttttcccacctgaggcatcctgtttgcgtagagctgcttaccgtactctgggtggtgccaaccctaggtaccgataggctcttgttagctttcctgttaacgctgtatttggggctggcccacggtctcgaccagcaggatctgcggtatctgagggcccaactccaacgcaagttacatttgctgtctcgccctcaagatggggaagcagagtag

SEQ ID NO: 44101 - DNA, 612 bp, Artificial Sequence
  Description of Artificial Sequence: Synthetic coding sequence
atggcccccgccctgctgctgatccccgccgccctggccagcttcattcttgcgtttggaactggtgtggaatttgtgcgcttcacgtcccttcgacccctcctgggtgggatcccagagtcgggcggcccagacgcccgccaggggtggttggctgccttacaggatcgctctatcctcgcacctctcgcttgggatctcggactactccttttgttcgtgggccagcacagcttgatggccgccgagagggtcaaagcttggacttctcgctacttcggggtgcttcagcggtcactatacgttgcgtgtaccgctttggcacttcaagtgtactaccacgtccttggcctcggagaacctctcgcactgaagagccccagggcccttcgcttgttcagtcatctccgccatcccgtatgtgtggagcttctgactgttctgtgggtggtacctaccctgggaacggaccggctcctccttgcctttcttttgactctctacttgggtcttgcccatggcctcgaccagcaggacttaaggtatctccgcgcccagctgcaacgcaaactgcatctgttaagccggccgcaggacggagaggctgaatag

SEQ ID NO: 44102 - DNA, 789 bp, Artificial Sequence
  Description of Artificial Sequence: Synthetic coding sequence
atggcccccgccctgctgctgatccccgccgccctggccagcttcatcttagcttttggaaccggcgttgaatttgtgagatttacctccttacgacctctgctcggaggaattccagagagcggtggcccggatgccagacaggggtggctggctgcgctacaggaccgatcaatcctggccccactggcatgggacctggggctcctgttgctttttgttggtcagcatagcctcatggccgctgaaagggtgaaggcctggacgtcccgttactttggcgttctgcagcgaagtctatatgtggcctgcactgccttggcactgcagctcgtgatgagatattgggagccaatacccaaaggccccgtgctctgggaggctagagcagaaccgtgggccacttgggtccccctactttgtttcgttctgcatgtaatctcatggctcctgatctttagcattttgctggtgttcgactacgccgaactgatgggcctgaagcaagtttactatcacgtgcttggcctcggtgagccactggctctgaagtccccccgggccctgaggctgttctctcatctgcgccatcctgtctgtgtggagctgttaactgtgctctgggtcgtcccaacacttggaacagatagactgctgctggctttcctgctaaccctctatcttggtctcgctcacggccttgaccagcaggacctgcggtacctccgtgcacagcttcagcgtaagctgcatctgctttctaggcctcaagacggagaagctgaatag

SEQ ID NO: 44103 - DNA, 612 bp, Artificial Sequence
  Description of Artificial Sequence: Synthetic coding sequence
atggcccccgccctgctgctgatccccgccgccctggccagcttcattctggcctttggcaccggagtggagttcgtcagattcacatcacttaggccactgttaggaggtattcctgaaagcggcggacctgacgccaggcagggctggttggcggcgctccaggatcgatctattttagctccacttgcctgggatctcggactcttacttctgttcgttggccagcactcactcatggctgctgagagagtaaaggcatggactagcaggtacttcggcgtgctgcagaggagcctgtacgtggcttgcacagccctcgcactccaggtctattatcacgtgctggggcttggcgaaccacttgctttgaagtcacctcgcgcattgcgtctattttcacacttacggcacccagtttgtgttgagttactcaccgtgctgtgggtggtgcccactctggggacagacagactgcttctggcttttctgttaaccttatatctgggtttggcccatgggcttgatcagcaagatcttcgctacctcagggcccagctacagcgaaagcttcacctcttgtctaggccccaggacggcgaggctgaatag

SEQ ID NO: 44104 - DNA, 789 bp, Artificial Sequence
  Description of Artificial Sequence: Synthetic coding sequence
atggcccccgccctgctgctgatccccgccgccctggccagcttcatcctagcctttgggactggtgtggaatttgtgcgtttcaccagtctgagaccattactgggaggaatccccgaatccggcggacccgacgccaggcaggggtggcttgctgcacttcaggatcgcagtattctcgctccgttagcatgggatttgggcctactgctcctgtttgtggggcagcactccctgatggccgctgagcgggtaaaggcctggacctcccgctatttcggcgtgctgcaacgctccctctacgttgcttgtacagcgctcgcgttgcagctggtgatgaggtattgggaacccataccaaaaggcccagtcctatgggaagcgcgggcagagccatgggccacttgggtgccacttctgtgttttgtgctgcacgtcatttcttggctcctgatcttctcaattctattggtgttcgactatgctgagctaatgggtctgaaacaggtgtactaccatgtgttggggctgggggaacctctggccctgaaatctccacgcgcccttagactgttttcccacctccgacaccccgtttgtgtggagctactgaccgtgctgtgggtcgtgccgactctgggaaccgacagactgcttctcgccttcttattaacgttgtatcttggtctggcacatgggttagatcagcaggacctccggtacttaagagcccagctacagcggaaactgcacctgctgagccgacctcaggacggtgaggccgaatag

SEQ ID NO: 44105 - DNA, 789 bp, Artificial Sequence
  Description of Artificial Sequence: Synthetic coding sequence
tgagagagcggccgggaggccaccggcgagggcgacctgagcagcaagctggggacccagggcctggagttttggcgcggtggtcgggtaagaaccgagggagcggagaaggggggtgataggtccatactgaacgctaggcaaggctggctcgccgccctgcaggatcgttccattctggcgccattggcgtgggatctgggccttctcttactcttcgtcgggcaacacagcctgatggctgccgagagggttaaagcttggacctcaagatacttcggggtgttgcagcgctctctgtacgtagcctgtacagctctagccctgcagcttgtgatgagatattgggagcccattccaaagggaccagtcctgtgggaagcacgcgctgagccgtgggccacctgggtccctctactgtgctttgtcctgcatgtgatatcgtggctattaatcttctctatccttctagtgtttgattacgccgagcttatgggcctgaaacaggtttactatcacgtgttaggactgggggagccactggcattaaagtcgcctcgtgctttgaggctgttctcccatcttcgccacccagtgtgcgtggaactccttacagtcttgtgggtagtccccactctgggaaccgataggctccttctcgccttcttgctgaccttgtatctcggtctcgcacatggtttagatcagcaggatctgcgttacctgcgcgcccagctgcagagaaaactgcacctgctcagtcggccacaggatggagaggctgaatag

SEQ ID NO: 44106 - DNA, 789 bp, Artificial Sequence
  Description of Artificial Sequence: Synthetic coding sequence
atggcccccgccctgctgctgatccccgccgccctggccagcttcatcctcgcgtttggaactggagtggaatttgtgaggtttacgagtctacgaccattgctggggggcatccccgagtcaggcggtcctgatgccagacaagggtggttggccgccttgcaagacaggtccatcctcgctccactcgcttgggacttgggactgctcctgttgttcgtgggacaacactccctcatggccgcggaaagagtaaaagcgtggacctctcgatacttcggtgtgcttcaaagatctctctacgtcgcctgcacagcccttgcgctccaacttgttatgaggtattgggagcctatcccaaaaggtcctgtcctgtgggaggctcgggctgaaccctgggcaacatgggtgcctttgctgtgctttgtccttcacgtcatcagttggctcctgatatttagtatcctgttagtgttcgactatgcggagctgatggggctgaaacaagtttactaccacgtcctcggcctgggcgagccgctcgcactcaagagcccccgagcgctccggctttttagtcacctgcgccacccagtgtgtgtggagctgctgactgtgctgtgggtcgtgccgacgctcggcaccgatagactcctgctggctttccttcttacactatatttgggtttagcacacggactggatcagcaggatttaagatatctgcgggcccagctccaacgcaaactgcacttgctgagccggcctcaagacggcgaagccgaatag

SEQ ID NO: 44107 - DNA, 612 bp, Artificial Sequence
  Description of Artificial Sequence: Synthetic coding sequence
atggcccccgccctgctgctgatccccgccgccctggccagcttcattctggcttttggaaccggagtcgagtttgtaaggttcacatcacttcgccccctgctgggtggcattccagagagcggcggccctgatgccagacaaggctggttggccgctctgcaggatagatctatactagcccccttagcctgggatttgggtctgctactcctcttcgtgggacagcacagcttgatggctgccgagcgggtcaaggcctggaccagtcgatactttggagtgctccagcggagtctttatgtggcatgtactgccctggccttgcaagtctattaccatgtcctcgggctgggtgaaccactagcgcttaaatccccccgagccctgagactgttcagccacttgcgccaccccgtctgcgtggaactgctcactgtgctgtgggtcgttcctacacttggaacagatcggctcctgctcgcctttctgcttaccctttacttaggcctggcacatggattggatcagcaggacttgcgctacctcagggcccaactgcagcgcaagctgcacttgctgtctaggccccaggatggcgaggctgagtag

SEQ ID NO: 44108 - DNA, 789 bp, Artificial Sequence
  Description of Artificial Sequence: Synthetic coding sequence
atggcccccgccctgctgctgatccccgccgccctggccagcttcattctggccttcggaaccggggtcgaatttgtgcgatttacatcattaaggccacttttgggaggtatccccgagagcggcggtcctgacgcccgtcagggctggttggctgcgcttcaggatcgctccattctggccccactcgcatgggatcttgggcttctgttgctctttgtcggccaacattccctcatggccgccgagcgtgtaaaggcatggacaagcagatattttggggtcttgcagcgctctttgtatgtcgcttgtacggccctggcgctgcagctcgtaatgcggtactgggagcctattcctaaaggccctgtcctttgggaagccagagcagagccttgggccacctgggttcctttattgtgcttcgtgttacacgtcatctcttggctgctcatcttttcgatcctgctggtgttcgactacgctgaactgatggggctgaagcaggtgtattatcacgtcctcggcttaggagagccactcgccctcaaatcaccccgcgccctgcggctattcagtcacttgcggcaccctgtatgcgtggagttattgactgtgctgtgggtcgtgcccaccctgggcacggataggttgctactggctttcctgctaacactttatttagggttagcccacggactggaccagcaggatctgcgctatttgcgcgcccaactgcagagaaaactacatctgctgtctaggccacaggacggcgaggcagaatag

SEQ ID NO: 44109 - DNA, 789 bp, Artificial Sequence
  Description of Artificial Sequence: Synthetic coding sequence
atggcccccgccctgctgctgatccccgccgccctggccagcttcattctcgcgtttggaaccggcgtggagtttgtacgcttcacatctctcaggccgctgcttgggggcatccctgaaagcggcgggcccgatgctcggcagggatggctagccgctctgcaggaccgctctatcctggccccgctggcatgggatctgggcctgcttctgctctttgtcggtcagcactcactcatggcagccgagcgggtaaaggcctggaccagcaggtatttcggtgttctacagcggtcactatacgtcgcatgcaccgccttggcgctgcagctcgtcatgcgatactgggagcccatcccaaagggtcccgtgctgtgggaggcccgcgcagagccatgggctacatgggttccgcttctgtgttttgtgctgcacgtgatttcctggctcctgatattttcaatcctgctcgtgtttgactacgccgaacttatggggctgaagcaggtctactaccacgtactaggactaggggaaccactggcccttaaaagtccccgtgcccttcgcctatttagccatctgagacaccctgtctgcgttgagcttctgacagtcctgtgggtcgtgcccacactcgggaccgataggcttttgctggccttcttattgaccctctatctgggtttagcccacgggctagatcagcaggacctgaggtacctgcgcgcgcaactgcagcgcaagctgcatctcctgagtcggccccaggacggcgaggccgagtag

SEQ ID NO: 44110 - DNA, 789 bp, Artificial Sequence
  Description of Artificial Sequence: Synthetic coding sequence
tgagagagcggccgggaggccaccggcgagggcgacctgagcagcaaactgggaacccagggactggaattttggagaggaggccgagtgcgcaccgagggcgccgagaaaggaggtgatcgatccatactaaacgctcggcagggttggctcgcagctctacaggatcggagcatactggctcctttggcatgggacctgggcctactcctcttgtttgttggccagcatagcctaatggctgctgagcgggtgaaggcctggacaagtagatacttcggtgtcctgcagcggtctctgtacgtggcctgtactgccctggctttacaactggtgatgcggtactgggagcccatacctaagggaccagtgttgtgggaagcccgcgcagaaccttgggccacctgggtccccttgttgtgttttgtgctgcacgtcattagctggcttttaatattcagtattctcctcgtgttcgattacgccgaactcatgggacttaagcaggtctactaccatgtacttggcctgggagaacccttagctctcaagagccccagagcgctgcgactgtttagccacctgagacatcccgtatgtgtagagctgctcacggttttgtgggtggttcccacactggggaccgataggttgctcctggcattcctcctgaccctgtacctgggcttagcccacggtttggatcagcaagatcttcgctaccttagggcacaattacagaggaaactgcatctgttatcacgcccgcaggatggcgaggctgagtag

SEQ ID NO: 44111 - DNA, 789 bp, Artificial Sequence
  Description of Artificial Sequence: Synthetic coding sequence
atggcccccgccctgctgctgatccccgccgccctggccagcttcattctcgctttcggcacaggagtagaatttgtcagattcacctctctgaggcccctgctcggaggaatccctgaatccggtgggcccgacgcgcgtcaggggtggctggcagctctgcaggacagaagtatcttggccccactggcctgggacctggggttactgctgctgtttgtcgggcagcacagccttatggcggccgagagagtgaaagcctggacttctaggtactttggagtgttgcagaggtccctgtacgtggcctgcacagctctggctttgcaattggttatgcggtattgggagccaatcccaaaagggcccgttctatgggaggcccgagctgagccttgggcaacttgggtgcccctcctgtgcttcgtcctgcatgtcatcagttggctcctgatcttcagtatactcctcgtcttcgattacgcagagctcatggggcttaagcaggtgtattaccacgtcttggggctcggtgaaccactcgcgctcaagagtccacgcgccctgagactgttctcacatctgaggcatcctgtgtgcgtagagttgcttaccgtgttatgggtagtccccaccctcggcacagatcgcctgctgttggccttcctgctcaccctctatttgggtctggctcacggacttgaccagcaggacctgcgctacctgagagctcagttgcagcgtaagttgcatctgctctcgagaccgcaggacggcgaagccgagtag

SEQ ID NO: 44112 - DNA, 789 bp, Artificial Sequence
  Description of Artificial Sequence: Synthetic coding sequence
tgagagagcggccgggaggccaccggcgagggcgacctgagcagcaagctgggaactcaggggctggagttctggagagggggaagagtgagaactgagggggctgagaagggtggagaccggagcatcctcaacgctagacaaggatggctggccgccctgcaggatcgcagtatcttggcacctctcgcctgggatctcggcctgcttcttctgtttgtgggccagcattccctgatggcggcggaaagagtgaaggcttggacatcacggtattttggtgtgctgcagcgttcactatacgtagcatgtacagctcttgcccttcagctcgtaatgagatactgggaacccatcccaaaagggcctgtgctttgggaagccagagctgagccctgggccacatgggttccactgctctgctttgtgctgcacgtgatcagctggctgctgattttttctatcttgctggtcttcgattacgccgagctcatgggtctgaaacaggtttattatcacgtgttagggctgggggaacccctggctctcaagtctcctagggctttgcgcctttttagccacctgcgccacccagtttgcgtagagctacttacagtcctttgggtggtacctacgctgggcactgaccgattactcctagccttcctgctaacattgtatctcggcctggctcatggactggaccagcaggatttgcgctatctacgggcacagctgcaaagaaagcttcacctgctgtcccggccccaggacggagaggccgaatag

SEQ ID NO: 44113 - DNA, 789 bp, Artificial Sequence
  Description of Artificial Sequence: Synthetic coding sequence
tgagagagcggccgggaggccaccggcgagggcgacctgagcagcaagctgggcacccaggggctggaattctggagaggcggccgcgtcagaacagagggagccgagaaagggggggatagaagcattctgaacgctaggcagggatggctcgcagctcttcaggatagaagcattctcgcaccgctggcatgggacctcgggctgcttctcctgtttgtaggccagcacagcctcatggccgccgaacgagtcaaggcatggaccagccggtacttcggcgtgttgcagcgctcactctacgtggcatgcacagcactggccctgcagctagtgatgcgttactgggaacctatcccaaaaggccctgtgttatgggaggctcgtgccgaaccttgggcaacgtgggttcccctcctatgcttcgtgctccatgttatcagctggctcctcattttttcaatcctcctggtttttgactacgccgaactcatgggacttaagcaggtgtattaccatgtgctggggttaggggagcccctggctctaaagtccccaagggctctgaggctgttttcccatctgcgccaccccgtgtgtgtggagctgctgactgttttgtgggtcgtgccaactctgggtaccgacaggctcctgctggccttccttcttacattgtacctggggttggctcacgggctcgatcagcaggatctcaggtacttgcgtgctcaattacaacggaagctacacttgctatctcggccgcaggacggagaggccgagtag

SEQ ID NO: 44114 - DNA, 789 bp, Artificial Sequence
  Description of Artificial Sequence: Synthetic coding sequence
atggcccccgccctgctgctgatccccgccgccctggccagcttcattctcgcattcggcacaggtgttgagttcgtaagattcacctccctccgaccactactgggcggcattcccgagagcggaggtccagacgccagacagggttggttggccgcactccaggacagatccattcttgcccccctcgcctgggacctcggccttttactgttgtttgtgggccagcactcgctgatggccgctgaacgcgtcaaggcctggacatctaggtattttggtgttctacagcgcagcctctacgtggcctgcactgctctggctctacagctggtcatgcgctactgggagcccatccccaagggccctgtgctgtgggaggctcgggctgagccttgggcaacttgggtccccctgctgtgtttcgtgctgcatgtgattagctggctgctaatcttttcaatcctcttagtgtttgactatgccgagttgatggggctgaagcaggtttattaccacgttctgggtctcggagagccacttgctctgaaatccccccgggccctgcgactgttttcacacttaagacaccccgtctgcgtggaactcctgacggtgctttgggtagttccaactctgggcacagaccggctgcttctggcatttcttctgactctctatttagggttagcacacggcctggaccagcaggacctgagatatcttagagcccagctgcagcgtaagcttcacctgctttcacgtccccaggatggagaagccgaatag

SEQ ID NO: 44115 - DNA, 789 bp, Artificial Sequence
  Description of Artificial Sequence: Synthetic coding sequence
tgagagagcggccgggaggccaccggcgagggcgacctgagcagcaaactgggaacacagggtctagaattttggcgaggcggtagggttcgaacggaaggcgcagagaaagggggagaccgctctatattaaatgcacgccaggggtggcttgctgccctgcaagaccgctcaatcctggcccctctcgcatgggaccttggcctattactactctttgtgggtcaacacagcctgatggccgccgaaagagtcaaagcctggaccagtcggtacttcggtgtattgcagcgcagtttatacgtggcttgtaccgctcttgccctgcagctagtcatgcgatactgggagcccatcccgaaggggccagtgctgtgggaggcccgtgccgagccgtgggctacttgggttcctctgctttgttttgtgctgcatgtgatctcctggctgctcatcttttctattctgttggtgtttgattacgcggaacttatgggtttgaaacaagtctactatcatgtgctggggctgggcgagcccctggcgctgaagtcgcctcgggctttacgcctttttagtcacctgcgccaccctgtgtgcgtggagctgctcacagtattatgggtcgtccctacccttggtaccgaccggctgctgttagctttcttgctaaccctctatctcggcctagctcatggactggaccaacaggatttgcggtatctgagggcacagctccagcgcaagctgcatttactgagcaggccgcaggatggtgaggcagaatag

SEQ ID NO: 44116 - DNA, 789 bp, Artificial Sequence
  Description of Artificial Sequence: Synthetic coding sequence
tgagagagcggccgggaggccaccggcgagggcgacctgagcagcaagttgggaactcaggggctggagttctggagaggggggcgggtcaggacagagggagctgaaaaaggaggcgatcgctcaatccttaatgccaggcaagggtggcttgcagccctgcaggataggtctatcctcgcaccactggcctgggacttgggactgctcctcttattcgtgggtcagcactctctcatggcggccgagcgcgtcaaagcgtggacctcacggtattttggcgtgctgcaaaggtctctctacgtggcctgtactgccctggcgctgcagctggttatgagatactgggagcccatcccaaaaggcccagtgctctgggaagccagggcagagccatgggcaacatgggtgcccctgctttgttttgtgctgcatgtgatttcctggctcctgattttcagcatcttactggtctttgattacgctgagttgatggggttaaagcaggtttattaccacgttctgggattgggcgaaccattagcactgaagagcccaagggctcttaggctgttttcacacctccgccatccagtttgcgtggaactgctcactgtgttgtgggtcgtacccactttgggaaccgacagactgcttttggccttcttgcttactctgtatctggggctggctcacggcctggaccagcaggatctacggtacctgcgggcgcagctgcagcgtaaactccatcttctgagccgtccacaggacggcgaggcagaatag

SEQ ID NO: 44117 - DNA, 612 bp, Artificial Sequence
  Description of Artificial Sequence: Synthetic coding sequence
atggcccccgccctgctgctgatccccgccgccctggccagcttcatcctcgctttcggtacgggtgtcgagttcgtgagatttacttccttacggcccctgttgggaggtatccctgaatccgggggcccggatgctagacaggggtggctcgcagcactgcaggataggtccatcctggctccactggcttgggatttggggttactgctgctgttcgtgggtcagcattccttaatggccgcagagagggtgaaagcctggacctccagatattttggtgttctgcagaggtcactctacgtggcctgcaccgctctcgctttacaggtgtactatcacgttttgggcctcggagaacccctggccctgaaatctcccagagccctccgcctcttttcacatctgagacaccctgtgtgcgtggagctcctaaccgtcctatgggtagtgcctactctcggcaccgatcgattgctcttggctttcctgctcacgctgtacctaggactggcacatgggctcgaccagcaggacctccgctatctccgagcccagctgcagaggaagttacacttactgagccggccacaggacggagaagcagagtag

SEQ ID NO: 44118 - DNA, 789 bp, Artificial Sequence
  Description of Artificial Sequence: Synthetic coding sequence
tgagagagcggccgggaggccaccggcgagggcgacctgagcagcaagctgggtacacagggtctcgagttttggagaggcggtcgggtacggacagagggcgccgagaaaggaggagatcggagcatactgaatgctagacagggatggctggctgccctgcaagatcgctcaatcctggccccactggcctgggacctagggctgcttctgctcttcgtgggacaacattccctgatggctgccgagcgagtgaaggcctggacatctaggtactttggtgtcctgcagcgaagcctgtatgtcgcttgtactgcactggctttgcaactggtgatgcgctactgggagccaatcccaaaggggccggtgttgtgggaagccagggccgagccttgggcaacctgggtaccccttctgtgtttcgtactacacgttatctcttggctgctgatattctctatactgttggtcttcgactatgctgaactcatggggcttaagcaggtgtactatcacgtccttggcctaggcgagcccttggcactgaagtcgccacgcgcactacggcttttctcgcatctgcggcacccggtctgtgtcgaattgctgacagtcctttgggtggtccccactctgggtaccgaccgccttctcctggccttcttgctcactttgtaccttggtctcgcccatgggttagaccagcaggatctgcggtaccttagagcacagttacagcggaagctgcatctgctgtccagacctcaggacggggaggctgaatag

SEQ ID NO: 44119 - DNA, 612 bp, Artificial Sequence
  Description of Artificial Sequence: Synthetic coding sequence
atggcccccgccctgctgctgatccccgccgccctggccagcttcattcttgcttttgggaccggtgtggagttcgtgagattcactagtctgcgtccattgctgggtggaatcccagaatctggaggtccggatgcgcggcagggctggctcgctgcactgcaggacaggagcatcttggccccgcttgcttgggatctcggtctgctgttactcttcgtgggccagcacagcctgatggcagccgaaagggtgaaggcttggacgagcaggtactttggcgtgctgcagaggtccctttatgtcgcctgcactgccctagccctgcaagtgtactaccacgtgcttgggttaggcgagcccttggctctcaaatctcctcgagcactccgcctcttctcgcacctgaggcaccctgtgtgtgtggagctgttgaccgtactatgggtagtaccaaccttgggtactgatagactactgctggctttcctcctgaccttgtacctgggactggcacatgggcttgaccagcaagaccttaggtatctccgggcgcagctccagaggaagctgcacctcttatcccgacctcaagatggcgaagcggagtag

SEQ ID NO: 44120 - DNA, 612 bp, Artificial Sequence
  Description of Artificial Sequence: Synthetic coding sequence
atggcccccgccctgctgctgatccccgccgccctggccagcttcattcttgcttttggaacaggggtagaatttgtgaggtttacctcattgcggcccctgctcggtggaatccccgagtctggcgggccagatgccaggcaaggctggttagcagccctacaggatcgtagcattctggcacctctcgcctgggacctcggccttctgctgctctttgtgggacaacactccctgatggcagccgaacgagttaaggcctggacctcaaggtacttcggcgttctgcagcgctcactttacgtggcttgtaccgcattggcactgcaagtgtactaccatgtgctcggtctgggggagcctctcgcactaaaatccccccgggcccttcgattgttcagtcatttgcggcatcccgtctgcgtcgagctgctcaccgtgctgtgggtggtacccacgctgggtacggataggctgctcctggcgtttctactcaccctgtacctgggtctggcgcacggtctggatcagcaggatcttcggtatctgcgcgcccagcttcagcgcaaactgcatttgctgagtcgcccccaagatggtgaggcagagtag

SEQ ID NO: 44121 - DNA, 612 bp, Artificial Sequence
  Description of Artificial Sequence: Synthetic coding sequence
atggcccccgccctgctgctgatccccgccgccctggccagcttcattttggcattcgggaccggggtggaattcgtccggttcacctctcttcggccactgctaggcgggatcccagagagcggaggtccggacgcacgccagggatggctggccgccttacaggataggtccatactcgcgcccttagcttgggatctgggcttgctcctgctgttcgtaggtcagcattccctgatggccgccgaacgcgtgaaggcttggaccagccgttattttggtgttcttcaacgtagcctgtatgttgcctgtaccgctctcgccctacaggtgtactatcatgtgctgggcctaggtgagccacttgctctcaagtccccgcgcgctctcaggctcttctcccatttaagacatccagtgtgtgtcgaattactgacagtcttgtgggttgttccaaccctcggtactgatcgactcctcctagcgtttctattaacattgtatctgggtctggcccacggcctcgatcagcaggatctccggtacttgcgagcacagctacaacgcaaactacacctgttgtcccgcccccaagacggagaagcggagtag

SEQ ID NO: 44122 - DNA, 750 bp, Artificial Sequence
  Description of Artificial Sequence: Synthetic coding sequence
atggccatgctgcgggtgcagcccgaggcccaggccaaggtggacgtgttccgggaggatctctgcaccaaaacagaaaaccttctaggctcctactttcctaagaaaatttccgagcttgacgcgtttttgaaggagcccgctcttaatgaagcaaatctttccaatctaaaggcgcctttggacatacccgtcccagacccggtcaaggagaaagagaaagaagagcgtaaaaagcagcaggaaaaagaggacaaagatgaaaagaaaaaaggggaggacgaagacaaaggtcccccctgtggccctgtcaactgcaacgagaagattgtcgtgctgctccagagactgaaaccagagataaaggacgtaatcgagcaactgaatttagtgacaacatggctacagctgcaaatccccaggatcgaggatggaaataattttggcgtggctgtccaagaaaaagtctttgagctgatgacaagtcttcatactaagctcgaaggctttcacacccaaatcagtaagtatttttccgaacggggcgacgctgtaacgaaagccgcaaagcagccacacgtgggtgactacaggcagcttgtccacgagctggatgaagctgaatatcgggatatcaggctgatggttatggagatacgcaatgcttacgcagttctatatgatatcattctgaaaaactttgagaagttaaagaagccacgcggcgaaacaaaagggatgatctactag

SEQ ID NO: 44123 - DNA, 5697 bp, Artificial Sequence
  Description of Artificial Sequence: Synthetic coding sequence
atgctgctgagcggcggcgacccccccgcccaggagtggttcatggtccagacaaaaagcaaacccagagtccagcggcagagactccaagttcagaggatctttagggtcaagcttaatgcctttcagagccggccggatacgccctacttttggcttcagttggaggggcccagagagaacatgggcaaggcgaaggagtacctgaaggggctatgcagccccgaactgtggaaggaggtccgttatccgcccatcctccattgcgccttcctgggagcccagggactcttcctcgattgtctgtgctggtccaccctggcgtatttggtgccggggccccctgggagtttgatggtcgggggacttaccgagtcatttataatgacgcagaactggctggaggaactggtcggacgtctgcggtggggccctgcaccactcctcactccacgtggaatctgggaagcggaagttacaagggcgttcggcgcactggtgtggattcggggagatcagcatgccggagacctacttcaactccccccggccgttcaggaattgctactgagcctcgttagggacgctgccggaaaggaggatatcattgagtggctgtcccggtttggaatcagcgacagccatagcgaccctgaggtgctaatttgcccaccacagcagcagaaggaagcacctgccatggtgagtgtgggtgagtctcccggccctttcgttgatatgggaacactacagaatcgaggacccgaaaatagcaaaagattgagctcccttggggctaccggatcactgatcacagctcaatccacacctcaagaagcagcaaatcagcttgtgagggtgggatcgaacaatcaagacggaatggactccgcacaagaggaaggaaccgtgcaggccacctctagccaagattccaccaatcacacccaggctcttctgaaacaacgccaggttcagaagattgaagataagcttctatttcagccacctgtgtcggctctgggcgtttgccccccctggaaggcttggacccccggtcctgcattcggccctttatggcctggtgcaatcgcagccacattttggagaataaacgagctgcactcactgcacctcgcttggctgctctcacaggcttgctttaacttccccttctggcagaggccacttgggccaatccagctgaagcttcctggtcagaaccccctccccctgaacctagaatggaagcagaaggagctggcaccactaccgagcgccgaaagtcctgctgggcggccagacggcggtctcggcggtgaggcggcactacagaattgccccaggcccgagatttccccaaaggtgacctcattgctggtagtgcccggcagctccgacgtgaaagacaaagtgagtagcgatctaccgcagattggcccaccactgacttccacgccccagctgcaggccgggggggagccaggagaccagggttcaatgcagctggactttaaaggcctggaagaaggccctgcgccagtactgcctacaggccagggaaaacctgtcgcacaggggggcttaacggatcagtcggtgccgggtgcacagaccgtgccagaaacgctcaaggttcctatggctgccgccgtccccaaagccgaaaatcctagtcgcacgcaagtgccctctgcagcacctaaattgcccacatcacgtatgatgctcgctgttcacaccgagcccgctgctcccgaagtgcctttggctccgacaaagcccactgcacagctgatggctaccgctcagaagacggtggtaaaccagcctgttctggttgctcaggtcgaacccacaacccccaaaaccccccaggcccagaagatgccagtagccaagacaagccccgctggcccaaagacgcctaaggcgcaggcaggccccgccgccaccgtgagcaaagcgccagccgccagtaaggcacctgccgcccctaaagtgccagtgactccgagagtgagccgcgcgccgaaaacacctgccgcacagaaggttcctacggatgcaggcccgacactggatgtggctagattactcagcgaggttcagcccacttctcgggctagcgtgtccctgctgaagggccaggggcaggcagggcgccagggacctcagagctccggcacattagcgctgtcttcgaaacatcaatttcagatggaggggctgctaggcgcatgggagggagcacccagacagcccccaagacacctgcaggctaactcaaccgttactagttttcagaggtaccatgaagctctcaacacccctttcgaacttaatctaagcggcgaaccagggaatcagggtctcaggagagtggttatcgacggctcatcagtcgcaatggtgcatggactgcagcactttttctcctgcaggggcatagctatggctgtgcagtttttctggaaccgcggacaccgggaagtcaccgtctttgtgcccacgtggcaactcaagaagaatagaagagtacgggaaagccactttctcaccaaactacacagtttgaagatgctatcaattacccctagtcaactcgagaacgggaagaaaatcacgacatacgactatcgcttcatggtgaagttggctgaagagactgacgggatcatcgtgacaaatgaacagatccatatcctcatgaatagctctaaaaaactcatggttaaggatcggttgcttcctttcacttttgctggtaacctctttatggttccggacgatcccctgggtagagatggtcccacattggacgagtttttgaagaaaccgaatcgtctcgatacggacataggtaactttcttaaggtgtggaagactctaccaccgtcaagcgcaagcgtcactgagctctctgacgacgccgacagcggccccttggaatctctgcctaatatggaagaagtgcgggaagaaaaggaagagcgccaagatgaagagcaacgccagggtcagggaacacagaaagctgctgaggaggatgacctcgacagcagtctggctagcgtgtttagggtagaatgcccctccctgagcgaagagatccttcggtgcctttcgctgcacgacccacctgatggcgctttggatatcgacctgttgccaggggccgcaagcccctacctcgggattccctgggatggaaaggccccctgtcagcaggtcttggcacacctcgcgcaactaaccatcccaagcaactttaccgcattatcctttttcatgggcttcatggatagccacagggacgccatcccagattacgaggcgctggttggaccacttcactccctgctgaagcagaagccggactggcagtgggaccaagaacatgaagaggcattcttggccctcaagcgggcacttgtcagtgcattgtgtctaatggctccaaatagtcagctgcccttcagactcgaggtgacagtgagtcatgtggcactcacagcgatcctgcatcaagagcatagcggacgcaagcaccctattgcctataccagcaagcccctactccccgacgaggagagccaaggaccacaaagtggaggcgattctccatatgcagtagcctgggcgctgaagcacttcagcaggtgcattggtgacacaccggtggtcctggacctgtcttacgctagtcgtaccacagcggaccccgaggtgagagagggccgtcgggtctctaaagcatggctgatccgatggtctttgctagtccaggacaagggcaaaagggctctggagctggcgcttcttcagggcctcctcggggagaaccgactcctgacaccagctgcatcaatgccccgcttctttcaggtgctgcctcccttctcagacctctccacatttgtgtgtatccacatgtcaggatattgtttctatcgggaggatgagtggtgtgccggcttcggactgtacgtgttgtcccctacaagccctcctgtgtctcttagcttttcttgttctccctacactccgacctatgcccacctggccgcagttgcttgtggtctcgaacggttcggacaatcccctctccccgtggtgttcctgactcactgcaattggatattttccctgctatgggaacttttacctctttggagggccaggggatttcttagttccgacggcgcaccactaccacacccttccctgctctcatatatcatcagcttaacctctggtctgagttcgttaccattcatttatcggaccagctacagaggtagcctgttcgctgtaactgtggacacattggcaaagcaaggtgctcagggcggggggcagtggtggtctttgcccaaagatgttcccgctccgacggtaagccctcacgccatgggaaaacgaccgaatctgctggccctgcagctatcagattctaccttggccgacataatcgccagactgcaggccggccagaaattgagcggttccagccccttcagtagtgcctttaactccctatccctggacaaggaatccggtctgctcatgttcaagggagataaaaagcctcgggtctgggtagtgccaacccagctccgccgggaccttatctttagtgtacatgacattccgctaggtgcccaccaacgaccggaggagacctataagaaacttcgtctccttgggtggtggcctggtatgcaagagcatgtgaaggattactgcaggtcttgtctgttttgcatcccacgcaacctgataggatctgaactaaaggtcatagaatccccctggccgctcagatccactgctccttggtctaatttgcagatagaagttgtggggcccgtgacaatctctgaagagggccacaagcatgtgctgatcgtggccgaccccaacactcgctgggtcgaggcatttccgctgaagccttatacacatactgcagtagctcaggtattgctccagcacgtctttgctagatggggggtgccggtgagactcgaagccgcgcagggaccccagtttgcccggcatgtgttggtcagttgcggtctggccctgggagcccaagttgcaagtctgtcccgcgatcttcagttcccctgtctgacttcgtctggcgcgtactgggagtttaagcgagccctgaaggaattcatctttcttcatgggaaaaagtgggctgcctccttgccgctgttgcatctcgcctttcgcgcatcatctacagatgccactccatttaaggttctaaccggcggcgagtcccgcttgaccgaacctttatggtgggaaatgagcagtgccaacatcgagggcctcaaaatggacgtctttttactccagcttgtgggcgaactcctggagctccactggcgtgttgctgacaaagcttccgagaaagctgaaaatcggaggttcaaaagggaatcccaagagaaggagtggaatgttggtgaccaagtactcttgctttccttgccccgtaacggctcctcagctaaatgggtaggacccttttatatcggcgacaggttgtcccttagcctttatcggatatgggggttccctactcccgagaagcttggctgcatatatccatcgagtttgatgaaagcctttgccaaaagtggcaccccgctatctttcaaagtactggaacagtag

SEQ ID NO: 44124 - DNA, 7797 bp, Artificial Sequence
  Description of Artificial Sequence: Synthetic coding sequence
ggccggcccatcccccccaccagcagccccagcctgctgcccagcgcccagctgccttcttctcataacccccctccagtgtcatgtcaaatgcccctcctcgattcgaacacatcacaccagatcatggacactaatcctgacgaagaattcagtcccaatagctaccttctcagagcttgcagcggacctcagcaggcctctagtagcgggccgccgaatcatcactcgcagtctaccctgcggcctccactgcctcctccacataaccacacactcagtcaccaccacagttccgcgaactccttgaatcgtaattccttaaccaacaggagaagccagatccatgcccctgctcctgcccccaacgacttggcaactacccctgaatccgtgcagttgcaggacagttgggtgctgaactccaacgtcccccttgaaactcgtcactttctcttcaaaacatcatctggtagcacacccctcttttcctcttcttccccgggctaccctctgacatcaggaactgtttatacacccccgcccaggctactgcctcgcaacactttctcacgcaaggccttcaagttgaaaaaaccctccaagtattgcagctggaaatgcgccgcactctccgcaatcgccgctgccttgctgctcgctatcctcctggcctactttattgccatgcatctcctcggcctaaattggcaattacagccagcagacggacacacattcaataatggaattcgaaccgggcttcctgggaacgacgacgttgctaccatgccctcgggcggtaaagtgccctggtccctgaagaattccagtatagacagtggcgaggccgaggtcgggcgacgcgtaacacaagaggtgccccccggcgtgttttggagaagccagattcatatttcccagccccagtttctcaagtttaacatctcccttggcaaagacgcactctttggagtttatatcaggagggggttaccaccaagtcacgcacagtatgatttcatggaacgtctggacgggaaggaaaagtggtccgtcgtcgagtcccctcgcgagaggcggtctatccagacgttggtgcaaaatgaggcggtgttcgtgcagtacctggacgtcggtttgtggcacttagccttctacaacgatgggaaggataaggagatggtgagtttcaacacagtcgttttagattctgttcaagattgccccaggaactgtcacggcaacggcgagtgcgtaagcggcgtgtgtcactgtttccccggatttctcggcgctgattgcgccaaagcagcttgtccagtattgtgtagtggaaatggacagtatagcaagggaacctgccagtgctacagcgggtggaaaggtgccgagtgtgacgtgccaatgaatcagtgcatagacccctcttgcggcggacatggttcctgcattgatggaaactgtgtgtgctccgctggatataagggggaacactgcgaagaagtcgattgcttggatccaacttgttcttcacatggggtgtgcgtaaacggggaatgcctgtgcagcccaggttggggcggtttgaactgtgaacttgcccgcgtacagtgccctgaccaatgttcagggcacggtacgtacctgccagacacaggcttgtgttcctgcgatccaaattggatgggccctgattgcagcgtggaggtgtgctccgttgattgcgggacacatggcgtgtgtatcggtggcgcatgccgttgtgaggaggggtggaccggagcggcttgcgaccagagggtgtgccatccacgctgtatcgaacacgggacttgcaaagatggcaagtgtgagtgccgggagggctggaacggagagcattgtacaatcgacggatgcccggatctctgtaatggaaacggtcggtgcacccttggtcagaactcatggcaatgcgtgtgccagaccggatggcgggggcccggttgcaacgtggccatggagacaagttgtgcggataacaaagataatgagggggacggcctggtggattgccttgacccagattgttgtctgcagtctgcctgtcagaatagtctcctgtgtagaggttccagagaccctctagacatcatacagcagggccagactgactggcccgcagtgaagtcattttacgacagaattaaactacttgctgggaaagattcaacccatattattcccggggagaatccctttaacagttcactggtctcccttatacggggtcaggtagtcacaactgatggtacacccctagtgggtgtcaatgtgtcgttcgttaagtaccctaagtatggatatactatcaccaggcaggacgggaccttcgacctgatcgccaatggaggcgcttcactgaccctgcatttcgagcgggctcccttcatgagccaggagaggaccgtctggttgccttggaacagtttctatgcgatggacacactggtgatgaagaccgaggaaaatagtatcccatcatgcgatctctctgggtttgtccgacccgaccctatcatcatttctagccccctgtcaacgtttttctccgccgcccccggccagaaccccatcgtccccgagacccaggtactacacgaggagatagagctgcccgggtccaacgtcaagttgcgctacctcagtagccgcacggccggctataaatcattgctaaagatcactatgactcagtcgacggttcccctcaaccttatccgcgtgcacctgatggtcgcggttgaaggtcatctgtttcagaaatcctttcaggcctcacccaaccttgcttatacatttatttgggataagactgacgcctacggacagcgcgtttatggcttgtccgacgcagtggtaagtgtgggatttgagtatgagacctgtcctagcctcattctgtgggagaagcggacagctttacttcagggctttgagttagacccgtcaaacctcggcggttggtcactggataaacaccacattctaaatgtgaaaagcgggatcctgcataagggcactggcgagaatcagtttctgacccagcaaccggcgattatcacaagcatcatgggcaatgggagacggagaagcataagctgcccttcatgcaatggattggccgaggggaacaaacttctcgctcccgttgcactggctgtgggaatcgatgggtccctctacgtcggagatttcaattacatccgtcgcatctttccctcacgcaatgtcacatcaattctagaactcaggaacaaggagtttaaacattccaataacccagctcacaagtactatctcgcagttgaccccgtctctggtagtctgtacgtgagtgataccaattctagacgtatctaccgggttaagtcactttcaggaaccaaggacctcgctggaaattccgaggtggtggccggtaccggggagcagtgcttaccctttgatgaggcaagatgtggtgacggcggcaaggcaattgacgctaccttaatgtcaccacggggaattgctgttgacaaaaatggccttatgtacttcgttgatgctaccatgattcggaaagttgaccagaatggtatcattagcaccctgttaggctccaacgatctaactgcagtccggccgctcagttgcgatagcagcatggatgtcgcgcaagtgcgtctggagtggccaacagacttggccgtcaacccgatggataattcattgtatgtcctcgaaaacaacgtgatcctgcgcattactgagaatcaccaagtgtccatcatcgccggccggcctatgcactgtcaggtgccggggattgattactcactcagcaagctggccattcattcagctctggagagtgcctccgccatagcgatcagccatacaggcgtgctttacataacagagacagacgagaagaaaattaatcgattgcggcaggtcaccaccaacggggaaatttgcctgcttgccggcgcggcgagcgactgtgactgtaaaaatgacgtgaactgtaactgttactccggtgacgacgcatatgccactgatgctatccttaattcgccgtcttcactcgctgtggcgcccgatgggacaatctatatcgccgaccttggaaatattcgcatacgcgctgtgtcaaagaataaaccggtcctgaacgcgtttaaccagtacgaggccgcttcccctggcgagcaagaactgtacgtctttaatgccgacggcattcaccagtacactgtgtccttggttacgggggaatatctgtacaactttacctattcaaccgacaatgacgttaccgagctgattgacaataatgggaatagtttaaagatcaggagagattcctctgggatgcccagacatttactgatgccagacaatcagattattaccctgaccgtcggaacaaacggcggcctgaaggtggtatctacacagaacctggagttgggcttgatgacttacgatggaaataccggactgctggccacaaaatccgacgagacggggtggactacgttttacgattatgaccatgagggtcgccttaccaacgtaaccaggcctactggcgtagtgacaagcctgcacagggaaatggagaaatcgatcaccattgatatcgaaaatagtaatagagatgatgacgtcaccgtgatcacaaatctgtcctctgtcgaggcttcatatacggtcgtgcaggatcaggtccggaacagctatcaactatgcaacaatggtacccttagagtcatgtatgccaatggaatggggatttctttccattctgagcctcatgttttggctggcactattactccaacaatcggtagatgtaacattagcctgcccatggaaaatggactgaacagtatcgaatggcgcctcagaaaagagcagatcaagggaaaggtcaccatttttggcagaaagctcagggtgcacgggaggaacctgctgtccattgattacgacagaaacatccgcaccgaaaaaatttatgacgatcaccgcaaatttaccctgcggattatttacgatcaggtgggtcgcccctttctctggctcccatcctctggcctggcagcagttaatgtgtcctatttctttaatgggagactggctgggttgcagcgtggtgcgatgagcgaacgcactgatatcgataaacaaggacggatcgtgtcaaggatgtttgcagacgggaaggtctggtcgtattcatatctcgacaagtcaatggtactcctcctgcaatcccagaggcaatacatttttgaatacgactcatcagaccgcctgttggctgttaccatgccctctgtggcgagacattcaatgagtacccacacatcaatcgggtatattcgcaacatttacaacccgcctgagagcaacgcctccgtcatctttgactattctgacgatggccggatcttgaagactagctttctgggaaccggacgccaagttttctacaagtatggcaaactctctaaattgtctgagattgtatacgactccacagcagtcacatttggctatgatgagactaccggggtcctgaagatggttaacctgcagagcggcgggttttcatgcaccatccgctatcgaaagattggcccacttgtggataagcagatctatagattctccgaggagggtatggtaaacgcacggttcgattacacttaccacgataattccttccggattgcatcaattaaaccagtgatttctgagacacccctcccagtggatctctaccgttatgatgaaatctctgggaaagtcgagcattttgggaagttcggagtgatctactacgatattaatcagatcattacaacagctgtgatgaccctcagcaaacattttgatacacacggaaggatcaaagaagtacagtacgagatgtttaggagcctgatgtactggatgacagtgcagtacgattcaatgggacgggttatcaaaagagaattgaaattgggtccatatgccaacacgacgaagtacacttatgactacgacggagatggacagcttcagtctgtggccgtcaacgatcgaccaacatggcggtacagttacgatctgaatgggaatctgcacctgctgaacccaggaaattcggtacgcctgatgccgctccgttacgatctgagggatcggattacaagactcggggatgtgcagtacaaaattgacgatgacggttatctctgccaaagaggatccgacatctttgaatacaacagtaagggtcttttgacccgcgcatataataaggccagtggttggagcgtccagtacagatatgacggcgtgggcagacgagcgtcctacaagacgaacctggggcaccacctgcaatacttttactccgatctacacaatcctactcgtatcacccacgtgtacaatcactctaactctgagattaccagcttgtattatgacctgcagggacatctgtttgccatggagtcatcttccggcgaggagtactacgtggccagtgacaacactggaactcctttggccgtgttctccattaacggactcatgatcaagcagctccagtacacagcctatggcgaaatttactatgactcaaatcctgactttcagatggtgatcgggttccatggcggtctttatgatcctttaactaaactggtccacttcactcagcgggactacgatgtcctggctggccgctggacaagccctgattacactatgtggaaaaatgtggggaaagagccagcaccgtttaacctctatatgtttaaatccaacaaccctttgtctagtgagctggatctcaagaattatgtaactgacgtgaagtcctggttggtcatgtttggttttcagctgagcaatattatacccgggtttccaagggctaaaatgtatttcgttcctcccccttacgaattgtcagagagccaggcaagcgaaaacggccagcttataacgggagtacagcaaacaaccgagagacataaccaggcgttcatggccctggaagggcaggtgattacgaaaaagctgcacgcaagcatacgagagaaagcgggccattggtttgccacaacaacaccaataatcggaaagggcatcatgtttgcaattaaagaaggcagagtgacgactggggtgagctcaatcgcgagcgaagactcacgcaaagttgcatcagtgcttaacaatgcctactacttggacaagatgcattattccatagagggtaaagatacccactacttcgtaaagataggaagtgccgacggtgatttggttactttgggcaccactattgggagaaaagtcctggaaagcggcgtgaatgttacagtgagtcagcctactctgctggttaatgggcgcactcggaggtttaccaacatcgaatttcagtactcaacactgctcttatcaatcaggtacggtttgacaccagacacgcttgatgaggaaaaggccagggtgttggaccaggcccgccaacgggcattgggaaccgcatgggccaaggagcagcagaaggcgagggatggaagggaagggtcacggttgtggactgagggggagaagcagcaactgctgtcaacaggcagggtgcagggctatgaagggtactacgtgctgcccgtagaacagtaccccgagctcgctgactctagctccaatatccaatttctgcgccagaacgagatggggaagaggtag

SEQ ID NO: 44125 - DNA, 8325 bp, Artificial Sequence
  Description of Artificial Sequence: Synthetic coding sequence
atggacgtgaaggaccggcggcaccggagcctgacccggggccggtgcgggaaggaatgtcgctacacttcctctagccttgattccgaagattgccgggttcccacccagaaaagttactcatcctccgaaaccttgaaagcttatgatcatgacagcagaatgcactacggcaacagagttaccgatttgatccaccgcgagagtgatgagttcccccggcaagggacgaattttacattggccgagctgggtatttgcgagccttcgcctcatcgaagtggatattgcagtgacatgggaatactgcaccaggggtattccctatcgaccggctctgatgcagacagtgataccgagggtggcatgagccccgagcatgccataaggctgtggggtagggggatcaagagcagaagatcctctggtttgtctagtcgagagaactccgccctgacccttacagatagtgacaatgagaacaaaagtgatgacgagaacggaagacccattccccccacttcatcgcctagcctcctgcccagcgcccagcttccatccagccataacccaccccccgtttcctgtcaaatgccactgctggattcgaacacaagtcatcagatcatggacaccaaccccgatgaagaattcagtccaaatagctaccttttgagggcatgcagcggacctcagcaggctagcagttccgggccgcctaaccaccacagccagagtactctgaggccccccctcccgcccccgcacaatcataccctcagtcatcatcactccagtgctaacagtctgaaccgcaactctttgaccaatagaaggtcccaaatccacgcaccagcgccagctcctaatgatctggctacaacacctgagtcggtacagctacaggatagctgggtgcttaattccaatgtaccattggagactcgccacttcctgtttaagacctctagcggctccactccgcttttttctagctccagcccaggctatccattgaccagcggcacggtgtatacacctccacccagactcctgccacggaatactttctctcggaaagcgttcaagctgaaaaagccttctaaatactgttcctggaagtgtgcagctctgagcgctattgcagccgcccttttattggcaattctcctggcatatttcattgccatgcacttgttaggactgaactggcagctgcagccagctgacggccacactttcaataacggaattcgtacaggcttacctggcaacgacgatgtagctacaatgccttctggggggaaagtcccctggtccctgaaaaactccagcattgattcaggcgaagcagaggtgggaagacgagtgacccaggaggtgccacctggagttttttggcggtcccagatccacatatctcagccgcagtttctcaagttcaacatttccctcggaaaagatgccttgtttggagtttacatccggcggggactgcccccctcacatgcccagtacgattttatggagagactggacggcaaggaaaaatggagcgtggtggagagtcccagggagagaagatctatccagacattggtgcagaatgaagccgtctttgtgcaatacctggatgtcggcctttggcaccttgccttttacaacgatggcaaggataaggagatggtgtcatttaacacggtggtgctggactccgtgcaggactgccctcgtaactgccacggcaacggagagtgcgtctcgggcgtctgccactgcttcccaggattcttgggtgcggattgtgccaaagctgcctgcccagtgctatgttcaggaaacggacagtattccaaggggacctgccagtgctatagcggttggaaaggcgcggaatgtgatgtacctatgaatcagtgcatcgaccccagttgtggcggccacggatcatgcattgacggaaattgcgtgtgcagtgccggttacaaaggagagcattgtgaggaagtggactgcctcgacccgacatgttcatcccatggcgtgtgtgtgaatggggaatgtctctgttccccgggctggggcggcctcaactgtgagctagctcgcgtgcagtgtcctgatcagtgtagtggtcacggaacatatttacccgacaccggactgtgcagctgtgacccaaactggatggggcctgattgctctgtcgaggtgtgctccgttgattgtggaactcacggcgtgtgcatcgggggagcgtgccgatgtgaggagggctggactggcgcggcctgcgaccagcgcgtgtgtcatccccgttgtatagaacacggcacctgcaaggacggcaaatgtgagtgtagagaaggatggaatggcgaacactgcaccatcgggcggcagaccgctggaactgaaactgatgggtgtccggacttgtgtaacggcaatggacggtgcaccctgggtcagaattcttggcagtgcgtgtgccaaaccgggtggagaggccctggctgtaacgtggcgatggaaacaagctgcgccgacaataaggacaatgagggagacggactcgtggattgtttggatcccgattgttgtttgcagagtgcttgccagaactcactgttatgccgaggatcccgagacccgctcgacattattcagcagggacagacagactggcctgccgtcaagtctttctatgatcggatcaaacttctggctggtaaagattccacccacatcattcccggagagaacccatttaacagtagcttagtgtcactgatccgcgggcaggtggtcactacggatggcacacccttggtgggcgtgaacgtatccttcgtgaaatacccaaaatatggatacacaataacccgacaagatggtacctttgatcttattgcaaacgggggagcatcacttactctccacttcgaaagggccccatttatgtcccaggagcggaccgtatggctcccttggaattcattttatgcaatggacactctagtgatgaaaaccgaggagaactctatcccctcatgtgatctgtccggatttgttagacctgacccaattatcattagttcccctctatccaccttctttagtgcagccccaggccagaatcccatcgttcccgagactcaggtccttcacgaggaaatagagctgcccggttccaacgtgaagctgcggtatttgtcctcccggacagcgggctataagtctcttctgaagataactatgactcagtctactgttcccttgaatcttatacgtgtgcacttgatggtggcagtggaaggacacttatttcagaagtctttccaggctagtcctaatttggcttacacctttatatgggataagacagacgcatacggccagcgagtatatgggctgagcgacgctgtagtatccgtgggcttcgaatatgagacctgtcctagcctaatcctgtgggaaaagcgcactgctctcttgcagggctttgagctggaccccagcaacctcggcgggtggtctttggataaacatcacatcctaaatgtgaagtccgggattctccacaagggcaccggcgagaatcagttcctcactcaacagcccgcgatcatcacctcaattatgggaaatggccgccgccgctccatcagctgcccaagttgcaacgggctggctgagggaaacaagttactggcacccgtggcgctggcagtcggcatcgacgggagcctttacgtcggagactttaattacattaggcgcatttttccctctcgcaacgtgaccagcatcttggagctcagaaataaggaattcaagcactctaacaaccccgcccacaaatactacctcgctgtagatcccgtgtcaggaagtctgtacgtgagcgatacgaactctcgacgtatttatcgggtcaagtcgttgtcagggacaaaggacttagcaggcaatagcgaggtcgtcgctggaaccggggagcaatgtctcccattcgacgaggctagatgcggcgatggcggtaaggctattgatgccaccctgatgtcaccgagagggattgccgtcgacaagaacgggctgatgtattttgtggatgctaccatgatccggaaagtggatcagaatggcatcataagtactctcctggggtccaacgaccttaccgcggttcggcctctgtcctgcgattcgagcatggacgtagcccaggtgagactagagtggccaacggatttggctgtgaaccccatggacaattcactttatgtactcgaaaacaacgtcattctgcgaatcaccgagaaccaccaagttagcataatcgccggacgaccgatgcattgccaggtaccaggtatcgattacagtctttcgaaactcgccattcacagcgccctagaatccgccagtgctattgcaatttcacacactggcgtcctgtacatcacagaaacagatgagaagaaaatcaaccgcctgcgacaagtgacgacaaatggcgaaatttgtcttcttgccggagcagcttcagactgcgactgtaaaaatgatgtcaattgcaactgttactcaggcgacgacgcttatgccaccgacgctatcctgaatagccctagcagcctggcagtggctccagatggcaccatttatatcgcagatttagggaacattcggatcagagcagtctcgaagaacaaacctgtactaaacgcttttaatcaatacgaggcagcttctcccggtgaacaagaactctacgttttcaacgctgatggcatacatcagtacactgtttcactagttacgggcgaatatctatacaatttcacatattcaaccgataatgacgtgactgaactaattgataataacggcaatagtctgaagatccggcgggattctagcggaatgccacggcacctcttgatgccagataaccagataatcaccctgacagttggcaccaatggcggcctgaaggttgtatcaacccaaaacctggagttaggcttaatgacatatgacggcaatacgggattgctcgcaacaaagtcggatgagaccgggtggactacattctacgattatgaccatgaggggcgactcactaacgtgactcgcccaacaggcgtcgtcacctctctgcaccgggaaatggaaaagtctatcacaatcgatattgaaaacagcaacagagatgacgacgtgacagtgataacaaatctcagttctgttgaggcttcatacacggttgtccaagaccaagttcgaaacagctatcaattgtgcaacaatgggaccctaagggtcatgtacgctaacggaatgggaatttcatttcactccgaacctcacgtgctagccgggaccattacacccacaattggcaggtgcaatatctctttgccaatggaaaatgggctgaatagtatcgagtggcggttgaggaaagagcaaatcaagggcaaagtaaccattttcggacggaagttgcgggtccatgggcgcaacctcttatctatcgactatgaccgcaacatacgcactgaaaagatttacgacgaccatagaaagttcacacttcggattatttatgatcaggtgggaagaccgttcctgtggctgccatccagtggcctggccgctgttaatgtgtcgtacttctttaacggccggctggccgggttgcagcgcggcgccatgagcgaaaggaccgatatcgacaaacaaggacggatagtgtctcggatgtttgccgatgggaaggtatggagctacagctacctagataagagtatggtcctcctgctccaatctcaacgtcagtatatctttgagtatgattcctccgatcgtcttttggcggtgactatgccatcagtcgcacgccattcaatgtcgacacacacaagtataggatacatcagaaacatttataatccacctgagagtaatgcctccgtgatttttgactactctgatgatggccgaattctgaaaacaagcttcctcgggacgggccgccaggtcttctataaatacggaaaactgtccaagttgagtgagattgtttatgactctactgcggttacatttggttacgatgagaccaccggcgtgctcaaaatggtgaacctgcagagtggtgggtttagctgcacaattcggtacaggaagataggaccattggtggacaaacaaatctatcgcttcagcgaggagggtatggtcaacgcccgcttcgactacacctaccatgacaatagtttcagaatagcatcaatcaagccagttatctcagagactccactacccgttgatttgtatcgctacgatgagatctccgggaaggtggaacacttcgggaagtttggggtcatatactatgacatcaaccagatcataaccacagcagtgatgacactgtctaagcactttgacacacacggccgtatcaaggaagtccagtatgaaatgttccgatcactgatgtattggatgactgtgcagtatgacagtatgggacgggtgatcaaacgcgagctgaaactgggaccatacgctaacaccacgaagtatacatacgactacgacggcgacggccaattacaatccgtggctgtgaacgatcgtcccacatggcgatacagttacgatctgaacggtaacttgcatttgttgaacccaggtaattccgtccggctcatgccgctccgctatgaccttcgcgacaggattacacggctcggcgacgtccagtacaaaattgatgatgacggttatctatgtcagagaggaagcgatattttcgagtacaatagcaaaggactactgacccgagcctataataaggcctcgggctggagcgtgcaataccggtacgacggagtcggtaggcgggcatcatacaagactaaccttgggcatcacctccagtatttctacagcgaccttcacaacccgacccggatcactcatgtctacaaccattctaactccgaaatcacttccctgtattacgacctgcagggtcacttattcgctatggaaagcagttctggggaagagtattacgttgcttctgacaatactgggaccccactagcggtcttttccatcaacgggttaatgatcaagcagctgcaatataccgcgtatggagaaatttattacgacagcaatcctgactttcagatggtgattggatttcatggaggattatacgacccactgacaaagcttgtgcattttacacaacgagattatgatgtcctggccggaagatggacatctcccgactatactatgtggaagaacgtgggcaaggagcctgctcctttcaacctgtatatgttcaagtccaataatccactatcttccgagctcgacctgaagaactacgttaccgatgtgaaaagttggcttgtgatgtttggattccagctgagtaatattatccctggattcccccgagctaaaatgtactttgtgcccccgccttacgaactgagcgagagccaggcctccgagaatggccagcttatcaccggggttcaacagaccacagaaaggcacaatcaggcattcatggcactcgaaggtcaggtcataacgaaaaaactgcacgcttccatcagagaaaaagcgggacactggtttgcaaccacaacaccaatcataggtaaaggtataatgttcgcaatcaaagaggggagagtgacaactggtgtttcctcaatagcatccgaagactcaaggaaggtcgcttctgtgctcaacaacgcctactatctcgacaagatgcactattccatcgaaggaaaggatactcactactttgtgaagattggtagcgccgatggtgatctggttaccttagggacaaccatcggccggaaagtactggaaagcggagttaacgtcaccgtatcccagcccaccttgctagtcaacggcaggacgcggcggttcaccaacattgagtttcagtactcaacactgctcctctccatcaggtacggactcactccagatactttagatgaggagaaggcccgcgtgctggaccaagcacgccagagagccctgggtaccgcttgggctaaggaacaacagaaggcacgcgacgggagggaaggatcaaggctgtggaccgagggcgagaagcagcaactgctaagcaccggccgtgtgcaggggtatgagggatattatgtgctccccgtggaacaataccccgagctcgccgactcttcatctaatatccaattcctccgtcagaatgaaatgggtaaacgctag

SEQ ID NO: 44126 - DNA, 8322 bp, Artificial Sequence
  Description of Artificial Sequence: Synthetic coding sequence
atggacgtgaaggaccggcggcaccggagcctgacccggggccggtgtgggaaagagtgccggtacacttcctcctccctggactccgaggactgtagggtcccaacccagaagtcctatagttccagcgaaacgttgaaggcctatgaccacgattcgagaatgcattacggtaaccgggtgaccgacctgattcaccgagaatctgatgagttcccccggcaaggtacaaatttcaccctggccgaactgggcatctgtgaaccgtctccccaccgttccggctattgctcagacatgggaattctgcatcaggggtactccctgagcactggaagtgatgcagacagtgacactgaaggaggcatgtcaccggagcacgccataagactatggggtcgtggcatcaagtcgagacgatcatctgggctgtcaagtagggagaatagtgccctgacacttacggattccgacaatgaaaataaatcagacgatgaaaacggccgtcccatccctcctacaagtagcccatcgctcttgcctagtgcacaactgcctagtagtcataaccctcctcctgtctcctgccagatgcctctattggatagcaatacatcacaccagatcatggatacaaacccagacgaggaattttccccgaactcctatctgcttcgagcctgtagcggtcctcagcaggcatcctcttcagggcccccaaatcaccactcccagagtactctccgcccacccctgccgccaccccacaaccacacactgtcacatcaccacagtagcgcaaacagcctaaatcggaactccctcactaatcgaaggtcacagatacacgctcccgctcccgctccgaatgacctcgctacaaccccggaatcagtgcaactgcaagatagttgggtgctgaacagcaacgtccccctggagactcggcactttctattcaaaacatcatcagggagtacgcctttgttctcgtcgagtagccctggctatcctcttacttcagggaccgtctacacaccaccccccagacttctcccaaggaatacattttcccgcaaagcttttaaattaaaaaagcctagcaaatactgtagctggaagtgcgccgcactgtctgccatcgctgccgctttactccttgctattcttttggcctactttatcgccatgcatcttctagggctcaactggcagctccagcccgcagacgggcacacgttcaacaacgggattcgtaccgggctgcccggaaatgatgacgtggctaccatgccttcaggcggcaaagttccctggtcattaaaaaatagctccatcgactctggagaggccgaggtgggtcgccgagtaacccaagaggtgccacctggggttttttggcgatcgcagatccacatctcccagccacaattcctcaagtttaatatttctttgggaaaggatgcactatttggggtttatattaggcgcggcctgccccctagtcatgcccagtacgattttatggaaagactggacggtaaagagaagtggtccgttgtggagagccctcgggaaaggcgctccatccaaacgctggttcagaatgaggcggtatttgtccagtatcttgatgtgggactttggcatttagccttttacaatgacggcaaagacaaagagatggtgagctttaatactgtggtgctagacagcgtgcaggactgcccccggaattgtcatgggaatggcgaatgtgtgagcggcgtgtgtcattgctttcccggctttcttggcgcggactgcgccaaggcagcctgccctgttctctgtagcggtaatggccagtattcgaaggggacatgccagtgctactcaggatggaaaggagcggagtgtgacgtccccatgaaccaatgcatcgacccatcgtgtgggggccatggaagctgtatcgatggtaactgcgtttgtagtgccggatataagggtgagcactgcgaggaagtcgattgcctcgatccaacatgctccagccatggagtttgcgtcaatggtgagtgcctgtgctcacccggatggggtggactgaactgtgagctcgcccgcgtgcagtgtcccgaccagtgctcgggccacgggacatatctgcctgatacaggcctgtgttcctgcgatcccaactggatgggcccagattgctccgtggaagtttgttccgtagattgtgggactcacggggtgtgtattggtggagcttgtcgctgcgaagaaggatggacaggggccgcctgcgaccaaagggtgtgtcaccctcgatgcattgagcacggaacatgcaaagacgggaagtgtgagtgcagggaaggatggaatggagagcactgcaccattgtccgtgaaaccattgggggtgagtgctacggttgccccgacctctgtaatgggaatgggagatgcactttgggacagaattcttggcagtgtgtgtgccagactggatggagggggcccggctgcaatgtggcaatggaaacatcctgcgccgataataaggataatgaaggtgacgggctggttgactgcctcgacccagactgctgccttcaatctgcctgtcaaaactcgttattgtgtcgcggaagtagggaccctttagatattatccagcagggccagactgattggccagccgtaaagtccttttatgatcgaataaagctcttggccggaaaagatagtacccacataattcccggagaaaacccattcaatagctcgctcgtctccctgatacggggccaggttgtgacaactgacggaacccccctggtcggcgtcaacgtaagctttgtgaagtaccctaaatatggctacactatcacccgtcaggacggcaccttcgacctgatcgccaacgggggggccagtcttactctgcactttgaaagggcgccgttcatgtcacaggagcggaccgtttggctgccatggaatagcttctatgcaatggacacactggtgatgaaaactgaggaaaacagcatcccttcctgcgacctctcaggatttgtgcgaccagatcctatcataatcagctctccactgtctacattcttctccgcagccccaggacagaaccccatagtgccggagacgcaagtgctgcacgaagagatagagcttccagggagcaacgtcaagctcaggtacctatcctcccgcacggctggctacaagtccctgctgaagattactatgacacagtccacggttccgttaaacctgatacgtgtccacttgatggtcgcagtggagggccaccttttccaaaagagcttccaggcgagcccaaacttagcctatacctttatttgggataagaccgacgcctacggtcagcgggtctacggattgtccgacgctgtggtgagtgtcggattcgaatacgaaacatgcccatctttgatcctctgggagaagcgaacagcgctactacagggatttgagctggatcccagcaatttgggaggatggagcctggacaaacaccacatcctaaatgtgaaaagcggcatcctgcataaggggacaggcgaaaatcagttccttacacagcagccagcaatcataacatcaatcatggggaacggccgcaggcggagcattagttgtccatcctgtaatggtcttgctgagggtaacaaacttctggctcccgtggctctcgccgtcggcattgatgggagcctttacgtcggggatttcaattatatccgacgtatctttccatccagaaatgtgacatccatcctcgagcttagaaataaggaatttcacaataataaccctgcgcataaatattacctggcagtggaccccgtctctgggagcctttatgtctccgacacgaatagtcggagaatttatcgggtaaagtccttgtccggcactaaagacctcgcgggaaactccgaagtggtggccgggacaggcgagcagtgtctgccttttgatgaggcaagatgcggcgacggaggaaaggccatcgatgccacactgatgagcccccggggtatcgctgtcgataaaaacggactgatgtattttgtggacgctaccatgatcagaaaggtagaccagaacggtattataagtacactgcttgggagcaatgacctgacagcagtgcgacccctcagctgcgattcgagtatggatgtcgcccaggtgaggctggagtggccgactgatctcgcagtgaatcccatggataattcattgtacgtgcttgaaaataatgtgattctcaggatcacagaaaatcatcaggtgtctattatcgccggacgcccaatgcactgccaggttccaggcattgattattcactcagcaaactggccatccacagcgccctggagagcgcctccgccatagctatctcacacacaggggtcctttatatcacagagaccgacgagaagaagatcaatagattgagacaggtaaccactaacggggagatctgtctgttggccggggccgcgtctgactgcgactgcaaaaatgatgtgaattgtaattgctattccggcgatgacgcatatgccacagacgctatcttaaactcaccaagctctctggccgtggcacctgatggcacaatttacatcgctgatcttggaaatattcggattagagccgtctccaaaaataagcccgtcctgaatgctttcaaccagtatgaagctgcttcacctggcgagcaggagttatacgtgtttaatgccgacgggatccaccagtacaccgtgagcctggtcaccggggagtatctctacaacttcacttatagtaccgataatgacgtcactgagctcattgataataatggcaattcactcaagattagacgagacagttccggaatgcccaggcacttgctgatgccagacaatcaaatcatcactctgaccgtcggtaccaacggagggctaaaggtggtgagcactcagaacttagagcttgggctgatgacttatgacggaaatactggcctcctcgctactaagtcagacgagaccgggtggacaactttttacgattacgaccacgagggtagacttaccaatgtgactcgacccactggcgtcgtaacatccctgcaccgagaaatggagaagtccatcaccatagatatcgagaactcaaaccgggacgatgacgtgacggtcatcacaaatctgtccagcgtggaggcttcatataccgtggtacaggatcaggtaaggaattcctaccagctctgcaacaacggcactttgagggtcatgtacgccaatggaatggggatcagcttccacagtgaaccgcatgtccttgccggaaccatcacaccgacgattgggagatgcaacattagcctccctatggagaacgggttaaattccatcgaatggcgtctcagaaaggaacagattaaggggaaggtgactattttcggccggaaactacgagtccacggccgcaaccttttgagtatcgattatgacagaaatatccgtaccgagaagatttacgatgaccaccgcaagttcaccctgcgcatcatttacgaccaggtcgggaggccttttctgtggctgcctagttctggcttagcagctgtgaatgtttcctatttctttaacgggcggttggccggactccagcgcggagccatgagcgaacgaaccgacatcgacaaacaggggagaatagtttcgcggatgtttgccgacgggaaagtgtggtcatacagctatctcgacaagagcatggtactgctgctgcagtctcagagacagtatatcttcgagtacgactcttctgatcgccttttggctgttacaatgccgtctgtagcaaggcattcaatgagtactcacacttctattggctacatcagaaacatctataatccaccggaatcgaatgcttccgtgattttcgactactcggacgacgggcggatcctgaaaacgtcttttctgggaacaggccgtcaggttttttacaaatacggaaaactgtccaaattaagtgagattgtatacgattcaacagcagtcacatttggatacgacgaaaccaccggcgtgctaaagatggtcaatcttcagtctgggggtttcagctgcactattcgctatcgcaaaatagggcccttagtggataagcagatttatcgcttctcagaggaggggatggtcaatgcccgctttgactacacttatcatgacaattccttccgtattgcctcaatcaagcccgtgatcagcgaaacacctctcccagtggacctctatcggtacgacgagatctcaggcaaagtggaacatttcggcaagttcggtgttatttattatgatattaatcaaatcattacaaccgcggtgatgaccctatctaaacattttgacacccacgggagaatcaaagaggtccaatacgagatgttccgttccctcatgtactggatgacagtccagtacgacagtatgggaagagtgatcaagagagagctgaagctaggcccctacgctaatactaccaaatacacatatgactacgacggggacggccaacttcagtctgtcgctgtgaacgatagacctacctggcgctactcttatgacctgaacgggaaccttcatctgctgaaccctggtaatagcgtgcgcctgatgcctctccggtacgacttacgggaccgcatcacgcggctgggagacgtgcagtacaagattgacgatgatggctatctgtgccagcggggttctgacattttcgaatacaactccaagggactcttgaccagagcatataacaaggcatcaggctggtcagtacagtatcgttacgacggcgtcggcaggagagcctcttacaaaaccaatctagggcaccatctccagtacttctatagcgacctccacaaccctacacggatcactcatgtctataaccactccaattccgaaatcactagcctatactacgatctccaagggcacctgttcgctatggagtctagtagtggggaagaatactacgttgcttctgataatacaggaacccccctcgccgtgttttctattaatggtctgatgattaagcagctgcaatacacggcatatggggaaatctattacgattctaatcccgatttccagatggtgattggattccacggcggcctttacgaccccctgaccaagctggtccacttcacacagcgtgactatgacgtcctcgcaggcagatggactagtccggactacacaatgtggaagaacgtcggcaaggagcctgcaccttttaacctctacatgtttaagtccaataatcccctgtcatccgagctggacttgaagaattatgtgacggatgtgaagagttggctggtcatgtttggcttccaattgagtaatataattccgggtttcccacgggctaagatgtatttcgtgccacctccttacgaactgagcgagtcccaggccagtgagaacggacagctcatcaccggtgtccagcagactaccgagaggcacaatcaggcgtttatggcattggagggccaggtgatcactaagaaattgcatgccagcataagagaaaaggccggacactggtttgctaccacaacaccaattattggaaagggcattatgtttgcaatcaaagaggggagggtgaccacaggcgtatcctcgatcgcaagcgaagatagccggaaagtggctagcgtgctcaacaatgcttactacctggataaaatgcactattccatcgaggggaaggacactcactactttgtcaagatcggatctgcagacggagatctggtaaccttaggtacaacaattgggaggaaagttctcgagagcggcgtcaatgtgaccgtaagccagcctacactgcttgtgaatgggcgaaccagaagattcaccaacatcgagttccagtactctacacttctgctgagtatacgttatggactgacccctgacaccctggacgaggagaaggcccgggtgctagaccaggcacggcagcgtgccttgggcaccgcatgggccaaagagcaacagaaggcaagggacggccgggagggttcacgcctgtggaccgagggagaaaaacagcagctcttatctacggggagagttcagggttatgaaggctactatgtactgccagtggagcagtaccccgagctggccgactctagctctaacattcagtttcttcgacagaacgagatgggcaagcggtag

SEQ ID NO: 44127 - DNA, 8100 bp, Artificial Sequence
  Description of Artificial Sequence: Synthetic coding sequence
atggacgtgaaggagcggcggccctactgcagcctgaccaagagcagacgggagaaagagaggaggtatacaaattcctctgctgataatgaagaatgccgcgtgccaactcagaagtcttatagtagctctgaaactctcaaagcctttgatcacgatagctcgcgactgctgtacgggaaccgagttaaggatctggtgcatagggaagcggatgaattcactaggcagggacaaaacttcacgctgagacaactgggagtgtgcgagccggccacccgcaggggactcgccttctgcgccgagatgggtctcccccataggggatattccattagtgccgggtctgacgccgacacagaaaacgaggcagtgatgtcacccgagcacgccatgcgactgtggggccggggcgtcaaaagcggccggtcatcctgtctgagttcacgatccaactctgcgctgacacttacagacacagagcatgagaacaaaagcgattctgaaaacgaacaaccagcgagcaaccaggggcagtctactttgcaacccctgccaccttcacacaagcaacattccgcacagcaccacccaagcattacatctctcaatcggaactccttaaccaaccggaggaaccagagccctgcaccgcctgcggccctcccggcagagctccagaccactcctgaatccgtgcagctccaggacagctgggtgttgggatctaatgtgcccctcgagtctcggcactttctgttcaagactggcactggcacgaccccattgtttagtacggccacccccggctatactatggcttctggatccgtttacagcccacctactagacccctgccaagaaataccctgtcacgttctgcctttaaatttaagaaatcaagtaaatattgcagctggaaatgtactgccctctgtgcagtgggggtgtccgtgcttctggctatcctcctctcctattttatagccatgcatctattcggattgaattggcagctacaacagactgagaatgacacattcgagaatggcaaagtgaattcggatactatgcccaccaacaccgtgtctctgccctccggggacaatggaaagctagggggcttcactcaagagaacaacacaatcgacagcggtgaacttgacatcgggagaagagcaatccaagagatcccaccagggatattttggagaagccagctttttatcgaccaaccccagtttttgaaattcaatatctctctgcagaaggacgctctgattggggtgtacggccgtaaaggtttgcccccatctcacacccagtacgatttcgttgagctactcgatgggtctagacttatcgcccgagaacaaaggtcactgctggaaacggagagagccggacgccaggcacgctccgtctccctgcatgaggccgggtttatccagtacttggacagtggcatctggcatctggccttctacaatgatggaaagaacgccgaacaagtgtccttcaataccatcgtgatcgagagtgtggttgaatgccctagaaactgccacggaaatggggaatgcgtctcgggaacctgccactgcttccccggcttcctaggtcctgactgctccagggccgcctgtcccgttctgtgctccggaaacggccaatattcgaagggacggtgcctgtgcttcagcggatggaagggcaccgagtgcgacgtgcccacaactcagtgcatcgaccctcagtgtggcggacggggaatttgcattatggggtcgtgcgcctgcaactcagggtataagggtgagagctgtgaagaagcagattgcattgatccaggatgttcaaatcacggcgtgtgtattcacggagagtgccattgcagtcccgggtggggcgggtcaaactgtgagatccttaagaccatgtgccccgaccagtgctctggacatgggacctatctccaggaaagcggaagctgtacctgtgacccaaattggactggaccagattgctcaaatgaaatttgtagcgttgactgtgggagtcacggtgtgtgcatgggcggtacttgcagatgtgaggagggatggaccggcccagcatgtaaccaaagagcctgtcatccaagatgcgctgagcacggcacgtgtaaggatggaaagtgtgagtgcagccaaggatggaatggggaacactgtactatcgaagggtgtcccgggctctgtaactccaacggtcgctgtacacttgatcagaatggatggcactgcgtttgtcagccaggatggcgcggcgctggctgtgacgtggccatggaaacattgtgcaccgactctaaagataatgaaggcgatggactcatcgactgcatggacccagactgctgcctgcagtcatcctgccagaaccagccatattgcagagggttgccagacccacaggatatcatctcccagagtttgcaatccccttcacagcaggctgccaaaagcttttatgaccgtataagctttttaataggcagcgactctactcatgttattccaggcgagtcaccgtttaataagagcctcgcgagtgtcattcgcggacaggtcttgaccgctgatgggaccccactcattggcgtcaacgtcagcttttttcactatccagagtacggttacactattactcgccaggacggaatgttcgacctagtagccaacgggggcgcatcactgaccctagtttttgagcgcagtcccttcctcacccagtaccatacagtctggattccgtggaatgttttctatgtgatggacaccctcgtaatgaaaaaagaggaaaatgacataccaagctgtgatttatccggcttcgtgagacctaatcccatcatcgtaagtagtcccctgtccacgtttttccgctcatctcccgaggactcccccataatccctgaaactcaagtgttgcacgaggagaccaccatcccaggtacagatctgaaacttagctatctgagttcacgcgccgccggctataagagcgtgctgaaaattaccatgacacagagtattattccttttaatctgatgaaagtgcatctcatggttgctgttgtcggtagattatttcagaaatggttccccgcatctccgaatcttgcatatactttcatctgggataaaaccgacgcatataaccagaaagtgtacggcctaagtgaagcagttgtgagcgtcggctacgaatatgagagctgtctcgatttaactctgtgggaaaagagaacagctatcctgcagggctacgaattggacgcgtcaaacatgggcggttggacactggataagcaccacgtgcttgatgtacagaatggaattttgtacaagggaaacggggaaaaccagtttatatcccagcagccaccagtggtctccagcatcatgggaaatggtcggaggcgcagtattagctgccctagctgtaacgggcaggcagacgggaacaaactgctggctcctgtggcactggcatgtggaatcgatggatcactgtacgttggggatttcaattatgtacgcagaatcttcccatccggtaatgtcacttcagttctcgagctgtccagcaatcccgcacaccgctattacctcgccacggacccggtgacaggcgatctgtatgtgtccgatacgaatacgcggaggatttatcgccccaagtcgctgacaggggcgaaggatttaaccaaaaacgctgaagtcgttgcgggcactggtgaacaatgtctgccctttgacgaagcaagatgcggtgacggcggaaaagcagtggaggctactttaatgagtcccaagggcatggcagtcgacaagaatggcctgatctattttgtagatggcaccatgatacgtaaggttgatcagaatggcatcatttctactcttttgggttctaacgatctaacgtccgcgagacccctcacatgtgatacgagcatgcacatcagccaggttcggctcgaatggcccactgaccttgcaatcaatccaatggacaactcaatatacgtgctggacaacaatgtggtactgcagataaccgaaaatcgccaagtccgcatagcagcgggaagaccaatgcactgccaggtgcctggtgtcgagtatcctgtcggcaagcatgctgtacagaccacattggagtccgcgacagctatcgcggtctcatactcaggtgtgctatacatcacagaaactgatgaaaagaagatcaacagaattaggcaggtgacaaccgacggtgagattagtctagtggcgggcatcccctccgagtgcgactgcaagaatgacgctaactgcgactgctaccagagtggcgatggatatgcgaaagacgcgaaactttccgcaccttccagtctggcagccagcccagatgggaccctctatattgcggatcttggaaatattcgtatacgcgctgtctcgaagaataaacccctgctgaattctatgaacttctacgaagtagccagccctacggaccaggaattatacatcttcgatatcaatggcacgcatcagtacacagtgagtctggtgaccggagactatctgtataacttctcatatagcaacgataacgacataactgccgtcacagacagcaatggcaacaccctgcgcatccgcagagatcccaacaggatgccagttcgagtggtttctcccgacaatcaagtaatctggctcactatcggaaccaacggatgcttaaaatccatgaccgctcagggactggagctcgtgctgtttacctatcatggcaactccggcttattggccacgaaatcggacgagactggctggactacattcttcgactacgactccgaagggcgactgaccaatgtaacttttccgactggggtggtgactaatctgcatggtgacatggacaaggccataacagtcgatattgaatcaagtagcagagaggaagatgtgagcattacgagcaacctctctagtattgatagcttctatactatggtgcaggaccagttgcgtaatagctatcagatcggctatgacggaagcttgcgcattatatacgcgtctggactagactcccactaccagactgagcctcacgttctggccgggacagctaaccccacggtggccaagaggaatatgaccctgcccggcgaaaatggccagaatcttgtcgagtggcggttcagaaaagaacaggcccaagggaaggtcaatgtgttcggaagaaagctacgggtgaacggcagaaacttactttccgtagacttcgatcggactactaaaaccgagaaaatatacgatgaccatcgaaaatttctcctgaggatcgcttacgacacatcaggtcatcctacgctctggctcccatcaagcaaactcatggctgtgaacgttacctatagctccacaggtcaaatagcaagcatccagcgggggaccacgagtgaaaaggtggactacgatggacaggggcgaattgtgagcagagtatttgccgacggtaagacttggagttacacatatctggagaaatcaatggtgctgctgctacacagtcagcgtcagtatatattcgaatatgatatgtgggaccgtctgtcagcaattaccatgccaagtgtggcccgccataccatgcagaccattagaagcattgggtattacaggaacatatataatccccctgaaagcaacgcaagcattatcaccgactacaatgaggagggattgttgctgcaaacagcatttcttggaacctctcgtagggttctgttcaagtacaggagacagacccggctgtcggaaatcctgtatgactcgactagagtctcctttacgtatgatgagacagcaggtgttcttaagaccgttaaccttcaatctgacggatttatctgtaccatccgatacaggcagattggacccttaattgataggcagattttcagattttccgaagatggcatggttaatgcccggtttgactacagttacgataattcatttcgcgtgacctctatgcagggcgtcattaacgagacgccacttcccatcgacctatatcagtttgatgacatttccgggaaagtggagcagttcgggaagtttggagtgatttattacgatattaatcaaattatttccacagccgtcatgacgtacaccaaacacttcgacgctcatggccgcattaaggagattcagtatgagattttccggtccctcatgtattggattaccatacagtacgacaacatgggtcgggtcactaagcgggagatcaaaattggcccatttgctaatactaccaaatacgcttacgagtacgacgtggacgggcagctgcagacagtgtacctgaatgaaaagataatgtggcgatacaattacgacttgaacggaaacctccatcttttgaatccttccaactctgcccggctgacacctctgcgttacgatctgcgagatcggatcacaaggctaggggacgtgcaatatagactggatgaggatggttttctcaggcagagggggaccgagatcttcgagtacagctctaaagggctgttgactagagtgtactcaaagggcagcgggtggacagtaatctacagatatgacggccttggaaggcgtgtctcttcaaagacctcgctggggcagcacctgcaattcttctatgccgacctgacatatcccacccggatcacacatgtgtacaaccattcatcaagtgagattacatccctgtactacgacctgcagggccatctattcgcgatggagatatccagcggcgatgagttctatatagcgagcgataatacaggcaccccactggccgtgttcagcagtaacggtctcatgctcaagcaaatccagtataccgcctatggagaaatttattttgactccaatattgactttcagctggtcataggcttccatggggggttatacgaccctcttactaaactgatacatttcggcgaaagggattacgacattctagcagggcggtggacaactccagatatcgaaatctggaagaggatagggaaagaccccgctcctttcaatctctatatgtttcggaataataatccagcatccaaaattcacgatgtgaaagattacattacagacgtaaatagctggttggtgacctttggattccatttgcacaacgccatccctgggttcccggttcctaagttcgatctgacggagccttcctatgagctggtgaaaagccaacagtgggacgacattccccctatttttggtgtgcagcagcaggtggctaggcaagccaaggcattcctgtcccttggtaaaatggcagaggtacaggtgagcaggcgcagagctgggggcgcacagagctggctctggttcgcaacagtgaaaagccttatcggaaagggcgtgatgcttgccgtgagtcagggaagagttcagaccaacgtgctgaacatcgctaacgaggactgtatcaaggtcgcagccgtgttaaataacgcgttttacttggagaacttgcatttcactatcgaaggcaaagacactcactactttatcaagaccacaactcccgagtccgatctaggaactctgcggctcacatcaggccggaaggccctcgaaaatggaatcaatgtgacggtctcccagtctaccacagtcgttaacggtcgcaccaggaggtttgctgacgtggaaatgcagttcggtgccctggccctgcacgtgcgatacggaatgacgctggacgaggaaaaggcacgtatcctcgaacaagccaggcaacgtgccctggccagggcctgggcacgagagcagcagagagtgcgtgacggcgaagagggcgccagactgtggactgagggcgagaaaagacagctgctgtcagcaggaaaagtccaagggtatgacgggtactatgtgctgtcagtggaacagtaccccgagctggccgacagcgctaataacattcagttcttgcgccagtccgaaatcggacgacgctag

SEQ ID NO: 44128 - DNA, 8100 bp, Artificial Sequence
  Description of Artificial Sequence: Synthetic coding sequence
atggacgtgaaggagcggcggccctactgcagcctgaccaagagccgtagggagaaagagcgccgatacacgaactccagtgccgataatgaagaatgtcgggtgccgacgcaaaagtcttactctagtagtgagactctgaaggcattcgaccatgacagttcaagactgctctatgggaatagagtgaaagaccttgttcacagagaagcggatgagttcacacggcaaggacaaaacttcactttaaggcagctgggagtgtgtgaacctgcaactaggaggggcctggcattttgcgctgaaatggggcttccacacagaggctactccataagcgccggaagcgacgccgacacggaaaacgaagctgtgatgtctcccgaacatgccatgagactgtggggccgcggcgttaaatcaggcagaagttcttgcttgagcagccgcagcaattccgccctcaccctgacggacacggagcacgaaaataaaagcgattccgagaacgagcagcccgcctcaaaccagggccagtctaccctccagccactgccaccatcacacaagcagcactcggcccagcaccatccaagtattacctcactgaatcgcaactccctcactaaccggaggaaccaatctccagccccaccagcagctcttcctgccgaactgcaaacgaccccagaaagcgtccagctgcaggacagctgggtcctcggcagtaacgtccccttagaatctaggcacttcttattcaaaaccggcacgggcacaacaccattgttctcaacagccacacccggctatacgatggcatccgggtcagtgtactctccccctacaaggccactgcctcggaacaccttaagcaggagtgctttcaaattcaagaagagcagcaaatattgtagctggaaatgcaccgctttgtgtgccgtgggcgtatccgtgcttctcgctatcctcctgagttattttatcgccatgcatctattcggacttaattggcaactgcagcaaactgagaacgacaccttcgaaaacgggaaagtgaacagcgacacaatgccaaccaatacagtcagcctcccttctggagacaacggaaagctggggggctttacccaggaaaataacactatagatagcggcgagctggacatcggaagaagggccatccaagaaataccccctggaattttctggcgctctcagctattcattgaccagccgcaattcctgaaatttaacattagccttcaaaaagatgcattaattggagtttatggaaggaaaggcctcccccccagccacacccaatacgactttgtggaattgctagatggaagtagactaattgccagggaacagcgctccctgctggaaactgagcgcgcaggtcgacaggcaagatcagtgagccttcatgaggcggggtttatccagtacctcgactccggcatttggcaccttgcattctataatgacggcaagaacgcagaacaggtaagttttaacactatcgtgattgagagcgtggtagagtgccctcgcaactgccatggaaatggggaatgtgtgtccgggacctgtcactgcttcccaggctttcttggaccggattgctcacgtgccgcttgtcccgtgctatgctctggcaatggacagtactcaaagggccgctgcctgtgtttcagcggctggaaggggacagaatgcgacgttccaactactcaatgtatagatccgcaatgcggtgggaggggaatctgcattatgggttcctgtgcctgcaatagcggctataagggcgagtcatgcgaagaggccgactgtatcgatcccggctgtagcaaccacggcgtctgtatacatggcgagtgccactgcagccccggctggggaggatcaaactgtgaaattctgaaaaccatgtgcccagaccagtgctctgggcacggaacatatctccaagagagcgggtcctgcacctgtgatcccaattggacaggaccggattgtagtaacgaaatttgttctgtagattgcgggtcccacggggtgtgcatggggggtacatgcagatgtgaagaagggtggaccggcccagcgtgcaaccagcgtgcttgtcatccccggtgcgcggaacacggtacgtgtaaggatgggaaatgtgaatgctctcagggatggaacggagagcactgtacaatcgaggggtgccctgggctgtgtaacagcaatgggcgctgcactctggaccaaaatggatggcactgtgtgtgtcagcccgggtggcgcggagccggctgtgatgtagccatggagacactctgtacagactccaaggacaatgaaggcgacggacttattgactgtatggaccccgactgttgtctgcagtctagttgtcaaaatcaaccttactgtcgcggccttcctgatcctcaggatattatcagccagagcctgcagtccccatcacaacaagccgccaagtcattctacgataggataagtttcctgattgggagtgatagtacccatgtgattcctggcgaatctccattcaacaagagcttagcatcagtcatccggggtcaggttctgactgccgacggtactccactgattggagttaatgtgtccttctttcactatccggagtacggctataccattacccggcaggacggtatgttcgatctggtggccaacggcggtgcatctcttacactcgtctttgaaagatcgcccttcctcacacagtaccacaccgtgtggattccctggaacgtgttctatgtgatggacacactggtgatgaagaaggaggaaaatgacatcccttcctgtgacttatctggctttgtgcgccctaatcccataattgtatcatcacctctgtcaaccttttttcggtcctcccccgaggattcccccattatccccgaaactcaggtgctccacgaggaaaccacaatccccggaacggacctgaaactttcatatcttagttcacgcgctgccggctataagtctgttcttaaaatcacgatgacacaatctatcattcccttcaatcttatgaaagtgcacctcatggtggcggttgtcggaaggttgtttcagaagtggtttcccgcatccccaaacctggcatatactttcatctgggacaaaacagacgcctacaatcagaaggtgtatggcctgtctgaagctgtagtgtctgtcggctatgaatacgagagctgccttgacttgaccctgtgggaaaagcgtaccgccatcctccagggatacgagctggacgcatctaacatgggaggctggacactcgacaaacatcatgtgttagacgtgcaaaacgggattttgtacaaaggaaacggagaaaaccaatttatttcacagcagccccctgtagtctccagcataatggggaatggacggcggagatctatttcatgcccatcgtgcaacggccaggctgacggcaacaagctcctggcccctgtggcacttgcctgtggcatcgacggaagtctctacgtgggagattttaattacgtccgaagaatctttccttctggaaacgtcacttctgtcttggaactctcatcgaaccccgctcaccgctattacttggctaccgaccccgtgaccggtgacctgtacgtcagtgatactaacacaaggaggatctaccgtcctaaaagtttaaccggcgctaaggacctgaccaagaatgcggaggtcgtcgcaggaaccggcgagcagtgcctcccattcgatgaagcccgttgcggagacggggggaaggccgttgaagccacactcatgtccccaaagggcatggcagtagacaaaaacggcctcatctacttcgttgatgggaccatgattaggaaagttgatcagaacggcatcatttcgaccctgcttgggagcaatgatctcacaagtgctcgaccacttacgtgtgacacttcgatgcatatttcgcaggtgaggcttgagtggcctactgatctggcaatcaaccccatggataattcaatttacgtgctcgacaacaacgttgtgttacagatcaccgaaaataggcaagtgagaatcgccgcagggcgacccatgcactgtcaggtccccggcgtggagtatccagtgggaaaacatgctgttcagaccactctggaatcagcaactgcaatagctgtgtcctattccggtgttctctatatcactgagaccgacgagaaaaaaattaatcgaatcaggcaggtgacgacggatggcgagatcagtctagtggccggaatcccttccgaatgcgattgcaaaaatgacgccaactgcgactgctatcagagtggggatgggtatgccaaggatgcgaaattgtcagcaccttccagcctcgccgccagtccagatggcacgctttatattgccgacctgggtaatatcagaattcgcgctgtgtccaaaaacaagcctcttctaaatagcatgaatttctacgaggtcgcctcacccacagaccaggagttgtatatcttcgacatcaatggcacgcatcagtacaccgtcagtctggtgacaggcgactacctgtataacttttcttactctaatgataatgatattaccgccgtgaccgattccaatgggaataccctgcggatccggagagatcctaataggatgcccgttagggtggtcagcccagacaatcaagtcatctggttgacgattggaaccaatgggtgtttaaaatccatgacagcccaaggcctggaactcgtgttatttacataccatgggaacagcgggttgctggccactaaaagcgacgaaaccggctggacaacgttcttcgactacgactctgaaggacggctcacaaatgtcacttttccaacaggagtggttaccaatctgcatggggatatggacaaggcgatcaccgtggacatagaaagctcgtcacgggaagaggatgtgtctataaccagtaatctgagcagtattgacagtttttatacgatggtgcaggatcagcttagaaatagctaccagattggttatgacggctccctccgcattatctacgcatctggactcgacagtcactatcaaacggaaccccatgtcctggcaggcactgcgaatcctaccgtggctaagcggaatatgacactgccaggtgagaatggccagaatcttgtcgaatggcggttccggaaagaacaggctcagggcaaggtgaatgtatttggtcgcaagctgcgggtgaacgggcgtaacttgttgagtgttgatttcgacagaactacaaaaacggagaagatttacgatgaccaccgaaagttcttacttagaatagcttacgatacatccggccacccaacactatggctgcccagctccaagctgatggctgtaaacgtgacatattctagcactggacaaatcgccagcatccagaggggtacgactagtgagaaggtggactatgatgggcaagggaggattgttagcagggtattcgcagacgggaaaacatggtcctacacgtacctcgaaaagtctatggtgttactgctgcactcgcagcgccagtacatattcgaatatgatatgtgggatcgcctctctgctatcacaatgccctcagttgctagacataccatgcagactattagatctattggttattataggaacatctacaaccctccggagtctaacgcatcaattatcaccgactataatgaagaaggcctgctgctgcaaaccgccttcttggggacctcccgacgtgtgctgttcaaatacaggagacagactagactgagcgagattttgtacgatagtaccagggtgtccttcacttatgatgagaccgcaggagtgctcaagaccgtgaacttacagtcggatggttttatctgtactattcgatacaggcagataggcccactcatcgatcgccagatctttagatttagcgaggacgggatggtgaacgcaaggttcgactactcctacgacaattcattcagggttacgtctatgcaaggcgtcatcaacgagacacccctcccaattgatctctaccaatttgatgacatttccgggaaggtagagcagtttggaaaattcggggtcatctattacgacatcaaccagatcatatctactgcagtgatgacctatactaaacacttcgacgctcacggaagaatcaaagaaatacagtatgagattttccggtctttgatgtactggatcacaattcaatatgacaacatgggacgcgtgacaaagcgcgaaattaaaatcgggccgttcgccaatactacaaaatatgcttacgaatatgacgtggatggacagcttcaaacagtctacctcaatgagaaaattatgtggcgctacaactatgatttaaacggtaatctccacctgctgaacccttcgaattcggctcggctaacacctctgcgctacgatctacgtgacaggattactcggctgggggacgtgcagtatcgtctcgatgaggatggctttcttagacagcgcgggactgaaatattcgagtatagctccaagggtttgctgactcgcgtctacagcaaggggagcggttggacagtcatttaccgttacgacggcctgggccgccgcgtatcaagcaaaacttctctgggccaacacctgcaattcttctacgcagatctgacctatcccacacgcatcacccacgtctacaaccactcctctagtgagattacgtccctgtactatgacttgcagggacacctatttgcaatggagatctctagcggtgacgagttttacattgcttccgacaacacgggtacacccctggcagtgttctcatcaaatggtctcatgttgaagcagattcaatataccgcctatggagagatctattttgattctaatatcgatttccagttagtgatcggttttcacggtggtctgtacgatccccttaccaagctcatccattttggtgaaagagactatgatatcctggcagggcgctggacaactcccgatatcgagatctggaaaagaattggcaaagatcccgccccattcaatctttacatgttcagaaataataatccggcatctaaaattcatgatgtcaaagactatatcaccgatgtaaacagttggcttgtgacctttggttttcatttacacaacgccattcctgggtttccagttcccaaattcgacctgaccgagcctagctacgaacttgtgaagtctcagcagtgggatgacataccacccatcttcggggtgcagcaacaggtcgccaggcaagctaaggcatttctgagtctcggcaaaatggcagaagtgcaggtctctcgtagaagagccggaggtgcccagtcttggctttggtttgcaacggtaaagtctctgattggcaagggagtgatgctcgcagtaagtcagggacgtgttcagaccaacgttttaaacatcgccaacgaagattgcattaaagtggccgcagtgcttaataacgccttctacctcgaaaatctgcacttcacaatcgagggcaaagatacccattactttattaagaccaccacacctgaatccgacctcgggaccctgaggcttacatctggccgtaaggcactggagaacggcattaacgtcaccgtctcccagagcaccacagtggtgaacggaaggacccgacggttcgcggacgtggagatgcagttcggagctctcgcacttcacgtgagatacggtatgacactggatgaggaaaaggcacggatcctcgagcaggctcgtcagcgcgcactggctagagcctgggcacgtgagcagcaaagagtccgcgatggagaagagggcgctcgcctttggaccgaaggagaaaagcgccagctcctttccgccgggaaagtccaggggtacgatggctactacgtgttgtccgtggagcaatatcccgaacttgctgacagcgccaataatattcagtttctgaggcagtccgagatcggcagacggtag

SEQ ID NO: 44129 - DNA, 513 bp, Artificial Sequence
  Description of Artificial Sequence: Synthetic coding sequence
atggacgtgaaggagcggcggccctactgcagcctgaccaagagcagaagagaaaaagagcgacgatacactaatagctcagccgataacgaagagtgccgagtccctacccaaaaaagctacagcagttccgagacgcttaaggcctttgaccatgacagttcaagactgctgtacggtaaccgggtgaaggacctggtccaccgggaggccgacgagtttacccggcagggccagaactttacactgagacaattaggcgtttgcgaacccgccacacggcgtggcttggcattctgtgccgagatgggcttgccacaccgtggttactccatttctgccgggagcgatgccgatactgagaatgaagccgtgatgagtccagaacacgctatgcggctgtggggtcgaggagtcaaatccggcagatcttcctgtctcagcagccgtagtaatagcgcactgactctgacggacacggagcatgagaacaaaagtgatagtgagaattag

SEQ ID NO: 44130 - DNA, 981 bp, Artificial Sequence
  Description of Artificial Sequence: Synthetic coding sequence
atgtgccccctgaccctgcaggtgaccggcctgatgaacgtgagcgaacctaattccagctttgcattcgtgaatgagttcatcctgcagggcttcacatgtgaatggacgatacagatctttctcttttctctttttactactacctacgccctaacgattactggcaatggggcgatcgctttcgtcttatggtgcgactggagactccacacgcctatgtatatgtttctgggcaacttctcttttctggagatttggtacgtgagttctactgttcctaaaatgcttgtgaatttcctgtcagaaaaaaagaatataagcttcgctgggtgcttcctacagttctatttttttttctctcttgggaccagtgaatgtctcctgctgacagtcatggcttttgatcagtacttggccatttgtcgacctctgctgtaccctaatataatgactggtcatctctgtgccaaactagtgatactttgctgggtgtgcggattcctctggttcctcatccccatcgttctgatcagccagatgcctttctgcggcccaaacatcatcgaccacgtggtctgtgatcctggtccgagatttgcccttgactgcgtttctgccccaagaattcagcttttctgttatacactcagttctctggtcatttttggcaattttctatttatcattggcagttatactctggtgctcaaagcggttctgggtatgccatctagcaccggcagacataaagccttttcaacatgtggctcacacctcgcagtcgtgagtctttgttatagctctctgatggttatgtacgtcagtccaggactgggccatagtacaggcatgcagaagattgagactctgttttacgcgatggttacgccacttttcaaccctctaatctacagtctgcagaacaaagagatcaaagcagccctgcggaaggtgctgggttcctctaatatcatttag

SEQ ID NO: 44131 - DNA, 960 bp, Artificial Sequence
  Description of Artificial Sequence: Synthetic coding sequence
atggagcccggcaacgacacccagatcagcgagttcctgctgctgggcttctcacaggaaccgggcttgcagcctttcctcttcgggctgttcctgtctatgtacctcgtcacagtactgggtaacctgctgatcattctggcaactatcagcgatagtcatctgcatactcctatgtattttttcctcagcaacttgagttttgccgatatttgtgttactagcaccaccatccctaagatgcttatgaacattcaaacccagaataaggtgatcacctacattgcatgcttgatgcagatgtatttcttcatattgttcgcaggctttgaaaactttctgctttctgtcatggcatacgatagatttgtcgccatttgtcacccgctgcattatatggtgatcatgaatcctcatctgtgtggcttgttagtcttggctagctggaccatgtcagcactgtactccttactgcagatccttatggtggttaggctgtcattctgcaccgcattggaaatcccacattttttttgtgagctgaatcaggtgatccagctggcctgttcagatagctttctgaaccatatggtgatttattttacagtggcccttctcggtggagggccattgaccgggattctgtacagctactctaagatcatctccagtatccacgccatctcatccgcccagggaaagtacaaggcgttcagtacatgtgctagtcacttgtctgtggtgtctcttttctacggcgccatcttaggtgtgtatcttagttctgcagcaacccgtaactctcactcctctgctaccgcatcggtcatgtacacagtagtcacaccaatgctgaacccctttatttattccttgcgaaacaaagacattaagcgtgccctgggcatccacttgctgtgggggacaatgaaagggcagtttttcaagaagtgcccttag

SEQ ID NO: 44132 - DNA, 930 bp, Artificial Sequence
  Description of Artificial Sequence: Synthetic coding sequence
atgcgggagaacaaccagagcagcaccctggagttcatcctgctgggggtgactggacagcaagaacaggaggacttcttttatatactgttcctcttcatttaccccattaccctgatcggtaacctgttgattgtactcgccatctgctccgatgtgagactgcataacccaatgtacttcttattggccaatttgtccttagtggacattttcttcagctccgtcaccatccccaagatgctggccaatcatctactgggctcaaagagtattagctttggaggatgcctgacccagatgtattttatgatcgcccttggtaacactgacagctatatcctggccgcaatggcttatgatcgagcagtcgcaatctccaggccattgcactacacaactatcatgagccccaggtcgtgtatttggcttatcgctggatcgtgggtgatcgggaatgctaatgccctgccacacactctgctcacagccagcttgtctttttgcggaaatcaggaggtcgcaaacttctattgtgacattacgcctttgctgaagttgtcctgttccgacatccatttccacgtgaagatgatgtacctcggcgtggggatattttccgttccgctgctgtgtatcattgtgagctacattagggtcttcagtacagtgttccaggtgccctccacaaagggagtgctgaaggccttttctacatgcggcagccaccttacagtcgtttccctatattacggcacagtcatgggaacatatttccggcctctgacaaactattctctgaaagatgccgtgataacagtcatgtacacagcggtcacccccatgctcaaccctttcatctatagcctgcgaaatcgtgacatgaaggcagctcttcgtaagctctttaataaacgtatttcgagttag

SEQ ID NO: 44133 - DNA, 930 bp, Artificial Sequence
  Description of Artificial Sequence: Synthetic coding sequence
atgaagaaggagaaccagagcttcaacctggacttcatcctgctgggcgtgacatctcagcaggagcaaaataatgtgttcttcgttatcttcttatgtatctacccaatcactctgacggggaatttgctcattatcctggccatatgcgccgacattcgactgcataatcccatgtactttctgcttgccaacctgtcgctggtggacataatcttcagtagcgtgacgatcccgaaagtgctggctaaccatctcctcgggtctaagtttatctccttcggtggatgccttatgcagatgtatttcatgatcgccctagccaaagcagactcatatactctcgccgcaatggcatatgacagagccgttgcaatttcgtgtccacttcattacaccaccatcatgtcaccccgcagttgcatactcctgatcgccggcagctgggtaattggcaacaccagcgccctccctcacaccctgttgactgcatcattgtctttctgcgggaatcaagaggtggctaatttttactgcgatattatgcctctgctgaagctgagctgcagcgatgtgcatttcaacgtcaagatgatgtacctgggcgtgggcgtgttcagcctgcctctgctttgcatcatcgtaagctatgttcaggtgttcagcaccgtcttccaggtcccatctactaagtcactctttaaggcattttgcacttgcggatcgcatctgacagtggtgtttctctactatggcacgaccatgggaatgtactttagaccactgacaagctacagcccaaaagacgctgtgattaccgtaatgtacgtggcggtgacccccgccttaaacccttttatttattctttgcgaaactgggatatgaaggctgctctgcagaaactcttttctaagcggataagcagctag

SEQ ID NO: 44134 - DNA, 957 bp, Artificial Sequence
  Description of Artificial Sequence: Synthetic coding sequence
atgatgagcttcgcccccaacgccagccacagccccgtgttcctgctgctaggtttttcaagagccaacatcagctatacactgttgttctttctgtttcttgcaatctatctgaccaccatcttaggcaacgttactctggtgctactgatctcttgggatagtagactgcatagccccatgtactatctgctccgtggccttagcgttattgatatggggctctctacggtgacgcttcctcagctgctggcgcatttggtgagccattacccaacaattcctgccgcccgctgtttagcccaattcttttttttttacgcgtttggcgtcaccgatacactggtcatcgctgtgatggccttggacagatatgttgccatctgcgaccctctgcactatgccctcgtgatgaaccatcagaggtgcgcatgcctactggcgcttagctgggtcgtgtcaattctgcacacaatgctcagagtaggcctcgtcctgccactgtgttggaccggcgatgccggcgggaacgtgaacctgcctcactttttttgcgaccaccggcccctgttacgagcctcctgttctgatattcactctaacgaactggccatcttctttgagggtggattcctcatgctgggaccctgcgccctgattgtgctcagctacgtacggataggggccgccattctgagactgcccagcgccgctggtaggagaagagccgtgagcacttgcggctcacatctcacgatggtaggattcctgtacggcacaatcatatgcgtttactttcaaccccccttccagaatagtcagtatcaagacatggtggcgagcgtgatgtataccgctattactcctcttgccaatccgtttgtgtactccctgcacaataaggatgttaaaggcgccctgtgcagacttctggagtgggttaaggtggacccatag

SEQ ID NO: 44135 - DNA, 945 bp, Artificial Sequence
  Description of Artificial Sequence: Synthetic coding sequence
atggagaagcggaacctgaccgtggtgcgggagttcgtgctgctggggttaccttcatctgcagaacagcaacacctcctcagcgttctgtttctgtgcatgtacctcgccaccacactcggaaatatgctgattattgcaaccattggcttcgactcacacctccatagccccatgtacttctttctcagtaacttggcgtttgtagatatctgcttcacttctaccactgtacctcagatggtcgttaacattctcaccggcacaaagacgatttctttcgctggctgtctgacacagctcttcttttttgtgagcttcgtaaacatggattcactgttactctgcgtgatggcatacgatcgttacgtggcaatttgccaccctctgcactacacagcaagaatgaatctctgcctgtgcgtgcagctcgtggcagggttgtggctcgtgacctacctgcacgcactgttgcacaccgtcctgatcgcccagctgtccttctgtgcctccaatatcattcaccattttttctgtgaccttaatccactcctgcagttaagctgcagcgacgtttcttttaacgtaatgattatttttgccgtcggaggcctcctcgcgctaacaccgctggtttgcattctggtttcctatgggttaatcttctctactgtcctgaagatcacgtcgacccagggaaagcagcgggcagttagtacttgttcatgccacttatccgtggtggtcctgttttacggcacagccatcgcggtgtacttttctccctcatcccctcacatgcccgaaagcgacacattatctaccatcatgtattcaatggtcgccccaatgctcaatcccttcatctatacattgcggaatcgtgacatgaaaaggggactgcaaaaaatgcttctgaaatgcaccgtgttccagcaacagtag

SEQ ID NO: 44136 - DNA, 945 bp, Artificial Sequence
  Description of Artificial Sequence: Synthetic coding sequence
atgatgggccagaaccagaccagcatcagcgacttcctgctgctgggtcttcccattcaacccgagcaacaaaatttatgctacgctctgtttttagccatgtacctcacaacattattgggaaaccttctaataattgtactgatccgccttgacagccaccttcacactcccatgtatctgttcctaagcaatctttcattcagtgacctgtgtttttcttcggtgactattcctaagctcttgcagaatatgcagaatcaggacccaagtatcccatatgctgattgtttgacccagatgtatttcttccttcttttcggggatctggaatcctttctcctggttgctatggcgtacgatcgctatgttgcaatttgcttcccattacactacacagccatcatgtctcccatgctatgtctggctctggtggccctgtcatgggtactcacaacatttcacgcaatgcttcacacactgttgatggccaggctgtgcttttgcgctgacaatgttattccccatttcttctgcgatatgtcagccctcctgaagttggcttttagcgatacccgggtgaacgaatgggttatattcatcatgggaggcctcatcctggtgattcctttccttctgatccttggcagctacgcaaggatcgtgtcatcgatccttaaagtacctagctccaaaggtatatgcaaagcattcagtacatgcgggtctcacctgagcgtagtgagccttttctacgggacggtcatcggactgtacctctgctcatccgcaaattcctctacactgaaagacaccgtgatggcaatgatgtacactgtcgtcacccccatgctgaaccccttcatatactccttacgtaaccgagatatgaagggcgctctctctcgcgttatacaccagaagaagacttttttctctttatag

SEQ ID NO: 44137 - DNA, 972 bp, Artificial Sequence
  Description of Artificial Sequence: Synthetic coding sequence
atgatgggccagaaccagaccagcatcagcgacttcctgctgctggggttgccaattcagcccgaacagcagaatctatgctatgcactgttcttagccatgtatctgaccacgctcctgggaaacctgctcattattgtactcattagattggatagccacctgcacaccccagtctatctgtttctgtccaatctctccttcagcgacttgtgcttctctagcgttactatgcccaagctgttgcagaatatgcagaaccaggatcccagtatcccctatgccgactgcctgacacagatgtacttctttctttacttctccgatctcgagtccttcttacttgtcgctatggcttacgacagatatgttgcaatctgcttccctatgcactatactgctatttgttttctgctacattatacggccataatgagtccaatgctctgcctgagcgttgtggctttaagctgggtgctgactacctttcacgcaatgcttcacactctgctcatggctagactgtgcttctgtgctgacaacgtaattcctcactttttctgtgacatgtcggcgttacttaagctggcttgtagcgataccagagtgaacgagtgggtgatatttatcatgggaggactgattctcgtgatcccatttttactgatcctggggagttatgccagaatcgtgtctagtatcctgaaggtccccagctctaaggggatctgtaaggcattcagtacctgcggcagccacctatctgttgtttcacttttctacggtacggtcatcggactgtacctgtgcccttcggctaactccagtaccttgaaggacaccgtgatggccatgatgtacaccgtggtgacccccatgctgaccccatttatatactctctcaggaaccgcgacatgaagggcgccctggagcgcgtaatttgcaaacgtaaaaatcccttcttattgtag

SEQ ID NO: 44138 - DNA, 942 bp, Artificial Sequence
  Description of Artificial Sequence: Synthetic coding sequence
atggagggcaagaacctgaccagcatcagcgagtgcttcctgctggggttctccgagcagctcgaagaacaaaagccactgttcggatcgttcctttttatgtatctggtgaccgtggccggaaacttgctgattatactcgttatcattactgatacacagttgcacaccccgatgtatttttttcttgccaacttatccctcgcggatgcgtgcttcgtctccactacggtgcccaaaatgctcgcgaatatccagatccagtcccaagccatatcgtattcagggtgccttcttcagctttatttctttatgttgttcgtgatgcttgaggcatttttgctggctgttatggcctacgattgctacgtggctatctgtcatccactccattacatattgatcatgagtcccggtctctgtatctttctggtttccgcttcttggattatgaatgctctgcactcccttctccacaccctcctcatgaacagcctctcgttttgcgcaaaccacgaaattcctcactttttttgtgatattaaccccctgctttctttaagttgtactgacccttttactaatgagctggtgattttcatcactggcgggttaactggactgatctgcgtgttgtgccttatcatctcttacaccaacgtttttagcacaatactgaagatcccatctgcccagggcaagaggaaagccttctccacttgtagcagccatctttctgtggtttccctgtttttcgggactagtttctgtgtcgattttagttccccaagtacgcattcagcccagaaagacaccgtggcgtccgtgatgtataccgtggttacccccatgctgaacccttttatatacagcctgaggaaccaggaaattaagtcctcactccggaagttaatctgggtgagaaaaattcactcaccatag

SEQ ID NO: 44139 - DNA, 1611 bp, Artificial Sequence
  Description of Artificial Sequence: Synthetic coding sequence
atggccgagcacgccccccggcggtgctgcctgggctgggacttctctacacagcaggtgaaagtcgtggcagtcgatgcagagttgaatgtgttttacgaagagagtgtgcattttgaccgtgacttgccagaattcggcacccaaggaggtgtgcacgtgcacaaggacgggctaacagtaacatcccctgtcctgatgtgggtccaggctcttgatataatcctggagaagatgaaggcttctggcttcgatttctcgcaggtgctagcactcagtggagctggtcagcagcacgggtctatttactggaaggctggcgctcagcaagctttaacttctctgtctcctgacctacgcctccaccagcagctgcaggattgcttcagtattagtgactgcccagtatggatggattcatctacaacagcgcagtgcagacagctcgaagccgccgtcggcggggcccaggctctctcttgtttaaccggcagccgggcttacgaaagattcactggcaatcagatcgccaagatatatcagcagaatcctgaggcctactcccatacagagaggatctctctggtgtccagctttgcggcttctctatttcttggatcctacagtcctatcgattattccgatgggtctggcatgaacctgctgcagatccaggacaaggtgtggtcccaagcctgtctcggcgcttgcgctccccatctagaagaaaagctcagccctcctgttccaagctgttccgtcgtgggggccatctcttcctattatgtccagaggtacggtttccctcctggttgcaaagtcgtggctttcacaggcgataatcctgccagtctggccggcatgaggcttgaggagggagatatagctgtttccctagggacgtctgatacactgtttttgtggctccaggagcccatgcctgcactcgagggacacattttctgtaatcccgttgatagtcagcattacatggctctgctgtgtttcaaaaatggatctctgatgcgcgagaagatcaggaatgaaagcgtcagccgaagttggtctgacttcagtaaggcactgcagagtaccgagatggggaacggaggaaatctgggcttctattttgacgtgatggaaattaccccagagatcattggcaggcataggttcaataccgaaaaccataaggttgcagccttccccggagacgtcgaagtgagggctctgattgagggccagttcatggcgaagcgcatccacgctgagggcctcggttaccgcgtgatgagcaaaacaaagatcctggccactggtggagcctctcacaaccgggaaatcctccaggtgctggcggacgtatttgatgcccccgtgtacgtgatcgacactgccaattccgcttgcgtgggctcggcatacagagccttccacggactcgcaggcggaacagatgtgcctttctctgaagtcgtgaagctggcccccaacccccgcctagccgcgactccctctcccggcgcctcccaggtgtacgaagctctattgccccagtacgccaaactggagcagcgaattctcagccagaccagagggcctcccgagtag

SEQ ID NO: 44140 - DNA, 969 bp, Artificial Sequence
  Description of Artificial Sequence: Synthetic coding sequence
atgagccccgagaaccagagcagcgtgagcgagttcctgctgctgggcttgccaattagacctgaacaacaggccgtcttcttcgcactatttctggggatgtatctgactacagtgcttgggaacctgttgatcatgctcttgatccagttggactcccatctccacacacccatgtactttttcctcagccaccttgctctgacagatatcagcttttcctccgtgaccgtgcccaaaatgctgatgaatatgcagacccagcaccttgcggtgttttataagggctgcatttcgcagacttatttcttcatattttttgcagacctagattcattcctgataacaagcatggcatatgacaggtacgttgccatttgccacccattacattatgccacaattatgacccagtcccagtgtgtcatgttggtcgctggatcctgggtgatagcttgcgcctgtgcactcctccacacacttttgctagcgcagctgtctttctgtgctgatcatattattcctcactacttctgcgatttgggggctttgctgaaactgtcctgcagcgacacaagcctcaatcagttggctatctttactgccgccctgacagcaataatgttacctttcctatgcattctggtcagctacgggcatattggggtgactatcctgcagattccatcaacaaaaggcatttgcaaagctctaagcacatgtggctcacatctgagcgtggtcacaatatactacaggactatcatcggactatactttctccctccatcatctaacacaaatgacaagaacataatagcttctgttatttacaccgcagtcactcccatgctgaatccattcatctacagcctgcggaacaaagacataaagggcgccctgcggaaacttctgtccaggtcaggagccgttgcacatgcatgcaatttaaacacgctgggaggttag

SEQ ID NO: 44141 - DNA, 942 bp, Artificial Sequence
  Description of Artificial Sequence: Synthetic coding sequence
atgagccccgagaaccagagcagcgtgagcgagttcctgctgctgggcctgcccatccggcctgagcagcaggccgtgttcttcactctgttcctcggcatgtacctgactaccgtgctgggcaacctgctcattatgctacttattcagttggactcccacctacacacaccaatgtacttcttcttgtcgcatcttgctctcaccgacatcagctttagctctgtgactgtaccaaaaatgctaatggatatgcggacaaaatataagagtattctctacgaagagtgtatcagtcagatgtactttttcatcttcttcactgaccttgacagcttcctgataacatcgatggcttacgaccgttatgtcgcaatttgccacccgctgcactacacagtgattatgcgggaagaactgtgtgtgtttctggtggccgtgagctggatactaagttgcgcttcatctctgtctcatacactccttctgacccggcttagcttttgtgccgccaacaccattccccacgtgttttgcgacctggcagcgcttctcaagctgtcttgtagtgatatctttctgaacgagctggtgatgttcaccgtgggggtcgtagtgatcacgctgcctttcatgtgtattcttgtatcttacggatatatcggcgccacaatacttcgggtgcccagtaccaagggcatccataaagcactctctacgtgtggttcacacctcagcgtggtttccctgtattacgggtcaattttcggccagtatctgtttccgaccgtcagtagttccatcgacaaagacgtcatagtggcactaatgtacaccgttgtcactcccatgctgaaccctttcatctattccctccgtaatcgagacatgaaggaggcgctggggaagctattttctagagcaacattcttctcatggtag

SEQ ID NO: 44142 - DNA, 942 bp, Artificial Sequence
  Description of Artificial Sequence: Synthetic coding sequence
atgagccccgagaaccagagcagcgtgagcgagttcctgctgctgggcctgccgattcgacctgaacagcaggctgttttttttaccttattcttgggtatgtacctgacgacagttttaggcaatctgcttataatgctgctgattcagctcgacagtcacctgcacactccaatgtacttctttcttagccacttagctttgaccgacattagttttagttccgttacggtccccaagatgcttatggatatgcgaaccaagtacaagtctattttgtatgaggagtgtatcagccagatgtattttttcattttttttacagacctggattccttcttaattactagtatggcttatgaccggtatgtcgcgatatgccatccactccattacacagttatcatgcgggaggagttgtgtgtgttcttagttgcagtctcctggatcctgagctgtgcgtcaagcctcagtcataccctgttgttgacacgattgatgaagcgggagaaccagagttcagtgagtgagtttctgttactggacctgccaatatggccagagcagcaggcagtttttttcactcttttcctggggatgtacctaattactgtcttaggcaacttgttgatcatcctgctaatccgcctcgactcacacctgcatacgccaatgttctttttcctcagccaccttgcactgaccgacatttcactcagcagcgtgactgtaccgaaaatgcttctgagtatgcagacccaagatcagtccatcctttatgccggttgcgtgactcagatgtacttttttatcttctttaccgatctggataatttcctgctgacgagcatggcatacgatagatacgtcgcaatctgtcatcccctgcgatatacaaccatcatgaaggaggggctatgtaacctactggtcactgtgtag

SEQ ID NO: 44143 - DNA, 942 bp, Artificial Sequence
  Description of Artificial Sequence: Synthetic coding sequence
atgaagcgggagaaccagagcagcgtgagcgagttcctgctgctggatctaccaatttggccagaacagcaggccgtttttttcaccctattccttggcatgtacctcattacggttttagggaatctcctgattatccttttgatccggctggacagtcacctccatacccccatgttcttctttctgagccacctggccctcacagatatctccttgtcctcggtaacggtccctaaaatgctgctctccatgcagacccaggatcagtccattctgtacgctggttgtgttacacagatgtacttcttcatctttttcaccgacctggataactttctgttgacaagtatggcttacgacaggtacgttgcaatttgtcacccactcagatacactactatcatgaaggaagggttgtgtaatctccttgtgaccgttagttggattttgagctgtactaacgccctcagtcataccctactcctagcccagttgagcttttgcgccgataatacaatcccccattttttctgcgatctcgtggctctcctcaagctctcatgctccgacatttccctgaacgaactcgtaattttcaccgtcgggcaggcagtgatcaccttgcctcttatttgtatcctaattagctacgggcatattggcgtgactatcctgaaagctccttcgactaaggggatatttaaggctctctccacatgcggctcccacctcagtgttgtatcattatactacgggaccattatcgggctttactttctcccctccagttctgcttcctccgataaggacgtcatcgcctccgtaatgtataccgtgattacacctctgctcaatccattcatctactcactgagaaacagagacattaaaggggctctggagagactatttaacagagctacagtcctgtcccagtag

SEQ ID NO: 44144 - DNA, 951 bp, Artificial Sequence
  Description of Artificial Sequence: Synthetic coding sequence
atggaggccgccaacgagagcagcgagggcatcagcttcgtgctgttaggccttactacatccccgggacaacagcgccccctcttcgtgctttttttgttgctgtatgtggccagcctcttgggtaacggactgatagtggctgcgattcaggcctccccagctctgcatgctcccatgtatttcctgcttgcccacctgtccttcgccgacctgtgttttgcgagtgtgacggtgcctaagatgctggccaacctccttgctcatgatcactcaattagcttggctggatgcttgactcagatgtatttcttctttgctctgggcgttacagattcctgtctactcgctgccatggcttatgattgctacgttgccattagacaccctctgccatacgcaactcggatgtctcgcgctatgtgtgccgcactggtggggatggcatggctggtttcacatgttcattcactactctacatattacttatggcgaggctctcattctgcgcttcacaccaggttccccatttcttttgtgaccatcagccattgcttagattatcatgttcagacactcaccatattcagttgctcatcttcaccgaaggcgcagcagttgttgtgactcccttcctccttattctcgcatcttacggcgctattgccgctgctgtactgcaattgccttccgcctctggtcgactcagggctgtgtcaacctgtggatcacacctagcagtagtgtcactcttttatggaacagtgattgctgtctactttcaggccacttctcgtagagaggcagagtgggggcgtgtggccacagtcatgtacacagtggtaactcccatgttgaacccaattatttattctctgtggaatagagatgtgcagggtgcccttcgcgcgcttctgatcggcaggaggatctcggccagcgattcctag

SEQ ID NO: 44145 - DNA, 933 bp, Artificial Sequence
  Description of Artificial Sequence: Synthetic coding sequence
atgggccggaacaacctgacccggcccagcgagttcatcctgctgggcctgagctcccgcccggaggatcagaagccactgttcgcagtgtttctgccaatctacctgattactgtcattggcaacctgctaatcattctggcaataaggagcgacactaggctgcaaacccctatgtatttcttcctgagcatcctgtccttcgtcgatatttgctatgttacagtgataatccctaagatgttggttaactttctctctgagactaagaccatttcgtattctgagtgtctgactcagatgtatttcttcctggcttttggcaatacagattcttatctgctagccgccatggctattgaccggtacgtggccatttgcaatccatttcattatatcaccatcatgagtcatcggtgctgtgtgttattactcgtcctctccttctgtattccccactttcactcgttgctgcatatcttgctcaccaatcagctgatattctgtgcatcgaacgtcatccaccatttcttttgcgatgatcagccagtcctgaaactctcttgttcctcgcattttgtcaaggagatcaccgtgatgacagaaggattggcagtgataatgaccccattctcctgtattatcatatcatatctgcgtatccttattaccgtcctaaagattccaagtgcagccggcaaacggaaggcgttttccacctgtggatcccaccttaccgtggttaccctgttctacggatctattagttacctctacttccagcctctaagtaactatacggtcaaggaccaaattgccactataatttacactgtgctgacccctatgctgaatccatttatatactccctaaggaataaggacatgaagcagggcctggctaagcttatgcaccggatgaaatgccagtag

SEQ ID NO: 44146 - DNA, 1083 bp, Artificial Sequence
  Description of Artificial Sequence: Synthetic coding sequence
atggagcggaaccacaaccccgacaactgcaacgtgctgaacttcttctttgctgataagaaaaataaacgccgaaacttcgggcagatcgtctccgatgtgggcaggatctgctattctgtttcgctgagtttgggagaacccacaactatgggtagaaataatcttactagaccatcggaattcattctgttaggattgtcgtctaggcccgaagatcaaaaaccactgttcgctgtcttccttcccatctatctcatcaccgtcatcggtaatttactgattatactggccatccggtctgacacacggctacagaccccaatgtacttcttcctttctatcctatcttttgtggacatctgctacgtgactgtgattattcccaaaatgcttgttaattttttgagtgagaccaagacaatctcctactctgaatgcctgactcagatgtattttttccttgcatttgggaatactgactcttatctcctggccgccatggctatagaccggtacgttgccatttgtaacccctttcattatattaccattatgtctcatagatgctgcgtcctgctgctggtgctttccttttgtattccacattttcacagtctgctccacattctgttgaccaaccagcttattttctgcgccagcaacgtcatccaccacttcttttgcgacgatcagcctgtgttaaagctgagctgcagctcgcactttgtgaaggagataacagttatgacagagggactggccgtgatcatgacacctttttcgtgtatcattatttcatacttacgaatcttgataacagtgctcaaaatcccaagtgctgccgggaagcggaaggccttttcaacatgcgggtcacacctgacagtggtcacccttttttatgggagcattagttatttatacttccagcccctgagtaactacacggtcaaggatcagattgctaccatcatatatacggtcctcacccctatgttgaatccattcatctattcacttaggaataaggatatgaaacaaggactagccaaactgatgcacagaatgaaatgccaatag

SEQ ID NO: 44147 - DNA, 975 bp, Artificial Sequence
  Description of Artificial Sequence: Synthetic coding sequence
atgggcatgagcaacctgacccggctgagcgagttcatcctgctgggactgagctcccgaagtgaggaccagaggcccctctttgccctgttccttattatctacttggtgacattaatgggaaatcttctaattattctggcgatccattcagatccacgactccaaaaccccatgtactttttcttgtcaattctgtctttcgccgacatctgctacactactgtgattgtccctaagatgttggtgaacttcctgtccgagaaaaaaacgatctcctacgccgaatgcctcgcgcagatgtatttctttctggttttcggcaatatcgactcctatctccttgccgccatggctattaatagatgcgttgccatttgcaacccgtttcactacgtgacggtgatgaataggagatgttgtgtgctgttactggcgttccccattaccttttcatacttccattctctactacacgttctgctggtgaacagattgactttctgtacatccaatgtcatccaccacttcttctgtgacgtgaatccagtgctgaagctctcttgttcatccacattcgtcaacgaaattgtcgcgatgaccgagggcctggcctccgtgatggccccattcgtgtgtattattatctcttacctgcgcatcctgatcgctgttctgaagattcccagtgctgcagggaagcacaaagcgttctcaacgtgttcatctcacttgacagttgttatcctgttttatgggagcataagttatgtatacctgcagccgctcagctcatacacagttaaggacagaattgctacgataaattatacagtgctcaccagtgtgttgaacccctttatttacagtcttcgtaacaaagatatgaagagaggactgcagaagttgatcaataaaatcaaatcccagatgtcccgtttctctaccaaaaccaacaaaatttgcggaccgtag

SEQ ID NO: 44148 - DNA, 936 bp, Artificial Sequence
  Description of Artificial Sequence: Synthetic coding sequence
atggagaccaagaactacagcagcagcaccagcggcttcatcctgctaggcctctcctcgaatcccaagctccagaaacccctgttcgcgatttttttaatcatgtacctgctcactgcggtcggcaacgtcctgatcatcctggcaatctactccgaccctaggctccacactcccatgtatttctttctctctaacctcagcttcatggatatttgcttcacgacagtgattgtgcccaagatgctcgtcaatttcctcagcgagacaaagatcattagctacgttggctgcttgatacagatgtatttttttatggcatttggcaacacagactcctacctgctggccagtatggcaattgacaggctggtcgccatttgcaatccgctacactacgacgtggtaatgaagccgtggcattgtcttcttatgctcttgggatcctgtagtatctcacacctccactcactcttccgcgtgctgcttatgagtagattgtccttctgcgcctcacatatcatcaaacacttcttttgtgacactcaacctgtattgaaactcagttgctcggatacatcaagttcccagatggtagtaatgaccgagaccctggccgttattgtgaccccgttcctgtgtaccatcttctcctatctccagatcattgttactgtgctacggattccaagcgccgccggcaagtggaaggctttctcgacatgcgggtcccacttgacagtggttgtccttttctacggctcggtgatctacgtatacttccggccacttagcatgtattcggtcatgaagggacgggtggccaccgttatgtacacggtggtgacacccatgttgaaccccttcatctattctttgcggaataaagatatgaaaagaggcttaaagaaactcaggcaccgtatatattcttag

SEQ ID NO: 44149 - DNA, 936 bp, Artificial Sequence
  Description of Artificial Sequence: Synthetic coding sequence
atggagatcaagaactacagcagcagcaccagcggcttcatcctgctggggctgagctctaacccacagctgcaaaaacctctgtttgccatcttcctgatcatgtacctccttgctgccgtgggtaacgtcttgattattcctgctatttattccgatccccgcctccacaccccaatgtacttttttctctctaatctttcatttatggacatttgttttactacagtgatagtgcctaagatgttggtgaacttcctgtccgaaacaaaggtaatcagttatgtgggctgtctggcccagatgtatttcttcatggcctttgggaacactgacagctatttgcttgcttccatggctattgatcgcctcgtcgcaatctgcaaccctcttcattacgacgtcgtcatgaaacctcgccactgtctgcttatgctgttggggtcctgttcaattagtcatctgcattccctgtttagggtcctcctaatgtcaagactaagcttctgcgctagtcatatcatcaagcactttttctgcgatacccagcctgtattgaagttgtcctgtagtgacaccagctctagtcagatggtcgttatgacagagactctggccgtaatcgtgacaccatttctctgcatcatattttcctatttaaggattatggtgacagtattgagaatccccagtgcagcaggtaagtggaaggccttttctacgtgtggcagtcatctcactgctgttgcactgttctatggaagtattatttatgtgtatttcaggccactgtccatgtacagcgtggtccgagaccgggtggctacagtaatgtacacagtggtgaccccaatgctgaacccattcatctatagtcttagaaataaggacatgaagcgaggtttaaagaagttgcaggatagaatctacagatag

SEQ ID NO: 44150 - DNA, 1044 bp, Artificial Sequence
  Description of Artificial Sequence: Synthetic coding sequence
atgagctacttctaccggctgaagctgatgaaggaggccgtgctggtcaaactgccgttcacaagcctgccacttctcctgcaaacccttagccgcaaaagtagggatatggagattaaaaactactcatcttcaacatctgggttcatccttttgggcctgagctctaacccccagctccagaaaccattgtttgcaattttcctcattatgtatctgctcgctgccgtcggaaacgtgctgattatacccgcgatctacagtgaccctcgacttcacacccccatgtacttttttctgtcgaatctttcatttatggatatctgctttaccacggtcatcgtgcctaagatgcttgtcaactttctatcggagactaaggtcatatcttatgtgggctgcctcgcccagatgtacttttttatggcttttggcaacacagatagttatctgctggcgtccatggcaatcgacaggctcgttgccatatgtaacccactccattacgacgtggtcatgaagccccggcattgtttactgatgcttcttggctcttgctcaattagtcatctgcatagcctcttccgggttctattaatgtcacggcttagtttctgcgcttcacacattataaaacattttttctgcgacacacagccagtattgaagctgagctgttcagacacctcaagtagccagatggtagtgatgacggaaacccttgctgttatagtgaccccattcctgtgcattattttttcatatttgcgaatcatggtgactgtgctgcggattccttctgccgcgggcaagtggaaagcgttttctacatgcgggtcgcacctgactgctgtggctctgttctacggaagtattatttatgtctatttccgacccttgtccatgtactctgtcgtacgggacagggttgcaacggtgatgtacacggtagtgacacctatgttgaacccgttcatctactccttgcggaacaaggatatgaaacgcgggctcaagaagctgcaagatcgaatttaccggtag

SEQ ID NO: 44151 - DNA, 930 bp, Artificial Sequence
  Description of Artificial Sequence: Synthetic coding sequence
atggagcggatcaaccacaccagcagcgtgagcgagttcatcctgctcgggctgtccagtcgtccggaggaccaaaaaactctgttcgtgctgtttctgattgtgtacctggttaccattactggcaatttgctgatcatcttagcgattcggttcaatccgcatttgcaaacacccatgtatttctttctgtcatttctgagcctgacggacatatgtttcacaacctcagtggtcccaaaaatgctcatgaactttctgagcgagaaaaaaacaatctcttatgccggttgtctgactcagatgtactttctttacgcactagggaactccgattcttgccttctcgccgtcatggccttcgaccgatacgtggcagtgtgcgatccattccactacgtgacgactatgagccatcatcattgcgttctgctggtggccttttcttgtagcttcccgcacctgcactctctgctacatacccttcttctcaatcgcctgacattttgcgatagtaacgtgatccaccattttctgtgcgatctgagccctgtccttaagctttcttgctcctccattttcgttaatgaaatcgtgcagatgacagaggctcctatcgtactggtcacacggtttctctgtatcgcgttcagttacattaggattctgactacggtgctaaagattccttctaccagtggcaagaggaaggcattttccacttgtggcttttatttgaccgtcgtcactcttttttatggctcaatcttttgcgtgtatctccagcctccttcgacatatgccgtgaaggatcatgtcgctactatagtttacacggtgctcagtagtatgctaaaccccttcatatattcactacgaaacaaagatttgaagcagggcttaagaaaattgatgtcaaagcgcagttag

SEQ ID NO: 44152 - DNA, 951 bp, Artificial Sequence
  Description of Artificial Sequence: Synthetic coding sequence
atcacccccatggagccccggaaccagaccagcgccagccagttcattctgctggggctgagcgaaaaaccagaacaggaaactttgctgttctccttgttcttttgcatgtacctggtcatggtggtcggaaacttgctgattatcctcgcaatctccattgactcacatctgcacacccctatgtattttttcctcgcaaacttgagcctggttgacttttgccttgctaccaacactatacccaaaatgctggtcagcctccaaaccggttctaaggcgatctcttatccatgttgtctgattcaaatgtactttttccacttttttggcattgttgatagtgtgattattgccatgatggcgtatgaccggtttgtggctatttgccatcctctgcactatgccaagattatgagcctgcgactgtgcagactgctggtgggagccctgtgggcattttcttgtttcatcagtttgactcatattctcctcatggctcgcctcgtgttctgtggttcccacgaagttccacactatttctgtgatctgacccctattctccgcctgtcatgcactgacacctcagttaataggatattcattctgatagtggcggggatggtgatcgctaccccattcgtctgcatcctggcctcatacgcccgtatactcgtggctatcatgaaggttccgtccgctggcggtagaaaaaaggccttttccacatgctctagtcatctttcagtagtcgcactgttctacggcactactattggcgtatatctgtgcccttcttctgtcctcacaacagtaaaggagaaggcgtcggctgtgatgtatactgctgtaacccctatgctcaatcctttcatctacagcttgcgcaaccgcgatctgaagggagcactgcggaagctggtgaacaggaagatcacaagtagtagctag

SEQ ID NO: 44153 - DNA, 942 bp, Artificial Sequence
  Description of Artificial Sequence: Synthetic coding sequence
atggagccccggaaccagaccagcgccagccagttcatcctgctgggcttatctgagaagcccgagcaggaaaccctccttttcagcctattcttctgcatgtacctcgtcatggtggttgggaacctgctgatcatccttgccattagtatagatagccacctacatacacccatgtacttctttctggccaacctctctcttgtggacttctgtctcgctaccaacaccatccctaaaatgctggtcagcctccagaccggcagcaaggctataagctacccttgttgcctaatccaaatgtatttcttccattttttcggtatcgtcgatagtgtcatcatcgccatgatggcgtacgaccgcttcgtcgctatttgtcacccgttgcactatgccaaaatcatgagcctcagactttgcagactgcttgtaggtgctttgtgggcctttagctgcttcatttctttaacacacatcctactgatggcccggctggtcttttgcggcagccacgaggtcccacattacttttgtgacctgactcctattctcaggctcagctgcacggacacctccgtgaaccggatcttcatacttattgttgccggaatggtgatcgcgacccccttcgtttgcatactggcaagttacgctaggatactggtcgctattatgaaagtccctagtgctgggggtaggaaaaaggctttctccacttgttcaagccatctgtccgtcgtagcgctgttctatggcaccacaataggagtgtatctgtgcccttcatcagtgctaacgaccgtaaaagagaaagctagcgcagtcatgtataccgcggtgacacctatgctaaacccatttatctacagcttgcgcaacagggacctgaagggtgccctgaggaaactggtgaacaggaagataacctcgtcctcctag

SEQ ID NO: 44154 - DNA, 936 bp, Artificial Sequence
  Description of Artificial Sequence: Synthetic coding sequence
atggagaaccagagcagcatcagcgagttcttcctgcggggcatctcggcccctcctgaacaacagcagagtctgtttggcattttcctttgtatgtatctggtcacactgaccgggaacctactgatcatactggctatcggttccgacctccacctgcatacccccatgtacttcttcctggccaacttgtcgtttgtggacatggggctcacttcatctacagtgacgaagatgctggtgaacatccagaccaggcaccatacaattagctatacgggctgcttgacccagatgtacttctttctcatgtttggtgacttggactccttctttttagcggccatggcttatgacaggtacgttgcaatctgtcaccccttgtgttactcaactgtgatgcggccgcaggtttgcgccctcatgctggctctttgctgggttctgacaaacatagtcgccctcactcacacatttctgatggcccgcctcagcttctgcgtgactggcgagattgcgcactttttttgtgacatcacccctgttctcaagctttcgtgctcagacacacacatcaatgaaatgatggtgtttgtgttaggaggtacagttctgatagtgccatttctttgcatcgtcacgagttatatccatatcgtccctgccattttaagagtacgcactcgggggggagtggggaaagcttttagcacttgctctagtcacctgtgtgtagtgtgtgttttttatggaacgctgttctctgcctacctgtgtcccccaagcatcgcctctgaagaaaaagacattgctgccgccgcaatgtatacgatcgtaaccccgatgctgaatccatttatatactcactgcgcaataaggacatgaagggggcgttgaaacgtttgttctctcatagatctattgtgtccagttag

SEQ ID NO: 44155 - DNA, 993 bp, Artificial Sequence
  Description of Artificial Sequence: Synthetic coding sequence
atggagggcttctacctgcggcggagccacgagctgcagggcatgggcaaacccgggcgggtgaatcagaccaccgtgtcggactttttactacttggcctgtccgagtggccagaagaacagccactcctatttggcatattcctgggaatgtacctggtaaccatggtcggaaatttgctcattatccttgctatcagttccgaccctcatcttcacacaccgatgtatttctttctggctaatttgtctctgaccgacgcttgctttactagtgctagcattcccaagatgcttgccaacatacacacccaaagccaaatcatctcttattccgggtgcctggcccaactgtattttctcctcatgttcggtgggctagacaactgcctcctggccgtgatggcatacgatcgttatgtggcgatttgccagccactccactactctacctcgatgagcccacagctctgtgcactaatgttaggcgtgtgctgggtgctcactaactgccccgctctgatgcatacattattactgacacgcgtggccttttgcgcccaaaaagctataccgcacttttattgcgatccatctgcgctgctcaaactcgcgtgctctgacacccatgttaatgagctgatgatcattaccatgggacttctgtttctgactgtacccttgttgctcatcgtattctcatacgtgaggatcttctgggctgtattcgtcatctcttcccccgggggccgatggaaagcattttcaacctgtgggtctcacctgacggtcgtcctgcttttctatgggagcctcatgggggtctatctccttccgcctagcacctactcaactgagcgcgaatccagagctgcggttttatacatggtaattatccccacactgaaccctttcatctactcactcagaaacagagacatgaaggaagctctcgggaagctgttcgtgtccggaaaaacctttttcctgtag

SEQ ID NO: 44156 - DNA, 945 bp, Artificial Sequence
  Description of Artificial Sequence: Synthetic coding sequence
atggacaacagcaactggaccagcgtgagccacttcgtgctgctggggataagtacccacccagaagagcagattcctttgtttctcgttttttcgctgatgtacgcaattaacatctctggaaatctcgcgataatcactctcatcctctccgccccgcgcctgcacatcccaatgtatatatttctatccaacctcgcgcttactgatatctgttttacctcgaccacagtacccaagatgctccagatcatcttctcccccacaaaagtcatttcttatactgggtgcttagcgcaaacctatttcttcatttgttttgcggtgatggagaacttcatactggccgtgatggcctatgatagatacatcgctatctgtcaccccttccactacaccatgattttaaccagaatgctgtgtgtgaaaatggtggtgatgtgccacgcgctttctcatctgcatgccatgctccacacatttctgatcggccaactgattttctgcgcagacaaccggatcccgcatttcttttgcgatctttacgcattaatgaagattagctgcacttcaacttacctcaacacactgatgatccacacagaaggggccgtcgtgattagcggcgccctggctttcatcacagcttcctacgcatgcatcatccttgtcgtgctgcgaatacctagcgcaaaagggcggtggaagacattttctacatgtggtagtcacctgacagtcgtagctatcttctatggaactttgtcctgggtgtatttccgtcccctaagcagctactccgtgaccaaagggagaatcataacagttgtatacaccgtagtgacacctatgcttaacccatttatttattcactccgtaatggcgacgtaaaggggggctttatgaagtggatgtcccgcatgcagacattctttttcaggtag

SEQ ID NO: 44157 - DNA, 978 bp, Artificial Sequence
  Description of Artificial Sequence: Synthetic coding sequence
atgaagaccttcagcagcttcctgcagatcggccggaacatgcaccagggtaaccaaacgacaattaccgagtttatcctattgggcttctttaagcaggacgaacatcagaacctgctctttgtactatttctgggcatgtaccttgtaaccgtcattggcaatggactgatcattgtggctatttcccttgatacatacctgcatactccaatgtacctctttctcgccaacctgtcctttgctgacatctcgagtatcagtaattccgtgcctaagatgctcgtcaatatccagacaaagtcccagtccatctcctacgaaagctgtattacccagatgtacttctctatcgtgtttgtggtgattgataacctgctgctgggtacaatggcctatgatcacttcgtcgccatctgtcatcctcttaactacacaattctgatgaggccgcgcttcgggatactcctgacagtgatcagctggttcctgtcgaatatcattgctctgacacatacgctcctgctcatccagctgcttttttgcaatcataatacactcccccatttcttttgtgaccttgccccactgttgaagctgtcttgctccgatactctcattaatgagctcgtgctgttcatcgtgggactgtctgtaataatcttcccctttaccctgtctttcttctcatatgtgtgcataataagagccgtgctaagagtgtcatcaacacagggaaagtggaaggcattctctacatgtggttcccatttaacggtggtactgctgttctacggaactatagtgggagtgtacttttttccatcatcgacgcaccccgaagacacagacaagattggagcagtgctgttcacagtggttacacctatgatcaaccccttcatctattcattacgtaacaaagacatgaagggggccctgagaaagctgattaacaggaagatctcaagcctgtag

SEQ ID NO: 44158 - DNA, 978 bp, Artificial Sequence
  Description of Artificial Sequence: Synthetic coding sequence
atgaagaccctgtgcagcttcctgcagatcagccggaacatgcaccaggagaaccagaccacgattacagagtttatcctcctgggcttgagcaatcaggcagagcatcagaacctcctgttcgtgctcttcttgagtatgtatgttgttaccgtggtagggaatggactcatcattgtcgccatctccctagacatatacctgcacactcctatgtacctattcttagcctacctatccttcgccgatatctcttcaatctcaaattccgtgcctaagatgctcgttaacatccagaccaatagccaatcaataagttatgaatcatgcattacacaaatgtacttttctatcgtgttcgtggtgaccgacaatctgctcctggggacgatggccttcgatcatttcgtggcgatttgccacccactgaactacactaccttcatgcgcgctaggtttggtaccctgttaacggtcattagctggttcctgtcaaacatcattgcccttactcacaccttgctcctcatacagctgctattttgtgatcataacaccttgcctcactttttttgcgatctggccccactcctcaaattgagctgttctgacactatgattaacgagctggtgttattcattgtgggcctctcggtgatcattttcccctttgtcctcatcttcttctcatatgtgtgtattatcagagcagtcctgggggtctcatccactcagggaaaatggaaggctttctcaacatgtggcagccacctgacgatcgccttactattttacgggactacagtgggcgtatatttcttcccctcatccacgcaccctgaagataccgacaagattggcgctgtgctttttacggtggttaccccaatgatgaatccattcatctactcactgcgtaacaaagacatgaaaggggctttaagaaaactgataaacagaaaaatatcctccctttag

SEQ ID NO: 44159 - DNA, 912 bp, Artificial Sequence
  Description of Artificial Sequence: Synthetic coding sequence
atgagcttcagcagcctgcccaccgagatccagagcctgctgttcctcacttttcttaccatttacctcgtgacattgatgggcaactgcctaattatattggtgacgctggcagaccccatgctccatagcccgatgtactttttcctgcgcaatctctcctttttggaaattggctttaatctggtgatcgtgcctaagatgctgggcacattgctggcccaggataccactatctccttcctgggatgcgccacccaaatgtacttctttttcttttttggtgtagccgagtgctttctgttggctacaatggcctatgaccgatatgtagcgatttgcagtcctctgcattatcccgttattatgaaccagaggacccgagctaaattggccgcagcctcttggttccctggttttccagtcgcaaccgtgcagaccacctggctcttcagctttcccttctgtggcactaacaaggtaaatcactttttttgtgacagtccccccgtgctcaggctggtgtgcgctgacacagccttgtttgaaatctacgctatcgtgggcacgatccttgtcgtaatgattccttgtctcttgatcctctgttcctatactcacattgctgctgccattctcaagattccctctgccaaaggcaagaacaaagccttttcaacctgttccagtcatttgctagtcgtgtcccttttttatatttcactgagcctcacgtattttcgacccaagagtaataattctccggaaggcaaaaagctgttgtccctgagctatacagtgatgacgcctatgctaaatccaataatctattccctgcgcaataatgaggtaaagaatgccctcagccgaaccgttagtaaggcactcgccttacgcaactgcatcccttag

SEQ ID NO: 44160 - DNA, 945 bp, Artificial Sequence
  Description of Artificial Sequence: Synthetic coding sequence
atgaagcggcagaaccagagctgcgtggtggagttcatcctgctgggtttttccaacttccccgaattgcaggtgcagctttttggtgtgttcttagttatttatgtggtgacactgatgggtaacgccattatcaccgtaataatctcactgaaccagagtctgcatgttccaatgtacctgtttctgcttaacttatcagtggtggaggtgtctttctccgccgtaataacccccgaaatgctggtcgtactgagcacagagaaaaccatgatctcttttgtgggatgcttcgcccagatgtactttatcctgctgtttggggggacagaatgttttctgctgggggctatggcttatgatcggtttgcagccatttgtcaccctctcaattacccagtaattatgaatcggggggtgtttatgaagctagtcatattctcctggatttcgggtattatggtcgccactgtgcagactacttgggttttctccttccccttttgcgggccgaatgaaataaatcatctgttctgcgagaccccacccgttcttgagcttgtctgtgcagacacattcctgttcgagatctatgctttcactggcactattctcatcgttatggttcctttcctgctgatcctgctaagttatattcgcgtccttttcgcaatcctgaaaatgcccagcacaactggccgtcagaaggccttcagcacctgtgccagccacctgacttccgtcacacttttctacggtactgctaatatgacttacctgcaacctaagagcggatattcccccgaaaccaagaagctaataagtctcgcctacacgcttctaacacctttgttgaatccgttgatctattcactccgaaactcagaaatgaaacgtacacttattaaactatggagacgaaaagtaatacttcacaccttctag

SEQ ID NO: 44161 - DNA, 948 bp, Artificial Sequence
  Description of Artificial Sequence: Synthetic coding sequence
atgatgtgggagaactggaccatcgtgagcgagttcgtgctggtgtcattcagtgcactgtccacagagttgcaggcactcctatttctcctgttcctcactatttatctagttactctcatgggaaacgtgctaattatcctggttacaattgccgactctgccctccagtcacctatgtacttcttcctgcgaaatctgtcttttctcgaaataggatttaacttggtgatcgttccaaagatgctgggcacgctcattatccaggacacaacaatcagcttcctgggctgtgcaacccagatgtatttttttttttttttcggcgctgcggaatgttgcctcctcgctactatggcctatgatcgctacgtggcaatatgcgacccgttacactatccagtgatcatgggacatattagctgcgctcagttagcggccgcgagctggtttagcggcttcagtgtggcaacagtgcagaccacatggattttcagtttcccgttttgtggccccaaccgggttaaccactttttctgcgacagtccccccgtgattgcactggtgtgcgctgacactagtgttttcgagctggaagctctgaccgctacagttctgttcatcctgtttccatttctactgatcttgggatcctacgtcaggattctttccaccatcttccgcatgcctagtgccgaaggcaagcatcaagccttctcaacttgctccgcccacctcctggtggtgtctttgttttattccacagctatcctcacctatttcaggccacaatcctccgctagcagcgagagcaagaagctgttgagcctgtcatccactgtagtaacacctatgctcaacccaatcatctactcatcccgaaataaggaggtgaaagcagccctcaagcggctaattcaccgcacactgggctcgcagaaactgtag

SEQ ID NO: 44162 - DNA, 954 bp, Artificial Sequence
  Description of Artificial Sequence: Synthetic coding sequence
atggccatcggcaactggaccgagatcagcgagttcatcctgatgagcttttcgtctctcccaaccgagatccaatcacttttattccttacctttctcactatttacctggtaaccctgaagggcaattccttgatcatactggtgacactggcagacccgatgctgcattcaccaatgtatttctttctcaggaatttgtctttcctggaaatcggattcaacctggtaatcgtgccaaagatgctaggcacccttctggcccaggatacaacgatttctttcctaggttgcgcaactcagatgtacttctttttcttcttcggagttgccgaatgttttctcctggcgaccatggcctacgatcgttacgtggctatctgttctcctctgcactatccagttattatgaatcagcgcacaagggcgaagctggccgccgccagttggtttccgggttttccagtggccacagtacaaaccacttggctcttttccttcccgttttgtgggactaacaaggtcaaccatttcttttgtgattctccgccggtattgaaattggtatgtgccgatacagcccttttcgagatttatgcgatcgtagggaccattcttgtcgtgatgatcccctgccttcttatcctgtgcagttacactagaatcgcggccgcaatcctgaagatcccatctgccaaaggaaagcataaggctttttcaacctgctcatcgcatctgctggtggtaagcctgttctatatttcgtcctcactgacctacttttggccgaagtcaaacaattctcctgaaagtaagaagctcctaagtctcagctatactgtagtcacgcctatgctgaaccccattatctattctctgcgcaacagcgaagtcaaaaatgcactgagccgaaccttccacaaggtattggctttgcgcaactgcatcccctag

SEQ ID NO: 44163 - DNA, 966 bp, Artificial Sequence
  Description of Artificial Sequence: Synthetic coding sequence
atgcccatcctgatggccatcggcaactggaccgagatcagcgagtttattctcatgagcttctcatcattgcctacggagatccagtctctgctctttctgaccttcctcacaatttatctagtgaccttaaaagggaacagcttaatcatcctggttactttggccgatcctatgctccatagcccgatgtactttttcttgagaaatttgtcatttttggaaatcggcttcaaccttgtaattgttccgaagatgcttgggacgcttcttgcccaggataccaccatcagcttcctgggctgcgctacgcagatgtattttttctttttcttcggcgtcgccgagtgttttctgctggctaccatggcctatgacaggtacgtggcaatatgcagccctctccactaccccgttatcatgaatcagagaactagggccaagctcgctgctgcgtcctggttcccaggcttcccagtcgcgacagtccaaacaacctggcttttttcctttcctttttgcgggactaacaaagtgaaccacttcttctgcgactccccaccagtcctgaaattggtgtgcgccgatacagccctgttcgagatttacgccattgttggcacgattctagtggtgatgatcccctgtctgttgattttgtgtagttacactcgtatcgcagcagctatactgaaaattccttctgctaaggggaagcataaggcctttagcacctgtagctctcacttactggtggtaagtttattttacatttcgagtagcttaacctatttttggcctaaaagcaataattctccggaatcaaagaaattactgtccctttcctacaccgtcgtgactcctatgctgaaccctataatctattcccttcggaacagtgaggtcaaaaacgccctctcaagaacattccacaaagtgctggcattgcggaactgcatcccgtag

SEQ ID NO: 44164 - DNA, 945 bp, Artificial Sequence
  Description of Artificial Sequence: Synthetic coding sequence
atggagcggcagaaccagagctgcgtggtggagttcatcctgctggggttttccaactaccctgaactgcagggccagctgtttgtcgcattcctagtgatctatttagtaactctgattggaaacgcaatcataatcgtgattgtcagcctggaccagagcctccatgtccccatgtatttattcctgctgaacctctccgtagtggacctatccttttccgctgtgattatgcccgagatgctagtggttctgtcgaccgaaaagacgactatttccttcggcggctgcttcgcccaaatgtacttcatactgctctttggaggggctgagtgcttcttgttaggcgctatggcgtatgacagatttgccgccatctgccacccgctgaattatcagatgatcatgaataaaggggtctttatgaagctgataatctttagttgggccctgggctttatgctgggaactgtgcaaaccagctgggtgtcatcgttcccattttgtgggctcaacgaaatcaaccacatctcttgcgagacgcccgcggtgctggaattagcttgcgccgacaccttcctcttcgaaatctatgcctttacaggaacttttctgattatcctggttccctttttgctcatcctactgagttacattcgcgttctctttgctatcctcaagatgcccagcactacaggacgccagaaggcattttctacttgcgcggcccacctgacttcagtgacactgttttacggcaccgcttccatgacttacctccagccaaaatctggatatagtcccgaaacgaaaaaggtgatgtccttgtcttattcactattaaccccccttctgaacctgctcatctatagtctgcggaacagcgaaatgaaacgtgcgctgatgaagctgtggcgcaggcgcgtcgtgttacatacaatttag

SEQ ID NO: 44165 - DNA, 951 bp, Artificial Sequence
  Description of Artificial Sequence: Synthetic coding sequence
atgatctgcgagaaccacacccgggtgaccgagttcatcctgctgggatttactaacaaccctgaaatgcaagtgtctctcttcattttcttcctggcgatttacacggttaccctactgggcaactttctgatcgtgacagtgaccagcgtggacctcgctctgcagacgcccatgtatttttttctgcaaaacctcagtcttctcgaggtgtgtttcactctggtgatggttccgaagatgttagtcgatcttgtgtcacctcgcaaaatcatcagcttcgtgggatgtggaactcaaatgtatttttttttcttcttcggatcttcagaatgctttttgctttctatgatggcatatgatagatttgtcgccatttgtaaccctctccactatagcgtcataatgaatcgttccttatgtctgtggatggctatcggaagctggatgtcgggcgtacctgtatccatgttgcagacagcatggatgatggcgctgcctttttgcggtccaaacgctgtcgatcatttcttttgcgacggccctcccgtactcaagttagtgacagtggataccacaatgtacgagatgcaagccctggcatccacgctgttgttcattatgtttcctttttgcctaatattggtgtcatacacaagaatcatcatcaccatcctgcggatgtcctcggctactggtagacagaaagcattttccacatgtagctctcaccttatcgtggtttccttgttttatggcaccgcatcattaacatatctgaggcccaagtccaaccagtccccggagtccaaaaaactcgtgtccctgtcgtacacagttataaccccgatgctcaatccaataatatacggcctgaggaataacgaagtgaagggggcagtgaaaaggaccatcacgcagaaagtcctccagaaactagatgtgttctag

SEQ ID NO: 44166 - DNA, 1020 bp, Artificial Sequence
  Description of Artificial Sequence: Synthetic coding sequence
atggagaagcgggagatcaacagcgccttcggcgtgaagagccggtatcgctacctgggccctctttacgttatttatacttattaccacatcagaatcatcctgctgtttacacaggctccagacctagacctgttcccagctgccaacgtcagtatcatgggcgcaataaagctgtctcacaaccttcatacccccatgtattttttcctctgtggcctgtccttctctgagacttgtaccacagtggtcgtgatccctagaatgctcgtggattttctgtccgagagtaagacaatttctctgcccgaatgtgcaacgcagatgtttttttttcttggctttgccagcaataattgtttcatcatggccgcaatgagctatgacaggtatacggcgattcataatcccctgcagtaccatactttaatgaccagaaagatctgccttcaaatgatgatggcctcctggatggtgggcttcctgttcagtttgtgtattatagtgactgtcttcaatctgagtctgtgcgatctgaataccatccagcactatttttgtgacataagccctgttgtaagcttagcttgcaattacactttttatcacgagatggcaatattcgtattaagtgcctttgtccttgtggggtcttgcattctaattatgatctcttatgtattcatcgttttcattgttatcaagatgccatccgctaagggacgcagcaaagcttttagcacgtgcagctcacacctgacagtggtcagcattcactatgggttcgcttgttttgtatatcttcgcccaaagaactcaaatagttttgacgaggatatgcttaccgccatgatttacacgatcctgatgccacttctgaaccccatagtgtactccctccggaacaaggaaatgcagatcgcactgagaaagacgttaggcagcgtgttcggggtctttccccaaaagaccaaaaaggagccagaacacttgaaaaaactgcattcaatcgataaatag

SEQ ID NO: 44167 - DNA, 954 bp, Artificial Sequence
  Description of Artificial Sequence: Synthetic coding sequence
atgctgcggaacggcagcatcgtgaccgagttcatcctggtgggctttcagcagagcagtaccagcacacgggctctcttgtttgcgttatttttggccctttattcgctgacaatggctatgaacggcctgatcatatttattacctcttggacggaccctaaactcaatagccccatgtacttctttctggggcacttatcgctgctagacgtctgcttcattactacaaccattcctcaaatgctcatacacctggtggttagggaccacatagtgtcgtttgtttgttgtatgacacagatgtacttcgtattctgcgtgggcgttgccgaatgtattttactagctttcatggcttacgatcgatacgtggccatctgctaccctctgaattacgtccccattatctcacagaaagtctgtgtccgtctggtggggaccgcctggtttttcggattgattaatggtattttcttggaatatattagctttcgagagccattccggagagacaaccacattgagagtttcttctgcgaagcaccaatcgtaatcggactcagctgtggagatcctcagttcagcctttgggcgattttcgccgatgcgatcgtcgtgattctctcccctatggttctgacagttacctcttatgtccatatcctggccacgatcctctctaaagcatccagttcaggaagagggaagaccttctcaacctgcgcttctcacctcactgtcgtgattttcctatacacatctgcaatgttcagctacatgaatcctcattccacccatggtcctgacaaagataagcccttctcactcctctacaccattatcaccccaatgtgtaacccaattatctactccttcaggaacaaggagatcaaggaggcgatggtgcgtgcactcgggcggactcggctggcccaaccccagagcgtatag

SEQ ID NO: 44168 - DNA, 906 bp, Artificial Sequence
  Description of Artificial Sequence: Synthetic coding sequence
atggagttcgtgctgctgggcttcagcgacatccccaacctgcactggatgttattctcgatcttcctcctgatgtacctgatgatcctcatgtgcaatgggatcatcattttactcatcaaaatccacccggcactgcagacaccgatgtatttcttcctgagcaacttttctctgctcgagatctgctacgtaaccataataatcccccgaatgctcatggacatttggacacagaagggcaacatctccctatttgcgtgtgccacacagatgtgttttttcctcatgctgggggggacggagtgcttgttactgacagtcatggcctacgacagatatgtcgccatctgtaagccattgcaatatcctctggtaatgaatcacaaagtgtgtattcaacttatcatagctagctggaccattacaatccccgtcgtgatcggggagacgtgccagatatttcttttgcccttctgcggcacaaacaccataaatcattttttttgtgacatccccccaatcttgaagttggcatgtgggaacatcttcgtcaatgagattaccgtgcacgtggtggctgtcgtatttattacagtcccctttttgctcattgtggttagttacggcaagattattagtaacattctgaaattgtcttccgcccgtggcaaggccaaggcattttctacttgctcctctcacctgatcgtggtgatcttattcttcggcgccgggactataacttacttgcagcctaagccgcaccaatttcagaggatggggaagctgatttcactgttttacacaatattgatccccactcttaatcctataatttacactctacgcaataaggacatcatggtggctctgcgaaagttacttgcgaaactgctgacgtag

SEQ ID NO: 44169 - DNA, 939 bp, Artificial Sequence
  Description of Artificial Sequence: Synthetic coding sequence
atgagcgccaacaccagcatggtgaccgagttcctgctgctgggcttctcccatttagccgatctgcagggtctactgttcagtgtctttctcacaatctacttattaaccgtggccggcaatttcctgatcgtggtactggtatctaccgacgctgccttacagtctccaatgtactttttcttacgcacgttatccgccttagaaatcgggtatacttcagtcacagtgcccctgctcctccaccacctgctgactggtagaagacatatttcccgctctggttgcgcccttcagatgttttttttcttattttttggggccaccgaatgctgcctcctggcagctatggcctacgatcggtacgctgctatatgtgagccgctgcgatacccccttttgctgtcccacagggtgtgtctacagctcgcagggtccgcgtgggcatgcggtgtccttgtcggactagggcacactccattcattttttccctccccttttgcggtccaaatacgattccccaattcttctgcgagatccagccggtcctacagttagtttgcggagatacctccttaaatgagttgcagataattctggcaactgctctcctgattctgtgcccgttcggattaattcttggcagctatggcaggatactggtcaccatatttcgtattccatctgtggctggccgccgcaaagctttcagtacttgtagctcccatctcatcatggtgtcactgttttatggtaccgccttgttcatttatattcggcctaaggcttcttatgaccccgcaactgaccctttggtgtccctgttttacgctgttgtaactcccatacttaatccaattatctattcactcagaaacaccgaagtgaaagcagcgctgaagcgaactatacagaagaccgtgcccatggaaatctag

SEQ ID NO: 44170 - DNA, 939 bp, Artificial Sequence
  Description of Artificial Sequence: Synthetic coding sequence
atgagcgccaacaccagcatggtgaccgagttcctgctgctgggcttctcgcacctggccgacctgcaaggcctcttatttagcgtgtttttgaccatctacttactcacagttgccggcaacttcttgattgttgtgctggtgagtaccgacgccgcgctacagagtccgatgtactttttcttgagaactctgagcgctctcgagatcggatacacatcagtaactgtcccccttctgcttcatcatctcctgacagggagaagacacatctcacgttctggctgtgccctgcagatgttctttttcctgttctttggtgccactgagtgttgcctgttagccgccatggcgtacgacagatacgccgcaatttgcgagcccttgcgatatcccctcctgcttagtcacagggtatgcctacaactcgcgggatctgcttgggcctgtggggtgctcgtcggcctgggacacacaccgtttattttttcactgcccttctgcgggccaaatacaattcctcagttcttctgtgagattcagccagtcctgcagctcgtgtgtggcgatacgtcactgaatgagctgcagattatcctagcaacagctctcttaatactgtgcccctttggtttgattcttggatcttatgggcggatcctagttacaatcttcaggattccttccgttgcaggacgccggaaagcctttagcacgtgttctagtcatctgattatggtctccctgttttacggcaccgcattattcatctacatccgccctaaggcttcttacgatccggccaccgacccactcgtaagcctattctatgctgtggtgacaccaattctaaatcctattatctactcccttcgaaatacagaggtgaaggcggctctcaagaggaccattcaaaagacagtcccgatggagatctag

SEQ ID NO: 44171 - DNA, 939 bp, Artificial Sequence
  Description of Artificial Sequence: Synthetic coding sequence
atgagcgccaacaccagcatggtgaccgagttcctgctgctgggcttttctcatctggctgatcttcagggcctgctcttctcagtcttcttgacaatttatctactaactgtcgccggcaactttctgattgtcgtccttgtaagcacggacgccgcactccaatcacccatgtatctgttcctcagaacgcttagcgctttagagattggttacacatcagtaaccgtccctttgctgttacaccacttgttaaccggacggcggcacatttcaaggtctggatgcgctctgcagatgtttttcttcctttttttcggcgccacagagtgttgcctccttgcggcaatggcatatgaccgttacgctgccatttgcgagcccctgcgttaccctctcctcctgtctcatcgcgtgtgtctgcagctggcaggatccgcatgggcgtgtggggtgctggttggtttgggtcacaccccatttatcttcagcctccctttctgcggccctaacaccatccagcagtttttttgcgagatccaacctgttttgcaactggtttgcggagacacctccctgaacgaactgcagattatcctggccaccgccctgttgatcctgtgcccattcgggttgatccttggtagttacggtagaatcctcgtaaccatcttccggattccctctgtggccggtaggcgcaaagcgttcagcacttgcagtagccatctcatcgtggtctccctgttttatggcactgcgctcttcatctacattaggcctaaagctagctacgatcctgctactgatcccctcgtctctctgttttacgctgtagtcactcctatcctgaacccaattatttattcgttacgcaataccgaagttaaagcagctctgaagaggactattcagaagactgtcccaatggagatttag

SEQ ID NO: 44172 - DNA, 939 bp, Artificial Sequence
  Description of Artificial Sequence: Synthetic coding sequence
atgagcgccaacaccagcatggtgaccgagttcctgctgctgggctttagtcacctggccgacctgcagggcctcctattttccgtgtttctaactatctaccttctgacagtggctggcaactttttaatcgtcgtgctggtctcaactgacgccgctctgcagagtccaatgtacttcttcttgagaaccctcagcgcattggagattggatataccagcgtcaccgttcctctgctgttacaccacctgctcaccggccgccgccatattagcagatcaggttgtgcactgcagatgttcttctttcttttttttggtgccacagaatgttgtctccttgccgctatggcatatgatcggtatgccgcaatctgtgagccacttcgctacccactgttgctgagtcaccgcgtttgcctgcagttggcggggagcgcttgggcttgcggcgtccttgtcggcctggggcataccccattcattttttccctcccattctgcgggcccaacaccatcccacaatttttttgtgagatccagccggtgctccagctggtatgcggtgatactagtctgaatgaactgcagattatcttggccacggcgttgctgatcctgtgtccattcgggctgattctaggaagctacggccgcatactggtaaccatctttaggatccctagcgtggctggtcggcggaaagctttctcaacatgcagctcacatctcattgtggtgtccctgttctatgggaccgccctctttatttacattcgacctaaggcaagttatgatccagccacagatcccctcgtgtccctgttctacgcagtggtgacccctatccttaatcctatcatctacagcttgagaaacacagaggtcaaggcagccctgaagcggacaattcagaagactgttccaatggagatttag

SEQ ID NO: 44173 - DNA, 939 bp, Artificial Sequence
  Description of Artificial Sequence: Synthetic coding sequence
atgagcgccaacaccagcatggtgaccgagttcctgctgctgggcttttctcatttggcggatctgcagggactgttattttcagtcttcctgaccatatatcttctgaccgttgctgggaatttcctcatcgttgtgttggtttccactgatgccgcgctgcagagtcccatgtatttcttcctgcggaccctcagtgcactagagatcggatatacctccgtgaccgtgccactcctgttacaccatctgctcactggtaggagacatatttcccggtcaggctgcgccctgcagatgtttttttttctgtttttcggcgcaaccgaatgctgcttgctggctgctatggcttatgatcggtatgctgctatatgtgagccactaagataccccctgctgctcagtcatagggtttgtctgcagctggctggctccgcctgggcttgtggtgtactggtgggactgggtcacacccctttcatcttctcactcccgttctgcggccctaacacgatcccccagttcttttgcgagatccaacctgtgctccaactggtctgtggtgacaccagtctaaacgagctacagattatccttgcaaccgccctgctgattctctgtccttttggccttattttaggctcttacggtagaattctcgtgacgatatttcgaataccaagtgtcgccggcagacgtaaagccttcagcacctgtagttctcatctgatcatggttagcctgttttacgggaccgccctgtttatctatattcggccgaaagcatcctacgatcctgccaccgatcccctcgtatctcttttttacgctgtggttactcctattctcaacccgattatttatagcctacgtaatactgaagtgaaggccgccctgaagaggactatacagaagactgtgcccatggaaatatag

SEQ ID NO: 44174 - DNA, 939 bp, Artificial Sequence
  Description of Artificial Sequence: Synthetic coding sequence
atgagcgccaacaccagcatggtgaccgagttcctgctgctgggctttagtcacttagctgatctacaaggtttgctgttctctgtgtttctgaccatctacctgctgacagtcgccggaaattttctgatagttgtgttggtgtctaccgatgcggccctccaatcaccaatgtatttctttttacggacactgagtgccctggagattgggtacacttctgtgacagtgcccctcctcctgcaccacctcctgaccggtaggcggcatatctctcgatccgggtgcgccttgcagatgttctttttcctctttttcggagccaccgaatgttgcctgttggccgcaatggcctacgaccgttatgcggcaatttgcgagcccttgcgctaccccctgctgctctcgcatcgtgtttgccttcaattagccggaagcgcttgggcatgcggagtactggttgggttaggtcacacccccttcattttttcattacccttttgtgggcccaacaccatccctcagtttttttgtgagattcaacctgtcctgcaactggtctgtggtgacacttctctcaatgaacttcagataattctcgctaccgccttattgatactttgtccctttggcctgatcctcggctcttatggtcggatactagtgacaatcttccgtatacctagcgtggcaggacgtcgtaaagctttcagcacttgtagctcacacttaattgtggtcagtcttttttatgggactgctctgttcatttatatccggccgaaggcatcctatgacccagcgaccgatccactggtgtcactgttctacgctgtggtcacgcctattctgaatccaataatctactcccttagaaatactgaagtaaaggcagccctgaagcgcactatccagaaaacagtacccatggagatctag

SEQ ID NO: 44175 - DNA, 939 bp, Artificial Sequence
  Description of Artificial Sequence: Synthetic coding sequence
atgagcgccaacaccagcatggtgaccgagttcctgctgctgggctttagccatctggcggatttacagggtttattattctctgtctttttgactatttatctgcttacggtggccgggaacttcctgatcgtggtgcttgtatccactgatgcagccctgcagagccccatgtatttcttcttaaggaccctgagcgcgctggagatcggctatacttctgttaccgttcctttgttgcttcaccacttgttgaccggacggcgtcatatctctcgtagtggctgcgctctccagatgtttttctttctgttttttggggccaccgaatgctgcttgcttgccgcaatggcttacgaccgatacgccgcgatttgcgagccgcttcggtaccctctgctgctttctcaccgcgtctgcttacagcttgccgggagtgcatgggcctgtggagtgctggtagggcttggacatactccctttattttctctctgccattttgtggccccaacacaatcccccaattcttctgtgagattcagccagtgctgcagttagtctgtggggacacctccctgaacgagctgcaaattatattggcgacagcgctgctgattttatgcccgtttgggctaattttgggatcttacggacggattttggtcacaatctttagaattccatccgttgcaggacgaagaaaggctttctctacatgctctagccatctgatcgtcgtctcgctcttctacggaacggctctgtttatctacatacgaccaaaggctagctacgacccagccacagatccactcgtgtcgctgttctacgccgtcgttacacccatcttgaatccaattatttacagcctcaggaataccgaggtgaaggccgctctgaaacgcactattcagaagacagtgcccatggaaatttag

SEQ ID NO: 44176 - DNA, 939 bp, Artificial Sequence
  Description of Artificial Sequence: Synthetic coding sequence
atgagcgccaacaccagcatggtgaccgagttcctgctgctgggcttcagccatctagccgatctgcagggattgctgttctctgtgtttcttaccatttacttactcactgtggcaggtaactttctaattgttgtcctggtgagcaccgatgcagctctgcagagcccaatgtacttctttctgaggacactgtcagctctggaaatcgggtacacaagtgtcaccgtaccactgctcctgcaccacttactgacgggacgcagacacatatcaagatctggctgtgccctgcaaatgttcttcttccttttcttcggagcaacagagtgctgcctgctcgctgctatggcttacgacaggtacgctgccatatgtgaaccgttaagatatcccttgctactgagtcatcgcgtctgcctgcagttagcaggatccgcttgggcctgcggtgtgctggttgggctaggacatactccctttatcttttccctccctttttgtggtcctaatacaatacctcaattcttctgcgagatccagccggttctgcagctggtctgtggcgatacttctctcaacgaactgcagatcatactggcaacggccctgctaatcctgtgtccatttgggctaattctgggttcgtacgggcgaattctggtgaccatcttcagaattccgtctgtagcaggaaggagaaaggcttttagcacatgttcgtctcacctgatcgtagtgtctttgttctatggaaccgctttgttcatatacattagacccaaagctagttacgaccctgcgacagacccactcgtttccctgttctatgcagttgtcacacctatcctgaatcccattatatactccctgagaaatacagaagtgaaagcagccttgaagagaacgatacaaaagaccgtccccatggaaatctag

SEQ ID NO: 44177 - DNA, 888 bp, Artificial Sequence
  Description of Artificial Sequence: Synthetic coding sequence
agcgtgaccgagttcctgctgctgggcgtgaccgacatccaggagctacagccatttctctttgtcgtttttcttaccatttacttcatctctgtcgctggcaacggcgctatcctaatgattgtgattagcgatcctcggctgcatagccctatgtacttctttttgggcaacctcagttgccttgatatttgctattcctcggtgacactcccgaagatgcttcaaaactttctgagcgcccataaaatctctcgcagcggctgcgctctccagatgttttttttcctattttttggggccaccgaatgttgtctactcgctgccatggcatatgataggtacgctgccatttgcgagccattgagatatcctctgctacttagccatagagtgtgcttgcaattagccggctccgcttgggcctgtggcgttctcgtgggtctgggacataccccgtttattttcagcctgccgttctgtggccccaatacgatcccccagttcttttgcgaaatacagccagtcctccagcttgtgtgcggggatactagtcttaatgaacttcagataatactagccaccgccctgctgatcttatgccccttcggactcattctcggctcctacggccgcattctcgtcaccatttttcgaattccatccgtggcggggagaagaaaggccttctctacctgttcttcccacctgattatggtaagtctgttttatgggacagccctctttatctacatcagaccaaaagcctcctacgaccccgccaccgacccattggtgagtctcttttatgctgtggtgacacccatcttaaatcccattatttatagcctccgcaacacggaagtcaaagccgccctgaaacggtag

SEQ ID NO: 44178 - DNA, 888 bp, Artificial Sequence
  Description of Artificial Sequence: Synthetic coding sequence
agcgtgaccgagttcctgctgctgggcgtgaccgacatccaggagttacagccttttctgttcgtggtgtttttgaccatctacttcatcagtgttgcgggcaacggggctattttaatgatcgtgatctccgacccgaggctgcattcaccaatgtatttcttcttgggcaacctgagctgccttgatatctgttactccagcgtcaccctgcctaaaatgttgcaaaacttcttatccgcacataagatctcaagatcaggctgtgcgttgcaaatgttcttctttctgttttttggagctacagaatgctgcttattggctgcaatggcttacgatcgctacgcagcaatttgtgagcctctcaggtaccccctacttctctctcacagggtatgtttacagctggcagggtcggcttgggcgtgcggcgtactcgttggacttggacacactcccttcattttttccctaccgttttgcgggccaaacacaatcccccagtttttctgtgagatacaacctgtactacagcttgtctgcggagatacatcactgaatgagctccagatcatcctggctaccgctctgctgattctctgtccatttgggctgatcttgggatcctacggtaggattctcgtaacaattttcagaatcccaagtgtggcggggcggagaaaagcctttagtacttgctccagccatctaatcatggtcagcctattttatggtaccgcacttttcatctacattaggccgaaagcaagctacgatcctgctaccgatcccttggtgtccttattttatgcagttgttacccctattctgaatcctatcatctattcactcaggaataccgaagtgaaagctgccctgaaaaggtag

SEQ ID NO: 44179 - DNA, 888 bp, Artificial Sequence
  Description of Artificial Sequence: Synthetic coding sequence
agcgtgaccgagttcctgctgctgggcgtgaccgacatccaggagctacagccctttttatttgtggtgttcctgaccatttacttcatctctgtggccggtaatggcgcgatcttgatgatcgtgatttctgacccccgattacatagccctatgtatttttttttggggaaccttagttgtctggacatatgctactcttctgtgactctgcccaagatgctgcaaaatttccttagcgcccataaaataagcaggagcggttgtgcattacagatgttttttttcttgttctttggcgccactgaatgttgtttactagctgctatggcttacgatcgctacgctgctatctgcgagcctttgcgctaccctctgctcctgagccaccgggtctgcctccagctagcaggctcagcttgggcatgcggcgtgttggtgggattgggccacactccgttcatcttttcactgcctttctgcggccctaatacaatacagcaattcttttgcgagattcaaccagtgctgcagctcgtatgcggcgacacctccctcaatgagctgcagatcatactggctactgcattactgatactgtgccctttcggactcatcctcggctcttacggacggatactggtgacaatcttcagaataccctctgtggcgggtcgcaggaaggctttcagtacctgtagcagtcatctgatagtggtttccctgttttatggcactgcccttttcatttacatccggcccaaagctagctatgacccagcaactgaccccctggtttcactgttttatgccgtggttactcctattctgaatcctattatctactccctgaggaacacagaagttaaggcggcactcaagcgctag

SEQ ID NO: 44180 - DNA, 888 bp, Artificial Sequence
  Description of Artificial Sequence: Synthetic coding sequence
agcgtgaccgagttcctgctgctgggcgtgaccgacatccaggagctccagcctttcctatttgtcgtctttttgaccatctacttcatatccgtagccgggaatggcgccattctcatgatcgttatcagcgatcccaggctccactcgcccatgtatttcttcctgggcaacctgagctgtctggatatttgctatagttctgtgacactgcctaagatgttgcagaacttcctgagtgcacataaaatttcaagaagcggctgtgctctgcagatgttcttctttcttttttttggggctaccgagtgctgccttctggctgccatggcttacgatcgttatgcagccatctgcgaacccttgcgttaccctctgctgctgtcccatagggtttgtttgcagcttgcaggttctgcatgggcatgcggcgtgctggtcggccttgggcatacaccttttatattctctctacctttctgcggccctaatacgattcctcagttcttctgtgaaatacaacccgtactccagttagtttgcggggacacgtcactgaatgagttgcagatcattttagcaactgcactgctgatactctgtccttttggtctgatattaggatcctacggtagaattctggttaccatcttccggataccatccgtagctggccgcaggaaggccttcagtacctgttcttcccatttgattgtggttagcctgttctacgggacagctctttttatatatattcgacctaaggcctcgtacgaccccgccacagatccgcttgtctctctgttttatgctgtggtgaccccaatcctgaaccctattatctatagcttgcgtaacaccgaagttaaggccgcgctaaagcgctag

SEQ ID NO: 44181 - DNA, 915 bp, Artificial Sequence
  Description of Artificial Sequence: Synthetic coding sequence
gagcggatgagcgccaacaccagcatggtgaccgagttcctgctgctgggtttctcccatctggctgatctgcaggggctcctgttttcagttttcctcacaatctatttactgacagttgccggtaatttccttatcgtggtgttagtcagtactgacgctgctctgcagtctccaatgtatttctttctgagaaccctgagcgcactggagataggctacaccagtgtgaccgtcccactgctgcttcatcacctgctgactgggcggaggcacatcagcagatccggctgtgccttgcagatgtttttctttctgttttttggagccaccgaatgctgcctactcgctgcaatggcatacgatagatacgcggcaatctgtgagccactgagatacccactgttgctgtcccatagagtgtgtctgcagctggccggctctgcatgggcctgcggagtgctagtgggattagggcacaccccctttattttcagccttccgttctgtggtcccaacaccataccacagttcttttgcgaaatacagcctgtcctgcagcttgtttgtggggatacgtctctcaatgaattgcagattatactcgccacggctctcctgatactctgtcctttcgggttaattctgggcagctatggacggatactggtgactatcttccggatccccagcgtggcgggaagaagaaaggcattcagcacttgctctagccacctgatagtggtcagcctgttttatgggacagccctgttcatttacatacggccaaaggccagctatgatccggctaccgacccactggtgagtctcttctacgcagttgttactccgatcctaaatccaatcatttacagcttgcggaacactgaagtgaaggccgctttgaagaggtag

SEQ ID NO: 44182 - DNA, 888 bp, Artificial Sequence
  Description of Artificial Sequence: Synthetic coding sequence
agcgtgaccgagttcctgctgctgggcgtgaccgacatccaggagctgcagccatttctcttcgtggttttcctgactatatactttatcagcgtggcagggaacggtgccattcttatgatagtgatttctgatccacgcttgcattcccctatgtacttttttctggggaatctttcatgtctggatatatgttactcaagcgttacactccccaagatgcttcagaatttcctgtccgctcacaagataagccgctctggatgcgccctgcagatgttcttctttctgttcttcggagccaccgagtgctgtctcctggccgctatggcttatgacaggtacgcagcgatatgcgaacctctgagataccctcttctgctgagtcatcgtgtgtgtctccagctggccggatccgcttgggcttgcggtgtgctggttgggttaggccacactccttttatcttctcattgccattctgtggccccaatacgatcccacagttcttttgtgaaatccagcccgtgctgcagctcgtttgtggcgacacatctcttaatgaacttcagataatattggccaccgccctgcttattttgtgcccgtttggactgatcctgggaagctatggaagaattctggtcactatctttcggattccatctgtggcaggacggcgaaaagcgttttccacgtgttctagtcatttgatcgtagtgtctcttttttatggcaccgctttgttcatttacattcgacctaaagcatcttacgacccggcaaccgacccactcgtctcactcttctacgcagtggtcacccctatcctgaatcccatcatctactctctcaggaatactgaagtgaaagcagcgctgaaacggtag

SEQ ID NO: 44183 - DNA, 888 bp, Artificial Sequence
  Description of Artificial Sequence: Synthetic coding sequence
agcgtgaccgagttcctgctgctgggcgtgaccgacatccaggagctgcagccctttctttttgttgtattcctaactatatactttattagcgttgccggtaatggcgccatactgatgattgtgatcagtgaccctcgactgcatagccctatgtatttcttcctgggcaacctgagctgtctggatatatgctactctagcgtcacacttcccaaaatgctgcagaatttcttgtcagcccacaagatttctaggtctggttgcgccctacagatgtttttcttcttgtttttcggtgccaccgagtgctgtctccttgcggctatggcatatgacaggtacgcagcaatatgtgaacccctgcgttatcctctcctgctctcgcacagagtctgtttacaattggccggcagtgcatgggcttgcggggtgctagtgggtctcggtcataccccattcatcttcagtttgccattctgcggtccaaacactatcccgcagttcttctgtgagatacagcctgtcctccaattggtttgtggcgacacgtccctcaacgagctgcaaatcatcctagccacagccctgctgattctgtgccctttcggacttatcctgggaagctatggtcgcatcctcgttaccatctttaggatcccatcagtggctggaagaaggaaagcattttccacgtgttccagccatctcattgttgtgagcctattttacggtacagcactttttatttatatccgtcctaaggcctcttacgacccagccacggacccattggtatctttattctacgccgtggtgacaccaatcctcaatcctattatatacagtctacgcaacaccgaagttaaagccgctttaaaaagatag

SEQ ID NO: 44184 - DNA, 939 bp, Artificial Sequence
  Description of Artificial Sequence: Synthetic coding sequence
atggaggtgaagaactgctgcatggtgaccgagttcatcctgctggggatcccacatacagagggtttggaaatgacgctctttgtgctattccttcctttctacgcatgcacccttctgggaaatgtcagtatcttggtggccgtgatgtccagcgccaggttacacacgccaatgtatttcttcctgggcaatctgtctgtgttcgatatgggcttctcatccgtaacgtgtcccaaaatgctcctctatcttatgggcctttccagattgatcagttataaggactgcgtctgtcagctgtttttttttcatttcttagggtccatcgaatgctttctgttcacagtcatggcctacgacaggtttactgccatttgttaccctctaaggtataccgtcattatgaatcctaggatatgtgtagccctcgcagtgggcacctggcttctcggctgtattcattcgagcatattgaccagcttaacgttcaccttgccctactgcggccctaacgaggttgaccacttcttctgtgacatccctgctttactacccctggcgtgcgccgatacatctctcgctcagcgcgtgtctttcacaaatgtggggctcatcagtctggtttgtttcctgctgatacttctcagttacacacggattactatctcaatcctgtccatccgcacgaccgaggggaggcgcagggcattctccacctgcagtgcacatctgatcgcgatcctttgcgcctacggtcccatcattactgtgtatctgcagcccacgccgaacccgatgctgggcacagtggtgcagatcctcatgaatctcgtggggccaatgctgaaccctctcatttacacgctgcggaacaaagaagtaaagacagcacttaagacaattctgcatcgtacaggccacgtgccagaatcctag

SEQ ID NO: 44185 - DNA, 933 bp, Artificial Sequence
  Description of Artificial Sequence: Synthetic coding sequence
atgggcaagaccaagaacaccagcctggacgccgtggtgaccgacttcattctgttgggtctgtcccatccccctaacctccgcagcctgctgttcttggttttttttatcatttatatcctaactcagctgggaaatctgctgatactgctaactatgtgggctgaccctaaactatgcgccaggccaatgtacattctgctgggagtgcttagctttctcgatatgtggctctctagtgtgaccgtcccaagactgattctggattttactccctcaataaaggctatccccttcggtggatgtgtagcacagttatacttttttcatttccttggttccacgcagtgctttctgtacacactgatggcctacgaccgctacctggcgatttgtcagcctctgcactacccagtgctcatgaacggccgcctatgcacggtcctggttgctggagcatgggtggcaggcagcatgcacgggtccatccaggccactctgacttttcgccttccttactgcggacccaaccaggttgactacttcatatgtgacattcgggctgtgctccggctcgcatgcgctgacacaactgtaaatgagctggtgactttcgtagatgtgcgggtggtcgcagctagctgtttcatgctgatcctcctgagttatgcaaacattgttcatgccatcttaaagatacgcaccgctgacggtaggcggcgagcgttctctacttgcgggtcacatctaattgtggtgaccgtatactacgttccttgcatcttcatttacttgagggccggatctaaagatcctttagacggcgctgctgcagtattctatacagtggtaacccctctgctgaacccattaatctacaccttgagaaatcaagaagtgaaatctgcattgaagcggattacggcaggctag

SEQ ID NO: 44186 - DNA, 942 bp, Artificial Sequence
  Description of Artificial Sequence: Synthetic coding sequence
atggagcggatcaacagcaccctgctgaccgccttcatcctgaccggaatcccctatcctctgaggctgcgaactctcttctttgtgttcttcttcttaatttatatccttacgcaactggggaatcttttgatcctgattaccgtgtgggcagatccaaggctgcacgctcgccctatgtacatcttcctcggcgtgctctccgtgattgacatgtcaatttcctctataattgtgccacgtctgatgatgaacttcaccttaggcgtcaagcccatcccttttggaggctgtgtggcacagctgtacttttaccatttcttaggatccactcagtgctttctctatacactcatggcctacgaccgctatttggcgatttgtcaaccgctaaggtacccggttcttatgacagccaagttgagtgccctgctggtggctggagcctggatggctggttcaatacacggagctcttcaggcaattttgactttccgcttaccctattgcggcccaaatcaggttgactatttcttttgtgacattcctgccgtgctgcgactggcttgtgctgacacgactgtgaatgaactcgtgacattcgtcgacatcggcgttgttgtcgcgtcttgtttttctctgatactgctctcctacatccagataattcaggccatactgcgcattcataccgcggatggccgccggcgcgccttctcaacatgcggggcacatgtgacagtggtgaccgtttattacgtgccctgcgcctttatatatctgaggcccgagactaactcccccctggacggggccgcggcactggtccctacagctataactccattcctgaacccccttatctatactctgcggaatcaggaggtcaagcttgctctgaaaaggatgctgcggagcccccggacccctagtgaggtatag

SEQ ID NO: 44187 - DNA, 936 bp, Artificial Sequence
  Description of Artificial Sequence: Synthetic coding sequence
atgagcaacgccagcctggtgaccgccttcatcctgaccggcctgccacatgcccctggtttggatgctctgctgtttgggatattcctggtggtgtatgtgctcaccgtactgggtaatctgctcattctgctggttatccgcgtcgatagccatctgcacacgcctatgtattatttcctcacaaatctgtctttcatcgatatgtggtttagtaccgtaactgttcccaagatgcttatgacactcgtgagcccctcaggcagggcgattagttttcacagctgtgttgcccagctttacttcttccatttccttggatcgaccgagtgtttcctgtatactgtaatgtcttatgatcggtatctcgcgatatcttaccctcttagatacacttccatgatgtccggctcccgttgtgcgcttctagccactgggacttggctgagcggaagcttgcattcagccgtgcaaactatactgactttccacctaccatactgcggacccaaccaaatacaacattacttttgtgatgcaccgcccatcctcaagctggcatgtgcggacacctctgccaatgtgatggtgatcttcgttgacatcggcattgttgctagcgggtgttttgtactcattgttctgtcttacgttagcattgtgtgcagtattctgagaattagaacctccgacggcagaagacgcgcatttcagacgtgcgcaagccattgcatagttgtcctgtgctttttcgtcccctgcgttgtgatttatctccgccctggcagcatggatgccatggacggcgtggtggccattttttacaccgtcctgacacccctcctaaaccccgtggtctatacattgaggaacaaggaggtgaaaaaagcagtcctgaagctgcgagacaaggtggctcatccacagcgcaaatag

SEQ ID NO: 44188 - DNA, 936 bp, Artificial Sequence
  Description of Artificial Sequence: Synthetic coding sequence
atgagcaacgccaccctgctgaccgccttcatcctgaccggcctgccacatgcccccgggctggatgcaccacttttcggtatctttctggtggtgtatgtgctgaccgtactggggaacttactgatcctgctggtcatcagagtggacagccacctgcacacccccatgtactattttctgacaaacctgagttttatcgatatgtggttctctacagtaactgtgcccaagatgttgatgacccttgtgtcacctagcggacgaacaataagcttccattcatgtgtggcccagttatacttttttcatttcctgggttccactgaatgtttcctatacaccgttatgagctacgatcgttacctggcgatctcatatcctcttcgatatactaacatgatgaccggacgatcatgcgcattgttagctacgggaacctggctgtcagggtcactgcactcagcagtacagaccatattgacatttcacttgccatactgcggccctaaccagattcaacattatttttgcgacgcaccaccaattctcaagctagcctgtgccgatacttctgctaacgagatggtgatttttgtgaacatcggcctggtcgcctccggttgctttgtgctgatcgtcctgtcgtatgtgtccattgtgtgttcaatccttcggatacgaacttccgaaggacggcaccgagcttttcagacctgcgcctcccactgtattgtagtcctgtgcttctttggcccaggattgttcatctacctgaggcctggttctagagacgcattacacggagtggtggccgttttttataccacactcacgcccctgtttaatccagtggtgtatactctccgtaataaggaggttaaaaaagccctgttgaaactgaagaatgggagcgtctttgcccaaggggaatag

SEQ ID NO: 44189 - DNA, 936 bp, Artificial Sequence
  Description of Artificial Sequence: Synthetic coding sequence
atgagcaacgccagcctgctgaccgccttcatcctgatgggcctgccacatgcccctgccctggacgcacctttatttggcgtcttcttggtggtttacgtgctcaccgtcttgggcaacctcctgatactgctcgtcataagagtggattctcacctgcacactaccatgtactattttcttaccaatctctcattcattgatatgtggttctccaccgtcaccgtcccaaaactgctgatgactctggtcttcccctctggtagagccatcagtttccatagttgcatggcacagctctacttctttcatttcctaggtggcaccgaatgtttcctgtatcgggtgatgagctgtgaccggtacttggccatctcttatccactgcggtatacttccatgatgactgggcggtcctgtacacttttagcaacgagtacctggctgtccgggagcctccactccgccgtacaagccatacttactttccatcttccgtactgtggacctaactggatccagcactatctgtgcgacgccccacctattctgaagctggcctgcgcagatacctccgcgatagagacagttatctttgtgacagtcggtattgtcgcctcaggttgtttcgtgctaatagtactgtcttacgttagtattgtctgttccatcctcaggattaggacttctgaaggtaagcatcgcgccttccagacatgcgccagccattgtattgtggttctctgcttctttggccctggtctcttcatctacctgagaccaggaagtcgcaaggccgttgacggcgtagtggcagtcttttacactgtcctgacaccactgcttaatccagtggtttataccctgagaaataaagaggtcaaaaaggctctgctgaagctcaaggacaaggtcgcgcattctcagtccaagtag

SEQ ID NO: 44190 - DNA, 936 bp, Artificial Sequence
  Description of Artificial Sequence: Synthetic coding sequence
atgagcaagaccagcctggtgaccgccttcatcctgaccggcctgccccatgcccctggcctcgatgcaccactcttcggaatctttctggtggtgtatgttctgactgttttgggcaacctgctgatcctgttggtgattagagtggactcacatctgcataccccgatgtactatttcctgactaatctatcgttcatagatatgtggtttagtacagtcacggtgcccaaaatgctcatgacgctggtgagccctagtggtcgcgccatctcatttcactcatgtgtggcccagctttatttcttccacttcctaggaagtactgagtgtttcttgtacaccgtaatgtcttatgacagatatctggccatctcttatccactgcgatacaccagcatgatgtcaggctctagatgcgcactgttggcaactagcacttggttgtcagggtccctgcactccgcagtgcagacaatcctcactttccacctgccgtactgcgggcctaatcaaatccagcactacctgtgtgacgccccccccatcctgaaattggcttgtgctgacacatccgccaacgagatggtcatctttgtagatatcggcttagtcgcctctggctgctttctgctgattgtactgtcctacgtgagcattgtgtgcagtattctccggatccacacttccgaaggtagacatcgtgccttccaaacgtgcgctagccattgtattgtggtcctttgctttttcgtgccttgcgtgttcatttatctcagacctggctctcgggatgtcgtcgatggagtagttgccatcttctataccgtcctcactcctttacttaatcccgtagtttacaccctcaggaataaggaagtcaagaaggccgtgttaaaacttcgagacaaggtggcacattctcaaggcgaatag

SEQ ID NO: 44191 - DNA, 957 bp, Artificial Sequence
  Description of Artificial Sequence: Synthetic coding sequence
atgcagcgggccaaccacagcaccgtgacccagttcatcctggtgggttttagcgtgtttccccacctgcagctaatgctcttcctactatttctgctgatgtaccttttcaccttgttaggaaacctgctcataatggcaacggtgtggagcgagagaagcctgcacaccccaatgtatctgttcctatgtgctctcagtgttagcgagatcctgtacacagtggccatcataccaaggatgctcgccgatttgttaagcacccaacggtcaatagcctttttggcctgcgctagtcagatgtttttctcattctcctttggcttcacccacagtttcctgcttaccgtgatgggctacgacaggtatgtggccatttgtcaccctttgcggtataatgtgctgatgagcccgagaggatgcgcttgtttggtgggctgctcctgggcgggcggcttggtcatgggtatggtagtaacctctgcgattttccaccttgctttttgcggccataaggaaatacaccactttgcatgccacgtgccaccactgctcaagctggcctgcggcgatgacgtactggtggtcgccaagggtgtagggctggtgtgcattactgctttactcggctgttttctactaatactccttagttatgccttcatagtggcagcaatcctcaaaattccatccgccgaggggagaaataaggctttctctacatgtgcaagtcacctgaccgtggtggtcgttcactacggttttgcaagtgtcatatacttaaaaccgaaatcaccacagagccttgaaggcgacacactgatgggaataacctacactgtgctgacaccttttctctccccaattattttctctctgcggaacaaggaactgaaagtggcaatgaagaaaacatttttcagtaaactgtatcctgaaaaaaatgtgatgatgtag

SEQ ID NO: 44192 - DNA, 948 bp, Artificial Sequence
  Description of Artificial Sequence: Synthetic coding sequence
atgctgggcctgaaccacaccagcatgagcgagttcatcctggtgggattttcggcgttcccacatctgcagttaatgctgtttctgttgttcctgcttatgtaccttttcactttgctcggaaatctcctgatcatggccacagtgtggtctgaaagatccctgcacacccctatgtatctgtttctctgtgtgcttagcgtgagtgaaatattatataccgtggctataatccctaggatgctggctgacctgctttctacccagcggtctatcgccttccttgcctgcgcctctcagatgttcttttccttctcattcggatttacccacagtttcctgcttacagtgatgggatatgaccgatatgtagcgatatgtcaccccctccgatacaatgttctgatgagccctagaggttgtgcctgtctggtcgggtgctcctgggccggaggctccgttatgggtatggtggtcacgagtgctattttccagctgacattttgcgggagtcacgaaattcagcatttcttatgtcatgtgccccctcttctgaagctagcttgcgggaacaatgtccccgctgtggcgttaggagttggcctcgtttgcattatggctctgcttgggtgcttcttacttattctcttgagttatgcttttatcgttgccgatatcttaaagataccatctgcagagggccggaacaaggctttcagcacttgcgcatcacacctgattgtggtgatagtacactacggttttgcctccgtgatctacctcaagcccaaaggcccccactcccaagaaggcgacaccctcatggccacaacctacgcggtgctaacaccctttttgtctcccataatattcagcctccgaaataaagagctgaaggtggcaatgaagagaacctttctgagcactctctatagcagcggcacctag

SEQ ID NO: 44193 - DNA, 951 bp, Artificial Sequence
  Description of Artificial Sequence: Synthetic coding sequence
atgcccggccagaactaccggaccatcagcgagttcatcctgagcggattcagtgcgttcccgcagcaactcttaccagtgctgtttctgttgtacctcttaatgttcctatttaccctcctggggaacctgcttattatggctaccgtgtggatcgaacgacggctgcacactcctatgtatctgttcttatgcgccctctcaattagcgaaatcctgtttaccgttgcaatcaccccccgcatgttggctgacctcctcttcactcaccgcagcattacctttgtcgcctgcgccatccaaatgtttttttcattcatgttcggatttacccacagtttccttctgatggtgatgggctacgaccactacgtgactatatgtcaccctctccactacaacatgctaatgtccccacgggggtgcgcacatctggtcgcctggacctgggccggtgggtccgtgatgggcatgatggtgacaatgatggtgttccatcttacgttttgcggatctaacgttatccaccacttcctgtgtcatgtactctcattactcaaactggcctgtggttccaagaccagcagcgtcatcatgggcgtgatgcttgtgtgcgtcactgcgcttatcggttgtcttttcctgataatcctatcctttgtgttcatagtcgccgctatattgagaatacccagtgcggaagggcgccataaaaccttcagcacgtgtgttagccatctgaccgtggtcgtcatgcactacagtttcgcctcgcttatctatctcaagcccaaagggctgcactctatgtacagtgatgcactgatggccacaacttacacagtgtttaccccctttctgtcccccattatattctcactgaggaacaaagagctgaagaatgctatcaataaaaacttttgccggagattctgccctttatctagttag

SEQ ID NO: 44194 - DNA, 951 bp, Artificial Sequence
  Description of Artificial Sequence: Synthetic coding sequence
atgcccagccagaactacagcatcatcagcgagttcaacctgttcgggttttcggcattcccccagcatctcctgccaattttgtttctcctgtatctcctcatgtttttgtttaccctgctgggcaacctgttgatcatggcaaccatctggatcgagcacagacttcacactccaatgtatctctttttatgtacactgtccgtttccgagatcctgttcacagtggccataactcctagaatgctcgcggatctgctgtctacgcatcactctattacattcgtcgcctgtgcaaaccagatgttctttagttttatgtttgggtttacacatagttttctgctgttggtgatggggtacgacagatacgtggccatctgtcatcccttacgctataacgtgttgatgtctccacgcgactgcgctcacctggtcgcgtgcacttgggccggtggcagcgtcatgggaatgatggttactacaatcgtctttcatctgaccttctgtggttcaaatgtcattcatcatttcttttgccatgttctgagcctgctgaaactggcatgtgaaaacaagaccagcagcgtgattatgggggttatgctggtgtgcgtgacagccctgattggatgcctgttcctcatcatattgagctatgttttcatagtcgctgccattctcagaattccttcagctgagggacgacacaaaactttcagtacatgtgtgtcccacctcaccgttgtggtcacgcattattcatttgccagttttatatatctgaaacccaaggggctgcattccatgtactcagacgccctcatggcaactacatacaccgtgttcacgcccttcctctctccaatcatattttctctgcggaacaaagagctgaaaaatgcgataaacaagaacttctacagaaaattttgccctccgtcttcctag

SEQ ID NO: 44195 - DNA, 948 bp, Artificial Sequence
  Description of Artificial Sequence: Synthetic coding sequence
atgcagggcctgaaccacaccagcgtgagcgagttcatcctggtgggattcagcgcttttcctcatctacagctgatgctcttcctactctttctgttgatgtacctctttaccttacttgggaatctgctcattatggccaccgtctggagtgagcgaagtttgcacatgcctatgtaccttttcctctgtgccctctcaattactgagatcctgtatacagttgccattattccccggatgctggccgatctgctttccacccaaagatctatcgcattcctggcatgcgcctcccagatgtttttctctttctctttcgggttcacccattcatttctgcttactgttatgggctatgacagatatgtagctatttgccaccctctccgttataatgtgttgatgagcctacgggggtgtacatgtagagtcggttgctcgtgggccggcggcctcgtgatgggaatggtggtcactagcgctattttccatcttgccttttgcggccataaagaaatccatcatttcttttgccatgtgccgcctctgctgaaattggcctgcggggacgacgtgctagtggtcgccaagggagtcgggctcgtatgcatcacggcactgctgggttgctttctgttaatcctgttgtcctacgccttcatcgtggccgcaattttaaagatcccatccgccgagggccggaataaagccttttctacttgcgcaagccatctgaccgtcgtggtggttcattatgggttcgccagtgtgatctaccttaaacccaaagggccccagtctcctgaaggagacacactaatggggatcacttatacagtactcaccccctttctttctcccattattttctcgctcaggaacaaggaattaaaagtcgctatgaaaaagacttgtttcaccaaactatttcctcagaactgttag

SEQ ID NO: 44196 - DNA, 963 bp, Artificial Sequence
  Description of Artificial Sequence: Synthetic coding sequence
atgctgctgtgcttccggttcggcaaccagagcatgaagcgggagaacttcacactgatcactgacttcgtattccagggcttctccagcttccacgagcaacaaatcactttgttcggcgtatttcttgcactatacatcttaaccctggctggcaatataataattgtgaccatcatccgcatggatctccatctgcatacgccaatgtacttcttcctgagcatgctaagcacttcggaaacagtctatacacttgtcatcctgcccagaatgctctcgtccttagtcggaatgagccagcccatctcattggctgggtgcgctacacaaatgttcttttttgtgacctttggtattaccaattgttttctgctaaccgcaatgggatatgacaggtacgtcgcaatctgtaacccgttgcgctatatggtgatcatgaataagagactacgtattcagctggtgttaggcgcatgttctatcggactcattgtggcaatcacacaggtcacgtcggtctttcggctgcctttttgcgcgcgcaaagtgccacatttcttctgcgacattcgccctgtgatgaaattgagttgtatcgacaccaccgtcaatgagatccttactttaatcataagcgtcctggtactggtcgtccccatgggactggtttttatcagctatgtgctgattattagcactatcttgaaaatcgctagtgttgagggtcggaagaaggcattcgcgacttgcgcgtcccatctgacggtcgtgatcgtgcactactcctgcgccagtatcgcctatcttaaacctaagagtgaaaataccagggaacacgatcagctaatctcagtcacctatacagtgatcacgccccttctcaatcctgttgtatacactttgaggaacaaagaagtaaaggatgccttatgtagagctgtaggtggtaaattctcttag

SEQ ID NO: 44197 - DNA, 990 bp, Artificial Sequence
  Description of Artificial Sequence: Synthetic coding sequence
atgcccaagctgaacagcaccttcgtgaccgagttcctgttcgagggattctcttcttttcgcagacagcataagctggtcttcttcgtggtgttcctgaccctgtacttacttaccttgtctgggaatgtaatcatcatgacaatcatacggctggaccatcacctgcacactcccatgtacttcttcctctgcatgctgtccatctccgaaacctgctataccgtggcaattattcctcacatgctctccggcctgttaaacccacatcaaccaattgctacacagtcttgtgcaacacaactcttcttctacctgacgtttggcattaacaactgcttcttgttgaccgtgatggggtacgatagatatgtcgcaatctgtaaccctttacgatacagcgtcattatggggaagcgggcttgtatacagcttgcatccgggagcctgggcatcggcctcgggatggcgatcgtgcaagtaacttctgtatttggccttccgttttgcgacgcttttgtgatcagtcatttcttctgcgacgtccggcatctgttaaagctcgcctgcaccgacacaactgtgaatgagatcatcaattttgtggtgtctgtttgtgtcctcgtccttccgatgggcctggtgttcatttcgtacgttctcatcattagtaccatcctgaagatcgccagtgctgaaggacagaagaaggcttttgcgacttgtgcatcccacctgacagtcgtgattatccactacgggtgtgccagtataatctacttaaaacctaagagtcagtcatcactcggacaggaccgactcatatccgtcacctatacccaccacagccccacagagccatgttgtgtccagcctgaggaacagggaggccagcggtgctccgcacaatctaggggggccaaaaactctgtttcgttaatgaagcgcggctgtgagggcttcagcttcgctttcatcaacatgtattag

SEQ ID NO: 44198 - DNA, 930 bp, Artificial Sequence
  Description of Artificial Sequence: Synthetic coding sequence
atgaagcggaagaacttcaccgaggtgagcgagttcatcttcctgggattctcgagcttcggcaagcaccagatcaccctgtttgtggtgttccttaccgtgtacatcttgacactggtcgccaatattatcatagtaaccatcatttgtattgaccatcatttgcacactcctatgtacttttttctgagcatgttggcctccagcgagacagtgtacaccctggtgatcgtacccaggatgctcttgagtctgattttccacaaccagccaatctctctggccggttgtgcgactcagatgttctttttcgtcatactggctaccaataactgctttcttctgactgccatgggatatgacaggtacgtggcaatttgtcgccctctccggtatacagttatcatgtctaaaggtctctgtgcacagttagtgtgtgggtcctttgggattggtttgacaatggctgtgctccacgttacagctatgttcaacctgcctttttgtggtaccgttgtggaccactttttctgtgacatttaccccgtcatgaagctgtcttgcatagatactactattaatgaaatcattaattacggggtgtcttcatttgtaatctttgtgccgatcgggctaatattcatatcctatgtgcttgtcatcagcagtatcctgcagatcgcctcagccgaaggcagaaaaaagaccttcgctacttgtgtgtctcacctgacagttgtaattgttcactgcggctgcgcctcaatagcctatctgaaacctaagtcggagtctagcattgagaaagacctcgtgctatctgtaacttacaccatcattacaccactcctgaaccccgtggtttactccctccgtaataaggaagtaaaggatgctctgtgcagggtcgtcgggcgtaacatctcctag

SEQ ID NO: 44199 - DNA, 942 bp, Artificial Sequence
  Description of Artificial Sequence: Synthetic coding sequence
atggagcaggtgaacaagaccgtggtgcgggagttcgtggtgctgggattttcgtcactcgccaggctgcagcagctgttgtttgtgattttccttctactgtacttatttacactcggaacaaacgctatcatcattagtactattgtgctggacagagcattgcataccccaatgtactttttcctggcaatactgtcctgtagcgaaatttgctatacattcgtaattgtgccgaagatgttggtcgatctgctgagtcagaaaaaaaccattagctttctggggtgtgccatccagatgttttctttcctattttttgggagtagccattcattcctccttgcggccatgggttatgatcgttacatggcaatttgcaatccgctgagatacagtgtgttgatgggacacggggtttgcatgggtttaatggctgcagcttgtgcttgtggcttcacagtgtcactggtgaccacaagcctggtattccacctcccattccattcttctaaccagcttcaccattttttctgcgatatctcgcctgttctgaaactcgcgtcgcagcacagtggcttcagtcagcttgtcattttcatgttgggcgtttttgcactggtcattccattactccttatactggtgtcatacattaggatcatctctgctattctgaaaataccatcaagcgttggtcgctataagacattcagtacttgcgcctcacatttgatcgtggtgactgtccactactcgtgtgccagctttatctacctgagacctaaaaccaactacacttcctcgcaggatactttgattagtgtgtcttatacaattttgacgcccttatttaatccaatgatctacagcctccgtaacaaagaatttaaatcagccctgaggaggaccattggacagaccttctatcccctgagttag

SEQ ID NO: 44200 - DNA, 939 bp, Artificial Sequence
  Description of Artificial Sequence: Synthetic coding sequence
atggagcgggtgaacgagaccgtggtgcgggaggtgatcttcctgggcttctcgagtttagcaagattgcagcagcttcttttcgtaatatttctgttgctgtatctgtttactttggggaccaacgcaatcatcatttcaaccattgtgctggatcgagccctgcacatcccgatgtattttttcctggcgatcctgtcatgctcagagatctgttataccttcattatcgtgcctaaaatgctggtggatcttttgtctcagaagaaaaccatttctttcctcggatgcgccatacagatgttctcctttctgtttctgggctgctctcattctttcttgcttgctgtgatgggctatgacagatatatcgcgatatgtaaccccctgaggtacagcgtacttatgggccacggggtatgcatgggcctggttgctgcagcctgcgcatgcggctttacagtggctcaaatcattacatctctggtcttccacttgcctttctatagttctaaccagctgcatcactttttttgtgatatcgcccctgtgctgaaactcgcttctcatcataaccacttctctcagatcgtgatcttcatgctgtgtacactagtgctagctatacccctgctgctcatcctggtgagctacgttcatattctgtccgccatcctgcagtttccctccactctcggacggtgcaaggccttcagtacctgtgtgtctcacctcattatcgtaacggtccattatggatgcgccagctttatatatctcagaccacagagtaactacagttcgagtcaggacgccctcatttcagtgtcttacacaattattactcccctgttcaatcctatgatctacagtctgcgtaacaaagagttcaaaagcgccctgtgcaagatcgtgcggcgtaccatctcactgctatag

SEQ ID NO: 44201 - DNA, 942 bp, Artificial Sequence
  Description of Artificial Sequence: Synthetic coding sequence
atggccggcgagaaccacaccaccctgcccgagttcctgctgctgggtttcagtgacctgaaagctctccagggtcctctcttttgggtggtgctgttagtgtacttggtgactctcctggggaatagtctgattattttgctgactcaagtatcccccgcactgcactctcctatgtacttttttctccggcaactatcagtggttgaactcttctacactactgatattgtgccaagaacgctggcaaacctaggatccccccacccacaggctatttcctttcaggggtgcgccgcccaaatgtatgttttcatcgtcctcgggataagcgaatgctgtttacttaccgccatggcctatgacaggtatgtagctatttgccagcccttgcgttactccactttgttgagcccacgggcatgcatggctatggtggggacttcgtggttgactggtattatcacggcgaccactcacgctagtcttatattttctctgccatttcgatcccacccaatcatccctcatttcttatgcgacattctgccagtcctgcgactggcaagcgctggaaagcataggtccgagatatccgtgatgacagcaacaattgtctttatcatgatccccttcagccttatcgtgacaagctacatacggattttaggcgctatcctggcaatggcctcaactcaaagccgacgaaaagtcttttccacatgttccagtcacctactggttgtgtcgctgttcttcgggacagcttctattacgtatatccgaccccaggccggctccagcgtgaccaccgaccgcgtcctctccctcttctatacggtaatcactcctatgctgaatccaattatttacacccttaggaataaggacgtgagacgggccttgagacacctggtcaagcgacagaggccaagtccttag

SEQ ID NO: 44202 - DNA, 960 bp, Artificial Sequence
  Description of Artificial Sequence: Synthetic coding sequence
atgcccgtgggcaagctggtgttcaaccagagcgagcccaccgagttcgtgttcagggctttcactacagccaccgaattccaagtcctgctgtttctgcttttcctcctgctgtacctcatgatactctgtggtaacaccgccatcatctgggtggtatgtactcattcaacccttaggacacctatgtacttcttcctgagcaatcttagttttctcgaactttgctacaccaccgtggtggtgccccttatgctaagcaatatcctcggagcacaaaagccaataagcctggcgggttgcggcgcccaaatgttctttttcgtcacgttgggcagcactgactgcttcttactggccatcatggcttatgacaggtacgtcgcaatctgtcacccgctccactatacactgattatgactagagagctgtgcactcagatgttgggaggcgctctcggactggctctcttcccttcactgcagctgactgccttgatctttactctgccgttttgtggtcaccaccaggaaatcaaccattttctctgcgacgtgcctcccgtccttcgcctcgcatgtgccgatattagggtgcaccaggccgtattgtatgtggtgtctatcctggtattaaccattccattcctgttgatctgcgtgtcgtacgtctttataacatgcgcaatcctgtcgatccggtctgccgagggcagaagacgcgctttctccacgtgttcattccatctaacggtggtgctcctgcaatatggctgctgtagcctggtgtatctgaggcctaggtcctctacctctgaagatgaggactcacagatagccctggtttatacgttcgtgacccccctgctcaatccattactgtacagtttaagaaacaaggacgtgaaaggggccctgcgcagtgcaattatccggaaggcggcatcagacgcaaactag

SEQ ID NO: 44203 - DNA, 1008 bp, Artificial Sequence
  Description of Artificial Sequence: Synthetic coding sequence
atgccccagatcctgatcttcacctacctgaacatgttctacttctttcctcccctgcaaatcctcgccgagaacctgacaatggtcacggagtttcttctgttgggctttagttctctgggcgagattcaactggccctatttgtagtgttccttttcctctacctcgtaattttgtccggcaacgtgactattattagtgtcatccacttggacaagtcgcttcacacaccaatgtactttttcttagggatcttaagcacttccgaaacattctatacctttgtcatccttcctaagatgcttattaatcttctgagcgtggctcggacgattagctttaactgctgtgccctacagatgttcttcttcttaggtttcgctatcactaattgcctgctgttgggagtcatggggtatgaccgctatgccgcgatttgtcaccctctccattatccaaccctgatgtcctggcaggtatgcggcaagttagctgctgcgtgtgctatcggcggtttcctagcaagccttaccgtggtgaacctggtcttttcacttcccttctgcagtgccaacaaggtgaatcactatttttgtgatatcagcgccgttatcctgctggcctgtactaacaccgacgtaaacgaattcgtcatcttcatctgtggagtactggtattagtggtgccttttctgttcatatgtgtttcttacctgtgcattctccgcaccatacttaaaattccctccgctgagggaagacgaaaagccttctccacatgcgcctcacatttgtcagtggtgattgtacactatgggtgcgcatctttcatctatctgcggcctacggcaaattatgtgagcaacaaagaccggttagtaacggtcacttatacaattgtgactccgttactgaatccgatggtttattcactcagaaataaggatgtgcaactggccatccggaaagttttgggcaagaaaggtagtctcaaattatacaattag

SEQ ID NO: 44204 - DNA, 996 bp, Artificial Sequence
  Description of Artificial Sequence: Synthetic coding sequence
atgaccagccggagcgtgtgcgagaagatgaccatgaccaccgagaacccaaatcagacagtggttagtcacttctttctggagggactgcggtataccgccaagcacagcagcctatttttcctgttgtttcttcttatatacagcatcactgtggccggcaatctgctaattctgctcacagtggggtctgattcgcacctcagtctccctatgtaccactttcttggacacctgtccttcttggacgcttgcctgagcactgtgactgtgcctaaagtcatggcaggcctgctcacccttgatggcaaggtgatcagcttcgaaggatgcgctgtgcagctctattgttttcacttcctcgcttcgacagaatgtttcctgtatacagtgatggcctatgacagatacttggccatctgtcagcccctgcactacccagtggcgatgaataggcgcatgtgcgccgaaatggccggtattacatgggctataggggccacccatgcagctatacacacgtcgctgactttccgcttgctctactgcggtccctgtcacattgcttatttcttctgcgacatcccaccagtgcttaaactcgcatgcaccgacaccaccatcaatgaactggtgatgctcgcatctatcggtatcgttgctgccggctgcctaatactcattgtcatctcctacatattcatagtggccgctgttctgaggataagaaccgctcaggggaggcagcgcgccttcagcccatgcaccgcccagctgacaggagtgctgctttattatgtgccccctgtgtgtatctacctccagccccgctcctctgaagccggcgccggagccccagccgtgttctacaccatcgtcacaccaatgcttaatcctttcatttatacgctccgaaacaaggaggtcaaacatgccctgcagagactcctctgctcgtcttttcgggagtccaccgccgggagtccccccccctag

SEQ ID NO: 44205 - DNA, 945 bp, Artificial Sequence
  Description of Artificial Sequence: Synthetic coding sequence
atgcggggcttcaacaagaccaccgtggtgacccagttcatcctggtcggttttagtagtctcggtgagctgcagcttctattgttcgttatcttcctgctcctgtatctgaccatcctggtcgccaatgtgaccatcatggccgtgatccgcttctcatggaccttgcatacacctatgtacgggttcctgtttattctctcatttagtgagagttgctacacattcgtgattatccctcagctgctggtccaccttttgtctgatacaaaaaccattagctttatggcctgcgccacccagctcttcttcttcttgggctttgcctgcacgaactgcctgcttatcgcagtgatgggctatgatcggtacgtcgcgatctgccaccctctccgttacacactgataatcaacaaaaggctgggcctcgagcttatcagcctttctggggctaccggcttttttatcgcactcgtggccaccaaccttatctgcgacatgcgattttgcggcccaaaccgggtgaatcactacttttgcgacatggctccagtgattaaactggcatgcacggacacacacgtcaaggagctcgccctcttcagtctgtcaatattagtgatcatggtgcccttcctgctaatcctcattagttatggattcattgtcaatacaatactgaagatccccagtgccgaagggaagaaagcttttgtgacgtgtgctagccacttgaccgtggtgttcgttcattacggatgtgcaagcatcatctatctccgtcccaaatccaaatccgcgtctgataaggaccagctcgtagctgttacttatacagtggtaactccgctcttgaacccgctcgtgtacagcctgagaaataaggaagtgaagaccgccctcaagcgcgtcttgggaatgccagtggcaacgaaaatgtcttag

SEQ ID NO: 44206 - DNA, 930 bp, Artificial Sequence
  Description of Artificial Sequence: Synthetic coding sequence
atggagggcatcaacaagaccgccaagatgcagttcttcttccggccattttcgccagatcccgaggtgcaaatgctaatctttgtggtatttctgatgatgtatcttaccagcctcggagggaatgccactatagcagtcatcgtgcagatcaaccacagcttgcacacacctatgtatttcttcctggccaatcttgcggtcctcgagattttctacacatcttctataacccccttggctctggcaaatctgctatcaatgggtaagaccccggtttcgatcaccgggtgtggcacccaaatgttcttttttgtgttcctcggtggtgccgactgtgtgttgctggtggttatggcttatgaccagtttatcgcaatctgccatccgctgcgctaccggctcatcatgagttggtcactgtgcgtggagctgttagtgggaagcttagttcttgggttcctactgtcgctgcccctgaccattctgattttccaccttcctttctgccataacgacgagatatatcacttttattgcgacatgcctgccgtgatgcgcctcgcctgtgctgatacacgcgtgcacaaaacggcgctgtatatcatctccttcattgtgttgagtataccactgtcattaatttccatcagctatgtgtttatcgtcgtagcaattcttcggattcgaagcgccgaggggcggcaacaggcatattctacatgctcaagccacattctcgtcgttctactccagtatggatgtacaagttttatttatttgtccccttcttcaagctactctcctgaaatgggcagggtggtctctgtagcttatacatttattacacccatactgaaccctctcatttactcactgcgcaacaaagagcttaaggatgccctcaggaaggccctacgcaaattctag

SEQ ID NO: 44207 - DNA, 918 bp, Artificial Sequence
  Description of Artificial Sequence: Synthetic coding sequence
atggagttcgtgttcctggcctaccccagctgccccgagctgcacattcttagctttctgggtgtgtccctcgtgtatggtttgataatcactggcaatattctcatcgttgtctctatacacacagaaacttgcctgtgcacaagcatgtactacttcttgggcagcctgagcggcattgagatatgttacaccgcggtggtggtgccccacatacttgctaacactctgcagagtgaaaaaacgattactttgctgggatgcgccacccaaatggcattttttattgctcttggcagcgccgattgcttcctgctcgcagctatggcctacgacaggtacgtggcaatttgtcatcccttgcagtatcccctgctcatgacactgacactctgtgtgcaccttgtcgtagctagcgtgattagcggtttatttttatcattgcaattagtagccttcatctttagcctgccattctgtcaggctcaaggcatagagcactttttctgtgatgttcccccagttatgcacgtggtgtgtgctcagtcacacattcacgaacagtcggttctcgtcgcagcgattctcgccattgcagttccattttttctgatcacgaccagctacacatttatcgtcgcagctcttctgaagatccactcagctgctggtcgccaccgtgcctttagcacttgctcatcgcacttgaccgtcgtgctcctccagtatggttgttgcgcctttatgtacctgtgcccctccagcagctacaacccaaagcaagataggttcataagcctggtatataccctcggtactcccttgcttaatccactcatctatgctttgcgtaattccgagatgaaaggcgctgtgggtcgagtcctgaccagaaactgtctatcccagaattcttag

SEQ ID NO: 44208 - DNA, 981 bp, Artificial Sequence
  Description of Artificial Sequence: Synthetic coding sequence
atggtgctgaacgtgtactgctgcttcttccagatcagcgacatccagacaatgaaaattaaccagactatcctcaaagagtttatcttggtaggcttctccgtgtacccgcacgtgcaaacatttctgtttgtcgtctttttctgtctgtacctgctgacgctggccggcaatctcatcattatggggctgacctgggtggacagatctcttcatacgccgatgtacttattcctgagcgcactcagtttcagcgagacttgctacactttgacaattgttcctaagatgctggaagatctgcttgcaaaggaccgtagtatttccgtgacgggctgcagtttgcaaatgtgcttcttcctggggcttggaggcaccaattgcataatcctgacactgatgggatatgacaggtttcttgccatttgtaatcccctcaggtaccccttgctcatgactaacatcgtttgcgggcagttggtggctagcgcctgtaccgctggattcttcatcagtctaaccgagaccgctttaatcttcagagattcattctgcaggccaaacctcgtgaagcattttttctgccatatgttagctgtgatccggttgtcatgcattgactccaaccatactgagtttattattaccctgatcagcgtctccggcttgcttgggacactgcttctgatcatcttaactgatgttttcattatttcaactgtgctgcgtattccatccgcagaagggaaacagaaagcattcaccacttgcgcttctcacctcactgtggtgattatccactttggatttgccagcatcgtgtacctgaaaccggaagcatctggcgacgataccctgatcgccgtgccctacaccgttataaccccgtttctctctcctattattttctcgctgcggaacaaagacatgaagaacgcgtttcgtcggatgatgggaaacaccgtggccttaaagaagtag

SEQ ID NO: 44209 - DNA, 942 bp, Artificial Sequence
  Description of Artificial Sequence: Synthetic coding sequence
atgggccagaccaacgtgaccagctggcgggacttcgtgttcctgggattctccagcagcggggagctgcagctgctactcttcgccttgtttctcagcctttatcttgtcaccctgaccagcaacgtgtttattattattgccatcaggcttgacagtcacctgcatacgcccatgtacttattcctgtctttcttaagtttctccgagacatgctatacgcttgggatcatacctcgcatgctgagcggtctggccggtggcgaccaggcaatctcatacgtggggtgtgccgcacaaatgtttttcagtgcctcctgggcctgcacaaactgcttcctgcttgccgccatgggattcgacaggtacgttgcgatctgcgctccgctgcattatgcctcccatatgaaccctactctttgcgctcagctggtcattacatcttttctcacagggtacctgttcggtctaggaatgactctagtcatttttcacctgagtttttgttccagtcatgaaatccagcatttcttctgcgacacaccacccgtgctgtctctggcctgcggtgacaccggtcccagcgagttaagaatattcatcctgagcctgctcgtcttactggtatcttttttctttattacaatttcttacgcatatatcttggcggctatcttacgaataccatccgctgaaggacagaaaaaagctttttccacttgcgcctctcatctcacagtggttataatacactacggttgcgcctcttttgtttatctgaggcccaaagccagttatagcctggagcgagatcagttgatcgccatgacatacaccgttgtaacacccctgctgaacccaatcgtgtattctctgagaaaccgcgctatacagaccgccctgcggaatgcatttcgcgggcgcctcttgggcaagggatag

SEQ ID NO: 44210 - DNA, 39 bp, Artificial Sequence; identical to SEQ ID NO: 20246
  Description of Artificial Sequence: Synthetic coding sequence

SEQ ID NO: 44211 - DNA, 948 bp, Artificial Sequence
  Description of Artificial Sequence: Synthetic coding sequence
atggagatcgtgagcaccggcaacgagaccatcaccgagttcgtgctgctcggattctatgacatccccgagcttcactttctcttttttattgtgttcacagcagtatatgtatttatcattatcggcaatatgctcataatagtggcagtggtgagctctcagcgtctgcacaagcccatgtatattttcctggcgaatttgtcttttctggatatactttacacgtcagccgtgatgccaaagatgttagagggcttcctgcaggaggccaccattagtgtcgccgggtgtctgctgcagttctttatcttcggtagtctagccaccgctgagtgcctgctcctcgctgtgatggcttatgacagataccttgctatttgttaccctctgcactacccattactgatgggcccaaggcggtacatgggcctggtggtgacgacttggttgagcggctttgtggtggacgggctcgtcgttgcactggtggcacagttaaggttttgcgggcctaatcacatagaccaattctactgtgatttcatgttgttcgtggggctggcatgtagtgaccctcgggtggcccaagtgacgactcttatcctttccgtgttttgcctcacaatccccttcggactgatcttgactagttatgcacgtattgtcgtggcggtgctcagggttccggcaggcgcctctcggaggcgcgcattcagcacatgtagctcccacctggccgtggttacgaccttctatggcaccctcatgattttctacgtcgcacccagcgccgtacacagccaattgttatccaaagtgttctccctgttgtatactgtcgtgacacccctgttcaaccctgtgatctacacgatgcggaacaaggaagtgcatcaggcactgaggaaaatactctgtatcaagcagacggaaacgctcgactag

SEQ ID NO: 44212 - DNA, 948 bp, Artificial Sequence
  Description of Artificial Sequence: Synthetic coding sequence
atggagatcgtgagcaccggcaacgagaccatcaccgagttcgtgctgctcggcttctacgatattccagagcttcacttcctgttcttcattgtgtttaccgctgtttatgtcttcattatcatcggcaatatgctcattatcgtcgcagtggtgagctctcagcggctgcataagcccatgtatatattcctggcgaatcttagctttctagatattctgtacaccagcgctgttatgcccaaaatgcttgagggttttctccaagaagccaccatttcagtggctggctgcctgttacagtttttcatcttcggttccctcgccacagccgaatgcctgctgctagctgtcatggcatacgataggtacctggctatatgctacccactgcactaccctctgctgatgggacccaggagatacatggggctggttgttactacatggctgagtggctttgtggtagacggcctggtggtggccctggttgcccagctccgtttttgcgggcccaaccatattgaccagttttactgtgatttcatgttatttgtgggtcttgcctgcagcgacccaagagtggcacaggtcaccactctgatcctgagcgtgttttgcctgaccataccgttcggtctcattctaaccagttatgccaggatagtcgtggcagtcctcagggtccccgcaggcgcgtcacgccggagagccttttccacatgcagttcccacctggccgttgtaactacattctatggaacgctgatgatcttctacgttgctccctctgcagtccactcccagctgctgtccaaagtattttccctgctgtatacagtcgtaaccccattgtttaaccccgtgatttataccatgaggaataaagaagtgcatcaggctctgcggaagatcttatgcataaagcagaccgaaacactggactag

SEQ ID NO: 44213 - DNA, 948 bp, Artificial Sequence
  Description of Artificial Sequence: Synthetic coding sequence
atggagatcgtgagcaccggcaacgagaccatcaccgagttcgtgctattgggcttctatgatatccctgaactgcacttcctgttcttcatcgttttcacagcagtctacgtgtttatcatcatcggaaacatgctaatcatcgtggccgtcgtgagttcgcagcgcctgcacaagcccatgtacattttcctcgcgaaccttagctttctcgacatcctctacacgagtgccgtcatgcccaaaatgctggagggtttcttgcaggaagccaccattagtgtcgcaggctgcctcctgcagttcttcatcttcggtagtctcgcaactgctgagtgtctactcctggccgtcatggcgtacgaccgatatctggctatttgttatccactgcattatccactgctgatgggtccacgaagatatatgggtctcgtggtgacaacatggttgtctggctttgtggtcgacggactggtcgtcgcccttgtggcccaattgagattttgcggaccaaaccacattgaccagttttattgtgatttcatgctgttcgttggcttagcctgctccgacccacgggtggctcaggtaacaactctgatcttatctgtcttctgtttgacgatcccttttggtctgattctgacctcctatgccaggatcgtcgtggccgtgttacgagtgcctgctggagcttctagaaggcgggctttttccacatgctcctcgcacctcgccgtggtgacaacattttacggcactctgatgatcttttacgtggctccatctgccgtgcacagccaactgcttagcaaagtgttcagtctgctgtatactgtggtcaccccactcttcaatcccgtgatttataccatgagaaataaggaggtgcaccaggccctgcgtaagatcctctgtatcaagcagaccgaaaccctagattag

SEQ ID NO: 44214 - DNA, 948 bp, Artificial Sequence
  Description of Artificial Sequence: Synthetic coding sequence
atggagatcgtgagcaccggcaacgagaccatcaccgagttcgtgctcctgggattttatgacatacccgagctgcactttctttttttcatcgtgtttaccgcggtgtatgtttttatcatcattggcaacatgctgatcattgtagccgtggtcagctcccagcggctacataagcctatgtatattttcttagccaatctgtcttttctggatattctttatacctctgccgtgatgccaaagatgctcgaaggtttcctgcaagaggctaccatatccgtcgctgggtgcttactgcagttcttcattttcggctcgctggccaccgcggagtgcttgctcttagctgttatggcctacgatcgctatctggcaatctgttatccattgcattacccactgcttatgggtcctcggaggtatatgggcttagtggttacaacttggctatccgggtttgtggtagatgggctcgtggtggcccttgttgcacagttaaggttctgcgggccaaatcacatcgaccagttttactgtgatttcatgttattcgtgggactcgcttgcagcgacccgagggtggcccaggtaacaaccttgattctgtctgtcttttgcctgacaattccttttggtctgatcctgacaagttatgcacgcattgtggtggcagtcctgagagttccagccggtgcaagcaggagacgtgccttctccacgtgttcctctcacctggctgtcgttacaacattctacggtactctgatgatattctacgtggcaccgagcgccgtccactcacagctcctgagtaaggtgttctctcttctgtacaccgtggtgacacctctgttcaatccagtcatctacacaatgcgtaataaggaagtgcaccaagctctacgaaagatcctgtgtataaagcagactgaaactctggactag

SEQ ID NO: 44215 - DNA, 948 bp, Artificial Sequence
  Description of Artificial Sequence: Synthetic coding sequence
atggagatcgtgagcaccggcaacgagaccatcaccgagttcgtgctactggggttctatgacatcccagaattgcactttctgtttttcattgtgtttaccgctgtgtacgtattcattatcattgggaatatgctcatcatcgtggcagtggtgtccagtcagaggctacacaaaccaatgtacattttcctggctaacctaagctttcttgacatactctacacctccgctgttatgcctaagatgttggagggattcctgcaggaggcaacgatctctgtggcgggctgccttctgcagttctttatctttggatcactcgcaacggcagaatgccttctcttagctgtgatggcctatgacagatacctcgctatctgttaccccctccattatcccctattgatgggacctagacggtatatgggcttagtggtaaccacatggctttcagggttcgttgtggacggcctcgtggtggcactggttgcccaactgcgcttctgcggtccaaaccacatcgaccaattctattgtgatttcatgctgttcgtgggtctggcctgttcagaccccagagtggcccaggtgacaacactgattttgagtgtcttttgcctgacaatcccattcggcctgatccttacatcatacgcgagaatcgttgtggccgttctgcgcgtcccagcaggggcgagtcggcgtagagctttttcgacttgctctagtcatcttgcggtggtaaccacgttttatggaacactgatgattttctacgtcgccccaagcgccgtgcatagccaactgctctctaaggtgttttccctcctgtacacagtcgtgaccccgctttttaatccagtgatctatacgatgcgcaacaaagaggtgcatcaagctcttagaaagatcttgtgcatcaagcagactgaaactctggactag

SEQ ID NO: 44216 - DNA, 948 bp, Artificial Sequence
  Description of Artificial Sequence: Synthetic coding sequence
atggagatcgtgagcaccggcaacgagaccatcaccgagttcgtgctgctgggattctatgacatacctgagttacatttcctgttctttattgtatttacggctgtgtacgtgtttatcattatcggcaacatgctgattattgttgcggtcgtgtcgtcacaacggctccataaacctatgtatatcttcttagcaaatctatcattcctggatattctatacacgagcgccgtcatgcctaagatgctggagggatttctgcaagaagccactatcagtgtggccggctgcctgttgcagttcttcatcttcggttccctggcgaccgctgaatgcctgcttctggcagtcatggcctacgaccgctacctagctatttgttacccactgcactaccccttactcatgggccctcggcgctacatgggccttgtggtgaccacgtggctaagcggttttgtggtagacggcttggtggtggcattagttgcccagctacgtttctgtggacctaaccatattgatcagttttattgcgacttcatgctgtttgtcgggctggcgtgctctgacccacgcgtggcgcaggttactacactgatcctctccgtcttttgtctgactatcccatttggtttaatactcacttcttacgcgcgaatcgtggttgctgtgctcagggttcccgcgggtgcgagccgcagacgggccttctcaacatgcagtagccacttggctgtggtaaccaccttttatggcacccttatgatcttctacgtcgctccctctgctgttcacagccagttgctatccaaagtcttcagcctcctgtatactgtggtgacacctctgttcaatcccgtgatttataccatgaggaataaagaagttcaccaggccctgcgcaagatcctctgcatcaagcaaacggagacactggactag

SEQ ID NO: 44217 - DNA, 948 bp, Artificial Sequence
  Description of Artificial Sequence: Synthetic coding sequence
atggagatcgtgagcaccggcaacgagaccatcaccgagttcgtgctcctcggcttttacgacatccccgaactacatttcctcttcttcattgtcttcacagctgtttatgttttcatcatcattgggaacatgcttatcatcgttgccgtagttagcagtcaacggcttcacaagccaatgtacattttcttagctaacttatcattccttgatatcttgtacacctcagctgtgatgcctaaaatgctggagggattcctacaggaggcgacaattagcgtggcgggttgcctcctgcagtttttcatcttcggttccctagccacagcagaatgcttactgcttgccgtaatggcgtatgacagatacttagcaatctgttatcccctgcactatcctcttctgatgggccctaggaggtacatggggctggtggtgactacgtggctgtcaggcttcgtggtcgatggactggtcgttgcactggttgcacaactcaggttttgtggccccaaccacattgaccaattttactgtgacttcatgctcttcgtgggtctcgcttgttccgaccctagggtggcacaagtcaccactctgatcctgtcagtattctgcctcactatcccttttgggctcatcttgacatcatatgcccgcattgtggtggctgtgctcagagtgcccgcgggcgcgtcacggcgtcgcgctttcagtacgtgcagctctcacctggcagttgttactactttctacggtactctcatgatcttctacgtggcccctagcgctgtgcactcacagctgctgtctaaggtattttccctcttgtatactgtggtcacacctctttttaatcctgtgatctacaccatgcggaacaaggaggtccaccaggccctgcgcaaaatcctctgcatcaagcagaccgagacgctggattag

SEQ ID NO: 44218 - DNA, 948 bp, Artificial Sequence
  Description of Artificial Sequence: Synthetic coding sequence
atggagatcgtgagcaccggcaacgagaccatcaccgagttcgtgctcctggggttttacgacataccggagttgcactttctgttctttatcgttttcactgccgtgtacgtgtttattataataggtaatatgcttattatagttgctgttgtgtcttcacaacggctgcacaagcctatgtatatatttttggccaacctaagcttcctagatatcctctatacctccgccgtgatgcccaagatgcttgagggcttcctccaggaggctaccattagtgtggctgggtgcctgttacagttcttcatatttggttccctggccacggcggaatgcttattgttggcggttatggcttatgacagatacctggccatatgttaccccctgcactacccgttgcttatgggcccccggcgttatatgggtctggtggtaaccacatggctcagcggcttcgtggtagatggcctcgttgtagctctagtagcacagctccgattttgcggaccgaaccacatagaccagttttactgcgactttatgctctttgtggggctggcctgctcagaccctcgcgttgcccaggtgacaaccctgatactgtctgtcttctgtctaacgatccccttcggattgattctcacaagttacgccaggattgtagtcgctgtgctgagggtgccagcgggtgcttctagaagacgcgcattctcaacatgctcctcacacttagcggttgtgactactttctacggtaccctgatgatcttctacgtggccccctcagctgtacacagccagctcttgtccaaggtctttagcctactgtacactgtggttacacctctgttcaacccggtcatctataccatgcggaataaggaagtgcaccaggctctgagaaaaatcctgtgcatcaaacaaacagaaacattagattag

SEQ ID NO: 44219 - DNA, 948 bp, Artificial Sequence
  Description of Artificial Sequence: Synthetic coding sequence
atggagatcgtgagcaccggcaacgagaccatcaccgagttcgtgctgctgggcttctacgatatccctgaattacattttctattttttatagtcttcactgccgtgtacgtcttcatcataatcggaaatatgttaattatcgtagccgtcgtgagcagtcagaggctgcacaagcccatgtatatctttctggcaaacttaagcttcttagatattctctacacaagcgccgtgatgcctaaaatgttagagggttttctgcaagaagctaccataagcgtagccggttgtttgctgcaattcttcatcttcgggtccctcgcaactgccgagtgcctgctgctcgcggtgatggcttacgacagatatcttgcaatctgttacccgcttcattaccccctgctgatgggacccagacgatacatgggactcgtggtgacgacatggctctctgggtttgtagtggacggcctggtcgtggctttggtggcccagctgcggttttgtggccctaaccatattgatcaattttactgcgattttatgctgttcgttgggttggcctgttcagaccccagagtagcacaggtgactacacttatactgagcgtgttttgtctgacaattcccttcggcctcattctgacctcctatgctcgtatagtggtcgcagtcctacgagtgccagcaggtgcatctcgccgcagggctttctccacatgcagtagccacttggccgtggtgactacattctacgggactctgatgatattctatgtcgccccctccgctgtccattcacaactcttgtctaaggtgttttctctactctacaccgtggtcaccccgctgttcaatcccgtaatctataccatgcgtaataaggaagtgcaccaagctctccgaaaaattctgtgtatcaagcaaaccgaaacattggattag

SEQ ID NO: 44220 - DNA, 948 bp, Artificial Sequence
  Description of Artificial Sequence: Synthetic coding sequence
atggagatcgtgagcaccggcaacgagaccatcaccgagttcgtgctgctgggtttctatgacattcccgagctccatttcttgttctttatagtgtttacagctgtatacgtctttataatcatagggaacatgcttattatcgtggctgtggtgagctcacagagacttcataagcctatgtatatatttctggccaaccttagcttcctggacatcctttacaccagcgctgttatgcctaaaatgttggaggggttccttcaggaagccaccataagcgtggctggttgcctgctgcagttctttatctttgggtcactggctaccgctgagtgtctgctgcttgcggtaatggcgtatgatcgctatctcgccatctgttatccgctccattatcctctactaatgggcccacgcagatatatgggcttggtggtgacgacctggctgtctggctttgtggtggacggattggtggtcgctctcgtggcccagctgcgcttctgcggtccaaaccatatcgaccaattctattgcgactttatgctgttcgtgggcctagcctgtagtgacccccgcgtggcccaagtaaccacactgatcctctcagtcttttgcttgaccatcccctttggccttattctgacctcttacgcacgcatcgtggtggccgtgctgagggtgcccgccggtgcaagcaggaggcgggcattttctacttgcagcagccatctagccgtggtgacaacgttctatggcacactgatgattttctacgttgcgccttccgcagtgcatagtcagctgctctccaaggtttttagtctgctttatacagtcgtgacgccattattcaaccccgtaatttatactatgagaaacaaggaagtgcaccaagccctgcggaaaatcctctgtatcaagcagaccgaaaccttggactag

SEQ ID NO: 44221 - DNA, 948 bp, Artificial Sequence
  Description of Artificial Sequence: Synthetic coding sequence
atggagatcgtgagcaccggcaacgagaccatcaccgagttcgtgctcctgggcttttacgacatccccgagctgcatttcctcttctttattgtctttaccgccgtgtacgttttcattatcatcgggaacatgctgatcatcgtcgccgtcgtttcttctcagcgattgcacaaacctatgtatatctttctggccaatttatcattcttggatatcctctatacatctgctgtgatgcccaaaatgctcgaaggattcctgcaggaagccacaatctcagtggccggttgcttgctgcagttttttattttcggcagtctcgctacggccgagtgcctgctgctggcagtgatggcctatgacaggtacctcgccatctgttatcctctgcactaccccctcctgatgggaccaagacggtacatgggtttagtggttacaacatggctatctggctttgtcgtagacggactagtggtcgccctcgtggctcagctgaggttttgcggaccaaaccatatagaccaattctactgcgactttatgttgttcgtcggcttagcatgcagcgacccgcgcgtcgcacaagtgacgactctgatattaagtgttttttgcctgactattccatttggcttgatcctgacatcctacgcccgcatcgtagtggcagttctcagagtgccagccggcgcatcccgacgaagagccttttcaacctgctcaagccatctggctgtggtgacaaccttctacgggactctcatgattttctatgttgcccccagtgcagtccactcacagcttcttagtaaggtcttcagccttctttacactgtcgtcactccactgttcaaccctgtcatctataccatgcgtaacaaagaggtacaccaggctttaagaaaaattctgtgtataaagcagactgaaaccctggactag

SEQ ID NO: 44222 - DNA, 948 bp, Artificial Sequence
  Description of Artificial Sequence: Synthetic coding sequence
atggagatcgtgagcaccggcaacgagaccatcaccgagttcgtgctgctgggattctatgacattcccgaactacacttcttgttctttatcgtctttacagccgtatacgtatttattattatcggaaatatgctaatcatcgtggctgtcgtgtcgagccaacggctgcataaacccatgtacatcttcctagccaatctctcatttctggatatcctgtataccagcgccgttatgcccaagatgctcgaggggttcctccaggaggcgaccatttctgtggccggatgtttgctccaattcttcatcttcggatctctggcaactgccgaatgtctcctgctggccgtgatggcctatgatagatatctcgccatctgttacccactgcactacccgcttcttatgggtcctcgccggtatatgggtctggtggtgactacctggctttctggtttcgtagtggatggactagtagttgctctggtggctcagctacgcttttgtggccctaaccatatcgatcagttttattgcgactttatgcttttcgtgggtctcgcttgcagcgacccccgagtggctcaggtgactactctcatcttatcagtgttctgcctgactattccattcgggctgattctgaccagctatgcccggattgtggttgcagtgttgcgtgtgcctgccggggcctctcgcagacgcgcattctcgacttgcagctcacatctggccgtggtcaccaccttctacggcactttgatgattttctacgttgccccaagtgccgtccattcccagctcttgtcaaaggtgttcagtctgctttacacagttgttacaccactttttaatccagtgatttacaccatgagaaacaaggaggtgcaccaggctctgcggaagatcctgtgcatcaaacagacagaaacattggattag

SEQ ID NO: 44223 - DNA, 948 bp, Artificial Sequence
  Description of Artificial Sequence: Synthetic coding sequence
atggagatcgtgagcaccggcaacgagaccatcaccgagttcgtgctcctgggattctacgacatacccgaactccacttcttgttctttatcgtgtttactgcagtatacgtcttcatcatcattggaaatatgcttatcattgtggcggtggtttctagccagaggctgcacaagccaatgtatatcttcttagctaatctatctttcctggacatcctttatacctcggctgttatgcctaagatgctggagggatttctgcaggaagcaacgatttcagttgccggctgcctgcttcagttctttattttcgggagtctggccactgcagagtgcctgctcctggccgtgatggcttatgacaggtacctcgccatttgctaccctctgcattatcccctcttgatgggcccccggagatatatgggcctggttgttaccacctggctcagcggcttcgtcgtggacggccttgtggtggctctggtggcgcaacttcgattctgtggccccaaccacattgatcaattttactgcgactttatgctcttcgtgggcctcgcatgctctgaccctcgcgtcgcccaggtaacaaccctaatcctttccgttttctgtctgacgatcccttttggacttatccttacaagttacgcccgaatagtggtggcagtgctgagggtgcccgctggcgcatcaagacggcgggcattctcgacgtgcagttctcatctagcagtggtgactacattttacggaaccctgatgattttttacgtggccccctcggccgtgcactctcagctcctcagtaaggtgttcagcctgttatacactgttgtgacaccccttttcaacccagtgatttacactatgagaaataaggaagtacaccaggcattacggaagatcctttgtatcaagcagaccgaaaccctggattag

SEQ ID NO: 44224 - DNA, 948 bp, Artificial Sequence
  Description of Artificial Sequence: Synthetic coding sequence
atggagatcgtgagcaccggcaacgagaccatcaccgagttcgtgctgcttgggttttatgatatccccgagctgcactttctattttttattgtatttactgccgtatacgttttcatcattatcgggaacatgcttataatcgtcgccgtggtgtcctcccagagactgcacaaacccatgtacatcttccttgctaacttatctttcctggatatcctttacacaagtgcagtgatgcccaagatgctcgagggcttcctgcaagaggcaaccatcagtgtcgctggatgccttctgcagttctttatttttgggtccctagcaactgctgagtgcctcctgttggcggtcatggcctacgatcgttacctggccatctgctacccacttcattaccccctgttgatgggcccgaggaggtatatgggcctagtagtcacaacctggctcagcggatttgtagtcgatggcctggtcgtggctctggttgcccaactgcgattttgtggccctaatcatatcgaccagttctactgcgattttatgttattcgtgggactggcttgcagtgaccctcgggtggcacaggtgacaacattaatactcagcgtgttttgcctgactattcccttcggattaatcctgacctcctacgctcggattgttgtggcagtacttagggtacctgcgggcgcctctagaaggagggccttttccacctgtagttcccacctggccgtcgtgaccacattctacggaaccctaatgattttttatgtcgctcccagcgctgtgcattcgcaactcctgtcgaaggtgttcagtcttctttacactgtggtcaccccactgttcaatcctgttatttacacaatgcgtaataaggaagtgcaccaggccttaagaaagatcttatgtattaaacaaactgagacgctggattag

SEQ ID NO: 44225 - DNA, 948 bp, Artificial Sequence
  Description of Artificial Sequence: Synthetic coding sequence
atggagatcgtgagcaccggcaacgagaccatcaccgagttcgtgttattaggattttatgatatcccggagctccactttctatttttcattgtgtttactgcagtgtatgtctttataattatcggtaatatgctgatcatcgttgctgtggtgtcatcgcagcggctacacaaaccaatgtacatcttcctcgcaaacttgtcgttcctggacattctgtacacgtcagccgtaatgcctaagatgttggagggatttctccaggaggccaccatcagtgtcgcagggtgccttctgcaattcttcatttttgggtccctcgcaacagccgagtgtctgctgctggccgtaatggcttatgatcggtacttggccatctgctaccccctgcactatccccttctgatgggaccacgacgttacatgggcctggtggtgactacttggctgtctggtttcgttgttgacggacttgttgtagccctggtcgctcagctgcggttctgcggtcctaatcatatcgatcaattctactgtgatttcatgctctttgtgggcctcgcttgttcagatcctcgagtcgcccaggtgacaacactgattctgtccgtattttgtctcaccatccctttcgggttaattcttacctcttacgcaaggattgttgtggcagttctcagagtgcctgccggcgcctccagaaggagggcattttccacatgctcttcgcacctggccgtggtcaccaccttctacgggacgctcatgatattttacgtcgcgcccagtgccgtccattcccagctgcttagcaaggttttctctcttctctatactgtcgtgacacctttgtttaaccccgttatatacacaatgcggaacaaagaggtgcaccaggccctaaggaagattttatgcattaaacagactgaaacattggactag

SEQ ID NO: 44226 - DNA, 948 bp, Artificial Sequence
  Description of Artificial Sequence: Synthetic coding sequence
atggagatcgtgagcaccggcaacgagaccatcaccgagttcgtgctgctgggattctatgacattccagaactgcacttccttttcttcatcgtatttaccgcagtgtacgtctttatcattatcggaaatatgcttattattgtggcagtggttagcagccaaagactacataagcctatgtatatcttcctcgccaatctctcctttctggatattctgtatacatccgcagttatgcccaagatgttggagggtttcctgcaggaggccaccatctctgtggcaggctgtttattgcagttttttatttttgggtctctcgctaccgctgaatgcctgttgcttgcagttatggcctacgataggtatctggcaatttgctacccactccactatccacttttgatgggaccccgccggtacatgggtctggttgttacgacctggctgtcgggattcgtggtggacgggctggtggtcgctcttgtggcacaattacgtttctgcggaccaaaccatatcgatcagttctattgcgactttatgttgtttgtaggattagcatgtagtgacccacgtgttgcacaagttaccacgctcattttgtctgtattttgcctgacaatcccgttcggcctgattttgacaagctatgctaggatagtggtggccgttcttcgggttcctgccggcgcctctcggagaagagcttttagcacttgctcttcacatctggcagtggtgactactttttatgggacacttatgatcttctacgtggcgccctctgccgtacatagccaactcctgtccaaggtgttttccctgttgtataccgtggtcaccccgttattcaaccctgtgatctatacaatgagaaacaaagaggtgcatcaagcgctgaggaaaatcctctgcatcaagcagaccgagacccttgactag

SEQ ID NO: 44227 - DNA, 948 bp, Artificial Sequence
  Description of Artificial Sequence: Synthetic coding sequence
atggagatcgtgagcaccggcaacgagaccatcaccgagttcgtgctgttgggattctacgacattcccgaattacattttctcttcttcatagtattcactgccgtgtacgtgttcatcataattggaaacatgctgattatagtggcagtggtttcaagccagcggcttcacaagcctatgtatattttcctggcaaatctttcattcctcgatatactgtacacctcagcagtcatgcccaagatgttagagggatttctgcaggaggccaccatttctgtcgctggctgcctcctgcagttctttatatttggttcattggctactgcggagtgtctgttactggctgttatggcctacgatcggtacctggcaatttgttatcccctgcactaccctctgttgatgggacctaggcgttatatgggacttgtagttaccacatggttgagcggattcgttgttgatggcctagtggtggcactagtggcacaattgagattttgcggcccaaaccatatcgatcagttttattgcgacttcatgctgtttgttggactggcatgctccgatcctcgcgtcgcccaagtgactacactcatcctgtctgttttttgtttaacaattcccttcggcctgatcctcacaagctacgctagaatcgtcgtcgccgtgctccgcgtgcccgctggggctagcaggcgaagagctttctctacctgctcatcccatttggctgtcgttacaacgttttacggtaccctcatgatattttacgtggctccgagtgcagtccacagtcagctcctctccaaagtgttctctcttttgtatacggtagttacaccactcttcaacccagtcatctatacaatgcgaaataaggaggtgcaccaggcacttcgaaagattttatgcattaagcaaaccgaaactctggattag

SEQ ID NO: 44228 - DNA, 948 bp, Artificial Sequence
  Description of Artificial Sequence: Synthetic coding sequence
atggagatcgtgagcaccggcaacgagaccatcaccgagttcgtgcttctggggttctatgacatcccagaactgcattttctgttcttcattgtgttcaccgccgtctacgtcttcattattatcggaaatatgctcataatcgtggcggtggtaagctcccagagactgcataaaccaatgtacattttcctggcaaacctctcattccttgatatcctctacacttctgctgtcatgcccaagatgctagaaggtttcttgcaggaagcaaccatatccgtggctggttgtctcctacagttttttattttcggaagtttggcaacagctgagtgtctgctactggccgtcatggcttacgacaggtaccttgcgatctgttaccccttgcattatccgctcctcatgggtcctcgacggtacatggggctcgtggtcactacttggctttcaggtttcgtcgtcgatggcctagtggtcgcgctggttgcccagctgagattctgcggtcctaatcatatcgatcagttttattgcgattttatgttgtttgtcgggcttgcctgctcggatcctcgagtcgcccaggttactacactaatcttaagcgtgttttgtcttacaatcccattcggactgatcttgacatcctatgcccgcatcgtggtcgccgtacttcgtgtgcccgccggggcctccagacgaagagccttctccacatgctcctctcacctggctgtcgtaactactttctatggaacgctgatgatcttttacgtcgctcctagtgcggtacattctcagctgctgtccaaggtcttttcacttctctatacggttgtgactcccctattcaaccctgttatttacactatgaggaacaaagaggtccatcaggccctgcggaagatactgtgtatcaaacagaccgaaaccctcgattag

SEQ ID NO: 44229 - DNA, 948 bp, Artificial Sequence
  Description of Artificial Sequence: Synthetic coding sequence
atggagatcgtgagcaccggcaacgagaccatcaccgagttcgtgttgcttggattttatgacataccggagctgcacttccttttctttattgtttttactgctgtctacgttttcattattatcggaaacatgcttataattgtggccgttgttagcagtcaaagacttcacaagcccatgtacatctttttggcaaatttaagcttccttgatattctctacacatcagctgttatgccaaagatgctcgagggatttcttcaggaggctacaatttctgtagccgggtgcttgctgcaattttttatattcgggtccctcgccactgccgaatgtctcttgctagccgttatggcatatgacagatatctggctatatgctaccctttgcactatcccctgttgatgggtccccgccgctatatgggacttgtagtgaccacctggcttagtggctttgtggtggacgggttggtggttgcgctcgtcgcccagttacgcttttgcggcccaaatcacattgatcaattttactgcgatttcatgttattcgtgggtcttgcttgcagcgaccctcgcgtagcacaggtgacaaccctaatactttcagtgttttgcttgaccattcctttcgggctcatcctgacctcgtacgcgaggattgttgtggcggtcctgcgggttcctgccggcgctagtagaaggagggcattctccacctgctcctcacatctcgccgttgtcacgaccttctacggaacactgatgatcttctacgtcgctccgagcgcagtgcatagtcagctactctcaaaagttttctccctgctgtatactgtggttacacctctgtttaacccagttatttacaccatgcgcaacaaggaagttcaccaggctttgcgtaaaatcttgtgtattaagcagaccgagaccctggattag

SEQ ID NO: 44230 - DNA, 948 bp, Artificial Sequence
  Description of Artificial Sequence: Synthetic coding sequence
atggagatcgtgagcaccggcaacgagaccatcaccgagttcgtgttactgggattttatgacatccccgaactacatttcctgttcttcattgtattcacggctgtctatgtctttattatcattggcaacatgctcattatcgttgccgtggtttccagtcagcgtttacacaagcctatgtatatatttttggccaacctaagcttcttggacatcctttacacctccgcagtgatgccaaaaatgctggaaggttttctgcaggaggctaccatttcagtggctggatgcctgctccagttctttatattcggttcactcgctacagccgagtgcctgctcttggccgtgatggcgtacgaccggtatctagcgatctgctatcccctgcattatcctctgctcatgggtccgcgcagatatatgggattggtagtgacaacctggctgtcaggttttgtcgtcgatggcctcgtggtagctctggtggcacaactgcggttctgtggacccaaccatatcgatcaattctactgcgacttcatgctcttcgtcggcctagcgtgttcagatcctagggtggctcaggtaacaactctgatattgtcagttttttgcttgacaattccttttggcctcattcttacttcatacgcccggattgttgtggcagtgttacgcgtcccagcaggcgctagtagacgacgggcctttagcacatgttcctctcatttggccgtcgtgaccactttttacggcacccttatgattttttacgtcgcacccagcgccgtccatagccagctcctgtccaaagtgtttagcctcctgtacactgttgtgacacctctattcaaccctgttatctacacaatgaggaacaaggaggtacatcaggccctccgtaaaatactgtgtattaagcaaaccgagaccctggattag

SEQ ID NO: 44231 - DNA, 948 bp, Artificial Sequence
  Description of Artificial Sequence: Synthetic coding sequence
atggagatcgtgagcaccggcaacgagaccatcaccgagttcgtgctcttgggcttctatgacatcccggagttgcatttcctattttttatagtgttcactgctgtgtacgtctttatcattatcgggaatatgctcatcattgtggccgtcgtcagtagccaacggcttcacaagcccatgtacatttttctcgccaatctgtcctttctagatatcctgtatacaagtgctgtgatgcccaaaatgctggagggcttcctgcaggaggcaacaatatcggtagctgggtgcctccttcagttcttcatctttggctcacttgccactgccgagtgcctcctgctggccgtcatggcctacgaccggtatctggccatctgctaccctctccactaccccctccttatgggtccccgtcgatatatgggattagtggtgactacttggctgagcggattcgtggttgatgggctcgtggtggcacttgtcgctcaactgcggttctgtggccctaatcatattgaccagttctactgtgacttcatgctcttcgtggggctggcctgctctgaccccagagtggcacaggtgacaacgctaattctgtccgttttttgcctgactatacccttcgggctgatactgacctcctatgcacgcatcgtggtggctgttctgcgggtgccagctggggcttcaagaaggagggcattctccacttgttcttcacaccttgcagtggtgacaaccttctatgggactctcatgatattctacgtggccccctctgccgtgcactctcaacttttgtccaaggtcttctcactgttatataccgtggtgacgcccctctttaatcctgtaatttatactatgcgtaacaaggaggtacaccaggcacttcgcaagattctgtgcataaaacagactgagactcttgactag

SEQ ID NO: 44232 - DNA, 1038 bp, Artificial Sequence
  Description of Artificial Sequence: Synthetic coding sequence
atgcacttcctgagccagaacgacctgaacatcaacctgatcccccacctgtgcctccaccgacactcggtcattgccggcgcctttactatacacagacatatgaagatttttaattccccatcgaattcttccaccttcaccggttttattttactcgggttcccctgccccagggagggacagatcttactgttcgtgctattcacagttgtgtaccttttaaccttaatgggcaacggctctataatctgcgccgttcactgggatcagagactccatgcccctatgtacatcttgttagcaaattttagcttcctcgagatttgctatgtcaccagtaccgtgcccagtatgctggctaattttctatcagatacaaaaatcattagcttttctgggtgctttcttcagttctacttctttttttcactgggaagcacggaatgcttcttcctggccgttatggcatttgaccggtaccttgctatatgccgccccctccggtatcccactattatgacccggcgactgtgcacaaacttagtggtgaactgttgggtactcggcttcatctggtttctcattcccatagtgaatatttctcagatgtctttttgcggaagccggatcatcgaccattttttatgcgacccagcccccctgttaaccctgacctgtaagaagggaccggtgattgagttagttttttctgtgttatcccccctgccggtctttatgctgttccttttcatcgtcgggagttacgctctggttgttagagctgttcttagagtcccctcggcagcggggcggcggaaggcttttagcacatgtggttcccacctggctgtagtgagtctcttttatgggagcgtactcgtaatgtatggaagccctccatccaaaaatgaagccggcaagcagaagaccgtgaccctgttctactccgtggtgacgccgctcctcaaccccgtgatttacagcctgcggaataaggacatgcggaaagccttgaagaagttttggggcacttag

SEQ ID NO: 44233 - DNA, 981 bp, Artificial Sequence
  Description of Artificial Sequence: Synthetic coding sequence
atgtgccccctgaccctgcaggtgaccggcctgatgaacgtgagcgagccaaactcatctttcgcatttgtaaacgagtttattctgcaaggtttctcttgcgaatggaccatccaaattttcctgttttcacttttcaccactacttatgccttgactatcacagggaacggtgcaattgctttcgttctgtggtgcgatcggaggttgcataccccaatgtacatgtttttaggtaacttctccttcctcgagatctggtatgtgagctccacggtgcctaaaatgcttgtgaacttcctgtctgagaagaagaacatatcattcgctggctgctttctgcagttctatttttttttctctctgggcacatcggagtgccttctactgaccgttatggcctttgaccagtatctggcaatatgtcggcctctcctttacccgaacatcatgacgggccatctgtatgccaaactggtgattttgtgctgggtgtgtggattcctgtggttcctaattccgattgtactcatttcccagatgccattctgtgggccaaacatcatagaccatgtcgtgtgcgaccccggcccacggttcgccctggactgcgtgtctgcacctaggattcaactgttttgctacactctaagtagtctggttatatttggcaatttcctattcatcatcgggagctataccttagtcctgaaggccatgctcggtatgccttcctctaccggccgccacaaagccttttctacatgcggatcccacctggctgtcgtgtccctttgttactccagccttatggtcatgtacgtgtcacccggcctgggccatagtaccggaatgcaaaagatcgagaccctcttttatgcaatggttactcccttgtttaatcccttgatttactcactgcagaacaaagaaatcaaagctgcactacggaaggtcctgggatcatcaaatataatctag

SEQ ID NO: 44234 - DNA, 975 bp, Artificial Sequence
  Description of Artificial Sequence: Synthetic coding sequence
atgagcttcttcttcgtggacctgcggcccatgaaccggagcgccacccatattgtgactgaattcattttactcggctttccgggatgttggaagattcagatattcctgttcagcctcttcctggttatttatgtcctgacacttctcggcaatggggccatcatatacgcagttagatgcaatccacttctccacacgcccatgtattttcttctggggaattttgcattcttggagatctggtatgtttcctcaactattccaaacatgctggtgaatatcctatccaagaccaaggccattagcttttcgggttgtttcttgcagttctacttttttttctcccttggaactaccgaatgccttttcctagctgtcatggcttacgatcgatatttagccatctgtcatccgttacagtacccagccatcatgaccgtccgtttttgtggaaagcttgtgtccttctgttggctgattggatttctggggtacccgatacccattttttacatttcccaactgcccttttgcggacctaacataatagatcacttcctatgcgatatggatcccctgatggctcttagctgcgcccctgcccccattacggaatgtatcttctacacccagtcatctttagtcctgttttttacttctatgtatatcctacgttcttatatactgctgttgactgctgtgttccaggtgccaagcgcagcgggccggaggaaggccttcagtacttgtggcagtcacctagtggttgtgtcactgttctacggtacagttatggttatgtacgtgtcacccacctatgggatcccaacactgctccaaaagattctgacactggtgtatagcgtgacaacccctttattcaaccccctcatttatactctgaggaataaagatatgaagctcgcactccggaacgtgctgttcggaatgagaatcaggcagaacagctag

SEQ ID NO: 44235 - DNA, 993 bp, Artificial Sequence
  Description of Artificial Sequence: Synthetic coding sequence
atgttcttcatcatccacagcctggtgaccagcgtgttcctgaccgcactcgggccccagaataggaccatgcatttcgtgaccgaatttgtgctgctcggcttccacggtcaacgcgagatgcagagttgttttttttcttttatcttagtgctctatctgctgacactactcggaaatggcgcaatcgtttgtgcagtgaaactcgatagacgtctgcacactcctatgtacattctgctcggaaatttcgcctttctcgagatttggtacatcagtagtacagtacctaatatgctggttaacatcctatcagagataaaaacaattagctttagcggatgcttcttacagttctacttcttcttctccttgggaacgactgagtgtttttttcttagtgtgatggcctacgaccggtatttagctatctgcaggcctttgcattacccgtccataatgactgggaaattctgtatcatcttggtctgtgtgtgctgggtcggaggctttctttgttatcctgtccccatcgtgttgatcagtcagctgcccttctgtggaccaaatattattgatcacctcgtgtgcgaccccggacccctgttcgcactggcatgcatatcagctccttctacagaactgatatgctacacattcaatagcatgatcatcttcggaccgttcttgtcaattctgggatcctacaccctggtcatccgtgctgtcctctgtataccttccggtgctggccggaccaaagcattttccacctgcggctcgcatctaatggtggtgagcctgttctatgggacccttatggttatgtatgtttcccccacgtctggaaaccctgctggtatgcagaagatcatcacgcttgtgtacaccgctatgaccccgttcctcaaccccctcatttatagcctgcgaaacaaggacatgaaagatgccttgaaacgtgtgctggggcttacagtgtcccagaactag

SEQ ID NO: 44236 - DNA, 969 bp, Artificial Sequence
  Description of Artificial Sequence: Synthetic coding sequence
atggagccccagaacaccagcaccgtgaccaacttccagctgctggggttccagaacctgctggagtggcaggctctcttgttcgtcattttcctgctgatttactgccttaccatcatcggaaacgtggtgattatcacggtagtctctcaaggccttcgtctgcactctccaatgtatatgttccttcagcacctgagtttcctagaggtgtggtatacatccaccacagtccccttgttgctcgccaatctcttgagctggggtcaggcgatttcgttctccgcctgcatggcccagctgtacttttttgtgttccttggggcaacagagtgctttctgctggcattcatggcctacgacagatatctggccatatgttcaccccttaggtatccgttcttaatgcatagagggctttgcgctagactggtggttgtgagttggtgcacaggcgtgtccaccggcttcctgccaagtttgatgattagtcgattggatttctgcggtaggaatcagattaaccatttcttttgcgacctgcctccactcatgcagttatcctgtagccgcgtgtacatcacggaggttacaatctttattcttagtattgcggttttatgtatatgtttcttcctgaccctggggccttatgtgtttatagtgtcttcaattttgagaataccaagcacttccggacgccgcaaaacttttagtacctgtggatctcacctcgcggtcgtgacactgtactatgggaccatgatctcgatgtacgtgtgtccgtccccccacttactgccagaaatcaataagattatctccgtcttttatactgttgtgactcccctgctgaatcctgtaatctatagtctgaggaataaggatttcaaggaggccgtgcgcaaggtaatgagaaggaaatgcgggatactgtggtcaacaagcaaacgcaaattcctgtactag

SEQ ID NO: 44237 - DNA, 924 bp, Artificial Sequence
  Description of Artificial Sequence: Synthetic coding sequence
atgctgaacaccaccagcgtgaccgagttcctgctgctgggcgtgaccgatatccaggagttacagccatttctgttcgtggtgtttttaaccatttacttcatcagcgtgaccgggaatggagcggtgctgatgatcgtcatttccgacccaaggctccattctctcatgtacttctttctcgggaacctcagctaccttgacatttgctactctacagtgaccctccctaagatgctccaaaattttctgtccacccacaaagccattagttttttagggtgcatctctcaactgcatttcttccattctctaggatctaccgaatccatgctattcgcagttatggcattcgacttatcagtcgctatctgcaagccgctgaggtacacagtaattatgaatccacaattgtgtacccagatggccatcacaatttgggtcatcggcttctttcacgcgttgctgcatagcgtaatgacaagtcgcctaaacttttgtggttctaaccgcattcaccactttttatgcgatatcaaacccttgctgaagctggcctgtggcaatactgaactgaaccagtggctcctgagtaccgtaactggcacgatcgcaatgggaccttttttcttgactctcctgagctatttttatataatcacatacctgttctttaagactagatcctgttccatgctgtgcaaggccctatccacctgtgccagccattttatggttgttatcctgttctatgctccagtgctctttacctacatccacccagcattggagagcttcatggatcaggatcgaattgtcgcaatcatgtataccgtcgtgaccccagtgctcaacccactcatctacactctcagaaataaagaagtgaaaggtgcactgggccgcgttattagacggttatag

SEQ ID NO: 44238 - DNA, 924 bp, Artificial Sequence
  Description of Artificial Sequence: Synthetic coding sequence
atgctgaacaccaccagcgtgaccgagttcctgctgctgggcgtgacagacatccaagagctgcagccctttctgttcgtggtgtttttgaccatttattttatatccgtaacgggcaacggggcagtgttaatgatttttatcagcgacccgcgattacattctcctatgtacttcttcctgggaaatctgagttatctagacatctgctactccacggtaacccttccaaagatgttacagaacttcctgtcaacccacaaggccatctcgttcttagggtgcatcagccagctgcactttttccattttctggggtcaacagagtccatgctcctagctgtcatggcttttgatagatctgtagccatttgcaagcccctcaggtacacagttatcatgaatccccaattgtgcacacagatggccattaccatctgggtgattggtttttttcacgccctgcttcactctataatgacgagtcgcctgaacttttgcggctccaataggatccatcactttctgtgcgatattaaacccctcctcaaattggcgtgtggcaataccgaactcaaccagtggctgttatccaccgtgacaggcactatcgctatgggtcctttctttctgaccctgctttcgtacttctacatcattacatatctgttctttaaaacccgcagctgctcaatgctgtgcaaagccctgtcaacttgcgcctctcacttcatggtcgtgatactgttctacgcccctgtcctcttcacctacatccaccctgccctagagagctttatggaccaagacaggatcgtggccattatgtataccgtagtgacccctgtcctcaatcccctcatctacacccttcggaacaaggaggtgaaaggcgctcttggaagagtgattcggaggttatag

SEQ ID NO: 44239 - DNA, 924 bp, Artificial Sequence
  Description of Artificial Sequence: Synthetic coding sequence
atgctgaacaccaccagcgtgaccgagttcctgctgctgggcgtgacagatattcaggagctgcagcctttcctcttcgtggtattccttaccatctattttatctctgtcaccggaaatggcgctgtgcttatgattttcatttctgacccacgattgcacagtcctatgtatttctttctcggaaatctgagctacctcgatatttgttactcaacggtgacactaccaaaaatgttgcaaaattttctgagcacgcacaaggcgatttcatttttaggatgcatctcccagcttcatttttttcacttcctcggttccacggaaagtatgctgctggccgtgatggcctttgacaggtgtgttgctatttgcaaaccactgaggtacaccgtgatcatgaatccccagctctgcacccaaatggctatcactatttgggttatcggcttctttcacgcacttctgcattcaatcatgacttcccggctgaacttctgtggctccaaccggatccaccatttcctgtgtgacatcaaaccattactgaagttggcctgcgggaataccgaactgaatcagtggctgctgagcacagtgaccggtaccattgctatgggcccattcttcctgacattgctgtcttacttctatatcattacctatctcttctttaagaccagaagctgcagtatgctctgcaaggcattaagtacatgtgcaagccattttatggtggtcattctattctacgcacctgttttgttcacttacatccatccagctcttgaaagcttcatggatcaggatcggatcgtcgccataatgtacacggtagtgacaccagttctgaacccgctcatctataccctcagaaacaaggaagtcaaaggtgccttagggagagtgattcgcagactttag

SEQ ID NO: 44240 - DNA, 951 bp, Artificial Sequence
  Description of Artificial Sequence: Synthetic coding sequence
atggagaacgtgaccaccatgaacgagttcctgctgctgggcctgacaggagttcaggagctgcagccttttttctttgggatctttctgatcatttacttgatcaacctgattggaaatggctcgatccttgtgatggtggtactcgaacctcagcttcactcccccatgtactttttcctgggtaacctctcttgcctcgacatttcctactccagcgtgacattacccaaactgctagtaaatctggtgtgttcccgcagggctatctcctttctgggttgcattactcaactgcacttttttcacttcctgggttcaactgaagccatcctgctggccatcatggcttttgacagatttgttgccatatgtaatcctcttcgatatactgtcatcatgaatccccaggtgtgtattctccttgcagctgctgcgtggctcatcagcttcttctatgccctcatgcacagtgtgatgaccgctcacctctcattctgtggctcccagaaactgaatcattttttttatgacgtgaaaccactcctggaactcgcgtgttctgacactctcctgaatcagtggctactaagcatagtgactggcagcatcagcatgggtgccttcttcctaaccttattgagttgcttttatgtcatcgggtttttactgttcaaaaaccgatcatgccggattctccacaaggctctctctacctgtgcctcccactttatggttgtatgcttgttttacggacctgtggggtttacgtatattagaccagcaagtgctacttcgatgattcaggatcgaataatggctatcatgtactccgcggtgaccccagttctgaaccccctgatctacacacttcgcaacaaagaggtgatgatggccctgaagaagatctttggtcggaaactgtttaaggattggcagcagcaccactag

SEQ ID NO: 44241 - DNA, 951 bp, Artificial Sequence
  Description of Artificial Sequence: Synthetic coding sequence
atggagaacgtgaccaccatgaacgagttcctgctgctgggcctgacaggcgtccaggagctacagccttttttcttcgggattttcctcatcatctacttaattaatcttattggtaacgggtcaatcctggtcatggtagtgctagagcctcagcttcactcccccatgtactttttcctgggtaatctttcttgtcttgatatctcctacagctccgtgaccctaccaaaattactggttaaccttgtatgcagcaggcgggccatatcatttctgggctgcattacccaattgcacttcttccacttcctggggagcacggaggcaatcctattggccattatggcctttgatagatttgtggcgatctgtaatccgctgcgctacacagtgatcatgaacccgcaggtctgcatattactggccgctgctgcctggctaataagcttcttttatgctcttatgcatagtgttatgactgcccatctgtctttttgtggaagccagaagttaaatcacttcttctacgacgtgaaaccattattggagctggcctgttctgacaccctactgaatcagtggctgctcagcattgtgacaggtagcatcagtatgggggcgtttttcctcacactattgtcatgcttttacgtcatcgggttcctgctgtttaaaaatagatcttgtaggatcctacataaggctctgagtacctgtgcaagccatttcatggttgtgtgtttgttctacgggcccgtcggtttcacttatatccgtcccgcctctgctactagtatgatccaggacagaatcatggcaataatgtattctgcggtaactccagtgctaaacccattgatctatactctgaggaacaaggaggtcatgatggctctgaagaaaattttcggaagaaaacttttcaaggattggcagcagcaccattag

SEQ ID NO: 44242 - DNA, 951 bp, Artificial Sequence
  Description of Artificial Sequence: Synthetic coding sequence
atggagaacgtgaccaccatgaacgagttcctgctgctgggcctgacaggagtccaggaactccaaccattcttttttgggatattcttaattatatatctgatcaacttgatcggaaatggttccatactcgtgatggtggtgctagagcctcagctgcatagtcctatgtactttttccttgggaatctgagttgtctcgatatctcctactcctcagtcaccttacccaagcttctcgtcaacctcgtatgcagtcgccgggcgatctcctttctgggctgtatcacgcagctgcattttttccactttctgggtagtactgaagccatcttgctagccattatggcctttgacagatttgtcgctatttgcaatccattgcgctataccgtcattatgaatccccaggtgtgtatcctgctcgccgctgccgcttggttgatctcgttcttctacgcgctcatgcactccgtcatgacagcccatctgagcttctgcgggagccagaagctgaatcacttcttttatgatgtcaaaccactgttggagctcgcatgctcagacacgctgctgaaccagtggttgctgtccatcgtcacagggtccatttctatgggagctttttttctaacattgctttcatgcttctacgttattggttttttgctgtttaaaaataggtcatgtagaattctacacaaagcactgtccacctgcgcgagtcatttcatggtagtctgtctgttctatggaccagtgggattcacctacatccggccggcctccgccaccagcatgatacaggaccgaattatggccatcatgtactccgcggtgactcctgtgctgaacccacttatctacacattgagaaacaaagaagtaatgatggcccttaaaaagattttcggccggaagcttttcaaggattggcagcagcaccactag

SEQ ID NO: 44243 - DNA, 951 bp, Artificial Sequence
  Description of Artificial Sequence: Synthetic coding sequence
atggagaacgtgaccaccatgaacgagttcctgctgctgggcctgaccggggttcaagagctgcaacccttcttcttcggcatcttcctgattatatatctaatcaacctgattggcaacggctccattctcgttatggttgtactggaacctcagctgcacagtccgatgtatttctttctcggcaatctcagctgtctggatatctcctatagcagcgtgacactgcctaagttgttagtgaaccttgtgtgctctagacgagcgattagctttctgggatgtatcacccagctgcacttctttcattttctaggcagcactgaggccatcctgttagcaataatggcatttgaccggttcgtggctatttgcaatccgctgaggtacaccgtcattatgaaccctcaggtttgcatcctccttgcagccgctgcatggctcatcagtttcttctacgctctcatgcattccgtgatgacggctcacctaagcttttgtggtagtcagaagttgaatcattttttctacgacgtgaagccacttctggagctggcatgctccgacacactgctgaatcagtggttgctgtctatcgttaccggctctatctcgatgggtgctttcttcctgacattgctgtcatgcttctacgttatcggattcctgctgttcaaaaaccgcagctgccgaatcctccacaaggccctctcgacatgcgcatcacactttatggtcgtctgtctattctacggacccgtggggttcacttacatccgcccggcctcagcaacctccatgatccaggataggatcatggccattatgtattcggctgtgacacccgtgctcaatccccttatttataccctgcgaaataaagaagtgatgatggcactgaagaaaatctttggccgtaaattatttaaggattggcaacaacaccattag

SEQ ID NO: 44244 - DNA, 951 bp, Artificial Sequence
  Description of Artificial Sequence: Synthetic coding sequence
atggagaacgtgaccaccatgaacgagttcctgctgctgggcctgacgggggtgcaggagctacagccattcttttttggaattttcttgattatctatctcatcaatctgatcggaaacggctccatcctagtcatggtggtgttagaacctcagcttcattcacctatgtatttctttctgggaaacctcagctgtcttgatatcagctatagctccgtaacattacccaagctgctggtcaatctggtatgtagtaggcgagcgatctctttcctggggtgtattactcaactccactttttccatttcctggggagtaccgaagctatactgctcgctataatggcctttgaccggtttgtagctatctgtaatccccttcgctacactgtgatcatgaatccacaagtttgcatcctcctggccgctgccgcttggctgataagtttcttttatgccttgatgcattcagttatgaccgcccacctgtctttttgtgggtcccagaagcttaatcattttttctacgacgtgaaacccctgttagagttggcctgctccgacacactcctgaaccagtggcttctgtccatcgtcacagggtccatctccatgggagcattcttccttacgcttttgtcatgcttctatgtgatcggttttctgctcttcaaaaatagatcttgccggatcctgcataaagcactgtcgacgtgtgcgtcccatttcatggtcgtttgccttttctacgggccagtaggcttcacttacattagacccgccagtgcaacctcgatgatccaggataggataatggcaatcatgtacagcgcagtcactccggtgctgaaccccctgatttacacacttagaaataaggaagtaatgatggctctgaaaaaaatctttggtcggaagctgttcaaggattggcagcaacaccattag

SEQ ID NO: 44245 - DNA, 951 bp, Artificial Sequence
  Description of Artificial Sequence: Synthetic coding sequence
atggagaacgtgaccaccatgaacgagttcctgctgctgggcctgaccggcgtccaggagttacaacccttttttttcggtattttcctgattatataccttataaacctgataggaaatgggtccatcttggtgatggtagtcctggaaccacagcttcacagtccaatgtatttttttctgggaaatctgtcctgcctcgatatttcttactcttccgtgaccctgcccaagctacttgtcaatttggtgtgcagcaggcgagccatctccttcttagggtgtatcacccaactgcattttttccatttcctgggttccacagaggcaatcctgcttgcaatcatggcctttgatcgtttcgtggctatctgtaatcccctcagatacaccgtgatcatgaacccccaggtatgtattctgctagctgccgcagcctggctgatatcctttttctatgccctgatgcactcagtgatgacagcacacctttctttttgcggttctcagaaactgaaccatttcttttatgacgtaaaaccgctgctggagctggcctgctctgacactctgctcaatcaatggttactgagtattgtgacgggctctatatcaatgggtgcgttcttcctcacccttctgtcctgcttttacgtcataggattcctgctgtttaaaaacagaagctgtcgtatcctgcataaagccctttcaacgtgcgcttctcactttatggtggtttgtttgttttacggacctgtaggcttcacttatatccgcccggctagtgcaaccagtatgattcaagacaggataatggccatcatgtacagcgccgtcactccagtcctcaatcctttaatctatacactgcggaacaaggaggtgatgatggctctgaagaaaatttttggaagaaaattgttcaaagactggcagcaacatcattag

SEQ ID NO: 44246 - DNA, 951 bp, Artificial Sequence
  Description of Artificial Sequence: Synthetic coding sequence
atggagaacgtgaccaccatgaacgagttcctgctgctgggcctgactggcgtgcaagagctccagcccttcttcttcggaatctttttaattatctacctgatcaatctgataggcaacggttctatcctggtcatggtcgttctggagcctcaactgcattcgcccatgtacttttttctcggcaacctgtcttgcttggatattagctattctagcgttactttgccgaagctcttggtgaatctagtctgttcaaggcgagcgatctctttcttgggatgcataacccaactgcacttctttcacttccttggatctacagaagctattctgctggcaatcatggcattcgaccgctttgtcgctatctgcaaccccctgcgctatacagtgataatgaacccgcaagtgtgcatattacttgctgctgctgcctggctcatcagcttcttctatgccctcatgcattcggtgatgacggctcacctgagcttttgcggctcccaaaagctcaaccattttttctacgacgtgaagcctctgctcgagttagcctgtagcgatactttgctgaaccagtggctcctgtcaatagtgacaggatcgatcagcatgggcgctttctttttaacccttctttcgtgtttctatgttatcggcttcctgctttttaaaaacagaagctgtagaattttacataaagctttatctacgtgtgcttcacatttcatggttgtatgcctcttctatggcccggtgggctttacctatatacggcctgcttccgctacaagcatgatccaggataggattatggccatcatgtacagtgctgttactcctgttttgaatcctttgatctacacgctgaggaataaagaagttatgatggctctgaagaagatttttggccggaaactttttaaagactggcagcagcatcactag

SEQ ID NO: 44247 - DNA, 951 bp, Artificial Sequence
  Description of Artificial Sequence: Synthetic coding sequence
atggagaacgtgaccaccatgaacgagttcctgctgctgggcctgaccggggttcaggagcttcaacctttctttttcggaatatttttaatcatttacctcattaatctaattgggaacggcagcatcctcgtgatggtggtgctggagccacagctacactctcccatgtacttcttcctagggaacctctcctgtctggacatctcttatagctcagtgacactccccaaacttctggtgaacctagtgtgtagtcggagggctattagctttctgggttgcataactcagttgcacttcttccacttcctaggcagcaccgaggccattctccttgccatcatggcgttcgacagattcgtggccatttgcaatcccttgagatacacagttattatgaacccccaagtgtgtatcctgctggccgctgccgcctggttgatctcattcttttatgccctgatgcattcagtgatgactgcccatctcagcttctgtggatcacaaaagttgaatcactttttctacgacgtgaaaccgctgctggagctggcatgttctgacacgctgcttaaccagtggcttttgtccattgtgactggaagtatatctatgggagcattctttcttaccctcctgagctgcttctacgtgatcggcttcctcctcttcaagaatagaagctgtcggatccttcacaaagctctctcaacttgcgccagccacttcatggtggtgtgcctcttctatgggcctgttggcttcacatacatcaggcctgcttctgcaacgagtatgatacaggaccgaatcatggccatcatgtattctgcagtgacacctgtgcttaatcctctaatatataccctcaggaataaagaggtcatgatggccctgaaaaagatattcgggcgtaaattgtttaaggactggcagcaacatcattag

SEQ ID NO: 44248 - DNA, 987 bp, Artificial Sequence
  Description of Artificial Sequence: Synthetic coding sequence
atgaagctgtggatggagagccacctgatcgtgcccgagacccggcctagccctcgcatgatgagtaatcaaacgctcgttacagaattcattttgcaaggattttcagaacatccagaatatcgcgtctttttgttttcctgctttttgtttttgtactctggagcccttacaggaaatgtgctgatcaccctggctattacattcaaccccgggctccatgctcccatgtacttcttcctcctcaatctagcaacaatggacataatctgcacctcatccatcatgccaaaagcccttgcctcattggttagtgaggaatcatccatctcctacgggggttgcatggctcagctgtatttcctaacatgggctgcctccagtgaactactcctcctgaccgtcatggcttatgacagatacgccgcaatctgtcacccacttcattactctagtatgatgtccaaggtgttttgcagcggattggcaaccgccgtgtggttactctgcgctgtaaataccgctatccacacagggctaatgcttcgactagatttctgcggaccgaatgtgatcatacactttttctgtgaagtccccccactgctgctgttgtcttgttcttctacatatgttaatggggtgatgatagtcctggccgatgccttctacggaattgtaaatttcttgatgactattgccagttacggctttatcgtgtcatccattctgaaggttaaaactgcttgggggcgacaaaaggcgttctccacctgttcatctcacctcactgttgtgtgcatgtactatacagcggtgttttacgcatacatctcgcccgttagtggttattcagccggtaagtcaaaactcgccggtttactctatacggtgttgtctcccactctaaacccattgatttacacactcagaaacaaggaggtcaaggcggccctgagaaagctttttcctttcttccggaattag

SEQ ID NO: 44249 - DNA, 987 bp, Artificial Sequence
  Description of Artificial Sequence: Synthetic coding sequence
atgaagctgtggatggagagccacctgatcgtgcccgagacccggcctagcccacggatgatgtccaatcagacgctggtgacagagtttatcctgcaaggctttagcgaacaccccgagtatagggtgttcttatttagctgtttcctgttcctttacagtggtgccttgacaggcaatgtgcttatcactctggccattacctttaaccccggtctgcacgccccgatgtacttcttcttgctgaatctggctacgatggacatcatttgcacctctagcatcatgccaaaagcccttgctagtctggtgtcagaggaaagctccatttcatacggcggctgcatggcccaattatattttctcacatgggccgcttcatctgagttactactgttaacggttatggcatatgataggtacgcagcaatctgtcatccattacattattcttctatgatgtctaaggtgttctgttctggattggcgactgcagtgtggctgctgtgcgccgtgaacaccgctatccacaccggcttgatgttgcgtcttgatttttgtggaccgaatgtcattatccactttttctgtgaagttccaccccttctgcttctcagttgctcaagtacctatgtgaatggtgtgatgattgtgctcgctgacgcgttctacgggatcgtcaatttcctgatgactatagcgagttacgggttcatagtgtcctctattctcaaggttaaaaccgcgtggggtcggcagaaagccttttccacctgttcctcccacctgactgttgtgtgtatgtactataccgctgtgttctacgcttatatctcccctgtttcaggatactctgccgggaagagtaaactcgcgggtctgctctacaccgtgctcagcccgactctcaaccccctcatctacaccctgcgtaataaagaggtcaaggcagccctgaggaaactctttcccttcttcagaaactag

SEQ ID NO: 44250 - DNA, 987 bp, Artificial Sequence
  Description of Artificial Sequence: Synthetic coding sequence
atgaagctgtggatggagagccacctgatcgtgcccgagacccggccctcccctaggatgatgtccaatcagacgctagttacagaattcattctccaaggtttcagcgaacacccagagtacagagtgtttctcttttcctgctttctcttcttgtattctggcgcgctgacaggcaacgtactgatcactctcgccatcaccttcaacccggggttgcacgctcccatgtattttttcctgctgaacctggccacaatggatattatttgcacctcatctatcatgcccaaagccctcgcatcgctggtgagtgaggagagctctatcagctatggcggatgtatggcccagctgtatttcctgacctgggcagccagttctgaattgctactcctaacagtcatggcctatgacaggtatgccgcaatatgccacccactgcattatagttctatgatgagtaaggtgttttgctctggcctggctacagctgtgtggctgctatgcgcggtaaacacggccatccatactggcctgatgttgaggctcgatttttgcgggcccaacgtgatcattcacttcttctgcgaagtccccccgctcctgctgctttcctgcagctccacatacgtgaatggagtgatgatcgtgctcgccgacgcattctatgggatagtgaatttcctgatgaccatagccagctacggattcatagtctcctccattctgaaggtgaagaccgcgtggggaagacagaaagccttctcaacctgttcaagccacctaacagtggtatgtatgtactatacagccgtgttttacgcatacatcagccccgtgtccggttactccgcagggaagtctaaattggctggtctactgtacactgtcctctctcccacccttaacccattgatatatactctgcggaacaaagaggtcaaggctgctctacgcaagctctttccattttttaggaattag

SEQ ID NO: 44251 - DNA, 957 bp, Artificial Sequence
  Description of Artificial Sequence: Synthetic coding sequence
atggagtgggagaaccacaccatcctggtggagttcttcctgaaggggttaagcggtcacccccggttggagctgctcttctttgtgctgatcttcatcatgtacgtcgtgatcctgttaggaaacggcacccttatcctgatatcaatactcgacccccatcttcacacccccatgtacttctttctcggaaatctgagcttcctcgacatctgctacaccaccacatccatccctagtactttggtgagctttctgagtgagaggaaaactatcagcctgagtggatgcgctgtgcagatgttcctcggactggcaatgggtaccactgaatgtgttctcctggggatgatggccttcgaccggtatgtggctatctgcaatcctctacgatacccaatcatcatgagcaaagacgcttacgtgccaatggcagccggaagctggattatcggggctgtgaactccgcggtgcagtccgtcttcgtggttcagctgcccttctgtagaaacaatatcatcaatcacttcacatgcgagattctggcagtaatgaagctggcatgtgcagacatatcagataatgagttcattatgctcgtggccactactctctttattctgactccgctgctcctgatcattgtgtcttacacattaattatcgtgtccatctttaagatcagcagcagcgaagggaggtctaaggctagttcaacctgtagtgcgcatcttaccgtcgttattatcttctacgggaccattttgttcatgtatatgaagccaaaatccaaggaaactcttaactctgacgatctcgacgctactgacaagattattagcatgttttacggcgtgatgaccccaatgatgaacccgttgatctactccctccggaataaggacgtaaaagaggcagtgaaacaccttctgaatcgccggtttttcagtaagtag

SEQ ID NO: 44252 - DNA, 1044 bp, Artificial Sequence
  Description of Artificial Sequence: Synthetic coding sequence
atgatcgtgcagctgatctgcaccgtgtgcttcctggccgtgaacaccttccacgtgcggagcagcttcgactttttgaaagctgacgacatgggcgagataaaccagaccctagtatccgagtttctactgttagggctgagcggatacccgaaaattgagattgtttattttgccttgatactggtcatgtatctggttatcctcattggtaacggggtgttaataattgcctctatcttcgattcacactttcatacaccaatgtacttctttctcgggaacctgtcattcctggatatctgttacacctcctcttcggtgccctctactctggtttcattgatttcgaaaaagcgcaacatctctttctctggctgcgccgttcagatgttttttggtttcgcaatggggtcaacggagtgcctgcttttaggtatgatggcctttgaccgctacgtagctatctgcaaccccctccgctaccccattattctgagtaaagtggcttacgtgctgatggctagcgtgagctggttgagcggaggcatcaatagcgccgtgcaaacccttctggcaatgcgcctccccttctgcggaaataatataatcaatcatttcgcttgcgaaatattggcagtgttgaagctggcatgcgctgacatcagtcttaatatcatcacaatggtgatttctaatatggccttcctggtgcttcccctcatggtaatattttttagctacatgttcatcctttacacaatactccaaatgaactcagctacgggccgcagaaaggctttctccacctgttctgcccatctgaccgtggtcataatattctatggtaccatattctttatgtacgcaaaacccaagtcccaggatttgattggtgaggaaaagttacaggccctagataagctcatttcactgttctacggagtcgtgacccctatgctaaacccgatcctctatagcctgagaaataaggacgtgaaggcggcagtcaaatatcttctcaacaagaaaccaattcattag

SEQ ID NO: 44253 - DNA, 957 bp, Artificial Sequence
  Description of Artificial Sequence: Synthetic coding sequence
atggacaagatcaaccagaccttcgtgcgggagttcatcctgctgggactaagtgggtacccaaaactggaaatcatcttcttcgctcttatcctggtcatgtacgtggtcatcctcatcgggaacggggtattgatcatcgcttctatcttagactctcgactgcacatgccaatgtatttctttctgggaaatctctcttttttggacatctgttataccacttcttccataccatccaccctcgtgtctctcataagcaagaaacggaacatttccttcagtggttgcgccgtccagatgttcttcggtttcgcaatgggctctaccgagtgcttcctcctgggtatgatggccttcgatcgatacgttgccatctgcaatccactccgctacccaattatcatgaacaaggtggtttacgttctgttaacgagcgtgagttggctgtccggcggaataaattccaccgttcagacttccctggccatgcgctggcccttttgcggtaataatattatcaatcacttcttatgtgagatcctggcagtgctgaaattagcctgttcggatatatcagtgaacatcgtgactttggccgtgtcaaatatcgcatttctcgtactgccactcctcgtgattttctttagttacatgtttatcttgtacacaatactgcggacaaatagtgccaccggaaggcataaagcttttagcacctgcagcgcccatctgaccgtcgtgattattttttacggcaccattttctttatgtacgcaaagcctaaaagccaggatcttctcggtaaggataacctccaggccaccgagggcttggtgagtatgttctatggagtggttactcctatgctgaaccccatcatttactctctgcgtaacaaggacgtcaaggcggcaatcaagtaccttctgagtcgcaaagctattaaccagtag

SEQ ID NO: 44254 - DNA, 1041 bp, Artificial Sequence
  Description of Artificial Sequence: Synthetic coding sequence
atgttcatccaggtgatcttctacatctgctgcctggccgtgaagatattatatatcggatcaagtttcgggatccttaaagcagatatggacaagattaaccaaacctttgttcgagaattcattctacttggccttagcggttatcccaagttagagatcatttttttcgctctgattcttgtcatgtacgttgtaatacttatcggaaacggcgtgctaatcatcgccagcatacttgatagtcggctacacatgcccatgtattttttcctcggaaacctgtcatttctggacatctgctacacgacttcttcgatcccctctactctcgtatcgttgatttccaagaagagaaacatctcatttagtggctgtgccgtccagatgttttttgggtttgccatggggtccacagagtgctttctgctcggcatgatggcattcgataggtacgtggccatatgtaacccactgaggtaccctattatcatgaataaggttgtttacgtgctcctcacatctgtcagctggttgtccggcgggattaattcaaccgtgcagacctccctagctatgaggtggcccttctgcggaaacaatatcattaaccattttctgtgcgaaattttggcagttctgaaactcgcttgttccgacattagcgtcaacattgtgacactggccgtcagtaacatagcgttcttagtgctccctcttctcgttatcttcttctcatacatgttcatcttatataccatcctcaggaccaatagcgccactggcaggcataaggccttttctacctgttcggcccatctgaccgttgtaatcatcttttacggaacaatcttttttatgtatgcaaagcccaaatctcaggatctactgggcaaagataatctacaggccacagaagggctggtgagcatgttttacggcgtggtgacacccatgctcaatcccatcatctattcgttgcgcaacaaagatgtgaaggcggcgatcaaatatctcctgtcccggaaagcaatcaactag

SEQ ID NO: 44255 - DNA, 957 bp, Artificial Sequence
  Description of Artificial Sequence: Synthetic coding sequence
atggagtgggagaaccacaccatcctggtggagttcttcctgaaggggctgtctggacatcctcggctggaactccttttcttcgttctgatcttcatcatgtacgtggtgattcttctgggcaatggtacactgatcctgataagcatcttagacccccatctgcacactcccatgtattttttcttaggcaatctctcattcctggacatttgctataccactacatccatcccatcaacactggttagctttttgagtgagcggaagaccatcagcctgtctggttgcgctgttcagatgttcctttccctcgcaatgggcacaacagagtgcgttcttttgggcgtgatggcatttgatagatatgtagcgatatgtaacccattgagatacccaattatcatgtctaaagatgcctacgtgccaatggcggccggatcgtggatcatcggggccgtcaatagcgcagtgcagaccgtattcgtcgtgcagctgcccttctgtcgtaataatattattaatcacttcacatgcgagatactggcagttatgaaactcgcctgcgctgatatctctgggaacgagtttatactcctggtaaccacaaccctgttcttgctgactcccttactcctgatcattgtgagctataccctgatcatcctatcaatctttaagatctctagctccgagggcaggtcgaaaccctcctcaacgtgcagcgcacgccttacagtcgtgattacattctgcggcaccatctttctgatgtatatgaagcccaaaagccaagaaacactgaacagcgacgacctggacgccaccgataaactcatctttatcttttatagggtgatgacgcccatgatgaatccccttatctacagtctccggaataaggacgtgaaagaagccgtgaagcatttgttaagacgcaaaaactttaacaagtag

SEQ ID NO: 44256 - DNA, 963 bp, Artificial Sequence
  Description of Artificial Sequence: Synthetic coding sequence
atggagcggaccaacgacagcaccagcaccgagttcttcctggtgggccttagcgcgcatccaaagctgcagacagtgttttttgtgctgattctctggatgtatctgatgatcctgctcggaaacggcgtgttgattagtgtgataatcttcgactcacacctccacacccccatgtatttctttctgtgtaacctctctttcctagacgtatgttatactagcagttccgtccctttgattctggctagcttcttagccgtcaaaaagaaagtgtcctttagcggttgcatggtgcagatgttcatatctttcgcaatgggagcaactgagtgcatgatcttggggacaatggcgctggaccggtacgtagcaatttgttacccattgcgataccctgtgatcatgtctaagggggcttatgtggccatggccgcaggcagctgggtcactggactcgtcgatagtgtggtccagactgctttcgcaatgcagttgcctttttgtgccaataacgtaatcaagcactttgtttgtgaaatactagctatccttaaactggcttgtgcagatatcagcatcaacgtgatctctatgacgggtagcaacttgatagttctggtgatccctctgttggtgatcagtatcagctatattttcattgtcgcaacaatcctgaggattccctccactgagggcaagcataaagccttttctacttgttctgctcacctaactgtcgtgattatattctatggcacgatatttttcatgtacgctaaaccagagtctaaggcgtccgtggactccgggaacgaagacattattgaagcactgatcagcctgttctatggtgtaatgactcccatgcttaatcctctgatttacagtctaaggaataaagatgtaaaggcggcagtcaagaacatcctgtgtaggaagaacttctctgacggcaagtag

SEQ ID NO: 44257 - DNA, 957 bp, Artificial Sequence
  Description of Artificial Sequence: Synthetic coding sequence
atggagtgggagaaccagaccatcctggtggagttcttcctgaaggggcatagtgtgcatccacggctggaactgttgttttttgtgctgatatttataatgtacgttgtgatactactggggaatgggacactcattcttattagcatcctggacccacacctgcataccccaatgtacttctttttggggaacctgtcctttttggatatctgctacactacgactagcattccttctacactggtgtcatttctgtctgaacgaaagactataagcttctctggttgcgccgttcagatgtttcttgggttggccatgggtaccacagaatgtgtgctgctgggcatgatggcattcgatcgctacgtggccatctgtaaccccctaaggtaccccataatcatgagcaaaaatgcctacgtgccaatggctgtggggtcttggtttgcaggtatagtcaactcggccgtacaaaccacattcgtggttcaactgcccttttgtaggaagaatgtgattaaccatttctcctgcgagatactggccgtgatgaagctggcgtgcgctgacataagcgggaatgagttcctgatgctggtcgcaaccatcttgttcactcttatgcctctgctcctgatcgtgatctcttattccctcatcatcagcagcatcctgaagatccatagctctgaaggccgaagtaaggctttttcaacctgcagcgcacacctgactgtggtaattatcttctacgggaccatactgttcatgtacatgaaacccaagtctaaggagaccctgaactccgacgacttagatgcaaccgacaagatcatttcaatgttttacggggtcatgacccccatgatgaacccgttaatctatagcctgcgcaataaagatgttaaggaggctgtgaagcaccttcctaataggagattttttagcaagtag

SEQ ID NO: 44258 - DNA, 1041 bp, Artificial Sequence
  Description of Artificial Sequence: Synthetic coding sequence
atgtaccggttcaccgacttcgacgtgagcaacatcagcatctacctgaaccacgtactcttctatacaactcagcaggccggggatcttgaacacatggagactaggaactattccgctatgacggagttttttctggtgggactaagccagtaccctgaacttcagcttttcctgtttctgctatgtctgatcatgtacatgatcatccttctcggcaactccctcctcataattattacgatcctggattcgagactgcatacacccatgtactttttccttggaaatttatctttcttagatatttgctacacctccagctccataccacctatgctcatcatcttcatgtcagagcgcaagtctatcagctttatcggctgtgcccttcagatggttgtgagtcttggacttggcagtactgagtgtgtgcttctcgcggtgatggcttacgatcactatgttgccatttgtaatcccctgcggtacagcattatcatgaatggagttctgtacgttcaaatggctgcttggagctggataatcgggtgcctgacaagcttgcttcagacagtgctgactatgatgctgccattttgcgggaacaacgttatcgatcacattacgtgcgagatcctggcccttctgaaactggtatgctcggacatcaccatcaatgtgttgatcatgacagtcaccaatattgtgtccctcgttattctcctgctgctgatatttatatcttacgtcttcatcctgtcctcaatactgcggatcaactgcgctgaggggcgcaagaaggctttcagcacttgctctgcccacagcatagtggtaatactgttctacggatcagcactgttcatgtatatgaagcccaagtcgaaaaacacaaatacctccgatgagattatcggcctgagttacggtgtggttagcccgatgctgaacccaattatttacagcctacgcaacaaagaggtcaaggaagcagtgaaaaaagtcctctcacgacacctccatttactgaagatgtag

SEQ ID NO: 44259 - DNA, 960 bp, Artificial Sequence
  Description of Artificial Sequence: Synthetic coding sequence
atgttccccgccaactggaccagcgtgaaggtgttcttcttcctgggattttttcattaccccaaagtgcaggttatcatcttcgccgtctgccttctgatgtacttgatcactctgttaggtaatatcttcctgatctctattactatcctggactcccatctgcatacaccaatgtacctgttcctcagcaacctgtccttcttagacatttggtatagctcatctgctctgtcaccaatgctcgctaacttcgtcagtggcaggaatacaatctccttcagcgggtgcgccacgcaaatgtatctgtctttggccatgggcagcacggagtgtgtactcctgcctatgatggcgtatgatagatatgtggcgatttgtaatccactcagatatcccgtcatcatgaaccggcggacatgcgttcagatagccgcgggctcttggatgaccggttgccttaccgctatggttgaaatgatgtctgtcctgcccctgagcctgtgtgggaactctatcatcaaccattttacgtgtgagatactggcaattctcaagcttgtttgcgtagacacatctttagtccagctgattatgctcgtgattagtgtccttctgctgcccatgccaatgctgttaatctgcatcagctacgcctttattttggccagtatccttcgcatctcttccgtcgagggcaggagcaaagctttctctacttgcaccgcacatctcatggtggtcgttctgttctatggtacagcactgagtatgcacctgaagccttctgccgtggacagccaagaaatcgataagtttatggctctcgtctacgcaggacaaactcccatgctgaatccaatcatttactctctaaggaacaaagaggtgaaggtagcactgaagaaactcttgatccgcaaccacttcaataccgcttttatatcaatcctcaaatag

SEQ ID NO: 44260 - DNA, 927 bp, Artificial Sequence
  Description of Artificial Sequence: Synthetic coding sequence
atggccatggacaacgtgaccgccgtgttccagttcctgctgatcggcatcagtaactatccgcagtggagagatacttttttcaccttagtattgatcatctatctcagcacccttctagggaacggattcatgattttcctgatccactttgatccgaacttgcacacgcctatttactttttcctaagtaacctgtcctttctggatttgtgttatggtacagcgtcgatgcctcaggcactggtgcattgcttctctacacacccctatttgtcatacccccgctgcctggctcagacaagtgtgtctctcgccttagcaactgccgagtgcctgttactggctgcaatggcttatgatcgcgtggtagccatctcaaatcccttgagatattctgtcgttatgaatggcccagtttgcgtgtgcctggtggcgacatcttgggggacatcactggtcttgactgcgatgctgatcctgagtctgcgcctccatttctgtggggctaacgtcattaaccattttgcctgcgagatcctttccctaatcaaactcacttgttcagacacctcattgaacgagttcatgattttaatcaccagcatattcacccttctcttaccctttggctttgtgctactgagttatattcggattgccatggcgatcatcagaattcggtcactgcaaggcaggttaaaagccttcacaacctgcggctcccatctgactgtcgttacgattttctacggatcagctatatctatgtacatgaaaacgcagagtaagtcctatcctgaccaggataaattcatatctgtgttttatggtgccctgacaccaatgctaaacccccttatctacagtttgcgaaaaaaggatgtaaaacgcgccatcaggaaggtcatgctaaaacggacctag

SEQ ID NO: 44261 - DNA, 939 bp, Artificial Sequence
  Description of Artificial Sequence: Synthetic coding sequence
atggagcccctgaaccggaccgaggtgagcgagttcttcctgaagggattttctggctatcctgctctcgagcatctgctgttccctctctgttcggcaatgtatctagtcaccctattgggcaacacagcaatcatggcagtatctgtgcttgatatccacttgcacactcctgtgtacttcttcctgggcaatttaagcacattagacatctgctacacccctacattcgtgccgttgatgcttgtacatctgctcagtagtcggaaaaccatctcgtttgctgtttgcgccattcagatgtgtctttctctgtctacaggttccacagaatgtttgctgctcgccataactgcgtatgataggtatctagctatctgccaacctctgcggtaccacgtgctgatgagccaccgtctatgtgttctactgatgggcgctgcctgggtgctgtgtctccttaagtctgtgacagaaatggtgatcagtatgcgactgcctttctgcgggcatcacgtagtctctcactttacctgtaagatcctagcagtcttaaagcttgcctgcgggaacactagcgtgtcagaggactttctgttggctggatcaatcctgttgctgcctgtgcctctggctttcatatgcctgtcttatctgttaatcctcgctactattctccgcgtgccatctgctgcccggtgctgtaaggctttttctacatgcctggcccaccttgctgtcgttctgcttttttacggaacaatcatcttcatgtatctcaagccgaagagtaaggaggcccatatctctgatgaggtcttcacggtgctgtacgccatggttacaacgatgctgaacccgactatatactccctccgcaataaagaagtcaaggaagcagctagaaaagtctggggaagatcaagagccagcaggtag

SEQ ID NO: 44262 - DNA, 930 bp, Artificial Sequence
  Description of Artificial Sequence: Synthetic coding sequence
atggccaacctgaccatcgtgaccgagttcatcctgatgggcttcagcaccaacaagaacatgtgcatcctgcatagcatcctgttcttactcatttacctgtgcgcactgatggggaacgtgcttattattatgatcaccactctcgatcaccacctacacacgccagtgtattttttcctcaaaaacctgtcgtttctggacctgtgtctgatcagcgtgacggcacctaaatcgattgccaatagccttattcataataatagcatttcatttttaggctgcgtgagtcaggtgttcttgctgctgtcatctgcctccgccgagctgctcctccttactgtgatgtcatttgatagatacaccgctatttgccacccgctgcactacgacgtcataatggatcgctccacatgcgtgcagcgtgccacagtcagttggctgtacggaggcttaatcgcggtgatgcacaccgctggcacatttagtctgagttattgcggctccaacatggtgcatcaatttttttgtgatattcctcagttactagcaatttcatgctctgagaatctgattagagaaatagccctgattctgataaacgtggttctcgatttctgctgttttatcgtcataataatcacttatgtccacgtgtttagtacagtcaagaagatcccaagtacagagggtcagtcgaaggcctatagtatctgtcttcctcaccttttggtggtactgtttttatctactggctttatagcgtacctgaaacccgcctcagagtcaccttccattctcgatgcagtaatctctgtcttttacaccatgttaccacccacattcaaccccatcatttattctttgaggaataaagccatcaaagtggctcttggcatgcttataaagggtaaactgaccaagaagtag

SEQ ID NO: 44263 - DNA, 945 bp, Artificial Sequence
  Description of Artificial Sequence: Synthetic coding sequence
atggccaacgtgaccctggtgaccggcttcctgctgatgggcttcagcaacatccagaaattacgcattttatacggggtattgttcctgctgatttacttggccgcactgatgagcaacctgctgatcataaccctgatcactctggatgttaagcttcagacacctatgtatttcttccttaaaaacttgagcttcctggacgtttttctcgtgtcagtacccattccgaagttcatcgtcaataacttgacccataataacagcatcagtattttaggctgtgctttccaattacttctgatgacatccttctccgctggagagatatttatcttgacagctatgagctatgatcgctacgttgccatatgttgccctctgaactacgaggtaattatgaatactggcgtctgtgtgctgatggccagcgttagctgggccataggcgggcttttcggcaccgcatacacggccgggacgtttagtatgcctttttgcggctcttccgtgattccccagtttttttgtgacgtgccctctctcctgaggatttcatgctctgaaactttaatggtgatatatgctggcattggtgttggcgcttgcctgtccattagttgcttcatctgtatcgtgatctcatacatttacatatttagcaccgttcttaagatccctacaaccaagggacagagcaaagcatttagtacgtgctttcctcacctgacggtgttcactgtgttcattattaccgcgtatttcgtctatctcaagcccccgagtaatagccctagtgttatagacagacttctgtcagtcatttacaccgtcatgccccccgtgttcaatccagtcacttactctttacgcaacaacgacatgaaatgtgcattgatcaggctcctccagaagacctacggccaagaggcatactttatatag

SEQ ID NO: 44264 - DNA, 939 bp, Artificial Sequence
  Description of Artificial Sequence: Synthetic coding sequence
atgcccaacagcaccaccgtgatggagttcctgctgatgcggttctccgacgtctggacccttcagattctccattcagcaagtttttttatgctttatctggtgaccctgatgggtaacatcctcatcgtgaccgttactacttgcgactcttccctgcacatgccgatgtattttttcctaagaaatctatcgattcttgatgcttgctacatatccgtcaccgtgccaacctcttgcgtcaatagcctcctggactccactacaatctctaaggctggttgtgtggctcaagtctttctggtggtgtttttcgtgtacgtggaactgctgtttttgactatcatggcccacgaccggtacgtagcagtgtgccagcccctgcattaccccgtaatcgtgaattcacgcatctgcattcagatgacactggcaagtctactgagcggcctcgtgtacgctggtatgcataccggcagcacttttcaattgcctttttgccgatctaatgtgattcatcagttcttctgcgatatcccttcactattaaagctttcatgttctgacacctttagtaacgaagtgatgatagtggtctcagccctcggcgttggcggtgggtgcttcatctttattattcggtcctatatccacatctttagcactgtgcttggctttcctagaggagctgatcgcacaaaggccttctccacctgcattccgcatatcctggtcgtgtccgtgtttctgtcctcctgtagcagcgtgtacctccgccctccagcaataccagcggctacgcaggaccttatcctctccgggttctactcaatcatgcctcccttgttcaaccccattatttacagcctgcgcaataagcagattaaagtggctataaagaagattatgaagcgcattttctatagtgagaatgtttag

SEQ ID NO: 44265 - DNA, 3666 bp, Artificial Sequence
  Description of Artificial Sequence: Synthetic coding sequence
atgatgttccggagcgaccggatgtggagctgccactggaagtggaaaccttctcccttattgtttctctttgctttgtacattatgtgtgttccgcactcagtttggggctgtgcaaattgccgtgtcgtcctgagtaatccctccggcacattcacctcgccatgttatcctaatgactatcctaactctcaggcttgcatgtggacgctgcgggcccctacaggctatatcatccaaatcacctttaatgacttcgatatcgaggaagccccaaactgtatttacgacagtctgagtctggataacggagagtctcagactaagttttgtggcgcaactgcgaaagggctgtctttcaattccagcgccaacgagatgcacgttagtttttcgtcagacttcagtatacagaaaaagggcttcaatgcgtcgtacattcgggtggccgtgagcctccgcaaccaaaaggtgatcctgccccagacatcagatgcttaccaagtgtcagtggcgaaaagcatctccattcctgagttatccgcgtttaccctgtgtttcgaagccacaaaggttggtcacgaggattccgactggaccgccttctcatattccaacgccagcttcacccagctgttgagttttggtaaggccaaaagcgggtactttctctctatatcagattccaaatgtctactcaacaacgctctgccggtcaaggaaaaagaggacatctttgcggaaagcttcgagcagctgtgtctcgtgtggaacaactctcttggctccatcggtgtgaattttaagagaaattacgagacagtgccctgcgattcaaccatctccaaagtaatacccggtaacggcaaactgctgctcggctctaaccagaatgagatcgtctccctgaaaggcgacatttacaatttccgcctgtggaacttcaccatgaacgccaaaattctcagtaatttaagctgcaacgtcaagggaaatgtcgtggattggcaaaatgacttctggaacatcccgaacttggctctcaaagcagaaagcaatctgtcatgtggcagctacctcatcccgctgcccgccgctgagctggctagttgcgctgatcttggaaccttatgtcaggctactgttaactcccccagcacgactcccccaactgtcacgaccaacatgccggtaacaaaccgaattgacaaacagcgcaacgatgggattatttacagaatcagcgtggtgattcagaatatattgcggcatcccgaggtaaaggtgcagtccaaggtcgctgagtggctgaactcaacttttcaaaattggaattatacagtgtatgttgtcaacatttcctttcatctctccgctggcgaggataaaataaaggtaaagcggtctctcgaggacgagccacgtctggtactttgggcattactggtgtataacgctacaaataacacaaatctggaagggaagatcattcagcagaagttgctcaagaataacgagagtttggatgaaggattgaggctgcacaccgtgaatgtgaggcagctagggcactgtctggccatggaggaacctaaaggatattattggccatcgattcagccttccgagtatgtgctgccatgcccagataagcctggcttctctgctagtagaatttgtttttataacgcgaccaaccctctggtcacctactggggccctgtggacattagcaactgcctgaaggaggccaacgaagtagccaatcagatcctgaacctcactgctgacgggcagaacctgacatcagccaacataacgaatattgtcgagcaggtcaagagaattgtcaataaggaggaaaatatcgacatcactctgggcagtactttgatgaatatcttttcgaacatcctgagctccagtgactccgatttgcttgaatcctcttctgaggccctcaagaccattgatgagctggcattcaagatagacctgaactcaacaagccatgtcaatattacaacaaggaatctggcgttgtcagtgtcgtccttgctccctgggaccaatgcaatttccaacttttctataggactgccttctaacaacgagagctacttccaaatggattttgagtccggacaagttgatcctctcgcaagtgtgattctgccaccaaatctgctggagaatcttagcccagaagactctgtgctggtgagacgggcacagtttacattttttaataaaacaggtttgtttcaggacgtaggtccccagcggaagacacttgtaagctatgtcatggcatgttctattgggaacatcaccatccaaaaccttaaggacccggtgcagatcaagataaaacatacaagaacacaagaggttcaccatcctatatgcgccttttgggatctgaataagaacaagtctttcggaggatggaataccagcggctgcgttgctcaccgagacagcgacgcatccgagacagtgtgcctgtgcaaccacttcactcacttcggtgtattaatggatctgcctagatctgcaagccagttggacgctcgcaacacaaaggtgctgacatttataagctacataggatgtggcatctcagcaattttctctgctgccaccctgcttacttacgtagctttcgagaagctcaggagggattatccctctaaaatccttatgaacctttctaccgccctgcttttcctgaatcttcttttcttgctcgacggttggatcactagctttaacgtagacggtttatgtatcgccgtcgctgttcttctgcacttctttctattggcaactttcacttggatgggcctagaagcaatccacatgtatatcgcactggtaaaagtgttcaacacttacatccgcaggtatatcttaaaattttgtattatcgggtgggggttacccgccttggtggtatctgtggtgcttgccagccgaaataataatgaagtgtacggcaaagagagctacggtaaggagaaaggcgacgagttctgctggatacaggatcccgtgatcttctatgtaacgtgcgctggatacttcggagtaatgttctttctaaacatcgctatgttcatagtagtgatggtgcagatctgcggcagaaacgggaaaagaagcaatcggacgctgcgcgaagaggtgctgcggaacctccgcagcgttgtaagtcttactttcctgcttggcatgacttggggattcgcttttttcgcctggggtcccctcaatatccctttcatgtacctgttttccatcttcaatagtctccaaggactcttcatttttatatttcactgcgctatgaaggagaatgtgcaaaaacaatggaggcagcacctttgctgtggacgctttcgcctggcagacaattccgattggtctaaaaccgctaccaacatcataaagaagtcaagcgataacctcggaaagtccctttcatcttcttctattgggtcaaattccacatatttgacatcaaagtctaagagcagttctacgacctacttcaagcggaacagtcacaccgacaacgtttcatacgagcatagttttaacaagagtggcagtctgcggcagtgctttcacgggcaggtccttgtcaagacaggaccttgctag

SEQ ID NO: 44266 - DNA, 966 bp, Artificial Sequence
  Description of Artificial Sequence: Synthetic coding sequence
atggtgaacctgaccagcatgagcggcttcctgctgatgggcttctccgacgagcggaagctccagatactgcatgctctggtgttcctcgttacctacttgctggcattgaccggaaacctgttgattatcacaattatcaccgtggacagacggctgcacagtcctatgtattatttcttgaaacacttgagccttctggatttatgttttatttcggtcacggtcccccagagcatcgcaaactcattgatgggcaatgggtacatcagcctggtacagtgcattctccaggtgtttttctttatcgccttagcgtcaagcgaggtggctattctcaccgtcatgtcttacgatcggtacgcagcaatttgccagcccttacactacgagactatcatggatccgcgggcctgtaggcatgcagtcatagccgtgtggatcgcgggcggattgtcaggccttatgcacgccgctatcaatttttccatacccctgtgtggaaagcgcgtgatccaccagtttttttgtgatgtgccgcaaatgttgaaacttgcctgctcatacgagtttattaacgagattgcactcgctgcatttacgacctcagctgccttcatctgtttaatatctattgtgctgtcgtacatcagaatctttagcacagtgctgagaattccatcagccgagggcagaaccaaagtgttttcaacatgcctgccacatctgttcgtagccacttttttcctgtctgcggctggcttcgagtttttgcgtctgcctagtgacagctcctcaactgtcgacctggtcttctccgttttttatactgttattccacctacattaaatcccgtcatctatagcctgagaaacgactcaatgaaggcagccctgcgcaaaatgttgtccaaggaagaactgccccagaggaagatgtgtctaaaggctatgtttaagctgtag

SEQ ID NO: 44267 - DNA, 966 bp, Artificial Sequence
  Description of Artificial Sequence: Synthetic coding sequence
atggtgaacctgaccagcatgagcggcttcctgctgatgggcttcagcgatgagcgaaagctccagatacttcacgccctcgttttcctcgtgacgtatctcctagctcttacaggaaacctgctgataatcacaatcatcaccgttgaccgacggctgcattctccaatgtattacttcttgaaacatctgagcctgctagacctctgctttatcagcgtcaccgttccacagagtattgctaactccctaatgggaaacggttacatctctttggtgcaatgcatcttacaggttttctttttcattgccctcgcatcttctgaagtggctattcttacagtaatgagctacgatcgctatgccgccatctgccagcccttacattacgagacaatcatggacccgcgggcctgccggcacgctgttattgctgtatggatcgccggaggtctctccggtctgatgcacgctgctattaacttcagcattcctctgtgcggaaaacgggtcatccaccagttcttttgcgacgtacctcagatgctgaaattggcctgctcatacgagtttatcaacgagatcgctttggccgcatttacaacttcagcagcatttatttgtctgattagtatcgtgttatcttatatcagaatattctcgactgtgctgcgaataccctcggccgaaggacgtacaaaagtcttctcgacttgcttaccccatctgtttgtggccaccttcttcctgagtgccgcaggattcgagtttctgcggttgccttctgacagcagctccaccgttgatctggtgttctcggtattttacaccgtgataccacctacgctaaaccccgtcatttatagcctgaggaacgatagcatgaaggccgctctgcgaaagatgctgtctaaagaagaactcccccagagaaagatgtgtctgaaggctatgttcaaactttag

SEQ ID NO: 44268 - DNA, 945 bp, Artificial Sequence
  Description of Artificial Sequence: Synthetic coding sequence
atgaccaaccagacccagatgatggagttcctgctggtgcggttcaccgaaaattgggttctgctgaggctgcacgctctgctgttctcactcatatacctcactgccgttctgatgaacctcgttattatcctgctaatgattctggatcatcgactgcatatggctatgtatttttttctgagacacctgagtttccttgacctatgcctcatttcagcaaccgtgccaaaaagcatactcaacagcgtggcatcaacagattctattagcttcttgggatgcgtacttcagctgttcctcgtggtgttactggccgggtctgagattggcatactcacagccatgtcctacgaccgctatgcggccatatgttgcccccttcactgcgaggcagtgatgtcacgcggtctttgcgtgcagctgatggcactaagctggttgaaccgcggagcccttggccttctctatactgcaggaacattctcacttaatttttatgggagcgatgagctccatcaattcttttgcgatgtgcccgcactgctgaagttaacatgtagcaaagagcatgccattattagtgtaagtgtggccattggcgtctgttatgccttttcatgtttggtatgcatcgtcgtaagctatgtgtacatttttagcgctgtgctcagaatttctcagagacagcggcagtccaaagctttctccaactgcgtgccacacctcatcgtcgtgaccgtgttcctggttaccggcgccgtggcctacctgaagcccggttctgatgcaccatcgatcttggatctgctcgtgtcggtgttttacagcgtggcccctcctaccttgaaccccgtcatttactgccttaaaaacaaagatattaagtccgccctttcaaaggtcctgtggaatgttcgctcatcaggagtgatgaagcgttag

SEQ ID NO: 44269 - DNA, 933 bp, Artificial Sequence
  Description of Artificial Sequence: Synthetic coding sequence
atgggcgagaaccagaccatggtgaccgagttcctgctgctgggctttctcctgggtccccggatccagatgcttctattcgggctgttcagcctgttttacatttttacactgcttggcaacggggcgatcctcggattaatttctctcgactctcgcctccacacaccaatgtacttcttcctcagccatctggcagtggtggatatcgcgtatacaagaaacaccgttccccagatgctggccaacttgctgcaccctgccaagcctattagctttgcaggctgcatgacgcaaacttttctatgcctgagctttggtcattcagagtgcctcctgcttgtgctgatgagctacgaccggtatgtcgccatctgccacccgctccgctactctgtgatcatgacctggcgcgtgtgtattactctcgccgtgacttcgtggacctgcgggagccttctcgccctggctcacgtggtgcttattcttcgactgcccttcagtggacctcatgagatcaatcacttcttctgtgaaatcctcagcgtgctccgtttggcctgcgctgatacttggctaaaccaggtggttatctttgctgcctgtgtttttttcctagtgggccctcctagcctagtgctagtgtcatatagtcatatcctcgctgcaatcctcaggattcagtcaggcgaaggaagacgcaaggcattcagtacatgctcctcgcatttatgcgtggtgggattgttctttggaagcgcaatcataatgtatatggccccgaaaagccgtcaccccgaggagcagcaaaaagtcttttttctgttctactcatttttcaacccaactcttaacccactcatatacagcctccgcaacggcgaagttaaaggagccttgaggcgcgctctgggcaaggagagccactcttag

SEQ ID NO: 44270 - DNA, 933 bp, Artificial Sequence
  Description of Artificial Sequence: Synthetic coding sequence
atggagagcaaccagacctggatcaccgaggtgatcctgctgggctttcaagtggatcccgcgctggagctgtttttgtttgggtttttcctcctattttattctttgaccctgatggggaatggcataattcttgggcttatttacttggattcccgactccatacacccatgtatgtgtttttgtcccacttggctatagtggatatgagttacgccagttctacagtgcctaagatgttggccaacctagtcatgcacaagaaggtcataagtttcgccccgtgtatccttcaaacatttctatatctggccttcgccatcacagagtgtctgattttggtgatgatgtgctatgatagatacgttgctatctgtcatcctctccaatatacactgatcatgaattggagagtctgcaccgttctggccagcacctgctggattttcagctttttactggctctggtgcatatcaccctaatcctacgactgcccttttgcggacctcagaaaattaatcactttttctgccagatcatgagcgtcttcaaactcgcatgcgccgacactcgcctgaaccaggttgtgctgttcgcaggcagcgcctttatcctggttgggcccttatgtttagtgctggtgtcatacttacatattctcgttgctattctccggatccagagtggggagggcaggcgtaaagcgtttagcacatgttcatctcatctctgtgtcgtggggctgtttttcggcagcgctatagttatgtacatggcccccaagagctcccattctcaggaacgccgcaagatcttgtccctattttattccttattcaatcccattcttaacccgctcatttattccttgcggaatgctgaggtaaagggggccctaaaaagagtgctttggaaacagaggagcatgtag

SEQ ID NO: 44271 - DNA, 933 bp, Artificial Sequence
  Description of Artificial Sequence: Synthetic coding sequence
atggagggcaacaagacctggatcaccgacatcaccctgccccggttccaggtgggtccagcacttgaaattcttctctgtggactgttttctgcattttacaccctcaccttgctcggcaacggagtcatcttcgggattatttgtctggactgcaaactgcacacacctatgtacttctttctctctcatctggctatcgtggacatcagctatgcttcgaactatgtgccaaaaatgctaaccaatctgatgaaccaagagagcaccatcagcttctttccatgcatcatgcagaccttcttgtacctagccttcgcccatgttgaatgcttgattctggtggtcatgtcctacgaccgatatgccgacatctgtcatcccttgcgatataacagtctcatgtcttggcgggtctgcactgtgctcgccgtggctagctgggtgttttccttcctactcgctcttgtgccactggtgcttatcttgagcctccctttctgtggtccacacgagatcaaccacttcttttgcgaaatccttagtgtgctgaagctggcctgcgcagatacttggcttaaccaggtggtgattttcgcggcatgtgtgttcatcctggtgggacccttgtgccttgtattggtaagctatctccgaatcctcgctgctattttgcgcatacagtcgggagagggaaggcgaaaagctttctcaacatgcagtagtcacttatgtgtagttggactcttcttcgggtctgccattgttacctacatggctcccaagagccgacacccggaagaacagcagaaggtgctgtcccttttctacagtctgtttaaccccatgctgaatcctctgatttacagtctgagaaatgctgaggtcaagggagccctgagacgcgctctgcgcaaagagagactaacctag

SEQ ID NO: 44272 - DNA, 957 bp, Artificial Sequence
  Description of Artificial Sequence: Synthetic coding sequence
atggagggcaaccagacctggatcaccgacatcaccctgctgggctttcaagttggacccgccctggctattctcctctgcggcctcttctcagtgttctatacacttacattgctcggtaacggggtgatctttgggataatctgtctggattctaaactgcacacaccaatgtatttcttcctgagtcatctagctattatagacatgtcctacgcctccaataatgtgcctaagatgctggctaacctgatgaaccagaagcgaaccatctccttcgtgccgtgcatcatgcagacatttctgtaccttgccttcgctgtaactgaatgtcttatcctagtggtcatgtcatatgatcggtacgtggccatctgccaccccttccagtacactgtaatcatgtcctggcgcgtgtgtacaattcttgtcctgactagctggtcctgtggtttcgcactctccttagttcacgaaatcctgctgttgcggcttcctttctgcggccctagagatgtgaaccacctcttctgtgagatcctgagcgtgctgaagttggcctgcgcggacacctgggtcaaccaagtggtgatttttgccacatgtgttttcgtgttggtcggccccctctccctgatcttggtgtcctatatgcatattctcggtgcaattttgaaaatccagacaaaagaaggacggattaaggcctttagtacgtgcagctcccatttgtgtgtggtgggcctctttttcgggatcgccatggtggtgtatatggtaccggattccaatcagcgcgaggagcaggagaagatgttatctctctttcattcagtgtttaacccgatgctaaaccctcttatctactcactgcggaacgcccagctcaaaggcgcattgcatcgagctctgcagcggaagcggtcaatgcgaaccgtctatggcctttgcctgtag

SEQ ID NO: 44273 - DNA, 933 bp, Artificial Sequence
  Description of Artificial Sequence: Synthetic coding sequence
atgggcggcaaccagaccagcatcaccgagttcctgctgctgggctttccgattggcccgcgcattcagatgttactgtttgggctcttctccctgttctacatctttatccttctgggaaatgggaccattctgggtctgatcagcttagattcccgactccacacacctatgtactttttcttaagtcatctggcagtcgtcgatatagcatgcgcttgttctacagtgccccagatgctggtgaatctgctccatcccgcaaagcctatcagcttcgccgggtgtatgacccagatgtttctgtttctcagtttcgcacatacggagtgtttgttactcgtggttatgtcctacgacaggtatgtggcgatttgccaccctctcaggtattctaccatcatgacgtggaaggtgtgtattacactggccttaacatcctggatcttgggggtgctgcttgcactagtccacctggtcctgctgctgccgctgtctttctgtggcccgcagaaactgaaccacttcttttgcgagatcatggcagtgttgaagctggcttgcgccgacactcatatcaatgaggtaatggtgttagcgggggccgtctcagtgctggtaggcgcttttttctctacagtcattagttatgtccacatcttatgcgctattctcaagatccagagcggtgagggctgccaaaaggcctttagtatctgcagcagccatctctgcgttgtcggtctgttttatgggacagcaattattatgtacgtcgagccgcagtacgagagcccaaaggagcaaaaaaagtacttacttttattccacagcctgttcaatcccatgctgaacccccttatttattccctacggaataaagaggtgcagggcaccctgaagcggatgctggagaaaaagcgaacgtcttag

SEQ ID NO: 44274 - DNA, 933 bp, Artificial Sequence
  Description of Artificial Sequence: Synthetic coding sequence
atgggcgacaacatcaccagcatccgggagttcctgctgctgggcttccccgtgggccctcggatacagatgctcttgttcggattgttcagcctattttacgtgttcacccttttgggtaacggcaccatcttaggattgatttctctggattcacggctgcatgcacctatgtactttttcctctcacacctggcagttgtagatatagcctatgcatgcaacaccgtgccccgtatgctggttaaccttctgcaccccgcgaagccaatcagttttgcagggaggatgatgcagacatttctgtttagcactttcgcagtgaccgagtgtctgctgctggtcgtgatgtcttacgacctctacgtcgccatatgtcacccgttgagatatctggctatcatgacatggcgcgtatgcataacactggctgtgacatcatggacaaccggtgtgttgctcagcctcattcacctcgtactgctactgcctctgcccttctgccggcctcagaagatctaccacttcttctgcgagatcctcgccgtgctcaagctggcttgcgccgatacacacattaatgagaacatggtgctcgctggggctatttccggtctggtgggtccactgtccacaattgttgtgagctatatgtgcatcctttgtgcaattttgcagattcaatcccgggaagtacagaggaaggcatttcgtacatgcttctctcacctgtgcgtgataggactagtatacggaacagcaattatcatgtatgtaggcccccgctacggaaaccctaaagaacaaaagaaatacctactgctcttccattcgctttttaatcccatgctgaacccactgatttgctcccttcgcaactccgaggtgaagaatacacttaaaagagtgctgggagtggagagggccctgtag

SEQ ID NO: 44275 - DNA, 933 bp, Artificial Sequence
  Description of Artificial Sequence: Synthetic coding sequence
atgggcgagaaccagaccatggtgaccgagttcctgctgctgggcttccttctgggtcctcgcattcagatgctgctcttcgggctgttctcacttttctatatattcaccttattaggtaacggagctatactgggactgattagcctggatagccgccttcatacccccatgtatttctttctctctcaccttgcggtggtggacattgcgtacacgcgaaacacagtgccacaaatgctcgccaatttgctgcaccccgcaaagcccatctcattcgccggttgtatgacacagacattcctgtgtctgtcttttgggcactcagaatgtctgctgctggttctgatgagctacgatcgttatgttgctatttgtcaccctctgcggtattcagtcatcatgacttggagggtctgtatcacgttggcagtcacgtcctggacctgtgggtccctgctggccctggcacacgtcgtcctcattcttagattgcccttcagtggcccacacgaaattaatcacttcttttgcgagatcctgtctgtcctcagactcgcatgtgccgacacctggctgaatcaggtcgtcatcttcgccgcgtgcgtttttttcctggttgggccgccatcactggtgcttgtgtcttacagtcacattcttgccgcaatactacgcattcaaagcggggaaggcaggagaaaagcgttttccacatgctcctcccacttgtgtgtggttgggctgttcttcggttcagctattatcatgtacatggcacccaagtcgcgccaccccgaggaacaacagaaggtgttctttctcttttactccttcttcaatcctaccctcaaccctctcatctacagcctgagaaacggcgaggttaagggcgcgctgcgacgggccctcggcaaggagagtcatagctag

SEQ ID NO: 44276 - DNA, 936 bp, Artificial Sequence
  Description of Artificial Sequence: Synthetic coding sequence
atgaccaagaaccagacctgggtgaccgagttcatcctgctgggcttccctttgtcgctgcgaattcagatgttgttatcaggcttgttctcattgctgtatgtgtttactctgctgggtaatggcgcaatcctaggactgatttggttagacagtagattgcacacccccatgtatttcttccttagccatctggcgataatcgatatcagttacgcatctaacaatgttcctaagatgttgaccaacttgggcctaaacaaacgcaaaacaattagctttgtcccttgtaccatgcagacttttttgtacatggcctttgcccacactgagtgcttgattttggtcatgatgtcctacgaccgctacatggcaatttgtcatcctcttcagtattccgtgatcatgcggtggggcgtgtgtacagtccttgcggtgacatcttgggcctgtggatcgctcctagctctggtgcatgtggtgttgatcctccgactgccattttgtggaccccatgagattaaccatttcttctgcgaaatcttaagcgtgctgaagttagcctgcgctgacacttggcttaaccaggtcgtgatctttgcggccagcgtgttcattctcgtggggccactgtgtctagttttggtatcctattccagaatcctggcagccatattaaggatccaatcaggcgaaggacgaaggaaggcattctccacttgtagcagccatctttgcatggttggcctgttcttcggctctgccatcgtgatgtacatggcccccaaatccagacatccagaggagcagcagaaggtcctgtccttgttttatagcctgttcaatccaatgcttaaccctctgatctacagcctcaggaacgctgaggtgaagggcgctctcaagagagtcctttggaaacaacggtcgaaatag

SEQ ID NO: 44277 - DNA, 933 bp, Artificial Sequence
  Description of Artificial Sequence: Synthetic coding sequence
atgggcgacaacatcaccagcatcaccgagttcctgctgctgggcttccctgttggtcctcgtattcagatgttactattcgggctgttttccctgttttatgtgtttacactattgggcaacggtaccattcttggcttgatctcattggacagcaggctgcacgctcctatgtatttcttcttgtcccacctcgccgtggtagacatagcctacgcatgtaacaccgttcctaggatgcttgtgaatctcctccacccagctaaacctatttcatttgccggaaggatgatgcagacctttttattcagcacattcgcagtcaccgaatgtttgctccttgtggtgatgtcctacgacctctatgtagctatttgccatcccctcagatacctcgccataatgacatggcgcgtctgtattaccttagctgttactagttggaccaccggcgtcctgctctcactgattcacctagtgctcctgttgcctctaccattctgccggccccagaagatttatcacttcttctgtgagatcctggccgtgctgaaattggcctgcgcagacacgcatatcaacgagaacatggtccttgccggagcaatctcaggtctggtgggcccattgagcaccatcgtggtaagttatatgtgtatcctttgtgcaattcttcagatccagagtcgtgaggtgcagaggaaggcattctgtacatgctttagtcacttatgcgtgatcggactattctacggaaccgcaattatcatgtatgtgggcccacggtatggaaatcccaaagaacagaaaaaatatctcctgctctttcactctctcttcaatcccatgttgaacccacttatctgtagcttaagaaactcagaagtcaagaataccctgaaaagggtgctgggagtcgagcgggccctgtag

SEQ ID NO: 44278 - DNA, 972 bp, Artificial Sequence
  Description of Artificial Sequence: Synthetic coding sequence
atgtggcagaagaaccagaccagcctggccgacttcatcctggagggcttatttgatgatagcctaacgcacttgttcctgttcagcctgactatggtggtttttttaatagccgttagtgggaacaccctgactatcctattaatctgcatcgatcctcagctgcacacaccaatgtactttttgctcagccagctgtctcttatggacctgatgcatgtgagcactatcatactcaagatggctaccaactacctgtcgggaaagaaatccatctcatttgtcggatgtgcaacccagcattttctgtatctgtgtctgggcggcgcagagtgcttcctcctggcagtaatgtcatacgataggtacgtggccatttgccacccattgcggtacgcggtgctaatgaacaagaaagtcggcctgatgatggccgtgatgtcatggttgggcgccagcgtgaatagtttgatacacatggctatcttgatgcacttcccattttgtggaccccggaaggtgtatcatttttactgcgaatttccagctgtagtcaagctggtctgcggcgatattaccgtgtatgaaaccactgtgtacatcagctctattctgctcctgctacctattttcctcatctccacatcatacgtgtttatccttcagagcgtgattcagatgcgaagcagtggttccaaaaggaatgccttcgccacttgtggctcacacctaacagtagtgtcactatggttcggagcctgcattttctcatatatgagaccgaggtcccagtgtacacttcttcaaaataaggtagggtcagtcttctactcaattatcacaccaacactaaatagtctgatctatacccttcggaataaggatgttgcgaaggccctccggagggtcctcagaagagacgtgattactcagtgtattcagcgcctacagctatggctgcctagggtatag

SEQ ID NO: 44279 - DNA, 951 bp, Artificial Sequence
  Description of Artificial Sequence: Synthetic coding sequence
atggagctgtggaacttcaccctgggcagcggcttcatcctggtgggcatcctcaacgatagtggatctccagaactgttatgcgccacgatcacgatcctgtacttattagccctgatctccaacggactgttgctcctggcaattacaatggaagccaggctgcacatgcccatgtatctgttacttggccaattgtcccttatggacctgctttttaccagcgtcgtgaccccaaaggccctcgcagatttcctgcggcgcgaaaatacgatctcctttggtggctgcgccttgcagatgtttctcgccttaaccatgggcggggcagaggaccttctgctggctttcatggcatatgataggtacgtcgctatttgccacccgctgacatacatgacactgatgagcagcagggcatgttggctgatggtagccaccagctggatcctggcttctttaagcgccttgatttacactgtgtacacaatgcactaccctttctgtcgcgctcaagagattagacaccttctatgcgagattccccatctcctcaaggtcgcttgtgcagacactagtaggtatgaactaatggtctacgtcatgggagtgactttcctgattccctctctcgccgccattctggccagctatacgcaaatccttctgacagtgctccatatgcctagcaatgaggggagaaagaaggctctcgtgacttgctcttcacatctaacagtggtcggcatgttctatggcgcagctacattcatgtatgttctgccatcttcatttcactctacacgccaagataacatcataagcgtgttttatacgatagtcacgcccgccctgaacccgctgatctactccctgcgcaacaaagaagtgatgcgggctcttcgccgggtcctcggaaagtacatgttgcctgctcacagtacactgtag

SEQ ID NO: 44280 - DNA, 987 bp, Artificial Sequence
  Description of Artificial Sequence: Synthetic coding sequence
atgggccaccagaaccacaccttcagcagcgacttcatcctgctgggcctgttctcttcgtcacccacctcagtcgtttttttccttgtgctgtttgtgatcttcatcatgagcgtcaccgagaatacactcatgattctacttataaggtcggattcccgcttgcataccccaatgtactttctgctaagccacctgtctctaatggatattctgcacgtgtctaatatcgtgccgaagatggtgacaaactttctcagcggctcccgcaccatcagttttgctggctgtgggttccaggttttcctctccctgacccttctcggcggtgagtgtctgctgttagccgctatgagctgtgataggtacgtggctatctgtcatccccttcggtacccgatcttaatgaaggagtatgcttcagctttgatggccggcggtagctggctgatcggcgtgttcaacagcactgtgcacactgcttatgctctgcagttccctttttgtggttcccgggctatcgaccatttcttttgcgaggtgccagcaatgctgaaactgtcctgtgccgatacaacacgctacgagcgcggggtgtgcgtctctgctgttatatttctgttgatacctttttccttaatcagtgctagttatggacagattatcttgacagtcctgcagatgaagagctccgaggcacgtaaaaagagcttttccacgtgctcctttcatatgattgtggtcactatgtactacgggccgttcatctttacatacatgaggccaaagtcttaccatactcctggacaagataaattcttagctatcttttacacaatactaacaccaaccctgaacccgttcatctacagctttcgaaataaagacgtgctggctgtgatgaaaaacatgctgaaaagtaattttctgcacaagaaaatgaaccggaaaatacccgaatgcgtcttttgcctcttcctgtgctag

SEQ ID NO: 44281 - DNA, 1008 bp, Artificial Sequence
  Description of Artificial Sequence: Synthetic coding sequence
atgaacatcagcgacgtgatcagcttcgacatcctggtgagcgccatgaagaccggcaaccagtcgttcgggaccgacttcctgctggtcggactattccaatatggctggataaactctctgttgttcgtcgtgatcgccacactctttaccgtcgcgctgacgggaaacatcatgctgattcatttaattcggttgaacacacggctccacacccccatgtacttccttctctcccagctctcaatagtggatcttatgtatatcagtaccacggtgcccaagatggcggtaagcttcctctcccaaagtaaaactatacggtttctcgggtgcgagatacagacatatgtcttcctggcactcggcgggactgaggccttgctgttgggctttatgagttatgacaggtatgtagccatctgtcatccgctccattaccccatgctgatgtctaagaagatttgctgtctgatggtggcttgcgcttgggcctcaggttccatcaatgcatttattcatacgttgtatgtcttccaacttcccttttgtagatctaggttgatcaatcatttcttttgtgaagttccagcccttctgtctttggtgtgtcaggacacctctcaatatgaatacacggtcttactgtccggacttataattcttcttctcccatttctcgctatcctcgcatcttacgctagagttttgatcgtggtgttccagatgtcctccgggaaggggcaggccaaggcggtgagcacttgctctagccacctcatcgtagcctccctgttctatgccaccaccctgttcacctatacgcgacctcactccctgcggagtcctagccgtgataaggctgtggccgttttttatacaattgtcacgcctctgttaaacccattcatctattccttgagaaacaaggaggtgacgggtgcggtgaggcgcctgttaggttactggatctgttgcagaaaatatgatttcagaagcctgtactag

SEQ ID NO: 44282 - DNA, 930 bp, Artificial Sequence
  Description of Artificial Sequence: Synthetic coding sequence
atgaagaacaagaccgtgctgaccgagttcatcctgctgggcctgacagatgtgcctgaattgcaggtagccgtgttcactttcctctttttggcctacctcttgtcaatcttaggcaacctcacaattctgatccttacgttattggactctcacctccaaacacccatgtacttcttcctgcgcaactttagttttctggagatttctttcactaacatttttatccctcgcgtcctgatctctatcaccaccggcaacaaaagcatctcatttgccggatgcttcacccagtacttttttgctatgtttctcggggccacagaattttacctcctcgccgccatgagttacgatcgatacgtggcgatatgtaagcccttgcactacactactattatgagtagcaggatctgcattcagctgattttctgcagctggcttgggggccttatggcaatcataccgactatcactctgatgtcccagcaggatttctgcgcaagcaaccgcctgaaccactacttctgtgactatgagccactcctcgaattgagttgctccgatacctccctgattgagaaagtcgtgttccttgtggctagcgtcactttagtggtcactctggtgctggtaatactctcttatgcttttatcatcaaaacaatactcaagctgccttccgctcagcagcggaccaaggccttttctacttgttcatcccatatgattgtgatttcgctgagttatgggtcttgtatgtttatgtacatcaaccccagcgcgaaggagggcgacacctttaacaagggggtcgccttgctcattaccagtgtggctcctcttctcaacccattcatttatacattgaggaatcagcaagtgaaacaacctttcaaagacatggtgaaaaagctcctgaacctgtag

SEQ ID NO: 44283 - DNA, 963 bp, Artificial Sequence
  Description of Artificial Sequence: Synthetic coding sequence
atggacgccaccgcctgcaacgagagcgtggacggcagccccgtgttttacctgctgggcatcccctctctacccgaaaccttctttctcccagtcttctttatttttctcctgttctaccttctgattctgatggggaatgcactcatcctggtggcggtcgtcgctgagccgtcccttcataagcccatgtacttcttcctgataaacctgtctaccctggacattctatttacaactaccacagttccgaaaatgctctcgctgttcttgctcggcgatcgctttttgagcttttccagctgtcttctgcagatgtatctgtttcagagctttacctgtagtgaggctttcatccttgtcgtgatggcttacgaccgctatgtcgccatctgtcaccccctgcactatccagtgctcatgaatccgcagaccaatgccactcttgcagcgagcgcatggctgactgcacttctgctgcccattcccgccgttgtgaggacatcccagatggcatataactctatcgcatatatctaccactgcttctgcgaccacttggccgtggtgcaggctagctgcagtgacaccactccacaaacccttatgggattctgtatcgctatggtagtgagcttcctgccattgttgttggttctgttatcatacgtccacatacttgcgtccgtcctgaggatcagctccctggaagggagggctaaagctttttccacctgctcaagccacctactagttgtcggcacctattactcttcaatcgcaatagcctacgtagcgtaccgggctgatctccccttggattttcacataatgggaaatgttgtttacgccatcctgactccgattctcaacccactcatctacacactgaggaacagggacgtgaaagcagccatcactaagatcatgtcccaggacccaggatgtgatcgttcaatttag

SEQ ID NO: 44284 - DNA, 954 bp, Artificial Sequence
  Description of Artificial Sequence: Synthetic coding sequence
atgaagagcgacaaccacagcttcctgggcgacagccccaaggcctttatattgttgggggtgtccgaccgcccatggctggagctgccactattcgtcgtacttttgctgagttacgtactggctatgcttgggaatgttgcaatcattctagcttctcgcgtagatccacagctacatagccccatgtacatctttctcagtcacctgagctttctcgacctgtgctacacaacaacaacagtgccacagatgctggtcaacatgggttcctcacagaaaacaattagctacggcggctgcactgtacagtacgccgtcttccattggctcggctgcactgaatgcatagtgctcgcagccatggcactagaccggtacgtcgctatctgcaaacctttgcactacgctgtgctgatgcaccgtgctctctgccagcagctcgttgcattggcgtggctgtctggttttggcaattcattcgtgcaagtggtactgacagtgcagctgccattttgcggacggcaggtacttaataatttcttctgtgaagtgcctgccgtgattaaactgagttgcgccgacactgcagtgaatgatacgatcttagccgttttagtagctttctttgttttggttccactcgctcttatcctgctgagttacggctttatcgcccgggccgtgcttaggatccagagttctaagggtcgacacaaagcatttggtacatgctctagccacctgatgatagtgagtttattctatctgcccgccatttacatgtacctccagcctcccagtagctattcccaggaacagggtaagttcattagcttgttttacagcatcatcacgcccacactgaatccattcacttataccctgcgtaataaggacatgaagggcgctcttcggaggctactcgcccgcatttggcggctatgtggctag

SEQ ID NO: 44285 - DNA, 1074 bp, Artificial Sequence
  Description of Artificial Sequence: Synthetic coding sequence
atgaactgggtgaacaagagcgtgccccaggagttcatcctgctggtcttctctgatcagccatggttggagataccacccttcgtgatgtttctattctcctacatacttactatcttcgggaacctgacaattattctggtgtcccacgtagactttaaactccacacccccatgtactttttcctgtcaaatctgtctctgctcgacctgtgctacacaacctcaacagtcccgcagatgttggttaacatttgcaacactaggaaggttattagttatggtggttgcgtcgcccagttgtttatattcctggcgctgggctctacagagtgtcttctgctcgcagtgatgtgctttgacaggttcgttgctatttgcaggcccttacattatagcatcataatgcatcagagactttgctttcaactggctgccgctagctggataagcggcttttccaattcggtgttacagtcaacatggacactgaagatgccgttgtgcgggcataaggaggttgatcatttcttctgtgaggtcccagccttactcaaactgagttgtgtggatacgactgcaaatgaggcagaactcttttttatatccgtgttatttctactcatcccagtgactttgattcttatttcatacgccttcatagtgcaagcagtgttgcggattcagagcgcagagggccagcggaaagcctttggaacctgcgggagccacctgattgtggtgtccctgttttacggcaccgcgatctccatgtacctgcagccacctagcccaagctcaaaagacaggggaaagatggtgagcttgttttgcggaatcatcgccccgatgctgaatccactcatctacactcttagaaataaagaggtgaaggaggcctttaaaagactggtggccaagtcactactgaatcaagagatacgcaatatgcagatgatctccttcgcaaaggacacagtcctcacctatttaaccaatttctctgcaagttgccccatctttgtcatcacgatcgaaaattactgcaacctccctcagaggaaatttccctag

SEQ ID NO: 44286 - DNA, 942 bp, Artificial Sequence
  Description of Artificial Sequence: Synthetic coding sequence
atgaactgggagaacgagagcagccccaaggagttcatcctgctgggcttttccgaccgagcctggctccaaatgcctctgtttgtggttctactgatctcttacaccattacaattttcggcaacgtgtccattatgatggtgtgtatcctagatccaaagcttcacacccctatgtactttttcctcacaaacctcagtatcctggatctttgttataccactaccacagtgcctcatatgctggtcaacatcgggtgtaataaaaagacaatctcctacgccgggtgcgtagcccacctcattatctttctcgcgctcggcgccacagagtgccttcttttggcagtcatgtccttcgatcgctatgtggctgtgtgtagacccctgcactacgtggtaattatgaattactggttctgtctgaggatggcagccttctcctggctgatcgggtttggaaactccgtgcttcaaagcagtttgacattgaatatgccaaggtgcggccaccaagaagttgaccatttcttttgcgaagtgccggcacttcttaaactgtcctgcgccgacacaaagccaatcgaggccgaactgttttttttttccgtcctcattctgctgattccagtgactctgatcctgatctcgtacggctttattgctcaggccgttttaaaaatacggtccgcggagggtcgacaaaaggccttcggaacgtgcggttcacatatgatcgtcgtctcgctcttttacggaactgccatctacatgtatctgcaacccccttccagtaccagcaaagattgggggaagatggtgtctttattctacggcataattactagcatgctaaatagcctcatttacagtctacgaaacaaagacatgaaggaagcctttaaacgactaatgcctcggatcttcttctgcaagaaatag

SEQ ID NO: 44287 - DNA, 942 bp, Artificial Sequence
  Description of Artificial Sequence: Synthetic coding sequence
atgaactgggagaacgagagcagccccaaggagttcatcctgctgggcttctcagatcgtgcgtggctgcagatgcctttatttgtggttttactgatatcctatacaattaccatctttggaaatgtaagcattatgatggtttgcatcctggacccgaaattacataccccaatgtatttttttctgaccaaccttagcattttggacctgtgctacactacaacaacagtgccccatatgctcgtgaacatcgggtgcaacaaaaaaaccatctcttacgccgggtgtgtggcgcaccttataatattcctggccttaggggctaccgagtgtttactgctcgcggtcatgtccttcgacaggtatgtggctgtctgcagaccactccactacgtagtcatcatgaactattggttttgtctacgaatggctgctttcagctggcttatcggatttggcaattcagtactgcagagctcccttactctgaacatgcctagatgtggccatcaggaggttgaccactttttttgtgaggtccctgcgcttctcaagctgagctgcgcagacactaagccaatcgaggcggagctgttttttttctctgtgctcattctcctgattcccgtgacccttatcctaatttcctacggatttatagcccaggccgtgctgaagattagaagcgcagagggacgccaaaaggctttcggaacctgtgggtcgcatatgatagtggtgtcacttttttatggcaccgccatctatatgtatctgcagcctccgtcctcaacctcaaaggactggggaaagatggtttcgttgttttacggcatcatcacaagcatgctcaacagtctgatatacagcctgaggaacaaggacatgaaagaagctttcaagcgactgatgcctcgcatttttttttgtaagaaatag

SEQ ID NO: 44288 - DNA, 942 bp, Artificial Sequence
  Description of Artificial Sequence: Synthetic coding sequence
atgaactgggagaacgagagcagccccaaggagttcatcctgctgggattctcggacagagcctggttgcaaatgccgctgtttgtggtgctcttgatctcgtacactattaccatctttggaaatgtgagcattatgatggtatgtattctggaccccaagctccacactcccatgtatttctttctcaccaacttatctattcttgatctgtgctacaccacaacaaccgttcctcatatgctcgtgaatatcggctgcaacaagaaaactatttcctatgccggctgcgtggctcaccttattatttttcttgcactgggagcaaccgagtgccttcttctggcggtgatgagctttgacaggtatgtggccgtatgcaggcccctccactacgtcgtcatcatgaattactggttttgccttcgaatggccgccttctcttggctaattggttttggaaattctgtcctgcaatccagccttactcttaacatgcctcgttgcggccatcaggaggtcgaccattttttttgcgaggttcctgctctgctcaaactgagttgtgctgataccaaacccattgaggccgagctgttctttttcagcgtgctgattttgcttatccctgtgaccttaatcttgataagctatggtttcatcgcccaagcagtcctgaaaattcgctccgcagagggacggcaaaaggcattcggcacttgtggctctcatatgatagtggtatcccttttctacggtaccgcaatttacatgtatctgcagcccccttcctctacctctaaagactggggcaagatggttagccttttttatgggatcatcacttccatgctgaactccctgatttactctctccgcaataaggatatgaaggaggcttttaaacggttaatgccccggatattcttctgcaaaaaatag

SEQ ID NO: 44289 - DNA, 942 bp, Artificial Sequence
  Description of Artificial Sequence: Synthetic coding sequence
atgaactgggagaacgagagcagccccaaggagttcatcctgctgggcttcagcgatcgcgcttggcttcagatgcccctgttcgtggtactactcatctcatatacaatcactatatttggcaatgtctccattatgatggtgtgcattctggatcccaagttgcacacgccaatgtacttttttctgaccaatctttctattctggatctctgttacactaccaccacagtcccccatatgctcgtgaacattggctgtaataaaaaaaccattagctacgcaggatgcgtggcccacctcatcatatttttagcccttggggcaactgaatgtctcctgctggctgtgatgtccttcgatagatacgttgccgtgtgccgccctctgcactatgtcgtaatcatgaattattggttttgcttgcggatggcggctttctcgtggttaattgggttcggcaactccgtcctgcagagtagtctcacgttgaatatgccaaggtgtggtcaccaagaagtggaccattttttttgtgaggtccccgctttgttaaaactcagctgtgcagacactaagcctatcgaggccgagctcttcttcttctccgtcctgatcctgttgataccggtgaccctgattctcattagttacggcttcatcgcgcaggccgtgctcaagatacggtctgctgaggggcgccagaaggccttcgggacgtgcgggtctcatatgatcgtcgtgtctttattttacggtactgcaatatacatgtatcttcagcctccttcctcaacttcaaaggattgggggaagatggtttctctattttacggaatcattacatctatgctgaattcactgatttattcactccgcaacaaggacatgaaagaagcttttaagcgactgatgccccgtattttcttctgcaaaaagtag

SEQ ID NO: 44290 - DNA, 942 bp, Artificial Sequence
  Description of Artificial Sequence: Synthetic coding sequence
atgaactgggagaacgagagcagccccaaggagttcatcctgctgggattcagcgaccgagcctggctccagatgcctttgtttgtcgttctcctcatatcctataccatcacaatttttgggaacgtatctattatgatggtgtgtatcctggatcctaagttacacacaccgatgtatttcttcttaacaaatttatccatcctggacctgtgctatacaaccactacagtgcctcatatgctggtcaatattggatgcaacaaaaaaacaatctcttacgcggggtgcgtcgcccacctgatcatattcctcgcactgggcgctacagaatgtctgcttctggcagttatgtcttttgaccggtatgttgcagtttgtaggccattacactacgtggttataatgaattattggttttgcctgcggatggcagcgttttcttggctcatcggattcggcaactcagttctccagtcctctcttaccctgaatatgcctaggtgcggccaccaggaggtggaccactttttttgcgaggtgccagctctgctgaagttgagctgcgctgatactaagccaattgaggctgaactgttttttttttccgtgctcatcttgctgatcccagtgaccctgatcttaatcagctacggctttatcgctcaggccgtattaaagattcgctcagctgaaggaaggcagaaagccttcggcacctgtgggtcacacatgatcgttgtttccctcttttacggtaccgccatctatatgtatctccagccgcccagctctacttctaaagactgggggaagatggtgagtctgttctacgggattattacctccatgctgaacagcctcatttactcactacgcaacaaggatatgaaggaggcgttcaagcgactgatgccaagaatctttttctgcaagaagtag

SEQ ID NO: 44291 - DNA, 942 bp, Artificial Sequence
  Description of Artificial Sequence: Synthetic coding sequence
atgaactgggagaacgagagcagccccaaggagttcatcctgctggggttctctgatcgtgcttggctgcagatgccactgtttgtcgtgctgctgatctcgtacacgatcacgatctttggcaatgtgtcgattatgatggtgtgtattctagatcccaaactgcacacccccatgtatttcttcttgactaacttgtccatccttgacctttgctatactactactacagtgccccatatgttggtaaacatcggttgtaataagaaaacaatttcctacgcaggttgcgtggcacatcttatcatattccttgccctcggggccacggagtgcctgttgctggccgtgatgtcatttgatcgttatgtcgctgtatgccgccccctccactacgtggtgataatgaactactggttttgtttgagaatggctgccttttcttggctgataggatttggaaattctgtcctgcagtctagcttaaccttgaacatgccccgttgtgggcaccaggaagtggaccattttttttgcgaggtcccagcgctcctgaagctgtcttgtgctgatacaaaaccgatcgaggccgaactatttttcttctctgttttaatcttgctaattcctgtgaccctgatcctgataagctacggctttattgcccaagccgtgctcaagatccgatcagccgaagggagacaaaaggcctttgggacatgcggcagccacatgatcgtcgttagcttgttctacggaaccgcgatctatatgtacctgcagcccccatcgagcacctcgaaagattgggggaagatggtatctctgttttatggcatcattacgtctatgctcaactccctgatctacagcctgcgaaataaagacatgaaagaggcctttaaaagactcatgcccagaatattcttttgcaaaaaatag

SEQ ID NO: 44292 - DNA, 942 bp, Artificial Sequence
  Description of Artificial Sequence: Synthetic coding sequence
atgaactgggagaacgagagcagccccaaggagttcatcctgctggggttctctgatagagcatggctgcaaatgccgctgttcgtggtgctgctgataagttacacaattacaatctttggcaacgtgtctatcatgatggtctgcatactcgacccaaagctgcatacccccatgtactttttcctgactaacctttctattctggatctttgctacaccactaccacagtgccccacatgctggtgaacatcggctgcaataagaagacaataagctacgctggctgtgtggctcatctgattatctttctggccctgggcgcaactgaatgtctcctgcttgctgtgatgtcatttgaccgctacgtggccgtgtgccgacccctgcactatgtggtgatcatgaattattggttttgccttaggatggccgccttttcgtggcttatcggttttggaaactctgtgctccagagcagcctcaccttgaatatgccaaggtgtggtcatcaagaagtcgaccactttttttgtgaggtccccgcacttttgaagctctcctgcgccgacactaaacccatcgaagccgagttgttcttcttctctgtgttaattctgttgattccggtcactctgatactgataagctatggattcatagctcaagctgttctgaagatccgctctgcggaagggcgccagaaggccttcgggacctgtggatctcatatgatcgtcgtttccctcttttatggtactgcgatctatatgtatttgcagcccccttccagcacctccaaggactggggaaaaatggtgtccctgttctacggcatcatcacatctatgctcaacagcctcatatactctctgcgcaataaggatatgaaagaagcatttaagcgtctgatgcctcgaatttttttttgcaaaaagtag

SEQ ID NO: 44293 - DNA, 942 bp, Artificial Sequence
  Description of Artificial Sequence: Synthetic coding sequence
atgaactgggagaacgagagcagccccaaggagttcatcctgctgggctttagcgaccgtgcgtggctccagatgccactgttcgttgtgctgttaatcagctataccataaccatatttggcaatgtctccatcatgatggtttgcattttggacccaaaacttcatacccccatgtatttcttcctaaccaatctgtctattctagacctgtgttatactaccactactgtcccacacatgctcgtgaatatcggctgcaataagaagacgatctcttacgctggctgcgttgcccacttgataattttcctggctctgggggcgacggaatgcctgttactggcagttatgagttttgatcgttacgtcgccgtttgccggcctcttcactatgtggtgattatgaactactggttctgccttagaatggcagccttctcctggcttatcggattcggtaacagcgtcttgcagtcctctttgacgctgaatatgccaagatgcggccaccaggaagtcgaccattttttctgcgaggtgcccgcgctcttgaagctgtcttgcgccgatactaaacccatagaagctgaactgtttttttttagcgtgctgatcctccttatccctgtcaccttgatcctcattagctatggattcattgcgcaggccgttttgaagattcgatccgctgagggcagacaaaaggcctttggcacttgtggatcccacatgatagtagtgtcccttttttatggcaccgccatttatatgtatctgcaacctcctagctcaacaagtaaagattggggcaagatggtctctttgttttatggcatcattacatccatgctgaactctttgatctacagcctgaggaataaggatatgaaggaggcatttaaaagacttatgcctcgaatatttttttgtaaaaaatag

SEQ ID NO: 44294 - DNA, 942 bp, Artificial Sequence
  Description of Artificial Sequence: Synthetic coding sequence
atgaactgggtgaacgacagcatcatccaggagttcatcctgctgggattctctgaccgaccctggctggagttccctctactcgtggtatttttgatctcatatacagtaacgatattcgggaatctgactatcatcttagtctcccgcctagatacaaagctgcacacacccatgtacttctttctcactaacctctccctcctcgatctgtgctatacgacgtgcaccgtgccccagatgttggtgaatctgtgcagcatcagaaaggtgatctcttataggggctgtgtggctcagctattcatcttcctggccttgggagctactgaatacctgctcctggctgtgatgtctttcgatcgcttcgtggccatctgccgcccattgcattactccgtcatcatgcatcagcggctctgcctccaactagcagctgctagctgggttactggattctcaaactccgtctggctgtcaaccctcactctccagctgcctctgtgtgatccctatgtgatcgatcacttcctttgtgaggtccctgcgctgctcaagcttagttgtgtggaaacaactgccaacgaagccgagctgtttctggtttctgagttgtttcatctcatccctctgactctgattctgattagttacgcttttatcgtcagagcggtactcaggattcagtccgctgaggggaggcaaaaggcttttggtacttgtggcagccacctaatagtggtcagtttgttctatagcactgccgtaagtgtctacctgcagcctccgtctccctccagtaaggaccaggggaaaatggtgtcactgttttacggcattatagctcctatgctgaatcctctgatttacaccctaagaaacaaagaggttaaagaaggattcaagcgcctggtggcccgtgtgtttttgatcaaaaaatag

SEQ ID NO: 44295 - DNA, 939 bp, Artificial Sequence
  Description of Artificial Sequence: Synthetic coding sequence
atggacggcgtgaacgacagcagcctgcagggcttcgtgctgatgggtatcagcgatcacccacagctggaaatgatctttttcatcgctatcctttttagttacctgctaaccttgctcggcaactccactattatcctattgtcacggctggaagccaggctgcacacccccatgtactttttcttgtcaaacctctctagtctcgatctggcgttcgccacctcatccgtgccccagatgctaatcaacttgtgggggccaggcaagacaatttcgtatggtggttgcataacgcagctctacgtgttcctctggctgggcgccaccgaatgcatattgctggtcgtgatggcatttgaccggtatgtggcagtgtgtaggcctctgaggtacactgctatcatgaacccgcaattgtgctggctgctggcagtcatcgcttgcctgggagggcttggtaactctgtcattcagtccacattcaccctgcagctacctttgtgcggtcaccgcagagtcgaagggttcctgtgcgaggtgcctgcaatgattaaactcgcctgtggcgatacaagcctcaatcaagctgtgttgaacggcgtgtgcaccttttttacggcggtaccattgagtatcatcgtgataagttactgcctcattgctcaggcggtgctgaagatccggtcagccgagggtcggagaaaagctttcaatacctgcctgagccacctcctcgttgtgtttctgttttatggatcggccagctatggttatctactgccggcgaagaactcaaagcaggatcagggcaagttcattagcctgttctacagtctcgtgacacccatggttaatccccttatatacacactgcgaaatatggaagtgaagggggcactgagacggctcctggggaaaggacgggaggtggggtag

SEQ ID NO: 44296 - DNA, 963 bp, Artificial Sequence
  Description of Artificial Sequence: Synthetic coding sequence
atgatggagatcgccaacgtgagcagccccgaggtgttcgtgctgctgggattcagcaccagaccctctttggaaaccgtgctgttcatcgtggtactcagtttttacatggtgagtatattggggaatgggatcattatcctagtttcccacaccgacgtccatcttcatactccaatgtacttctttctggccaacctgcccttcctcgacatgtcctttactaccagtatagtccctcaactcctggccaacctatggggcccacagaagaccataagctatggcggctgcgtcgttcaattctacatcagccactggctcggcgcaaccgagtgcgtgttgttagccaccatgtcatacgatcgttacgcagctatctgccgacccctgcactacacagtgatcatgcatcctcagctgtgtctgggcttggctctggcatcttggctcgggggccttaccacttcaatggtgggatccaccctcacaatgctgttacctctgtgcgggaataactgtatcgatcattttttttgtgaaatgccactgatcatgcagttggcatgcgtggatacaagcctgaacgaaatggagatgtaccttgcaagctttgtcttcgtggtcctgccactgggccttattctggtgtcctatggtcatattgcacgggccgtccttaaaattcggtctgctgagggcagacggaaagcttttaacacctgctccagccatgtggccgttgtctctctgttttacggatccatcatctttatgtatctccaaccagctaaatctacctctcatgaacagggaaaattcattgccctgttttacactgtggtcacgcctgcccttaaccctctgatttacactctgcgaaatacggaggtgaaatctgcgttacggcacatggtgctcgaaaattgctgcgggtctgctggcaagctcgcccaaatctag

SEQ ID NO: 44297 - DNA, 927 bp, Artificial Sequence
  Description of Artificial Sequence: Synthetic coding sequence
atgcggcagatcaaccagacccaggtgaccgagttcctgctgctggggctttccgatggaccccacactgagcagttgctgttcatcgtgctgctgggagtgtacctggtaaccgttctcggcaatcttctcttgatatctttagtccacgttgattcccaactgcatacaccgatgtacttctttctctgcaatctttctctagccgacctgtgctttagcaccaacattgttccccaggcgctggtgcatctgctgagtaggaaaaaagtgattgcctttacactgtgtgccgctcgcctgctgttctttctgatttttggttgtacgcagtgtgccctgttggctgttatgagctacgatagatatgtcgctatctgcaatccactaagatatccaaatatcatgacgtggaaagtgtgtgtgcagttagccactgggtcttggaccagcggaatcttggtgagcgtggtggatacaacttttatcctgaggctgccctataggggatcaaactcaattgcacacttcttctgcgaggctccggcgctcctaatcctggcctcaaccgatacccacgcctccgaaatggctattttcctaatgggcgtggtcatactgttgattccggtcttcctaatccttgtctcatacgggcggattattgttacagtggtcaaaatgaaaagtacagtggggtcccttaaagcattcagcacctgtggcagccatttaatggtggttatcctattttatggttcagccatcattacatacatgacacctaagagttcaaaacaacaggaaaagagcgtgagtgtgttctacgcaatcgtcacgcctatgctgaaccccctgatttactctcttagaaacaaggacgttaaggcagcgttaagaaaagttgctacccgaaatttcccctag

SEQ ID NO: 44298 - DNA, 993 bp, Artificial Sequence
  Description of Artificial Sequence: Synthetic coding sequence
atgtgcagcttcttcctgtgccagaccggcaagcaggccaagatctctatgggggaggaaaaccagacatttgttagcaagttcattttcttggggctgtctcaagatctgcaaactcagatcctcttattcatactatttttgatcatttatttgctgaccgtccttggtaatcagctgattattatactcattttcctcgatagcaggctccacactcccatgtattttttcttgagaaacttgtcatttgccgacttatgcttcagcacatccatcgtgccacaagttctggtgcatttcctggtgaagcgaaagaccatctcgttctacggttgcatgacccagataatagtgttcttgttggtcgggtgcactgagtgtgcattgctggccgtcatgtcttacgatagatacgtggctgtttgtaaacccctgtactactccaccataatgacccaaagagtgtgcctctggttgtctttcaggtcctgggccagtggcgctctcgtcagtcttgtcgacacaagcttcacattccacctcccctattggggtcagaacatcatcaaccattacttttgtgaaccacccgccctcctgaagcttgcgtccatcgacacttactccaccgaaatggcaatcttctcaatgggtgtcgttatcctgctggcaccagtgagcctgatcctcgggtcctattggaacataatttccacggttattcaaatgcagagcggtgaaggacggctcaaggcttttagtacttgtggcagtcatttaatagtggtggtgctattctacggtagcggcatttttacttatatgcggccaaatagcaagacaactaaagagttggacaagatgatcagcgtcttttacactgcggtcacccccatgcttaatcccatcatctatagcttacggaataaggacgttaagggagccctccgtaaattggtggggcgcaagtgcttctcccacagacagtag

SEQ ID NO: 44299 - DNA, 954 bp, Artificial Sequence
  Description of Artificial Sequence: Synthetic coding sequence
atgggcaccgacaaccagacctgggtgagcgagttcatcctgctgggcctgagtagcgactgggatacaagagtgtccttattcgtcttattcctggtgatgtacgtggtgacggttttgggtaattgtttaatcgttttacttataagactcgattccagactgcatactccaatgtatttttttctgaccaacctgagccttgtagatgtgagttatgctacttctgtggtgcctcagctgctggctcactttctcgctgagcataaggctatcccatttcaaagctgcgctgcccagttgttctttagtctcgcactcggggggatagagttcgtgttgctggcagtcatggcatacgatcgttacgtcgcggtctgtgacgcgctccggtattcggctattatgcatggaggcctctgtgctaggctagcaataacctcttgggtgtcaggattcatttccagtccagtgcaaaccgccatcacttttcagcttccaatgtgtcgaaacaagttcattgaccatatatcttgtgagctgttggcagtggtgcgcctggcatgtgtggatacttcctccaatgaggtcactattatggtatcgtccatagttctgctgatgactcccttctgtctggttctgctgagctatatccagattatttcaacaatcctgaaaatccagtctcgcgagggcaggaaaaaggcctttcatacatgcgcaagtcatcttaccgtggtggctctgtgttacggcgtggcaatttttacatacattcagccccattcctcgccctctgtgcttcaggagaagctctttagcgttttttacgccattcttacccctatgctaaatcctatgatctacagtctgaggaataaggaggtgaaaggtgcatggcagaagctgctttggaagttttcaggtctgacttctaaactggcaacgtag

SEQ ID NO: 44300 - DNA, 954 bp, Artificial Sequence
  Description of Artificial Sequence: Synthetic coding sequence
atggagatcgacaaccagacctgggtgcgggagttcatcctgctgggattatcatccgactggtgcacccagattagtctgttctctctcttcctggtgacgtacctcatgaccgtgcttggtaattgtctcatcgtgcttctgatccgcttggattcaaggttgcacactccaatgtatttttttctgactaacctgagtctggtcgatgtcagctatgccacgtccgtggttccacaactcttggcgcatttcctggccgagcacaaggccattccgttccagtcctgcgcggcccagctcttcttcagcctggcactggggggaatcgaatttgtgctcttagcagtgatggcttacgatagacacgtcgcagttagcgataggctgcggtattccgctattatgcacggcggcttatgtgcccgtctggctattacctcgtgggtttcgggatccataaacagtctggtccagactgcgatcacgttccagctgccgatgtgcaccaataaattcatcgaccatatctcctgtgagcttctggctgtggtgcgcttagcttgcgttgacacaagtagcaacgaggccgcaatcatggtctcatctatagtgctgctgatgacacccttctgcctggtgctgctctcctacatacggatcatttccactatcttaaaaatacagtctagggaaggacgcaaaaaggccttccacacctgcgcatcacatcttactgtagtggccctgtgctatgggacaactatctttacttacatacagccccatagtgggccttccgtgttacaagaaaaactgattagcgttttttacgctatcgtgatgccgctgttgaaccctgtgatctactctctgcgcaataaggaggtcaaaggcgcctggcacaagttgctcgaaaaattttcggggcttacatctaagctggggacatag

SEQ ID NO: 44301 - DNA, 954 bp, Artificial Sequence
  Description of Artificial Sequence: Synthetic coding sequence
atgggcatggtgcggcacaccaacgagagcaacctggccggcttcattctacttggctttagcgactatcctcagttgcaaaaagttttgtttgtgctgattcttatcttgtatctgcttaccatccttgggaatacaacaataatcctggtttcccgccttgaaccaaagctccacatgcctatgtatttcttcctgtcacacctgtcctttctgtacaggtgcttcacatcatcagtgatcccccagctcctggtcaatctgtgggagcccatgaaaacaatcgcctatggaggctgtctggtccacctatacaacagccacgctctggggtccactgagtgcgttctaccggcagttatgtcttgtgatcggtacgtggcggtctgccgcccactccactataccgtactcatgcacattcacctttgcatggccctggcgagcatggcctggcttagcggaatcgccactaccctggtgcagagcacactcacactgcaactgcccttttgtgggcataggcaggtagaccacttcatatgcgaggtgcccgtgctgatcaagctagcgtgcgtggggacgacctttaatgaggccgaattgttcgtggccagcattctttttctaattgtccctgttagcttcattctcgtcagctccggttatatcgctcatgccgtgttgagaattaaatccgctacaaggcggcagaaagcctttggcacttgcttctctcacctgacagtggtcaccatattctatggaaccatcattttcatgtatttacagcctgcgaagtctcgctcccgtgatcagggaaaattcgtgagcctgttttacacagtggtgaccagaatgctgaatccgctgatttacactcttcgcatcaaagaggtgaaaggcgcactgaagaaggtccttgcaaaagctttaggcgtgaatatcctgtag

SEQ ID NO: 44302 - DNA, 930 bp, Artificial Sequence
  Description of Artificial Sequence: Synthetic coding sequence
atgggcctgggcaacgagagcagcctgatggacttcatcctgctgggattttccgaccatccacgtctcgaagcggtccttttcgtgttcgttcttttcttctacctccttacgctggttgggaatttcaccattatcataattagctacctggaccctcccctccacacacctatgtattttttcctatctaacctcagcttgttggatatctgcttcaccaccagcctggccccccaaacgctcgtgaatctgcagcgcccaaaaaaaacaatcacctacggaggctgcgttgcgcagctgtatatcagcctcgcactgggctccacagagtgcattctgctggctgatatggccctagacagatacatcgcagtgtgtaagcccctccattacgttgtgataatgaacccgagactgtgccagcagctggccagtatttcatggcttagcggcctggccagctcactgatccacgcgacattcactctccaactgccgctgtgtggcaatcatcggttggaccactttatctgcgaggtccccgccttgctgaagctcgcttgtgtggatacaacagttaacgagctggtgctctttgtagtttcagtgctgttcgtagtcattccgcctgctcttatttctatctcttacggtttcatcacgcaggcagtcctgagaatcaaaagtgtggaggctaggcataaggcattctccacatgtagttcccatctgactgtcgtgatcattttttacggtactatcatctatgtttatctgcagccgtccgactcctatgcccaggaccaggggaagtttataagcttgttttacacaatggttacacctactttgaaccctatcatatacacgctgcgcaacaaggacatgaaagaggctctccgaaagctcctgtctggcaaactctag

SEQ ID NO: 44303 - DNA, 951 bp, Artificial Sequence
  Description of Artificial Sequence: Synthetic coding sequence
atggaggagaccaacaacagcagcgagaagggcttcctgctgctgggattctctgaccagccacagttggagagatttttatttgccatcatattgtacttctacgtgctttccctactgggaaatacagccctgattctggtgtgttgtctagacagtcggctgcatacccctatgtattttttcctatctaacctatcatgcgtggacatatgcttcacaacctccgtagctccccagctactggtgaccatgaacaaaaaggataaaacaatgtcatacggcgggtgtgttgcccaattatacgtggccatgggattgggctctagtgaatgtatcctgctggctgtgatggcatatgataggtacgctgcggtatgcagacccctgcgctacatagctatcatgcacccacgattttgtgcctctctcgctggcggcgcctggctttctggtcttattacttcactgatccagtgctcgctgacggtccaactacccctatgtggacaccgtaccctcgaccatatcttctgcgaggtgcctgttctaattaagttagcctgtgttgacacgactttcaatgaggctgagttatttgtggcaagcgtggtgttcctcatcgtgcctgtgctcctgatccttgtatcgtatgggtttatcacacaggctgtcctgcgtataaaatctgccgccggccggcaaaaggcattcggaacttgttctagccaccttgtggtggtcattatcttttacggcacaatcatctttatgtacttacagcctgctaatcgaagaagcaagaaccaaggtaagtttgtatcacttttctatacgatagtcacacctctcttaaacccaatcatttacactttacggaataaggatgttaagggcgctctgaggacactgatcttaggctctgctgccggccagtcgcacaaagactag

SEQ ID NO: 44304 - DNA, 951 bp, Artificial Sequence
  Description of Artificial Sequence: Synthetic coding sequence
atggtgaaccagagcagccccatgggcttcctgctgctgggcttcagcgagcaccccgctttggagcgaacactgttcgtggtcgtcttcacgagttacctgctgacccttgttggcaacacattgataattttacttagtgtgctgtatccgcgattgcactcgcccatgtactttttcttgagcgatctctcatttttagacctatgtttcaccacctcctgtgtgccgcagatgctggtcaacctgtggggcccaaagaaaacaattagcttcctcggttgtagcgtgcagctgttcatcttcttgagtttgggaaccacagagtgcatcctgctcactgtaatggcatttgacaggtacgtcgccgtgtgccagccccttcactatgcgacgatcattcacccgagactctgctggcaactggcctccgtcgcatgggtgatgtcccttgtgcaaagcatcgtgcagaccccatctacccttcatttgcctttttgtccacatcagcaaatcgatgactttctctgtgaagtgccatcactgatccgcctatcctgcggcgacactagctacaacgaaatccagctcgctgttagcagtgttatcttcgttgtagtgccgctttcccttattctcgcatcttacggtgccaccgctcaggccgtgcttaggatcaactccgcaacggcttggcggaaggccttcgggacctgctcttcgcacctgactgtggtcacccttttttacagctctgtcattgccgtgtacctccagcctaagaacccctatgcccaaggccgcggtaagttcttcggcttattctatgctgtcggcacaccgtctctaaatcctctggtctacaccttaagaaacaaggagattaaacgggcactgcggcgactgctgggtaaggagagagactctcgcgaatcttggagggctgcttag

SEQ ID NO: 44305 - DNA, 951 bp, Artificial Sequence
  Description of Artificial Sequence: Synthetic coding sequence
atggtgaaccagagcagccccatgggcttcctgctgctgggcttctctgagcaccctgccctggagagaaccctgttcgtggttgtgttcacttcttacctgctgacgctcgtaggtaatactctgataatcctgctctcggtgctgtaccctcgtctccacagccccatgtacttctttctgtctgatctgagctttcttgatctgtgtttcaccaccagctgcgttccacagatgctcgtcaacctgtggggaccaaaaaaaaccatcagttttttagggtgttccgtgcagctctttatttttctgtccctaggaactactgagtgtatcctgctcacagtgatggcgttcgacaggtacgtagcagtatgccagcctcttcattatgctaccattattcacccgaggttgtgttggcagttagcttcggttgcatgggttatgtcgcttgtgcagtccatcgtccagacacccagcactttgcatctgcccttttgcccacaccagcaaatagacgacttcctgtgcgaggtccccagccttattcgtctgagctgcggcgatacatcttacaacgaaatacagttggctgtcagctccgttatcttcgtagtggtgcctttaagccttatcctggcttcctacggagccacggcacaagctgtccttcggatcaacagcgccaccgcttggaggaaggcctttggcacgtgctcatctcatttaactgttgttaccttattctactccagcgtaattgctgtctacttgcagcctaagaacccctacgcccaaggtaggggcaagttctttgggttattctacgcagtcggtactccgtctctaaatccgctcgtgtacacccttcgcaacaaggaaataaaacgggccctgcgtcgactactagggaaagaacgtgattctcgcgagtcttggagagccgcatag

SEQ ID NO: 44306 - DNA, 951 bp, Artificial Sequence
  Description of Artificial Sequence: Synthetic coding sequence
atggtgaaccagagcagccccatgggcttcctgctgctgggcttcagtgagcacccagctttagaaagaaccctgtttgttgtggtgttcacatcctatctgcttactctggtgggcaacacactaattattctcctgagtgttctgtacccgagactccactccccgatgtacttcttcctttcagatctgtccttccttgatttatgtttcacaacaagctgtgtgccacagatgctcgtgaatctgtggggtccaaaaaagaccatctcattcctgggctgctccgtgcagctcttcatatttctttcccttggtactacagaatgcattctcctgaccgtgatggcatttgaccgatacgtggccgtctgtcagcctctgcattacgccactataatccatccccggttgtgctggcaactcgcctccgtagcctgggtgatgtcactggtgcagtccatagttcagacaccttctacactgcacttacccttctgtcctcatcagcagatcgatgatttcctctgcgaagtgccctcgttaatccgcttgagctgtggggatactagctataatgaaatccagctggctgtcagctccgtgatttttgtggtggttcccctgagtctgattcttgctagctatggcgccaccgctcaagccgtcctgagaatcaattctgccaccgcttggcgtaaggccttcggaacttgtagctcccacctgacagttgttacactgttttactcttccgtcatagccgtgtacctacagccaaagaacccctacgcacagggtaggggaaaattctttggactgttctatgctgtgggcactccaagccttaacccactcgtctacaccctgaggaacaaggagataaaacgggccctgcgtaggctgctggggaaagaacgagattccagagaatcgtggcgggcggcttag

SEQ ID NO: 44307 - DNA, 951 bp, Artificial Sequence
  Description of Artificial Sequence: Synthetic coding sequence
atggtgaaccagagcagccccatgggcttcctgctgctgggcttctctgagcaccctgccctcgagcggactcttttcgtggtggtctttacatcctatcttctcaccctagtcggcaacacattgataatcctactcagcgtgctctatcctcgcctacacagcccaatgtattttttcctttctgacttatccttcttggatctttgcttcaccacatcttgtgtcccccaaatgctggttaacctgtggggcccaaagaagaccatatcctttctcggctgtagtgtgcagctttttatcttcctatccctcggcactacagaatgcatcttactcacagtgatggccttcgaccggtacgtcgccgtgtgtcagcccttacattacgctactatcatccacccccggctatgttggcaactggcctccgtggcttgggtgatgtctcttgtgcaaagcatcgtccagactccgtcgacgttacacctgccattctgccctcatcagcagatagacgatttcctgtgcgaggtccctagccttataaggctctcgtgcggggacacgtcctataatgagatccagcttgctgttagcagcgtgatttttgtggtagtgcctttgagcttaatcctggcgtcatacggcgccacagcccaagccgtgctccggatcaattccgctacagcttggcgaaaggcttttggcacctgcagctcacatttgaccgtggtgaccttgttttacagttctgtgatcgcagtgtacttgcagccgaagaatccgtatgctcaggggcggggaaaattttttggattgttttatgctgtggggacgcccagtctgaatccactagtatacaccttgaggaacaaagagatcaaaagggcgctgcgaagactactcggaaaggagcgcgattccagggagtcatggcgcgccgcctag

SEQ ID NO: 44308 - DNA, 951 bp, Artificial Sequence
  Description of Artificial Sequence: Synthetic coding sequence
atggtgaaccagagcagccccatgggcttcctgctgctgggcttctcagagcaccccgctctggaacggaccctattcgtggtggtgttcacttcctacctcctgaccctggtgggaaacaccttaatcatcctcctgtcagtgttgtacccgagactgcacagccctatgtattttttcttatctgacctgagctttctcgatctgtgcttcaccacctcctgcgtacctcagatgctcgtgaatctttggggtcccaagaaaaccatttcgttcctgggttgctcggtgcagctgttcatatttctctcactcggcaccaccgagtgcattcttctgactgtcatggcctttgatcgctacgttgccgtttgccagcccctacactacgcaacgatcattcacccccgcctctgctggcagctggccagcgtggcgtgggtaatgagccttgtccagtccatagtacagacgccatctaccctgcacctgcccttctgcccgcaccagcagatcgatgactttctatgtgaagtccctagcctgattcggctgtcctgtggcgacacaagttacaacgagatccagctcgcggtgtccagcgtgatcttcgtagtagtcccattatcgctgatccttgcttcatacggagccacggctcaggcagtgcttcggatcaatagcgccaccgcttggaggaaggcgttcggcacgtgcagtagtcatctcacggtcgtcactctgttttactcgtcagtgatcgctgtctacctgcagccaaagaatccatacgcacagggccgggggaagttttttgggcttttttacgccgtaggcactccctctcttaacccgctcgtgtacaccctgagaaataaggaaatcaagcgggctcttcggcgcctgctgggtaaggagcgggacagccgggagtcctggagagctgcttag

SEQ ID NO: 44309 - DNA, 951 bp, Artificial Sequence
  Description of Artificial Sequence: Synthetic coding sequence
atggtgaaccagagcagccccatgggcttcctgctgctgggcttcagtgagcaccccgcactggagcgaaccctgttcgtcgtggtcttcacttcttacctgctgacactggtgggcaacactctgatcatacttctgagtgtgttataccccagactccactcccccatgtatttctttctgtcagacctatcgttcctggacctgtgcttcaccacttcttgtgtcccccagatgctggtgaatctttggggccccaagaaaacaatatcctttctcggttgtagcgtgcagctgttcatcttcctctccctgggaacaactgaatgcatcctcctgaccgtcatggcctttgatcgatatgtagccgtctgtcagcctctacattatgctaccatcatccatcccaggctgtgttggcagctcgccagcgtggcctgggtgatgagtctagtgcagtctatagttcagaccccctctactctgcacctgcccttctgtccccaccagcaaatagacgacttcttgtgcgaggtgccttccctgattagattgtcctgcggcgatacatcttacaatgagatacagctggccgtctcatccgtgatttttgtagtcgtcccactctcattgattctcgccagttacggggctactgcacaagccgtactccgcatcaattcggccaccgcttggcgcaaagccttcggcacatgtagctctcacctcactgttgtcacactgttctacagttctgttatcgccgtgtatctgcagcctaagaacccctacgcccagggtcgggggaagttctttggtctgttttacgccgtgggtacgccaagcctaaacccactcgtgtatactttgagaaacaaggagatcaaaagagctctgcgcagattgttgggcaaggaacgtgacagccgcgaatcttggagggctgcctag

SEQ ID NO: 44310 - DNA, 951 bp, Artificial Sequence
  Description of Artificial Sequence: Synthetic coding sequence
atggtgaaccagagcagccccatgggcttcctgctgctgggcttcagtgaacaccctgctctagagcgaaccttgtttgtggtcgttttcacttcctacctcctaaccttagtcggaaatactctgattatcttactgtccgttctataccctcgacttcacagccccatgtatttcttcctctcagatttgtctttcctggacctctgcttcacaacatcctgtgtacctcagatgctcgttaacttgtgggggcccaaaaaaacaatctcattcttgggttgctcggtgcagctgttcattttcttaagcctgggaacaaccgagtgcatcctgctaacagtgatggcctttgacaggtatgtggccgtgtgtcagccacttcactatgcaactattattcaccctagattgtgttggcaactggcaagcgtggcttgggtcatgtcccttgtgcagtcaatagtgcagactccatccactctccatcttcctttttgcccgcaccaacaaattgatgatttcctgtgtgaggtaccgtctctgatccggttatcctgtggggatacaagctacaacgagattcagctggccgtgtcctcagtcatattcgtggtggtgcctttatccctgatccttgctagctacggagcaaccgcccaagccgtgctaagaattaactctgccaccgcttggcgcaaggcttttggcacgtgctcttcacacctgaccgtcgtaaccctgttctacagttcagtaattgcagtgtacctgcaacctaaaaacccatacgcccaagggcgggggaaattttttggcctgttttacgctgtgggcactccaagcttgaacccactcgtctacaccttgcgcaacaaggagatcaagcgcgcgcttcggcgattactcgggaaggagcgggactcacgcgagtcctggcgagccgcctag

SEQ ID NO: 44311 - DNA, 951 bp, Artificial Sequence
  Description of Artificial Sequence: Synthetic coding sequence
atggtgaaccagagcagccccatgggcttcctgctgctgggcttcagcgagcacccagccctggagaggactctcttcgtcgttgttttcactagctacctcctgactcttgttggcaatactctgataattctactttccgtgctgtaccctcgattgcattcccccatgtatttctttctgagcgacctgagcttcctggatctgtgcttcacgactagttgcgttccccagatgctcgtcaacctctggggccctaagaagaccatttccttccttggctgctctgtgcaactgttcatctttttgtctcttggaaccaccgaatgtattctgcttaccgttatggcattcgatcgctacgttgcagtttgccagcccttgcactatgcaactataattcaccctaggttatgctggcaacttgcgtcagtcgcatgggtcatgtctcttgttcagagcattgtgcaaaccccatccacactccatctgccattttgtcctcaccaacagatcgacgatttcctctgcgaggtgccttcactcattaggttgagttgcggcgacacttcttacaatgagatccagttggccgtgagcagcgtgatattcgtcgtggtgccactaagcctcatcctggccagctatggcgccacggctcaggctgttctgcggattaacagtgccacagcctggcggaaggctttcggaacctgtagcagccatctgacggttgtgaccttgttttactctagcgtgatcgctgtctatttgcagccaaaaaacccctatgcacagggaagaggaaaattttttgggctgttctacgcagtgggtaccccctctctgaatccactggtgtatactttgcgtaacaaggaaatcaagagagcgctccggcgcctgttagggaaagagcgagattcgagagagtcttggagggccgcgtag

SEQ ID NO: 44312 - DNA, 951 bp, Artificial Sequence
  Description of Artificial Sequence: Synthetic coding sequence
atggtgaaccagagcagccccatgggcttcctgctgctgggcttcagtgaacaccccgccctcgagcgaacactgttcgtagtggtgttcacaagttacctgctcaccctcgtaggcaacactctgatcatcctactgtccgtgctgtacccaagattacattccccaatgtacttcttcctgtccgacctcagctttctggatttgtgctttacaactagctgcgtaccccaaatgctagtgaacttgtgggggccaaagaagaccatcagctttttgggatgttccgtgcaactcttcatattcctttcactcggcacaaccgaatgcatcctgttaaccgtcatggcctttgaccggtacgtggcagtctgtcagccattacactatgccactattatccatccaaggttatgttggcagctggcctccgtggcttgggttatgtcactagtgcaaagtatagtgcagactccatccactctgcatcttccgttctgcccccatcagcaaatcgacgatttcctgtgtgaggtaccatccctcattaggctgagttgtggtgatactagctacaatgagatacaactagcggtgtcgtccgtgatctttgtggttgtcccgctcagcctcatcttggcgagctatggagcgactgcgcaggctgtattgagaataaattccgcaacggcttggaggaaggccttcggcacatgcagctctcacttgaccgtggtgaccctgttctactcttccgtaattgcagtttatctccagccaaaaaacccttatgcccaaggtagagggaagtttttcggcctgttttacgccgtgggcactccctcactgaaccccctggtctatactttaagaaataaggagattaagagagccttaaggaggctgctcggaaaggagcgggacagcagagagtcttggcgggccgcatag

SEQ ID NO: 44313 - DNA, 951 bp, Artificial Sequence
  Description of Artificial Sequence: Synthetic coding sequence
atggtgaaccagagcagccccatgggcttcctgctgctgggcttctcagaacatcctgcactggagagaactctgtttgtggtcgtctttaccagctacttgttgacgcttgtaggaaatacactgattatcctgctatctgtgctctatccccgcttgcactcccctatgtactttttcctctcagacctgagtttcctggacctttgctttaccacatcatgtgtgccacagatgctcgtcaacctgtggggaccaaagaagaccatctcttttctcggatgtagtgttcagttgttcatctttctgagcctcggcacgactgagtgcattttactgacagtgatggccttcgatcgctatgtcgccgtttgccaacccctgcattatgctacaatcatacatcccagactgtgctggcagcttgcaagcgtcgcatgggttatgagtctggtgcagtctattgtacagaccccgtcaaccctacatctccctttctgcccacatcagcaaatcgacgatttcctatgcgaagtaccctctttaattaggctgtcctgtggtgacacaagttataacgagattcagcttgctgtgtcttccgtgatcttcgtcgtagtgccgctcagtctcatcctggcctcatatggagccactgcacaagctgttctgaggattaactctgctacagcttggagaaaagcttttggcacctgttcatcccatctcacagttgtaacattgttctactcatcagttatagcagtctatctacagccaaagaacccctatgcgcagggtcgcgggaagttcttcggcttgttctatgctgttggcaccccaagcctgaatcccctcgtctacacattgagaaacaaggaaataaaacgagcccttcgacgcctgcttgggaaggaaagagactcgcgggaatcctggagggctgcttag

SEQ ID NO: 44314 - DNA, 951 bp, Artificial Sequence
  Description of Artificial Sequence: Synthetic coding sequence
atggtgaaccagagcagccccatgggcttcctgctgctgggcttcagtgaacaccctgctctggagagaacgctctttgtggtggtcttcacttcctacctgctaactctggttggcaatactcttatcatccttctgagcgttctgtacccccgacttcacagtccaatgtactttttcctttcagacctgtccttcctggatctgtgttttacaacaagttgtgtgcctcagatgcttgtgaacctgtggggacccaagaagacaatctcttttctggggtgcagtgttcagctttttatctttctttctctgggaacaactgaatgcattctgcttacggtgatggccttcgaccgatacgtggctgtgtgccagccgctacattatgctacaattattcatccccgcttgtgttggcaattggcctcagtggcctgggttatgagtttggttcagtccatcgtgcaaaccccgagcacactacacttacctttttgcccacaccagcagattgacgatttcctttgtgaagtgcccagtctgatccggttaagctgcggagatacctcgtataacgaaattcagcttgcagtgtcgagtgtgatcttcgtagtggttcccctgtctctcatactggcctcttatggtgcaactgctcaagctgtgctgagaattaatagcgctacagcctggagaaaagcatttgggacatgctcaagccacctcactgtggtgacactcttttactcgtccgtcattgccgtgtacctccaacctaagaatccctacgctcagggcaggggtaagttcttcggattgttctacgcggttggaaccccatccttgaacccccttgtttacaccctcagaaacaaggagattaaacgagccctgcgtcgactgctggggaaagaacgtgactccagggaaagctggagagccgcttag

SEQ ID NO: 44315 - DNA, 951 bp, Artificial Sequence
  Description of Artificial Sequence: Synthetic coding sequence
atggtgaaccagagcagccccatgggcttcctgctgctgggcttctccgaacatccagccctggagaggactctgttcgtggtggtgttcacttcttacctccttaccctggtgggaaataccttgataatactcctgtcagtgctttatccgcggctacactcccctatgtacttctttctgtcagatttgtcattcttggatctttgcttcaccacatcttgcgtgccccagatgctggtgaatctatggggtccaaaaaaaaccataagttttttaggttgctctgtgcagttatttatttttctctctcttgggacgaccgagtgcatcctcctcacagttatggctttcgataggtatgttgccgtgtgtcagccacttcattatgccaccataatccaccccagactgtgttggcagctcgcttccgtcgcctgggtaatgagcttggtacaaagtatagtccagacgccttcgaccctgcacttgcccttttgtcctcaccagcaaatagacgacttcttgtgtgaggtgccctccctcattagactgagttgtggtgatacgagctacaacgaaattcagctcgccgtatccagtgtcatctttgtggttgttcccctgtccttgatactggccagctatggcgctactgctcaggccgtcctgaggatcaacagcgccactgcttggagaaaggccttcggcacctgttcgtcgcacttgaccgtggtgaccctcttttattcttcagtgatcgcagtgtatttacagcccaaaaatccttacgcacagggccgcggaaagtttttcgggctcttctatgctgtgggaactcctagtctgaatcctttggtctacacactgagaaacaaagaaattaaacgggctctcaggcggttactgggaaaagaacgcgatagtcgcgagtcttggcgggccgcatag

SEQ ID NO: 44316 - DNA, 951 bp, Artificial Sequence
  Description of Artificial Sequence: Synthetic coding sequence
atggtgaaccagagcagccccatgggcttcctgctgctgggcttctccgagcatcccgccttggagcggacactgtttgtggtggtgtttacgtcttacctccttacattagttggaaataccctcattatcctccttagcgtcctgtaccccaggctgcattcccccatgtatttttttctctccgacttatcattcttggacttgtgcttcacaacgtcctgtgttccacagatgctggtaaatttgtggggacccaagaaaaccatcagcttcctgggatgctccgttcagcttttcatttttttgtcactgggtactactgaatgcattctcttgactgtgatggcgttcgacagatatgtggccgtgtgtcagccgctgcactacgccaccatcatccatcccagactatgctggcaactggcatcagtggcctgggttatgtcccttgtccagtctatcgtgcaaacgccctcaactctccacttacctttctgtcctcaccagcagatcgacgattttctttgtgaagtcccctctttaataaggctgagctgcggtgataccagttacaatgagatccagttggcagtctccagtgttatctttgtggtggtgcctctgagcctgatcttagcctcctatggcgccaccgcccaggccgttttgcggatcaattctgcaacggcgtggcgcaaagctttcggaacatgttcctcccacctgacggtggtgacactcttctacagtagcgtaatcgctgtgtacttgcagcccaaaaacccatacgcccagggtcgtggcaagtttttcgggctcttctatgccgttggcacaccgagcctaaacccgctggtttataccctccgcaataaggaaattaagagagcactacgaaggcttcttggcaaggagcgggactctcgggagtcctggagagccgcctag

SEQ ID NO: 44317 - DNA, 951 bp, Artificial Sequence
  Description of Artificial Sequence: Synthetic coding sequence
atggtgaaccagagcagccccatgggcttcctgctgctgggcttctccgaacatccagcactggaacggacattatttgtggtagtcttcacctcatatctcctcacactggtgggcaacacactcattatcttgctgtcagttctatatccaaggctgcactcgcccatgtatttcttcctgtccgatttgtcctttctcgatctgtgctttacaacttcttgtgtgccacagatgttggtgaatttgtgggggccaaagaaaacaatttccttcctcggatgcagcgtgcagcttttcatattcttatcactgggaactacagagtgtattctcctcacagtaatggccttcgaccgttatgtagccgtctgccagcccctgcattacgctacgataattcacccccgtctatgttggcagctggcgtccgtggcctgggtgatgtctttagtccagagcattgtgcaaacgcccagcacactgcacctgccattctgtccacaccagcaaattgacgattttttgtgcgaggtgccaagtctcattcgtttgtcttgcggcgacacctcatataacgagatccagctggccgtatccagcgtcattttcgtcgtggtgcctctctctttgatcctggctagctacggagctacagctcaagctgtattgcgcataaattcggccactgcatggcggaaggccttcgggacgtgttctagccacttaaccgttgtcacactgttttattcttccgtgatcgctgtgtacctacagcctaagaatccctatgcccaggggcgtgggaagtttttcggactcttttatgctgtgggaacccctagcctcaacccccttgtgtacaccctaagaaacaaagaaatcaaaagggctttgaggcgtctgttagggaaagagcgtgattcaagggaatcctggcgggcagcatag

SEQ ID NO: 44318 - DNA, 951 bp, Artificial Sequence
  Description of Artificial Sequence: Synthetic coding sequence
atggtgaaccagagcagccccatgggcttcctgctgctgggcttcagcgagcaccctgccctggagcgaaccctttttgtagtggtgtttacctcctatctcctgactctcgtgggaaatacattgattatactcctctcagtactctatccaaggctgcattcccccatgtacttcttcctcagcgacctgtcttttctggatctgtgttttactacttcctgcgtgccacagatgctggtcaatctgtggggccccaaaaagactatttcctttctggggtgcagtgtccagctgttcatctttttgagtctgggaactaccgagtgtatcctcttgacagttatggccttcgatcgatatgtggctgtgtgtcaaccactgcattatgcaaccatcatacatcctcgactgtgttggcagctggcatccgttgcctgggtgatgtctctggtccaatcaattgtgcagactccatctaccttgcatttgccgttctgtcctcaccaacagatcgacgatttcctctgcgaagtccctagccttattcgattatcttgcggcgacaccagctataatgagatccagctggccgtcagctccgtgatattcgtggtggtcccattgtccttgattctggcctcatatggtgctacagcccaggccgtactcaggattaatagcgccaccgcatggcgcaaagcttttggtacatgtagtagccacctgacagttgtgactcttttttattcttccgtgatagccgtctacctgcaaccaaaaaacccttatgctcaggggagagggaagttcttcggccttttttacgcagtgggtacccccagcttgaatcctctcgtgtatacactccgcaacaaagaaatcaagagggctttacggcgcctgctgggcaaggagagggacagtagggaatcctggagggctgcctag

SEQ ID NO: 44319 - DNA, 951 bp, Artificial Sequence
  Description of Artificial Sequence: Synthetic coding sequence
atggtgaaccagagcagccccatgggcttcctgctgctgggcttcagcgaacatccagccctggagcggaccctgtttgtggtcgtctttacttcctacctgttgaccctggttggaaacactctcattattctcttaagcgtgctatatcccagattacacagccctatgtacttctttttgtccgacttaagctttctggacttatgctttactacctcctgcgtgccccagatgcttgtgaatctgtgggggcccaaaaagactatttctttcctaggatgcagcgtgcagctgttcatcttccttagcctcggaactactgaatgcatcttgcttaccgttatggctttcgatcgttatgtggccgtctgtcagcccctccattatgccacaattatccatccacggctctgctggcagctagcatctgtcgcatgggtgatgagcctggtccagagtattgtgcagacccctagcactctgcatttgcccttttgtccacaccagcaaatcgatgatttcttgtgcgaggtgccaagtctcattaggctctcatgtggggacacaagttataatgagattcagctcgccgtttcttccgttatcttcgttgtggtacccctgtctttaatcttggcgtcctacggcgctacagcacaggccgtcttgaggataaattctgccaccgcttggagaaaagcatttggcacctgcagcagtcacttaacagtcgtaaccttattttattcctccgtgattgccgtgtatctacagccgaaaaatccttatgcacagggcaggggcaagttcttcggactgttttacgccgtcggcacaccatcactgaatccactcgtttacaccctgcgcaacaaggagataaaaagagcactaagacggcttctcgggaaggagcgggatagtagagagtcgtggcgcgccgcctag

SEQ ID NO: 44320 - DNA, 951 bp, Artificial Sequence
  Description of Artificial Sequence: Synthetic coding sequence
atggtgaaccagagcagccccatgggcttcctgctgctgggcttctccgaacatcccgcccttgagaggactctgttcgttgtcgtttttactagctatctgctgacactggtggggaacacgttaattattctgctgtccgttctttacccacgcttgcactcacccatgtacttttttttaagtgacctaagttttctggatctatgtttcacaacatcctgcgtgcctcaaatgctggtgaatttatggggtcctaagaagactattagcttcctcggctgctccgtgcagctgtttatctttctgtcgctgggaacgacagagtgcatccttctcaccgtgatggcgtttgataggtacgtcgctgtttgtcagcccctccactatgctacaatcatccatccaaggctctgttggcagctagcttccgtggcttgggtgatgagcttagtgcagagtatcgtccagaccccttccaccctccacctgcctttctgcccccaccagcagattgatgattttctgtgcgaggtcccgtccctgatccgcctatcctgtggcgacacttcttataatgaaatccagcttgctgtcagcagcgtgatcttcgtggtggtgcccctgagtctgatactcgccagctatggtgccacagcacaggccgtgctgaggatcaactcagcaactgcctggcggaaggctttcggaacatgtagtagccatctgaccgttgtgacgctcttctatagctcagttattgctgtttacctgcagcccaagaacccctatgcacagggacggggaaaattttttggcttattttatgctgttgggactccttctctcaacccactggtgtacacattacgcaacaaggaaatcaaacgagccttgaggcggctgctgggtaaggagcgcgactcccgcgaatcatggagggcggcatag

SEQ ID NO: 44321 - DNA, 951 bp, Artificial Sequence
  Description of Artificial Sequence: Synthetic coding sequence
atggtgaaccagagcagccccatgggcttcctgctgctgggcttcagcgagcatccggcgctcgagcgcacgctgtttgtggtggtgtttacaagctatctgctaacacttgtcggcaatactctcatcatcctcttgtccgtgctttacccgcgactgcattctcctatgtacttctttctgagcgatctgtcgttccttgacttgtgcttcaccacgtcatgtgtgccacagatgctggttaatctgtgggggccgaaaaagacgatctcttttttaggatgttccgttcagctgttcattttcctgtccctgggaaccactgagtgtatactgttaactgtgatggcattcgatcgatacgtggctgtgtgtcagccgctccattacgccaccattattcatcccagactgtgctggcagcttgcgagcgtcgcctgggtgatgagtcttgtgcagagtattgtgcagacaccttccaccctgcatcttcccttttgtccccatcaacagatcgatgacttcctttgtgaagtcccatcattaatcaggcttagctgcggcgacacgagctacaacgagatccagcttgccgtgtcctctgtcatattcgtggtggtgcctctgagcctgattctcgcgagttatggtgcgactgcacaggctgtgctcagaattaattctgctacagcctggaggaaagcctttggtacgtgttcaagtcacctgacagtagtgacgctgttctattctagtgtcattgctgtgtacctccagccaaagaacccctatgcacaggggaggggcaagttctttggcctgttctatgccgtgggaacgcctagcctgaatccactggtatataccctgaggaacaaagagattaagcgagctctcaggagactgctcggaaaggagcgcgactcgcgagagagttggcgggctgcgtag

SEQ ID NO: 44322 - DNA, 951 bp, Artificial Sequence
  Description of Artificial Sequence: Synthetic coding sequence
atggtgaaccagagcagccccatgggcttcctgctgctgggcttctctgagcatccagccctggaacgcacgctttttgtagtggtttttacctcctatctcctgacattggttggcaataccctgatcatcctgctgtctgtactgtatccgagattgcactctccgatgtacttcttcctctcggatcttagtttcctcgatctctgtttcacgaccagctgcgtacctcagatgctggtcaacctgtggggccctaaaaagacaatcagctttctgggctgtagcgtccagctctttatctttctctcactgggcacgaccgaatgtatcctcctgactgttatggcctttgaccgctatgtcgcagtgtgtcaaccgctgcattatgccactatcatccatcccaggttatgttggcagctcgcatcagttgcctgggtcatgtccttggtgcagtcaattgtgcagactccctccacactgcacctccccttctgcccacatcaacagatcgacgatttcttgtgcgaggtcccgtcattaatacgcttgagctgtggggacacttcatacaacgagattcagttggccgtatcttcagtgatttttgtggtggtgccgctgtccctgatcttggcctcctatggggccactgctcaagccgtgcttcggattaatagcgccaccgcatggaggaaagctttcggaacttgctcttcgcacttgaccgtagtcactttattttattcttccgtgatcgcagtctacttacagccaaaaaatccttatgcccaaggccgcgggaagttctttggtcttttttacgcagttggcactcctagtttgaacccattggtgtacactctacgcaacaaggagatcaagcgagccttgcgccggctgctgggcaaggaacgcgactcccgtgaaagctggcgagccgcatag

SEQ ID NO: 44323 - DNA, 951 bp, Artificial Sequence
  Description of Artificial Sequence: Synthetic coding sequence
atggtgaaccagagcagccccatgggcttcctgctgctgggcttctccgaacaccctgccctggaaaggaccttattcgtggtggtctttacttcttatctgctaacactggtggggaacaccctgattatactccttagcgtgctatatcctcggctccattccccgatgtatttctttttaagcgatcttagcttcctcgatctttgttttacaacctcatgtgtgccacagatgcttgttaacctatggggccccaagaaaactatctccttcctgggttgttcagtgcaactgttcatctttttatccctgggaacgacggaatgcatcctgctcaccgtcatggcatttgatcgatacgtcgccgtgtgccaacccctgcactacgccaccataattcatcccagactctgctggcagctggcgtcggtggcctgggttatgtccttagtgcagtccatagtgcagaccccatctacgctgcacttgcctttctgcccacaccagcaaattgacgacttcctgtgcgaggtcccatccctgattcggttgtcatgtggggatacctcttacaatgagatccaacttgccgtgtcatctgtgattttcgtggtggtacccctgagcctgatcttggccagttacggcgctacagcacaggcagtgctacggattaactcagccaccgcctggcgcaaggcttttggaacctgttcgagccacctcacagtggttacccttttttactctagtgtgatcgctgtgtatctccaacccaagaatccctatgctcaaggccgtgggaagtttttcggcctgttctacgctgttggcaccccaagcctcaatcccctggtgtacacactgaggaataaggagatcaagagggctctgcggcggctgctggggaaagagcgggattctcgggagagctggagagctgcgtag

SEQ ID NO: 44324 - DNA, 951 bp, Artificial Sequence
  Description of Artificial Sequence: Synthetic coding sequence
atggtgaaccagagcagccccatgggcttcctgctgctgggcttctcggagcatcctgcccttgaacgcactttgtttgtcgtggtgttcacctcctacctgctcaccctagttggaaacactctaatcattcttctgtccgtactgtacccacggctgcatagtccaatgtacttttttctgtccgacctgtcattcctggatctctgtttcaccacaagctgcgtgccccagatgctggtcaacctctggggaccgaaaaagacaattagctttttggggtgcagcgtgcaactattcatattcctcagtctgggcactaccgaatgcatcctgttaaccgtgatggctttcgataggtacgtggctgtttgtcagcccctgcactacgccaccattatccaccctaggctttgttggcagctggcttctgtagcttgggtaatgagtcttgttcaaagtatagttcagacaccctccactcttcacttaccgttttgccctcatcagcagatagatgattttctgtgcgaggtgccatccctcatcagactctcctgcggagacaccagttacaatgagatccagctggccgtctcctccgttatcttcgtagtagttcccctgagtctcatcttggcctcctacggcgccactgcccaagccgttttgcggattaatagcgcaactgcatggcgaaaggcctttggaacatgtagctctcatcttacagtggtgacactcttctattcgtccgtgatcgccgtctacttgcagccaaaaaatccttacgcccagggacgcgggaagttcttcggcctcttttatgctgttggaacgccttctctgaatccgctcgtttatacactgaggaacaaagaaattaagcgagccttgcgccggctgttgggcaaggagcgcgacagtagagaatcttggcgcgccgcttag

SEQ ID NO: 44325 - DNA, 951 bp, Artificial Sequence
  Description of Artificial Sequence: Synthetic coding sequence
atggtgaaccagagcagccccatgggcttcctgctgctgggcttctctgaacaccccgctctggaacgcacactctttgtggtggtgtttacgtcctatctactgaccctcgtcggcaacacattgatcatcctgctgagtgtgctctacccccgcctgcattctcctatgtacttttttctgtctgatctgtctttcctggatctgtgtttcaccacatcatgcgtgccacagatgctggtcaatttgtggggccccaaaaaaaccatctcgttccttggttgtagtgtgcaactttttatatttctgtcattggggacaactgaatgcattcttctgactgtgatggcttttgacaggtacgtggctgtttgtcagccactccactatgcgaccataattcacccgcggctgtgttggcagctcgccagtgtggcctgggtcatgagtctggtacagtccattgtgcagaccccaagcactctccatctcccattttgcccccaccagcagattgatgacttcttgtgtgaggtgcccagcttgattaggctgtcatgcggggataccagctacaacgaaattcaactggcggttagcagtgtgatctttgtagttgtcccactaagcttaattcttgcgagctatggcgccaccgcacaggccgtgttgagaattaattccgcaaccgcctggcggaaagcgtttgggacatgtagctctcatttgaccgtggtcaccttgttttactccagcgtcatcgcggtgtacctccagccaaagaatccttacgcacagggtaggggcaagttttttggactgttctacgctgttggaacgccctctcttaatccactcgtttatacactcagaaacaaggaaataaaacgggctttgagacgcctcctgggaaaagagcgcgattcccgggaatcctggcgagcggcctag

SEQ ID NO: 44326 - DNA, 951 bp, Artificial Sequence
  Description of Artificial Sequence: Synthetic coding sequence
atggtgaaccagagcagccccatgggcttcctgctgctgggcttctccgaacatcctgcactcgagcgcacgctgttcgtcgttgtctttacttcctacttgctaacactcgtaggtaacacattgatcatcttactgtctgtactatatcccaggctgcattcacctatgtacttttttttatcagatctttctttcctcgacttgtgcttcaccacttcatgtgtgcctcagatgttggttaacttatggggaccaaaaaagactatttcttttcttggatgttctgtgcagctgtttatctttctgtctttgggcacaacagaatgtatactgttaactgtcatggccttcgatcggtatgtggcagtatgccagccactccactacgctacaattatacacccgcgcctgtgctggcaactcgccagcgtggcttgggttatgtctctggtacagtctatcgtgcagaccccctccaccctgcaccttccgttttgccctcaccagcagattgacgatttcctgtgcgaagttcctagcctgattcggttgtcttgtggggacacgagctataatgagattcagcttgccgttagctctgtgatatttgtcgtagtgcctctttctctgatactagcatcttatggggctaccgcgcaagccgtgcttcggatcaatagtgccactgcatggagaaaggctttcggaacgtgcagctcgcatttaacagtggtgacactcttttatagctccgtcatcgccgtgtacctgcaacccaaaaatccttacgcacaggggcggggcaaattttttggcctattttatgctgttggcacaccctcgctgaatcccctcgtgtatactctgcggaataaagagatcaagcgggctctccggagattgctcggtaaggagcgcgacagtagagaaagctggcgggccgcctag

SEQ ID NO: 44327 - DNA, 951 bp, Artificial Sequence
  Description of Artificial Sequence: Synthetic coding sequence
atggtgaaccagagcagccccatgggcttcctgctgctgggcttcagtgaacatcccgccctggagcgaaccctttttgtggtcgtcttcaccagctatctgttgactctcgtgggcaataccctgattatcctgctctccgttttatacccacgccttcattcccctatgtactttttcctctccgacctgagtttcctggacctttgctttaccacctcttgtgtacctcaaatgcttgtcaacctgtggggtccgaaaaagacaatcagtttccttggctgctctgttcagctcttcatctttctgagcctcggcaccaccgaatgcatcctgctaaccgtcatggctttcgataggtacgtggccgtttgccagcccctccactatgctaccatcatccatccgagactgtgttggcagctggcatctgtggcctgggttatgagtctcgtccagtcaatcgtgcagaccccaagcactcttcacctcccattctgtccccatcagcagatcgatgacttcctttgtgaggtgccaagtctaatccgcttaagttgcggtgataccagttacaatgaaatccagttagctgtgagctcagtgatcttcgtagttgtgcctcttagcctgatcctggccagttacggagccaccgcccaggccgttctgcggatcaattctgccacagcctggaggaaggcctttgggacatgtagcagccatctgaccgtggtgaccctgttctacagctctgttatcgctgtgtatctgcagcccaagaacccttacgcccaagggaggggcaaattcttcgggctgttctacgctgtgggtactccctcactcaacccactcgtatatacactcagaaacaaagagattaaacgcgctctgcgcagactgctcggcaaggaaagagatagcagggaaagctggcgtgcagcgtag

SEQ ID NO: 44328 - DNA, 951 bp, Artificial Sequence
  Description of Artificial Sequence: Synthetic coding sequence
atggtgaaccagagcagccccatgggcttcctgctgctgggcttcagcgaacatcctgccttagagcgcacactcttcgtggtggtgttcaccagctacttgctcacgctagtgggaaatactctcattatcctcttaagtgttctgtatccccgcctgcactcacctatgtatttctttctgtctgacctttccttcctcgatctctgtttcaccacttcctgcgtgccccaaatgctagtgaatttgtggggtcccaagaagacaatttcattcctcggatgctcggtgcagctttttatcttcctatccctcggtactactgagtgcattctcttaaccgtgatggcatttgatcgttatgtagccgtctgtcagccactgcactatgctacaataattcaccccagactgtgctggcagctcgcctccgttgcttgggttatgagcctggtgcaaagtatcgtccagacaccgagcacgcttcatttaccattctgtcctcaccagcagattgacgatttcctgtgcgaggtgccatcccttattagactgtcttgcggagacacctcttataatgagattcagttggctgtgtccagcgtaattttcgtcgtcgtgcccttgtctctgattctggcaagctacggggccacagctcaggcagttctgaggattaacagcgccaccgcctggcgtaaggcatttggaacctgctcttctcatctaacggtggtgactctcttctactcaagcgtgattgcagtctatttgcagccaaaaaacccatatgcccagggccggggaaagtttttcggactattctatgctgtgggtacaccctccttaaatccactggtgtataccctgaggaataaggagattaagcgggcactgagacggctccttgggaaggagagggatagccgggagagctggagagccgcttag

SEQ ID NO: 44329 - DNA, 951 bp, Artificial Sequence
  Description of Artificial Sequence: Synthetic coding sequence
atggtgaaccagagcagccccatgggcttcctgctgctgggcttctcggaacatcccgccttggaaagaaccttgttcgtggttgtgttcacatcatacttgctaacactcgtagggaacacgctaatcattctactcagcgtcttgtacccccggttacactcacctatgtatttctttctgtccgatttgagtttcctggatctgtgcttcacaaccagctgtgttcctcaaatgctcgtcaatctgtggggccctaaaaagaccatcagcttcctgggctgcagtgtgcaactcttcatctttctttctctcgggacgacagaatgcattctcctgacagtgatggccttcgatcggtatgttgccgtgtgccagccccttcactatgctactataattcacccccggttatgttggcagctagcctcagtggcttgggttatgtccctggtccagtccatcgtccagacaccctccacgctacatcttccattttgcccacaccagcagatagatgacttcttgtgtgaggtaccttctctgattcgattgtcttgcggtgatactagctacaatgaaatccagcttgccgtgtctagcgttatttttgtggtggtgccactctccttgattctggctagttatggcgcgacagcacaagccgtgctgcgaattaatagcgctacagcatggaggaaggccttcgggacctgctcatctcacttaacagtggtcaccttgttttacagctcagtgattgctgtgtaccttcaacccaagaatccctacgcacaaggacgaggaaagttttttggtctgttctatgccgtaggcaccccaagtctcaatcctctggtgtataccctgcggaacaaggagattaagcgggcattgagacgcttattgggtaaggaacgagacagtcgagagtcctggcgcgctgcctag

SEQ ID NO: 44330 - DNA, 951 bp, Artificial Sequence
  Description of Artificial Sequence: Synthetic coding sequence
atggtgaaccagagcagccccatgggcttcctgctgctgggcttcagcgagcacccagctctagagcggacgcttttcgttgtcgtcttcacaagctatctactgactttggtgggcaacactcttataatactgctctcagtgctttacccgcggcttcactcccccatgtatttcttcctcagtgatttaagcttcctggatttatgttttaccacatcgtgtgttcctcaaatgctggtgaatttgtggggccccaaaaagactatttccttcctgggatgctcagtacagctattcatcttcctctctcttggcactacagagtgtattctactcacagtcatggcctttgatcgctacgtggccgtgtgccagccgctgcattacgccactataatccatccacggctgtgctggcagctcgcgtctgtcgcctgggtcatgtccctggtgcagagtatcgtccaaaccccaagcaccttgcacctgcccttttgtccccaccagcagattgacgacttcctgtgtgaggtgccttcactcattcggcttagctgtggcgatacctcgtataacgaaatccagctggccgtaagttctgtgatctttgtggtagttcctctgagcctgatactggccagctatggggctacagcgcaggcagtgctgcggattaattctgcgacggcctggaggaaggcattcggaacctgttcctcccacctgactgttgtgacactgttctattcttccgtgatcgccgtgtatctgcagcccaaaaacccatacgctcaaggaaggggtaaatttttcggactgttctatgctgtgggcactccttctttaaatcccctggtgtataccctgcggaacaaggagatcaaacgggctctccggcgattgttaggcaaggagagggactctagggagtcatggcgcgccgcttag

SEQ ID NO: 44331 - DNA, 951 bp, Artificial Sequence
  Description of Artificial Sequence: Synthetic coding sequence
atggtgaaccagagcagccccatgggcttcctgctgctgggcttctctgagcatccagctcttgagagaactctgttcgtggtcgtgtttacatcctacttactaactctggtgggcaatacgctgatcattctcttgtcagttctgtacccccgccttcactccccaatgtacttcttcttgtccgacctctccttcctcgatctgtgttttacaacctcctgcgtaccccaaatgctggtcaacttatggggtcccaagaagactatttcctttctgggctgcagcgtgcaactgtttatcttccttagtctcggaacaacggaatgcattctgctgacagttatggctttcgacaggtacgtggcagtgtgtcagccgttgcactatgcaactatcatccacccgcggttatgttggcagcttgcctccgtcgcctgggttatgagcttagtacagtcgatcgtccagacacccagtactttgcatctgcctttctgcccccaccagcaaatagatgactttttgtgtgaagttccctctctcattcgcctgtcctgcggtgatactagctacaatgagattcagctggccgtatcttcagtcatcttcgtggttgtgccactcagcctaattctggcttcctatggcgcgactgcccaggccgtgttgagaatcaatagcgcaaccgcgtggcgcaaagcgttcggcacctgttcatcccacctgaccgttgtaacccttttttactcatccgtcatcgccgtgtatctccagcctaagaacccatacgctcagggtcgtggcaaattctttggacttttctacgcagtaggaacccccagcttgaacccactagtctatactcttcgcaataaagaaatcaagcgtgcattgagaaggctgctgggaaaggaacgtgactccagagagtcctggagagccgcctag

SEQ ID NO: 44332 - DNA, 951 bp, Artificial Sequence
  Description of Artificial Sequence: Synthetic coding sequence
atggtgaaccagagcagccccatgggcttcctgctgctgggcttcagcgagcatcctgcactagaaagaactctgtttgtggttgtctttaccagctacttgttaacattggtaggaaacactctgattattcttctgtctgtgctttatcccagattacattcacctatgtactttttcttgtctgatcttagctttcttgacttatgttttacgacctcttgcgtgccgcagatgctcgtgaatctttggggccctaagaagactatttcatttctgggatgtagtgtgcagctttttatatttctgtcactgggcaccactgaatgtattctgctgaccgttatggcgttcgatcggtatgttgccgtgtgtcagccgctccactacgcgactatcatacacccacgactatgctggcaactagccagcgtcgcctgggtgatgtccctagtacagtcaatcgttcagaccccaagcactctccacctgccgttttgtccccaccagcagattgatgacttcctctgtgaggtacctagcctgatccggctcagctgcggagatacatcgtacaacgagattcagcttgctgtctccagcgtcatcttcgtggtggtgcctctctcattgatcttggcttcttacggtgcgacagctcaagctgtgctccgcatcaacagcgctaccgcttggcgcaaggcctttggcacatgcagctcccatctcacagtggtgacccttttctattccagtgtgatcgctgtctacctgcagcccaagaacccttatgctcaggggcggggaaaattttttggtctgttctatgccgtgggaaccccttcactgaaccctttggtgtacactctgaggaacaaagagattaaaagggccctcaggcgactgctgggtaaagagagggatagccgagaatcttggcgtgccgcctag

SEQ ID NO: 44333 - DNA, 951 bp, Artificial Sequence
  Description of Artificial Sequence: Synthetic coding sequence
atggtgaaccagagcagccccatgggcttcctgctgctgggcttctccgagcaccccgcactcgagagaactttgttcgttgtggttttcaccagctatcttctcacacttgtggggaacacactgatcattttgctcagtgtgctgtatcctcgtctccactccccaatgtatttcttcctgagcgacctgagttttctggacctgtgtttcactacaagttgtgtgcctcagatgctggtaaacctctgggggcccaagaaaacaatcagttttctgggatgctccgtgcagctgttcatttttctcagccttggaacaacagaatgcattctgctcaccgtaatggcattcgacagatatgtggctgtgtgccagcccctgcactatgctaccatcatccacccacggttgtgttggcagctggcgtccgtagcttgggtgatgtcgctcgtgcaaagtatagtacaaaccccgtccaccctgcatctgccattttgtccccatcaacagatagacgatttcttgtgcgaggtgccctccctgattaggctcagctgtggggacacttcttacaacgagatccaattggccgtgagttctgtgatcttcgtggtggtgccactgagcctgatactcgcctcctacggcgccaccgcacaggcagtgctgaggatcaattccgcgacggcatggcgaaaggcatttggaacctgcagctcacaccttactgtggttacgctgttttatagctccgtaatcgcggtgtacctccagcccaagaatccttacgcacagggccgtgggaaattttttggcctgttttacgcagtgggcacacccagtctgaacccccttgtgtatactctacgcaacaaagaaatcaaaagagccctgcgaagattactgggcaaagaaagggactcaagggaaagctggcgggcggcttag

SEQ ID NO: 44334 - DNA, 951 bp, Artificial Sequence
  Description of Artificial Sequence: Synthetic coding sequence
atggtgaaccagagcagccccatgggcttcctgctgctgggcttctctgaacacccggcactggaacggacactcttcgtggttgtgtttacatcatatctgcttacgctggtgggtaacacgctgatcatccttcttagcgtcttgtaccctcgactgcattcaccaatgtacttttttcttagtgacctgtcttttttagacctgtgtttcacgaccagctgcgtgccgcagatgctcgtcaacctgtgggggccaaagaaaacaatatcatttctgggctgcagtgtccagctgtttatctttttatccttaggcacaaccgagtgtatactactgacggtgatggccttcgatcgatacgtggcagtttgccaacccctgcattacgcgacaatcattcatccacgcctgtgttggcagctggcaagtgtggcatgggtcatgtcactggtgcaaagcattgtgcagaccccgagtaccctgcatctccctttttgtccacaccaacagatcgacgactttctctgtgaagtgccgagtttaatccgactgtcctgcggagatacttcatacaacgagatccaactggcggtatcttctgtgatattcgttgtggtccccctctctctgatcctggccagttacggcgccactgcccaggcggtactaagaatcaactctgccaccgcctggcggaaggccttcggaacgtgctccagtcacctgacagttgtaactctgttctactcatccgtcatcgccgtctacttacagccgaagaacccatacgcacagggaagaggaaaattctttgggctcttctacgcggtgggaactccaagcctcaaccctctcgtatataccctccgcaacaaagaaattaagagagcgttaagacgcctgctgggtaaggaaagggactcccgggaatcttggagagctgcttag

SEQ ID NO: 44335 - DNA, 951 bp, Artificial Sequence
  Description of Artificial Sequence: Synthetic coding sequence
atggtgaaccagagcagccccatgggcttcctgctgctgggcttctccgagcaccccgctctggagagaacactttttgtcgtagtcttcacgagctatctgctgacattggtgggtaacacattaatcattcttttatccgtgctctatcccaggctgcatagtcctatgtacttctttctgagcgatctcagtttcctagatctctgtttcaccactagttgcgtgcctcagatgctcgtgaacctgtgggggccaaagaaaaccattagtttcctcgggtgctccgtccagttgtttatttttttgtccctgggcactacagaatgcatcctcctgacagttatggccttcgacaggtacgtcgcagtgtgccagcccttacattacgccacgatcatacacccccggctgtgctggcagctggcttctgttgcgtgggtcatgagcctggttcaaagcattgtccaaacgccttcaacactgcatctgccgttttgcccccaccagcagatcgatgactttttgtgtgaggtcccctctttgatccgcctgagttgtggcgatacaagttacaacgagatccagttagccgtgagctcagttatcttcgtagtagtacccttgtccctgatcttagcctcatacggtgcaaccgctcaggcggtattgcggattaactcggcgacagcttggcgcaaagctttcggaacctgctcctcacacttaacggtggtaactctgttctacagcagtgtgatcgccgtttaccttcagcccaagaatccttacgcccagggcaggggcaaatttttcggacttttttatgcagtgggaacccctagcctcaatcctctggtgtacacactccggaataaagaaatcaagcgcgcattgcggagacttttgggcaaggaaagggattctcgagagagctggagagccgcttag

SEQ ID NO: 44336 - DNA, 951 bp, Artificial Sequence
  Description of Artificial Sequence: Synthetic coding sequence
atggtgaaccagagcagccccatgggcttcctgctgctgggcttctctgaacaccctgctttggaaaggaccttgttcgtggtggtgttcactagttacctgctgacactcgtggggaacacactgataattttgctgagcgttctctatccacggctccacagccctatgtatttcttcctatccgacttaagctttttggacctttgcttcacaacctcctgtgtaccgcagatgttggtaaacttatggggtcctaagaagaccatcagctttttgggatgctcagtgcagctgttcatatttctgtctctgggtactacagagtgtatcctcctaacagtgatggcttttgaccgctacgtcgcagtatgtcagccactgcactatgctactattattcatcccagactgtgttggcaactggcctctgtggcatgggttatgtccctggtacagtccatcgtgcagacacctagcactctacacctgccattttgccctcatcagcaaatcgatgacttcctctgcgaagtgccctcactgatccggctctcttgtggtgacactagttacaacgagatccaactggccgtgtctagcgtaatttttgtggtagtccccctgtctcttattcttgccagttacggcgccaccgcccaggccgtgttgcgtatcaattcagcaaccgcctggagaaaagctttcggtacttgttcctcacatctcacggtcgtcaccctgttctactcctcggtgatagctgtgtatctgcagcccaagaacccatatgcccaaggccgcggcaaattttttggactgttctacgccgttggaaccccctctctgaatcccctcgtgtacacactcagaaataaagagatcaaaagagcacttagacggttgctgggcaaggagagggattccagagaaagctggcgggcagcatag

SEQ ID NO: 44337 - DNA, 951 bp, Artificial Sequence
  Description of Artificial Sequence: Synthetic coding sequence
atggtgaaccagagcagccccatgggcttcctgctgctgggcttctctgaacaccccgccctcgaacgaacactctttgttgtagtgtttacgtcctacctgctcactttagtcggaaatacccttatcatcctgctttcagtcctctaccctcggttgcacagtcctatgtactttttcctaagcgatctctcattcctggacctttgttttacaaccagttgtgtgccacaaatgctggtgaacctgtggggaccaaagaagactataagttttttaggttgttctgtacagctgtttattttcctgagtttggggaccactgaatgtatcctattaacagtgatggcatttgatcggtatgttgccgtttgccagcccttgcactatgccacaatcatccaccccaggctgtgttggcaactagcgagtgtggcttgggtgatgtccctggttcagtcaatcgtacagactccatcgactcttcacctccccttctgcccacatcaacagatcgacgactttctttgtgaagtgccaagcctgattcggctgtcctgcggagatacatcatataatgagatccaactggctgtgtctagtgtcatcttcgtcgttgttccactgtctctcatcttggcctcatatggcgctaccgcacaagcagtactgcggatcaacagcgccaccgcttggaggaaagcattcggaacatgcagcagccaccttactgtcgtcaccctcttttacagtagcgtgattgctgtgtacctacagcccaagaatccatacgcacaggggcgggggaagttcttcgggcttttctatgccgttgggacaccatccctgaatcctcttgtgtacactctccgcaataaagagattaagagagcattgaggaggcttcttggcaaggaacgtgatagcagagaatcctggcgggcagcctag

SEQ ID NO: 44338 - DNA, 951 bp, Artificial Sequence
  Description of Artificial Sequence: Synthetic coding sequence
atggtgaaccagagcagccccatgggcttcctgctgctgggcttctctgaacaccccgctctcgagcgtaccctgttcgttgtggtctttacatcatatttgctgactctggtgggcaatactttgattatcctgctctctgtgctttatccaagactgcactcgccaatgtacttctttttgagtgacctttctttcctcgatctctgcttcaccacatcttgtgttccccaaatgctcgtcaacttatggggacccaagaagaccatctcttttctgggctgttcggtgcaactattcatctttctttcacttggaaccaccgaatgtattctgctgactgtaatggccttcgaccgatatgtggcagtgtgccaacctctccactatgccactataattcaccctcgcctttgctggcaactggccagtgtagcatgggtgatgagcctggtgcagtcgattgttcagacacccagtacccttcatcttcccttctgcccccaccagcaaatagacgacttcctgtgtgaagtaccgtcattgatcaggctcagctgcggcgacacctcatacaatgagatccagctggctgtgtctagcgtgattttcgtggttgtgcctctgtctctgattctcgcctcctatggagcaaccgcacaagcagtgcttcgtataaactcggctaccgcttggagaaaggccttcggcacttgcagtagccacctcaccgttgtaacccttttttacagctccgtgattgcagtgtaccttcagccgaaaaacccatacgctcaaggtcgcgggaaattttttggtctgttctatgctgtcggcacacctagtttgaatcctctcgtgtatacgttgcggaacaaggagatcaaacgcgccttgcggcggctgctgggcaaggagcgggacagcagagagtcctggcgcgcggcttag

SEQ ID NO: 44339 - DNA, 951 bp, Artificial Sequence
  Description of Artificial Sequence: Synthetic coding sequence
atggtgaaccagagcagccccatgggcttcctgctgctgggcttctccgaacatcccgctctggagagaacattgttcgttgttgtgtttacatcttatctacttactctggtgggaaatacgttaattatcctgctcagcgtactgtatccacgcttacactcaccaatgtactttttcctgtctgatttgtctttcttggacctgtgcttcacaacatcatgtgtgccgcagatgctggttaatttgtggggacctaagaagacgattagcttcctaggctgttcggtccagttattcatctttctctccctgggaacgactgagtgcatcctccttaccgtaatggcgttcgaccggtacgtggctgtgtgccagccacttcactacgctaccataatccatccccggttgtgttggcagttagcaagcgtagcttgggttatgtctctagtgcagagcattgttcagaccccttccacactgcatctacccttctgcccacaccaacagatagacgacttcctgtgtgaggtcccctcgctgatccgtttatcgtgcggcgatactagttacaacgaaatccagctggccgttagctccgtgatcttcgtcgtggtgcctctgtctctcatcctggcttcttatggtgctacagcccaggccgttctaaggattaactcagctactgcctggaggaaggctttcggaacatgctcttcccacttgacagtggtcactttgttttactccagcgtcattgccgtatatctgcaaccaaagaatccatatgcacagggcagaggcaaattctttgggctattctacgcagtggggacgcccagtcttaaccccctggtttataccttaaggaacaaggaaataaaacgggctctccggaggctccttggaaaggagagagattctagagagtcttggagagcagcctag

SEQ ID NO: 44340 - DNA, 951 bp, Artificial Sequence
  Description of Artificial Sequence: Synthetic coding sequence
atggtgaaccagagcagccccatgggcttcctgctgctgggcttctcagaacatcctgcattagagagaacactgttcgtggttgtgtttacctcctatctgctgacactggtgggtaacacactcatcattcttctttccgtcctatacccaaggttgcatagccccatgtatttttttctgtccgacctgtcttttttagatttgtgctttaccacctcttgtgtgccacagatgttggtcaacctttggggacctaaaaagactattagctttttggggtgctcagttcagctctttatatttcttagcttgggaaccaccgaatgcatcttgctcacagtgatggcctttgatcgttatgtcgcagtgtgtcaaccgctccactacgccaccatcatccacccgcgactctgttggcagctggcctctgtagcttgggtgatgagcctggtgcagtcaattgtccagactccttccactctgcacctccccttctgcccacatcagcagattgacgacttcttatgcgaagttccctctctgatccgactgtcttgtggcgacacctcctataatgagatccagttggcggttagcagtgtgatattcgtcgtggtcccactttcgttaattctggcgagctacggggccaccgctcaggccgtgctgcggataaactcggcgactgcatggagaaaagcttttgggacgtgcagttcacacctaactgttgtgacgttattttattccagtgtaattgccgtgtaccttcagccaaagaacccgtacgcacagggccgggggaagttctttggcttattttacgctgttggcacaccttcgctcaatcctctggtttacaccctccgcaacaaggagatcaagcgagccctgcggaggttgctgggaaaagagcgcgactctcgagagtcttggcgcgccgcttag

SEQ ID NO: 44341 - DNA, 951 bp, Artificial Sequence
  Description of Artificial Sequence: Synthetic coding sequence
atggtgaaccagagcagccccatgggcttcctgctgctgggcttctcagaacaccccgccctggaaaggacactgttcgtggtagtcttcacctcctacctgttaacactggtaggtaacactctgattattcttctctccgtgctgtacccgaggttgcattctccgatgtactttttcctctccgatctaagttttttggacctgtgctttacgaccagctgtgttccgcaaatgcttgtgaatctttgggggccgaagaagaccatctcctttctgggctgctccgtgcaattatttatttttctgagcctcgggactacagaatgcattcttcttaccgttatggcttttgatcggtacgtggctgtgtgtcagccactacactatgccactatcattcacccccgcctctgttggcaacttgcttcagtcgcctgggtgatgagtctcgtacagtctattgtccagactccgtcaacacttcatctccctttctgcccccatcaacagattgacgatttcctgtgcgaagtgccctcgcttattcggttatcctgtggagatacatcatacaatgaaatccaactcgccgtgagcagtgtgatattcgtggtggtccctctctccttgattctcgcgtcttacggcgcaacggcccaggcggtactgcggattaatagtgccaccgcttggcgaaaggcattcggaacttgctcttcacacctcaccgtcgtgactctcttttactcgagcgtaatcgccgtgtacctccagcctaagaacccctacgctcaaggccgcggcaaattcttcggattgttttacgcagtgggcactccctctttgaacccactggtgtacaccctgaggaataaagagatcaaaagggccctccgaagattgctgggcaaagagcgcgatagcagggaatcatggcgcgctgcttag

SEQ ID NO: 44342 - DNA, 951 bp, Artificial Sequence
  Description of Artificial Sequence: Synthetic coding sequence
atggtgaaccagagcagccccatgggcttcctgctgctgggcttcagcgaacacccggccttggaaaggaccctgtttgtggtggtcttcacttcttacctgctgaccttagtcggaaataccctgatcatccttctcagcgtactgtatcccagactgcattctccaatgtatttcttcctgagtgatctgagttttctcgatctgtgttttactacatcatgcgtcccccaaatgctggttaatctctggggtccaaaaaagacgatttcgtttcttggttgttccgtgcagctctttatcttcttgtctctgggcacaaccgagtgcatcttacttaccgtgatggcatttgatcggtatgtggccgtgtgccagccacttcactacgccactataatacatccccgcctttgttggcagcttgctagcgtggcatgggtcatgtcacttgtccagagcattgtccaaacacccagcacgctccacctgcccttttgtccacaccagcagatcgacgattttctgtgcgaggtgccctcccttatccgcctgagttgcggagataccagctacaacgaaatccagctggccgtctcttctgtgatatttgttgtggtgcctctctcactgattctggcttcgtacggggctactgctcaagccgtgctccgcattaatagcgcaacagcttggcggaaggccttcggtacatgctcatcacatttgaccgtcgtgacactgttttattccagcgttattgcggtctacctccaaccaaaaaatccttatgcccagggccggggaaagttctttggtctgttttatgctgtgggcacgcctagtctgaatccactagtctacaccctgcgaaacaaagagattaagagagctctgaggagactgctcggaaaagagcgggactctagagagtcctggagagcggcctag

SEQ ID NO: 44343 - DNA, 951 bp, Artificial Sequence
  Description of Artificial Sequence: Synthetic coding sequence
atggtgaaccagagcagccccatgggcttcctgctgctgggcttctcagagcatcccgcactcgagcgaaccctatttgtcgtcgtgttcacctcatacctgctgactctggtaggaaacaccctcatcatcttactgtccgtattataccctcgtctgcattcaccaatgtatttctttctgtctgacttatctttcctcgatttgtgctttacaacatcttgcgttccgcagatgttagtgaacctgtgggggccaaagaagacaatttctttcttaggctgcagtgtgcagctttttatctttcttagccttggaaccacagaatgtattctgctaacagtgatggcgttcgaccgatatgtagcagtttgtcaacccctccactacgctacaatcatccatccaaggctatgttggcagttggcaagcgtagcctgggtgatgagccttgtgcagtctattgtgcaaacaccctcaactctccacctacctttctgtccccaccaacagatagatgattttctttgtgaagttcctagcttgatccgcctgagctgcggggatacctcttataatgagatccagctggcagtctccagcgtcatttttgtggtggttcctctgtctcttatccttgcatcttacggcgcaacagctcaagcagtgctgaggattaattctgcgacagcatggcgcaaagcttttgggacctgtagtagtcatctaaccgttgtcactctgttctattcttcagtgatagcagtgtatctccagcccaagaacccatacgcccagggtagaggtaagttttttggtttgttctacgccgttggtacgcctagcctgaatcccctggtgtatacactcagaaataaagagattaaacgtgcactccggaggctcttgggaaaagagcgagattcgagggagtcttggagagccgcctag

SEQ ID NO: 44344 - DNA, 939 bp, Artificial Sequence
  Description of Artificial Sequence: Synthetic coding sequence
atggtgaaccagagcagcacccccggcttcctgctgctgggcttctctgaacacccaggtctggaaaggactttgttcgtggtggtgctcacatcttatctgctgacgctggtgggaaacaccctcattatcctcttatctgccctggacccaaaattacactccccaatgtacttctttctgtccaacctgagcttcctggatttgtgctttacaacatcatgtgtgccacagatgttggtcaatctgtggggtccaaagaagactatttctttcctagattgttcagtgcagatatttattttcttatctcttgggaccactgaatgtatactcctgacagtgatggcctttgacaggtacgtcgccgtgtgtcaaccacttcattacgctacaataattcaccccagactgtgttggcaactggcgtcagtggcatgggttatcgggctagttgagtccgtggtgcaaaccccaagtaccctgcacctgcccttttgtcctgatcgccaggttgacgattttgtatgtgaggtgcctgctcttataaggctgtcatgcgaggataccagttacaacgaaatccaagtcgcggtcgcgagcgttttcattctggtcgtgcccctgagtctcattcttgtcagttacggggcaatcacctgggctgttctgaggatcaactcagctaagggccggcgcaaagctttcggcacatgcagctcacatctgaccgtggtgactctcttctattcctctgttattgccgtatatctacaaccaaaaaatccatacgcacaggaacgggggaagttcttcggcctgttttatgccgttgggacccccagtctcaaccctctaatctacacactgcgcaataaagaggtgacacgggcctttcggcgcttgctgggcaaggaaatggggttgacccagtcttag

SEQ ID NO: 44345 - DNA, 939 bp, Artificial Sequence
  Description of Artificial Sequence: Synthetic coding sequence
atggtgaaccagagcagcacccccggcttcctgctgctgggcttctcagaacatccgggactggaacgtacacttttcgtcgtggtgctgaccagctacctgctcactcttgtcggcaataccttgatcattcttcttagtgccctggatcccaagttacatagtcctatgtacttcttcttgtctaacctctcctttctggacctttgctttaccacctcttgcgtgcctcagatgctggtcaatttgtggggccccaagaaaacgattagtttcctggattgcagtgttcaaattttcatctttttaagcctgggtaccactgagtgtatattgctgaccgtcatggccttcgatcggtatgtcgctgtttgtcagccacttcattacgctaccatcatacaccctaggctgtgttggcagctcgcgtccgtggcctgggtgatcggtctcgtagaatctgtagtgcaaaccccttctactcttcatctccctttctgtccagaccgtcaggtcgatgactttgtatgtgaggtaccggcactcatacggctgagttgtgaagacactagctacaatgagatacaggtggctgtggcttctgtgttcattctagtggtacctctctctctgatcctcgtatcatacggcgccatcacgtgggcagtcctcaggattaattctgcaaaagggaggcgcaaagcctttgggacctgctcgtctcatctgacagtcgtcacccttttttatagcagtgtcatcgccgtctacctccagccgaagaatccttatgctcaggaacgcgggaaattttttggacttttctatgccgtgggaaccccctctctgaacccgctgatttacaccctaagaaacaaggaagtcactcgggcctttcgacgtctgcttggcaaggagatgggtttaactcaatcctag

SEQ ID NO: 44346 - DNA, 939 bp, Artificial Sequence
  Description of Artificial Sequence: Synthetic coding sequence
atggtgaaccagagcagcacccccggcttcctgctgctgggcttcagtgaacatccaggtctggaaaggacgctcttcgtggtcgtgttaacgtcttacctgcttacgctggtcgggaacacattaataatcctgctgagcgctctggatcccaagctacactctcccatgtacttctttctctcaaatttgtcatttctggacctgtgcttcaccactagctgcgtccctcaaatgctggtgaacctctggggccccaagaaaaccatatcctttcttgactgcagtgtgcagatttttatattcctgagtctgggtaccactgaatgcattctcctgaccgttatggcatttgaccgatacgtggcagtctgtcagccactccattatgccacgattatccaccccaggctgtgctggcaacttgcgtctgtggcctgggtgatcggactagttgagtcagtggtgcaaaccccttccactctccacttacccttttgccccgatcgccaggtcgacgattttgtatgtgaggtgcccgctcttatccgcctgtcttgtgaagacacctcctacaatgagatccaggtggccgtggcctctgtgtttatcttagttgtccctctcagcctgattctggtctcttacggggccatcacatgggccgtcttgcggatcaatagtgccaaaggtaggcgaaaggcgtttggcacttgcagttcccacctcaccgtggtgactcttttttattcttcagttatcgcggtatatttacagcccaagaacccctacgcacaagagcggggaaaattcttcgggctgttctatgcggttgggacaccttctctgaatcctcttatctacacactcagaaacaaggaggtgacccgggccttcagaagactgttaggaaaggagatgggcctcactcagtcatag

SEQ ID NO: 44347 - DNA, 939 bp, Artificial Sequence
  Description of Artificial Sequence: Synthetic coding sequence
atgctgatgaagaagaacgccagcttcgaggacttcttcctgctgttggggtttagcaattggccacacttagaagtggtgctcttcgtggtaatcctgattttctacctgatcacattaatcggtaatctgttcataattatcctgagttacttagacagtcatctgcacacacctatgtattttttccttagcaacctgagctttttagatctgtgctacacaaccagctctattccccagttgctagtgaatctatggggccccgagaagactatatcctacgccgggtgcacggtacaactctattttgtcctagccttaggcacagccgaatgcgtactcttagttgtcatgagctacgaccgatatgctgctgtctgtaggcccctgcattacaccgtgctgatgcatccaaggttttgcagactgctcgccgccgctagctgggtatccggctttaccacttccgctttgcacagtagctttactttctggataccattatgcaggcacagactggtggaccactttttctgcgaagtcccggccctgcttcgtctgagctgcgtggacactcaggccaacgaactcactctcatggtgatgagctctatatttgtcttgattcccctaatcctgattctgacaagttatggcgccatagctcgtgccgtgctgtccatgcagtctaccaccgggctccaaaaagttttgcgaacctgcggtgcacacttgatggtggtgagccttttttttatccccgttatgtgtatgtatctgcaacctcctagcgaaaattcccaggaccagggcaaatttattgccttattctacactgttgtgacaccctccttaaacccgctgatctacaccttcaggaataaggacgtacgcggcgcagtgaaaagactcatgggatgggagtggggcatgtag

SEQ ID NO: 44348 - DNA, 939 bp, Artificial Sequence
  Description of Artificial Sequence: Synthetic coding sequence
atgatgatcaagaagaacgccagcagcgaggacttcttcatcctgttgggattcagcaactggccccagctggaggtcgtccttttcgttgtgattctcattttttacctcatgacactgacaggcaatttattcataataatcctctcgtatgtggactcgcaccttcacactccaatgtactttttcctgtcgaacctatctttcttggatctgtgtcacactacatcgtcaattccccaattattagtgaacctgcgcggacccgaaaagaccatttcctatgctggctgtatggtccagctttacttcgtgctggctctgggtattgccgagtgcgttctgctggtggtgatgtcatacgaccggtacgtggctgtttgtcgcccactgcattacacggtcctcatgcacccaagattttgtcacctgctggcggctgcttcctgggtcattggcttcactatcagcgcgttacattcttcctttaccttttgggtccctctgtgcggacacaggttggtggaccacttcttttgcgaagtgcctgcactactcagattatcatgtgtcgacacgcatgccaatgaactgacccttatggttatgtctagcatctttgtcttgatccccttaattttgattctgacagcttatggagctattgcacgcgcagttttaagtatgcagagcacaacaggtctgcagaaggtgtttaggacctgcggagcacatctcatggtggtgtctttgtttttcatcccggtgatgtgcatgtacctgcagcccccatccgaaaactcgcccgatcagggcaaattcattgccttgttttataccgtggtgacaccttccctgaatcctctgatctacaccctcagaaataagcatgtcaagggtgccgctaaacgtctgctgggttgggaatggggtaaatag

SEQ ID NO: 44349 - DNA, 939 bp, Artificial Sequence
  Description of Artificial Sequence: Synthetic coding sequence
atgatgatcaagaagaacgccagcagcgaggacttcttcatcctgttggggttctccaattggcctcagctggaggtcgtgctctttgtggttatcttaatcttttacctcatgacgctgaccggtaatctgttcattatcattctgtcttatgttgactcccacttacatacaccaatgtattttttcctcagcaatctctcatttctggatctatgtcacactacttccagcataccacaactcttggtcaacctgcggggtcctgagaagacaattagctacgccgggtgcatggtccagctgtacttcgtcttagccttgggaattgccgagtgtgttctgttggttgtgatgtcatatgacaggtacgtggctgtgtgtcgtccattacactataccgtgctgatgcatccccgattctgccacctgctggcagccgcctcatgggtcatcggcttcaccatctctgcgctgcacagctcctttacattctgggtccccctctgtggacaccgcctggtggaccacttcttctgcgaggtgcctgcactgctgaggctatcatgtgtcgatacccacgccaatgaactgacactgatggtgatgagtagtatctttgtcctgataccactgattctgatactcactgcttacggcgccattgcgcgggctgtcctgtcaatgcagtccacgactggattgcaaaaggtgtttcgcacctgcggggcgcatttgatggtggtttcccttttcttcattccggtaatgtgcatgtacctccagccaccctcagagaactcgcccgatcaagggaagtttatcgctctattttataccgttgtcacaccatcgctgaacccactgatttatacactccggaacaagcatgtgaagggcgcagccaaaagactcttaggttgggagtggggcaagtag

SEQ ID NO: 44350 - DNA, 939 bp, Artificial Sequence
  Description of Artificial Sequence: Synthetic coding sequence
atgatgatcaagaagaacgccagcagcgaggacttcttcatcctgttaggatttagtaattggccccagttagaagtggtgttgttcgttgtgatcctaatcttttacctgatgacactcacagggaacttattcataattattctgtcttatgtcgacagccacctgcacacgcccatgtatttttttctctcaaatctgagttttctggacctatgccatactacatcctcgataccacaactgctcgtgaatcttcgaggaccagagaagactattagctacgctgggtgtatggtccagctgtacttcgtccttgcgttggggatcgctgaatgtgtgcttctcgtggtcatgtcatacgaccggtacgtcgccgtctgtcggccattgcactacactgtgctcatgcatcctaggttctgtcacctgctagctgccgctagctgggtgatcggttttaccatatccgctctacacagttccttcacattctgggttcccttgtgtggtcacaggctggtggatcacttcttctgcgaagttcccgctctgcttaggctatcctgcgtcgacacgcacgccaatgagcttactctgatggtaatgtcatctattttcgtcctcattccgttgatcctgatcttgacagcatatggagcaattgcacgcgccgtgctttccatgcagagcaccaccgggcttcagaaggtgttcagaacgtgcggcgcacatcttatggtggtatcactgttcttcatacccgttatgtgcatgtacctgcagcccccaagcgaaaacagtcctgaccaaggtaaattcatcgcactcttttacaccgtggtcacccccagtttaaatccactgatatatactctgaggaacaaacacgtgaagggtgctgccaagcgcctcctaggctgggagtgggggaaatag

SEQ ID NO: 44351 - DNA, 939 bp, Artificial Sequence
  Description of Artificial Sequence: Synthetic coding sequence
atgatgatcaagaagaacgccagcagcgaggacttcttcatcctgcttgggttcagcaattggccccagctagaagttgtgctctttgtagtaattctgatcttctacttaatgactctgacaggtaacttgtttattattattctcagttatgtggacagccaccttcataccccaatgtattttttcctgtctaacttatcattccttgacctctgtcacactaccagctcaatccctcagttgttagttaacctccggggcccagagaaaactatttcctatgcagggtgcatggtccagttgtattttgtgctggccttagggatcgctgagtgtgtgctattggtggtcatgtcctatgatcgctatgtggccgtgtgtcgccccctgcactacacagtgctgatgcaccctagattctgccacttgcttgcagcggcgtcatgggtcattgggttcacaattagcgccttacacagttcctttacattttgggtgcccctctgtggacaccgcttagtggatcacttcttttgtgaagtgcccgccttattacgcctgtcctgtgtcgacacgcatgcaaatgaactcacattaatggtaatgagcagcatctttgtgttgataccgcttatactcatcctcaccgcctacggtgctatcgctcgagctgtactgagcatgcagagtacaacaggcctccagaaggtattccgtacatgcggagcacatctaatggtcgtgagtctcttctttatccctgtcatgtgcatgtatctacagccgccatccgagaatagccccgaccaggggaagttcattgctcttttctatacagtggtcacaccttcactcaacccgcttatttatactctgcgcaataagcacgtaaagggcgcggccaaacgacttttgggatgggaatggggtaaatag

SEQ ID NO: 44352 - DNA, 939 bp, Artificial Sequence
  Description of Artificial Sequence: Synthetic coding sequence
atgatgatcaagaagaacgccagcagcgaggacttcttcatcctgctggggttctctaactggccgcagttagaagtggttctttttgttgttatccttatattctacctcatgactttaactggaaatctgttcataatcattctgtcctacgtcgactcccatctccatacccccatgtacttcttcctcagtaacctctcttttctggacttgtgtcacacaacctccagtatccctcagctcctggtaaacctgagggggcctgaaaagactatctcttacgcagggtgcatggtgcaattatactttgtccttgccctgggcatcgcagagtgtgtgttacttgtggtcatgtcctatgacaggtatgtcgcagtttgtaggcctctccactacacagttctgatgcacccacggttttgccatcttctggctgccgcctcctgggtcatagggttcacaatcagtgcactgcacagtagctttaccttctgggttccactttgcggccacaggctggtggaccacttcttctgcgaggtacccgctctgttgaggctgtcctgcgtggatacacacgcgaacgaattaaccctaatggttatgagctccatctttgttttaattccactgatcctcatcctgactgcctatggagccatagcacgggccgtcctctccatgcagtctaccacgggcttgcaaaaggtttttagaacctgcggggcccacctgatggtcgtgagcttattttttatccccgtcatgtgtatgtacttgcaacccccaagcgagaactccccagatcagggtaaatttatcgcgctcttctatacagtggtgaccccctcgctcaacccgttgatctatacgttgcggaacaaacacgtgaagggcgccgctaagcgattactcggctgggaatggggcaagtag

SEQ ID NO: 44353 - DNA, 936 bp, Artificial Sequence
  Description of Artificial Sequence: Synthetic coding sequence
atgaacgacgacggcaaggtgaacgccagcagcgagggctacttcatcctcgtcggtttctctaactggcctcatcttgaggttgtgatatttgtggtggtcctgattttctacctaatgactctgatcggcaatctcttcatcatcattctgtcttacttggactcgcatctacatacgcctatgtatttcttcctctcaaatctgtctttcctcgatctgtgctatactacctcttccatcccccagcttctggtgaatttgtggggccccgagaaaacaatatcttacgctgggtgcatgattcaactttacttcgtcttggcattgggaaccacagaatgcgtacttctggtggtgatgtcctatgacaggtatgccgctgtttgtcggccacttcactacaccgtgctgatgcatccccgattctgccatctgctcgctgtggcctcatgggtcagcggcttcactaattcagcattgcacagcagcttcaccttctgggtgcccctctgcggccatcgacaagtagatcacttcttttgtgaggtgcctgcacttttgcgcttgtcatgtgtggatacacacgtcaacgaattgacccttatgatcacctcctcaatcttcgtgctcatacccctgattttgatcctaaccagttatggcgcgattgtacgcgctgtgttgcgcatgcaaagcaccacaggacttcaaaaggtctttggtacctgcggtgctcatctgatggccgtctccctatttttcattcccgccatgtgcatctatcttcagccacccagtggcaatagccaggaccaggggaagtttattgctctgttttatacagtggtgactccctccctaaacccactcatctacacgctgcggaacaaggtggtcagaggggctgttaagcgcctgatgggatgggaatag

SEQ ID NO: 44354 - DNA, 936 bp, Artificial Sequence
  Description of Artificial Sequence: Synthetic coding sequence
atgaacgacgacggcaaggtgaacgccagcagcgagggctacttcatccttgtcggcttttccaactggcctcacctagaggtggtaatcttcgtcgttgttctgattttctacctgatgactcttatcggaaacctgttcatcattatattgtcttatctggactcccacctgcacaccccaatgtacttctttctgagcaacctctccttcctggatctgtgttacacgacctccagcataccccagctgttggtcaacctttgggggcccgagaagaccatcagctacgccggatgtatgattcagctttattttgtgctggcccttggaaccaccgaatgcgtgctattggtagtgatgtcctacgatagatatgctgcagtgtgccggcccctccactatactgtgctcatgcatccaaggttttgtcacttactagcagttgcgagctgggtgagcgggttcactaactcagctcttcactcttcctttacgttttgggtgcccctatgtgggcaccgacaagtggaccactttttttgcgaggtgcctgctcttctgcggctctcttgtgtggacacacacgtaaatgaactaacactgatgattacgtcctccatcttcgttttgattccactgatccttatcctgacatcatatggagctatcgtgagggctgttctgaggatgcaaagcaccactggcctgcaaaaggtgttcggtacgtgtggcgcccacctaatggcggtgtcactgtttttcattcccgctatgtgcatttatctccaaccaccttcaggcaattctcaggaccagggcaaattcatcgctcttttttataccgtggtcaccccaagcttaaatcccctgatttataccctcaggaataaggttgtacgaggagccgtgaagagactgatgggctgggagtag

SEQ ID NO: 44355 - DNA, 936 bp, Artificial Sequence
  Description of Artificial Sequence: Synthetic coding sequence
atgaacgacgacggcaaggtgaacgccagcagcgagggctacttcatcttagttggtttctctaactggccccatctggaagttgtgatttttgtggtggtactcatcttctacctgatgaccctgatcggcaatttgtttattataattctttcatacttggatagccatctccatacacccatgtacttcttcttatctaatctaagttttttggacttgtgttacaccacttctagcatcccccagttgctcgttaacctctggggacctgagaagacaattagctatgccgggtgtatgatccaactctacttcgtgctcgctttgggaacaaccgagtgcgttctactagtggtcatgtcatacgataggtatgcagctgtttgtagacctctgcattacaccgtcctgatgcatcccagattctgccatctgttagccgtggcatcctgggtcagcggattcaccaattcagcccttcatagctcttttacgttttgggtcccactgtgcggacaccgccaagtagatcactttttctgtgaggtccccgccttgctcaggttatcctgcgtcgatactcacgtgaatgagttgacactaatgataacatcgagtatcttcgttttgatccccctcatcttgatactcacttcctacggggcgatagtaagagccgtcctccgtatgcagtcaacaactggactgcagaaggtgttcgggacctgtggagcccatctgatggccgttagcctattttttatacctgccatgtgcatttacttacagccacctagcggtaactcccaggatcagggcaaattcattgcactgttctacactgttgtcaccccatccctaaacccattaatctacactcttcggaataaggtggtgaggggagcagttaagcgacttatggggtgggaatag

SEQ ID NO: 44356 - DNA, 936 bp, Artificial Sequence
  Description of Artificial Sequence: Synthetic coding sequence
atgaacgacgacggcaaggtgaacgccagcagcgagggctacttcattctcgtgggcttttccaattggccgcacctggaagttgtaattttcgttgttgtccttattttttatcttatgacactcattggaaatttgtttatcatcattttgtcatacctagattctcacttacacacacctatgtacttcttccttagtaatttgtccttcttagatttatgctacacaactagctcaatcccccagttgcttgtcaatctgtggggcccagagaaaacaatttcgtatgccgggtgtatgatacaactctattttgtactcgcactggggaccaccgagtgtgttctgctggtggtcatgtcatatgatcgatacgccgcagtttgcagacctctccactacaccgtcttaatgcatcctcggttctgccatctcctggctgtagcgtcctgggtctcaggattcacgaacagcgcactgcactcttcttttacattttgggtccccctgtgtggccatcggcaggtggaccacttcttctgtgaagtgccggcactgctgaggttgtcctgtgtggacacccatgtcaatgaattgaccctgatgattacgagctctatcttcgtcctgatcccattgatcctgattctgacatcgtacggtgcaatagtgcgggcagtgctccggatgcaaagtacaactggcctgcaaaaagtgtttgggacctgtggcgctcatctgatggccgtgagcctgttcttcatccctgcgatgtgtatttatctgcagcctccgagcggcaacagtcaggatcaaggcaaatttattgcacttttctacacggtggtgacaccttccctgaatcctctcatttataccctacgcaataaggtggttcgcggcgcggtgaagcggttaatgggatgggaatag

SEQ ID NO: 44357 - DNA, 777 bp, Artificial Sequence
  Description of Artificial Sequence: Synthetic coding sequence
atgaacgacgacggcaaggtgaacgccagcagcgagggctacttcattcttgtcggtttttccaactggccgcatcttgaagtggtgatcttcgtggttgttctcatcttttatcttatgacactgatcggcaatctctttatcatcattctctcttatcttgactcccacctgcacacccctatgtatttcttcctcagtaacctgtctttcctcgacttgtgttacacaacaagttccatcccccagttgctagtcaatctctggggacctgaaaagacaatcagctacgcaggctgcatgattcagctctacttcgtgctcgccttgggcactactgaatgtgtcctgctggtggtaatgtcttacgaccgatacgccgcagtgtgccggcctcttcattatacggtgctgatgcatcccaggttctgtcacttattagctgtggccagctgggtttctgggtttacaaacagcgcccttcactcctcatttacattctgggtgccattatgtggtcataggcaagtggatcacttcttctgtgaagtgcctgcactgcttcggttaagctgcgtcgatacacacgtcaatgagttgactctgatgattacatcgtccatcttcgtcctcatcccattgatcctcattctcacttcctacggcgccatcgtacaggccgtactgcgcatgcaatctaccacgggcttgcaaaaagtgttcgggacctgtggcgcacacctgatggccgtttccttgttctttatcccggcgtag

SEQ ID NO: 44358 - DNA, 936 bp, Artificial Sequence
  Description of Artificial Sequence: Synthetic coding sequence
atgaacgacgacggcaaggtgaacgccagcagcgagggctacttcattctcgtcgggtttagcaattggccccacctggaggtggtgatcttcgttgtggtactgatcttttaccttatgactcttattggtaacctgttcatcattatccttagttacctcgatagtcatctccatacccctatgtacttcttcttgagcaatctttcctttttagacctgtgttatacaacctcaagcatacctcagctactagtaaacctgtgggggccagaaaaaacaatatcatacgctgggtgcatgatacagctctattttgtgctcgctcttggcaccacagagtgtgtcctcctcgtggtgatgtcgtatgatcgatacgcggccgtctgtaggcccttgcattacacggtgctgatgcatccacgcttctgtcacttgctggctgtggcatcttgggtgtcaggcttcacaaatagtgccctacactctagtttcactttctgggtgccactgtgtggtcatagacaggtggatcactttttctgcgaggtgccagccctcctccggctatcatgcgtcgatacccatgtgaatgagctgaccctgatgattacctcatcaatcttcgttctcatccctctgatactgatcctcacatcatatggggccatcgtacgtgctgtgttgcgaatgcagagcaccaccgggctgcagaaggttttcgggacctgcggtgcccacctgatggcagtcagtctcttcttcatcccagctatgtgcatctatttgcagcctcctagcggaaacagccaggatcagggtaagttcatcgctctgttttacacagtcgtgaccccgagcctaaatccactgatatacacccttagaaataaggtggtccgaggcgccgtaaagcggctgatgggctgggaatag

SEQ ID NO: 44359 - DNA, 936 bp, Artificial Sequence
  Description of Artificial Sequence: Synthetic coding sequence
atgaacgacgacggcaaggtgaacgccagcagcgagggctacttcatcctggtggggttcagcaactggccccacctggaagtggtcatattcgtggttgtgctcatcttttacttaatgaccctaatcggaaacctcttcatcattattctctcctatctggactcccacttgcacaccccaatgtatttcttcctgagtaatctgagttttctggacctctgttacacaacttcgtctatcccacaattgctggtcaatctctggggccctgagaagacaatttcctacgctggatgcatgatacagctttacttcgttctggccttggggaccaccgagtgcgtgctgctggtagtgatgtcatatgatcggtacgcagccgtgtgcagacctcttcattatacagtgctgatgcatccaagattttgtcatctcctggccgtggcctcttgggtctctggatttaccaacagtgctctgcacagttcgtttaccttctgggtgcctctctgtggtcatcggcaggtggaccacttcttttgtgaggtgccagctctgcttagattgagttgcgtggacacacacgtaaatgagctcacactgatgataaccagcagcattttcgtgctgattcctctgattctgatcctgacttcgtatggagcaattgttcgtgcagtgcttagaatgcaatccacgactggactacagaaagtgtttggcacctgtggcgcccacctgatggccgtgtcgcttttttttatacctgccatgtgcatctacctgcagcccccatccggcaactctcaggatcaaggtaaatttatcgcactcttttatacagtggttaccccttcactgaaccctcttatatacaccctcaggaacaaagtcgttaggggtgccgtgaaacggctgatggggtgggagtag

SEQ ID NO: 44360 - DNA, 951 bp, Artificial Sequence
  Description of Artificial Sequence: Synthetic coding sequence
atgcagggcgagaacttcaccatctggagcatcttcttcctggaggggttcagtcaatacccagggctcgaagtcgtgttgttcgttttttcgctggtaatgtacctaacaacactactcgggaattctactctcatactgataaccattctagacagtagactcaagacgccaatgtatctgtttctgggaaacctgtcttttatggatatttgttatacatctgcttccgtccccacgctgttggtaaatcttcttagctcccaaaagacaataatctttagcgggtgtgctgttcagatgtatttgagtctggcaatgggcagcacagagtgcgtgctgctcgcagtcatggcttatgaccggtacgtagcgatttgcaaccctctgaggtactccatcatcatgaacagatgcgtgtgtgctaggatggcaacagtgtcctgggtcaccgggtgtctgacagccctccttgaaacaagttttgcgctgcagatcccactctgcggcaaccttatcgatcactttacgtgtgagattctggccgtgttaaagctcgcatgtactagctccttgctgatgaacacgatcatgttagtggtctccatactgcttttgccaatcccaatgctccttgtttgcattagttacattttcattctaagcacgattttgcggattacctccgccgaggggcgaaataaagcctttagcacttgtggcgcccacctgaccgtggtgatactgtactatggggcagccctcagcatgtatctcaaacctagtagttccaatgcccaaaaaatcgacaagattatttctctcctgtatggagttctgactccaatgctgaaccccataatttattcccttcgcaataaggaagtgaaggatgccatgaaaaaattgttgggaaaaatcacactgcatcagacccatgagcatctgtag

SEQ ID NO: 44361 - DNA, 1038 bp, Artificial Sequence
  Description of Artificial Sequence: Synthetic coding sequence
atgaacatcaccctgtacagcttcctgtacgtgctgcggctgaacgaaggtaactctacaggaagaaacatcgatgaacgcaagaagatgcagggcgaaaactttaccatctggtcaatcttttttttagaagggtttagtcaataccctggcctcgaggtggtcctcttcgtgtttagtctcgtcatgtatttgaccacactattaggtaactcgaccctgattctgattacgatcctcgattctagactgaagacccccatgtacctgtttctcggcaacttgagtttcatggacatctgctacacgagcgcctcggtgccgacgctattggtgaacttgttgtcatcccagaagaccatcatcttttccggctgcgcagtgcaaatgtacctctccctggccatgggaagcacagagtgcgttttgcttgcagtgatggcatacgaccggtatgtggcgatttgcaatcccctccgctattccatcattatgaacaggtgtgtttgtgctcgaatggcaaccgtttcatgggtgactggatgtttgacagctctgctcgaaacctccttcgcgctgcagatccctctgtgtggaaacctgatcgatcacttcacgtgcgaaatcttagccgtgctgaaattagcgtgcacgtcctcactcctgatgaacacaatcatgcttgtggttagcatcctgctattgccaattcctatgctgctcgtgtgcattagttacatcttcatcctgtccaccatcctgcgtattacatcggcagagggcaggaataaggctttttctacctgcggtgcccacctgaccgtggtgatcttgtattatggagccgctctatcaatgtatctgaaacctagcagcagcaacgctcaaaaaattgataaaattatttccctgctgtacggcgtgttgacaccgatgcttaatccaattatatacagcttaagaaataaggaagtcaaagatgctatgaagaagctgctggggaagattaccctccaccagactcatgagcacctttag

SEQ ID NO: 44362 - DNA, 939 bp, Artificial Sequence
  Description of Artificial Sequence: Synthetic coding sequence
atggagaagtggaaccacaccagcaacgacttcatcctgctgggcctgctgccacccaaccagaccgggatttttttgctgtgtctgatcattctcatattctttctggcaagcgtagggaattctgccatgatccacttgattcacgtggatcctagactgcacacccccatgtatttcctcctgtcgcagctgagcctgatggacttaatgtatattagcacaacggtgcccaaaatggcctacaactttttgagtggccagaaaggaatatcatttctcggttgtggggtgcagtcctttttcttcctgaccatggcttgctctgagggcctgctgttaacttctatggcttatgatagataccttgctatctgccactccctgtattacccgatccgtatgagtaagatgatgtgcgtgaaaatgatagggggaagctggactctgggttcaataaactcattggcacacactgtgtttgctctgcacattccttactgcagatcacgagcgattgaccacttcttttgcgacgtcccggccatgctccttttagcttgtacggacacgtgggtgtacgaatatatggtctttgtgagcacctctttattccttctgtttccattcatcggaatcacaagttcatgcggccgtgtgctgtttgctgtatatcatatgcattctaaagaaggccggaaaaaggcatttactaccatttccacccacctaaccgttgtaatcttctactacgcaccttttgtgtacacctatctgaggcctcgaaacctccggagtccagctgaggataagattcttgccgttttttatactatcctgacacctatgctgaaccctattatatacagtctgaggaataaggaagttctcggcgcaatgcggcgagtgtttgggattttttcctttctcaaggaatag

SEQ ID NO: 44363 - DNA, 939 bp, Artificial Sequence
  Description of Artificial Sequence: Synthetic coding sequence
atggagaagtggaaccacaccagcaacgacttcatcctgctgggcctgctgccaccaaatcagacaggtatctttcttctgtgtttgattatcctaatctttttcttggcaagtgtgggtaactctgcaatgattcacctcattcacgtggacccgcgactgcacacccctatgtacttcctgttaagtcagctgtcgctgatggacttaatgtatatatccaccacagtgccgaagatggcctacaatttcctgtccgggcaaaagggcatctcattcctggggtgcggtgtccaaagctttttctttctgactatggcgtgtagcgagggacttctgcttaccagtatggcctacgaccgctacctcgccatatgtcacagcctatactatcctattaggatgtccaaaatgatgtgcgtgaagatgataggtggatcatggacgctggggagcataaattccctggctcacacagtctttgccctgcatatcccatactgccgatcaagagctattgaccattttttttgcgacgtccccgccatgctgctcctggcctgtactgatacatgggtttatgagtatatggtcttcgtgtctacaagtcttttcctcctgttccctttcattggcatcacaagcagctgtggaagggttctgttcgctgtgtaccacatgcactctaaagagggtcggaagaaggctttcaccacaatttctactcacctcactgtggtcatcttttattacgccccttttgtgtatacttacttacggccaagaaaccttcggagtccagccgaggacaaaattctcgccgtgttctacactatccttactccaatgctgaatccgataatttattcactgaggaacaaggaggtactgggcgccatgaggcgcgtatttggaatattttctttcctcaaggaatag

SEQ ID NO: 44364 - DNA, 939 bp, Artificial Sequence
  Description of Artificial Sequence: Synthetic coding sequence
atggagaactacaaccagaccagcaccgacttcatcctgctgggccttttcccccaaagccgcataggtctatttgttttcacactgatattcctgattttcttaatggcactgattggcaatctcagcatgattctgctcatattccttgacatccatctccacaccccaatgtacttcctgcttagtcaactgtctttgattgatttgaactacattagcacaatcgtgccaaagatggtatacgactttttgtatggcaataaaagcatatcttttacaggatgtgggattcagtccttctttttcttgaccctagcagtagcggagggactgctgctgacctctatggcatacgatcgctacgtagcaatttgctttcctctccattacccgattaggatcagcaagcgcgtgtgcgtaatgatgattacggggtcgtggatgattagtagtatcaattcatgcgctcacaccgtgtacgcgctttgtattccctattgtaagtccagagcgatcaatcactttttttgtgacgttcctgccatgcttacactggcctgcacagatacttgggtgtacgaatcgaccgtgtttctgagttcaacaatttttcttgtcctaccattcactgggatcgcctgctcatacggacgggtgctgctggctgtatatagaatgcatagtgccgaggggcgcaagaaagcttacagcacgtgcagtactcatctgaccgtcgtgtcgttttactacgcccctttcgcctacacatatgtgagaccgaggagccttcgctcccctactgaagataagattctggctgtgttctatactatcctgacacccatgttaaatcccatcatatatagtctgagaaacaaggaggtcatgggagccctgacccaggttatccagaaaatcttttccgtcaaaatgtag

SEQ ID NO: 44365 - DNA, 939 bp, Artificial Sequence
  Description of Artificial Sequence: Synthetic coding sequence
atggagaactacaaccagaccagcaccgacttcatcctgctgggctttttccctcctagccgaatcggccttttcctgttcattcttatagtgttcatattcctcatggctctgatcggcaacctgtcaatgatcttactcattttcttagacactcaccttcataccccaatgtacttcctcttgagtcagttgtctttaatcgatttgaactatataagcactatcgtccccaagatggctagcgactttcttagcggaaataagtcaattagcttcaccggttgtggaattcagtctttctttttctccgcattggggggggccgaagcattgcttctggccagcatggcctacgaccgttacattgccatctgtttccccctccactatcccatccgcatgtccaagcgtatgtgtgtgctcatgatcaccgggtcttggattatcggatcaattaatgcctgcgcgcatactgtatacgtgctgcatattccgtattgccagagcagagcaatcaaccacttcttctgcgatgttcccgcaatggtgaccttggcttgcatggacacttgggtatacgaagggactgtgtttctcagcaccactatcttcctggtgttccctttcatagccatatcttgcagttatggacgggtcctgcttgctgtgtatcacatgaagtccgcagagggacggaaaaaagcatatcttacctgctccactcatctcactgtagtaaccttctattacgcaccctttgtttacacttatctccgcccaaggtctctgcggagccccacagaggataaggtgctggcagttttttacacaactctcacaccaatgctcaatcctataatctatagcttgaggaacaaggaagtaatgggagcactcacccgagtttcccagagaatttgctcggggaaaatgtag

SEQ ID NO: 44366 - DNA, 939 bp, Artificial Sequence
  Description of Artificial Sequence: Synthetic coding sequence
atggagaactacaaccagaccagcaccgacttcatcctgctgggcctgtttcctccatcgaagatcggcttgtttctgttcatcttgttcgtgcttatctttttaatggcccttatcggcaatctgtccatgatccttttgattttcctagatacgcacttacacacgcctatgtattttctgcttagccagctttctttgatagatctgaactatatctctactattgttcccaagatggccagtgactttctatatggtaataagtcaataagctttatcggctgcggcattcagagctttttcttcatgactttcgccggagcggaagccctgcttcttacctccatggcctatgacaggtatgttgccatctgttttcctctgcactaccccatcaggatgagtaagcggatgtacgttctgatgataaccggttcatggatgatcggatcgattaattcctgcgcgcatactgtgtacgcattccgcatcccctactgtaagagcagagcaattaaccacttcttctgcgacgtgcctgccatgctcacactggcctgcactgatacatgggtgtacgagtatacagtgttccttagcagcaccatattcctagttttcccttttaccggcatcgcctgcagctacggctgggtgttactcgccgtttataggatgcatagtgctgaaggtaggaagaaggcgtactctacttgttctacccacctcactgtcgtgacattttattacgcgcccttcgcgtatacatacctctgtccgaggagcctacgctctctgaccgaagacaaagtgctagctgtgttctacacgattttgacacccatgctaaaccccattatctattcccttagaaacaaggaggttatgggcgccttgacaagggtcattcaaaacatttttagtgtgaaaatgtag

SEQ ID NO: 44367 - DNA, 939 bp, Artificial Sequence
  Description of Artificial Sequence: Synthetic coding sequence
atggagaactacaaccagaccagcaccgacttcatcctgctgggcctcttccctcctagtaggattgatctcttcttcttcatactcatcgtgtttatcttcctgatggccctcataggtaacttaagcatgatcttgctgatattcctggatactcatcttcatacccctatgtactttctcctcagtcagctcagtctgatcgatcttaattacattagcacaattgttcccaagatggcctcagatttccttcacggaaataaaagcattagtttcacagggtgcgggatccaatcattttttttcctggccctcggtggagcagaagcactcctgcttgcatcgatggcttatgaccgatacatcgccatttgctttccactgcactatcttattaggatgagcaaaagggtgtgcgtgctaatgattactgggagttggataatcggctctatcaacgcctgcgcccacactgtttacgtcctccacatcccttactgtaggagtagagccattaatcacttcttctgcgatgtgccggccatggtgactttggcatgtatggatacgtgggtgtacgagggaacagtcttcctgtccgctactatctttctcgtgttcccttttatcgggatctcttgctcgtacggtcaggtgctgttcgcggtgtaccacatgaagagtgcagagggacggaagaaggcttatctgacatgttctactcacctaacggtcgtcaccttctactatgcccctttcgtgtacacatacctgcgaccgcggagcctgagatctccaacggaagacaaggtgctcgctgtattttacactattttgacccccatgctgaatcccattatctacagccttagaaacaaggaagtgatgggcgccctcactagagtgagccaacgcatctgttccgtgaagatgtag

SEQ ID NO: 44368 - DNA, 1044 bp, Artificial Sequence
  Description of Artificial Sequence: Synthetic coding sequence
atggcctgggagaaccagaccttcaacagcgacttcatcctgctggggatcttcaatcattcaccccctcatacctttttattcttcctcgtgctcggtatcttcctggtggctttcatgggtaactcagtgatggtgttacttatataccttgacacccagctgcacacccccatgtattttctcctttctcagctgagcttaatggacctgatgttaatttgcacaaccgtaccaaaaatggccttcaactacttgtccgggtctaagtccatatccatggcaggctgcgtcacacagatttttttctatatttcccttagcggctcagagtgtttcttgcttgccgttatggcctacgatcggtatatcgctatctgccaccccctgaggtacacaaacttaatgaatcctaagatctgcggcctgatggcaactttcagctggatactgggctcaactgatggaatcattgatgccgtggccacatttagtttctccttctgtgggtcgagggagattgctcacttcttttgcgagtttccaagcctgctaattctgtcctgtaatgacacatccatattcgaggaggttatttttatctgttgcatcgtgatgctagtattccctgtggctataatcatcgcaagctatgccagagttattttggccgtgattcatatgggtagcggagagggccgctgcaaggcatttacaacgtgcagctcccatctcatggtggtgggcatgtactacggagctgctctctttatgtatattcgtccaacatccgaccactcacctactcaagacaagatggtctcagtgttctatacgatacttacacccatgttgaatccgctgatatattcccttaggaataaagaagtaacccgcgccttcatgaaaatcctgggaaaagggaaatctgagtccgaactgccccataagctttacgtactccttttcgccaaattctttttcttaatctcaattttcttctacgacgttaaaatcctggccttgattatgtacattgcctag

SEQ ID NO: 44369 - DNA, 939 bp, Artificial Sequence
  Description of Artificial Sequence: Synthetic coding sequence
atggcccgggagaacagcaccttcaacagcgacttcatcctgctgggaattttcaaccacagtcctacacataccttcttgttttttcttgtgctcgccattttctctgttgcatttatgggtaactccgtgatggtcctcctgatttatttggatactcagttgcacacaccaatgtacttgttgttgagccagctgtcactgatggacctgatgttgatctgcactactgtgcccaagatggcttttaattatctcagcggaagcaaatccatctcaatggcgggctgcgcgacgcaaatctttttttacacatcactgctgggcagtgaatgcttccttctggcggtcatggcctacgataggtacacagctatctgccacccccttcggtacaccaacctgatgagccccaagatttgtggtctgatgactgcctttagttggattctcggatccaccgacgggatcatcgacgtagtggccacatttagtttcagctactgtgggtcacgtgagattgcacactttttctgcgatttcccctcactcctgatcctaagctgtagcgacactagcatcttcgagaagatcttattcatttgttgcattgtgatgattgtatttcctgttgccattataattgcatcatatgcgagggtgattctggcagtcattcacatgggtagcggcgaaggtagacggaaagcgtttacgacgtgttcttcacacctgcttgttgtaggtatgtactacggagcagccctgttcatgtatatcagaccaacctctgacaggagccctactcaggataagatggttagcgtattctatactattctaacccccatgttaaaccccctcatttactccttaaggaataaagaagtcactcgagccttcatgaaaatcctgggcaaagggaagtcaggtgaatag

SEQ ID NO: 44370 - DNA, 936 bp, Artificial Sequence
  Description of Artificial Sequence: Synthetic coding sequence
atggtgtgggagaaccagaccttcaacagcatcttcatcctgctggggatcttcaatcactccccgacacacacattcctgttttccctggttttaggcatcttctcacttgccctgatggagaatatctctatggtgttgctcatttacattgagaaacaactgcacaccccgatgtactttctgttgtcccagcttagcctgatggatcttatgctgatatgtaccactctgccaaagatgatattcagttacctttccgggaaaaagtcaatctcacttgctgggtgcggaactcagatctttttctacgtctctctgctcggtgctgaatgttttcttctagccgttatggcttatgataggtatgtggcaatctgccacccactccagtacacgattttgatgaatcccaagctgtgtgtgttcatgaccgttgcaagttggaccctgggtagtctggatggaattattgtcctggctgcagtcttatcattcagttactgcagttccctggaaatccaccacttcttttgcgatgttgctgcacttctgcccctgtcctgcacagaaacctcagctttcgaacggcttcttgtgatatgctgcgtggtcatgctcattttccccgtatctgtaattatattatcttattcccacgttctgcgcgccgtgattcacatggggtccggggaaagcaggcgtaaggctttcactacgtgtagcagtcacctctcggtggtgggtctgtactatggggcggccatgttcatgtacatgcggcctgcatcaaaacatacaccagaccaagataaaatggttagcgctttttacaccatcctgactcctatgctgaatcccctaatttacagtttacgcaacaaagaggtgttcagggcattacaaaaggttctcaagaagagaaagttaatttag

SEQ ID NO: 44371 - DNA, 939 bp, Artificial Sequence
  Description of Artificial Sequence: Synthetic coding sequence
atggcctgggagaaccagaccttcaacagcgacttcatcctgctggggatatttaaccactcccctacacatactttccttttctttctagtacttgctatcttcagtgtcgccttcatggggaactcagtgatggtgctgttgatctacctggacacacagttgcatactccgatgtatttcctgctgtcccagctctttcttatggaccttatgcttatctgcagcactgtccctaagatggcatttaactacttaagcggttctaaaagtatcagtatggccggctgtgctacacagattttcttctatgtgagcctgctgggtagcgaatgttttctgctggctgtcatgagctacgaccgctacatcgctatttgtcatccacttcggtataccaatttgatgagaccgaaaatatgcggtctgatgaccgctttctcttggatcttggggtccatggacgccattatcgatgctgtggctacatttagttttagctattgcgggtcgagggaaatcgcgcatttcttttgcgactttccctccctgctgatcctgtcctgtaatgatacttcaattttcgagaaggtactgtttatttgttgtatcgtgatgattgtatttccggttgccataataattgccagctatgcccgagtaatattagccgtgatccacatgggttccggagagggacgaagaaaagcatttaccacttgctctagccacctgatggtcgtgggcatgtactacggcgctgggctgtttatgtatataaggcctacatcggatagatctcctatgcaggataaactggtcagcgtcttttataccattctcacgcccatgctgaatcccttgatctacagccttcgcaataaagaagtgactcgggccctgcgcaaagttctgggtaaggggaagtgcggggaatag

SEQ ID NO: 44372 - DNA, 939 bp, Artificial Sequence
  Description of Artificial Sequence: Synthetic coding sequence
atggcctgggagaaccagaccttcaacagcgacttcctgctgctgggtatattcaaccacagccccactcacaccttcctcttctttctggtcctcgccatcttttcagtggcgtttatggggaactcaattatggtgctgttaatatatttagatacacaattacacacaccaatgtatttcctgttgagccagctttcattgatggatctcatgttaatctgcactaccgttcccaagatggctttcaactatttgtctggatcgaagagcattagcatggcaggctgtgcgacgcagatcttcttctacatctctttgctcggatctgaatgcttcctactggctgtaatgtcttacgatcgctacaccgccatatgccatcccttacgatatacgaacctgatgagacccaagatctgcggactcatgactgctttcagctggatcctgggttctaccgacggaataatcgacgcagtcgctacttttagttttagctactgtgggagccgagaaatcgcccacttttgttgtgactttccatctctcctaatcctgtcttgcaacgatacctccatcttcgaagaggtcatatttatctgttgcattgtgatgctcgtgtttcccgtagcgattataattacctcctatgcccgggtcatactggccgtaatacatatgggcagcggcgagggaaggcggaaggcctttacaacttgctcctctcacctgatggtggtgggaatgtattatggagccgggctgttcatgtgcattcaaccaacctctcaccacagcccgatgcaagataagatggtgtccgtcttctataccattgttacccctatgctaaaccctctgatctattcattgcgcaataaagaggtaaccagagcactcatgaagattctgggaaagggcaagagcggggactag

SEQ ID NO: 44373 - DNA, 960 bp, Artificial Sequence
  Description of Artificial Sequence: Synthetic coding sequence
atggagaaggccaacgagaccagccccgtgatgggcttcgtgctgctaaggttatccgcccatcctgaactcgagaaaactttctttgtgcttattctcctcatgtatctggtgatcctcctaggtaacggagtattgattctagtgactatccttgattctcgtctccatacacctatgtattttttcctaggcaacctcagcttcctcgacatctgctttacgacgtcatcagtcccgcttgtgctcgattctttcctcacaccccaggaaacaataagtttttcagcatgcgctgtgcagatggccctctcctttgctatggcggggactgaatgtctcctgctgagcatgatggcattcgaccgatacgttgcaatctgtaaccccctaaggtactcagtcattatgtctaaagccgcgtacatgcccatggcggcttcatcctgggccatcggcggtgctgcttctgtagtccacacgtcactggcaatccagttgcctttttgtggcgataacgtgatcaatcacttcacatgcgagatcttggccgttctcaagctggcctgtgccgacatatccattaacgtcattagtatggaagtgacaaacgtgattttcttaggcgtccctgtgttgtttatcagtttttcctacgtcttcatcatcacaacaattctgcgtatcccgtccgctgaaggcagaaagaaagttttcagcacctgcagtgctcacctcacagtcgtcatcgtcttttatgggacgctattctttatgtatggtaagccaaagtctaaagacagcatgggggcggataaagaggacctctctgataaactaatcccgcttttctacggtgtggttaccccgatgctcaatcctatcatctacagcctcagaaacaaagacgtgaaggcggcggtgcggcggctcctgcgcccaaaaggatttacccaatag

SEQ ID NO: 44374 - DNA, 1110 bp, Artificial Sequence
  Description of Artificial Sequence: Synthetic coding sequence
atgtggcaggagtactacttcctgaacgtgttcttccccctgctgaaggtctgttgcttaaccatcaattcccatgttgttattctgttaccgtgggagtgttaccacctgatttggaaaatcctcccctatataggtactaccgtgggcagcatggaggagtataacacctcctctaccgacttcacgttcatgggactgtttaatcgcaaagagacatcagggcttattttcgcgattatttcaatcattttttttaccgcgctcatggctaatggagtgatgatttttctgatacagaccgatctgcggctccacacgcccatgtacttcctgttgtcccatttgtctctgatcgacatgatgtacatcagcactatcgtacccaagatgctggtcaattatcttctggatcagaggactattagctttgtgggctgcactgctcagcacttcctgtacctgaccctcgtgggcgctgagttcttcctgcttggcctgatggcctatgacagatacgtggccatttgcaatcccctcaggtatccggtgcttatgtctagacgtgtgtgctggatgatcatagcagggtcctggtttggcggctcactcgatggatttttgctaactccgattaccatgagctttccattctgtaacagccgcgagattaatcactttttctgtgaagctccggctgtgttaaaactggcttgtgccgacaccgcactttacgagacagtcatgtatgtatgttgcgtgttgatgcttctgataccattctctgtggtgctcgccagctatgctaggatcctgactacggttcaatgtatgtcttctgtagagggccgcaagaaagctttcgccacttgttcttcgcacatgaccgtggtatcattgttctacggggcagcaatgtacacttacatgttgccacacagctatcacaagccagcccaggataaagtgctcagcgtgttctacactatcctcacacctatgctgaatccgttgatctacagcctacggaataaagacgtgacaggcgctttaaagagagctctgggtcgtttcaaaggcccccaaagagtgtccggcggggtcttttag

SEQ ID NO: 44375 - DNA, 939 bp, Artificial Sequence
  Description of Artificial Sequence: Synthetic coding sequence
atgcggctggccaaccagaccctgggcggcgacttcttcctgctgggcatctttagtcagataagtcacccaggtcgcctgtgcttgctgatcttttcgatctttctcatggccgtgagttggaacataaccttgattctgctgatccatatcgattcttctctgcatacacctatgtacttttttatcaaccagttgagtcttattgatctaacttacatttccgtgactgtccccaagatgctcgtcaaccagctggccaaggacaagactatatccgtgttgggatgtgggactcaaatgtatttctacctgcaactcggtggggccgagtgctgcctcctggccgcaatggcctatgatcggtacgtcgccatttgtcatccattgaggtattctgtgttgatgtcccatcgcgtgtgcctgctactcgctagtggctgctggtttgtcggctctgtagatgggtttatgttaacccctatcgcaatgagctttcccttttgtaggtcacatgaaattcagcattttttctgcgaagtacccgcagttctcaagctgtcttgcagcgacacatctctatataaaatctttatgtacctgtgctgtgttattatgctccttatacctgtgaccgtgatctccgtttcctattattatattattcttacgatccacaagatgaacagtgtcgagggacggaaaaaggccttcacaacctgtagtagtcacattacagtggtgagtctcttttatggagcagctatctataattatatgctgccctcaagctatcaaacaccggaaaaggatatgatgtcttctttcttctatactatcctgacccccgtgctgaatccaatcatttactctttccgaaacaaggatgtgacaagggccctcaaaaagatgctgagcgtgcagaaacctccttactag

SEQ ID NO: 44376 - DNA, 951 bp, Artificial Sequence
  Description of Artificial Sequence: Synthetic coding sequence
atgaccaacaccagcagcagcgacttcaccctgctgggcctgctggtgaatagcgaggccgcgggaatagtattcacagtgatcctggctgtctttctcggcgcagtaaccgccaatttggtgatgatcttcttgatccaagtcgattcaaggcttcatactccgatgtacttcctgctatcccagctcagtatcatggataccctgtttatttgcacaactgtgcccaagctgctcgctgacatggtaagcaaggagaaaattattagtttcgtggcctgtggaatccagattttcctgtaccttaccatgattggcagtgagtttttcctcttgggacttatggcctatgattgttatgtggccgtgtgcaaccctctgaggtatccggtccttatgaataggaagaaatgtctgctgcttgcagcaggcgcctggtttggcggctcgctagacggtttcctgcttacaccaatcaccatgaatgtgccatattgcggctcacgcagtattaaccattttttttgtgagattccagcggtgcttaaactggcatgcgccgatacctccctctacgagacactcatgtatatttgttgcgtactcatgctgctcatccccatttccatcatcagtactagctactcactcattctgctgaccatacataggatgccctcagcggagggacgcaaaaaggcttttacgacgtgctccagtcatctgactgttgtctctatcttctacggagctgctttttatacatacgtgttaccacagtcctttcatacgccagagcaggacaaggtggtgagtgctttctacaccatagtaacccccatgctgaacccactgatttattccttgcgcaataaagacgtaatcggcgctttcaaaaaagtgtttgcctgctgctctagcgctcagaaggtagccacgtccgatgcatag

SEQ ID NO: 44377 - DNA, 963 bp, Artificial Sequence
  Description of Artificial Sequence: Synthetic coding sequence
atggagatgcggaacaccacccccgacttcatcctgctgggcctgttcaaccacactagggcccatcaggtgctcttcatgatgctgctagctactgtcctgacatccctgttctctaacgccctcatgatcctgttaatccactgggatcatcgactgcaccgacccatgtactttttgctcagtcagctgtctctgatggatatgatgctcgtcagtacgactgttccaaaaatggccgcagactatctgacaggtaacaaggccatcagccgagcggggtgcggcgtgcagattttctttctgccaactctcggggggggagaatgctttttgctggcagcgatggcatacgacagatacgcggctgtgtgccacccccttcggtatccaaccttgatgtcgtggcagctgtgtttaagaatgacaatgagcagttggctgctcggtgcggctgacggcctgttgcaggcagtagccaccttgagttttccttactgtggagctcatgagatagatcactttttctgtgaagcgcctgtgctcgtgaggctggcttgcgctgatacctctgtgttcgaaaacgcaatgtacatttgttgcgttcttatgctgctggtgccgttctctcttattttgagtagctacggactcattctcgctgctgttctacttatgagatctactgaggccaggaagaaggcttttgctacatgctcatcccatgtggccgttgttggcctgttctacggggcgggcattttcacatatatgcggcctaagtctcaccggtctacaaatcacgacaaagtggtctccgccttctatactatgtttacacccctgttaaatcctttgatttattcggtgcgcaacagtgaggtaaaggaggcactcaagcgctggctgggtacctgcgtgaacctcaaacatcaacaaaacgaggctcaccggtcacgttag

SEQ ID NO: 44378 - DNA, 975 bp, Artificial Sequence
  Description of Artificial Sequence: Synthetic coding sequence
atgggcatggagggcctgctgcagaacagcaccaacttcgtgctgacgggccttattacccacccagccttccctggcctgctgttcgccatcgtcttctctatttttgttgtggctatcacagccaacctcgtgatgatactgctcattcatatggattcccgcctgcacacacccatgtatttccttcttagccagctgtctattatggacacaatctacatctgtatcacagtccctaaaatgttgcaggatttattgtcgaaggacaagaccatttcttttctggggtgcgcagtgcagattttcctatatctcacgctaatcggaggggaattctttctgctcggtctcatggcctacgaccgctatgttgcagtttgcaatccacttcgttatccccttttaatgaatcggagagtgtgtctcttcatggtcgtgggctcctgggtcggggggagcttagatggattcatgctgactcccgtaaccatgtcctttccgttttgcagaagcagggaaatcaaccactttttctgtgagataccagccgtgctcaagctgtcatgcacagacacgtctttatatgagaccttaatgtacgcctgctgcgtcctcatgctcttgattcccttaagcgtaatttcagtcagttatacccatatcttgctgactgttcataggatgaatagtgccgagggccgcaggaaggcttttgctacttgtagctcccatatcatggtggtgtcggtcttttacggggcagctttttacactaatgtactgccacatagttaccatacccccgaaaaagacaaagtcgtgtcagccttctataccatcctcacaccaatgttgaacccactgatttactccctgagaaacaaggatgttgctgccgcccttcgcaaggtgctaggcagatgcggttcgtcacagagtatccgggtggcgacagtaatcaggaagggatag

SEQ ID NO: 44379 - DNA, 954 bp, Artificial Sequence
  Description of Artificial Sequence: Synthetic coding sequence
atggagcagagcaactacagcgtgtacgccgacttcatcctgctgggcctattcagtaacgctcggtttccttggctgctttttgccctcatcctgctcgtctttctaacaagcatcgcctccaatgttgttaaaatcatcctgatccacatcgactctcggctgcatactcccatgtacttcctgttatctcagctttctctgcgtgatatcctctatattagcaccatcgtgcctaaaatgttggtggaccaggttatgtcccagagagccatcagctttgcaggttgtacagcacagcactttctgtacctgactctggccggagcagaattcttcctcctgggtctgatgagctatgaccgatacgtagcgatttgcaatccactgcactacccagttctgatgtcaaggaaaatctgttggctcatagtggccgctgcctggctggggggctcaatcgacggatttctgttgaccccagtcactatgcagtttcctttctgcgcttcccgagagataaatcattttttctgcgaagtaccagccctcctcaaactcagttgcactgacacgagtgcgtacgaaactgccatgtacgtctgctgtatcatgatgctgcttattccatttagtgtgatatccggaagctacacccgcattctgatcacagtatatcgcatgtccgaagctgaaggacgaggcaaagcagtggctacttgttcaagtcatatggtggtcgtgagtctcttctacggagctgctatgtacacatatgtgcttccgcattcctatcacacccccgagcaagacaaagctgtgtccgctttttacacgattttaaccccaatgttaaatcctctcatctacagcctaagaaataaagacgtgaccggtgccttgcaaaaggtcgtaggtcggtgtgtttcaagtgggaaggtgacaactttttag

SEQ ID NO: 44380 - DNA, 948 bp, Artificial Sequence
  Description of Artificial Sequence: Synthetic coding sequence
atggccaacatcacccggatggccaaccacaccggccggctggacttcattttgatgggtctgtttaggcagtccaaacatccagcattgctgtctgtggtgatctttgtcgtgttcctgaaggcactgtccggtaatgctgttcttattttgttgattcactgtgatgctcacttgcactccccaatgtacttcttcatctctcagctgtcattgatggatatggcctacataagtgtgaccgtacctaaaatgctactcgaccaggtgatgggggtgaacaaagtttccgcaccagagtgtgggatgcaaatgttcttatacttaactctagcggggagtgaattcttcctgctggctacaatggcatatgatcgatacgtagcaatctgtcaccccctaagatacccagtcctgatgaatcaccgagtctgcctattcctagcctctgggtgttggttcctcggatcggttgatggcttcatgctgacacccatcacaatgtcatttccattttgccgctcctgggagattcatcacttcttctgcgaagttcccgccgtgaccatcctttcttgcagcgacacctccctttacgaaaccctcatgtatctgtgctgtgtgctaatgctcctgatcccagtcaccataattagttctagctacctcctgatcctgctgacagtccaccgaatgaatagcgcagagggccgcaaaaaagcgtttgcaacctgcagctcgcatttaacggttgtgattctcttttatggggcagccgtgtacacttacatgttaccctcatcataccacacacccgaaaaagacatgatggtgagcgttttctatactatcctaactccagttctcaatcctctgatttacagtctgagaaacaaagacgtcatgggagcgctcaagaaaatgctgaccgttcgctttgtgctctag

SEQ ID NO: 44381 - DNA, 957 bp, Artificial Sequence
  Description of Artificial Sequence: Synthetic coding sequence
atgtgcagcggcaaccagaccagccagaaccagaccgccagcaccgactttaccctcacaggactgttcgcagagagtaagcatgctgccttactgtacaccgtaacctttctattgtttctgatggctttgactgggaatgcattgttaattctcctcattcacagtgagccaaggctacacacccccatgtacttttttatttctcagttagccctcatggacctgatgtacctatgtgtcaccgtgccaaaaatgctggtgggccaggtcacaggagacgacacgatatctccctccgggtgcggcatacaaatgttcttttatctcacactggccggtgccgaagtcttcctcctggccgctatggcctatgatcgatacgcagctgtgtgccgccctctgcactaccctctcctgatgaatcaacgggtgtgccaactattggtgagcgcgtgctgggtccttggaatggtagatggattgctccttactcctatcacaatgagctttcccttctgccagtctcgcaagattctatctttcttctgcgagactccggccctgctcaaactaagttgttctgacgtcagcttatataagactttaatgtacctctgctgtattctcatgcttctcgctcccataatggtcatctcgtcatcttatactctgattttgcatctgatccaccgcatgaacagcgccgctgggcaccgcaaagccctggccacctgcagctcccacatgatcatcgtgctgctgttgttcggagccagcttttacacctatatgctcccaagcagctatcatactgccgaacaagatatgatggtgagcgctttctacaccatttttacgccagtgctgaatcccctgatctactccttacggaacaaggatgtgaccagggccctgcgttccatgatgcagagcagaatgaatcaggagaagtag

SEQ ID NO: 44382 - DNA, 963 bp, Artificial Sequence
  Description of Artificial Sequence: Synthetic coding sequence
atggagatgcggaacaccacccccgacttcatcctgctgggcctgtttaaccatacacgagctcaccaggtgcttttcatgatggtcctatcaatcgttctgacttctctgtttggaaatagtctgatgatcctcctgattcactgggaccatcgtctgcacaccccaatgtactttctgctttcccagttgagcctgatggacatgatgttggtttcgaccacggttccgaagatggccgccgactacctcaccggcagcaaagccattagtcgggccggatgcggcgtccaaatcttttttctccccactctcggtgggggagagtgtttcctcctcgccgctatggcttacgataggtatgccgctgtgtgccatcccctgaggtacccgacactgatgtcttggcagttatgtctcaggatgactatgtcttgctggctcttgggtgccgctgacggcctcttgcaggccgtggtgactttatcctttccgtattgtggagctcacgagattgatcacttcttttgcgagacccccgtcctggtaagattggcctgtgcagacaccagcgtatttgagaatgccatgtatatctgttgtgttctgatgttactggtgcccttctccctgatcttgtccagctatgggttaatactagccgccgttttgcacatgcgaagcacagaagcccggaaaaaggcctttgccacctgctcttcccatgtggcggtggtgggcctattttatggggcggctatctttacatatatgaggcccaaaagccatcgatccacgaaccatgacaaagtggtgagcgcattttacacaatgtttacgccccttctgaatccccttatttatagcgtgaaaaattccgaagtgaagggagcccttaagcgctggctgggcacctgtgtgaacattaaacatcagcagaacgaggctcatcggtctcgatag

SEQ ID NO: 44383 - DNA, 957 bp, Artificial Sequence
  Description of Artificial Sequence: Synthetic coding sequence
atgtgcagcggcaaccagaccagccagaaccagaccgccagcaccgatttcacactgacaggcctgtttgcagaaagtaagcatgccgcccttctgtataccgtcacctttctcctcttcttgatggccctgaccggtaatgcattgctgattctcctgattcactcagagcccagactccatacacctatgtactttttcatttcccagctcgcgcttatggacctcatgtacctgtgtgtcacggtgcctaaaatgctagtaggtcaggtaactggggatgataccatctctccgtcaggatgcggaatacagatgttcttccacctgaccctcgccggagctgaggtgtttttgctggcagctatggcatatgatcgatacgctgccgtttgccgcccattacattatccactgctaatgaaccaacgcgtttgtcagctactggtaagtgcttgttgggttctgggcatggtggatgggttgctcctcactccgatcaccatgtccttccccttttgtcaaagtagaaagatcttgtccttcttctgcgagaccccagcactgttgaagctatcgtgcagcgacgtcagcctgtacaagatgctgacctacctttgctgcatcctgatgctactcacccctatcatggtgatcagttctagctacactctcatcctccatctcattcatcgaatgaacagtgcagcggggaggcggaaggcgttggcaacatgtagcagccatatgatcatagtcttattattgtttggcgcatctttttatacctacatgcttaggtcatcataccacactgccgagcaagacatgatggtgagcgccttctataccattttcactccagtattaaatccattaatctactcactcagaaataaggatgtcacccgcgcgttgcgttccatgatgcaatcgaggatgaatcaggaaaagtag

SEQ ID NO: 44384 - DNA, 972 bp, Artificial Sequence
  Description of Artificial Sequence: Synthetic coding sequence
atgggcatggagggcctgctgcagaacagcaccaacttcgtgctgaccggtcttatcacacaccccgcatttccaggccttctgttcgccgtggtgttctccatctttgtggtcgccataacagcaaatctggtcatgatcttgctcatacacatggatagcaggctgcatacacccatgtatttcctgctcagtcagctctctattatggacacaatttatatctgtattaccgtgcccaaaatgcttcaggatctcttaagtaaggataagacaatcagcttcctcgggtgcgcagtacagattttctacttgaccctaattgggggagagttttttttgttaggcctaatggcctacgatcgatatgtcgccgtgtgtaacccgttgcgctacccgctcctcatgaaccgccgagtatgtctcttcatggtggtcgggagctgggttggcggtagcctcgacggattcatgctgaccccggtcaccatgtccttccctttctgtcggtcccgagaaatcaaccacttcttctgtgagatacccgcagtcttaaagttgtcctgcacggacacaagtctgtacgagacgctcatgtatgcctgttgcgttctgatgttgttgataccgttgtcggtcatttctgtgtcttacactcacattctgctgactgtccatcgaatgaactctgcagagggacggcgaaaggcatttgctacgtgcagctctcacatcatggtggtttcagtattctatggcgcagcattttatacaaacgtcctgccgcacagctatcacactcccgagaaggacaaagttgtgtctgcgttctacaccatactaacaccaatgctgaatcccctgatctattctctccgtaacaaagatgtcgcagccgccctgcggaaagtgctgggtcggtgtggatctagccagtccatcagagttgccactgtaatcagaaagggatag

SEQ ID NO: 44385 - DNA, 1047 bp, Artificial Sequence
  Description of Artificial Sequence: Synthetic coding sequence
atggacaacatcacctggatggccagccacaccggctggagcgactttatactgatgggcctgttcagacagagcaaacatcctatggccaacataacctggatggcaaaccatacgggctggtcagactttatcctcctgggcctgttccggcagtcaaagcaccctgctctgctgtgcgtggtcattttcgtggtcttccttatggccctgagcggcaatgccgtgctcattctcctcattcattgcgacgcccacctgcatacgccaatgtatttctttattagtcaactgtctctgatggatatggcttacatttctgtgaccgttcccaaaatgctgctcgaccaagttatgggcgtgaataaaatcagcgccccagaatgcggaatgcagatgtttttttacgtcacactcgccgggtctgaattctttctgctcgctaccatggcttacgaccgctacgttgcaatctgccacccactcagatatccagtgctaatgaaccatcgcgtctgcttgttcctgagctcagggtgctggtttctggggtctgtagacgggttcacatttacaccaattacaatgaccttcccgttccgcgggtccagggaaatccaccattttttctgcgaagtgccagcagtgttgaacctgtcgtgtagcgacacatctctctatgagatcttcatgtatctgtgttgtgtgctcatgctgctgatccccgtggtgatcatctccagttcttacctactaatcctgttgacgatacacggaatgaattctgctgaggggcggaagaaggctttcgctacatgcagttcacatctcactgttgtcatccttttctatggtgccgccatttacacttacatgcttccttcctcctaccacacacctgaaaaggacatgatggtttcggtcttttacaccattctgacaccagtggtgaatcctttaatctactcacttcgcaataaggacgtcatgggtgcactgaagaaaatgctgacagttgagcccgcattccagaaagcaatggaatag

SEQ ID NO: 44386 - DNA, 948 bp, Artificial Sequence
  Description of Artificial Sequence: Synthetic coding sequence
atggccaacatcacccggatggccaaccacaccggcaagctggacttcatcctgatgggcttatttcggcggtccaaacatcccgcactgctgtcggttgtgatcttcgtcgtcttcctgaaagctttgagtggcaatgctgtcctgatcctgctcattcattgcgatgcccatttgcatagtccaatgtacttcttcatctctcagcttagtcttatggatatggcctatatatctgtcacagtgcctaagatgcttctcgatcaggtgatgggcgtcaacaaagtctcagctccggagtgtggaatgcaaatgttcctgtaccttactcttgcgggaagtgagtttttccttctggctaccatggcctacgacagatacgtcgctatctgccatccactgcgctatcccgttctgatgaaccacagagtctgcctctttctggcatccgggtgttggtttttgggctccgttgatggattcatgctaacaccaataactatgtcctttccattttgcagatcttgggagatccatcacttcttttgcgaagtccctgccgtaacaattctaagctgttctgacacaagcctctacgaaactcttatgtacttgtgctgcgtgctcatgttactcatcccagtgactataatttcatctagctatttgctgatactcctcacagtacacaggatgaactctgccgaggggcgcaaaaaagctttcgcgacatgcagctctcacttgaccgttgtcatcctgttctacggcgccgcggtctatacctatatgcttccaagcagctaccacacaccagaaaaagacatgatggtgtctgtcttctacactatcctgacgccagtgctgaatcccctcatatacagtctgaggaataaggacgttatgggagctttaaagaaaatgctcacggtgcggtttgttctttag

SEQ ID NO: 44387 - DNA, 927 bp, Artificial Sequence
  Description of Artificial Sequence: Synthetic coding sequence
atgaacgagaacaacgagaccctgacccggggcttcaccctgatggggctgttcacccacaataagtgctcaggcttctttttcggagttatctgcgccgtcttttttatggccatgatcgcgaacggtgtgatgatttttctgattaatatagacccccatctccatactcccatgtactttctcctgagccaccttagcgttatcgacacactgtacataagtacaatcgtgcccaaaatgttggttgattatcttatgggcgagggtactatttcttttattgcatgcacagcccagtgtttcctgtacatgggatttatgggagcagagtttttcttgttgggcctgatggcctacgaccgctatgtcgcgatttgcaacccgctgagatatcccgttctcattagctggcgggtgtgctggatgattctggcctcaagctggtttggtggcgcccttgactcattcctgctaaccccaatcaccatgtcgctgcctttttgcgcatcgcatcaaatcaaccatttcttctgcgaggcacctaccatgctgcggctggcctgcggagacaagaccacctatgagacggtgatgtatgtgtgttgcgtggccatgcttctaatcccattcagcgtcgtcacagccagctatacccgcatacttatcaccgtgcaccagatgacttctgccgaggggaggaagaaggcattcgctacttgttcaagtcacatgatggttgtgactcttttttacggagcggccctgtatacttatacactcccacagtcataccacacccccataaaggacaaagtgttttcggccttttacacaattcttacaccactcctgaatcctttgatctactcgttaaggaatcgcgatgtcatgggcgcacttaaacgcgtggtcgcaaggtgttag

SEQ ID NO: 44388 - DNA, 948 bp, Artificial Sequence
  Description of Artificial Sequence: Synthetic coding sequence
atgggccggtgggtgaaccagagctacaccgacggcttcttcctgctgggcatattcagccatagtcagactgatctggtgctcttttcggcagtaatggtggtttttaccgtcgctttgtgcggaaatgtactgctgatttttctcatttatctcgacgctggccttcatacaccaatgtatttttttttgtcccaacttagcttgatggatctaatgttggtttgcaatatcgtgcccaaaatggctgcaaatttcctgtctggccgcaaatccattagcttcgtcggctgcggaattcagatcggatttttcgtcagcctagttgggagcgaggggctcctcctgggactgatggcctatgaccgctacgtggcagtcagtcaccccctgcactaccccatccttatgaatcagcgtgtttgcctgcagatcactgggtcatcgtgggcatttggcatcattgatggggtgattcagatggttgcagctatgggcctcccttattgtggtagcaggagcgttgatcatttcttctgcgaggtgcaggcactcctgaaactggcttgcgcggatacctcactgtttgatactttgctgtttgcatgctgcgtgttcatgcttcttctgccattctccatcattatggcctcatacgcctgcattctgggtgcagtgctgcgtatccgctccgcacaagcatggaagaaagccctggctacctgtagttcccacttgacagctgtgacactgttctatggcgccgccatgttcatgtaccttcggcccagacggtatagagcgccctctcacgacaaggtagcgtcgatcttctacacagtgctgacccctatgctgaatccgctaatctattccctgcgtaacggagaggttatgggcgctcttagaaagggccttgacagatgccgaatcgggtcccagcactag

SEQ ID NO: 44389 - DNA, 948 bp, Artificial Sequence
  Description of Artificial Sequence: Synthetic coding sequence
atggagacctgggtgaaccagagctacaccgacggcttcttcctgctggggatctttagccactcaacggccgacttggtcctgtttagcgtggtgatggcagtgtttactgtggccctttgtggaaacgtgctgttaatattcctgatctatatggatccgcatctgcacactccaatgtactttttcctgagccaactcagcctgatggatctgatgctggtctgtactaatgtccctaagatggcggccaatttcctttccggccgcaagtcgatatcttttgtgggctgcgggattcaaatcggattgtttgtttgccttgtgggatcagaagggctgttgctgggcctgatggcatacgacaggtatgtcgctatcagccacccccttcattatcccatcctgatgaatcagcgagtgtgcctgcagattacaggatcttcctgggccttcggcatcatcgatggtctgatacagatggtggtcgtgatgaatttcccctactgtggtctccgaaaggttaatcacttcttctgtgaaatgctcagccttttgaagctagcctgtgtggatactagtttattcgaaaaagtgatctttgcttgttgcgtcttcatgctgctctttcccttctccattattgtagcctcgtatgcccatattctggggactgtcctccagatgcacagtgctcaagcctggaagaaggcattagctacatgttccagtcacctaactgccgtcactctcttctatggagctgcaatgtttatctatcttcgccctaggcattacagagctccttctcatgataaggtggcctctatcttttacacagtcctcacgccaatgctgaaccctcttatttactcactgcggaaccgtgaggtcatgggagcccttagaaaaggcctagatcgctgccgtatcggttcccaacattag

SEQ ID NO: 44390 - DNA, 963 bp, Artificial Sequence
  Description of Artificial Sequence: Synthetic coding sequence
atggaccagagcaactacagcagcctgcacggcttcatcctgctgggctttagcaatcaccctaagatggaaatgatcctgtccggcgtggttgcaatcttctacttgatcactctcgtgggcaacacagcaatcatcttggcctccctgttagactcccaactgcatactcctatgtacttttttttgagaaatctctcctttctcgatttgtgttttacaactagtatcattccgcaaatgttagtgaatctgtggggaccagacaagacaattagctacgtgggctgcattatccaactgtacgtctacatgtggttggggtctgttgagtgcctgttgctggccgtgatgtcttatgacagatttacagccatttgcaagcccctacactatttcgtcgtaatgaatcctcatctctgcctgaaaatgataatcatgatatggagtatatccctagcaaactctgtcgtcctttgcactcttactcttaatctgcctacttgtggcaacaatatcctcgaccatttcctgtgtgagctgcctgccctagtgaagatcgcctgcgtggacacaacgaccgtcgagatgagcgtatttgctctcggtattatcatcgtcctgacacctcttatactcattctcataagttatgggtacatcgccaaagcggtcttgcgtaccaaatccaaggcttcccaacgcaaggccatgaacacatgcgggtcgcatctaactgttgtatccatgttttatggtaccatcatttatatgtacttgcagcctggcaatcgggcctctaaagatcagggaaaatttctcaccttgttttacactgtcattaccccgtctttaaacccgctcatttacactctcaggaataaggatatgaaggatgccttgaagaaattgatgcggtttcaccacaaaagcaccaagataaaaaggaattgtaagtcctag

SEQ ID NO: 44391 - DNA, 963 bp, Artificial Sequence
  Description of Artificial Sequence: Synthetic coding sequence
atggaccagagcaactacagcagcctgcacggcttcatcctgctgggcttttctaaccacccaaaaatggagatgatactttctggtgtggtcgccatcttctatctcatcacccttgtggggaacacggccatcattcttgcaagtctgcttgatagtcagctccacactcccatgtatttctttctgagaaatctgagctttctggacctgtgcttcacaaccagcattatcccccagatgctcgttaacttgtggggtccagataaaacaatctcctacgttggatgtatcatccaactgtacgtgtatatgtggttgggctctgtggagtgccttctccttgccgtgatgtcgtatgaccgattcaccgccatctgcaagcctttacattatttcgtcgtcatgaacccgcacctctgcttgaaaatgataataatgatatggtccatcagcttggcaaattctgtggtcctgtgcaccttaactcttaatctccccacgtgtggcaataacatattggatcacttcctatgtgaactccctgcgctggtgaaaattgcctgcgtggacactacaaccgtggagatgtctgtatttgctttaggtataatcatcgtgctgacaccccttatccttatcctcatctcttacggttacatcgccaaggcagtgctcaggacaaagagtaaggcttctcagagaaaggccatgaacacatgtggatcccacctgaccgtcgtgtcaatgttttatggtaccattatctacatgtacttacagcccgggaatcgggcatccaaagaccagggcaaattcctaaccttgttttacaccgtgataacccccagcctgaatccattaatctacaccctaagaaataaggacatgaaggacgccctgaagaaactgatgaggttccaccataagtccactaaaatcaaacgaaattgcaaatcttag

SEQ ID NO: 44392 - DNA, 963 bp, Artificial Sequence
  Description of Artificial Sequence: Synthetic coding sequence
atggaccagagcaactacagcagcctgcacggcttcatcctgctggggttctccaaccaccccaagatggagatgattctgagtggagtggtcgccatcttttacctgattaccctggtgggcaatacagctatcatcttggcctccctcctggattcccagctgcatacacccatgtatttttttctgcgcaatctgtccttcttggatctgtgtttcaccacttcaattattccccagatgctggtgaacctatggggtccagataaaactatcagttacgtcggttgtatcatccagctgtatgtgtacatgtggctggggtctgtcgaatgtctcctgctcgccgtaatgagttatgatcggttcaccgcgatttgtaagcctttgcactatttcgttgtgatgaatccgcatttgtgtctcaagatgataatcatgatctggtcaatttccctggcaaatagcgtggtgttgtgtactcttacgctgaatctgcctacgtgcggcaataatattctcgaccactttttgtgcgagctgcccgcactggtcaagatcgcttgcgtggacactaccacggtggaaatgtccgtgttcgccctgggtatcatcatcgtgctcactccattgatactgattctcatcagctatggctatatagccaaggcagtacttagaactaagtcaaaggcttctcaacgcaaagctatgaatacctgcggctcccatctgactgtggtttccatgttctacggaacaatcatatacatgtacctgcaaccaggtaacagagctagtaaggatcaaggaaagtttcttactcttttctataccgttattactccaagccttaaccctctaatatacacactgagaaacaaggacatgaaagacgcactgaaaaaactgatgagattccatcacaaaagcacaaagatcaagcgtaactgtaaatcttag

SEQ ID NO: 44393 - DNA, 963 bp, Artificial Sequence
  Description of Artificial Sequence: Synthetic coding sequence
atggaccagagcaactacagcagcctgcacggcttcatcctgctggggttcagcaaccaccctaagatggagatgattctgagtggtgtggttgctattttctacttgataacactggttggtaacacagccatcattttggctagcctgcttgattcacagttacacactcccatgtatttcttcctgagaaatctctcttttttagatctgtgttttactacttccatcataccccagatgctggtgaacttgtgggggccagacaaaacaattagctacgtaggatgcattatccagttatatgtgtatatgtggctgggaagcgtggaatgtcttctgctggcagtgatgagctacgaccggtttactgccatatgtaagccactgcattactttgttgtcatgaatcctcacctgtgcctgaaaatgattattatgatatggtctatatcacttgcaaactccgttgtcctgtgcaccttgacacttaacttgcctacttgcgggaataacatcctggaccactttctctgcgaactgccggccttggttaagattgcctgtgtggacacgactacggtagagatgtcagtcttcgcactgggtatcattattgttcttacaccccttatactcattcttatatcgtatgggtatatcgccaaggccgtcctgaggactaaaagcaaggccagccaaaggaaagctatgaacacttgcgggtcacatctcacagtggtttccatgttttatggtacaatcatctacatgtatcttcaaccagggaatcgcgcatccaaggaccagggcaaattcctcaccttattctataccgtcatcacgccctctctgaatcctttgatctataccttgaggaataaggatatgaaagatgccctgaagaaactcatgaggttccaccacaaatctaccaagatcaagcgcaattgcaagtcttag

SEQ ID NO: 44394 - DNA, 963 bp, Artificial Sequence
  Description of Artificial Sequence: Synthetic coding sequence
atggaccagagcaactacagcagcctgcacggcttcatcctgctggggttcagcaatcatcccaagatggaaatgattctgagtggcgtggtagccattttctatctgatcacgctggtcggaaacactgccatcattctagcctccctgctggactctcagctgcatacaccaatgtatttctttctgcggaaccttagtttccttgacctttgttttacgacgagtattatcccccagatgttggtaaatctgtggggacctgacaaaactataagctacgtggggtgcattattcagctatacgtctacatgtggttaggtagtgtggagtgcctgctgctcgccgtcatgagttacgatagattcaccgccatttgcaagcccttacattatttcgtagtcatgaacccacacctctgtctgaaaatgatcatcatgatttggagcattagcctggctaacagtgttgtactttgtactctgacgttgaacttgccaacttgtggtaataacatcctggaccacttcctttgcgaactgcctgccctggtcaaaattgcatgcgttgacacaaccacggtggaaatgtctgttttcgctttgggcatcattattgtcttgacccccctgatactgatcctcatttcgtatgggtacatagccaaagccgtgctgcgcactaagtccaaagccagtcagcgcaaggctatgaacacgtgcggctcgcacttgactgtggtgtctatgttttatggcactattatatacatgtatctacaaccggggaaccgggcatccaaggatcaaggtaaattcctgacgctgttctacaccgtgatcacaccaagtctgaatccattgatctacactttacgcaataaggatatgaaggacgccctgaaaaagttaatgcgtttccatcacaagagcaccaagatcaaacgcaactgtaaaagctag

SEQ ID NO: 44395 - DNA, 963 bp, Artificial Sequence
  Description of Artificial Sequence: Synthetic coding sequence
atggaccagagcaactacagcagcctgcacggcttcatcctgctgggcttcagcaaccatcccaagatggaaatgatcctgagcggggttgtcgccattttctaccttatcactctagtcggcaatacagccatcatcttggctagcttattggactctcagctccatacccccatgtatttttttctcaggaacttgtccttcctggatctatgttttacaacctctataattccccagatgctggtcaatctttggggcccagacaaaactatttcatatgtcggctgtatcatccaactgtacgtgtacatgtggctgggtagtgtggagtgcttgctgctggcagtcatgagctacgatcgatttactgccatatgcaagcccctgcattactttgtagtgatgaacccccacctctgtctgaagatgattatcatgatctggagcatatccctggctaattccgtagtcctatgcactctcactctgaacctcccaacatgtggtaacaatatcctggaccactttctgtgtgaactgcctgccttagttaaaattgcttgcgttgacacaacaaccgtggagatgagtgtgtttgcactggggatcattatagtgttgacgcccctgattctgattttgatttcttacggatacatcgccaaagccgtgcttagaacgaagtctaaagcatcacagagaaaggcaatgaacacttgtggtagccatctcacggtagtttcaatgttttatgggacaataatctatatgtatttgcagcctggaaatcgagctagcaaagaccagggtaaattcctgactcttttttatacagtcataaccccctcccttaaccccctcatttatacacttcgcaataaagatatgaaggacgcattgaaaaagttgatgcgctttcaccataaatctacaaagattaagagaaattgcaagtcgtag

SEQ ID NO: 44396 - DNA, 963 bp, Artificial Sequence
  Description of Artificial Sequence: Synthetic coding sequence
atggaccagagcaactacagcagcctgcacggcttcatcctgctgggattcagcaaccatcctaaaatggaaatgattctctctggtgtggtggcgatcttttatcttatcacactggtgggcaatactgccatcattttggcaagtctcctggattctcagctgcacaccccgatgtatttcttcctgagaaacctctcattcctcgacctctgtttcaccaccagcattataccccaaatgctggtgaacctctgggggcctgacaagaccatttcgtacgttggctgcatcatccagctgtacgtttatatgtggctcgggtcagtggaatgcctgttgctggccgttatgtcatatgatcggtttaccgcgatatgcaagcccctgcattactttgttgtgatgaacccacatttatgtctgaaaatgatcatcatgatctggtcaattagcctcgctaactcagtagtgctgtgcactctcacgctaaacctgccaacttgcgggaataacatcctggaccacttcttgtgcgaactgccagcccttgtcaaaattgcctgcgttgatactacaaccgtagagatgtctgtgttcgccctgggtataataatagtcctgacacccctgattctgatcctgatttcgtacggatacatcgcaaaagccgtgttgcgcactaaaagtaaggcttctcagagaaaggcaatgaatacctgcgggagtcacttaacagttgtcagcatgttttatggaacaatcatttatatgtatctgcagccgggtaatcgtgccagcaaggatcaggggaagtttttgaccctgttctatacagtgattactcctagcctgaatccactcatttataccctgcggaataaggatatgaaggacgccttaaaaaaactcatgcgatttcaccacaagagcactaaaattaaacggaactgtaagtcatag

SEQ ID NO: 44397 - DNA, 963 bp, Artificial Sequence
  Description of Artificial Sequence: Synthetic coding sequence
atggaccagagcaactacagcagcctgcacggcttcatcctgctgggattctccaaccaccctaagatggagatgatcctgtccggagtggtggctatcttttacctgattaccctcgttggaaacactgcaatcatcctcgccagcttactggactctcagctccacacccccatgtatttcttcttacggaacctgagttttctcgatctttgtttcactacgtctatcattcctcagatgttggtaaacctgtggggtccagataaaaccatctcatatgtggggtgcatcatccagttatatgtgtacatgtggttgggctctgtagaatgtctgctgctcgcagtcatgagctacgaccggttcacagcgatttgtaagcccttgcactactttgtggtcatgaatccccatctgtgcctgaaaatgattataatgatctggagtatctcattggctaacagcgtggtgctttgcaccctgaccctgaatctgcctacttgcggaaacaacattctggatcacttcctgtgtgagttaccggcgctggtgaagattgcatgtgtagacactactaccgtggaaatgtccgttttcgccctcggcattatcattgtgctgacacctctgattcttatccttatatcttatgggtacatcgccaaggcagttctgcgtactaagtcaaaggcaagccagcgtaaagctatgaatacctgcggcagccatctcaccgtggtgagcatgttctacggcaccatcatctatatgtatctgcagccgggaaaccgcgcttccaaagaccagggcaaatttcttactctcttttatacagtaatcacgccgagccttaaccccctgatctatactctgcggaataaggatatgaaggacgccctcaagaagttaatgcgttttcatcacaaatccacaaaaatcaagcgaaattgtaagagctag

SEQ ID NO: 44398 - DNA, 945 bp, Artificial Sequence
  Description of Artificial Sequence: Synthetic coding sequence
atggacggcaccaacggcagcacccagacccacttcatcctgctgggcttcagcgatcgaccacacctggaacgcatcctgttcgtggtcattttgattgcgtacctgctaacgctcgtgggtaacactacaattattcttgtgtctagactagacccacatcttcacacgcccatgtactttttcctcgctcacttaagcttcctggacctgtccttcacaacctcctcaattccacagctgctctataatttgaatggttgcgataagaccatcagctacatgggctgtgcaatacagctgtttctgttcctgggtctggggggcgtcgaatgtcttcttctggccgtcatggcatacgatcggtgcgtggcgatctgcaaacctctacattacatggtcattatgaatccacggctttgtagagggctagtgtctgtgacatgggggtgtggggtagccaacagcctggctatgtctcccgttacactacggttaccgcgatgtggccaccatgaggttgaccacttcctacgcgaaatgccggctttaatccgcatggcctgtgtgtccacagtcgctattgaggggaccgtgttcgtgctcgcagttggcgtggtgttatcaccactagtcttcatactgctgagctatagttacattgttcgggcagtgttgcaaattagaagtgcaagcgggcgccaaaaggccttcggaacttgtggcagtcaccttactgttgtcagcctgttttacgggaatatcatatacatgtatatgcagcctggggcttcgtcatcccaggatcagggaatgtttctgatgctcttttacaacatagtcactcccctgttgaacccactgatttacaccctcaggaacagggaggttaagggtgctctcggcagactgctgctcggtaaacgcgagctgggcaaggagtag

SEQ ID NO: 44399 - DNA, 945 bp, Artificial Sequence
  Description of Artificial Sequence: Synthetic coding sequence
atggacggcaccaacggcagcacccagacccacttcatcctgctgggcttctctgaccggcctcatttggaacggatcctgtttgtcgtcatcctcatcgcatacttgctgactttggtcggaaacactactattatcctggtgtcgcgtctagacccccacctccatacccctatgtatttcttcttggcccatctctctttcctggatctctcctttaccacttcaagcattccccagctgctgtacaatctgaacggatgtgacaaaacaattagctacatgggctgcgccattcagcttttcttgtttctcggactgggcggggtcgagtgtctcctgctcgctgtaatggcctacgaccgatgcgtggccatctgcaagcccctacactatatggtcataatgaacccccggctctgccgaggcctagtatccgtgacctgggggtgtggagtcgctaattcactcgcgatgagtccagtaaccctgaggctgcctcgctgtggccatcatgaggtggatcatttcctcagagaaatgccagccctgatcaggatggcctgtgtgtcaaccgtagccattgaaggaacagtctttgtcctggctgtcggtgtggtgctttcacccttagtgttcattctgcttagctatagttatatcgttagggccgtgctgcaaatacggagcgcatctgggagacagaaggcctttggcacctgcggatctcatctcactgtggtctcgctgttctatgggaacatcatctatatgtatatgcaaccaggcgcctcgagctctcaggaccaaggaatgtttctgatgctcttttataacattgtcacgcccctgcttaaccccctgatctatacccttagaaatagagaggttaaaggagccctaggcagacttttgctgggaaaacgggaacttggcaaggagtag

SEQ ID NO: 44400 - DNA, 936 bp, Artificial Sequence
  Description of Artificial Sequence: Synthetic coding sequence
atgggcagcttcaacaccagcttcgaggacggcttcatcctggtgggcttttccgattggccccagttggaacccattctattcgtctttatcttcatcttctacagtctaactctttttggtaatacgatcatcatcgccctgtcctggctggatcttcgattacacacacctatgtattttttcctgagtcatctgagcctgctcgatctgtgcttcacaacatctacggtgccccagttgctgattaacctgtgcggggtggatagaactatcacccgggggggttgtgtcgcccagctgttcatttacttggcattaggatcaaccgagtgcgtgctcttagtggttatggcattcgaccgctatgccgccgtgtgtagacctctccattacatggcgattatgcatccccacctgtgtcaaacattggccatcgcctcgtggggtgctggtttcgtcaatagcctcatccagacagggctggctatggcaatgcccttgtgcgggcatcgacttaatcattttttctgtgagatgcctgtgtttcttaagctcgcatgtgccgacacagaagggacagaagccaaaatgttcgtggcccgcgtaatcgtcgttgccgttcccgccgctctgatcctgggtagctatgtgcatatcgcccacgccgtgctgcgggtaaagtccaccgcagggcgcaggaaagccttcgggacgtgtggaagccatttattggtggtctttctcttttacggatccgcaatctacacatacctccagtctattcataattacagtgagcgggaggggaagttcgtggcacttttctacactattataactcccatactcaatcctttgatctataccctccggaacaaggacgtcaaaggggccctgtggaaagtcctttggcggggccgcgactccggctag

SEQ ID NO: 44401 - DNA, 945 bp, Artificial Sequence
  Description of Artificial Sequence: Synthetic coding sequence
atgggcgacgtgaaccagagcgtggccagcgacttcatcctggtgggactcttttcccactcgggatctagacaactacttttcagtttggtggctgtaatgtttgtgataggcctccttggcaacaccgtgctgctgtttctgataagggtggattctagactccacacgcctatgtacttcttgttgtctcagctttccctttttgatatcggatgcccaatggtcaccattccaaagatggcctccgatttcctgagaggtgagggggcaacttcttatgggggcggggcggcgcagatcttcttcctgacacttatgggcgtggcggagggggttttgctcgtgttgatgtcttatgaccgatacgttgccgtctgtcaaccactacagtatccagtgctgatgagacggcaagtgtgcttactgatgatgggaagcagctgggtagtcggtgtccttaacgcctccatccagacctccataaccctccacttcccttactgcgccagcaggatcgttgatcatttcttttgtgaagtgcctgcgctgctcaagctctcttgcgcagacacgtgcgcatatgaaatggccctgtctacaagtggggtgctgattctcatgctgcccctgagtctgatcgccacctcctatggtcacgttttgcaggcagttctcagtatgcgctccgaagaggcccgacataaagctgtaactacgtgtagctctcatatcactgtggtgggcctgttttatggcgctgcagtgttcatgtatatggtcccctgtgcctaccatagtccgcagcaggataacgtggtgtcactgttttattccttggttacacctacactcaacccccttatttattccctgcgcaatcccgaggtttggatggccctggtcaaagtgctcagccgtgccggcctgagacaaatgtgctag

SEQ ID NO: 44402 - DNA, 948 bp, Artificial Sequence
  Description of Artificial Sequence: Synthetic coding sequence
atgcagcccgagagcggcgccaacggcaccgtgatcgccgagttcatcctcctgggattgttggaagccccaggcctccagccggtggtgtttgtgttatttctgttcgcatatctcgtgacagtgcgaggtaacctgtcaatcttggcagctgtgctcgtggagcctaaactgcacactcccatgtacttttttctgggcaatctttcagtccttgacgtgggctgcatatcggttaccgtcccctcaatgttatcgcggctgctgtcccgcaagagggcagttccctgtggcgcatgcctgacacagctattcttttttcatctgtttgtgggagtagactgctttctgttgaccgccatggcttacgataggtttctcgccatttgtcgacctcttacgtactcaactagaatgagccagaccgttcagcggatgttagtggctgcttcctgggcatgtgcctttaccaacgcattgacacatactgtggccatgagcacactgaatttttgcggaccaaatgttataaatcacttctactgtgaccttccgcagctgtttcagctctcatgctcctccactcagttgaatgagttgctgctctttgctgtgggctttatcatggcagggacaccaatggccttaatagtcatctcttacattcacgtggccgcagctgtcctgcgtatccgcagcgtcgaggggcgtaaaaaggccttctccacttgcggatctcaccttacagtcgtggccatcttttacggttccggaatctttaattacatgcgattgggatcgaccaaactgtctgataaggacaaagcagttggtattttcaataccgtgattaatcccatgctcaacccaattatttactctttcagaaatccagacgtgcagtcagcaatctggaggatgctgacaggtagacgctcactggcctag

SEQ ID NO: 44403 - DNA, 966 bp, Artificial Sequence
  Description of Artificial Sequence: Synthetic coding sequence
atgagcctgcagaagctgatggagcccgaggccggcaccaaccggacggcagtagcggagtttattctgctgggcctggtgcagaccgaagaaatgcaacccgttgtatttgtcctgctgttgttcgcttatctggtcacgacagggggcaacttatccatactggcagcagtgctagtcgaacctaaactgcatgcccccatgtatttcttcctcggaaacctgtcagtgctcgatgtgggctgcataaccgtaactgtcccagcaatgttgggacgattgcttagtcacaaatccacaattagttacgatgcttgtttatctcagctcttcttttttcacctgctcgccggaatggactgttttctcctcaccgccatggcctatgatagattgctggccatctgccagcccctaacatattctacacggatgtcccagaccgtccaaagaatgctggttgcagctagcctagcctgtgccttcacaaatgccctcacacacacggtggctatgagtaccctcaatttctgtggtcctaatgaggtcaatcacttctattgtgacctgcctcaactgttccagctgtcgtgtagtagcacccagctcaacgagctgctgcttttcgccgtgggctttattatggctggaacacctctcgtgctgattatcaccgcttattcacatgtcgccgcagccgttttgagaataagatcagtcgaagggagaaagaaagccttttccacctgtggtagccaccttacagtagtctgtctgttttttgggaggggcattttcaattacatgcgcctcggaagcgaggaggcaagtgacaaggataagggtgttggcgtgttcaacacggtgatcaatcccatgcttaacccattaatctattctctgcgtaaccccgatgttcaaggggcattgtggcagatcttcttgggacgtcgcagtcttacttag

SEQ ID NO: 44404 - DNA, 966 bp, Artificial Sequence
  Description of Artificial Sequence: Synthetic coding sequence
atgagcctgcagaagctgatggagcccgaggccggcaccaaccggacagctgttgccgagttcatcctcttagggctagtgcagactgaggagatgcagccggtggtgttcgttctcctgcttttcgcctatctggtgaccaccggtggcaacctgtcaatcttagccgcagtgctggtggagcctaaactgcacgctccaatgtacttttttctcggcaatctgagcgttctggatgtaggctgtataacggtgaccgttcccgccatgctcggtagacttttatcgcataagagcacaatctcttatgatgcatgcttgtcccaattattcttttttcacttgctggcaggaatggattgctttctccttacagccatggcttatgacaggcttctagccatctgccagccactaacttattccaccaggatgtcccaaacggtgcaaaggatgctggtcgctgcgagttgggcctgcgcattcacgaacgctctgacccatacagttgccatgagcactcttaatttttgcggtccgaacgaggtgaatcacttttattgcgacttacctcagttgttccagctgagctgtagttcaacccagctaaacgaactcctcctgtttgtagcagcagcatttatggctgtggcccctcttgtattcatttctgtatcatatgcgcacgttgttgcagccgtcttacagattcgaagcgccgaagggagaaagaaagcattttccacctgtggaagccaccttactgtggtcggcattttttacggcacaggcgtgttcagctacatgcgcctaggctccgtcgaatccagtgacaaggacaagggggtgggcgtgtttatgacagtgatcaacccaatgcttaaccccctgatttacagtcttcgcaatactgacgtgcagggagcattatgccaactgctggtcgggaaacgctccctgacctag

SEQ ID NO: 44405 - DNA, 1035 bp, Artificial Sequence
  Description of Artificial Sequence: Synthetic coding sequence
atggagctgctgaccaacaacctgaagttcatcaccgaccccttcgtgtgccgcctccgccacttatcacctactccttccgaggaacatatgaaaaataagaacaacgtcacagagtttatactgctcgggctgacccagaatcccgagggtcagaaagtcctgttcgtgacatttctgctgatctacatggttactatcatgggcaatctgctcataatagttactataatggcctcgcagagccttggatcccctatgtatttttttcttgcctccctgagctttattgatacagtgtacagcacagccttcgcccctaaaatgatcgtggaccttctgtccgaaaagaaaactatcagtttccaaggttgtatggcacaactgtttatggatcacctcttcgcgggggccgaagtgatcctgctcgtggtaatggcctacgatagatacatggccatttgcaaaccactgcacgaattgatcactatgaatcgacgcgtgtgtgtactcatgctgttagccgcctggattggtggcttccttcatagcctagtgcaattcctttttatttatcaactgcccttctgcggccccaatgtgatagataactttctttgtgatttgtaccctttattgaaactggcatgtaccaatacttacgtaacagggctttccatgattgccaatgggggtgctatttgcgcagttacttttttcactattttattgtcgtacggagtcattctccacagcctcaaaacccagtctctggagggcaaaaggaaggctttctatacctgtgctagtcacgtgaccgtagttattctctttttcgtgccatgcatttttctttacgcgcggccaaacagcacattccctattgataagtcaatgacagtggtgttgacctttatcacaccaatgctgaatccgttgatctatactctaaaaaacgcagagatgaaatccgcaatgaggaaattgtggtccaaaaaagtgagcctggcaggaaagtggctgtaccactcttag

SEQ ID NO: 44406 - DNA, 987 bp, Artificial Sequence
  Description of Artificial Sequence: Synthetic coding sequence
atgcggcccagcagcaacgtgaccgagttcgtgctgctgggcctgacacaggatccagatgtcaagaagactttgttcgtgatgttccttctgatttacattgtcaccatggttggcaatctcctcatttgggtgacaacgatcggcagcccatcactcggtagcctgatgtacttcttccttgcctacctctccctcatggacgcaatctactccacagccatgagtccgaagctgatgattgacctgctgtgcgacaagattgcgatctcactctcagcttgcatgggccagctgttcatcgagcatctgctgggaggtgcagaggtgttccttctcgtggtgatggcgtatgaccgctatgtggctatatccaaaccattgcattacctgaacatcatgaacagactggtatgtatactgttactggtggtcgcaatgattggaggatttgttcactccgtcgtgcagatcgtgtttttgtactcccttccaatctgcggtccgaatgttatcgatcatagcgtgtgcgacatgtacccgctgctggagctgctgtgcttggatacatactttattggactgactgttgtggccaacggaggcatcatttgcatggtcatttttaccttcctgcttatttcgtgtggcgtgatattaaattttcttaagacttactcccaggaagaacggcataaggcactgccaacttgtataagtcatatcatagtagtggcacttgtgtttgtgccctgcatttttatgtacgtgagaccggtgtccaatttccccttcgataagctgatgacagtcttctatagcattattaccctgatgctgaacccgctgatatacagcttgaggcaaagcgaaatgaaaaatgctatgaagaacctgtggtgtgagaagctgtccatcgtgagaaagagggtctcacctaccctgaacattttcatacccagttctaaggccactaaccggaggtag

SEQ ID NO: 44407 - DNA, 930 bp, Artificial Sequence
  Description of Artificial Sequence: Synthetic coding sequence
atggagccccggaagaacgtgaccgacttcgtgctgctgggcttcacacagaacccaaaagaacagaaagtactcttcgtgatgtttcttttgttttatattttgaccatggtcggaaatctgctgatcgttgttacagtaacggtcagtgagacactgggcagccctatgtactttttcctggccgggttgtcgtttatcgatatcatatactcttccagcatttccccaaggctcatttctgggctcttctttgggaacaattcgataagtttccaatcatgcatggcacagctgtttatcgagcacatctttggtggctccgaagtcttcctgcttctcgtgatggcatatgactgctatgtggcaatctgcaaacctcttcactatctcgtcataatgaggcagtgggtgtgcgtcgtcttacttgtcgtcagttgggtgggaggctttctgcactccgtctttcagctgagcattatctacgggttgccgttctgtgggccaaatgtcatcgatcactttttttgcgatatgtatcccctccttaagctggtatgtaccgatactcacgccattgggctgttggtggtagctaacggaggcctagcctgtacaatagtctttcttctcctgctgatcagctacggagtaatcctccacagcctcaagaacctcagccaaaaggggcgacaaaaggctcttagcacctgttccagccacatgaccgtggttgtcttcttcttcgtaccctgcatatttatgtacgcaagaccagccagaacatttccaatagataaaagcgtgtcggtgttttacaccgttatcacaccgatgcttaatcccctcatttacaccctaaggaattccgaaatgactagtgccatgaagaagctgtggcggagagatctcatttctagcagcacctag

SEQ ID NO: 44408 - DNA, 948 bp, Artificial Sequence
  Description of Artificial Sequence: Synthetic coding sequence
atgcggcagaacaacaacatcaccgagttcgtgctgctgggcttcagccaggatcctggcgtgcagaaggccctattcgtgatgttcctcctcacctacctggtaaccgtcgtaggcaacctgctcattgtagtggatataatcgcctcaccttccctaggcagccctatgtattttttcctagcctgtctctccttcatcgacgccgcctattcaacgactatcagccccaaacttattgtggggttgttctgcgacaagaagacaattagcttccaggggtgcatgggccaattgtttatagatcatttctttggaggtgctgaagtttttctcttggtggtgatggcttgtgaccgatacgtcgcaatttgcaaacccctgcactatttgacgattatgaatagacaggtgtgctttctcctgttagtcgtggccatgattggcggatttgtgcattctgctttccagattgtcgtgtatagccttccattctgcggccctaatgttattgtgcatttctcttgcgatatgcaccccctcctggaattagcctgcactgatacttactttattggcctcaccgtcgtggtgaactcaggcgctatttgcatggtgatcttcaatctgctgttgatctcatatggcgtcatcctgtcctcactgaagacttactctcaggagaaacgcggcaaggctctgagtacctgtagcagcggatcgacagtggtcgtcctctttttcgtaccttgcatttttatttacgtacggccagtgagcaactttccaactgataagttcatgactgtgttctacacaatcattacacatatgctctcaccactgatctatactttgaggaatagcgagatgcgcaatgccattgaaaagctccttggtaaaaaactgacgattttcattatcggcggagtgtccgtactgatgtag

SEQ ID NO: 44409 - DNA, 930 bp, Artificial Sequence
  Description of Artificial Sequence: Synthetic coding sequence
atggccagcaccagcaacgtgaccgagctgatcttcaccggcctgtttcaggacccggccgtgcagtctgtgtgctttgtagtattcctccctgtctatctggccactgtggttgggaacggtctgattgtcctgacagtaagtataagtaagtccctggattcacctatgtacttctttctgtcatgtctgtcactggtggaaatttcctattcttccacgatagctcctaaattcattatagatctactggcaaaaataaaaaccataagtctggaaggatgtcttacccagatttttttctttcacttctttggggttgccgaaatcctactgatcgtcgtgatggcatacgactgctatgtcgctatctgcaagcccttgcattacatgaacatcatatcacgccagctgtgtcacctcctggttgcagggagttggctgggcgggttttgtcattccatcattcagatcctggtcatcattcagctgccattctgcggacccaacgtcatcgatcattatttttgcgacttgcaacccctgtttaagctcgcgtgcacagatacatttatggagggagttatcgttttggccaattccggtcttttcagtgtgttttcattcctcatactcgtatctagttacatcgtcatcctggtaaatcttcgcaatcactccgccgaagggcgtcacaaggctctctccacgtgtgcctcccacatcaccgtggtgatcctgttcttcgggccagccattttcttgtatatgcggccgtccagtaccttcactgaggataagctggtcgccgttttttacacagtcatcacacctatgctgaaccctattatctatactcttagaaacgcggaggttaaaatagcgattcgtcggctgtggtccaagaaagaaaatccaggcagggagtag

SEQ ID NO: 44410 - DNA, 933 bp, Artificial Sequence
  Description of Artificial Sequence: Synthetic coding sequence
atgcagcagaacaacagcgtgcccgagttcatcctgctgggcctgactcaggatcccctgagacaaaaaattgtattcgtcatttttttaattttttatatgggcactgtagttggcaatatgctgatcatcgtgaccatcaagtcatctagaaccctgggcagtccgatgtacttctttctgttctacctgtctttcgccgactcatgtttcagcacttccactgctccacgtcttatagtagacgccttgtcggagaagaaaattataacctataatgagtgtatgacgcaagtcttcgccttacatctgttcggttgtatggaaatctttgtcttaatattgatggccgtggaccgatatgtggcaatctgtaaacctcttcgctaccctacaatcatgtctcaacaggtttgcattattttgatagtgctggcttggatcggctcgctgatacacagtaccgcccagattatattggcattgcgtctccctttctgcggtccctacctcatcgatcattactgttgtgatctacagccgctcttaaagcttgcgtgcatggacacatatatgattaacctcctgctcgttagcaacagtggagccatttgttcaagctcatttatgatcctgatcattagttatattgtgattttgcattccctcagaaaccacagcgccaaagggaagaagaaagcattgagcgcttgcacgtcgcatattatagtggtgatcctgtttttcggcccctgcattttcatttacacacggcctccaacaacttttcccatggataagatggtcgccgtattctatacaattgggacaccctttctgaatccgctcatctacaccctgcgaaacgcagaagtcaaaaacgcgatgcgcaagctgtggcatggaaagataattagtgagaataagggttag

SEQ ID NO: 44411 - DNA, 930 bp, Artificial Sequence
  Description of Artificial Sequence: Synthetic coding sequence
atggagaagaagaagaacgtgaccgagttcatcctgatcggcctgactcaaaacccaattatggaaaaggttacattcgtggtcttcctggtcctgtatatgataacactctccggtaatctcctgatcgtcgtgacaattacaacgtcacaagctttgagcagccctatgtacttcttccttacccatttaagcctcatcgacacagtgtattcttcctcctcagccccaaagcttatcgtggattcatttcaggagaaaaaaataatctcttttaatggttgtatggctcaggcgtatgctgagcacatttttggcgccactgaaattattctgcttaccgtcatggcgtgtgattgctatgtcgctatctgtaaacctctgaactacaccacaattatgtctcactccttgtgtatcttgctggtggcggtagcctgggttggtggttttctgcatgctacaattcagatattattcacagtgtggctcccattttgtggcccgaatgtgataggccactttatgtgcgatctatacccacttttgaagctggtgtgtattgatacacacaccctcggtttatttgtggccgtaaattcaggattcatttgcctgctgaacttcctcattctagttgtttcctacgtgattatcttgcggtcgctgaagaataactcattggaaggcagatgtaaggctctttccacatgcatcagccacatcattgtagtggtgctattctttgtgccgtgtattttcgtctatctgaggtctgttacaaccctccccatagataaggcggtcgctgtattttacacaatggtggtgcctatgcttaacccggtcgtgtataccttgagaaacgccgaagtgaagagcgccatacgtaagctgtggaggaaaaaagtcacctcggataatgactag

SEQ ID NO: 44412 - DNA, 930 bp, Artificial Sequence
  Description of Artificial Sequence: Synthetic coding sequence
atggccaaccggaacaacgtgaccgagttcatcctgctgggcctgacggaaaaccccaagatgcaaaagattattttcgtggtttttagcgtgatttacatcaacgctatgatcggcaacgtcttgattgtcgtcactatcacagccagcccaagtctgagatcccccatgtatttctttttagcttacctgagcttcatcgatgcctgttatagtagcgtgaacacgcccaaattgattaccgattcactctacgagaacaaaacgatcctgtttaacgggtgcatgacccaggtctttggggaacactttttccggggtgttgaagtgatattgctcacagtgatggcctacgatcactacgtagccatctgcaagccactgcattacaccaccgttatgaagcagcacgtgtgctctctcctggtcggggtgtcgtgggtgggaggcttccttcatgccaccattcagatcctgtttatttgtcagctgcccttttgcggtcccaatgttattgatcacttcatgtgcgacttatacaccctgattaatctagcatgtacaaatacccacaccctggggctctttatcgccgcgaattctgggtttatctgtctgctcaactgcctgctcctcctcgtgagttgcgtagttatattgtattccctgaaaactcattctttggaggctcgccacgaggctctgagcacttgtgtgtctcacatcactgtggtgatcctgtcttttatcccttgtatcttcgtctatatgcggccgcctgctacactcccaattgataaagccgtcgcggttttttacacgatgattacctccatgctaaatccactgatttatactctaaggaacgctcaaatgaagaacgccatccggaagttgtgctcccgcaaagccataagttccgtgaagtag

SEQ ID NO: 44413 - DNA, 1113 bp, Artificial Sequence
  Description of Artificial Sequence: Synthetic coding sequence
atgttcagcatgaccaccgaggccctgaacaacttcgccctgggctgtactaatcttctcatgaccatgataccacagatcgacttgaaacaaatttttctgtgtcctaactgccgtctgtacatgatcccagtcggcgccttcatcttcagccttggaaacatgcagaatcagagcttcgtgacagagtttgtgttgttagggctgtcccagaaccccaatgttcaggagatagtcttcgttgtgtttctcttcgtatatattgccacagtgggaggtaatatgctgatcgtagttacaatactgagcagcccagcgctccttgtgagcccaatgtacttttttttgggcttcctctctttcctcgacgcctgcttttccagtgtcatcacaccgaagatgatagtggactcattgtacgtaacaaagacaatcagcttcgagggatgtatgatgcagctatttgccgaacatttctttgcaggagtggaagtaattgttctgaccgcaatggcatacgaccgttacgtggccatctgcaaaccgctgcactactcttcaataatgaatcggagattgtgcggtatcttaatgggggttgcttggactggcggcctcctccatagtatgatccagatcctgtttacgttccagctgcccttttgtggccccaacgtaataaatcacttcatgtgtgacctgtaccccctactggagctggcgtgcactgacacccatatcttcggtctgatggtggtgattaattctgggtttatatgcatcatcaacttcagccttctcttggtcagctacgccgtgatactgctctctctgaggacccactcgtccgaagggcgatggaaggctcttagcacttgtggatcccacattgcagtggtcattctcttctttgtgccctgcatcttcgtgtacacgagacctccttccgcattcagcttagataagatggcagcaatcttttatattatactgaaccctcttctgaatccactgatctacacctttcgtaacaaggaagtgaagcaagccatgcggcgcatctggaaccgacttatggtggtgtctgacgaaaaggagaacatcaaattatag
